United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 63

SEQ ID NO: 2245619 - RNA, 19 nt, Yersinia pestis
auaacaaacacauccagga

SEQ ID NO: 2245620 - RNA, 14 nt, Yersinia pestis
auaaauuaucugaa

SEQ ID NO: 2245621 - RNA, 12 nt, Yersinia pestis
aguuagcgugag

SEQ ID NO: 2245622 - RNA, 13 nt, Yersinia pestis
aguuacugcgcuc

SEQ ID NO: 2245623 - RNA, 16 nt, Yersinia pestis
aguuacuguaagauaa

SEQ ID NO: 2245624 - RNA, 13 nt, Yersinia pestis
aguuaucaaucag

SEQ ID NO: 2245625 - RNA, 21 nt, Yersinia pestis
aguucacaccguauagcaucg

SEQ ID NO: 2245626 - RNA, 14 nt, Yersinia pestis
aguucagaucgcau

SEQ ID NO: 2245627 - RNA, 18 nt, Yersinia pestis
aguuggguaucuuugcuu

SEQ ID NO: 2245628 - RNA, 23 nt, Yersinia pestis
auaaaaggauggcccaagccauc

SEQ ID NO: 2245629 - RNA, 12 nt, Yersinia pestis
auaaaaacuauc

SEQ ID NO: 2245630 - RNA, 22 nt, Yersinia pestis
auaaagccuuguugaaucagau

SEQ ID NO: 2245631 - RNA, 15 nt, Yersinia pestis
auaaaucggcggcca

SEQ ID NO: 2245632 - RNA, 22 nt, Yersinia pestis
auaaauauugguacauaggucu

SEQ ID NO: 2245633 - RNA, 18 nt, Yersinia pestis
auaaaccagcaagccgug

SEQ ID NO: 2245634 - RNA, 14 nt, Yersinia pestis
auaaaccagccagu

SEQ ID NO: 2245635 - RNA, 20 nt, Yersinia pestis
auaaacgccagucagcuagc

SEQ ID NO: 2245636 - RNA, 15 nt, Yersinia pestis
auaaacgggcuucca

SEQ ID NO: 2245637 - RNA, 18 nt, Yersinia pestis
auaaacacgcaaucagau

SEQ ID NO: 2245638 - RNA, 19 nt, Yersinia pestis
auaaacagcuuaucagcgu

SEQ ID NO: 2245639 - RNA, 22 nt, Yersinia pestis
auaaaaucgaacccuucagcau

SEQ ID NO: 2245640 - RNA, 22 nt, Yersinia pestis
auaaaauagcccagugcggaag

SEQ ID NO: 2245641 - RNA, 21 nt, Yersinia pestis
auaaaauagggcugucagcca

SEQ ID NO: 2245642 - RNA, 19 nt, Yersinia pestis
aguuaauguuuauauugau

SEQ ID NO: 2245643 - RNA, 15 nt, Yersinia pestis
agugaugacuagcga

SEQ ID NO: 2245644 - RNA, 19 nt, Yersinia pestis
agucgucgaauccaugaug

SEQ ID NO: 2245645 - RNA, 18 nt, Yersinia pestis
agucgcuccucagccuuu

SEQ ID NO: 2245646 - RNA, 20 nt, Yersinia pestis
aguccagccaccccguggca

SEQ ID NO: 2245647 - RNA, 15 nt, Yersinia pestis
agucagcaacgcgau

SEQ ID NO: 2245648 - RNA, 23 nt, Yersinia pestis
aguaaucguucguuuacugccuu

SEQ ID NO: 2245649 - RNA, 17 nt, Yersinia pestis
aguaaugggaucaaaug

SEQ ID NO: 2245650 - RNA, 17 nt, Yersinia pestis
aguacagcgcaucggau

SEQ ID NO: 2245651 - RNA, 15 nt, Yersinia pestis
agguuagcuaugcag

SEQ ID NO: 2245652 - RNA, 22 nt, Yersinia pestis
agguucaauucccgccagguuu

SEQ ID NO: 2245653 - RNA, 12 nt, Yersinia pestis
agguuaucagcc

SEQ ID NO: 2245654 - RNA, 21 nt, Yersinia pestis
agguugcaaauuuccagaugg

SEQ ID NO: 2245655 - RNA, 22 nt, Yersinia pestis
agguaauacucauccagauuau

SEQ ID NO: 2245656 - RNA, 16 nt, Yersinia pestis
aggggggaaagcaaua

SEQ ID NO: 2245657 - RNA, 21 nt, Yersinia pestis
agggcgcuuguuuuacaauua

SEQ ID NO: 2245658 - RNA, 18 nt, Yersinia pestis
agggccacuucgguggcc

SEQ ID NO: 2245659 - RNA, 15 nt, Yersinia pestis
agggaguucaucaaa

SEQ ID NO: 2245660 - RNA, 15 nt, Yersinia pestis
aggcuggcagguuau

SEQ ID NO: 2245661 - RNA, 21 nt, Yersinia pestis
cauacuccauuuuuuugaugc

SEQ ID NO: 2245662 - RNA, 21 nt, Yersinia pestis
cauaacuuaauggcaccgugg

SEQ ID NO: 2245663 - RNA, 22 nt, Yersinia pestis
cauaauggacgaacagugccaa

SEQ ID NO: 2245664 - RNA, 16 nt, Yersinia pestis
cauaagauaacgggca

SEQ ID NO: 2245665 - RNA, 18 nt, Yersinia pestis
cagugugcgcaucagcca

SEQ ID NO: 2245666 - RNA, 18 nt, Yersinia pestis
cagugucuggcaauccag

SEQ ID NO: 2245667 - RNA, 14 nt, Yersinia pestis
cauauuuaacugac

SEQ ID NO: 2245668 - RNA, 13 nt, Yersinia pestis
caucaaaccggcu

SEQ ID NO: 2245669 - RNA, 16 nt, Yersinia pestis
cauauuggugcgguua

SEQ ID NO: 2245670 - RNA, 22 nt, Yersinia pestis
caucaaucgucaauccaaucau

SEQ ID NO: 2245671 - RNA, 16 nt, Yersinia pestis
caucaaugauucgcug

SEQ ID NO: 2245672 - RNA, 15 nt, Yersinia pestis
cauauuaaaugcauu

SEQ ID NO: 2245673 - RNA, 18 nt, Yersinia pestis
caucacgauagccaguga

SEQ ID NO: 2245674 - RNA, 23 nt, Yersinia pestis
cauccggugagacagugagguua

SEQ ID NO: 2245675 - RNA, 15 nt, Yersinia pestis
caucgucagccccug

SEQ ID NO: 2245676 - RNA, 18 nt, Yersinia pestis
caucuaugggcuucgcca

SEQ ID NO: 2245677 - RNA, 15 nt, Yersinia pestis
caucugaaagcuuca

SEQ ID NO: 2245678 - RNA, 18 nt, Yersinia pestis
caucggcauucgcagcgc

SEQ ID NO: 2245679 - RNA, 15 nt, Yersinia pestis
caucuugcaacaacg

SEQ ID NO: 2245680 - RNA, 21 nt, Yersinia pestis
caucuucuucuuuaaccggua

SEQ ID NO: 2245681 - RNA, 16 nt, Yersinia pestis
caugaugacaaugcgu

SEQ ID NO: 2245682 - RNA, 21 nt, Yersinia pestis
cagucaccgcuguaaaugcgu

SEQ ID NO: 2245683 - RNA, 17 nt, Yersinia pestis
cagucacuaauaccuga

SEQ ID NO: 2245684 - RNA, 18 nt, Yersinia pestis
cagucacuuacugaucaa

SEQ ID NO: 2245685 - RNA, 18 nt, Yersinia pestis
cagucgcacugauagcaa

SEQ ID NO: 2245686 - RNA, 21 nt, Yersinia pestis
cagucugagguggccauuacg

SEQ ID NO: 2245687 - RNA, 22 nt, Yersinia pestis
cagugaugaccauucacgccgc

SEQ ID NO: 2245688 - RNA, 15 nt, Yersinia pestis
cagugcacgggaaau

SEQ ID NO: 2245689 - RNA, 16 nt, Yersinia pestis
cagucugaggcccgcu

SEQ ID NO: 2245690 - RNA, 15 nt, Yersinia pestis
cagucuaaacgccgc

SEQ ID NO: 2245691 - RNA, 22 nt, Yersinia pestis
cagucuaaacgccgcgucaaua

SEQ ID NO: 2245692 - RNA, 21 nt, Yersinia pestis
caguacgacgacggauauucu

SEQ ID NO: 2245693 - RNA, 15 nt, Yersinia pestis
cagggcgcaauggcg

SEQ ID NO: 2245694 - RNA, 14 nt, Yersinia pestis
caggguaauaaccg

SEQ ID NO: 2245695 - RNA, 19 nt, Yersinia pestis
caggggcgaugucaccauc

SEQ ID NO: 2245696 - RNA, 15 nt, Yersinia pestis
caggguuaucggugc

SEQ ID NO: 2245697 - RNA, 19 nt, Yersinia pestis
cagggugaaagcccaacug

SEQ ID NO: 2245698 - RNA, 22 nt, Yersinia pestis
caggguauuccacccgcacaau

SEQ ID NO: 2245699 - RNA, 15 nt, Yersinia pestis
caggcacuuugucaa

SEQ ID NO: 2245700 - RNA, 21 nt, Yersinia pestis
caggcagaucguaaagacgcc

SEQ ID NO: 2245701 - RNA, 21 nt, Yersinia pestis
cagauguaaccacccacgggu

SEQ ID NO: 2245702 - RNA, 16 nt, Yersinia pestis
cagcaagagcagccaa

SEQ ID NO: 2245703 - RNA, 16 nt, Yersinia pestis
cagcaaacucagccaa

SEQ ID NO: 2245704 - RNA, 12 nt, Yersinia pestis
cagcaaaucauu

SEQ ID NO: 2245705 - RNA, 21 nt, Yersinia pestis
cagccaaaauaaucaccagac

SEQ ID NO: 2245706 - RNA, 16 nt, Yersinia pestis
cagcauccugaacuuc

SEQ ID NO: 2245707 - RNA, 17 nt, Yersinia pestis
cagcaggggcguuagcu

SEQ ID NO: 2245708 - RNA, 23 nt, Yersinia pestis
cagaacagguuuuuuccccaugg

SEQ ID NO: 2245709 - RNA, 15 nt, Yersinia pestis
cagaaaucagccaua

SEQ ID NO: 2245710 - RNA, 16 nt, Yersinia pestis
cacuucucugacacac

SEQ ID NO: 2245711 - RNA, 15 nt, Yersinia pestis
cacuuguaccugugc

SEQ ID NO: 2245712 - RNA, 23 nt, Yersinia pestis
cacuuccugauggccguaucaug

SEQ ID NO: 2245713 - RNA, 18 nt, Yersinia pestis
cacguuuaauucaaaguu

SEQ ID NO: 2245714 - RNA, 14 nt, Yersinia pestis
cacuauuucagaca

SEQ ID NO: 2245715 - RNA, 15 nt, Yersinia pestis
cacugaugagcuggc

SEQ ID NO: 2245716 - RNA, 13 nt, Yersinia pestis
cagauaugaucaa

SEQ ID NO: 2245717 - RNA, 18 nt, Yersinia pestis
cagauaaagcuugaucac

SEQ ID NO: 2245718 - RNA, 19 nt, Yersinia pestis
cagauaggcuugugcgcca

SEQ ID NO: 2245719 - RNA, 18 nt, Yersinia pestis
cagacguuuaaauaagcu

SEQ ID NO: 2245720 - RNA, 16 nt, Yersinia pestis
cagacaacgcuuggca

SEQ ID NO: 2245721 - RNA, 23 nt, Yersinia pestis
cagcguaauaccacuacccgcug

SEQ ID NO: 2245722 - RNA, 14 nt, Yersinia pestis
cagcggccaugacg

SEQ ID NO: 2245723 - RNA, 19 nt, Yersinia pestis
cagcggcgaaagcauggca

SEQ ID NO: 2245724 - RNA, 22 nt, Yersinia pestis
cagcgcuggcuuuuucacacgc

SEQ ID NO: 2245725 - RNA, 21 nt, Yersinia pestis
cagccgauguguuucgacggu

SEQ ID NO: 2245726 - RNA, 14 nt, Yersinia pestis
cagcccgguaucac

SEQ ID NO: 2245727 - RNA, 16 nt, Yersinia pestis
cagcgaagugccgcca

SEQ ID NO: 2245728 - RNA, 14 nt, Yersinia pestis
aaagcugauaaccu

SEQ ID NO: 2245729 - RNA, 15 nt, Yersinia pestis
ccaccaauuucaucg

SEQ ID NO: 2245730 - RNA, 20 nt, Yersinia pestis
ccaccaauagcgaucagcaa

SEQ ID NO: 2245731 - RNA, 12 nt, Yersinia pestis
ccacaacugaau

SEQ ID NO: 2245732 - RNA, 19 nt, Yersinia pestis
ccaauauggguauugagcg

SEQ ID NO: 2245733 - RNA, 22 nt, Yersinia pestis
ccaaucaucacgauaauaucga

SEQ ID NO: 2245734 - RNA, 16 nt, Yersinia pestis
ccaauccaugccagcc

SEQ ID NO: 2245735 - RNA, 15 nt, Yersinia pestis
ccaaucuccaaugac

SEQ ID NO: 2245736 - RNA, 19 nt, Yersinia pestis
ccaaagggagccauugcaa

SEQ ID NO: 2245737 - RNA, 21 nt, Yersinia pestis
ccaaagccgguaucaacucug

SEQ ID NO: 2245738 - RNA, 16 nt, Yersinia pestis
ccaagaaaagcaccgc

SEQ ID NO: 2245739 - RNA, 18 nt, Yersinia pestis
ccaagaaaagcaccgcag

SEQ ID NO: 2245740 - RNA, 23 nt, Yersinia pestis
ccacgauuagcccguucggucac

SEQ ID NO: 2245741 - RNA, 20 nt, Yersinia pestis
ccacgcacgauauucagugc

SEQ ID NO: 2245742 - RNA, 14 nt, Yersinia pestis
ccacgccccaacgg

SEQ ID NO: 2245743 - RNA, 14 nt, Yersinia pestis
aaauaaccucuaau

SEQ ID NO: 2245744 - RNA, 19 nt, Yersinia pestis
aaagggccugcaaacggcu

SEQ ID NO: 2245745 - RNA, 19 nt, Yersinia pestis
aaaggcggugauaaacccu

SEQ ID NO: 2245746 - RNA, 20 nt, Yersinia pestis
aaauaagcguagggauaaau

SEQ ID NO: 2245747 - RNA, 17 nt, Yersinia pestis
aaauaagaucaauaugu

SEQ ID NO: 2245748 - RNA, 21 nt, Yersinia pestis
ccacuuauccagcucauuggc

SEQ ID NO: 2245749 - RNA, 16 nt, Yersinia pestis
ccagaacaauaccgcc

SEQ ID NO: 2245750 - RNA, 16 nt, Yersinia pestis
ccacuuaguggcauug

SEQ ID NO: 2245751 - RNA, 13 nt, Yersinia pestis
ccacugcggucaa

SEQ ID NO: 2245752 - RNA, 16 nt, Yersinia pestis
ccagauugucaaucac

SEQ ID NO: 2245753 - RNA, 17 nt, Yersinia pestis
ccagaagcauauggaug

SEQ ID NO: 2245754 - RNA, 17 nt, Yersinia pestis
ccagaagccagggucau

SEQ ID NO: 2245755 - RNA, 14 nt, Yersinia pestis
ccagaagcgcacau

SEQ ID NO: 2245756 - RNA, 14 nt, Yersinia pestis
aaauccccauucca

SEQ ID NO: 2245757 - RNA, 16 nt, Yersinia pestis
aaaucccccacgaucu

SEQ ID NO: 2245758 - RNA, 13 nt, Yersinia pestis
ccagccaccgcac

SEQ ID NO: 2245759 - RNA, 15 nt, Yersinia pestis
ccagccauauccaaa

SEQ ID NO: 2245760 - RNA, 18 nt, Yersinia pestis
ccagggcaccaagaccga

SEQ ID NO: 2245761 - RNA, 13 nt, Yersinia pestis
ccauuuagcuggc

SEQ ID NO: 2245762 - RNA, 20 nt, Yersinia pestis
cccaaaacuuggacaucugc

SEQ ID NO: 2245763 - RNA, 17 nt, Yersinia pestis
cccaaagcucuacacug

SEQ ID NO: 2245764 - RNA, 14 nt, Yersinia pestis
cccaacaauuugcg

SEQ ID NO: 2245765 - RNA, 11 nt, Yersinia pestis
cccaacgguaa

SEQ ID NO: 2245766 - RNA, 19 nt, Yersinia pestis
cccacguaauuauuguuca

SEQ ID NO: 2245767 - RNA, 12 nt, Yersinia pestis
cccaccauaaug

SEQ ID NO: 2245768 - RNA, 19 nt, Yersinia pestis
ccauugauuggcuccuaua

SEQ ID NO: 2245769 - RNA, 22 nt, Yersinia pestis
ccauugcucaaacucagcauca

SEQ ID NO: 2245770 - RNA, 23 nt, Yersinia pestis
ccauuaacgaugaccgugacauu

SEQ ID NO: 2245771 - RNA, 13 nt, Yersinia pestis
ccauuaauuggcc

SEQ ID NO: 2245772 - RNA, 14 nt, Yersinia pestis
ccauuaauuggccg

SEQ ID NO: 2245773 - RNA, 16 nt, Yersinia pestis
aaaucgccaaacugcu

SEQ ID NO: 2245774 - RNA, 19 nt, Yersinia pestis
aaaucgccaaacugcucau

SEQ ID NO: 2245775 - RNA, 19 nt, Yersinia pestis
aaauccugaauaauacugu

SEQ ID NO: 2245776 - RNA, 23 nt, Yersinia pestis
ccaugucacuagagcguuacaca

SEQ ID NO: 2245777 - RNA, 22 nt, Yersinia pestis
cccauggggccaccuaauccaa

SEQ ID NO: 2245778 - RNA, 19 nt, Yersinia pestis
cccauuccguuuaaacucc

SEQ ID NO: 2245779 - RNA, 22 nt, Yersinia pestis
cccaguuuuuaauuuaaacucu

SEQ ID NO: 2245780 - RNA, 14 nt, Yersinia pestis
cccauaaaucccga

SEQ ID NO: 2245781 - RNA, 21 nt, Yersinia pestis
cccauaccaaccauaucgcca

SEQ ID NO: 2245782 - RNA, 15 nt, Yersinia pestis
cccaguagcacaaug

SEQ ID NO: 2245783 - RNA, 19 nt, Yersinia pestis
ccccgcucgacucucaagc

SEQ ID NO: 2245784 - RNA, 17 nt, Yersinia pestis
ccccgcucgacucucaa

SEQ ID NO: 2245785 - RNA, 11 nt, Yersinia pestis
ccccaucgcca

SEQ ID NO: 2245786 - RNA, 15 nt, Yersinia pestis
cccgacagaacugau

SEQ ID NO: 2245787 - RNA, 17 nt, Yersinia pestis
cccgcucuaaguuaaca

SEQ ID NO: 2245788 - RNA, 12 nt, Yersinia pestis
cccgauaaacca

SEQ ID NO: 2245789 - RNA, 15 nt, Yersinia pestis
cccgcccgguaccgc

SEQ ID NO: 2245790 - RNA, 20 nt, Yersinia pestis
cccguuauaccucaagcugc

SEQ ID NO: 2245791 - RNA, 13 nt, Yersinia pestis
cccuacagcaaac

SEQ ID NO: 2245792 - RNA, 17 nt, Yersinia pestis
cccggcugaccuguugu

SEQ ID NO: 2245793 - RNA, 23 nt, Yersinia pestis
cccuuugaacugcaccccaaaug

SEQ ID NO: 2245794 - RNA, 17 nt, Yersinia pestis
cccuugaguauccaaua

SEQ ID NO: 2245795 - RNA, 17 nt, Yersinia pestis
ccgaagcucaagcuggu

SEQ ID NO: 2245796 - RNA, 21 nt, Yersinia pestis
ccgaaccuuuugccaguaacg

SEQ ID NO: 2245797 - RNA, 16 nt, Yersinia pestis
ccgacgauauuaccga

SEQ ID NO: 2245798 - RNA, 13 nt, Yersinia pestis
ccgaccacugaca

SEQ ID NO: 2245799 - RNA, 22 nt, Yersinia pestis
cgcuuuucgcuaucaauuaaug

SEQ ID NO: 2245800 - RNA, 12 nt, Yersinia pestis
cgcuuggcucug

SEQ ID NO: 2245801 - RNA, 19 nt, Yersinia pestis
cgcuuuacuccccugccua

SEQ ID NO: 2245802 - RNA, 12 nt, Yersinia pestis
cgcuuuaucgcc

SEQ ID NO: 2245803 - RNA, 19 nt, Yersinia pestis
cgcuuuacuccucugccua

SEQ ID NO: 2245804 - RNA, 19 nt, Yersinia pestis
cgcuuuacucuucugccua

SEQ ID NO: 2245805 - RNA, 20 nt, Yersinia pestis
cggaagugaguaucuucauc

SEQ ID NO: 2245806 - RNA, 14 nt, Yersinia pestis
cggaacaguugcuu

SEQ ID NO: 2245807 - RNA, 18 nt, Yersinia pestis
cgcuuagucgccagaaga

SEQ ID NO: 2245808 - RNA, 15 nt, Yersinia pestis
cgcuuaucccuccau

SEQ ID NO: 2245809 - RNA, 19 nt, Yersinia pestis
cgcuguuucucuucaucgc

SEQ ID NO: 2245810 - RNA, 13 nt, Yersinia pestis
cgcuguucaucgc

SEQ ID NO: 2245811 - RNA, 16 nt, Yersinia pestis
cgcugugccuggauca

SEQ ID NO: 2245812 - RNA, 22 nt, Yersinia pestis
cgcuguggcuaauaaugcacca

SEQ ID NO: 2245813 - RNA, 21 nt, Yersinia pestis
cgcuguacaacaagaucccaa

SEQ ID NO: 2245814 - RNA, 20 nt, Yersinia pestis
cgcuggcgauaaucucgugg

SEQ ID NO: 2245815 - RNA, 17 nt, Yersinia pestis
cgcuggcacugccauca

SEQ ID NO: 2245816 - RNA, 21 nt, Yersinia pestis
cgcugcuuuuacgcaaguaaa

SEQ ID NO: 2245817 - RNA, 14 nt, Yersinia pestis
cgcugauaaccagc

SEQ ID NO: 2245818 - RNA, 23 nt, Yersinia pestis
cgcgcuguggcuaauaaugcacc

SEQ ID NO: 2245819 - RNA, 18 nt, Yersinia pestis
cgcuaaucauauccauaa

SEQ ID NO: 2245820 - RNA, 12 nt, Yersinia pestis
cgcucagcaaaa

SEQ ID NO: 2245821 - RNA, 22 nt, Yersinia pestis
cgcuacgccucuauuuaucgcg

SEQ ID NO: 2245822 - RNA, 13 nt, Yersinia pestis
cgcucaggcgguc

SEQ ID NO: 2245823 - RNA, 12 nt, Yersinia pestis
cgcguuugauca

SEQ ID NO: 2245824 - RNA, 20 nt, Yersinia pestis
cgcgucaucgggguuuguca

SEQ ID NO: 2245825 - RNA, 23 nt, Yersinia pestis
cgcgguaacuaacaucagcgauu

SEQ ID NO: 2245826 - RNA, 13 nt, Yersinia pestis
cgccgucaucauc

SEQ ID NO: 2245827 - RNA, 19 nt, Yersinia pestis
cgccguaaacauggcucuc

SEQ ID NO: 2245828 - RNA, 22 nt, Yersinia pestis
cgcccacggggggucacgcgaa

SEQ ID NO: 2245829 - RNA, 13 nt, Yersinia pestis
cgcgaauaacaga

SEQ ID NO: 2245830 - RNA, 22 nt, Yersinia pestis
cgccugcccucguaauagccga

SEQ ID NO: 2245831 - RNA, 19 nt, Yersinia pestis
cgccuucauguugcaacau

SEQ ID NO: 2245832 - RNA, 17 nt, Yersinia pestis
cggcccgacuaaauccu

SEQ ID NO: 2245833 - RNA, 13 nt, Yersinia pestis
aacaucaauggca

SEQ ID NO: 2245834 - RNA, 22 nt, Yersinia pestis
aacauaaggcuagaucguuaca

SEQ ID NO: 2245835 - RNA, 21 nt, Yersinia pestis
cggcacucaaauagauagcaa

SEQ ID NO: 2245836 - RNA, 21 nt, Yersinia pestis
aacaggcgcaucgcgaucuga

SEQ ID NO: 2245837 - RNA, 18 nt, Yersinia pestis
cggcgcaagcgauaguua

SEQ ID NO: 2245838 - RNA, 15 nt, Yersinia pestis
cggcggaucaagcgc

SEQ ID NO: 2245839 - RNA, 23 nt, Yersinia pestis
cggguuuuuaacuuuaucagucu

SEQ ID NO: 2245840 - RNA, 23 nt, Yersinia pestis
cggguuuugccgggcaauuguga

SEQ ID NO: 2245841 - RNA, 23 nt, Yersinia pestis
cgguaacauauaaaccagccagu

SEQ ID NO: 2245842 - RNA, 17 nt, Yersinia pestis
cgguaacauauaaacca

SEQ ID NO: 2245843 - RNA, 22 nt, Yersinia pestis
cgguaccggcugggaucagacg

SEQ ID NO: 2245844 - RNA, 17 nt, Yersinia pestis
cgguacgcugauagcca

SEQ ID NO: 2245845 - RNA, 13 nt, Yersinia pestis
cgguacgcaucac

SEQ ID NO: 2245846 - RNA, 18 nt, Yersinia pestis
cgguauuaccaaucagcg

SEQ ID NO: 2245847 - RNA, 20 nt, Yersinia pestis
cggucgaacccauucaucaa

SEQ ID NO: 2245848 - RNA, 23 nt, Yersinia pestis
cggucauucacuguggcggccag

SEQ ID NO: 2245849 - RNA, 22 nt, Yersinia pestis
cggucauugagcggcaacugua

SEQ ID NO: 2245850 - RNA, 15 nt, Yersinia pestis
aaccaauacacagca

SEQ ID NO: 2245851 - RNA, 14 nt, Yersinia pestis
aaccaauauugagu

SEQ ID NO: 2245852 - RNA, 21 nt, Yersinia pestis
aaccacugaccuauugauaaa

SEQ ID NO: 2245853 - RNA, 15 nt, Yersinia pestis
aaccacgguaucaau

SEQ ID NO: 2245854 - RNA, 19 nt, Yersinia pestis
aaccacugaccuauugaua

SEQ ID NO: 2245855 - RNA, 21 nt, Yersinia pestis
aaccacacuuggugcuuagca

SEQ ID NO: 2245856 - RNA, 21 nt, Yersinia pestis
cgggucaugucgcuguagcgc

SEQ ID NO: 2245857 - RNA, 22 nt, Yersinia pestis
aaccagugccgcccagcgacgc

SEQ ID NO: 2245858 - RNA, 15 nt, Yersinia pestis
cggguucuaaauccu

SEQ ID NO: 2245859 - RNA, 14 nt, Yersinia pestis
cgggagggauuucu

SEQ ID NO: 2245860 - RNA, 17 nt, Yersinia pestis
cgggauccgccugcugg

SEQ ID NO: 2245861 - RNA, 19 nt, Yersinia pestis
cgggcacgauuugaucacg

SEQ ID NO: 2245862 - RNA, 23 nt, Yersinia pestis
cgggcgaaggucaauugcggcca

SEQ ID NO: 2245863 - RNA, 21 nt, Yersinia pestis
cgggccgcauucaccaccaua

SEQ ID NO: 2245864 - RNA, 14 nt, Yersinia pestis
cggcgucuuugcgu

SEQ ID NO: 2245865 - RNA, 23 nt, Yersinia pestis
cggcuaccgugcugccauauauu

SEQ ID NO: 2245866 - RNA, 13 nt, Yersinia pestis
cggcuaggcucag

SEQ ID NO: 2245867 - RNA, 16 nt, Yersinia pestis
cggcuagcguuaugcu

SEQ ID NO: 2245868 - RNA, 18 nt, Yersinia pestis
cggcucuauuucaugauu

SEQ ID NO: 2245869 - RNA, 24 nt, Yersinia pestis
aacaaaugggucgggaaucauuug

SEQ ID NO: 2245870 - RNA, 14 nt, Yersinia pestis
aacaaaguuaugcc

SEQ ID NO: 2245871 - RNA, 15 nt, Yersinia pestis
aacaaaggcgccaag

SEQ ID NO: 2245872 - RNA, 13 nt, Yersinia pestis
aacaaagccgcuu

SEQ ID NO: 2245873 - RNA, 22 nt, Yersinia pestis
cgacaccuucaaucauugagau

SEQ ID NO: 2245874 - RNA, 19 nt, Yersinia pestis
cgaauugacuuaacaguua

SEQ ID NO: 2245875 - RNA, 15 nt, Yersinia pestis
cgacaacuucaauac

SEQ ID NO: 2245876 - RNA, 22 nt, Yersinia pestis
cgacaaugcccccagcggugau

SEQ ID NO: 2245877 - RNA, 13 nt, Yersinia pestis
ccugucaccuguc

SEQ ID NO: 2245878 - RNA, 21 nt, Yersinia pestis
ccuguagcuuuuuaaauacca

SEQ ID NO: 2245879 - RNA, 13 nt, Yersinia pestis
ccuguaaaucuug

SEQ ID NO: 2245880 - RNA, 16 nt, Yersinia pestis
cgaaugcuauaaaccg

SEQ ID NO: 2245881 - RNA, 23 nt, Yersinia pestis
cgaauccccccauucacaccauu

SEQ ID NO: 2245882 - RNA, 15 nt, Yersinia pestis
cgaaggggcguuuaa

SEQ ID NO: 2245883 - RNA, 17 nt, Yersinia pestis
cgaaggguaucagcgac

SEQ ID NO: 2245884 - RNA, 17 nt, Yersinia pestis
cgagaaagucuuaaucu

SEQ ID NO: 2245885 - RNA, 13 nt, Yersinia pestis
cgauaucugcaua

SEQ ID NO: 2245886 - RNA, 22 nt, Yersinia pestis
cgauaucugcguuuucugcaua

SEQ ID NO: 2245887 - RNA, 18 nt, Yersinia pestis
cgauacccuucaucuuuc

SEQ ID NO: 2245888 - RNA, 23 nt, Yersinia pestis
cgauaaagagugaaauauaccgu

SEQ ID NO: 2245889 - RNA, 19 nt, Yersinia pestis
cgauaaauucgauaaaagg

SEQ ID NO: 2245890 - RNA, 19 nt, Yersinia pestis
cgauaaacaucaugacaaa

SEQ ID NO: 2245891 - RNA, 13 nt, Yersinia pestis
cgaguaaucagag

SEQ ID NO: 2245892 - RNA, 15 nt, Yersinia pestis
cgagguuaccguuag

SEQ ID NO: 2245893 - RNA, 17 nt, Yersinia pestis
cgccaugcuggaugaau

SEQ ID NO: 2245894 - RNA, 13 nt, Yersinia pestis
cgccaucgcacca

SEQ ID NO: 2245895 - RNA, 14 nt, Yersinia pestis
cgccauaucauauc

SEQ ID NO: 2245896 - RNA, 13 nt, Yersinia pestis
cgccaguguugcc

SEQ ID NO: 2245897 - RNA, 21 nt, Yersinia pestis
cgccagggguaagauccacca

SEQ ID NO: 2245898 - RNA, 22 nt, Yersinia pestis
cgcauuguuggguaaucaucag

SEQ ID NO: 2245899 - RNA, 13 nt, Yersinia pestis
cgcauuccaucag

SEQ ID NO: 2245900 - RNA, 20 nt, Yersinia pestis
cgccaauacccguucaacag

SEQ ID NO: 2245901 - RNA, 22 nt, Yersinia pestis
cgccaaauacaaaccguuugcc

SEQ ID NO: 2245902 - RNA, 12 nt, Yersinia pestis
cgccaagccagu

SEQ ID NO: 2245903 - RNA, 14 nt, Yersinia pestis
cgauucauugagca

SEQ ID NO: 2245904 - RNA, 14 nt, Yersinia pestis
cgauuaccugcaua

SEQ ID NO: 2245905 - RNA, 15 nt, Yersinia pestis
cgcaaccagcguuga

SEQ ID NO: 2245906 - RNA, 19 nt, Yersinia pestis
cgcaaccauccgcccaaua

SEQ ID NO: 2245907 - RNA, 14 nt, Yersinia pestis
cgauguggauaauu

SEQ ID NO: 2245908 - RNA, 22 nt, Yersinia pestis
cgaugugaagcaauuugaucac

SEQ ID NO: 2245909 - RNA, 11 nt, Yersinia pestis
cgauauugaua

SEQ ID NO: 2245910 - RNA, 23 nt, Yersinia pestis
cgauggcaaaggauaaugauauu

SEQ ID NO: 2245911 - RNA, 18 nt, Yersinia pestis
cgauggaccaugccauca

SEQ ID NO: 2245912 - RNA, 13 nt, Yersinia pestis
cgcaggcggucaa

SEQ ID NO: 2245913 - RNA, 23 nt, Yersinia pestis
cgcacccaaacugucugcgacaa

SEQ ID NO: 2245914 - RNA, 21 nt, Yersinia pestis
cgcacuuaaugccgcugauca

SEQ ID NO: 2245915 - RNA, 20 nt, Yersinia pestis
cgcacugggucaucacccag

SEQ ID NO: 2245916 - RNA, 19 nt, Yersinia pestis
ccucagacugcugacaaac

SEQ ID NO: 2245917 - RNA, 16 nt, Yersinia pestis
ccucacguuuagccau

SEQ ID NO: 2245918 - RNA, 12 nt, Yersinia pestis
ccucacgggcuu

SEQ ID NO: 2245919 - RNA, 19 nt, Yersinia pestis
ccugauccacuacuuauuu

SEQ ID NO: 2245920 - RNA, 11 nt, Yersinia pestis
ccucuucaggu

SEQ ID NO: 2245921 - RNA, 20 nt, Yersinia pestis
ccucguuguuguaugacaag

SEQ ID NO: 2245922 - RNA, 20 nt, Yersinia pestis
ccugagauuauuggcgauuu

SEQ ID NO: 2245923 - RNA, 17 nt, Yersinia pestis
ccugaaguugaucaaac

SEQ ID NO: 2245924 - RNA, 16 nt, Yersinia pestis
ccugaaucaacucauu

SEQ ID NO: 2245925 - RNA, 14 nt, Yersinia pestis
ccugacaaacggcg

SEQ ID NO: 2245926 - RNA, 22 nt, Yersinia pestis
ccugcuguuaguaacuguaagg

SEQ ID NO: 2245927 - RNA, 13 nt, Yersinia pestis
ccguaucaugggu

SEQ ID NO: 2245928 - RNA, 20 nt, Yersinia pestis
ccgucagacugcugacaaac

SEQ ID NO: 2245929 - RNA, 13 nt, Yersinia pestis
ccgguaauaccga

SEQ ID NO: 2245930 - RNA, 12 nt, Yersinia pestis
aaaugccaguaa

SEQ ID NO: 2245931 - RNA, 16 nt, Yersinia pestis
ccgcgccgacuguucg

SEQ ID NO: 2245932 - RNA, 23 nt, Yersinia pestis
ccgccagguuuacuggcgggcau

SEQ ID NO: 2245933 - RNA, 17 nt, Yersinia pestis
ccgcaggaagcaaugaa

SEQ ID NO: 2245934 - RNA, 21 nt, Yersinia pestis
ccgcaucauuguuuacuauuu

SEQ ID NO: 2245935 - RNA, 18 nt, Yersinia pestis
ccggcaucaaccaagaca

SEQ ID NO: 2245936 - RNA, 14 nt, Yersinia pestis
ccggcccaacuggc

SEQ ID NO: 2245937 - RNA, 14 nt, Yersinia pestis
ccgcugcaagcaau

SEQ ID NO: 2245938 - RNA, 16 nt, Yersinia pestis
ccgcuaaaucaucaaa

SEQ ID NO: 2245939 - RNA, 17 nt, Yersinia pestis
ccgcuaaggccaaugga

SEQ ID NO: 2245940 - RNA, 18 nt, Yersinia pestis
ccgcuaauucugcgccua

SEQ ID NO: 2245941 - RNA, 19 nt, Yersinia pestis
ccggaauaaagcucucgcg

SEQ ID NO: 2245942 - RNA, 12 nt, Yersinia pestis
ccggacucauua

SEQ ID NO: 2245943 - RNA, 13 nt, Yersinia pestis
ccggaucaucaac

SEQ ID NO: 2245944 - RNA, 18 nt, Yersinia pestis
uuuuuucaccaaccaauu

SEQ ID NO: 2245945 - RNA, 21 nt, Yersinia pestis
uuuuuugggaugaaaaauaca

SEQ ID NO: 2245946 - RNA, 13 nt, Yersinia pestis
uuuuuaauuuaaa

SEQ ID NO: 2245947 - RNA, 17 nt, Yersinia pestis
uuuuuaauuuagccauu

SEQ ID NO: 2245948 - RNA, 15 nt, Yersinia pestis
uuuuuacauuccaca

SEQ ID NO: 2245949 - RNA, 12 nt, Yersinia pestis
uuuuuacaagca

SEQ ID NO: 2245950 - RNA, 20 nt, Yersinia pestis
uuuuuacauauaauccaaaa

SEQ ID NO: 2245951 - RNA, 18 nt, Yersinia pestis
uuuuuacugcguaacccc

SEQ ID NO: 2245952 - RNA, 14 nt, Yersinia pestis
uuuuuagcuucgcu

SEQ ID NO: 2245953 - RNA, 21 nt, Yersinia pestis
uuuuuacccguacaaaaauaa

SEQ ID NO: 2245954 - RNA, 19 nt, Yersinia pestis
uuuuuacgccuauccucau

SEQ ID NO: 2245955 - RNA, 15 nt, Yersinia pestis
uuuuuaacgauauag

SEQ ID NO: 2245956 - RNA, 21 nt, Yersinia pestis
uuuuuaaugauugauuaucaa

SEQ ID NO: 2245957 - RNA, 18 nt, Yersinia pestis
uuuuucaacucagcggcu

SEQ ID NO: 2245958 - RNA, 12 nt, Yersinia pestis
uuuuucagcuuc

SEQ ID NO: 2245959 - RNA, 13 nt, Yersinia pestis
uuuuuaucccccu

SEQ ID NO: 2245960 - RNA, 12 nt, Yersinia pestis
uuuuuaucccua

SEQ ID NO: 2245961 - RNA, 14 nt, Yersinia pestis
uuuuuauauuccac

SEQ ID NO: 2245962 - RNA, 19 nt, Yersinia pestis
uuuuuauaggucaucccag

SEQ ID NO: 2245963 - RNA, 14 nt, Yersinia pestis
uuuugucauuuaau

SEQ ID NO: 2245964 - RNA, 23 nt, Yersinia pestis
uuuuguuacugcuuaccuuguuu

SEQ ID NO: 2245965 - RNA, 14 nt, Yersinia pestis
uuuuguuaauauuu

SEQ ID NO: 2245966 - RNA, 16 nt, Yersinia pestis
uuuuguuaauauuuau

SEQ ID NO: 2245967 - RNA, 15 nt, Yersinia pestis
uuuuggccgcuacug

SEQ ID NO: 2245968 - RNA, 18 nt, Yersinia pestis
uuuuggcuauuaaagccc

SEQ ID NO: 2245969 - RNA, 14 nt, Yersinia pestis
uuuuggcugauaga

SEQ ID NO: 2245970 - RNA, 17 nt, Yersinia pestis
uuuuggucguauucaua

SEQ ID NO: 2245971 - RNA, 23 nt, Yersinia pestis
uuuuggggucugaauauaaauuu

SEQ ID NO: 2245972 - RNA, 15 nt, Yersinia pestis
uuuugcuuaaaacag

SEQ ID NO: 2245973 - RNA, 22 nt, Yersinia pestis
uuuugcgacaggcucagcacaa

SEQ ID NO: 2245974 - RNA, 23 nt, Yersinia pestis
uuuucacuccggcaucauccuca

SEQ ID NO: 2245975 - RNA, 22 nt, Yersinia pestis
uuuucacccccacaucaggccg

SEQ ID NO: 2245976 - RNA, 19 nt, Yersinia pestis
uuuaccgucgauaaccaga

SEQ ID NO: 2245977 - RNA, 18 nt, Yersinia pestis
uuuuccgccaugagaacc

SEQ ID NO: 2245978 - RNA, 14 nt, Yersinia pestis
uuuuccggcuuucu

SEQ ID NO: 2245979 - RNA, 23 nt, Yersinia pestis
uuuucaguaucgaagacaaacac

SEQ ID NO: 2245980 - RNA, 15 nt, Yersinia pestis
uuuucauaaucaccu

SEQ ID NO: 2245981 - RNA, 16 nt, Yersinia pestis
uuuugccaauauugcc

SEQ ID NO: 2245982 - RNA, 18 nt, Yersinia pestis
uuuugcccgcgcuuccag

SEQ ID NO: 2245983 - RNA, 18 nt, Yersinia pestis
uuuugccacauuucccuu

SEQ ID NO: 2245984 - RNA, 23 nt, Yersinia pestis
uuuugacacgggaucaacauggu

SEQ ID NO: 2245985 - RNA, 23 nt, Yersinia pestis
uuuugaccaugcuuauugccaug

SEQ ID NO: 2245986 - RNA, 13 nt, Yersinia pestis
uuuucugccuauc

SEQ ID NO: 2245987 - RNA, 15 nt, Yersinia pestis
uuuucucuuucuucu

SEQ ID NO: 2245988 - RNA, 21 nt, Yersinia pestis
uuuucuccugggcugauauau

SEQ ID NO: 2245989 - RNA, 22 nt, Yersinia pestis
ucugcaagcccccaaaguagaa

SEQ ID NO: 2245990 - RNA, 15 nt, Yersinia pestis
ucugaucgaguucag

SEQ ID NO: 2245991 - RNA, 12 nt, Yersinia pestis
ucugaucaaucu

SEQ ID NO: 2245992 - RNA, 15 nt, Yersinia pestis
ucugagaucuaaaaa

SEQ ID NO: 2245993 - RNA, 21 nt, Yersinia pestis
ucugauagugauuuuuuucac

SEQ ID NO: 2245994 - RNA, 19 nt, Yersinia pestis
ucugauaucucuuuaucau

SEQ ID NO: 2245995 - RNA, 14 nt, Yersinia pestis
ucugacuaacucuu

SEQ ID NO: 2245996 - RNA, 19 nt, Yersinia pestis
ucugacuacugaaaccuga

SEQ ID NO: 2245997 - RNA, 12 nt, Yersinia pestis
ucugacuaagac

SEQ ID NO: 2245998 - RNA, 12 nt, Yersinia pestis
ucugacuguuga

SEQ ID NO: 2245999 - RNA, 16 nt, Yersinia pestis
ucugaagaugccaauc

SEQ ID NO: 2246000 - RNA, 18 nt, Yersinia pestis
ucugaagccuacgagaga

SEQ ID NO: 2246001 - RNA, 13 nt, Yersinia pestis
ucugaauaaaaaa

SEQ ID NO: 2246002 - RNA, 22 nt, Yersinia pestis
ucugaaggguauugaagauacc

SEQ ID NO: 2246003 - RNA, 22 nt, Yersinia pestis
ucugaauagcgcugcaucagca

SEQ ID NO: 2246004 - RNA, 17 nt, Yersinia pestis
ucugacggguauaucac

SEQ ID NO: 2246005 - RNA, 15 nt, Yersinia pestis
ucucuuuccagcaaa

SEQ ID NO: 2246006 - RNA, 16 nt, Yersinia pestis
ucucuuuccagcaaaa

SEQ ID NO: 2246007 - RNA, 18 nt, Yersinia pestis
ucucuuucagcucuucaa

SEQ ID NO: 2246008 - RNA, 15 nt, Yersinia pestis
ucucuuuauauucaa

SEQ ID NO: 2246009 - RNA, 13 nt, Yersinia pestis
ucucuuacauaaa

SEQ ID NO: 2246010 - RNA, 17 nt, Yersinia pestis
ucucuuacauaaagacc

SEQ ID NO: 2246011 - RNA, 14 nt, Yersinia pestis
ucucuuaccccuuu

SEQ ID NO: 2246012 - RNA, 23 nt, Yersinia pestis
ucucuuaaagaaaauuuacccug

SEQ ID NO: 2246013 - RNA, 14 nt, Yersinia pestis
ucucuuaggcaacc

SEQ ID NO: 2246014 - RNA, 16 nt, Yersinia pestis
ucucuucagagauuca

SEQ ID NO: 2246015 - RNA, 16 nt, Yersinia pestis
ucucuucgccuuugau

SEQ ID NO: 2246016 - RNA, 16 nt, Yersinia pestis
ucucuugaaaugauaa

SEQ ID NO: 2246017 - RNA, 19 nt, Yersinia pestis
ucucuugaaaugauaacaa

SEQ ID NO: 2246018 - RNA, 22 nt, Yersinia pestis
ucucuugaaaugauaacaauaa

SEQ ID NO: 2246019 - RNA, 20 nt, Yersinia pestis
ucucuugauuaccaauaauu

SEQ ID NO: 2246020 - RNA, 17 nt, Yersinia pestis
ucucugaugguaucaga

SEQ ID NO: 2246021 - RNA, 14 nt, Yersinia pestis
ucucugcucgcauu

SEQ ID NO: 2246022 - RNA, 18 nt, Yersinia pestis
ucucugggugcugcuccc

SEQ ID NO: 2246023 - RNA, 22 nt, Yersinia pestis
ucucuggcaacggcacauccca

SEQ ID NO: 2246024 - RNA, 18 nt, Yersinia pestis
ucucuggcacgcuuucug

SEQ ID NO: 2246025 - RNA, 22 nt, Yersinia pestis
ucucuggcuaaugucucuauuc

SEQ ID NO: 2246026 - RNA, 13 nt, Yersinia pestis
ucucucuaugucu

SEQ ID NO: 2246027 - RNA, 13 nt, Yersinia pestis
ucucuccaugaua

SEQ ID NO: 2246028 - RNA, 16 nt, Yersinia pestis
ucucuccuaaaaucua

SEQ ID NO: 2246029 - RNA, 23 nt, Yersinia pestis
ucucuccuauaucucaguugaaa

SEQ ID NO: 2246030 - RNA, 16 nt, Yersinia pestis
ucucuauuggcuuauc

SEQ ID NO: 2246031 - RNA, 13 nt, Yersinia pestis
ucucuauucacua

SEQ ID NO: 2246032 - RNA, 14 nt, Yersinia pestis
ucucuauucugcuu

SEQ ID NO: 2246033 - RNA, 18 nt, Yersinia pestis
ucuccccuaccucauccg

SEQ ID NO: 2246034 - RNA, 13 nt, Yersinia pestis
ucuccccuuaugc

SEQ ID NO: 2246035 - RNA, 21 nt, Yersinia pestis
ucuccuccagaauaucuucaa

SEQ ID NO: 2246036 - RNA, 20 nt, Yersinia pestis
ucucaugacaaagaauguua

SEQ ID NO: 2246037 - RNA, 14 nt, Yersinia pestis
ucucauuauuuauu

SEQ ID NO: 2246038 - RNA, 16 nt, Yersinia pestis
ucuacauugacuaauu

SEQ ID NO: 2246039 - RNA, 21 nt, Yersinia pestis
ucuccaguuggcgcacguucc

SEQ ID NO: 2246040 - RNA, 23 nt, Yersinia pestis
ucucauuuagcauuauucuucac

SEQ ID NO: 2246041 - RNA, 15 nt, Yersinia pestis
ucuccagaauauaaa

SEQ ID NO: 2246042 - RNA, 15 nt, Yersinia pestis
ucucuagauuaaccu

SEQ ID NO: 2246043 - RNA, 18 nt, Yersinia pestis
ucucuaucaauauauacc

SEQ ID NO: 2246044 - RNA, 23 nt, Yersinia pestis
ucucuaccgaucaaacagguaaa

SEQ ID NO: 2246045 - RNA, 18 nt, Yersinia pestis
ucucuaaucgcgcauuuc

SEQ ID NO: 2246046 - RNA, 15 nt, Yersinia pestis
ucucgcagccgccag

SEQ ID NO: 2246047 - RNA, 16 nt, Yersinia pestis
ucucgauacaauuuuu

SEQ ID NO: 2246048 - RNA, 21 nt, Yersinia pestis
ucucgagguguuuuccccaau

SEQ ID NO: 2246049 - RNA, 15 nt, Yersinia pestis
ucucgagaaauaaau

SEQ ID NO: 2246050 - RNA, 18 nt, Yersinia pestis
ucucgacaaauccuuuua

SEQ ID NO: 2246051 - RNA, 20 nt, Yersinia pestis
ucucgacauccaauucagua

SEQ ID NO: 2246052 - RNA, 13 nt, Yersinia pestis
ucugcguaugggg

SEQ ID NO: 2246053 - RNA, 20 nt, Yersinia pestis
ucugcguauggggauuuuau

SEQ ID NO: 2246054 - RNA, 20 nt, Yersinia pestis
ucugcggcaagcugugccug

SEQ ID NO: 2246055 - RNA, 22 nt, Yersinia pestis
ucugcggcaagcugugccugag

SEQ ID NO: 2246056 - RNA, 14 nt, Yersinia pestis
ucugcucccauguc

SEQ ID NO: 2246057 - RNA, 22 nt, Yersinia pestis
ucugcucccggcacuaaguguc

SEQ ID NO: 2246058 - RNA, 20 nt, Yersinia pestis
ucugcuagcaaauuccgcuu

SEQ ID NO: 2246059 - RNA, 16 nt, Yersinia pestis
ucugcucuugcucagu

SEQ ID NO: 2246060 - RNA, 17 nt, Yersinia pestis
ucugcucuugcucagua

SEQ ID NO: 2246061 - RNA, 13 nt, Yersinia pestis
ucugcugcugccc

SEQ ID NO: 2246062 - RNA, 14 nt, Yersinia pestis
ucugcugggauacu

SEQ ID NO: 2246063 - RNA, 20 nt, Yersinia pestis
ucugguugugagguuagaaa

SEQ ID NO: 2246064 - RNA, 13 nt, Yersinia pestis
ucugguugugcuu

SEQ ID NO: 2246065 - RNA, 19 nt, Yersinia pestis
ucuggcuuaucuuccagau

SEQ ID NO: 2246066 - RNA, 18 nt, Yersinia pestis
ucuggcugcuaauggucu

SEQ ID NO: 2246067 - RNA, 19 nt, Yersinia pestis
ucuggcuggcauauuucuc

SEQ ID NO: 2246068 - RNA, 21 nt, Yersinia pestis
ucuggcuggcauauuucucuu

SEQ ID NO: 2246069 - RNA, 19 nt, Yersinia pestis
ucuggcuuucucaacagca

SEQ ID NO: 2246070 - RNA, 17 nt, Yersinia pestis
ucuggugccguuuugcu

SEQ ID NO: 2246071 - RNA, 22 nt, Yersinia pestis
ucuggcuuucucaacagcauca

SEQ ID NO: 2246072 - RNA, 16 nt, Yersinia pestis
ucuggcgugucaucuu

SEQ ID NO: 2246073 - RNA, 14 nt, Yersinia pestis
ucugucguacuuuc

SEQ ID NO: 2246074 - RNA, 17 nt, Yersinia pestis
ucugucguacuuuccuu

SEQ ID NO: 2246075 - RNA, 15 nt, Yersinia pestis
ucuguggugccauaa

SEQ ID NO: 2246076 - RNA, 17 nt, Yersinia pestis
ucuguguaguggggcuu

SEQ ID NO: 2246077 - RNA, 19 nt, Yersinia pestis
ucugucgggaacacuuugc

SEQ ID NO: 2246078 - RNA, 12 nt, Yersinia pestis
ucuguaauaaua

SEQ ID NO: 2246079 - RNA, 13 nt, Yersinia pestis
ucuguaauaauaa

SEQ ID NO: 2246080 - RNA, 21 nt, Yersinia pestis
ucuuaggugacaggcaaagac

SEQ ID NO: 2246081 - RNA, 20 nt, Yersinia pestis
ucuuaucaaucaaaaaauaa

SEQ ID NO: 2246082 - RNA, 20 nt, Yersinia pestis
ucuuauuaggguugguuggu

SEQ ID NO: 2246083 - RNA, 13 nt, Yersinia pestis
ucuuacuaaaaua

SEQ ID NO: 2246084 - RNA, 18 nt, Yersinia pestis
ucuuagaccaccgccauu

SEQ ID NO: 2246085 - RNA, 21 nt, Yersinia pestis
ucuguucagcauaaauauuca

SEQ ID NO: 2246086 - RNA, 15 nt, Yersinia pestis
ucuuacccaacagug

SEQ ID NO: 2246087 - RNA, 17 nt, Yersinia pestis
ucuuaccggccucuuuc

SEQ ID NO: 2246088 - RNA, 22 nt, Yersinia pestis
ucuguguuuagcgucgcugaug

SEQ ID NO: 2246089 - RNA, 14 nt, Yersinia pestis
ucuguuaccaaugg

SEQ ID NO: 2246090 - RNA, 21 nt, Yersinia pestis
ucuuccagacaaagugaggga

SEQ ID NO: 2246091 - RNA, 19 nt, Yersinia pestis
ucuuccacucuuucaauga

SEQ ID NO: 2246092 - RNA, 21 nt, Yersinia pestis
ucuucagccuauccucaccgu

SEQ ID NO: 2246093 - RNA, 13 nt, Yersinia pestis
ucuucaccaauga

SEQ ID NO: 2246094 - RNA, 22 nt, Yersinia pestis
ucuucacgcucgguuauuuauc

SEQ ID NO: 2246095 - RNA, 14 nt, Yersinia pestis
ucuucaacugucac

SEQ ID NO: 2246096 - RNA, 11 nt, Yersinia pestis
ucuuauuuaac

SEQ ID NO: 2246097 - RNA, 21 nt, Yersinia pestis
ucuucaaccuggaaccaagcc

SEQ ID NO: 2246098 - RNA, 14 nt, Yersinia pestis
ugaaagcuaauauu

SEQ ID NO: 2246099 - RNA, 21 nt, Yersinia pestis
ugaaagccaaucucuuguuuu

SEQ ID NO: 2246100 - RNA, 20 nt, Yersinia pestis
ugaaagcuucaacuuccagu

SEQ ID NO: 2246101 - RNA, 17 nt, Yersinia pestis
ugaaaguggccacucac

SEQ ID NO: 2246102 - RNA, 19 nt, Yersinia pestis
ugaaaguggccacucaccu

SEQ ID NO: 2246103 - RNA, 16 nt, Yersinia pestis
ugaaaguuuauaugcu

SEQ ID NO: 2246104 - RNA, 14 nt, Yersinia pestis
ugaaaguuuauaug

SEQ ID NO: 2246105 - RNA, 14 nt, Yersinia pestis
ugaaauaaacaagc

SEQ ID NO: 2246106 - RNA, 13 nt, Yersinia pestis
ugaaauaacugcc

SEQ ID NO: 2246107 - RNA, 20 nt, Yersinia pestis
ugaaacgauaugcuccagau

SEQ ID NO: 2246108 - RNA, 20 nt, Yersinia pestis
ugaaaccaaaaccuuuacca

SEQ ID NO: 2246109 - RNA, 17 nt, Yersinia pestis
ugaaaccgaucacuaua

SEQ ID NO: 2246110 - RNA, 19 nt, Yersinia pestis
ugaaacuucaaaaucaagu

SEQ ID NO: 2246111 - RNA, 21 nt, Yersinia pestis
ugaaacuuuucaguuuuaauu

SEQ ID NO: 2246112 - RNA, 11 nt, Yersinia pestis
ugaaacucaac

SEQ ID NO: 2246113 - RNA, 17 nt, Yersinia pestis
ugaaacacuuauuugaa

SEQ ID NO: 2246114 - RNA, 22 nt, Yersinia pestis
ugaaacacuuauuugaaauacu

SEQ ID NO: 2246115 - RNA, 17 nt, Yersinia pestis
ugaaacauaauuaaaua

SEQ ID NO: 2246116 - RNA, 20 nt, Yersinia pestis
ugaaacauaauuaaauauua

SEQ ID NO: 2246117 - RNA, 13 nt, Yersinia pestis
ugaaaccacugcg

SEQ ID NO: 2246118 - RNA, 16 nt, Yersinia pestis
ugaaaaugguuuccag

SEQ ID NO: 2246119 - RNA, 14 nt, Yersinia pestis
ugaaaaaguccgca

SEQ ID NO: 2246120 - RNA, 13 nt, Yersinia pestis
ugaaaaacugugc

SEQ ID NO: 2246121 - RNA, 18 nt, Yersinia pestis
ugaaaagguuaacugcag

SEQ ID NO: 2246122 - RNA, 19 nt, Yersinia pestis
ugaacaaaccacauuccag

SEQ ID NO: 2246123 - RNA, 13 nt, Yersinia pestis
ugaaauuuuauuc

SEQ ID NO: 2246124 - RNA, 16 nt, Yersinia pestis
ugaaauuuuuuaauuu

SEQ ID NO: 2246125 - RNA, 21 nt, Yersinia pestis
ugaaauucuguagaguaaaac

SEQ ID NO: 2246126 - RNA, 18 nt, Yersinia pestis
ugaaauuaguuaauuuaa

SEQ ID NO: 2246127 - RNA, 21 nt, Yersinia pestis
ugaaaugauaacaauaaaauc

SEQ ID NO: 2246128 - RNA, 16 nt, Yersinia pestis
ugaaaucaguguauua

SEQ ID NO: 2246129 - RNA, 19 nt, Yersinia pestis
ugaaaucagaucaacagau

SEQ ID NO: 2246130 - RNA, 20 nt, Yersinia pestis
ugaaauauacacaagucauu

SEQ ID NO: 2246131 - RNA, 21 nt, Yersinia pestis
ugaaauaccgauuagaaaucg

SEQ ID NO: 2246132 - RNA, 23 nt, Yersinia pestis
ugaacgaacacaucuuugcugcc

SEQ ID NO: 2246133 - RNA, 18 nt, Yersinia pestis
ugaaccugacgcacagca

SEQ ID NO: 2246134 - RNA, 18 nt, Yersinia pestis
ugaaccgcgcucugcugg

SEQ ID NO: 2246135 - RNA, 18 nt, Yersinia pestis
ugaacgaggacuuccugc

SEQ ID NO: 2246136 - RNA, 23 nt, Yersinia pestis
ugaaccccgguuuuuacuguucu

SEQ ID NO: 2246137 - RNA, 19 nt, Yersinia pestis
ugaaccgccauugcauauu

SEQ ID NO: 2246138 - RNA, 24 nt, Yersinia pestis
ugaaccaaaauucacaacuuguga

SEQ ID NO: 2246139 - RNA, 18 nt, Yersinia pestis
ugaaccagauaacaacaa

SEQ ID NO: 2246140 - RNA, 18 nt, Yersinia pestis
ugaacauggauccugcaa

SEQ ID NO: 2246141 - RNA, 19 nt, Yersinia pestis
ugaacauggauccugcaaa

SEQ ID NO: 2246142 - RNA, 13 nt, Yersinia pestis
ugaacacagaaac

SEQ ID NO: 2246143 - RNA, 15 nt, Yersinia pestis
ugaacacuuaauucc

SEQ ID NO: 2246144 - RNA, 17 nt, Yersinia pestis
ugaacacuuaauuccau

SEQ ID NO: 2246145 - RNA, 18 nt, Yersinia pestis
ugaacacucuuuuuaauu

SEQ ID NO: 2246146 - RNA, 14 nt, Yersinia pestis
ucuuuaauaauaga

SEQ ID NO: 2246147 - RNA, 16 nt, Yersinia pestis
ucuuuaaucaccucaa

SEQ ID NO: 2246148 - RNA, 12 nt, Yersinia pestis
ucuuuaauuuuu

SEQ ID NO: 2246149 - RNA, 15 nt, Yersinia pestis
ucuuucauaucaaaa

SEQ ID NO: 2246150 - RNA, 18 nt, Yersinia pestis
ucuuucaccacugccaca

SEQ ID NO: 2246151 - RNA, 21 nt, Yersinia pestis
ucuuucaccaguggucaucac

SEQ ID NO: 2246152 - RNA, 13 nt, Yersinia pestis
ucuuuccagcaaa

SEQ ID NO: 2246153 - RNA, 16 nt, Yersinia pestis
ucuuuccagcaaaagc

SEQ ID NO: 2246154 - RNA, 18 nt, Yersinia pestis
ucuuucaucccauaugcu

SEQ ID NO: 2246155 - RNA, 16 nt, Yersinia pestis
ucuuuccuacacuggc

SEQ ID NO: 2246156 - RNA, 21 nt, Yersinia pestis
ucuuucucgauacaauuuuug

SEQ ID NO: 2246157 - RNA, 22 nt, Yersinia pestis
ucuuucuguucagcauaaauau

SEQ ID NO: 2246158 - RNA, 16 nt, Yersinia pestis
ucuuucuguucagcau

SEQ ID NO: 2246159 - RNA, 20 nt, Yersinia pestis
ucuuucuguucagcauaaau

SEQ ID NO: 2246160 - RNA, 18 nt, Yersinia pestis
ucuuucuggcuaaacgau

SEQ ID NO: 2246161 - RNA, 13 nt, Yersinia pestis
ucuuguucuaaua

SEQ ID NO: 2246162 - RNA, 16 nt, Yersinia pestis
ucuuguucuaauaaua

SEQ ID NO: 2246163 - RNA, 13 nt, Yersinia pestis
ucuuguguaauua

SEQ ID NO: 2246164 - RNA, 15 nt, Yersinia pestis
ucuuguuaauuuaaa

SEQ ID NO: 2246165 - RNA, 16 nt, Yersinia pestis
ucuuguuaauuuaaac

SEQ ID NO: 2246166 - RNA, 21 nt, Yersinia pestis
ucuuguuaucaccugucaccu

SEQ ID NO: 2246167 - RNA, 15 nt, Yersinia pestis
ucuuggauaacagau

SEQ ID NO: 2246168 - RNA, 20 nt, Yersinia pestis
ucuuggcacucgaucaaucc

SEQ ID NO: 2246169 - RNA, 21 nt, Yersinia pestis
ucuugggcagcgacaaccugu

SEQ ID NO: 2246170 - RNA, 23 nt, Yersinia pestis
ucuuccauuuuauuuaacguguu

SEQ ID NO: 2246171 - RNA, 15 nt, Yersinia pestis
ucuuccaucuuaccc

SEQ ID NO: 2246172 - RNA, 18 nt, Yersinia pestis
ucuuugaccagggcuaaa

SEQ ID NO: 2246173 - RNA, 18 nt, Yersinia pestis
ucuuugacucaauauugu

SEQ ID NO: 2246174 - RNA, 15 nt, Yersinia pestis
ucuuugauuuaaaua

SEQ ID NO: 2246175 - RNA, 16 nt, Yersinia pestis
ucuuugccuauuucag

SEQ ID NO: 2246176 - RNA, 16 nt, Yersinia pestis
ucuuugcguucugucu

SEQ ID NO: 2246177 - RNA, 22 nt, Yersinia pestis
ucuuugcugccaucagccggag

SEQ ID NO: 2246178 - RNA, 16 nt, Yersinia pestis
ucuuugcuucaggcac

SEQ ID NO: 2246179 - RNA, 21 nt, Yersinia pestis
ucuuuuagcgcuuuuacauca

SEQ ID NO: 2246180 - RNA, 14 nt, Yersinia pestis
ucuuuuacaaauuu

SEQ ID NO: 2246181 - RNA, 14 nt, Yersinia pestis
ucuuuuaaagaaga

SEQ ID NO: 2246182 - RNA, 15 nt, Yersinia pestis
ucuuugucaauaacc

SEQ ID NO: 2246183 - RNA, 13 nt, Yersinia pestis
ucuuuguuacaua

SEQ ID NO: 2246184 - RNA, 23 nt, Yersinia pestis
ugaaaaaauaaaugcucucgaga

SEQ ID NO: 2246185 - RNA, 21 nt, Yersinia pestis
ugaaaaacagagggccccgau

SEQ ID NO: 2246186 - RNA, 16 nt, Yersinia pestis
ucuuuuucugccugag

SEQ ID NO: 2246187 - RNA, 14 nt, Yersinia pestis
ucuuuucuuuaugu

SEQ ID NO: 2246188 - RNA, 13 nt, Yersinia pestis
ucuuuuguauaug

SEQ ID NO: 2246189 - RNA, 16 nt, Yersinia pestis
ucuuuuuccacacccu

SEQ ID NO: 2246190 - RNA, 12 nt, Yersinia pestis
ucuuuuuaauuu

SEQ ID NO: 2246191 - RNA, 11 nt, Yersinia pestis
ucuuuuuaauu

SEQ ID NO: 2246192 - RNA, 19 nt, Yersinia pestis
ucgguagcgguaauuaaua

SEQ ID NO: 2246193 - RNA, 20 nt, Yersinia pestis
ucgguaacuuacaggcugcc

SEQ ID NO: 2246194 - RNA, 16 nt, Yersinia pestis
ucggucuauaaaaccg

SEQ ID NO: 2246195 - RNA, 19 nt, Yersinia pestis
ucggucgauuuuuauuuuc

SEQ ID NO: 2246196 - RNA, 20 nt, Yersinia pestis
ucggucacacuggcacgggc

SEQ ID NO: 2246197 - RNA, 19 nt, Yersinia pestis
ucguaacccccagccagaa

SEQ ID NO: 2246198 - RNA, 20 nt, Yersinia pestis
ucguacaucuccgcuauuuu

SEQ ID NO: 2246199 - RNA, 18 nt, Yersinia pestis
ucguauaacauaauaaau

SEQ ID NO: 2246200 - RNA, 13 nt, Yersinia pestis
ucguccagcagca

SEQ ID NO: 2246201 - RNA, 14 nt, Yersinia pestis
ucgucggcccggcc

SEQ ID NO: 2246202 - RNA, 19 nt, Yersinia pestis
ucgucggcccggccaggcu

SEQ ID NO: 2246203 - RNA, 20 nt, Yersinia pestis
ucgucggcccggccaggcuc

SEQ ID NO: 2246204 - RNA, 22 nt, Yersinia pestis
ucgucuauagugccuaauaaau

SEQ ID NO: 2246205 - RNA, 21 nt, Yersinia pestis
ucgugaaguuuauacuauuua

SEQ ID NO: 2246206 - RNA, 17 nt, Yersinia pestis
ucuaaauccugcaaauu

SEQ ID NO: 2246207 - RNA, 19 nt, Yersinia pestis
ucuaacugauguauucccu

SEQ ID NO: 2246208 - RNA, 22 nt, Yersinia pestis
ucuaacugauguauucccucaa

SEQ ID NO: 2246209 - RNA, 17 nt, Yersinia pestis
ucuaacucauucauaau

SEQ ID NO: 2246210 - RNA, 14 nt, Yersinia pestis
ucuaacuaauaaua

SEQ ID NO: 2246211 - RNA, 16 nt, Yersinia pestis
ucuaaguaaaacaaag

SEQ ID NO: 2246212 - RNA, 17 nt, Yersinia pestis
ucuaagugccaguuaau

SEQ ID NO: 2246213 - RNA, 11 nt, Yersinia pestis
ucuacaacauc

SEQ ID NO: 2246214 - RNA, 18 nt, Yersinia pestis
ucgugauugagcguugau

SEQ ID NO: 2246215 - RNA, 23 nt, Yersinia pestis
ucguuagugaaguaauaaaaauc

SEQ ID NO: 2246216 - RNA, 15 nt, Yersinia pestis
ucguuauaauauuaa

SEQ ID NO: 2246217 - RNA, 20 nt, Yersinia pestis
ucguuagggauucgugucaa

SEQ ID NO: 2246218 - RNA, 15 nt, Yersinia pestis
ucguuuccagcggcg

SEQ ID NO: 2246219 - RNA, 22 nt, Yersinia pestis
ucguuuccagcggcguaucaaa

SEQ ID NO: 2246220 - RNA, 19 nt, Yersinia pestis
ucguuuaacucaaauaaac

SEQ ID NO: 2246221 - RNA, 18 nt, Yersinia pestis
ucguucgcccuucuucca

SEQ ID NO: 2246222 - RNA, 22 nt, Yersinia pestis
ucguucacucccguugccgccu

SEQ ID NO: 2246223 - RNA, 22 nt, Yersinia pestis
ucggcguucgguaaugccagcc

SEQ ID NO: 2246224 - RNA, 22 nt, Yersinia pestis
ucggcggucugagucagucagg

SEQ ID NO: 2246225 - RNA, 14 nt, Yersinia pestis
ucggcgcgcuugcc

SEQ ID NO: 2246226 - RNA, 16 nt, Yersinia pestis
ucggcggagagaaugg

SEQ ID NO: 2246227 - RNA, 14 nt, Yersinia pestis
ucggguaaaccaau

SEQ ID NO: 2246228 - RNA, 16 nt, Yersinia pestis
ucggggguugucagca

SEQ ID NO: 2246229 - RNA, 16 nt, Yersinia pestis
ucgggguuugucagca

SEQ ID NO: 2246230 - RNA, 16 nt, Yersinia pestis
ucgggcuaucaucaaa

SEQ ID NO: 2246231 - RNA, 22 nt, Yersinia pestis
ucgggcuuuacagucgcugcug

SEQ ID NO: 2246232 - RNA, 17 nt, Yersinia pestis
ucgggauccgccugcug

SEQ ID NO: 2246233 - RNA, 21 nt, Yersinia pestis
ucgggauccgccugcuggcca

SEQ ID NO: 2246234 - RNA, 20 nt, Yersinia pestis
ucgcuuuugugaucaguuca

SEQ ID NO: 2246235 - RNA, 13 nt, Yersinia pestis
ucgcuugcugccu

SEQ ID NO: 2246236 - RNA, 17 nt, Yersinia pestis
ucgcuuucagcagggcg

SEQ ID NO: 2246237 - RNA, 19 nt, Yersinia pestis
ucggauaaccgcauucccu

SEQ ID NO: 2246238 - RNA, 21 nt, Yersinia pestis
ucggaucagcgccugcuguua

SEQ ID NO: 2246239 - RNA, 16 nt, Yersinia pestis
ucggaucagcgccugc

SEQ ID NO: 2246240 - RNA, 15 nt, Yersinia pestis
ucgcuguggcuacca

SEQ ID NO: 2246241 - RNA, 21 nt, Yersinia pestis
ucgcugugaauuuaucaggcu

SEQ ID NO: 2246242 - RNA, 16 nt, Yersinia pestis
ucgcugugcccuuuuu

SEQ ID NO: 2246243 - RNA, 23 nt, Yersinia pestis
ucgcugggccuacuggugccuga

SEQ ID NO: 2246244 - RNA, 19 nt, Yersinia pestis
ucgcuguagcgccagguaa

SEQ ID NO: 2246245 - RNA, 18 nt, Yersinia pestis
ucggaugccgcuccagca

SEQ ID NO: 2246246 - RNA, 23 nt, Yersinia pestis
ucggccacccgccaucaggcaaa

SEQ ID NO: 2246247 - RNA, 20 nt, Yersinia pestis
ucggccauauuaccgcugaa

SEQ ID NO: 2246248 - RNA, 18 nt, Yersinia pestis
ucggccauuuacccguca

SEQ ID NO: 2246249 - RNA, 16 nt, Yersinia pestis
uccuuggaacuuacuc

SEQ ID NO: 2246250 - RNA, 15 nt, Yersinia pestis
uccuucagacugcug

SEQ ID NO: 2246251 - RNA, 15 nt, Yersinia pestis
uccuggaacgaagcc

SEQ ID NO: 2246252 - RNA, 14 nt, Yersinia pestis
uccuggccaaagcc

SEQ ID NO: 2246253 - RNA, 23 nt, Yersinia pestis
uccuggaaccagugaaugcugcg

SEQ ID NO: 2246254 - RNA, 16 nt, Yersinia pestis
uccuguauuuccugua

SEQ ID NO: 2246255 - RNA, 19 nt, Yersinia pestis
uccuguacauauauaauac

SEQ ID NO: 2246256 - RNA, 15 nt, Yersinia pestis
uccugcgguggccag

SEQ ID NO: 2246257 - RNA, 20 nt, Yersinia pestis
uccugcgucucuaacccauu

SEQ ID NO: 2246258 - RNA, 19 nt, Yersinia pestis
uccuuugcccuuacuauuu

SEQ ID NO: 2246259 - RNA, 17 nt, Yersinia pestis
uccuuuccauuuucauc

SEQ ID NO: 2246260 - RNA, 20 nt, Yersinia pestis
uccuuucucuccuuauacua

SEQ ID NO: 2246261 - RNA, 20 nt, Yersinia pestis
uccuuucuuuucgcuauuuc

SEQ ID NO: 2246262 - RNA, 17 nt, Yersinia pestis
uccuugggucaguuuua

SEQ ID NO: 2246263 - RNA, 15 nt, Yersinia pestis
uccuuguaaggugcu

SEQ ID NO: 2246264 - RNA, 23 nt, Yersinia pestis
uccuuggcgcggacgcuuuacuc

SEQ ID NO: 2246265 - RNA, 22 nt, Yersinia pestis
uccuuguggauccagcaccaca

SEQ ID NO: 2246266 - RNA, 15 nt, Yersinia pestis
uccuuuugacugguc

SEQ ID NO: 2246267 - RNA, 22 nt, Yersinia pestis
uccuuuuuauuuaagcaguuca

SEQ ID NO: 2246268 - RNA, 20 nt, Yersinia pestis
ucgaaaaaaauacuaucauc

SEQ ID NO: 2246269 - RNA, 12 nt, Yersinia pestis
ucgaaaauaacc

SEQ ID NO: 2246270 - RNA, 19 nt, Yersinia pestis
ucgaaagauagcaaaagaa

SEQ ID NO: 2246271 - RNA, 17 nt, Yersinia pestis
ucgaaagauagcaaaag

SEQ ID NO: 2246272 - RNA, 17 nt, Yersinia pestis
ucgaaucacuuauugga

SEQ ID NO: 2246273 - RNA, 18 nt, Yersinia pestis
ucgaaucacuuauuggaa

SEQ ID NO: 2246274 - RNA, 17 nt, Yersinia pestis
ucgaaauuaaggaaaag

SEQ ID NO: 2246275 - RNA, 11 nt, Yersinia pestis
ucgaaccgaua

SEQ ID NO: 2246276 - RNA, 22 nt, Yersinia pestis
ucgaacauaaaaaugcacugaa

SEQ ID NO: 2246277 - RNA, 14 nt, Yersinia pestis
ucgaggaucaccac

SEQ ID NO: 2246278 - RNA, 18 nt, Yersinia pestis
ucgacggccaauuucagu

SEQ ID NO: 2246279 - RNA, 21 nt, Yersinia pestis
ucgauaguaacaccagcaucc

SEQ ID NO: 2246280 - RNA, 23 nt, Yersinia pestis
ucgauaacgcuaagcgucucaag

SEQ ID NO: 2246281 - RNA, 17 nt, Yersinia pestis
ucgaucaaaacaauaaa

SEQ ID NO: 2246282 - RNA, 23 nt, Yersinia pestis
ucgaucaaaacaauaaaaagauc

SEQ ID NO: 2246283 - RNA, 15 nt, Yersinia pestis
ucgaucaaccauuca

SEQ ID NO: 2246284 - RNA, 18 nt, Yersinia pestis
ucgcaguaauagaaaaag

SEQ ID NO: 2246285 - RNA, 21 nt, Yersinia pestis
ucgcagacagauuuggccacg

SEQ ID NO: 2246286 - RNA, 13 nt, Yersinia pestis
ucgcacuucaacc

SEQ ID NO: 2246287 - RNA, 21 nt, Yersinia pestis
ucgcacgggcuuuaaugagua

SEQ ID NO: 2246288 - RNA, 15 nt, Yersinia pestis
ucgcacugcucugcc

SEQ ID NO: 2246289 - RNA, 18 nt, Yersinia pestis
ucgcaccacaaugauuuc

SEQ ID NO: 2246290 - RNA, 17 nt, Yersinia pestis
ucgcacccuuacccugg

SEQ ID NO: 2246291 - RNA, 22 nt, Yersinia pestis
ucgcacccacgguaucugcuuu

SEQ ID NO: 2246292 - RNA, 19 nt, Yersinia pestis
ucgcaauauauggccauua

SEQ ID NO: 2246293 - RNA, 12 nt, Yersinia pestis
ucgcaagcaaua

SEQ ID NO: 2246294 - RNA, 14 nt, Yersinia pestis
ucgauuuuagcuuu

SEQ ID NO: 2246295 - RNA, 16 nt, Yersinia pestis
ucgauuuccauauuau

SEQ ID NO: 2246296 - RNA, 13 nt, Yersinia pestis
ucgauuucugcau

SEQ ID NO: 2246297 - RNA, 14 nt, Yersinia pestis
ucgccugcugagcc

SEQ ID NO: 2246298 - RNA, 22 nt, Yersinia pestis
ucgccuuaucagcgaaaaauuu

SEQ ID NO: 2246299 - RNA, 22 nt, Yersinia pestis
ucgccuuaaaugcguagaguca

SEQ ID NO: 2246300 - RNA, 14 nt, Yersinia pestis
ucgccuucuggcaa

SEQ ID NO: 2246301 - RNA, 16 nt, Yersinia pestis
ucgccgucaaacucuu

SEQ ID NO: 2246302 - RNA, 14 nt, Yersinia pestis
ucgcccuucuucca

SEQ ID NO: 2246303 - RNA, 15 nt, Yersinia pestis
ucgcccuguaacuuu

SEQ ID NO: 2246304 - RNA, 19 nt, Yersinia pestis
ucgccgcaaauuaacacau

SEQ ID NO: 2246305 - RNA, 19 nt, Yersinia pestis
ucgccaauacaaucgucaa

SEQ ID NO: 2246306 - RNA, 18 nt, Yersinia pestis
ucgcauaaauguuaccca

SEQ ID NO: 2246307 - RNA, 16 nt, Yersinia pestis
ucgcaguuaaagacau

SEQ ID NO: 2246308 - RNA, 17 nt, Yersinia pestis
ucgccaaacugcucaua

SEQ ID NO: 2246309 - RNA, 15 nt, Yersinia pestis
ugauaauaaaaaaac

SEQ ID NO: 2246310 - RNA, 19 nt, Yersinia pestis
ugauaagugaauaaaucaa

SEQ ID NO: 2246311 - RNA, 17 nt, Yersinia pestis
ugauaauaguucauuuu

SEQ ID NO: 2246312 - RNA, 14 nt, Yersinia pestis
ugauaauaguucau

SEQ ID NO: 2246313 - RNA, 16 nt, Yersinia pestis
ugauaaucaaaacacc

SEQ ID NO: 2246314 - RNA, 16 nt, Yersinia pestis
ugauaaccacaacgac

SEQ ID NO: 2246315 - RNA, 17 nt, Yersinia pestis
ugauaaccguucaagag

SEQ ID NO: 2246316 - RNA, 20 nt, Yersinia pestis
ugauaacaauaaaaucuuaa

SEQ ID NO: 2246317 - RNA, 24 nt, Yersinia pestis
ugauaaccguuuuuucaacuggcu

SEQ ID NO: 2246318 - RNA, 21 nt, Yersinia pestis
ugauaacgccggauaaauuaa

SEQ ID NO: 2246319 - RNA, 21 nt, Yersinia pestis
ugauaaccucgguggcucaau

SEQ ID NO: 2246320 - RNA, 19 nt, Yersinia pestis
ugauaccguuuuauauuga

SEQ ID NO: 2246321 - RNA, 18 nt, Yersinia pestis
ugauaccauugggucagu

SEQ ID NO: 2246322 - RNA, 14 nt, Yersinia pestis
ugauacauuuccau

SEQ ID NO: 2246323 - RNA, 15 nt, Yersinia pestis
ugauaaugccuuuua

SEQ ID NO: 2246324 - RNA, 17 nt, Yersinia pestis
ugauacaucucggcuuu

SEQ ID NO: 2246325 - RNA, 17 nt, Yersinia pestis
ugaguucugaucauuau

SEQ ID NO: 2246326 - RNA, 14 nt, Yersinia pestis
ugaguuucauuagu

SEQ ID NO: 2246327 - RNA, 18 nt, Yersinia pestis
ugauaaacuguuuaagcu

SEQ ID NO: 2246328 - RNA, 21 nt, Yersinia pestis
ugauaaaauucguuugggcua

SEQ ID NO: 2246329 - RNA, 14 nt, Yersinia pestis
ugauaaacaauaaa

SEQ ID NO: 2246330 - RNA, 17 nt, Yersinia pestis
ugaguuuucgauaacca

SEQ ID NO: 2246331 - RNA, 19 nt, Yersinia pestis
ugauaaaacacucuuuuug

SEQ ID NO: 2246332 - RNA, 17 nt, Yersinia pestis
ugauaaaaguaauuuau

SEQ ID NO: 2246333 - RNA, 22 nt, Yersinia pestis
ugagucucagggaugaagcuca

SEQ ID NO: 2246334 - RNA, 14 nt, Yersinia pestis
ugaguuccagcccc

SEQ ID NO: 2246335 - RNA, 21 nt, Yersinia pestis
ugaguguuuuuuucgcuacug

SEQ ID NO: 2246336 - RNA, 18 nt, Yersinia pestis
ugaguuaaaaauaaauuc

SEQ ID NO: 2246337 - RNA, 18 nt, Yersinia pestis
ugagucagguggcuauuc

SEQ ID NO: 2246338 - RNA, 19 nt, Yersinia pestis
ugagccaccgcauuccagc

SEQ ID NO: 2246339 - RNA, 23 nt, Yersinia pestis
ugagcauuuuaguuuuauacccg

SEQ ID NO: 2246340 - RNA, 19 nt, Yersinia pestis
ugagcauauucaguaacaa

SEQ ID NO: 2246341 - RNA, 18 nt, Yersinia pestis
ugagcagugcgcggcgcc

SEQ ID NO: 2246342 - RNA, 18 nt, Yersinia pestis
ugauaguguaaaaaccau

SEQ ID NO: 2246343 - RNA, 19 nt, Yersinia pestis
ugauagugauuuuuuucac

SEQ ID NO: 2246344 - RNA, 18 nt, Yersinia pestis
ugauagguauugcgggug

SEQ ID NO: 2246345 - RNA, 20 nt, Yersinia pestis
ugauagcagaaacccccaac

SEQ ID NO: 2246346 - RNA, 21 nt, Yersinia pestis
ugauagauucaucaccaguca

SEQ ID NO: 2246347 - RNA, 14 nt, Yersinia pestis
ugauagauuucugc

SEQ ID NO: 2246348 - RNA, 14 nt, Yersinia pestis
ugauagcaaaacac

SEQ ID NO: 2246349 - RNA, 18 nt, Yersinia pestis
ugauaugagcgaggaggu

SEQ ID NO: 2246350 - RNA, 15 nt, Yersinia pestis
ugauaucucuuuauc

SEQ ID NO: 2246351 - RNA, 16 nt, Yersinia pestis
ugauaucucuuuauca

SEQ ID NO: 2246352 - RNA, 17 nt, Yersinia pestis
ugauaugaaaaaucuga

SEQ ID NO: 2246353 - RNA, 18 nt, Yersinia pestis
ugauaugcuucacaucau

SEQ ID NO: 2246354 - RNA, 16 nt, Yersinia pestis
ugauaugggaacgucu

SEQ ID NO: 2246355 - RNA, 23 nt, Yersinia pestis
ugauauuaaucagccuucagggu

SEQ ID NO: 2246356 - RNA, 22 nt, Yersinia pestis
ugaucaauaaaaaagucacuua

SEQ ID NO: 2246357 - RNA, 23 nt, Yersinia pestis
ugaucaaaucauacgcagccuga

SEQ ID NO: 2246358 - RNA, 13 nt, Yersinia pestis
ugaucaguucagc

SEQ ID NO: 2246359 - RNA, 16 nt, Yersinia pestis
ugaugccgaucaucuc

SEQ ID NO: 2246360 - RNA, 15 nt, Yersinia pestis
ugaugaguaacauaa

SEQ ID NO: 2246361 - RNA, 14 nt, Yersinia pestis
ugaugaguaauuuc

SEQ ID NO: 2246362 - RNA, 15 nt, Yersinia pestis
ugaugauaucaccuu

SEQ ID NO: 2246363 - RNA, 22 nt, Yersinia pestis
ugaucuugaauaauauucaaua

SEQ ID NO: 2246364 - RNA, 14 nt, Yersinia pestis
ugaucuugaauaau

SEQ ID NO: 2246365 - RNA, 19 nt, Yersinia pestis
ugaucuugaauaauauuca

SEQ ID NO: 2246366 - RNA, 13 nt, Yersinia pestis
ugaucuuuauuau

SEQ ID NO: 2246367 - RNA, 12 nt, Yersinia pestis
ugaucuggcuuu

SEQ ID NO: 2246368 - RNA, 15 nt, Yersinia pestis
ugaucugccaguaaa

SEQ ID NO: 2246369 - RNA, 16 nt, Yersinia pestis
ugaucugaguuucauu

SEQ ID NO: 2246370 - RNA, 17 nt, Yersinia pestis
ugaucugauauuauugc

SEQ ID NO: 2246371 - RNA, 20 nt, Yersinia pestis
ugaucgguuagcuacugaug

SEQ ID NO: 2246372 - RNA, 16 nt, Yersinia pestis
ugaucaugauuucucg

SEQ ID NO: 2246373 - RNA, 13 nt, Yersinia pestis
ugaucaucaaacu

SEQ ID NO: 2246374 - RNA, 14 nt, Yersinia pestis
ugaucaucaucaau

SEQ ID NO: 2246375 - RNA, 12 nt, Yersinia pestis
ugaucaucuuuu

SEQ ID NO: 2246376 - RNA, 15 nt, Yersinia pestis
ugcaauuguuuuacg

SEQ ID NO: 2246377 - RNA, 15 nt, Yersinia pestis
ugcaauuauaagcac

SEQ ID NO: 2246378 - RNA, 13 nt, Yersinia pestis
ugcacccccuucg

SEQ ID NO: 2246379 - RNA, 14 nt, Yersinia pestis
ugcacccccuucgg

SEQ ID NO: 2246380 - RNA, 16 nt, Yersinia pestis
ugcacccauagcucag

SEQ ID NO: 2246381 - RNA, 22 nt, Yersinia pestis
ugcacguuuaauuucacuucca

SEQ ID NO: 2246382 - RNA, 20 nt, Yersinia pestis
ugcaccgcugauaaccagca

SEQ ID NO: 2246383 - RNA, 18 nt, Yersinia pestis
ugcaacguuaaagaugaa

SEQ ID NO: 2246384 - RNA, 13 nt, Yersinia pestis
ugcaacucauuaa

SEQ ID NO: 2246385 - RNA, 16 nt, Yersinia pestis
ugcaacucggccgcua

SEQ ID NO: 2246386 - RNA, 20 nt, Yersinia pestis
ugcaagaguccagcacuggu

SEQ ID NO: 2246387 - RNA, 18 nt, Yersinia pestis
ugcaaucagaggccauca

SEQ ID NO: 2246388 - RNA, 17 nt, Yersinia pestis
ugcaaucaagggcgaua

SEQ ID NO: 2246389 - RNA, 22 nt, Yersinia pestis
ugcaauagcucauuuuaaauau

SEQ ID NO: 2246390 - RNA, 20 nt, Yersinia pestis
ugcaacagcgcucauagcaa

SEQ ID NO: 2246391 - RNA, 13 nt, Yersinia pestis
ugcaacaacuccu

SEQ ID NO: 2246392 - RNA, 14 nt, Yersinia pestis
ugcaacauuaaaaa

SEQ ID NO: 2246393 - RNA, 18 nt, Yersinia pestis
ugcaaccaguuaaagaau

SEQ ID NO: 2246394 - RNA, 13 nt, Yersinia pestis
ugcaacgccuuca

SEQ ID NO: 2246395 - RNA, 18 nt, Yersinia pestis
ugauuuuuauauuuugag

SEQ ID NO: 2246396 - RNA, 16 nt, Yersinia pestis
ugauuuuuaucaucau

SEQ ID NO: 2246397 - RNA, 18 nt, Yersinia pestis
ugauuuuuaucaucauaa

SEQ ID NO: 2246398 - RNA, 18 nt, Yersinia pestis
ugauuuuuauggcagaaa

SEQ ID NO: 2246399 - RNA, 18 nt, Yersinia pestis
ugcaaaaugcucuucacc

SEQ ID NO: 2246400 - RNA, 14 nt, Yersinia pestis
ugcaaaaucagcau

SEQ ID NO: 2246401 - RNA, 14 nt, Yersinia pestis
ugcaaaugucagau

SEQ ID NO: 2246402 - RNA, 16 nt, Yersinia pestis
ugcaaaugucagaucg

SEQ ID NO: 2246403 - RNA, 23 nt, Yersinia pestis
ugcaaaucauaagugcauuuuug

SEQ ID NO: 2246404 - RNA, 15 nt, Yersinia pestis
ugauuucagccaggc

SEQ ID NO: 2246405 - RNA, 20 nt, Yersinia pestis
ugauuggcuccuauagcuca

SEQ ID NO: 2246406 - RNA, 22 nt, Yersinia pestis
ugauuggcgaugcgcuccgcca

SEQ ID NO: 2246407 - RNA, 23 nt, Yersinia pestis
ugauuggcucaugcuuaaagccu

SEQ ID NO: 2246408 - RNA, 19 nt, Yersinia pestis
ugauuggauaaaauauuau

SEQ ID NO: 2246409 - RNA, 23 nt, Yersinia pestis
ugauugaaaaucaguuuacauga

SEQ ID NO: 2246410 - RNA, 16 nt, Yersinia pestis
ugauugagaucauauu

SEQ ID NO: 2246411 - RNA, 18 nt, Yersinia pestis
ugauugcagaccaaucaa

SEQ ID NO: 2246412 - RNA, 17 nt, Yersinia pestis
ugauucagugauaacaa

SEQ ID NO: 2246413 - RNA, 12 nt, Yersinia pestis
ugauucagaaag

SEQ ID NO: 2246414 - RNA, 17 nt, Yersinia pestis
ugauucacugauuagcc

SEQ ID NO: 2246415 - RNA, 17 nt, Yersinia pestis
ugauucacuggcaaaaa

SEQ ID NO: 2246416 - RNA, 19 nt, Yersinia pestis
ugauuccauguucucuccu

SEQ ID NO: 2246417 - RNA, 17 nt, Yersinia pestis
ugauuaggcauaaauaa

SEQ ID NO: 2246418 - RNA, 20 nt, Yersinia pestis
ugauuaggcauaaauaauaa

SEQ ID NO: 2246419 - RNA, 19 nt, Yersinia pestis
ugauuaauaucaaaacuga

SEQ ID NO: 2246420 - RNA, 12 nt, Yersinia pestis
ugauuaauauca

SEQ ID NO: 2246421 - RNA, 24 nt, Yersinia pestis
ugauuaagcguuaauaaacaugaa

SEQ ID NO: 2246422 - RNA, 18 nt, Yersinia pestis
ugauuaacauccauugua

SEQ ID NO: 2246423 - RNA, 15 nt, Yersinia pestis
ugacuauucugccua

SEQ ID NO: 2246424 - RNA, 12 nt, Yersinia pestis
ugacugaacauc

SEQ ID NO: 2246425 - RNA, 18 nt, Yersinia pestis
ugacugauguaagcucau

SEQ ID NO: 2246426 - RNA, 23 nt, Yersinia pestis
ugacuaauuaauaaccauaaaau

SEQ ID NO: 2246427 - RNA, 17 nt, Yersinia pestis
ugacuaauugugcagca

SEQ ID NO: 2246428 - RNA, 19 nt, Yersinia pestis
ugacuaacucuucuggcaa

SEQ ID NO: 2246429 - RNA, 19 nt, Yersinia pestis
ugacuaaaucgcuuaucuu

SEQ ID NO: 2246430 - RNA, 15 nt, Yersinia pestis
ugacuaaauuaaccc

SEQ ID NO: 2246431 - RNA, 17 nt, Yersinia pestis
ugacuaucgcgcuuuuu

SEQ ID NO: 2246432 - RNA, 22 nt, Yersinia pestis
ugacuaauuguuugcuuucaga

SEQ ID NO: 2246433 - RNA, 13 nt, Yersinia pestis
ugacuaaacugau

SEQ ID NO: 2246434 - RNA, 21 nt, Yersinia pestis
ugacuaaaauucaaacaaaua

SEQ ID NO: 2246435 - RNA, 23 nt, Yersinia pestis
ugacuaaaauucaaacaaauauu

SEQ ID NO: 2246436 - RNA, 16 nt, Yersinia pestis
ugacguuguuuccauu

SEQ ID NO: 2246437 - RNA, 19 nt, Yersinia pestis
ugacguugaguaauccucu

SEQ ID NO: 2246438 - RNA, 20 nt, Yersinia pestis
ugacgggucagcugacgcag

SEQ ID NO: 2246439 - RNA, 18 nt, Yersinia pestis
ugagagugaaugugagug

SEQ ID NO: 2246440 - RNA, 21 nt, Yersinia pestis
ugagagcgguuuauauuuuug

SEQ ID NO: 2246441 - RNA, 19 nt, Yersinia pestis
ugagagaccagggcaccaa

SEQ ID NO: 2246442 - RNA, 12 nt, Yersinia pestis
ugagagaaacuu

SEQ ID NO: 2246443 - RNA, 23 nt, Yersinia pestis
ugagcaaucuggcggccgcucac

SEQ ID NO: 2246444 - RNA, 23 nt, Yersinia pestis
ugagacaacaguaaaccggcuaa

SEQ ID NO: 2246445 - RNA, 17 nt, Yersinia pestis
ugagacagugagguuau

SEQ ID NO: 2246446 - RNA, 21 nt, Yersinia pestis
ugagacagugagguuauugac

SEQ ID NO: 2246447 - RNA, 18 nt, Yersinia pestis
ugagaaccaguucuggua

SEQ ID NO: 2246448 - RNA, 16 nt, Yersinia pestis
ugagaaccaguucugg

SEQ ID NO: 2246449 - RNA, 12 nt, Yersinia pestis
ugagaaauauuu

SEQ ID NO: 2246450 - RNA, 23 nt, Yersinia pestis
ugagaaaggauuugaagacaacu

SEQ ID NO: 2246451 - RNA, 22 nt, Yersinia pestis
ugacaucagccauauguugcca

SEQ ID NO: 2246452 - RNA, 19 nt, Yersinia pestis
ugacauccuuauuuuccgc

SEQ ID NO: 2246453 - RNA, 13 nt, Yersinia pestis
ugacaucccagca

SEQ ID NO: 2246454 - RNA, 21 nt, Yersinia pestis
ugacauuauuggcguaacugc

SEQ ID NO: 2246455 - RNA, 21 nt, Yersinia pestis
ugaccaaagcaguaaacauuu

SEQ ID NO: 2246456 - RNA, 13 nt, Yersinia pestis
ugaccaaacauug

SEQ ID NO: 2246457 - RNA, 15 nt, Yersinia pestis
ugacauuuucuaucu

SEQ ID NO: 2246458 - RNA, 14 nt, Yersinia pestis
ugacauuucuuaua

SEQ ID NO: 2246459 - RNA, 18 nt, Yersinia pestis
ugacauuucuuuuuaugu

SEQ ID NO: 2246460 - RNA, 23 nt, Yersinia pestis
ugacccuggcacuaaaauaucaa

SEQ ID NO: 2246461 - RNA, 17 nt, Yersinia pestis
ugacccgucagcguccu

SEQ ID NO: 2246462 - RNA, 15 nt, Yersinia pestis
ugaccagggcuaaaa

SEQ ID NO: 2246463 - RNA, 15 nt, Yersinia pestis
ugaccagauaggcuu

SEQ ID NO: 2246464 - RNA, 19 nt, Yersinia pestis
ugacgccaccauuccgcca

SEQ ID NO: 2246465 - RNA, 15 nt, Yersinia pestis
ugacgcagcaggcgu

SEQ ID NO: 2246466 - RNA, 20 nt, Yersinia pestis
ugacggcggcgagcacugcc

SEQ ID NO: 2246467 - RNA, 21 nt, Yersinia pestis
ugacgcguugcccuucuucag

SEQ ID NO: 2246468 - RNA, 12 nt, Yersinia pestis
ugacgcgcugcu

SEQ ID NO: 2246469 - RNA, 19 nt, Yersinia pestis
ugacgcgccauacugcaga

SEQ ID NO: 2246470 - RNA, 16 nt, Yersinia pestis
ugacgccgccgcguga

SEQ ID NO: 2246471 - RNA, 13 nt, Yersinia pestis
ugacgaaaugccg

SEQ ID NO: 2246472 - RNA, 12 nt, Yersinia pestis
ugacgaaugagc

SEQ ID NO: 2246473 - RNA, 16 nt, Yersinia pestis
ugaccuguuguaacac

SEQ ID NO: 2246474 - RNA, 22 nt, Yersinia pestis
ugaagccuucauguuuaucaaa

SEQ ID NO: 2246475 - RNA, 16 nt, Yersinia pestis
ugaagcagauaaagaa

SEQ ID NO: 2246476 - RNA, 14 nt, Yersinia pestis
ugaagcaguucacu

SEQ ID NO: 2246477 - RNA, 15 nt, Yersinia pestis
ugaagauacccuuga

SEQ ID NO: 2246478 - RNA, 20 nt, Yersinia pestis
ugaagauacccuucucuuua

SEQ ID NO: 2246479 - RNA, 22 nt, Yersinia pestis
ugaagauacccuucucuuuauc

SEQ ID NO: 2246480 - RNA, 19 nt, Yersinia pestis
ugaagcucauuaauccccg

SEQ ID NO: 2246481 - RNA, 19 nt, Yersinia pestis
ugaaggguauugaagauac

SEQ ID NO: 2246482 - RNA, 21 nt, Yersinia pestis
ugaaggcugauuaauaucaaa

SEQ ID NO: 2246483 - RNA, 16 nt, Yersinia pestis
ugaaggcguagguggu

SEQ ID NO: 2246484 - RNA, 16 nt, Yersinia pestis
ugaacguacuuugguu

SEQ ID NO: 2246485 - RNA, 15 nt, Yersinia pestis
ugaacgcucuuucug

SEQ ID NO: 2246486 - RNA, 22 nt, Yersinia pestis
ugaacgccucaaaaaccugugu

SEQ ID NO: 2246487 - RNA, 19 nt, Yersinia pestis
ugaacgcccuguaaugggu

SEQ ID NO: 2246488 - RNA, 22 nt, Yersinia pestis
ugaacucaacuuucucuggcac

SEQ ID NO: 2246489 - RNA, 17 nt, Yersinia pestis
ugaacucgccuucaggu

SEQ ID NO: 2246490 - RNA, 20 nt, Yersinia pestis
ugaacucgccuucagguaau

SEQ ID NO: 2246491 - RNA, 15 nt, Yersinia pestis
ugaacuguggcauga

SEQ ID NO: 2246492 - RNA, 21 nt, Yersinia pestis
ugaacuucaaaucgccaaacu

SEQ ID NO: 2246493 - RNA, 22 nt, Yersinia pestis
ugaacuucaaaucgccaaacug

SEQ ID NO: 2246494 - RNA, 22 nt, Yersinia pestis
ugaagaggguuuuuaaauuucu

SEQ ID NO: 2246495 - RNA, 17 nt, Yersinia pestis
ugaagaguuugaucaug

SEQ ID NO: 2246496 - RNA, 15 nt, Yersinia pestis
ugaagagaaauaacc

SEQ ID NO: 2246497 - RNA, 18 nt, Yersinia pestis
ugaagagaaauaacccau

SEQ ID NO: 2246498 - RNA, 13 nt, Yersinia pestis
ugaagaaaccuaa

SEQ ID NO: 2246499 - RNA, 14 nt, Yersinia pestis
ugaagaaaccuaau

SEQ ID NO: 2246500 - RNA, 12 nt, Yersinia pestis
ugaagaacagca

SEQ ID NO: 2246501 - RNA, 16 nt, Yersinia pestis
ugaacuuuaacuucca

SEQ ID NO: 2246502 - RNA, 17 nt, Yersinia pestis
ugaacuuuacuuuaauc

SEQ ID NO: 2246503 - RNA, 16 nt, Yersinia pestis
ugaacuucgaaagaaa

SEQ ID NO: 2246504 - RNA, 21 nt, Yersinia pestis
ugaacuucgaaagaaauaaaa

SEQ ID NO: 2246505 - RNA, 14 nt, Yersinia pestis
ugaauuaaccuuac

SEQ ID NO: 2246506 - RNA, 13 nt, Yersinia pestis
ugaauuaauuuau

SEQ ID NO: 2246507 - RNA, 13 nt, Yersinia pestis
ugaauuaacauac

SEQ ID NO: 2246508 - RNA, 14 nt, Yersinia pestis
ugaaugugaagagc

SEQ ID NO: 2246509 - RNA, 17 nt, Yersinia pestis
ugaauccauaagauuga

SEQ ID NO: 2246510 - RNA, 18 nt, Yersinia pestis
ugaaucaaggcuuuaaua

SEQ ID NO: 2246511 - RNA, 21 nt, Yersinia pestis
ugaaucagauacggcuccaga

SEQ ID NO: 2246512 - RNA, 18 nt, Yersinia pestis
ugaauggauugaaaccgc

SEQ ID NO: 2246513 - RNA, 15 nt, Yersinia pestis
ugaauggcugccauc

SEQ ID NO: 2246514 - RNA, 19 nt, Yersinia pestis
ugaauggggggcaaccugg

SEQ ID NO: 2246515 - RNA, 18 nt, Yersinia pestis
ugaauggugcuguauuua

SEQ ID NO: 2246516 - RNA, 15 nt, Yersinia pestis
ugaaguaugacgggu

SEQ ID NO: 2246517 - RNA, 16 nt, Yersinia pestis
ugaaguuauuuuuauu

SEQ ID NO: 2246518 - RNA, 21 nt, Yersinia pestis
ugaauaaaaaauuauuaaaua

SEQ ID NO: 2246519 - RNA, 18 nt, Yersinia pestis
ugaauacguucaaaugau

SEQ ID NO: 2246520 - RNA, 15 nt, Yersinia pestis
ugaauagaggacuau

SEQ ID NO: 2246521 - RNA, 21 nt, Yersinia pestis
ugaauaacuucgcgaacacaa

SEQ ID NO: 2246522 - RNA, 21 nt, Yersinia pestis
ugaauagcgcugcaucagcag

SEQ ID NO: 2246523 - RNA, 17 nt, Yersinia pestis
ugaauagggaauaagua

SEQ ID NO: 2246524 - RNA, 15 nt, Yersinia pestis
ugaauauuuuuaauc

SEQ ID NO: 2246525 - RNA, 13 nt, Yersinia pestis
ugaauauaaauuu

SEQ ID NO: 2246526 - RNA, 15 nt, Yersinia pestis
ugaauauaaauuuaa

SEQ ID NO: 2246527 - RNA, 17 nt, Yersinia pestis
ugaauauaaauuuaaua

SEQ ID NO: 2246528 - RNA, 18 nt, Yersinia pestis
ugcucaucaaccucagcc

SEQ ID NO: 2246529 - RNA, 16 nt, Yersinia pestis
ugcucauuaccaauac

SEQ ID NO: 2246530 - RNA, 18 nt, Yersinia pestis
ugcucauuuaaaauacuc

SEQ ID NO: 2246531 - RNA, 17 nt, Yersinia pestis
ugcucaucaaguauuuu

SEQ ID NO: 2246532 - RNA, 18 nt, Yersinia pestis
ugcguuuagggacagguu

SEQ ID NO: 2246533 - RNA, 18 nt, Yersinia pestis
ugcucaaucgaaugcaau

SEQ ID NO: 2246534 - RNA, 12 nt, Yersinia pestis
ugcucaacugcu

SEQ ID NO: 2246535 - RNA, 13 nt, Yersinia pestis
ugcucaacugcuc

SEQ ID NO: 2246536 - RNA, 18 nt, Yersinia pestis
ugcuccgcagugaucagu

SEQ ID NO: 2246537 - RNA, 23 nt, Yersinia pestis
ugcucauguucgcacugcucugc

SEQ ID NO: 2246538 - RNA, 18 nt, Yersinia pestis
ugcuccaaagcuuccaau

SEQ ID NO: 2246539 - RNA, 18 nt, Yersinia pestis
ugcucccguagcaaauaa

SEQ ID NO: 2246540 - RNA, 21 nt, Yersinia pestis
ugcuccuuacuauuuucauug

SEQ ID NO: 2246541 - RNA, 12 nt, Yersinia pestis
ugcuccuuacua

SEQ ID NO: 2246542 - RNA, 18 nt, Yersinia pestis
ugcuccuuacuauuuuca

SEQ ID NO: 2246543 - RNA, 22 nt, Yersinia pestis
ugcucgaucagcgucagcagau

SEQ ID NO: 2246544 - RNA, 14 nt, Yersinia pestis
ugcucgagcaccag

SEQ ID NO: 2246545 - RNA, 17 nt, Yersinia pestis
ugcugcaaccacuuauc

SEQ ID NO: 2246546 - RNA, 20 nt, Yersinia pestis
ugcugcacaaguuggugcag

SEQ ID NO: 2246547 - RNA, 16 nt, Yersinia pestis
ugcugcaccucugcug

SEQ ID NO: 2246548 - RNA, 21 nt, Yersinia pestis
ugcugauguuucuuugcgcca

SEQ ID NO: 2246549 - RNA, 16 nt, Yersinia pestis
ugcugaugauuuuggu

SEQ ID NO: 2246550 - RNA, 20 nt, Yersinia pestis
ugcugaguaaauuaaauuuu

SEQ ID NO: 2246551 - RNA, 15 nt, Yersinia pestis
ugcugagugaagaca

SEQ ID NO: 2246552 - RNA, 20 nt, Yersinia pestis
ugcugacgauaacuuuuggc

SEQ ID NO: 2246553 - RNA, 19 nt, Yersinia pestis
ugcugaaaaucaugaaauu

SEQ ID NO: 2246554 - RNA, 15 nt, Yersinia pestis
ugcugaaaaaugagu

SEQ ID NO: 2246555 - RNA, 18 nt, Yersinia pestis
ugcuuacuggccuggcau

SEQ ID NO: 2246556 - RNA, 14 nt, Yersinia pestis
ugcuguuauuacug

SEQ ID NO: 2246557 - RNA, 15 nt, Yersinia pestis
ugcuguauuuaaccg

SEQ ID NO: 2246558 - RNA, 21 nt, Yersinia pestis
ugcuguggcgauuuaauccaa

SEQ ID NO: 2246559 - RNA, 18 nt, Yersinia pestis
ugcuguuacgcacaaaca

SEQ ID NO: 2246560 - RNA, 16 nt, Yersinia pestis
ugcugggggcgguugc

SEQ ID NO: 2246561 - RNA, 17 nt, Yersinia pestis
ugcuggggacuuuucuu

SEQ ID NO: 2246562 - RNA, 17 nt, Yersinia pestis
ugcugccugcaccagug

SEQ ID NO: 2246563 - RNA, 15 nt, Yersinia pestis
ugcugccugccugcu

SEQ ID NO: 2246564 - RNA, 18 nt, Yersinia pestis
ugcugccugccugcugcu

SEQ ID NO: 2246565 - RNA, 19 nt, Yersinia pestis
ugcugccugccugcugcuc

SEQ ID NO: 2246566 - RNA, 20 nt, Yersinia pestis
ugcugccugccugcugcucc

SEQ ID NO: 2246567 - RNA, 12 nt, Yersinia pestis
ugcugcuguuau

SEQ ID NO: 2246568 - RNA, 15 nt, Yersinia pestis
ugcugccuugcugca

SEQ ID NO: 2246569 - RNA, 20 nt, Yersinia pestis
ugcugcuguggcacuaucug

SEQ ID NO: 2246570 - RNA, 13 nt, Yersinia pestis
ugcugcuuccugc

SEQ ID NO: 2246571 - RNA, 14 nt, Yersinia pestis
ugcugcuuccugcu

SEQ ID NO: 2246572 - RNA, 19 nt, Yersinia pestis
ugcuggaaugcagugccac

SEQ ID NO: 2246573 - RNA, 21 nt, Yersinia pestis
ugcuggcuaauacuggcuaaa

SEQ ID NO: 2246574 - RNA, 12 nt, Yersinia pestis
ugcuggcggcuu

SEQ ID NO: 2246575 - RNA, 14 nt, Yersinia pestis
ugcuuuaaaggcuu

SEQ ID NO: 2246576 - RNA, 18 nt, Yersinia pestis
ugcuuuauuggcuacagg

SEQ ID NO: 2246577 - RNA, 18 nt, Yersinia pestis
ugcuuuaucguagccaau

SEQ ID NO: 2246578 - RNA, 21 nt, Yersinia pestis
ugcuuuaaugaguuggcauuc

SEQ ID NO: 2246579 - RNA, 18 nt, Yersinia pestis
uggaaaaaauaauggcca

SEQ ID NO: 2246580 - RNA, 13 nt, Yersinia pestis
ugcuuauccagcc

SEQ ID NO: 2246581 - RNA, 15 nt, Yersinia pestis
ugcuucuuuaaucac

SEQ ID NO: 2246582 - RNA, 23 nt, Yersinia pestis
ugcgccuucgaaacugaucacug

SEQ ID NO: 2246583 - RNA, 16 nt, Yersinia pestis
ugcgcgaaauauugcc

SEQ ID NO: 2246584 - RNA, 13 nt, Yersinia pestis
ugcgccuguuagg

SEQ ID NO: 2246585 - RNA, 19 nt, Yersinia pestis
ugcgcgguugucggcauaa

SEQ ID NO: 2246586 - RNA, 15 nt, Yersinia pestis
ugccuuccugccacu

SEQ ID NO: 2246587 - RNA, 13 nt, Yersinia pestis
ugcgccagcagca

SEQ ID NO: 2246588 - RNA, 19 nt, Yersinia pestis
ugcgcccuuuuccgucagc

SEQ ID NO: 2246589 - RNA, 14 nt, Yersinia pestis
ugcgcuuugcagua

SEQ ID NO: 2246590 - RNA, 23 nt, Yersinia pestis
ugcgcuuucagcacgcuuuccag

SEQ ID NO: 2246591 - RNA, 23 nt, Yersinia pestis
ugcgcucaaccgaagcugcggcu

SEQ ID NO: 2246592 - RNA, 14 nt, Yersinia pestis
ugcggacagcgcgc

SEQ ID NO: 2246593 - RNA, 23 nt, Yersinia pestis
ugcggaagcgccgacacccagcc

SEQ ID NO: 2246594 - RNA, 14 nt, Yersinia pestis
ugcggaacagcgcc

SEQ ID NO: 2246595 - RNA, 18 nt, Yersinia pestis
ugcggauauaguuuuuac

SEQ ID NO: 2246596 - RNA, 14 nt, Yersinia pestis
ugcggauucaccca

SEQ ID NO: 2246597 - RNA, 21 nt, Yersinia pestis
ugcggauucacccauuaauag

SEQ ID NO: 2246598 - RNA, 20 nt, Yersinia pestis
ugcggccaucuaacugcaca

SEQ ID NO: 2246599 - RNA, 23 nt, Yersinia pestis
ugcgugacauacuuugccuuauc

SEQ ID NO: 2246600 - RNA, 19 nt, Yersinia pestis
ugcgugcaauaaagcgaua

SEQ ID NO: 2246601 - RNA, 18 nt, Yersinia pestis
ugcguaauaggcugcgca

SEQ ID NO: 2246602 - RNA, 17 nt, Yersinia pestis
ugcgguuacgggugauu

SEQ ID NO: 2246603 - RNA, 16 nt, Yersinia pestis
ugcgguuauuugcuau

SEQ ID NO: 2246604 - RNA, 12 nt, Yersinia pestis
ugcgguggccag

SEQ ID NO: 2246605 - RNA, 21 nt, Yersinia pestis
ugcaucuuuaauuaaugguca

SEQ ID NO: 2246606 - RNA, 17 nt, Yersinia pestis
ugcauguagcugcagcc

SEQ ID NO: 2246607 - RNA, 18 nt, Yersinia pestis
ugcauuaaaauaacaauu

SEQ ID NO: 2246608 - RNA, 19 nt, Yersinia pestis
ugcaucguggucaccgcca

SEQ ID NO: 2246609 - RNA, 15 nt, Yersinia pestis
ugcaucgcuucugaa

SEQ ID NO: 2246610 - RNA, 23 nt, Yersinia pestis
ugcaucgcgggcgcgcugcugcu

SEQ ID NO: 2246611 - RNA, 20 nt, Yersinia pestis
ugcaucuauugugucaauac

SEQ ID NO: 2246612 - RNA, 22 nt, Yersinia pestis
ugcaucuauugugucaauaccu

SEQ ID NO: 2246613 - RNA, 17 nt, Yersinia pestis
ugcaucaucacauucaa

SEQ ID NO: 2246614 - RNA, 18 nt, Yersinia pestis
ugcauccgcaaaaugggu

SEQ ID NO: 2246615 - RNA, 17 nt, Yersinia pestis
ugcaucaauaaauagag

SEQ ID NO: 2246616 - RNA, 14 nt, Yersinia pestis
ugcauauuucucuu

SEQ ID NO: 2246617 - RNA, 14 nt, Yersinia pestis
ugcauauaaaacac

SEQ ID NO: 2246618 - RNA, 20 nt, Yersinia pestis
ugcauaucauucgguuauuu

SEQ ID NO: 2246619 - RNA, 12 nt, Yersinia pestis
ugcauauuucuc

SEQ ID NO: 2246620 - RNA, 20 nt, Yersinia pestis
ugcauauuauuaaugaaauu

SEQ ID NO: 2246621 - RNA, 21 nt, Yersinia pestis
ugcauauuauuuugcacacga

SEQ ID NO: 2246622 - RNA, 22 nt, Yersinia pestis
ugcauauguagggguacagcag

SEQ ID NO: 2246623 - RNA, 17 nt, Yersinia pestis
ugcauagcuaaccuuaa

SEQ ID NO: 2246624 - RNA, 18 nt, Yersinia pestis
ugcaguuaaggcuggcug

SEQ ID NO: 2246625 - RNA, 16 nt, Yersinia pestis
ugcagugcaaccaaca

SEQ ID NO: 2246626 - RNA, 14 nt, Yersinia pestis
ugcaguuaaggcug

SEQ ID NO: 2246627 - RNA, 17 nt, Yersinia pestis
ugcaguuaaggcuggcu

SEQ ID NO: 2246628 - RNA, 12 nt, Yersinia pestis
ugcacugagcca

SEQ ID NO: 2246629 - RNA, 23 nt, Yersinia pestis
ugcacugagagaaccauuauuac

SEQ ID NO: 2246630 - RNA, 19 nt, Yersinia pestis
ugcacucguuguauuuucc

SEQ ID NO: 2246631 - RNA, 20 nt, Yersinia pestis
ugcacucguuguauuuuccu

SEQ ID NO: 2246632 - RNA, 14 nt, Yersinia pestis
ugccaguaauucac

SEQ ID NO: 2246633 - RNA, 21 nt, Yersinia pestis
ugccaguaauucacugcuuaa

SEQ ID NO: 2246634 - RNA, 20 nt, Yersinia pestis
ugccaucccccuuuggccgc

SEQ ID NO: 2246635 - RNA, 22 nt, Yersinia pestis
ugccaucuuguucuaauaauaa

SEQ ID NO: 2246636 - RNA, 15 nt, Yersinia pestis
ugccaucgccaacag

SEQ ID NO: 2246637 - RNA, 13 nt, Yersinia pestis
ugccaucgcuuug

SEQ ID NO: 2246638 - RNA, 16 nt, Yersinia pestis
ugccaugcacuccacu

SEQ ID NO: 2246639 - RNA, 22 nt, Yersinia pestis
ugccauggcgaaaauccuucau

SEQ ID NO: 2246640 - RNA, 12 nt, Yersinia pestis
ugccagcccauc

SEQ ID NO: 2246641 - RNA, 16 nt, Yersinia pestis
ugccagccccaaucac

SEQ ID NO: 2246642 - RNA, 13 nt, Yersinia pestis
ugccagcccugau

SEQ ID NO: 2246643 - RNA, 19 nt, Yersinia pestis
ugccagauagaccccuucu

SEQ ID NO: 2246644 - RNA, 14 nt, Yersinia pestis
ugccagagcaauaa

SEQ ID NO: 2246645 - RNA, 20 nt, Yersinia pestis
ugccagaaucgccugcacac

SEQ ID NO: 2246646 - RNA, 22 nt, Yersinia pestis
ugccagaaucgccugcacacgg

SEQ ID NO: 2246647 - RNA, 16 nt, Yersinia pestis
ugccagacaaugauga

SEQ ID NO: 2246648 - RNA, 20 nt, Yersinia pestis
ugccagacacaagauaaaua

SEQ ID NO: 2246649 - RNA, 22 nt, Yersinia pestis
ugccagacacaagauaaauacc

SEQ ID NO: 2246650 - RNA, 18 nt, Yersinia pestis
ugccagccggugauuggg

SEQ ID NO: 2246651 - RNA, 16 nt, Yersinia pestis
ugccaccugcgguugc

SEQ ID NO: 2246652 - RNA, 21 nt, Yersinia pestis
ugccacccuaucugcucuugc

SEQ ID NO: 2246653 - RNA, 18 nt, Yersinia pestis
ugccaauuuaacuuucau

SEQ ID NO: 2246654 - RNA, 18 nt, Yersinia pestis
ugccaauuccauauuuaa

SEQ ID NO: 2246655 - RNA, 22 nt, Yersinia pestis
ugccaauugaguaacugauuaa

SEQ ID NO: 2246656 - RNA, 15 nt, Yersinia pestis
ugccaauuauucucu

SEQ ID NO: 2246657 - RNA, 20 nt, Yersinia pestis
ugccacacagaaucaccaac

SEQ ID NO: 2246658 - RNA, 15 nt, Yersinia pestis
ugccaaauuauucau

SEQ ID NO: 2246659 - RNA, 18 nt, Yersinia pestis
ugccaaauaucuuucagc

SEQ ID NO: 2246660 - RNA, 16 nt, Yersinia pestis
ugccaacaauugcucc

SEQ ID NO: 2246661 - RNA, 16 nt, Yersinia pestis
ugccaaauaucuuuca

SEQ ID NO: 2246662 - RNA, 23 nt, Yersinia pestis
ugccaaaaugccuaccguuagca

SEQ ID NO: 2246663 - RNA, 15 nt, Yersinia pestis
ugcauuuuuucauuc

SEQ ID NO: 2246664 - RNA, 13 nt, Yersinia pestis
ugcauuggaaaaa

SEQ ID NO: 2246665 - RNA, 23 nt, Yersinia pestis
ugcauuucaacaaaacgaacacu

SEQ ID NO: 2246666 - RNA, 12 nt, Yersinia pestis
ugcauugauuaa

SEQ ID NO: 2246667 - RNA, 12 nt, Yersinia pestis
ugcauuggaaaa

SEQ ID NO: 2246668 - RNA, 13 nt, Yersinia pestis
ugcauucugcugg

SEQ ID NO: 2246669 - RNA, 13 nt, Yersinia pestis
ugccccacuucac

SEQ ID NO: 2246670 - RNA, 15 nt, Yersinia pestis
ugccaugucggcagg

SEQ ID NO: 2246671 - RNA, 22 nt, Yersinia pestis
ugccccauggcuaacauaugaa

SEQ ID NO: 2246672 - RNA, 17 nt, Yersinia pestis
ugcccguuaauauuaau

SEQ ID NO: 2246673 - RNA, 19 nt, Yersinia pestis
ugcccguuaauauuaaucg

SEQ ID NO: 2246674 - RNA, 18 nt, Yersinia pestis
ugcccuaauaccaauacc

SEQ ID NO: 2246675 - RNA, 19 nt, Yersinia pestis
ugcccgcgcuuccaggcug

SEQ ID NO: 2246676 - RNA, 14 nt, Yersinia pestis
ugcccgcgcuucca

SEQ ID NO: 2246677 - RNA, 20 nt, Yersinia pestis
ugcccgcguaaucucucaca

SEQ ID NO: 2246678 - RNA, 17 nt, Yersinia pestis
ugcccugccugguauuu

SEQ ID NO: 2246679 - RNA, 16 nt, Yersinia pestis
ugccgcacugccacca

SEQ ID NO: 2246680 - RNA, 15 nt, Yersinia pestis
ugccgaucaucucau

SEQ ID NO: 2246681 - RNA, 13 nt, Yersinia pestis
ugccgccucugcu

SEQ ID NO: 2246682 - RNA, 14 nt, Yersinia pestis
ugccgccucugcuc

SEQ ID NO: 2246683 - RNA, 19 nt, Yersinia pestis
ugccgccucugcuccggua

SEQ ID NO: 2246684 - RNA, 13 nt, Yersinia pestis
ugccgcauuaccc

SEQ ID NO: 2246685 - RNA, 23 nt, Yersinia pestis
ugccgcccugcucaaucgaaugc

SEQ ID NO: 2246686 - RNA, 17 nt, Yersinia pestis
ugccucugcuaacaaca

SEQ ID NO: 2246687 - RNA, 24 nt, Yersinia pestis
ugccuggaucaaguuagcaggcag

SEQ ID NO: 2246688 - RNA, 20 nt, Yersinia pestis
ugccugcuggcaaacuuuuc

SEQ ID NO: 2246689 - RNA, 20 nt, Yersinia pestis
ugccguuaauugugaucagu

SEQ ID NO: 2246690 - RNA, 15 nt, Yersinia pestis
ugccgugucuuccag

SEQ ID NO: 2246691 - RNA, 16 nt, Yersinia pestis
ugccggugagcacgau

SEQ ID NO: 2246692 - RNA, 18 nt, Yersinia pestis
ugccguacaacaauaaua

SEQ ID NO: 2246693 - RNA, 21 nt, Yersinia pestis
ugccguaaaauuuaaaguaaa

SEQ ID NO: 2246694 - RNA, 15 nt, Yersinia pestis
ugccguaaacaauaa

SEQ ID NO: 2246695 - RNA, 18 nt, Yersinia pestis
ugccgcuuguugccaccc

SEQ ID NO: 2246696 - RNA, 20 nt, Yersinia pestis
ugccgcuuguugccacccua

SEQ ID NO: 2246697 - RNA, 14 nt, Yersinia pestis
ugccggaaauuuau

SEQ ID NO: 2246698 - RNA, 20 nt, Yersinia pestis
ugccggaagagaagcagcgg

SEQ ID NO: 2246699 - RNA, 20 nt, Yersinia pestis
ugccggggagucgcuccuca

SEQ ID NO: 2246700 - RNA, 17 nt, Yersinia pestis
ugccgggcaauguguag

SEQ ID NO: 2246701 - RNA, 17 nt, Yersinia pestis
ugccgcgcccccagcca

SEQ ID NO: 2246702 - RNA, 18 nt, Yersinia pestis
ugccgcggcggccagcgg

SEQ ID NO: 2246703 - RNA, 23 nt, Yersinia pestis
ugccgcuaacgucgcuguuacuc

SEQ ID NO: 2246704 - RNA, 17 nt, Yersinia pestis
ugccgcuucaguaagaa

SEQ ID NO: 2246705 - RNA, 23 nt, Yersinia pestis
uuacauugaauggugcuguauuu

SEQ ID NO: 2246706 - RNA, 19 nt, Yersinia pestis
uuacaucaugaguaaaaga

SEQ ID NO: 2246707 - RNA, 15 nt, Yersinia pestis
uuaccaagagagaau

SEQ ID NO: 2246708 - RNA, 20 nt, Yersinia pestis
uuaccaaaagcauccaauac

SEQ ID NO: 2246709 - RNA, 13 nt, Yersinia pestis
uuacauuuuuaac

SEQ ID NO: 2246710 - RNA, 11 nt, Yersinia pestis
uuacauuuuua

SEQ ID NO: 2246711 - RNA, 13 nt, Yersinia pestis
uuacaucaucuuc

SEQ ID NO: 2246712 - RNA, 15 nt, Yersinia pestis
uuacagcgcaauaac

SEQ ID NO: 2246713 - RNA, 23 nt, Yersinia pestis
uuacagcuaaaggguaaccccau

SEQ ID NO: 2246714 - RNA, 23 nt, Yersinia pestis
uuacagcaaggcggcaagcaagc

SEQ ID NO: 2246715 - RNA, 18 nt, Yersinia pestis
uuacagcaaggcggcaag

SEQ ID NO: 2246716 - RNA, 23 nt, Yersinia pestis
uuacacuauaggcuauuuuacuu

SEQ ID NO: 2246717 - RNA, 13 nt, Yersinia pestis
uuacaauaaauca

SEQ ID NO: 2246718 - RNA, 22 nt, Yersinia pestis
uuacacugucgacugcuuuuca

SEQ ID NO: 2246719 - RNA, 15 nt, Yersinia pestis
uuaauuuaauuuaug

SEQ ID NO: 2246720 - RNA, 17 nt, Yersinia pestis
uuaauuuaaauaaaaua

SEQ ID NO: 2246721 - RNA, 18 nt, Yersinia pestis
uuaauuuaaauaaaauaa

SEQ ID NO: 2246722 - RNA, 16 nt, Yersinia pestis
uuaauuuaaacucuuu

SEQ ID NO: 2246723 - RNA, 14 nt, Yersinia pestis
uuaauuuaugaaca

SEQ ID NO: 2246724 - RNA, 13 nt, Yersinia pestis
uuaaucuuuaauu

SEQ ID NO: 2246725 - RNA, 20 nt, Yersinia pestis
uuaaucuuuaauucaucaga

SEQ ID NO: 2246726 - RNA, 12 nt, Yersinia pestis
uuaaucugcugc

SEQ ID NO: 2246727 - RNA, 12 nt, Yersinia pestis
uuaaugauaacg

SEQ ID NO: 2246728 - RNA, 17 nt, Yersinia pestis
uuaaugauugauuauca

SEQ ID NO: 2246729 - RNA, 16 nt, Yersinia pestis
uuaauagaaucugcug

SEQ ID NO: 2246730 - RNA, 20 nt, Yersinia pestis
uuaauagaaucugcugcaaa

SEQ ID NO: 2246731 - RNA, 19 nt, Yersinia pestis
uuaauagaagguuaaauuu

SEQ ID NO: 2246732 - RNA, 13 nt, Yersinia pestis
uuaaucugcauca

SEQ ID NO: 2246733 - RNA, 13 nt, Yersinia pestis
uuaaucuauuaau

SEQ ID NO: 2246734 - RNA, 17 nt, Yersinia pestis
uuaaucuccuggugguu

SEQ ID NO: 2246735 - RNA, 19 nt, Yersinia pestis
uuaauaccuuguucccgca

SEQ ID NO: 2246736 - RNA, 19 nt, Yersinia pestis
uuaauguaugguuguauuu

SEQ ID NO: 2246737 - RNA, 22 nt, Yersinia pestis
uuaauguaugguuguauuuuga

SEQ ID NO: 2246738 - RNA, 19 nt, Yersinia pestis
uuaauggggagugcgcgca

SEQ ID NO: 2246739 - RNA, 18 nt, Yersinia pestis
uuaauuccaugcaaaaua

SEQ ID NO: 2246740 - RNA, 11 nt, Yersinia pestis
uuaaugccccu

SEQ ID NO: 2246741 - RNA, 16 nt, Yersinia pestis
uuaaugccgcugauca

SEQ ID NO: 2246742 - RNA, 15 nt, Yersinia pestis
uuaaugguuuccaua

SEQ ID NO: 2246743 - RNA, 22 nt, Yersinia pestis
uuaauggcaccguggauaaaca

SEQ ID NO: 2246744 - RNA, 14 nt, Yersinia pestis
uuacugucaaugcu

SEQ ID NO: 2246745 - RNA, 14 nt, Yersinia pestis
uuacuuuauuuaaa

SEQ ID NO: 2246746 - RNA, 12 nt, Yersinia pestis
uuacuuuauuua

SEQ ID NO: 2246747 - RNA, 18 nt, Yersinia pestis
uuacuuuaucguccaugc

SEQ ID NO: 2246748 - RNA, 11 nt, Yersinia pestis
uuagaaaacag

SEQ ID NO: 2246749 - RNA, 14 nt, Yersinia pestis
uuacucaggaacaa

SEQ ID NO: 2246750 - RNA, 19 nt, Yersinia pestis
uuacucaggauuagcuucu

SEQ ID NO: 2246751 - RNA, 18 nt, Yersinia pestis
uuacuccucugccuaucc

SEQ ID NO: 2246752 - RNA, 14 nt, Yersinia pestis
uuacucuuccaacu

SEQ ID NO: 2246753 - RNA, 18 nt, Yersinia pestis
uuacucuucagccuaucc

SEQ ID NO: 2246754 - RNA, 15 nt, Yersinia pestis
uuacucguuuuacau

SEQ ID NO: 2246755 - RNA, 14 nt, Yersinia pestis
uuacucgcuccgag

SEQ ID NO: 2246756 - RNA, 21 nt, Yersinia pestis
uuacugccugcagcaacaaua

SEQ ID NO: 2246757 - RNA, 15 nt, Yersinia pestis
uuacuggaagcuauu

SEQ ID NO: 2246758 - RNA, 12 nt, Yersinia pestis
uuacugcuuuca

SEQ ID NO: 2246759 - RNA, 16 nt, Yersinia pestis
uuacugcguaacccca

SEQ ID NO: 2246760 - RNA, 15 nt, Yersinia pestis
uuacgcagguuaucu

SEQ ID NO: 2246761 - RNA, 14 nt, Yersinia pestis
uuacgaucugccug

SEQ ID NO: 2246762 - RNA, 14 nt, Yersinia pestis
uuacgcaaguaaaa

SEQ ID NO: 2246763 - RNA, 18 nt, Yersinia pestis
uuacccacauucaggccg

SEQ ID NO: 2246764 - RNA, 19 nt, Yersinia pestis
uuacccacauucaggccga

SEQ ID NO: 2246765 - RNA, 16 nt, Yersinia pestis
uuacgaucaacccccu

SEQ ID NO: 2246766 - RNA, 15 nt, Yersinia pestis
uuacccgaaagccau

SEQ ID NO: 2246767 - RNA, 17 nt, Yersinia pestis
uuacccgaaucacugac

SEQ ID NO: 2246768 - RNA, 22 nt, Yersinia pestis
uuacccgcgaucauuucaacua

SEQ ID NO: 2246769 - RNA, 14 nt, Yersinia pestis
uuacuaaaauauca

SEQ ID NO: 2246770 - RNA, 14 nt, Yersinia pestis
uuacgucagaaaua

SEQ ID NO: 2246771 - RNA, 22 nt, Yersinia pestis
uuacgguauuugaacuucaaau

SEQ ID NO: 2246772 - RNA, 22 nt, Yersinia pestis
uuacgggucagcucaccaccuc

SEQ ID NO: 2246773 - RNA, 21 nt, Yersinia pestis
uuacguacgccgaacuucauc

SEQ ID NO: 2246774 - RNA, 14 nt, Yersinia pestis
uuacgugaugaugc

SEQ ID NO: 2246775 - RNA, 18 nt, Yersinia pestis
uuacggcggccaucauuc

SEQ ID NO: 2246776 - RNA, 18 nt, Yersinia pestis
uuacgcgugauauucgua

SEQ ID NO: 2246777 - RNA, 22 nt, Yersinia pestis
uuacgcuaucaacuuucacccc

SEQ ID NO: 2246778 - RNA, 14 nt, Yersinia pestis
uuaaagacauauca

SEQ ID NO: 2246779 - RNA, 23 nt, Yersinia pestis
uuaaagacgcaugagcuuaugcg

SEQ ID NO: 2246780 - RNA, 16 nt, Yersinia pestis
uuaaagaagacgagua

SEQ ID NO: 2246781 - RNA, 20 nt, Yersinia pestis
uuaaagaagaauccacauaa

SEQ ID NO: 2246782 - RNA, 22 nt, Yersinia pestis
uuaaagaaaauuuacccugcua

SEQ ID NO: 2246783 - RNA, 13 nt, Yersinia pestis
uuaaacuuugcua

SEQ ID NO: 2246784 - RNA, 17 nt, Yersinia pestis
uuaaauaagaaguagaa

SEQ ID NO: 2246785 - RNA, 22 nt, Yersinia pestis
uuaaauaagauccagaacacca

SEQ ID NO: 2246786 - RNA, 11 nt, Yersinia pestis
uuaaauaacuc

SEQ ID NO: 2246787 - RNA, 19 nt, Yersinia pestis
uuaaaguaucgcuaucacc

SEQ ID NO: 2246788 - RNA, 13 nt, Yersinia pestis
uuaaagguaaaag

SEQ ID NO: 2246789 - RNA, 20 nt, Yersinia pestis
uuaaacagucuuauuacuca

SEQ ID NO: 2246790 - RNA, 16 nt, Yersinia pestis
uuaaacccggcaucaa

SEQ ID NO: 2246791 - RNA, 14 nt, Yersinia pestis
uguugccgcuucau

SEQ ID NO: 2246792 - RNA, 16 nt, Yersinia pestis
uguugccgcuucauau

SEQ ID NO: 2246793 - RNA, 20 nt, Yersinia pestis
uguugccggcggcgcuggcg

SEQ ID NO: 2246794 - RNA, 14 nt, Yersinia pestis
uuaaaugagaauaa

SEQ ID NO: 2246795 - RNA, 16 nt, Yersinia pestis
uuaaauguauaaaaaa

SEQ ID NO: 2246796 - RNA, 20 nt, Yersinia pestis
uuaaauguauaaaaaagaua

SEQ ID NO: 2246797 - RNA, 21 nt, Yersinia pestis
uuaaauguauaaaaaagauaa

SEQ ID NO: 2246798 - RNA, 18 nt, Yersinia pestis
uuaaaugcguagagucag

SEQ ID NO: 2246799 - RNA, 14 nt, Yersinia pestis
uuaaauggagggca

SEQ ID NO: 2246800 - RNA, 15 nt, Yersinia pestis
uuaaauuaauauuua

SEQ ID NO: 2246801 - RNA, 18 nt, Yersinia pestis
uuaaauuaauauuuaaag

SEQ ID NO: 2246802 - RNA, 21 nt, Yersinia pestis
uuaaauacugcacguuuaauu

SEQ ID NO: 2246803 - RNA, 14 nt, Yersinia pestis
uuaaauauuauuua

SEQ ID NO: 2246804 - RNA, 17 nt, Yersinia pestis
uuaaauauuauuuaauu

SEQ ID NO: 2246805 - RNA, 18 nt, Yersinia pestis
uuaaauauuauuuaauua

SEQ ID NO: 2246806 - RNA, 16 nt, Yersinia pestis
uuaacaaaaaauuaau

SEQ ID NO: 2246807 - RNA, 16 nt, Yersinia pestis
uuaaauuucuguuuuu

SEQ ID NO: 2246808 - RNA, 14 nt, Yersinia pestis
uuaaauuucuucaa

SEQ ID NO: 2246809 - RNA, 13 nt, Yersinia pestis
uuaaauuuuaauu

SEQ ID NO: 2246810 - RNA, 14 nt, Yersinia pestis
uuaaauuuuaauua

SEQ ID NO: 2246811 - RNA, 13 nt, Yersinia pestis
uuaaauuuuuaua

SEQ ID NO: 2246812 - RNA, 17 nt, Yersinia pestis
uuaaauucuaccuggcu

SEQ ID NO: 2246813 - RNA, 20 nt, Yersinia pestis
uuaaggacccguuuauaaag

SEQ ID NO: 2246814 - RNA, 17 nt, Yersinia pestis
uuaagcuaauucugggu

SEQ ID NO: 2246815 - RNA, 16 nt, Yersinia pestis
uuaauaaaaaacugac

SEQ ID NO: 2246816 - RNA, 18 nt, Yersinia pestis
uuaauaaacaugaauaac

SEQ ID NO: 2246817 - RNA, 21 nt, Yersinia pestis
uuaauaacuucaguuacucac

SEQ ID NO: 2246818 - RNA, 18 nt, Yersinia pestis
uuaacuuuaaauccaucg

SEQ ID NO: 2246819 - RNA, 15 nt, Yersinia pestis
uuaacuucuuccgca

SEQ ID NO: 2246820 - RNA, 17 nt, Yersinia pestis
uuaagaaaucuauuaau

SEQ ID NO: 2246821 - RNA, 19 nt, Yersinia pestis
uuaacuuuucuucauugcu

SEQ ID NO: 2246822 - RNA, 16 nt, Yersinia pestis
uuaagauaauuaucca

SEQ ID NO: 2246823 - RNA, 22 nt, Yersinia pestis
uuaagauuacguagacauaaau

SEQ ID NO: 2246824 - RNA, 15 nt, Yersinia pestis
uuaacccaaagcccu

SEQ ID NO: 2246825 - RNA, 23 nt, Yersinia pestis
uuaaccugagcggcguuguucuc

SEQ ID NO: 2246826 - RNA, 21 nt, Yersinia pestis
uuaacccuucucgugucacag

SEQ ID NO: 2246827 - RNA, 23 nt, Yersinia pestis
uuaacgauauaggguauaugccu

SEQ ID NO: 2246828 - RNA, 18 nt, Yersinia pestis
uuaacgucgcugaaaugc

SEQ ID NO: 2246829 - RNA, 18 nt, Yersinia pestis
uuaacgucagauaaacaa

SEQ ID NO: 2246830 - RNA, 14 nt, Yersinia pestis
uuaacgauccucua

SEQ ID NO: 2246831 - RNA, 22 nt, Yersinia pestis
uuaacgaugaccgugacauuuu

SEQ ID NO: 2246832 - RNA, 14 nt, Yersinia pestis
uuaacgcuuuaaug

SEQ ID NO: 2246833 - RNA, 13 nt, Yersinia pestis
uuaacaauucucu

SEQ ID NO: 2246834 - RNA, 22 nt, Yersinia pestis
uuaacacauuccaguaaaaaaa

SEQ ID NO: 2246835 - RNA, 20 nt, Yersinia pestis
uuaacacccaauaauaaaaa

SEQ ID NO: 2246836 - RNA, 21 nt, Yersinia pestis
uuaacacccaauaauaaaaaa

SEQ ID NO: 2246837 - RNA, 17 nt, Yersinia pestis
uuaacacaucaaaauua

SEQ ID NO: 2246838 - RNA, 15 nt, Yersinia pestis
uuaacaauuuuauug

SEQ ID NO: 2246839 - RNA, 15 nt, Yersinia pestis
uuaacacaucaaaau

SEQ ID NO: 2246840 - RNA, 13 nt, Yersinia pestis
uuauuugcuaucg

SEQ ID NO: 2246841 - RNA, 12 nt, Yersinia pestis
uuauuugauaua

SEQ ID NO: 2246842 - RNA, 16 nt, Yersinia pestis
uuauuugauauagaca

SEQ ID NO: 2246843 - RNA, 21 nt, Yersinia pestis
uuauuucacuggaaaaagugu

SEQ ID NO: 2246844 - RNA, 13 nt, Yersinia pestis
uuauuuccagauc

SEQ ID NO: 2246845 - RNA, 23 nt, Yersinia pestis
uuauuugucgccaacauuuauuu

SEQ ID NO: 2246846 - RNA, 18 nt, Yersinia pestis
uuauuuuaucuacuucua

SEQ ID NO: 2246847 - RNA, 13 nt, Yersinia pestis
uuauuuuauugga

SEQ ID NO: 2246848 - RNA, 12 nt, Yersinia pestis
uuauuuuaauug

SEQ ID NO: 2246849 - RNA, 12 nt, Yersinia pestis
uuauuuuaauuu

SEQ ID NO: 2246850 - RNA, 14 nt, Yersinia pestis
uuauuuuauaauga

SEQ ID NO: 2246851 - RNA, 13 nt, Yersinia pestis
uuauuuuaggucc

SEQ ID NO: 2246852 - RNA, 20 nt, Yersinia pestis
uuauugggcgcgauaaaaga

SEQ ID NO: 2246853 - RNA, 13 nt, Yersinia pestis
uuauuggcccuuu

SEQ ID NO: 2246854 - RNA, 18 nt, Yersinia pestis
uuauuggaaguacuuauu

SEQ ID NO: 2246855 - RNA, 22 nt, Yersinia pestis
uuauugcuaaguacuaucuauu

SEQ ID NO: 2246856 - RNA, 19 nt, Yersinia pestis
uuauuggggacaggcuccu

SEQ ID NO: 2246857 - RNA, 23 nt, Yersinia pestis
uuauuggggacaggcuccuccuu

SEQ ID NO: 2246858 - RNA, 17 nt, Yersinia pestis
uuauuguccgcgcggcu

SEQ ID NO: 2246859 - RNA, 14 nt, Yersinia pestis
uuauugucucuacu

SEQ ID NO: 2246860 - RNA, 21 nt, Yersinia pestis
uuauugucuuuaauaaaauca

SEQ ID NO: 2246861 - RNA, 19 nt, Yersinia pestis
uuauuucacgcuaauuauu

SEQ ID NO: 2246862 - RNA, 12 nt, Yersinia pestis
uuauuuauagaa

SEQ ID NO: 2246863 - RNA, 14 nt, Yersinia pestis
uuauuuauagguau

SEQ ID NO: 2246864 - RNA, 23 nt, Yersinia pestis
uuauuuauaugauaauaguucau

SEQ ID NO: 2246865 - RNA, 13 nt, Yersinia pestis
uuauuuauaaaac

SEQ ID NO: 2246866 - RNA, 21 nt, Yersinia pestis
uuauuuaacacauuccaguaa

SEQ ID NO: 2246867 - RNA, 22 nt, Yersinia pestis
uuauucgacuguuuuuacaauu

SEQ ID NO: 2246868 - RNA, 12 nt, Yersinia pestis
uuauuauugauu

SEQ ID NO: 2246869 - RNA, 14 nt, Yersinia pestis
uuauugagaagaaa

SEQ ID NO: 2246870 - RNA, 23 nt, Yersinia pestis
uuauucguggugaugaugacggu

SEQ ID NO: 2246871 - RNA, 12 nt, Yersinia pestis
uuauucuuuauu

SEQ ID NO: 2246872 - RNA, 19 nt, Yersinia pestis
uuauuauauauuuugaaua

SEQ ID NO: 2246873 - RNA, 19 nt, Yersinia pestis
uuauuaggcauugagucac

SEQ ID NO: 2246874 - RNA, 18 nt, Yersinia pestis
uuauuagccaaauacccu

SEQ ID NO: 2246875 - RNA, 19 nt, Yersinia pestis
uuauuagcguuacagcuaa

SEQ ID NO: 2246876 - RNA, 12 nt, Yersinia pestis
uuauuauuauuu

SEQ ID NO: 2246877 - RNA, 14 nt, Yersinia pestis
uuauuaucaucuuu

SEQ ID NO: 2246878 - RNA, 23 nt, Yersinia pestis
uuauuaaacagucuuauuacuca

SEQ ID NO: 2246879 - RNA, 17 nt, Yersinia pestis
uuauuaacuucaauuug

SEQ ID NO: 2246880 - RNA, 23 nt, Yersinia pestis
uuauuaaucaagauauuacuucu

SEQ ID NO: 2246881 - RNA, 11 nt, Yersinia pestis
uuauuacauuu

SEQ ID NO: 2246882 - RNA, 12 nt, Yersinia pestis
uuauuacucagc

SEQ ID NO: 2246883 - RNA, 18 nt, Yersinia pestis
uuauuaccuaauuuaucc

SEQ ID NO: 2246884 - RNA, 14 nt, Yersinia pestis
uuauuuucgaccaa

SEQ ID NO: 2246885 - RNA, 15 nt, Yersinia pestis
uuauuuucccuuucu

SEQ ID NO: 2246886 - RNA, 21 nt, Yersinia pestis
uuauuuuggaguauacauuau

SEQ ID NO: 2246887 - RNA, 17 nt, Yersinia pestis
uuauuuuggguauauag

SEQ ID NO: 2246888 - RNA, 21 nt, Yersinia pestis
uucaaaaaagcccccuuuuuc

SEQ ID NO: 2246889 - RNA, 19 nt, Yersinia pestis
uucaaaaacgcacgaaaac

SEQ ID NO: 2246890 - RNA, 20 nt, Yersinia pestis
uucaaaaacgcacgaaaaca

SEQ ID NO: 2246891 - RNA, 12 nt, Yersinia pestis
uucaaacaucgu

SEQ ID NO: 2246892 - RNA, 21 nt, Yersinia pestis
uucaaacaguacuucagguaa

SEQ ID NO: 2246893 - RNA, 20 nt, Yersinia pestis
uucaaaauagucaguaaaau

SEQ ID NO: 2246894 - RNA, 12 nt, Yersinia pestis
uucaaaaugcca

SEQ ID NO: 2246895 - RNA, 19 nt, Yersinia pestis
uucaaaauagaggaaauaa

SEQ ID NO: 2246896 - RNA, 19 nt, Yersinia pestis
uucaaaguaaaauaaaaaa

SEQ ID NO: 2246897 - RNA, 16 nt, Yersinia pestis
uucaagaaccgaaaua

SEQ ID NO: 2246898 - RNA, 12 nt, Yersinia pestis
uucaacuuuuuu

SEQ ID NO: 2246899 - RNA, 16 nt, Yersinia pestis
uucaagagcgauagau

SEQ ID NO: 2246900 - RNA, 14 nt, Yersinia pestis
uucaagaugcaggg

SEQ ID NO: 2246901 - RNA, 18 nt, Yersinia pestis
uucaagcagcauguguug

SEQ ID NO: 2246902 - RNA, 17 nt, Yersinia pestis
uucaacugcucauccau

SEQ ID NO: 2246903 - RNA, 19 nt, Yersinia pestis
uucaacuucuccuguauuu

SEQ ID NO: 2246904 - RNA, 14 nt, Yersinia pestis
uucaacuugccuga

SEQ ID NO: 2246905 - RNA, 18 nt, Yersinia pestis
uucaaccccuucuucacc

SEQ ID NO: 2246906 - RNA, 19 nt, Yersinia pestis
uucaacaaauucaccagca

SEQ ID NO: 2246907 - RNA, 17 nt, Yersinia pestis
uucaaauaauucagacg

SEQ ID NO: 2246908 - RNA, 17 nt, Yersinia pestis
uucaaauagcugguuaa

SEQ ID NO: 2246909 - RNA, 14 nt, Yersinia pestis
uuauccuccauucu

SEQ ID NO: 2246910 - RNA, 20 nt, Yersinia pestis
uuaucgcaguaauagaaaaa

SEQ ID NO: 2246911 - RNA, 19 nt, Yersinia pestis
uuaucggugcugacaaaca

SEQ ID NO: 2246912 - RNA, 18 nt, Yersinia pestis
uuaucuaaccgucaugcu

SEQ ID NO: 2246913 - RNA, 18 nt, Yersinia pestis
uuaucgccaagccaguaa

SEQ ID NO: 2246914 - RNA, 22 nt, Yersinia pestis
uuaucgccaagccaguaauuaa

SEQ ID NO: 2246915 - RNA, 21 nt, Yersinia pestis
uuaucgcuacguacuaucuau

SEQ ID NO: 2246916 - RNA, 22 nt, Yersinia pestis
uuaucgcuacguacuaucuauu

SEQ ID NO: 2246917 - RNA, 15 nt, Yersinia pestis
uuaucucccauuaau

SEQ ID NO: 2246918 - RNA, 16 nt, Yersinia pestis
uuaucuaucucaggcu

SEQ ID NO: 2246919 - RNA, 21 nt, Yersinia pestis
uuaucucccauuaauuaauca

SEQ ID NO: 2246920 - RNA, 13 nt, Yersinia pestis
uuaucuguuucaa

SEQ ID NO: 2246921 - RNA, 18 nt, Yersinia pestis
uuaucuuguaaauaguca

SEQ ID NO: 2246922 - RNA, 21 nt, Yersinia pestis
uuaucugugccagucuaaaau

SEQ ID NO: 2246923 - RNA, 17 nt, Yersinia pestis
uuaucugcauuaaaaua

SEQ ID NO: 2246924 - RNA, 18 nt, Yersinia pestis
uuaucugcauuaaaauaa

SEQ ID NO: 2246925 - RNA, 22 nt, Yersinia pestis
uuaucugcauuaaaauaacaau

SEQ ID NO: 2246926 - RNA, 22 nt, Yersinia pestis
uuauggguaccguuuauuuacu

SEQ ID NO: 2246927 - RNA, 18 nt, Yersinia pestis
uuaugggggcaaaacuca

SEQ ID NO: 2246928 - RNA, 22 nt, Yersinia pestis
uuaugaccaauagucacgucuu

SEQ ID NO: 2246929 - RNA, 21 nt, Yersinia pestis
uuaugacacccguacgaauuu

SEQ ID NO: 2246930 - RNA, 23 nt, Yersinia pestis
uuaugaauggggggcaaccuggu

SEQ ID NO: 2246931 - RNA, 17 nt, Yersinia pestis
uuaugaauuaauuuauu

SEQ ID NO: 2246932 - RNA, 23 nt, Yersinia pestis
uuaugaugcuggguauauauaca

SEQ ID NO: 2246933 - RNA, 14 nt, Yersinia pestis
uuaugccgugacug

SEQ ID NO: 2246934 - RNA, 11 nt, Yersinia pestis
uuauaaaacca

SEQ ID NO: 2246935 - RNA, 16 nt, Yersinia pestis
uuagaggcugauaacc

SEQ ID NO: 2246936 - RNA, 16 nt, Yersinia pestis
uuagaggauuuaacug

SEQ ID NO: 2246937 - RNA, 21 nt, Yersinia pestis
uuagaggauuuaacugaauca

SEQ ID NO: 2246938 - RNA, 20 nt, Yersinia pestis
uuagagguuauugacaaaga

SEQ ID NO: 2246939 - RNA, 20 nt, Yersinia pestis
uuagaguaaguaaaaaggau

SEQ ID NO: 2246940 - RNA, 15 nt, Yersinia pestis
uuauaaaccaaaugg

SEQ ID NO: 2246941 - RNA, 23 nt, Yersinia pestis
uuauaaggaauauacuuuacaua

SEQ ID NO: 2246942 - RNA, 14 nt, Yersinia pestis
uuauagccaaaucu

SEQ ID NO: 2246943 - RNA, 20 nt, Yersinia pestis
uuaucaaagugcuuaaccca

SEQ ID NO: 2246944 - RNA, 22 nt, Yersinia pestis
uuauauaguaacuauuuacaua

SEQ ID NO: 2246945 - RNA, 22 nt, Yersinia pestis
uuauauaauugaagauuuaaau

SEQ ID NO: 2246946 - RNA, 21 nt, Yersinia pestis
uuaucaguugguuuauccuuu

SEQ ID NO: 2246947 - RNA, 17 nt, Yersinia pestis
uuaucaggugaacgcac

SEQ ID NO: 2246948 - RNA, 22 nt, Yersinia pestis
uuaucaucauuacacugaauug

SEQ ID NO: 2246949 - RNA, 20 nt, Yersinia pestis
uuaucauaaauaaaagauaa

SEQ ID NO: 2246950 - RNA, 16 nt, Yersinia pestis
uuaucauauucaucaa

SEQ ID NO: 2246951 - RNA, 17 nt, Yersinia pestis
uuaucaucguaguaaua

SEQ ID NO: 2246952 - RNA, 16 nt, Yersinia pestis
uuaucaagaucaaaag

SEQ ID NO: 2246953 - RNA, 14 nt, Yersinia pestis
uuaucaaucaaaaa

SEQ ID NO: 2246954 - RNA, 15 nt, Yersinia pestis
uuaucaaucagcuga

SEQ ID NO: 2246955 - RNA, 16 nt, Yersinia pestis
uuaucaauagggcaga

SEQ ID NO: 2246956 - RNA, 15 nt, Yersinia pestis
uuaucaaucaaaaaa

SEQ ID NO: 2246957 - RNA, 17 nt, Yersinia pestis
uuauccauuuucugcca

SEQ ID NO: 2246958 - RNA, 13 nt, Yersinia pestis
uuauccacagcau

SEQ ID NO: 2246959 - RNA, 22 nt, Yersinia pestis
uuauccaauggcucaccuuuca

SEQ ID NO: 2246960 - RNA, 17 nt, Yersinia pestis
uuaucauugaguucuga

SEQ ID NO: 2246961 - RNA, 11 nt, Yersinia pestis
uuauccccuuc

SEQ ID NO: 2246962 - RNA, 13 nt, Yersinia pestis
uuauccccuucga

SEQ ID NO: 2246963 - RNA, 21 nt, Yersinia pestis
uuauccccgccucgacaagca

SEQ ID NO: 2246964 - RNA, 21 nt, Yersinia pestis
uuaucccuccaucaagccacc

SEQ ID NO: 2246965 - RNA, 15 nt, Yersinia pestis
uuaucccuccaucaa

SEQ ID NO: 2246966 - RNA, 15 nt, Yersinia pestis
uuauccguuaaccca

SEQ ID NO: 2246967 - RNA, 19 nt, Yersinia pestis
ugucccaaacucuggaugg

SEQ ID NO: 2246968 - RNA, 18 nt, Yersinia pestis
uguccauuacuguccuuu

SEQ ID NO: 2246969 - RNA, 15 nt, Yersinia pestis
ugucccgaugauugc

SEQ ID NO: 2246970 - RNA, 13 nt, Yersinia pestis
uguccaguuauca

SEQ ID NO: 2246971 - RNA, 21 nt, Yersinia pestis
uguccagggcaaucaggaaag

SEQ ID NO: 2246972 - RNA, 13 nt, Yersinia pestis
ugucauuuggauu

SEQ ID NO: 2246973 - RNA, 15 nt, Yersinia pestis
ugucauuuaauuaaa

SEQ ID NO: 2246974 - RNA, 14 nt, Yersinia pestis
ugucauuccaaccu

SEQ ID NO: 2246975 - RNA, 13 nt, Yersinia pestis
ugucauucuauca

SEQ ID NO: 2246976 - RNA, 20 nt, Yersinia pestis
ugucauuaccaaugguuuca

SEQ ID NO: 2246977 - RNA, 19 nt, Yersinia pestis
ugucauguugaccaaacag

SEQ ID NO: 2246978 - RNA, 14 nt, Yersinia pestis
ugucauuaauuggu

SEQ ID NO: 2246979 - RNA, 15 nt, Yersinia pestis
ugucauggugcuacc

SEQ ID NO: 2246980 - RNA, 18 nt, Yersinia pestis
uguccacaacaccacuuu

SEQ ID NO: 2246981 - RNA, 12 nt, Yersinia pestis
uguccaagaagc

SEQ ID NO: 2246982 - RNA, 14 nt, Yersinia pestis
uguccaaaggaagg

SEQ ID NO: 2246983 - RNA, 13 nt, Yersinia pestis
uguccaaaggaag

SEQ ID NO: 2246984 - RNA, 14 nt, Yersinia pestis
ugucaugcaauuac

SEQ ID NO: 2246985 - RNA, 14 nt, Yersinia pestis
ugucauggcacgcu

SEQ ID NO: 2246986 - RNA, 15 nt, Yersinia pestis
ugucaucacugcuau

SEQ ID NO: 2246987 - RNA, 16 nt, Yersinia pestis
ugucaacgcuucagua

SEQ ID NO: 2246988 - RNA, 18 nt, Yersinia pestis
ugucaauaaccucagccu

SEQ ID NO: 2246989 - RNA, 14 nt, Yersinia pestis
ugucaauaccuuac

SEQ ID NO: 2246990 - RNA, 18 nt, Yersinia pestis
ugucaauggguuugguua

SEQ ID NO: 2246991 - RNA, 21 nt, Yersinia pestis
ugucaauggguuugguuauua

SEQ ID NO: 2246992 - RNA, 15 nt, Yersinia pestis
ugucaauuaaaaacg

SEQ ID NO: 2246993 - RNA, 13 nt, Yersinia pestis
uguauuuaaaaga

SEQ ID NO: 2246994 - RNA, 22 nt, Yersinia pestis
ugucagggcuaagcaggaagau

SEQ ID NO: 2246995 - RNA, 14 nt, Yersinia pestis
ugucagggcaauaa

SEQ ID NO: 2246996 - RNA, 15 nt, Yersinia pestis
ugucagggcaauaac

SEQ ID NO: 2246997 - RNA, 14 nt, Yersinia pestis
ugucaggaagcaag

SEQ ID NO: 2246998 - RNA, 16 nt, Yersinia pestis
uguauucuuguauccu

SEQ ID NO: 2246999 - RNA, 23 nt, Yersinia pestis
uguauuguugcucaacauauugc

SEQ ID NO: 2247000 - RNA, 16 nt, Yersinia pestis
uguauugaugcaguga

SEQ ID NO: 2247001 - RNA, 22 nt, Yersinia pestis
uguaugacuacccccgcauuac

SEQ ID NO: 2247002 - RNA, 17 nt, Yersinia pestis
uguaugaguaucaauau

SEQ ID NO: 2247003 - RNA, 17 nt, Yersinia pestis
uguacaccuaaaacaua

SEQ ID NO: 2247004 - RNA, 19 nt, Yersinia pestis
uguccggguuuacccagcc

SEQ ID NO: 2247005 - RNA, 15 nt, Yersinia pestis
uguccguguuggcaa

SEQ ID NO: 2247006 - RNA, 19 nt, Yersinia pestis
ugucgauccgauaauaauu

SEQ ID NO: 2247007 - RNA, 21 nt, Yersinia pestis
ugucgauccgauaauaauucc

SEQ ID NO: 2247008 - RNA, 22 nt, Yersinia pestis
ugucgcagaaaacaggccgcua

SEQ ID NO: 2247009 - RNA, 14 nt, Yersinia pestis
ugucucuacucucu

SEQ ID NO: 2247010 - RNA, 20 nt, Yersinia pestis
ugucucuacucucuguuuug

SEQ ID NO: 2247011 - RNA, 19 nt, Yersinia pestis
ugucugagucgauagcuuu

SEQ ID NO: 2247012 - RNA, 14 nt, Yersinia pestis
ugucuauuuucauu

SEQ ID NO: 2247013 - RNA, 21 nt, Yersinia pestis
ugucggcaagcgauacagaua

SEQ ID NO: 2247014 - RNA, 17 nt, Yersinia pestis
ugucggcagguaaugca

SEQ ID NO: 2247015 - RNA, 19 nt, Yersinia pestis
ugucggcagguaaugcauu

SEQ ID NO: 2247016 - RNA, 18 nt, Yersinia pestis
ugucggcgaugaaaaaca

SEQ ID NO: 2247017 - RNA, 17 nt, Yersinia pestis
ugucgcuguagcgccag

SEQ ID NO: 2247018 - RNA, 15 nt, Yersinia pestis
ugucgucaucaggau

SEQ ID NO: 2247019 - RNA, 14 nt, Yersinia pestis
ugucgucccaggcc

SEQ ID NO: 2247020 - RNA, 13 nt, Yersinia pestis
ugucgggccaaua

SEQ ID NO: 2247021 - RNA, 18 nt, Yersinia pestis
ugucggguuaacuuuuuc

SEQ ID NO: 2247022 - RNA, 23 nt, Yersinia pestis
ugucuugccagcggcggccaucc

SEQ ID NO: 2247023 - RNA, 16 nt, Yersinia pestis
ugucuuuuucuuuuua

SEQ ID NO: 2247024 - RNA, 16 nt, Yersinia pestis
ugucuuuggacagucu

SEQ ID NO: 2247025 - RNA, 14 nt, Yersinia pestis
ugucuguaauaaua

SEQ ID NO: 2247026 - RNA, 21 nt, Yersinia pestis
ugucuuaggugacaggcaaag

SEQ ID NO: 2247027 - RNA, 13 nt, Yersinia pestis
ugucugcuguugc

SEQ ID NO: 2247028 - RNA, 15 nt, Yersinia pestis
ugucugcuguugcca

SEQ ID NO: 2247029 - RNA, 22 nt, Yersinia pestis
ugugaauuagguaacuuuccau

SEQ ID NO: 2247030 - RNA, 11 nt, Yersinia pestis
ugugaugaugg

SEQ ID NO: 2247031 - RNA, 17 nt, Yersinia pestis
ugugaugcauauuauua

SEQ ID NO: 2247032 - RNA, 23 nt, Yersinia pestis
ugugauccacacagcauucugcu

SEQ ID NO: 2247033 - RNA, 22 nt, Yersinia pestis
ugugauuucagccaggcgaucu

SEQ ID NO: 2247034 - RNA, 23 nt, Yersinia pestis
ugugccauaucgccagucuuucg

SEQ ID NO: 2247035 - RNA, 19 nt, Yersinia pestis
ugugcuuugccauucuggg

SEQ ID NO: 2247036 - RNA, 21 nt, Yersinia pestis
ugugcccuuuuugguuuucua

SEQ ID NO: 2247037 - RNA, 13 nt, Yersinia pestis
uguggaggaaggc

SEQ ID NO: 2247038 - RNA, 19 nt, Yersinia pestis
uguggaaucggccuucaau

SEQ ID NO: 2247039 - RNA, 21 nt, Yersinia pestis
ugugcuugcggaauuucuucu

SEQ ID NO: 2247040 - RNA, 23 nt, Yersinia pestis
uguggaucagaccuuuacaggac

SEQ ID NO: 2247041 - RNA, 21 nt, Yersinia pestis
uguggcaacucuagcgccagc

SEQ ID NO: 2247042 - RNA, 16 nt, Yersinia pestis
uguggcaccaugcugc

SEQ ID NO: 2247043 - RNA, 18 nt, Yersinia pestis
uguggcaccaugcugcuu

SEQ ID NO: 2247044 - RNA, 22 nt, Yersinia pestis
uguguaauuauauuuaauuuaa

SEQ ID NO: 2247045 - RNA, 12 nt, Yersinia pestis
uguugaccucaa

SEQ ID NO: 2247046 - RNA, 21 nt, Yersinia pestis
uguugauaaaaaucuuuuaau

SEQ ID NO: 2247047 - RNA, 21 nt, Yersinia pestis
uguugauacggccuauuucuu

SEQ ID NO: 2247048 - RNA, 15 nt, Yersinia pestis
uguucuuccugugcg

SEQ ID NO: 2247049 - RNA, 17 nt, Yersinia pestis
uguucuuauugcuaucu

SEQ ID NO: 2247050 - RNA, 15 nt, Yersinia pestis
uguucgcacugcucu

SEQ ID NO: 2247051 - RNA, 18 nt, Yersinia pestis
uguucgcacugcucugcc

SEQ ID NO: 2247052 - RNA, 19 nt, Yersinia pestis
uguucgcacugcucugccc

SEQ ID NO: 2247053 - RNA, 19 nt, Yersinia pestis
uguucgccagauuauuggc

SEQ ID NO: 2247054 - RNA, 13 nt, Yersinia pestis
uguucauugagac

SEQ ID NO: 2247055 - RNA, 15 nt, Yersinia pestis
uguucuuaauuuuau

SEQ ID NO: 2247056 - RNA, 20 nt, Yersinia pestis
uguucuuacuguuuucauua

SEQ ID NO: 2247057 - RNA, 19 nt, Yersinia pestis
uguucugauuuagcuaucg

SEQ ID NO: 2247058 - RNA, 20 nt, Yersinia pestis
uguucggggguugucagcag

SEQ ID NO: 2247059 - RNA, 21 nt, Yersinia pestis
uguucggggguugucagcagu

SEQ ID NO: 2247060 - RNA, 15 nt, Yersinia pestis
uguuagcugcgcgca

SEQ ID NO: 2247061 - RNA, 19 nt, Yersinia pestis
uguuaguucagacguacau

SEQ ID NO: 2247062 - RNA, 18 nt, Yersinia pestis
uguuagucgucugagcca

SEQ ID NO: 2247063 - RNA, 14 nt, Yersinia pestis
uguuagucuuauga

SEQ ID NO: 2247064 - RNA, 13 nt, Yersinia pestis
uguuauauuucuu

SEQ ID NO: 2247065 - RNA, 14 nt, Yersinia pestis
uguuauauuucuua

SEQ ID NO: 2247066 - RNA, 21 nt, Yersinia pestis
uguucaaaucugcuccaucaa

SEQ ID NO: 2247067 - RNA, 23 nt, Yersinia pestis
uguucaaaaacgcacgaaaacac

SEQ ID NO: 2247068 - RNA, 22 nt, Yersinia pestis
uguucaaaaacgcacgaaaaca

SEQ ID NO: 2247069 - RNA, 12 nt, Yersinia pestis
uguuauuuuucu

SEQ ID NO: 2247070 - RNA, 13 nt, Yersinia pestis
uguucauaaauua

SEQ ID NO: 2247071 - RNA, 14 nt, Yersinia pestis
uguguuuaaaucuu

SEQ ID NO: 2247072 - RNA, 15 nt, Yersinia pestis
uguguugaaugacgc

SEQ ID NO: 2247073 - RNA, 19 nt, Yersinia pestis
uguguugcgccauaauucc

SEQ ID NO: 2247074 - RNA, 18 nt, Yersinia pestis
uguuaccagacccugcac

SEQ ID NO: 2247075 - RNA, 13 nt, Yersinia pestis
uguuacuuuuaau

SEQ ID NO: 2247076 - RNA, 15 nt, Yersinia pestis
uguuacugcuuaccu

SEQ ID NO: 2247077 - RNA, 17 nt, Yersinia pestis
uguuaccaaaaccggca

SEQ ID NO: 2247078 - RNA, 20 nt, Yersinia pestis
uguuaccuaaccaaacauug

SEQ ID NO: 2247079 - RNA, 15 nt, Yersinia pestis
uggguaaaccaauca

SEQ ID NO: 2247080 - RNA, 14 nt, Yersinia pestis
ugggguuucuguca

SEQ ID NO: 2247081 - RNA, 21 nt, Yersinia pestis
uggguaacaauucaaugcuuu

SEQ ID NO: 2247082 - RNA, 23 nt, Yersinia pestis
uggguaacauguagcacacuacc

SEQ ID NO: 2247083 - RNA, 20 nt, Yersinia pestis
ugguaaauuccuauaaauuu

SEQ ID NO: 2247084 - RNA, 20 nt, Yersinia pestis
uggggugaacgaaagcagcc

SEQ ID NO: 2247085 - RNA, 21 nt, Yersinia pestis
uggggucaucaacgcacucag

SEQ ID NO: 2247086 - RNA, 21 nt, Yersinia pestis
ugggggcaaaacucacaaaau

SEQ ID NO: 2247087 - RNA, 22 nt, Yersinia pestis
ugguaaugcgcaccagcucaau

SEQ ID NO: 2247088 - RNA, 13 nt, Yersinia pestis
ugguaauuucagg

SEQ ID NO: 2247089 - RNA, 20 nt, Yersinia pestis
ugguaaccgguuugggcagg

SEQ ID NO: 2247090 - RNA, 14 nt, Yersinia pestis
uggucaaucaaguu

SEQ ID NO: 2247091 - RNA, 17 nt, Yersinia pestis
uggucaauaaaauuaac

SEQ ID NO: 2247092 - RNA, 15 nt, Yersinia pestis
ugguccccagagcgc

SEQ ID NO: 2247093 - RNA, 16 nt, Yersinia pestis
uggucauuuuucccuu

SEQ ID NO: 2247094 - RNA, 17 nt, Yersinia pestis
uggucauauaccgccac

SEQ ID NO: 2247095 - RNA, 20 nt, Yersinia pestis
uggucacccuuuugaauuca

SEQ ID NO: 2247096 - RNA, 14 nt, Yersinia pestis
uggucaugcacagu

SEQ ID NO: 2247097 - RNA, 13 nt, Yersinia pestis
uggucauccacaa

SEQ ID NO: 2247098 - RNA, 18 nt, Yersinia pestis
uggucauccacaaccaga

SEQ ID NO: 2247099 - RNA, 14 nt, Yersinia pestis
uggugggaucucac

SEQ ID NO: 2247100 - RNA, 12 nt, Yersinia pestis
ugguggcugcug

SEQ ID NO: 2247101 - RNA, 19 nt, Yersinia pestis
ugguggcuugggcuucaca

SEQ ID NO: 2247102 - RNA, 14 nt, Yersinia pestis
ugguggcuuuacca

SEQ ID NO: 2247103 - RNA, 13 nt, Yersinia pestis
uggugguggccug

SEQ ID NO: 2247104 - RNA, 21 nt, Yersinia pestis
uggucgccagauugacauuca

SEQ ID NO: 2247105 - RNA, 17 nt, Yersinia pestis
uggucuuggucauaccg

SEQ ID NO: 2247106 - RNA, 16 nt, Yersinia pestis
uguaauccggcaaaaa

SEQ ID NO: 2247107 - RNA, 13 nt, Yersinia pestis
uguaaugccuggu

SEQ ID NO: 2247108 - RNA, 18 nt, Yersinia pestis
uguaauuauauuuaauuu

SEQ ID NO: 2247109 - RNA, 12 nt, Yersinia pestis
ugguuuuuauug

SEQ ID NO: 2247110 - RNA, 14 nt, Yersinia pestis
ugguuuuguuaaua

SEQ ID NO: 2247111 - RNA, 19 nt, Yersinia pestis
ugguuuucuauuuccacaa

SEQ ID NO: 2247112 - RNA, 17 nt, Yersinia pestis
ugguuuucuauuuccac

SEQ ID NO: 2247113 - RNA, 20 nt, Yersinia pestis
uguaaaaaccaucugaugca

SEQ ID NO: 2247114 - RNA, 15 nt, Yersinia pestis
uguaacacauauuuc

SEQ ID NO: 2247115 - RNA, 16 nt, Yersinia pestis
uguaacaacugaacca

SEQ ID NO: 2247116 - RNA, 22 nt, Yersinia pestis
uguaacagagcagaaagcagca

SEQ ID NO: 2247117 - RNA, 21 nt, Yersinia pestis
uguaagcaccagcaccaacaa

SEQ ID NO: 2247118 - RNA, 20 nt, Yersinia pestis
uguaagcugggaaggcguaa

SEQ ID NO: 2247119 - RNA, 17 nt, Yersinia pestis
uguaagucauucuuggu

SEQ ID NO: 2247120 - RNA, 19 nt, Yersinia pestis
ugguuacgggcuugcugca

SEQ ID NO: 2247121 - RNA, 15 nt, Yersinia pestis
ugguuaaucuacccg

SEQ ID NO: 2247122 - RNA, 18 nt, Yersinia pestis
ugguuaacuuauagcuca

SEQ ID NO: 2247123 - RNA, 23 nt, Yersinia pestis
ugguuaaaucaccgacaccaacc

SEQ ID NO: 2247124 - RNA, 14 nt, Yersinia pestis
ugguuaacagcgug

SEQ ID NO: 2247125 - RNA, 18 nt, Yersinia pestis
ugguugccagauaauguu

SEQ ID NO: 2247126 - RNA, 13 nt, Yersinia pestis
ugguugucuaugu

SEQ ID NO: 2247127 - RNA, 18 nt, Yersinia pestis
ugguugguggcuuuacca

SEQ ID NO: 2247128 - RNA, 20 nt, Yersinia pestis
ugguuggcaccacggucaga

SEQ ID NO: 2247129 - RNA, 14 nt, Yersinia pestis
ugguuuauaacaag

SEQ ID NO: 2247130 - RNA, 10 nt, Yersinia pestis
ugguuuccau

SEQ ID NO: 2247131 - RNA, 16 nt, Yersinia pestis
ugguuugaauucaaga

SEQ ID NO: 2247132 - RNA, 14 nt, Yersinia pestis
ugguuuuaauauug

SEQ ID NO: 2247133 - RNA, 22 nt, Yersinia pestis
uggcuagccugcaccucaucaa

SEQ ID NO: 2247134 - RNA, 21 nt, Yersinia pestis
uggcuaucaauuguuugcuau

SEQ ID NO: 2247135 - RNA, 14 nt, Yersinia pestis
uggcuaucugaaac

SEQ ID NO: 2247136 - RNA, 14 nt, Yersinia pestis
uggcuaucaucccu

SEQ ID NO: 2247137 - RNA, 21 nt, Yersinia pestis
uggcucaauccaaaugacacu

SEQ ID NO: 2247138 - RNA, 13 nt, Yersinia pestis
uggcucaaugugc

SEQ ID NO: 2247139 - RNA, 14 nt, Yersinia pestis
uggcucaucaaagg

SEQ ID NO: 2247140 - RNA, 14 nt, Yersinia pestis
uggcucucuuuuuu

SEQ ID NO: 2247141 - RNA, 14 nt, Yersinia pestis
uggcuaaacccaac

SEQ ID NO: 2247142 - RNA, 24 nt, Yersinia pestis
uggcguuucugaagaugccaauca

SEQ ID NO: 2247143 - RNA, 16 nt, Yersinia pestis
uggcuaagcaugccgc

SEQ ID NO: 2247144 - RNA, 22 nt, Yersinia pestis
uggcuaagccgcaauaaauggc

SEQ ID NO: 2247145 - RNA, 21 nt, Yersinia pestis
uggcuaauaaugcaccaauca

SEQ ID NO: 2247146 - RNA, 22 nt, Yersinia pestis
uggcuaauaccauuucuuauau

SEQ ID NO: 2247147 - RNA, 15 nt, Yersinia pestis
uggcguuaaucaagc

SEQ ID NO: 2247148 - RNA, 14 nt, Yersinia pestis
uggcggaaauuaaa

SEQ ID NO: 2247149 - RNA, 14 nt, Yersinia pestis
uggcguaacugcug

SEQ ID NO: 2247150 - RNA, 16 nt, Yersinia pestis
uggcggucgcacugug

SEQ ID NO: 2247151 - RNA, 23 nt, Yersinia pestis
uggcggucgcacugugagcggca

SEQ ID NO: 2247152 - RNA, 16 nt, Yersinia pestis
uggcgcugaucaucau

SEQ ID NO: 2247153 - RNA, 17 nt, Yersinia pestis
uggcgcucggucaugcg

SEQ ID NO: 2247154 - RNA, 22 nt, Yersinia pestis
uggcgcgguucuaguauucagg

SEQ ID NO: 2247155 - RNA, 17 nt, Yersinia pestis
uggcgcggcucgagccu

SEQ ID NO: 2247156 - RNA, 13 nt, Yersinia pestis
uggaaaacagcaa

SEQ ID NO: 2247157 - RNA, 23 nt, Yersinia pestis
uggaaaaguaggacggugccaug

SEQ ID NO: 2247158 - RNA, 15 nt, Yersinia pestis
uggcgcgccacuucu

SEQ ID NO: 2247159 - RNA, 11 nt, Yersinia pestis
uggcugguuga

SEQ ID NO: 2247160 - RNA, 19 nt, Yersinia pestis
uggcuggggcgaugcgagu

SEQ ID NO: 2247161 - RNA, 21 nt, Yersinia pestis
uggcugcgggugccgcauuac

SEQ ID NO: 2247162 - RNA, 22 nt, Yersinia pestis
uggcucuggccagcgucuucag

SEQ ID NO: 2247163 - RNA, 21 nt, Yersinia pestis
uggcugaauaucaucuuuuuc

SEQ ID NO: 2247164 - RNA, 12 nt, Yersinia pestis
ugggaacaacag

SEQ ID NO: 2247165 - RNA, 20 nt, Yersinia pestis
uggcuuuacgcaacucagca

SEQ ID NO: 2247166 - RNA, 13 nt, Yersinia pestis
uggcuucugcuuu

SEQ ID NO: 2247167 - RNA, 14 nt, Yersinia pestis
uggcuucuggaugg

SEQ ID NO: 2247168 - RNA, 15 nt, Yersinia pestis
uggcuucuggauggg

SEQ ID NO: 2247169 - RNA, 21 nt, Yersinia pestis
ugggcgcauaaaaugagccug

SEQ ID NO: 2247170 - RNA, 17 nt, Yersinia pestis
ugggccgacucugcaug

SEQ ID NO: 2247171 - RNA, 16 nt, Yersinia pestis
ugggacuuuaucugcc

SEQ ID NO: 2247172 - RNA, 20 nt, Yersinia pestis
ugggccacaggcugcauggg

SEQ ID NO: 2247173 - RNA, 18 nt, Yersinia pestis
uggggacaggcuccuccu

SEQ ID NO: 2247174 - RNA, 21 nt, Yersinia pestis
ugggcgggaucuccagaagca

SEQ ID NO: 2247175 - RNA, 17 nt, Yersinia pestis
ugggcgggcaccaugcc

SEQ ID NO: 2247176 - RNA, 15 nt, Yersinia pestis
uucaucauccauaaa

SEQ ID NO: 2247177 - RNA, 12 nt, Yersinia pestis
uucaucauuauu

SEQ ID NO: 2247178 - RNA, 17 nt, Yersinia pestis
uucaucccaaucaucau

SEQ ID NO: 2247179 - RNA, 18 nt, Yersinia pestis
uucaucccaaucaucauc

SEQ ID NO: 2247180 - RNA, 21 nt, Yersinia pestis
uucaucagucacuaaaccauu

SEQ ID NO: 2247181 - RNA, 18 nt, Yersinia pestis
uucaucaccagucagccu

SEQ ID NO: 2247182 - RNA, 17 nt, Yersinia pestis
uucaucagagucuguca

SEQ ID NO: 2247183 - RNA, 16 nt, Yersinia pestis
uucaucaccagucagc

SEQ ID NO: 2247184 - RNA, 16 nt, Yersinia pestis
uucaucgcccuguaac

SEQ ID NO: 2247185 - RNA, 14 nt, Yersinia pestis
uucaucgacucuuu

SEQ ID NO: 2247186 - RNA, 15 nt, Yersinia pestis
uucaucgaaaaaaau

SEQ ID NO: 2247187 - RNA, 18 nt, Yersinia pestis
uucaucccauaugcuaua

SEQ ID NO: 2247188 - RNA, 24 nt, Yersinia pestis
uucauccuaaagauaauuaauuca

SEQ ID NO: 2247189 - RNA, 17 nt, Yersinia pestis
uucauccgcagcaaaac

SEQ ID NO: 2247190 - RNA, 14 nt, Yersinia pestis
uucauccguauuau

SEQ ID NO: 2247191 - RNA, 17 nt, Yersinia pestis
uucaugacgaaaaacac

SEQ ID NO: 2247192 - RNA, 20 nt, Yersinia pestis
uucaucuuuaacaacaacca

SEQ ID NO: 2247193 - RNA, 23 nt, Yersinia pestis
uucaucucaauaacuauuuuuga

SEQ ID NO: 2247194 - RNA, 17 nt, Yersinia pestis
uucaucguaucgugcag

SEQ ID NO: 2247195 - RNA, 21 nt, Yersinia pestis
uucaucgcgaccaauucauca

SEQ ID NO: 2247196 - RNA, 12 nt, Yersinia pestis
uucauuucaggu

SEQ ID NO: 2247197 - RNA, 14 nt, Yersinia pestis
uucauuucaggacu

SEQ ID NO: 2247198 - RNA, 12 nt, Yersinia pestis
uucauuuuaaaa

SEQ ID NO: 2247199 - RNA, 14 nt, Yersinia pestis
uucauuuuaaaaaa

SEQ ID NO: 2247200 - RNA, 16 nt, Yersinia pestis
uucauuuuaaaaaaau

SEQ ID NO: 2247201 - RNA, 16 nt, Yersinia pestis
uucauucguuagcucu

SEQ ID NO: 2247202 - RNA, 13 nt, Yersinia pestis
uucauuccagagu

SEQ ID NO: 2247203 - RNA, 14 nt, Yersinia pestis
uucauggguuucua

SEQ ID NO: 2247204 - RNA, 20 nt, Yersinia pestis
uucaugcuaauaccacaaca

SEQ ID NO: 2247205 - RNA, 20 nt, Yersinia pestis
uucauuaauuaauaagccca

SEQ ID NO: 2247206 - RNA, 18 nt, Yersinia pestis
uucauuagcucaaauauu

SEQ ID NO: 2247207 - RNA, 15 nt, Yersinia pestis
uucaguacauaaacc

SEQ ID NO: 2247208 - RNA, 17 nt, Yersinia pestis
uucagucaaucgcucuu

SEQ ID NO: 2247209 - RNA, 13 nt, Yersinia pestis
uucaggcuuuuuu

SEQ ID NO: 2247210 - RNA, 21 nt, Yersinia pestis
uucaggcacguaauaccuuaa

SEQ ID NO: 2247211 - RNA, 18 nt, Yersinia pestis
uucaggaucgaucuggau

SEQ ID NO: 2247212 - RNA, 23 nt, Yersinia pestis
uucaggagauagccucaccgcca

SEQ ID NO: 2247213 - RNA, 20 nt, Yersinia pestis
uucaggacugucuucaacuu

SEQ ID NO: 2247214 - RNA, 14 nt, Yersinia pestis
uucagccuauccuc

SEQ ID NO: 2247215 - RNA, 17 nt, Yersinia pestis
uucagccuauccucacc

SEQ ID NO: 2247216 - RNA, 21 nt, Yersinia pestis
uucagcguauugugauucaua

SEQ ID NO: 2247217 - RNA, 22 nt, Yersinia pestis
uucaggaaugguguaaaugccc

SEQ ID NO: 2247218 - RNA, 18 nt, Yersinia pestis
uucaggaauaaacagcag

SEQ ID NO: 2247219 - RNA, 19 nt, Yersinia pestis
uucagcuuccgcuucaacu

SEQ ID NO: 2247220 - RNA, 14 nt, Yersinia pestis
uucagcuugcaaca

SEQ ID NO: 2247221 - RNA, 17 nt, Yersinia pestis
uucagcuugcaacaaaa

SEQ ID NO: 2247222 - RNA, 14 nt, Yersinia pestis
uucagcucuucaau

SEQ ID NO: 2247223 - RNA, 23 nt, Yersinia pestis
uucagcucccgccgcaacaguga

SEQ ID NO: 2247224 - RNA, 21 nt, Yersinia pestis
uucauacugccgaccauaucu

SEQ ID NO: 2247225 - RNA, 13 nt, Yersinia pestis
uucauacaucauu

SEQ ID NO: 2247226 - RNA, 20 nt, Yersinia pestis
uucauaccuuaauuaacucu

SEQ ID NO: 2247227 - RNA, 17 nt, Yersinia pestis
uucauaucguccaaagg

SEQ ID NO: 2247228 - RNA, 20 nt, Yersinia pestis
uucaucaaggauaagaaucu

SEQ ID NO: 2247229 - RNA, 21 nt, Yersinia pestis
uucauauccgaugauauaccc

SEQ ID NO: 2247230 - RNA, 18 nt, Yersinia pestis
uucauaucuuuaccuguu

SEQ ID NO: 2247231 - RNA, 17 nt, Yersinia pestis
uucauaugcgccuauaa

SEQ ID NO: 2247232 - RNA, 20 nt, Yersinia pestis
uucaguuuauuuaagcugaa

SEQ ID NO: 2247233 - RNA, 15 nt, Yersinia pestis
uucaguggcuggaaa

SEQ ID NO: 2247234 - RNA, 23 nt, Yersinia pestis
uucagugauaacaacccuaacac

SEQ ID NO: 2247235 - RNA, 16 nt, Yersinia pestis
uucagucgcgauaaaa

SEQ ID NO: 2247236 - RNA, 22 nt, Yersinia pestis
uucaguuuuauuguauaaaaca

SEQ ID NO: 2247237 - RNA, 22 nt, Yersinia pestis
uucauaaaccaacgguucauau

SEQ ID NO: 2247238 - RNA, 12 nt, Yersinia pestis
uucauaaaucag

SEQ ID NO: 2247239 - RNA, 16 nt, Yersinia pestis
uucaaucacuucugcu

SEQ ID NO: 2247240 - RNA, 20 nt, Yersinia pestis
uucaaucacuucugcugcca

SEQ ID NO: 2247241 - RNA, 14 nt, Yersinia pestis
uucaaucacuuuau

SEQ ID NO: 2247242 - RNA, 23 nt, Yersinia pestis
uucaauggcguuauguaaaacga

SEQ ID NO: 2247243 - RNA, 18 nt, Yersinia pestis
uucaauacuggccaugug

SEQ ID NO: 2247244 - RNA, 21 nt, Yersinia pestis
uucaauacuggccaugugugu

SEQ ID NO: 2247245 - RNA, 21 nt, Yersinia pestis
uucaaguccugcuucaaagaa

SEQ ID NO: 2247246 - RNA, 22 nt, Yersinia pestis
uucaauaaaacucacuugugug

SEQ ID NO: 2247247 - RNA, 19 nt, Yersinia pestis
uucaagccgcgccaucucu

SEQ ID NO: 2247248 - RNA, 21 nt, Yersinia pestis
uucaauugcccccuagugaug

SEQ ID NO: 2247249 - RNA, 15 nt, Yersinia pestis
uucaauuuccaucug

SEQ ID NO: 2247250 - RNA, 22 nt, Yersinia pestis
uucacaagccaaacaaaugaac

SEQ ID NO: 2247251 - RNA, 19 nt, Yersinia pestis
uucaccacgauuagccaua

SEQ ID NO: 2247252 - RNA, 19 nt, Yersinia pestis
uucaccacacauaccacac

SEQ ID NO: 2247253 - RNA, 15 nt, Yersinia pestis
uucaccaaaccauca

SEQ ID NO: 2247254 - RNA, 20 nt, Yersinia pestis
uucacccaggcugugguggc

SEQ ID NO: 2247255 - RNA, 21 nt, Yersinia pestis
uucaccaaaaaaaccaccaaa

SEQ ID NO: 2247256 - RNA, 19 nt, Yersinia pestis
uucaccaaaggaagccgag

SEQ ID NO: 2247257 - RNA, 12 nt, Yersinia pestis
uucaccaaaaaa

SEQ ID NO: 2247258 - RNA, 19 nt, Yersinia pestis
uucacaucggucaauacca

SEQ ID NO: 2247259 - RNA, 20 nt, Yersinia pestis
uucacagcagaacaaaacaa

SEQ ID NO: 2247260 - RNA, 13 nt, Yersinia pestis
uucagacugcuga

SEQ ID NO: 2247261 - RNA, 22 nt, Yersinia pestis
uucagacugaaaguagaaauaa

SEQ ID NO: 2247262 - RNA, 21 nt, Yersinia pestis
uucagacggcagauccugaac

SEQ ID NO: 2247263 - RNA, 10 nt, Yersinia pestis
uucagacucc

SEQ ID NO: 2247264 - RNA, 22 nt, Yersinia pestis
uucagaauugugccccuuuuuu

SEQ ID NO: 2247265 - RNA, 20 nt, Yersinia pestis
uucagacaguaaauccugau

SEQ ID NO: 2247266 - RNA, 13 nt, Yersinia pestis
uucagacauacaa

SEQ ID NO: 2247267 - RNA, 20 nt, Yersinia pestis
uucagacggcagauccugaa

SEQ ID NO: 2247268 - RNA, 13 nt, Yersinia pestis
uucacuuuuaaaa

SEQ ID NO: 2247269 - RNA, 22 nt, Yersinia pestis
uucacuuuuaaaacuucccgca

SEQ ID NO: 2247270 - RNA, 15 nt, Yersinia pestis
uucagaagacaauaa

SEQ ID NO: 2247271 - RNA, 22 nt, Yersinia pestis
uucagaaaggacaguaauauuu

SEQ ID NO: 2247272 - RNA, 20 nt, Yersinia pestis
uucagcagggcgguuaauaa

SEQ ID NO: 2247273 - RNA, 16 nt, Yersinia pestis
uucagccaugggcuga

SEQ ID NO: 2247274 - RNA, 16 nt, Yersinia pestis
uucagcacgcuuucca

SEQ ID NO: 2247275 - RNA, 15 nt, Yersinia pestis
uucagcagcaagaaa

SEQ ID NO: 2247276 - RNA, 15 nt, Yersinia pestis
uucagaggaaagaga

SEQ ID NO: 2247277 - RNA, 19 nt, Yersinia pestis
uucagcaacgguuucaacu

SEQ ID NO: 2247278 - RNA, 20 nt, Yersinia pestis
uucacuauuuauuaaucuau

SEQ ID NO: 2247279 - RNA, 15 nt, Yersinia pestis
uucacguugguauac

SEQ ID NO: 2247280 - RNA, 20 nt, Yersinia pestis
uucacguuuuuccauucgca

SEQ ID NO: 2247281 - RNA, 21 nt, Yersinia pestis
uucacugccgaaccuuuugcc

SEQ ID NO: 2247282 - RNA, 15 nt, Yersinia pestis
uucacugaaucccag

SEQ ID NO: 2247283 - RNA, 17 nt, Yersinia pestis
uucacucauaauuuuga

SEQ ID NO: 2247284 - RNA, 18 nt, Yersinia pestis
uucacucuguuuuaaaaa

SEQ ID NO: 2247285 - RNA, 21 nt, Yersinia pestis
uucacuggccuauuaagauaa

SEQ ID NO: 2247286 - RNA, 18 nt, Yersinia pestis
uucacuuauucccacuua

SEQ ID NO: 2247287 - RNA, 20 nt, Yersinia pestis
uucacuuacugccaaagaau

SEQ ID NO: 2247288 - RNA, 17 nt, Yersinia pestis
uucacgauggaaaaaau

SEQ ID NO: 2247289 - RNA, 20 nt, Yersinia pestis
uucacgcaucacaucuugca

SEQ ID NO: 2247290 - RNA, 20 nt, Yersinia pestis
uucaccuauaauuaacagca

SEQ ID NO: 2247291 - RNA, 18 nt, Yersinia pestis
uucaccgcuuuucuggua

SEQ ID NO: 2247292 - RNA, 23 nt, Yersinia pestis
uucaccgccuuucauucugaaga

SEQ ID NO: 2247293 - RNA, 20 nt, Yersinia pestis
uucaccccagcaaagccaaa

SEQ ID NO: 2247294 - RNA, 14 nt, Yersinia pestis
uucacccugagugu

SEQ ID NO: 2247295 - RNA, 13 nt, Yersinia pestis
uucacccucuuuc

SEQ ID NO: 2247296 - RNA, 23 nt, Yersinia pestis
uuccauaaacggaacucaucuuu

SEQ ID NO: 2247297 - RNA, 18 nt, Yersinia pestis
uuccaucacugcauuauc

SEQ ID NO: 2247298 - RNA, 19 nt, Yersinia pestis
uuccagugccaauugagua

SEQ ID NO: 2247299 - RNA, 15 nt, Yersinia pestis
uuccagugguuuccc

SEQ ID NO: 2247300 - RNA, 17 nt, Yersinia pestis
uuccaguacugaccacg

SEQ ID NO: 2247301 - RNA, 13 nt, Yersinia pestis
uuccaguaaaaaa

SEQ ID NO: 2247302 - RNA, 19 nt, Yersinia pestis
uuccagcgcuuccacugcg

SEQ ID NO: 2247303 - RNA, 20 nt, Yersinia pestis
uuccagauagcgaaucacau

SEQ ID NO: 2247304 - RNA, 13 nt, Yersinia pestis
uuccagcagggcc

SEQ ID NO: 2247305 - RNA, 18 nt, Yersinia pestis
uuccagcaccccuucacc

SEQ ID NO: 2247306 - RNA, 23 nt, Yersinia pestis
uuccaaaugacagcaucaauauc

SEQ ID NO: 2247307 - RNA, 15 nt, Yersinia pestis
uucauuuuguauuuu

SEQ ID NO: 2247308 - RNA, 16 nt, Yersinia pestis
uucauuuugcuggaaa

SEQ ID NO: 2247309 - RNA, 13 nt, Yersinia pestis
uucauuuuucucc

SEQ ID NO: 2247310 - RNA, 17 nt, Yersinia pestis
uuccacgcccaacucuu

SEQ ID NO: 2247311 - RNA, 22 nt, Yersinia pestis
uuccaauguugccgcuucauau

SEQ ID NO: 2247312 - RNA, 13 nt, Yersinia pestis
uuccaauaccaau

SEQ ID NO: 2247313 - RNA, 16 nt, Yersinia pestis
uuccaauuggugcuuu

SEQ ID NO: 2247314 - RNA, 13 nt, Yersinia pestis
uuccacagaguau

SEQ ID NO: 2247315 - RNA, 21 nt, Yersinia pestis
uuccacagguggggcaguuaa

SEQ ID NO: 2247316 - RNA, 10 nt, Yersinia pestis
uucccauuua

SEQ ID NO: 2247317 - RNA, 13 nt, Yersinia pestis
uucccauuuaugg

SEQ ID NO: 2247318 - RNA, 23 nt, Yersinia pestis
uucccaguaagcucuacuaauau

SEQ ID NO: 2247319 - RNA, 18 nt, Yersinia pestis
uucccagucauaaauauc

SEQ ID NO: 2247320 - RNA, 24 nt, Yersinia pestis
uucccauagcuggcuucaaaauca

SEQ ID NO: 2247321 - RNA, 17 nt, Yersinia pestis
uuccccuaauucuccuu

SEQ ID NO: 2247322 - RNA, 18 nt, Yersinia pestis
uuccauuuuauuuaacgu

SEQ ID NO: 2247323 - RNA, 17 nt, Yersinia pestis
uuccaugcaaaauaugg

SEQ ID NO: 2247324 - RNA, 19 nt, Yersinia pestis
uuccaugacacauauuuca

SEQ ID NO: 2247325 - RNA, 17 nt, Yersinia pestis
uucccuguucucuguuu

SEQ ID NO: 2247326 - RNA, 20 nt, Yersinia pestis
uucccuguucucuguuucca

SEQ ID NO: 2247327 - RNA, 12 nt, Yersinia pestis
uucccugcauaa

SEQ ID NO: 2247328 - RNA, 14 nt, Yersinia pestis
uucccucugccuga

SEQ ID NO: 2247329 - RNA, 23 nt, Yersinia pestis
uucccuacugauuggauaaaaua

SEQ ID NO: 2247330 - RNA, 14 nt, Yersinia pestis
uucccgcucuucac

SEQ ID NO: 2247331 - RNA, 20 nt, Yersinia pestis
uuccgccgccaacagugaau

SEQ ID NO: 2247332 - RNA, 17 nt, Yersinia pestis
uuccgauaaccagaccg

SEQ ID NO: 2247333 - RNA, 11 nt, Yersinia pestis
uucgccccuua

SEQ ID NO: 2247334 - RNA, 14 nt, Yersinia pestis
uucgcaucuuccaa

SEQ ID NO: 2247335 - RNA, 22 nt, Yersinia pestis
uucgcauaggguucuagagcau

SEQ ID NO: 2247336 - RNA, 19 nt, Yersinia pestis
uucgcauucgugccauaaa

SEQ ID NO: 2247337 - RNA, 12 nt, Yersinia pestis
uucgcaggccag

SEQ ID NO: 2247338 - RNA, 19 nt, Yersinia pestis
uucgcagccaaaauaauca

SEQ ID NO: 2247339 - RNA, 16 nt, Yersinia pestis
uucgcagcuuccagca

SEQ ID NO: 2247340 - RNA, 17 nt, Yersinia pestis
uucgcucgcauaaaugu

SEQ ID NO: 2247341 - RNA, 18 nt, Yersinia pestis
uucgcuauuucucucuac

SEQ ID NO: 2247342 - RNA, 18 nt, Yersinia pestis
uucgcggggcguauuauc

SEQ ID NO: 2247343 - RNA, 17 nt, Yersinia pestis
uucgcgaucagacauuu

SEQ ID NO: 2247344 - RNA, 13 nt, Yersinia pestis
uucgcaagaagcg

SEQ ID NO: 2247345 - RNA, 15 nt, Yersinia pestis
uucgcagccaaaaua

SEQ ID NO: 2247346 - RNA, 16 nt, Yersinia pestis
uucgcacuuuaaauac

SEQ ID NO: 2247347 - RNA, 18 nt, Yersinia pestis
uucgaguugaacucauau

SEQ ID NO: 2247348 - RNA, 13 nt, Yersinia pestis
uucgaugauuauu

SEQ ID NO: 2247349 - RNA, 15 nt, Yersinia pestis
uucgaugauuuauau

SEQ ID NO: 2247350 - RNA, 20 nt, Yersinia pestis
uucgaaugauugacuugacu

SEQ ID NO: 2247351 - RNA, 22 nt, Yersinia pestis
uucgaaagaaauaaaagaaaac

SEQ ID NO: 2247352 - RNA, 19 nt, Yersinia pestis
uucgacaggcaauuaucca

SEQ ID NO: 2247353 - RNA, 15 nt, Yersinia pestis
uucgagcaacuuuua

SEQ ID NO: 2247354 - RNA, 23 nt, Yersinia pestis
uucgagguggcgauaaagaguga

SEQ ID NO: 2247355 - RNA, 17 nt, Yersinia pestis
uucgagugugaugaugg

SEQ ID NO: 2247356 - RNA, 15 nt, Yersinia pestis
uucgaguugaacuca

SEQ ID NO: 2247357 - RNA, 18 nt, Yersinia pestis
uuccuaugugauauuuua

SEQ ID NO: 2247358 - RNA, 14 nt, Yersinia pestis
uuccucaucgaaau

SEQ ID NO: 2247359 - RNA, 21 nt, Yersinia pestis
uuccucccagaauaauaagcc

SEQ ID NO: 2247360 - RNA, 20 nt, Yersinia pestis
uuccuacaacgugguuuauu

SEQ ID NO: 2247361 - RNA, 20 nt, Yersinia pestis
uuccuacuaugcguugagac

SEQ ID NO: 2247362 - RNA, 15 nt, Yersinia pestis
uuccucgcaggcuug

SEQ ID NO: 2247363 - RNA, 21 nt, Yersinia pestis
uuccucgccguagcauucauu

SEQ ID NO: 2247364 - RNA, 17 nt, Yersinia pestis
uuccgucccaagaaaag

SEQ ID NO: 2247365 - RNA, 14 nt, Yersinia pestis
uuccuaacaauauu

SEQ ID NO: 2247366 - RNA, 15 nt, Yersinia pestis
uuccggcuuucuaua

SEQ ID NO: 2247367 - RNA, 16 nt, Yersinia pestis
uucgaaaacucaaaga

SEQ ID NO: 2247368 - RNA, 15 nt, Yersinia pestis
uucgaaaauaaugaa

SEQ ID NO: 2247369 - RNA, 20 nt, Yersinia pestis
uucgaaacugaucacuggca

SEQ ID NO: 2247370 - RNA, 14 nt, Yersinia pestis
uuccuuugcccuua

SEQ ID NO: 2247371 - RNA, 14 nt, Yersinia pestis
uuccuucagccacc

SEQ ID NO: 2247372 - RNA, 13 nt, Yersinia pestis
uuccuuauaaauc

SEQ ID NO: 2247373 - RNA, 16 nt, Yersinia pestis
uuccuuaccugaugug

SEQ ID NO: 2247374 - RNA, 20 nt, Yersinia pestis
uuccuuaacgccccgccccu

SEQ ID NO: 2247375 - RNA, 14 nt, Yersinia pestis
uuccuguauuuccu

SEQ ID NO: 2247376 - RNA, 20 nt, Yersinia pestis
uuccugcgccacgcuuuagc

SEQ ID NO: 2247377 - RNA, 13 nt, Yersinia pestis
uugcaggucugca

SEQ ID NO: 2247378 - RNA, 14 nt, Yersinia pestis
uugcaguauuuugg

SEQ ID NO: 2247379 - RNA, 13 nt, Yersinia pestis
uugcaggcuuuca

SEQ ID NO: 2247380 - RNA, 21 nt, Yersinia pestis
uugcaggcacuuugucaauaa

SEQ ID NO: 2247381 - RNA, 17 nt, Yersinia pestis
uugcauacaaccguuac

SEQ ID NO: 2247382 - RNA, 14 nt, Yersinia pestis
uugcagugcguaau

SEQ ID NO: 2247383 - RNA, 20 nt, Yersinia pestis
uugcagucuccaucacucuu

SEQ ID NO: 2247384 - RNA, 16 nt, Yersinia pestis
uugcagucgcuucauc

SEQ ID NO: 2247385 - RNA, 22 nt, Yersinia pestis
uugcauacucaggcccugagau

SEQ ID NO: 2247386 - RNA, 13 nt, Yersinia pestis
uugcauacucagg

SEQ ID NO: 2247387 - RNA, 17 nt, Yersinia pestis
uugccacucauauucaa

SEQ ID NO: 2247388 - RNA, 22 nt, Yersinia pestis
uugccagcggcggccaucccag

SEQ ID NO: 2247389 - RNA, 16 nt, Yersinia pestis
uugccagccaggauag

SEQ ID NO: 2247390 - RNA, 14 nt, Yersinia pestis
uugccagugacucu

SEQ ID NO: 2247391 - RNA, 23 nt, Yersinia pestis
uugccauaagcgacgacauuaau

SEQ ID NO: 2247392 - RNA, 15 nt, Yersinia pestis
uugcccaauggcaaa

SEQ ID NO: 2247393 - RNA, 16 nt, Yersinia pestis
uugccgugguucaaau

SEQ ID NO: 2247394 - RNA, 21 nt, Yersinia pestis
uugcggaagguauccaauacc

SEQ ID NO: 2247395 - RNA, 17 nt, Yersinia pestis
uugcgccauacaguuaa

SEQ ID NO: 2247396 - RNA, 13 nt, Yersinia pestis
uugcggaucacau

SEQ ID NO: 2247397 - RNA, 22 nt, Yersinia pestis
uugcggcgcacccuccaauaau

SEQ ID NO: 2247398 - RNA, 15 nt, Yersinia pestis
uugcggcugaguggu

SEQ ID NO: 2247399 - RNA, 17 nt, Yersinia pestis
uugccuggcccaucuau

SEQ ID NO: 2247400 - RNA, 20 nt, Yersinia pestis
uugccuggccccguuguccc

SEQ ID NO: 2247401 - RNA, 16 nt, Yersinia pestis
uugccugaugccuuug

SEQ ID NO: 2247402 - RNA, 14 nt, Yersinia pestis
uugcgccacaaccc

SEQ ID NO: 2247403 - RNA, 19 nt, Yersinia pestis
uugcgccacaacccaauaa

SEQ ID NO: 2247404 - RNA, 18 nt, Yersinia pestis
uugcucucgcuccagcuc

SEQ ID NO: 2247405 - RNA, 20 nt, Yersinia pestis
uugcuaaauuuuguacaacu

SEQ ID NO: 2247406 - RNA, 20 nt, Yersinia pestis
uugguaaaaccgguuuuggu

SEQ ID NO: 2247407 - RNA, 16 nt, Yersinia pestis
uugguaacgcagaaau

SEQ ID NO: 2247408 - RNA, 19 nt, Yersinia pestis
uuggucaguugaauauucc

SEQ ID NO: 2247409 - RNA, 17 nt, Yersinia pestis
uuggugacaaacgcuug

SEQ ID NO: 2247410 - RNA, 14 nt, Yersinia pestis
uugguuggcuuuaa

SEQ ID NO: 2247411 - RNA, 13 nt, Yersinia pestis
uugguugcaagua

SEQ ID NO: 2247412 - RNA, 11 nt, Yersinia pestis
uugguuuauaa

SEQ ID NO: 2247413 - RNA, 14 nt, Yersinia pestis
uugguuuauaacaa

SEQ ID NO: 2247414 - RNA, 17 nt, Yersinia pestis
uuggcuuuuucuuccag

SEQ ID NO: 2247415 - RNA, 15 nt, Yersinia pestis
uuggcuuggacagaa

SEQ ID NO: 2247416 - RNA, 21 nt, Yersinia pestis
uuggccauuaaccuaaaaacg

SEQ ID NO: 2247417 - RNA, 22 nt, Yersinia pestis
uuggcccacuggccugagaacc

SEQ ID NO: 2247418 - RNA, 13 nt, Yersinia pestis
uuggccgcuuugg

SEQ ID NO: 2247419 - RNA, 16 nt, Yersinia pestis
uuggccgggacuccag

SEQ ID NO: 2247420 - RNA, 14 nt, Yersinia pestis
uuggcaaaaauaau

SEQ ID NO: 2247421 - RNA, 17 nt, Yersinia pestis
uuggcaaaggccagcgc

SEQ ID NO: 2247422 - RNA, 17 nt, Yersinia pestis
uuggcaaagucaucaaa

SEQ ID NO: 2247423 - RNA, 20 nt, Yersinia pestis
uuggaaaugacaaaucagcg

SEQ ID NO: 2247424 - RNA, 20 nt, Yersinia pestis
uuggauccgguugccagcca

SEQ ID NO: 2247425 - RNA, 19 nt, Yersinia pestis
uugcuggcuaucaucccuu

SEQ ID NO: 2247426 - RNA, 22 nt, Yersinia pestis
uugcuguaaacaucgacaccaa

SEQ ID NO: 2247427 - RNA, 21 nt, Yersinia pestis
uugcugcuguuauuacuguca

SEQ ID NO: 2247428 - RNA, 21 nt, Yersinia pestis
uugcuggagcauugcgcucug

SEQ ID NO: 2247429 - RNA, 13 nt, Yersinia pestis
uugcuugcugccu

SEQ ID NO: 2247430 - RNA, 15 nt, Yersinia pestis
uugcuugcugccugc

SEQ ID NO: 2247431 - RNA, 12 nt, Yersinia pestis
uuuaagaaaucu

SEQ ID NO: 2247432 - RNA, 13 nt, Yersinia pestis
uuuaagaaaucua

SEQ ID NO: 2247433 - RNA, 14 nt, Yersinia pestis
uuuaacuuuaucag

SEQ ID NO: 2247434 - RNA, 17 nt, Yersinia pestis
uuuaacuuucaucccuu

SEQ ID NO: 2247435 - RNA, 22 nt, Yersinia pestis
uuuaacuuccaauuucucaaau

SEQ ID NO: 2247436 - RNA, 17 nt, Yersinia pestis
uuuaaaguuuuuuauuu

SEQ ID NO: 2247437 - RNA, 23 nt, Yersinia pestis
uuuaaauuauugaguaacauuaa

SEQ ID NO: 2247438 - RNA, 22 nt, Yersinia pestis
uuuaaauucaauccauugaucu

SEQ ID NO: 2247439 - RNA, 13 nt, Yersinia pestis
uuuaaaaaauauc

SEQ ID NO: 2247440 - RNA, 18 nt, Yersinia pestis
uuuaaacacucaauaagu

SEQ ID NO: 2247441 - RNA, 17 nt, Yersinia pestis
uuuaaagaagaauccac

SEQ ID NO: 2247442 - RNA, 14 nt, Yersinia pestis
uuuacaaaccauau

SEQ ID NO: 2247443 - RNA, 16 nt, Yersinia pestis
uuuaauggcauuaauu

SEQ ID NO: 2247444 - RNA, 13 nt, Yersinia pestis
uuuacauuccaca

SEQ ID NO: 2247445 - RNA, 10 nt, Yersinia pestis
uuuacccugc

SEQ ID NO: 2247446 - RNA, 19 nt, Yersinia pestis
uuuaccgcagggcguucag

SEQ ID NO: 2247447 - RNA, 19 nt, Yersinia pestis
uuuaaugauugauuaucaa

SEQ ID NO: 2247448 - RNA, 16 nt, Yersinia pestis
uuuaauaugcaaaaaa

SEQ ID NO: 2247449 - RNA, 19 nt, Yersinia pestis
uuuaaucgccugaugcuuu

SEQ ID NO: 2247450 - RNA, 19 nt, Yersinia pestis
uuuaauagccaaaauaauu

SEQ ID NO: 2247451 - RNA, 18 nt, Yersinia pestis
uuuaauaugacuagauau

SEQ ID NO: 2247452 - RNA, 22 nt, Yersinia pestis
uuuaagcugcagaggugaacga

SEQ ID NO: 2247453 - RNA, 18 nt, Yersinia pestis
uuuaagcgccuuaagaga

SEQ ID NO: 2247454 - RNA, 22 nt, Yersinia pestis
uuuaaggaucuuucaguuaucu

SEQ ID NO: 2247455 - RNA, 18 nt, Yersinia pestis
uuguagcccacugacacu

SEQ ID NO: 2247456 - RNA, 14 nt, Yersinia pestis
uuguagugaaugac

SEQ ID NO: 2247457 - RNA, 19 nt, Yersinia pestis
uuguauugauaaaaauauc

SEQ ID NO: 2247458 - RNA, 22 nt, Yersinia pestis
uugucaauaaccucagccucau

SEQ ID NO: 2247459 - RNA, 13 nt, Yersinia pestis
uuguauuuuccug

SEQ ID NO: 2247460 - RNA, 20 nt, Yersinia pestis
uuguauuuuccugaucaacu

SEQ ID NO: 2247461 - RNA, 21 nt, Yersinia pestis
uugucuuuaauaaaaucaaaa

SEQ ID NO: 2247462 - RNA, 16 nt, Yersinia pestis
uugucuuuaauaaaau

SEQ ID NO: 2247463 - RNA, 20 nt, Yersinia pestis
uugugaacgguaugaguggu

SEQ ID NO: 2247464 - RNA, 19 nt, Yersinia pestis
uugugagguuagaaaacag

SEQ ID NO: 2247465 - RNA, 22 nt, Yersinia pestis
uugugucaucgcggaugccuuu

SEQ ID NO: 2247466 - RNA, 16 nt, Yersinia pestis
uuguuaucaucaccac

SEQ ID NO: 2247467 - RNA, 22 nt, Yersinia pestis
uuguucagcaccaguugaccau

SEQ ID NO: 2247468 - RNA, 12 nt, Yersinia pestis
uuguuauuauca

SEQ ID NO: 2247469 - RNA, 19 nt, Yersinia pestis
uuguucaccucgaugcuuu

SEQ ID NO: 2247470 - RNA, 12 nt, Yersinia pestis
uuguuauuacug

SEQ ID NO: 2247471 - RNA, 20 nt, Yersinia pestis
uuguugaacaguuuuuggua

SEQ ID NO: 2247472 - RNA, 19 nt, Yersinia pestis
uuguugaccucaaaauaca

SEQ ID NO: 2247473 - RNA, 16 nt, Yersinia pestis
uuguuucaauaaaucc

SEQ ID NO: 2247474 - RNA, 14 nt, Yersinia pestis
uuguugcucaacau

SEQ ID NO: 2247475 - RNA, 22 nt, Yersinia pestis
uugaauucaccaaauugcagaa

SEQ ID NO: 2247476 - RNA, 19 nt, Yersinia pestis
uugaauucaagaaggccgu

SEQ ID NO: 2247477 - RNA, 16 nt, Yersinia pestis
uugaacuucgaaagaa

SEQ ID NO: 2247478 - RNA, 23 nt, Yersinia pestis
uugaacuucgaaagaaauaaaag

SEQ ID NO: 2247479 - RNA, 22 nt, Yersinia pestis
uugaacuguggcaugacugaug

SEQ ID NO: 2247480 - RNA, 16 nt, Yersinia pestis
uugaacggugaggaua

SEQ ID NO: 2247481 - RNA, 17 nt, Yersinia pestis
uugacuuuaaaaaaauu

SEQ ID NO: 2247482 - RNA, 20 nt, Yersinia pestis
uugacuucggucaagaugcc

SEQ ID NO: 2247483 - RNA, 13 nt, Yersinia pestis
uugacgaauuaaa

SEQ ID NO: 2247484 - RNA, 13 nt, Yersinia pestis
uugaccugaagaa

SEQ ID NO: 2247485 - RNA, 22 nt, Yersinia pestis
uugaccgcuguuugauuaaaac

SEQ ID NO: 2247486 - RNA, 16 nt, Yersinia pestis
uugaaaaaauaaaugc

SEQ ID NO: 2247487 - RNA, 17 nt, Yersinia pestis
uugaaacagcaggggcg

SEQ ID NO: 2247488 - RNA, 20 nt, Yersinia pestis
uugaaaccgcugauaaccag

SEQ ID NO: 2247489 - RNA, 21 nt, Yersinia pestis
uugaaaccuacaucacaccca

SEQ ID NO: 2247490 - RNA, 19 nt, Yersinia pestis
uugaaaguuuauaugcuug

SEQ ID NO: 2247491 - RNA, 19 nt, Yersinia pestis
uugaaacuuuccugacccg

SEQ ID NO: 2247492 - RNA, 17 nt, Yersinia pestis
uugaacauucaucuuuu

SEQ ID NO: 2247493 - RNA, 20 nt, Yersinia pestis
uugaaccaauuuuucuguau

SEQ ID NO: 2247494 - RNA, 22 nt, Yersinia pestis
uugaaccgcuaucugcugacca

SEQ ID NO: 2247495 - RNA, 20 nt, Yersinia pestis
uugaaccguaugcuuucauc

SEQ ID NO: 2247496 - RNA, 13 nt, Yersinia pestis
uugaacgacaugu

SEQ ID NO: 2247497 - RNA, 20 nt, Yersinia pestis
uugaacgacaugugaguggu

SEQ ID NO: 2247498 - RNA, 18 nt, Yersinia pestis
uugaaccgcuaucugcug

SEQ ID NO: 2247499 - RNA, 11 nt, Yersinia pestis
uugaaccauaa

SEQ ID NO: 2247500 - RNA, 22 nt, Yersinia pestis
uucuugucaccugaguaauauu

SEQ ID NO: 2247501 - RNA, 11 nt, Yersinia pestis
uucuuucuuca

SEQ ID NO: 2247502 - RNA, 17 nt, Yersinia pestis
uucuuugacucaaugua

SEQ ID NO: 2247503 - RNA, 16 nt, Yersinia pestis
uucuuucuucagcggu

SEQ ID NO: 2247504 - RNA, 20 nt, Yersinia pestis
uugagaaguuauucauugcc

SEQ ID NO: 2247505 - RNA, 20 nt, Yersinia pestis
uugagaauuaaggaaacuca

SEQ ID NO: 2247506 - RNA, 17 nt, Yersinia pestis
uugaguggcagacugcu

SEQ ID NO: 2247507 - RNA, 21 nt, Yersinia pestis
uugaguauuucuuucacuucc

SEQ ID NO: 2247508 - RNA, 18 nt, Yersinia pestis
uugagucgcgacaucaug

SEQ ID NO: 2247509 - RNA, 22 nt, Yersinia pestis
uugaguuuaugguugcaaacca

SEQ ID NO: 2247510 - RNA, 14 nt, Yersinia pestis
uugaguauacuaaa

SEQ ID NO: 2247511 - RNA, 23 nt, Yersinia pestis
uugaguagcaggccgacaauacc

SEQ ID NO: 2247512 - RNA, 17 nt, Yersinia pestis
uugaguaguaaaaccua

SEQ ID NO: 2247513 - RNA, 18 nt, Yersinia pestis
uugaucaaacgaaacuaa

SEQ ID NO: 2247514 - RNA, 22 nt, Yersinia pestis
uugauccucguuagucacucaa

SEQ ID NO: 2247515 - RNA, 11 nt, Yersinia pestis
uugaucuaccu

SEQ ID NO: 2247516 - RNA, 23 nt, Yersinia pestis
uugauaacgccggauaaauuaau

SEQ ID NO: 2247517 - RNA, 15 nt, Yersinia pestis
uugauaaaaaucaau

SEQ ID NO: 2247518 - RNA, 18 nt, Yersinia pestis
uugauuggcucaugcuua

SEQ ID NO: 2247519 - RNA, 14 nt, Yersinia pestis
uugauuggcuccua

SEQ ID NO: 2247520 - RNA, 16 nt, Yersinia pestis
uugaugauuugaccga

SEQ ID NO: 2247521 - RNA, 15 nt, Yersinia pestis
uugaugcauauguag

SEQ ID NO: 2247522 - RNA, 10 nt, Yersinia pestis
uugaugauga

SEQ ID NO: 2247523 - RNA, 17 nt, Yersinia pestis
uugcaauugggguaaau

SEQ ID NO: 2247524 - RNA, 15 nt, Yersinia pestis
uugcaauuguuuuac

SEQ ID NO: 2247525 - RNA, 14 nt, Yersinia pestis
uugcaagguauuuu

SEQ ID NO: 2247526 - RNA, 23 nt, Yersinia pestis
uucugacgggacaaucuguuccu

SEQ ID NO: 2247527 - RNA, 21 nt, Yersinia pestis
uucugacgccaccauuccgcc

SEQ ID NO: 2247528 - RNA, 23 nt, Yersinia pestis
uucugaucguugccgcuaauucu

SEQ ID NO: 2247529 - RNA, 19 nt, Yersinia pestis
uucugggggugauauuugu

SEQ ID NO: 2247530 - RNA, 18 nt, Yersinia pestis
uucuggguacaacacaaa

SEQ ID NO: 2247531 - RNA, 23 nt, Yersinia pestis
uucuggaaugagaugaacacaga

SEQ ID NO: 2247532 - RNA, 23 nt, Yersinia pestis
uucuggcagauguaaccacccac

SEQ ID NO: 2247533 - RNA, 16 nt, Yersinia pestis
uucugaaaccccaaag

SEQ ID NO: 2247534 - RNA, 17 nt, Yersinia pestis
uucugaacgaccagaau

SEQ ID NO: 2247535 - RNA, 18 nt, Yersinia pestis
uucugaacaaaauaguca

SEQ ID NO: 2247536 - RNA, 18 nt, Yersinia pestis
uucuuacuaaaauaucac

SEQ ID NO: 2247537 - RNA, 15 nt, Yersinia pestis
uucuuacuaaaauau

SEQ ID NO: 2247538 - RNA, 16 nt, Yersinia pestis
uucuuacuaaaauauc

SEQ ID NO: 2247539 - RNA, 13 nt, Yersinia pestis
uucuuaauuuuau

SEQ ID NO: 2247540 - RNA, 17 nt, Yersinia pestis
uucuuaggucaucguca

SEQ ID NO: 2247541 - RNA, 12 nt, Yersinia pestis
uucuuccaucuu

SEQ ID NO: 2247542 - RNA, 22 nt, Yersinia pestis
uucuuccaccauccccugucuu

SEQ ID NO: 2247543 - RNA, 11 nt, Yersinia pestis
uucuuccaacg

SEQ ID NO: 2247544 - RNA, 21 nt, Yersinia pestis
uucuucauugcugcuguuauu

SEQ ID NO: 2247545 - RNA, 14 nt, Yersinia pestis
uucucauuaauaau

SEQ ID NO: 2247546 - RNA, 16 nt, Yersinia pestis
uucucaucgcuuuuuu

SEQ ID NO: 2247547 - RNA, 18 nt, Yersinia pestis
uucucgacauccaauuca

SEQ ID NO: 2247548 - RNA, 16 nt, Yersinia pestis
uucucauuaauaauga

SEQ ID NO: 2247549 - RNA, 24 nt, Yersinia pestis
uucuaguauucaggaaugcucuuu

SEQ ID NO: 2247550 - RNA, 17 nt, Yersinia pestis
uucuagcucuuccagca

SEQ ID NO: 2247551 - RNA, 13 nt, Yersinia pestis
uucgguggcccug

SEQ ID NO: 2247552 - RNA, 16 nt, Yersinia pestis
uucggcaggcagaaau

SEQ ID NO: 2247553 - RNA, 14 nt, Yersinia pestis
uucgucucaucaau

SEQ ID NO: 2247554 - RNA, 12 nt, Yersinia pestis
uucgugaaagca

SEQ ID NO: 2247555 - RNA, 22 nt, Yersinia pestis
uucguggaaaucgggugauaaa

SEQ ID NO: 2247556 - RNA, 23 nt, Yersinia pestis
uucuaaaugcuggcggaaauauc

SEQ ID NO: 2247557 - RNA, 19 nt, Yersinia pestis
uucuaaccaggugcagaua

SEQ ID NO: 2247558 - RNA, 16 nt, Yersinia pestis
uucguuagcucuucac

SEQ ID NO: 2247559 - RNA, 16 nt, Yersinia pestis
uucguguauaucacua

SEQ ID NO: 2247560 - RNA, 13 nt, Yersinia pestis
uucguguauauca

SEQ ID NO: 2247561 - RNA, 13 nt, Yersinia pestis
gagucacagcauu

SEQ ID NO: 2247562 - RNA, 17 nt, Yersinia pestis
gagucagggagucaggg

SEQ ID NO: 2247563 - RNA, 13 nt, Yersinia pestis
gagucagcacaga

SEQ ID NO: 2247564 - RNA, 14 nt, Yersinia pestis
gagucagcacagaa

SEQ ID NO: 2247565 - RNA, 15 nt, Yersinia pestis
gagucacugggguga

SEQ ID NO: 2247566 - RNA, 23 nt, Yersinia pestis
gagucacuggggugaaucaaaac

SEQ ID NO: 2247567 - RNA, 17 nt, Yersinia pestis
gaguaucaauauugugc

SEQ ID NO: 2247568 - RNA, 22 nt, Yersinia pestis
gaguauguauccaucugaugag

SEQ ID NO: 2247569 - RNA, 19 nt, Yersinia pestis
gaguauacggucaaaagcu

SEQ ID NO: 2247570 - RNA, 15 nt, Yersinia pestis
gagucaucgggguuu

SEQ ID NO: 2247571 - RNA, 16 nt, Yersinia pestis
gagucagucaggguga

SEQ ID NO: 2247572 - RNA, 21 nt, Yersinia pestis
gagucaguacggagaauauag

SEQ ID NO: 2247573 - RNA, 13 nt, Yersinia pestis
gagucagucaggg

SEQ ID NO: 2247574 - RNA, 15 nt, Yersinia pestis
gagucgcuccucagc

SEQ ID NO: 2247575 - RNA, 18 nt, Yersinia pestis
gagucuauugaaaaaaua

SEQ ID NO: 2247576 - RNA, 15 nt, Yersinia pestis
gagucucagggguga

SEQ ID NO: 2247577 - RNA, 14 nt, Yersinia pestis
gagugaugaaacca

SEQ ID NO: 2247578 - RNA, 23 nt, Yersinia pestis
gagugcauccagcguaaacagua

SEQ ID NO: 2247579 - RNA, 11 nt, Yersinia pestis
gauaaaaccac

SEQ ID NO: 2247580 - RNA, 16 nt, Yersinia pestis
gauaaaaaucuuuuaa

SEQ ID NO: 2247581 - RNA, 12 nt, Yersinia pestis
gauaaaaaugca

SEQ ID NO: 2247582 - RNA, 19 nt, Yersinia pestis
gauaaaaggcuauuuaaau

SEQ ID NO: 2247583 - RNA, 18 nt, Yersinia pestis
gauaaaaggcuauuuaaa

SEQ ID NO: 2247584 - RNA, 17 nt, Yersinia pestis
gauaaaacuauucugcu

SEQ ID NO: 2247585 - RNA, 18 nt, Yersinia pestis
gauaaaagaaagggcaac

SEQ ID NO: 2247586 - RNA, 23 nt, Yersinia pestis
gauaaaagaaagggcaacgacau

SEQ ID NO: 2247587 - RNA, 23 nt, Yersinia pestis
gauaaaggcaaaagcaucaccaa

SEQ ID NO: 2247588 - RNA, 22 nt, Yersinia pestis
gauaaacaauaaacagacuaaa

SEQ ID NO: 2247589 - RNA, 15 nt, Yersinia pestis
gauaaacaaauauga

SEQ ID NO: 2247590 - RNA, 15 nt, Yersinia pestis
gauaaaaaacgggcu

SEQ ID NO: 2247591 - RNA, 20 nt, Yersinia pestis
gauaaaaagaauaaguagcu

SEQ ID NO: 2247592 - RNA, 14 nt, Yersinia pestis
gaguucucaccaag

SEQ ID NO: 2247593 - RNA, 11 nt, Yersinia pestis
gaguucaacgu

SEQ ID NO: 2247594 - RNA, 21 nt, Yersinia pestis
gaguuaucuguuucaaauaag

SEQ ID NO: 2247595 - RNA, 17 nt, Yersinia pestis
gauacuugaaacagcag

SEQ ID NO: 2247596 - RNA, 20 nt, Yersinia pestis
gauacuuucggguaucuguu

SEQ ID NO: 2247597 - RNA, 16 nt, Yersinia pestis
gauagauuucacugcc

SEQ ID NO: 2247598 - RNA, 13 nt, Yersinia pestis
gauagauuuucag

SEQ ID NO: 2247599 - RNA, 18 nt, Yersinia pestis
gauagcaacauucaacgc

SEQ ID NO: 2247600 - RNA, 16 nt, Yersinia pestis
gauacgcgccgcagca

SEQ ID NO: 2247601 - RNA, 14 nt, Yersinia pestis
gauacgguccagca

SEQ ID NO: 2247602 - RNA, 19 nt, Yersinia pestis
gauacugcauuucaacaaa

SEQ ID NO: 2247603 - RNA, 14 nt, Yersinia pestis
gauacuggaagaaa

SEQ ID NO: 2247604 - RNA, 14 nt, Yersinia pestis
gauacaucaaauca

SEQ ID NO: 2247605 - RNA, 16 nt, Yersinia pestis
gauacagcccaagaga

SEQ ID NO: 2247606 - RNA, 14 nt, Yersinia pestis
gauacaccaacgca

SEQ ID NO: 2247607 - RNA, 13 nt, Yersinia pestis
gauacaauuuuug

SEQ ID NO: 2247608 - RNA, 18 nt, Yersinia pestis
gauacccuucaucuuuca

SEQ ID NO: 2247609 - RNA, 18 nt, Yersinia pestis
gauaccacccguugcauu

SEQ ID NO: 2247610 - RNA, 17 nt, Yersinia pestis
gauaauaaccugauauu

SEQ ID NO: 2247611 - RNA, 20 nt, Yersinia pestis
gauaauaaauacccugcacc

SEQ ID NO: 2247612 - RNA, 21 nt, Yersinia pestis
gauaauaaaacggcucaucgc

SEQ ID NO: 2247613 - RNA, 21 nt, Yersinia pestis
gauaaucaaaacaccuaguua

SEQ ID NO: 2247614 - RNA, 17 nt, Yersinia pestis
gauaaucacguucaacu

SEQ ID NO: 2247615 - RNA, 19 nt, Yersinia pestis
gauaaccucucgccgguua

SEQ ID NO: 2247616 - RNA, 13 nt, Yersinia pestis
gauaaauaaaaua

SEQ ID NO: 2247617 - RNA, 15 nt, Yersinia pestis
gauaaauaaccgagc

SEQ ID NO: 2247618 - RNA, 19 nt, Yersinia pestis
gauaacgcuaagcgucuca

SEQ ID NO: 2247619 - RNA, 23 nt, Yersinia pestis
gauaacggcuggucgcuggguuc

SEQ ID NO: 2247620 - RNA, 23 nt, Yersinia pestis
gauaauuucuacgccgucaucau

SEQ ID NO: 2247621 - RNA, 23 nt, Yersinia pestis
gauacaacaacgggucacagcca

SEQ ID NO: 2247622 - RNA, 16 nt, Yersinia pestis
gauaauuuaauuaguu

SEQ ID NO: 2247623 - RNA, 18 nt, Yersinia pestis
gauaauuauccauuuucu

SEQ ID NO: 2247624 - RNA, 21 nt, Yersinia pestis
gauaauuauccauuuucugcc

SEQ ID NO: 2247625 - RNA, 14 nt, Yersinia pestis
gauaauuaauucaa

SEQ ID NO: 2247626 - RNA, 20 nt, Yersinia pestis
gauaaucuccauugauucac

SEQ ID NO: 2247627 - RNA, 12 nt, Yersinia pestis
gauaaucuggca

SEQ ID NO: 2247628 - RNA, 13 nt, Yersinia pestis
gauagcaaucaau

SEQ ID NO: 2247629 - RNA, 16 nt, Yersinia pestis
gauaucagccagugcu

SEQ ID NO: 2247630 - RNA, 17 nt, Yersinia pestis
gauauccagugccaaaa

SEQ ID NO: 2247631 - RNA, 19 nt, Yersinia pestis
gauauccagugccaaaaua

SEQ ID NO: 2247632 - RNA, 12 nt, Yersinia pestis
gauaucucuuua

SEQ ID NO: 2247633 - RNA, 21 nt, Yersinia pestis
gauaucuaaguccaagacaga

SEQ ID NO: 2247634 - RNA, 21 nt, Yersinia pestis
gauaucgccaacguguauucc

SEQ ID NO: 2247635 - RNA, 17 nt, Yersinia pestis
gauauugcgcaguaaau

SEQ ID NO: 2247636 - RNA, 13 nt, Yersinia pestis
gauauugaugacg

SEQ ID NO: 2247637 - RNA, 14 nt, Yersinia pestis
gauauugaugacgc

SEQ ID NO: 2247638 - RNA, 20 nt, Yersinia pestis
gauaugacagaaaaaucaca

SEQ ID NO: 2247639 - RNA, 14 nt, Yersinia pestis
gauaugaauauccg

SEQ ID NO: 2247640 - RNA, 20 nt, Yersinia pestis
gauaugaugcggaagaaggc

SEQ ID NO: 2247641 - RNA, 22 nt, Yersinia pestis
gauaugcauuauugauguuauu

SEQ ID NO: 2247642 - RNA, 16 nt, Yersinia pestis
gauaugacuaaacuga

SEQ ID NO: 2247643 - RNA, 20 nt, Yersinia pestis
gauaugccggggauauuuug

SEQ ID NO: 2247644 - RNA, 17 nt, Yersinia pestis
gaucagcguauaaaacu

SEQ ID NO: 2247645 - RNA, 23 nt, Yersinia pestis
gauccaaaacaucggccagcguc

SEQ ID NO: 2247646 - RNA, 22 nt, Yersinia pestis
gaucagguuguccgaagagaaa

SEQ ID NO: 2247647 - RNA, 16 nt, Yersinia pestis
gaucagugaagagaua

SEQ ID NO: 2247648 - RNA, 13 nt, Yersinia pestis
gaucaguggcuua

SEQ ID NO: 2247649 - RNA, 22 nt, Yersinia pestis
gaucauggcuugugcagcaaua

SEQ ID NO: 2247650 - RNA, 16 nt, Yersinia pestis
gauauuuauuaaaaca

SEQ ID NO: 2247651 - RNA, 17 nt, Yersinia pestis
gauauuuauuaaaacac

SEQ ID NO: 2247652 - RNA, 14 nt, Yersinia pestis
gauauuuauuuacu

SEQ ID NO: 2247653 - RNA, 19 nt, Yersinia pestis
gauauuuauuuauuuccgc

SEQ ID NO: 2247654 - RNA, 17 nt, Yersinia pestis
gauauuuauuuccagau

SEQ ID NO: 2247655 - RNA, 18 nt, Yersinia pestis
gaucaacgccucacaacu

SEQ ID NO: 2247656 - RNA, 13 nt, Yersinia pestis
gaucaaccauuca

SEQ ID NO: 2247657 - RNA, 13 nt, Yersinia pestis
gaucagcauuucg

SEQ ID NO: 2247658 - RNA, 17 nt, Yersinia pestis
gaucagccaucagcgcc

SEQ ID NO: 2247659 - RNA, 17 nt, Yersinia pestis
gaucgaucucuuuauau

SEQ ID NO: 2247660 - RNA, 19 nt, Yersinia pestis
gaucgccaguuugcgacca

SEQ ID NO: 2247661 - RNA, 16 nt, Yersinia pestis
gaucggauaguuaucu

SEQ ID NO: 2247662 - RNA, 13 nt, Yersinia pestis
gaucgcugccacc

SEQ ID NO: 2247663 - RNA, 14 nt, Yersinia pestis
gaucgcugccaccg

SEQ ID NO: 2247664 - RNA, 15 nt, Yersinia pestis
gauccgggaaaaaau

SEQ ID NO: 2247665 - RNA, 16 nt, Yersinia pestis
gauccguuuaaucagu

SEQ ID NO: 2247666 - RNA, 19 nt, Yersinia pestis
gauccuggguuuuauugca

SEQ ID NO: 2247667 - RNA, 14 nt, Yersinia pestis
gauccaccacauca

SEQ ID NO: 2247668 - RNA, 16 nt, Yersinia pestis
gauccacuacuuauuu

SEQ ID NO: 2247669 - RNA, 18 nt, Yersinia pestis
gauccacuuauaucucca

SEQ ID NO: 2247670 - RNA, 17 nt, Yersinia pestis
gauccagcaacguaaca

SEQ ID NO: 2247671 - RNA, 21 nt, Yersinia pestis
gauccgauaauaauuccauga

SEQ ID NO: 2247672 - RNA, 22 nt, Yersinia pestis
gauccgcgauaacguuguuucu

SEQ ID NO: 2247673 - RNA, 23 nt, Yersinia pestis
gaugaaugacuggcuauuagaau

SEQ ID NO: 2247674 - RNA, 20 nt, Yersinia pestis
gaugaauaugcuucaucacu

SEQ ID NO: 2247675 - RNA, 17 nt, Yersinia pestis
gaucguccggcagggug

SEQ ID NO: 2247676 - RNA, 13 nt, Yersinia pestis
gaugaauuuaucc

SEQ ID NO: 2247677 - RNA, 16 nt, Yersinia pestis
gaugacaaugcguuau

SEQ ID NO: 2247678 - RNA, 22 nt, Yersinia pestis
gaugacaacaccguaacgcccu

SEQ ID NO: 2247679 - RNA, 18 nt, Yersinia pestis
gaugacaggggauagcaa

SEQ ID NO: 2247680 - RNA, 14 nt, Yersinia pestis
gaugagaaguaaaa

SEQ ID NO: 2247681 - RNA, 14 nt, Yersinia pestis
gaugaucucuggcc

SEQ ID NO: 2247682 - RNA, 21 nt, Yersinia pestis
gaugcauauuauuaaugaaau

SEQ ID NO: 2247683 - RNA, 23 nt, Yersinia pestis
gaugcauauuauuaaugaaauua

SEQ ID NO: 2247684 - RNA, 19 nt, Yersinia pestis
gaugccaaauuaaucuugu

SEQ ID NO: 2247685 - RNA, 20 nt, Yersinia pestis
gaugccaaucaaaaaaccgg

SEQ ID NO: 2247686 - RNA, 21 nt, Yersinia pestis
gaugaugaagcauuaaacaga

SEQ ID NO: 2247687 - RNA, 21 nt, Yersinia pestis
gaugcuaaccgaauaaaaccu

SEQ ID NO: 2247688 - RNA, 22 nt, Yersinia pestis
gaugcuaaagcguaagugcaau

SEQ ID NO: 2247689 - RNA, 14 nt, Yersinia pestis
gaugcuuggcccga

SEQ ID NO: 2247690 - RNA, 17 nt, Yersinia pestis
gaugcuaacaacuucca

SEQ ID NO: 2247691 - RNA, 17 nt, Yersinia pestis
gaugcuaaccgaauaaa

SEQ ID NO: 2247692 - RNA, 18 nt, Yersinia pestis
gaugcuaaccgaauaaaa

SEQ ID NO: 2247693 - RNA, 15 nt, Yersinia pestis
gauggaguaaucauu

SEQ ID NO: 2247694 - RNA, 18 nt, Yersinia pestis
gauggauaaauucagccg

SEQ ID NO: 2247695 - RNA, 21 nt, Yersinia pestis
gauggcaaccccugccaauau

SEQ ID NO: 2247696 - RNA, 22 nt, Yersinia pestis
gaugccuuggugauacccagca

SEQ ID NO: 2247697 - RNA, 20 nt, Yersinia pestis
gaugccuucuuucaaaguga

SEQ ID NO: 2247698 - RNA, 14 nt, Yersinia pestis
gaugccuuguuucu

SEQ ID NO: 2247699 - RNA, 15 nt, Yersinia pestis
gauuaccugcauauc

SEQ ID NO: 2247700 - RNA, 19 nt, Yersinia pestis
gauuacgggucagcucacc

SEQ ID NO: 2247701 - RNA, 17 nt, Yersinia pestis
gauuaccugcauauccu

SEQ ID NO: 2247702 - RNA, 12 nt, Yersinia pestis
gauuacuggccg

SEQ ID NO: 2247703 - RNA, 16 nt, Yersinia pestis
gauuaauacaucauca

SEQ ID NO: 2247704 - RNA, 22 nt, Yersinia pestis
gauuaauaaguaaauauuaucu

SEQ ID NO: 2247705 - RNA, 17 nt, Yersinia pestis
gauuacugucauuuccu

SEQ ID NO: 2247706 - RNA, 15 nt, Yersinia pestis
gaugucccagaaaua

SEQ ID NO: 2247707 - RNA, 23 nt, Yersinia pestis
gaugucauaugcgguaaugacuu

SEQ ID NO: 2247708 - RNA, 19 nt, Yersinia pestis
gaugucagauuaguuuuag

SEQ ID NO: 2247709 - RNA, 14 nt, Yersinia pestis
gauguuucuuugcg

SEQ ID NO: 2247710 - RNA, 20 nt, Yersinia pestis
gauuaaccuuaucaccaacg

SEQ ID NO: 2247711 - RNA, 19 nt, Yersinia pestis
gauuaaccuguaaaagcag

SEQ ID NO: 2247712 - RNA, 20 nt, Yersinia pestis
gauggugccgucaacaggag

SEQ ID NO: 2247713 - RNA, 22 nt, Yersinia pestis
gauggugcgccauuaaggccac

SEQ ID NO: 2247714 - RNA, 24 nt, Yersinia pestis
gaugguggcauaacguaaugucug

SEQ ID NO: 2247715 - RNA, 12 nt, Yersinia pestis
gauguaacagcg

SEQ ID NO: 2247716 - RNA, 14 nt, Yersinia pestis
gauguaaucugaau

SEQ ID NO: 2247717 - RNA, 14 nt, Yersinia pestis
gauggucaacuaaa

SEQ ID NO: 2247718 - RNA, 12 nt, Yersinia pestis
gaugggccaaac

SEQ ID NO: 2247719 - RNA, 16 nt, Yersinia pestis
gaugggaggaaacugc

SEQ ID NO: 2247720 - RNA, 13 nt, Yersinia pestis
gauuauuaaacua

SEQ ID NO: 2247721 - RNA, 16 nt, Yersinia pestis
gauuauuguuauccac

SEQ ID NO: 2247722 - RNA, 15 nt, Yersinia pestis
gauucucggcgggga

SEQ ID NO: 2247723 - RNA, 16 nt, Yersinia pestis
gauucucuauucugcu

SEQ ID NO: 2247724 - RNA, 17 nt, Yersinia pestis
gauuauuuauuuacagc

SEQ ID NO: 2247725 - RNA, 19 nt, Yersinia pestis
gauugagagaccagggcac

SEQ ID NO: 2247726 - RNA, 15 nt, Yersinia pestis
gauugaucaguggcu

SEQ ID NO: 2247727 - RNA, 22 nt, Yersinia pestis
gauuggagucaugaggcaguga

SEQ ID NO: 2247728 - RNA, 19 nt, Yersinia pestis
gauuggacccgucaccaca

SEQ ID NO: 2247729 - RNA, 14 nt, Yersinia pestis
gauugcugccaacg

SEQ ID NO: 2247730 - RNA, 21 nt, Yersinia pestis
gauuggcacccucuagcagcg

SEQ ID NO: 2247731 - RNA, 18 nt, Yersinia pestis
gauuguuacgccuucagc

SEQ ID NO: 2247732 - RNA, 13 nt, Yersinia pestis
gauuuaaacccuc

SEQ ID NO: 2247733 - RNA, 15 nt, Yersinia pestis
gauuuaaaaucccuc

SEQ ID NO: 2247734 - RNA, 12 nt, Yersinia pestis
gauuuaauccaa

SEQ ID NO: 2247735 - RNA, 13 nt, Yersinia pestis
gauuuaaugguuu

SEQ ID NO: 2247736 - RNA, 24 nt, Yersinia pestis
gauuucaccuauaauuaacagcau

SEQ ID NO: 2247737 - RNA, 13 nt, Yersinia pestis
gauuugaaccgcu

SEQ ID NO: 2247738 - RNA, 21 nt, Yersinia pestis
gauuugaaccgcuaucugcug

SEQ ID NO: 2247739 - RNA, 22 nt, Yersinia pestis
gauuucaggucgcaagcaauau

SEQ ID NO: 2247740 - RNA, 14 nt, Yersinia pestis
gauuucaucauuca

SEQ ID NO: 2247741 - RNA, 14 nt, Yersinia pestis
gauuucuucauuua

SEQ ID NO: 2247742 - RNA, 15 nt, Yersinia pestis
gauuucagcaccaua

SEQ ID NO: 2247743 - RNA, 20 nt, Yersinia pestis
gcaaaaacagucauuaacac

SEQ ID NO: 2247744 - RNA, 14 nt, Yersinia pestis
gcaaaaaauauuaa

SEQ ID NO: 2247745 - RNA, 18 nt, Yersinia pestis
gcaaaaacgccaucaaua

SEQ ID NO: 2247746 - RNA, 17 nt, Yersinia pestis
gcaaaaagaauuaauaa

SEQ ID NO: 2247747 - RNA, 17 nt, Yersinia pestis
gcaaaaauauacccgac

SEQ ID NO: 2247748 - RNA, 18 nt, Yersinia pestis
gcaaaucauaaaucaagg

SEQ ID NO: 2247749 - RNA, 19 nt, Yersinia pestis
gcaaauuaacacaucaaaa

SEQ ID NO: 2247750 - RNA, 18 nt, Yersinia pestis
gcaaauggcuuauuucac

SEQ ID NO: 2247751 - RNA, 14 nt, Yersinia pestis
gcaaagucaucaaa

SEQ ID NO: 2247752 - RNA, 22 nt, Yersinia pestis
gcaaaguauuuauacauaccac

SEQ ID NO: 2247753 - RNA, 15 nt, Yersinia pestis
gcaaauaaacaaaau

SEQ ID NO: 2247754 - RNA, 21 nt, Yersinia pestis
gcaaagugcugcaaggcauua

SEQ ID NO: 2247755 - RNA, 16 nt, Yersinia pestis
gcaaagcgggccagca

SEQ ID NO: 2247756 - RNA, 15 nt, Yersinia pestis
gcaaaauagcacaga

SEQ ID NO: 2247757 - RNA, 17 nt, Yersinia pestis
gcaaaaucccagcagca

SEQ ID NO: 2247758 - RNA, 13 nt, Yersinia pestis
gcaaaaugccaac

SEQ ID NO: 2247759 - RNA, 21 nt, Yersinia pestis
gcaaagacuuuuccaacggcu

SEQ ID NO: 2247760 - RNA, 23 nt, Yersinia pestis
gcaaagagaacgggcaaccugua

SEQ ID NO: 2247761 - RNA, 18 nt, Yersinia pestis
gcaaagagacugggcugc

SEQ ID NO: 2247762 - RNA, 15 nt, Yersinia pestis
gcaaacgaacgaaua

SEQ ID NO: 2247763 - RNA, 18 nt, Yersinia pestis
gcaaacgaacgaauaauu

SEQ ID NO: 2247764 - RNA, 18 nt, Yersinia pestis
gcaaaccugguuugcgcc

SEQ ID NO: 2247765 - RNA, 23 nt, Yersinia pestis
gcaaacgccgcucuucagcauca

SEQ ID NO: 2247766 - RNA, 20 nt, Yersinia pestis
gcagugcguaaucagccgcg

SEQ ID NO: 2247767 - RNA, 14 nt, Yersinia pestis
gcagugcagcaaaa

SEQ ID NO: 2247768 - RNA, 17 nt, Yersinia pestis
gcagugcagccaagauc

SEQ ID NO: 2247769 - RNA, 20 nt, Yersinia pestis
gcagugcacgggaaaugagc

SEQ ID NO: 2247770 - RNA, 17 nt, Yersinia pestis
gcauagacgaaggcacg

SEQ ID NO: 2247771 - RNA, 16 nt, Yersinia pestis
gcauacguugccagcc

SEQ ID NO: 2247772 - RNA, 19 nt, Yersinia pestis
gcauacgugccaaaaugcc

SEQ ID NO: 2247773 - RNA, 13 nt, Yersinia pestis
gcauauaaaacac

SEQ ID NO: 2247774 - RNA, 23 nt, Yersinia pestis
gcauauacuggagcuauggaaga

SEQ ID NO: 2247775 - RNA, 20 nt, Yersinia pestis
gcauaucaaugcaacuggca

SEQ ID NO: 2247776 - RNA, 21 nt, Yersinia pestis
gcauauacagcccgguaucac

SEQ ID NO: 2247777 - RNA, 13 nt, Yersinia pestis
gcaggucugcaug

SEQ ID NO: 2247778 - RNA, 15 nt, Yersinia pestis
gcagggcauucgccu

SEQ ID NO: 2247779 - RNA, 22 nt, Yersinia pestis
gcaggcuuucacgcuccacacc

SEQ ID NO: 2247780 - RNA, 22 nt, Yersinia pestis
gcagggaaagguagaucgggga

SEQ ID NO: 2247781 - RNA, 19 nt, Yersinia pestis
gcagucagccacaaaaguu

SEQ ID NO: 2247782 - RNA, 22 nt, Yersinia pestis
gcagucgauaaacaucaugaca

SEQ ID NO: 2247783 - RNA, 21 nt, Yersinia pestis
gcaucacgauagccagugaca

SEQ ID NO: 2247784 - RNA, 22 nt, Yersinia pestis
gcaucacuucauacacggcggc

SEQ ID NO: 2247785 - RNA, 18 nt, Yersinia pestis
gcaucagcaaaguauuua

SEQ ID NO: 2247786 - RNA, 17 nt, Yersinia pestis
gcaucagacggcagcaa

SEQ ID NO: 2247787 - RNA, 16 nt, Yersinia pestis
gcaucagcccauugcu

SEQ ID NO: 2247788 - RNA, 13 nt, Yersinia pestis
gcaucagccagcc

SEQ ID NO: 2247789 - RNA, 18 nt, Yersinia pestis
gcaucagcccauugcugu

SEQ ID NO: 2247790 - RNA, 19 nt, Yersinia pestis
gcaucaguaacuucucucc

SEQ ID NO: 2247791 - RNA, 11 nt, Yersinia pestis
gcaucaucgca

SEQ ID NO: 2247792 - RNA, 13 nt, Yersinia pestis
gcaucauccagcu

SEQ ID NO: 2247793 - RNA, 21 nt, Yersinia pestis
gcaucaucaguauugacgaug

SEQ ID NO: 2247794 - RNA, 12 nt, Yersinia pestis
gcaucauacuga

SEQ ID NO: 2247795 - RNA, 16 nt, Yersinia pestis
gcaucauacugacggg

SEQ ID NO: 2247796 - RNA, 18 nt, Yersinia pestis
gcauauuuuggcaacuca

SEQ ID NO: 2247797 - RNA, 23 nt, Yersinia pestis
gcauauuuuggcaacucagcacg

SEQ ID NO: 2247798 - RNA, 16 nt, Yersinia pestis
gcauauuuuuagucua

SEQ ID NO: 2247799 - RNA, 17 nt, Yersinia pestis
gcauauuuuuagucuau

SEQ ID NO: 2247800 - RNA, 12 nt, Yersinia pestis
gcauaugaaaaa

SEQ ID NO: 2247801 - RNA, 22 nt, Yersinia pestis
gcauaugaaaaaccuccggcua

SEQ ID NO: 2247802 - RNA, 18 nt, Yersinia pestis
gcauaugaguuucaaaua

SEQ ID NO: 2247803 - RNA, 13 nt, Yersinia pestis
gcauauuacccag

SEQ ID NO: 2247804 - RNA, 18 nt, Yersinia pestis
gcauauuauuaaugaaau

SEQ ID NO: 2247805 - RNA, 16 nt, Yersinia pestis
gcaucaaccaagacau

SEQ ID NO: 2247806 - RNA, 20 nt, Yersinia pestis
gcaucaccgguuuacccugc

SEQ ID NO: 2247807 - RNA, 16 nt, Yersinia pestis
gcaucaccaaacagug

SEQ ID NO: 2247808 - RNA, 23 nt, Yersinia pestis
gcauccccacugacaucauuuua

SEQ ID NO: 2247809 - RNA, 19 nt, Yersinia pestis
gcauccccacuuguaccug

SEQ ID NO: 2247810 - RNA, 15 nt, Yersinia pestis
gcaucccagccacca

SEQ ID NO: 2247811 - RNA, 19 nt, Yersinia pestis
gcauccaagccaucauuag

SEQ ID NO: 2247812 - RNA, 14 nt, Yersinia pestis
gcauccgcccacac

SEQ ID NO: 2247813 - RNA, 19 nt, Yersinia pestis
gcauccggcgguaaaucug

SEQ ID NO: 2247814 - RNA, 20 nt, Yersinia pestis
gcaucgaguccguuaaaaaa

SEQ ID NO: 2247815 - RNA, 15 nt, Yersinia pestis
gcaucgacgagcggc

SEQ ID NO: 2247816 - RNA, 22 nt, Yersinia pestis
gcagcagugccugguuuuacgc

SEQ ID NO: 2247817 - RNA, 18 nt, Yersinia pestis
gcagcaucccaaugaaua

SEQ ID NO: 2247818 - RNA, 13 nt, Yersinia pestis
gcagcaggucucg

SEQ ID NO: 2247819 - RNA, 21 nt, Yersinia pestis
gcagcaccaauaucaauauuc

SEQ ID NO: 2247820 - RNA, 21 nt, Yersinia pestis
gcagcaaaaccaagcugauga

SEQ ID NO: 2247821 - RNA, 16 nt, Yersinia pestis
gcagcaaaaccaagcu

SEQ ID NO: 2247822 - RNA, 22 nt, Yersinia pestis
gcacugugagcggcauccagua

SEQ ID NO: 2247823 - RNA, 15 nt, Yersinia pestis
gcacugguugcuuca

SEQ ID NO: 2247824 - RNA, 23 nt, Yersinia pestis
gcacugggucaucacccagcaaa

SEQ ID NO: 2247825 - RNA, 22 nt, Yersinia pestis
gcacugggaucugaucaaucuc

SEQ ID NO: 2247826 - RNA, 14 nt, Yersinia pestis
gcaggaaacaugcu

SEQ ID NO: 2247827 - RNA, 12 nt, Yersinia pestis
gcaggcaaacaa

SEQ ID NO: 2247828 - RNA, 21 nt, Yersinia pestis
gcaggccccaucauaaaggcu

SEQ ID NO: 2247829 - RNA, 17 nt, Yersinia pestis
gcaggccccaucauaaa

SEQ ID NO: 2247830 - RNA, 17 nt, Yersinia pestis
gcagcguauucaguaaa

SEQ ID NO: 2247831 - RNA, 15 nt, Yersinia pestis
gcagcgucaaggucg

SEQ ID NO: 2247832 - RNA, 17 nt, Yersinia pestis
gcagcgcgcagccaacg

SEQ ID NO: 2247833 - RNA, 21 nt, Yersinia pestis
gcaauuggccuuccaucguca

SEQ ID NO: 2247834 - RNA, 20 nt, Yersinia pestis
gcaauucaauauaggguugu

SEQ ID NO: 2247835 - RNA, 14 nt, Yersinia pestis
gcaauggugauaaa

SEQ ID NO: 2247836 - RNA, 19 nt, Yersinia pestis
gcaauggcgcgucaucgcg

SEQ ID NO: 2247837 - RNA, 20 nt, Yersinia pestis
gcaauggcucaggcucauca

SEQ ID NO: 2247838 - RNA, 15 nt, Yersinia pestis
gcaauguucaaaucu

SEQ ID NO: 2247839 - RNA, 13 nt, Yersinia pestis
gcaauuaauacaa

SEQ ID NO: 2247840 - RNA, 12 nt, Yersinia pestis
gcaauuucucug

SEQ ID NO: 2247841 - RNA, 23 nt, Yersinia pestis
gcacaacggaaggcccagccggg

SEQ ID NO: 2247842 - RNA, 22 nt, Yersinia pestis
gcacaaucgcgcuguacaacaa

SEQ ID NO: 2247843 - RNA, 14 nt, Yersinia pestis
gcacauaaagcgca

SEQ ID NO: 2247844 - RNA, 18 nt, Yersinia pestis
gcacaucaaguacuucaa

SEQ ID NO: 2247845 - RNA, 24 nt, Yersinia pestis
gcacaucaauauaaaacaucucuu

SEQ ID NO: 2247846 - RNA, 13 nt, Yersinia pestis
gcacacaucuguc

SEQ ID NO: 2247847 - RNA, 14 nt, Yersinia pestis
gcacacaucugucg

SEQ ID NO: 2247848 - RNA, 19 nt, Yersinia pestis
gcacacaguuauuaggcau

SEQ ID NO: 2247849 - RNA, 20 nt, Yersinia pestis
gcacacaguuauuaggcauu

SEQ ID NO: 2247850 - RNA, 19 nt, Yersinia pestis
gcacacagaugcuggcuuu

SEQ ID NO: 2247851 - RNA, 17 nt, Yersinia pestis
gcacacugacagcaacg

SEQ ID NO: 2247852 - RNA, 16 nt, Yersinia pestis
gcaccaagaaaaccca

SEQ ID NO: 2247853 - RNA, 17 nt, Yersinia pestis
gcaccaaccauugacua

SEQ ID NO: 2247854 - RNA, 12 nt, Yersinia pestis
gcaaugaaagug

SEQ ID NO: 2247855 - RNA, 21 nt, Yersinia pestis
gcaaugcuaccuguaacauua

SEQ ID NO: 2247856 - RNA, 14 nt, Yersinia pestis
gcaauggcgaugag

SEQ ID NO: 2247857 - RNA, 18 nt, Yersinia pestis
gcaaucuccaguaaaucu

SEQ ID NO: 2247858 - RNA, 19 nt, Yersinia pestis
gcaaucucugcaguacaga

SEQ ID NO: 2247859 - RNA, 15 nt, Yersinia pestis
gcaaucacaaccccc

SEQ ID NO: 2247860 - RNA, 22 nt, Yersinia pestis
gcaaucaauguauugcuccaga

SEQ ID NO: 2247861 - RNA, 16 nt, Yersinia pestis
gcaauaggcuauuuua

SEQ ID NO: 2247862 - RNA, 13 nt, Yersinia pestis
gcaauagccaugg

SEQ ID NO: 2247863 - RNA, 18 nt, Yersinia pestis
gcaauauauggccauuac

SEQ ID NO: 2247864 - RNA, 22 nt, Yersinia pestis
gcaauauauggccauuaccccg

SEQ ID NO: 2247865 - RNA, 23 nt, Yersinia pestis
gcaaguaaaagucagcaaaucaa

SEQ ID NO: 2247866 - RNA, 21 nt, Yersinia pestis
gcaaguggggggagugugccg

SEQ ID NO: 2247867 - RNA, 14 nt, Yersinia pestis
gcaagugugcagga

SEQ ID NO: 2247868 - RNA, 12 nt, Yersinia pestis
gcaaauuuaucc

SEQ ID NO: 2247869 - RNA, 23 nt, Yersinia pestis
gcaaauuuaugcgcuuucucgac

SEQ ID NO: 2247870 - RNA, 17 nt, Yersinia pestis
gcaaauugcugaaaaaa

SEQ ID NO: 2247871 - RNA, 17 nt, Yersinia pestis
gcaacuucuacauagaa

SEQ ID NO: 2247872 - RNA, 20 nt, Yersinia pestis
gcaagaacaauccauccggu

SEQ ID NO: 2247873 - RNA, 22 nt, Yersinia pestis
gcaagaaacucccuucaaucaa

SEQ ID NO: 2247874 - RNA, 15 nt, Yersinia pestis
gcaagaaagaaaaau

SEQ ID NO: 2247875 - RNA, 21 nt, Yersinia pestis
gcaagaaagaaaaauagacuc

SEQ ID NO: 2247876 - RNA, 18 nt, Yersinia pestis
gcaaggggcuugagucgu

SEQ ID NO: 2247877 - RNA, 21 nt, Yersinia pestis
gcaagcgcugcuuuaaaggcu

SEQ ID NO: 2247878 - RNA, 23 nt, Yersinia pestis
gcaagcccccaaaguagaacugg

SEQ ID NO: 2247879 - RNA, 17 nt, Yersinia pestis
gcaagccaaaacagccu

SEQ ID NO: 2247880 - RNA, 22 nt, Yersinia pestis
gcaccuucaacgauauagagcu

SEQ ID NO: 2247881 - RNA, 16 nt, Yersinia pestis
gcaccugaucgugcca

SEQ ID NO: 2247882 - RNA, 15 nt, Yersinia pestis
gcaccucggggcacu

SEQ ID NO: 2247883 - RNA, 22 nt, Yersinia pestis
gcaccgaugucuaacaaacuca

SEQ ID NO: 2247884 - RNA, 13 nt, Yersinia pestis
gcaccgcccccuc

SEQ ID NO: 2247885 - RNA, 16 nt, Yersinia pestis
gcaccacuaaggucau

SEQ ID NO: 2247886 - RNA, 14 nt, Yersinia pestis
gcaccagcucaaua

SEQ ID NO: 2247887 - RNA, 13 nt, Yersinia pestis
gcacuaaaauauc

SEQ ID NO: 2247888 - RNA, 15 nt, Yersinia pestis
gcacuaaaaucugcu

SEQ ID NO: 2247889 - RNA, 22 nt, Yersinia pestis
gcacuaaaaucugcucccggca

SEQ ID NO: 2247890 - RNA, 16 nt, Yersinia pestis
gcacguuuaauuucac

SEQ ID NO: 2247891 - RNA, 14 nt, Yersinia pestis
gcacgugccgcugg

SEQ ID NO: 2247892 - RNA, 16 nt, Yersinia pestis
gcacuaucacaucaaa

SEQ ID NO: 2247893 - RNA, 12 nt, Yersinia pestis
gcacuaucaccg

SEQ ID NO: 2247894 - RNA, 16 nt, Yersinia pestis
gcacucagcauauugu

SEQ ID NO: 2247895 - RNA, 17 nt, Yersinia pestis
gcacuccagauaacaua

SEQ ID NO: 2247896 - RNA, 23 nt, Yersinia pestis
gcacuccagauaacauacaccau

SEQ ID NO: 2247897 - RNA, 15 nt, Yersinia pestis
gcacucauaaugcug

SEQ ID NO: 2247898 - RNA, 20 nt, Yersinia pestis
gcacugccccgaagcucaag

SEQ ID NO: 2247899 - RNA, 21 nt, Yersinia pestis
gcacugauuuuuucgaguagu

SEQ ID NO: 2247900 - RNA, 15 nt, Yersinia pestis
gcacugcagaaaaug

SEQ ID NO: 2247901 - RNA, 17 nt, Yersinia pestis
gcacugcagaaaaugcg

SEQ ID NO: 2247902 - RNA, 14 nt, Yersinia pestis
gcacugcucugccc

SEQ ID NO: 2247903 - RNA, 17 nt, Yersinia pestis
gcacuggcaauaaagag

SEQ ID NO: 2247904 - RNA, 20 nt, Yersinia pestis
gcacuggcaauaaagaggcc

SEQ ID NO: 2247905 - RNA, 18 nt, Yersinia pestis
gcacugcgcgaucccaga

SEQ ID NO: 2247906 - RNA, 22 nt, Yersinia pestis
gcacuccccgcccguagaaaau

SEQ ID NO: 2247907 - RNA, 16 nt, Yersinia pestis
gcacugaacaaugcca

SEQ ID NO: 2247908 - RNA, 12 nt, Yersinia pestis
gcacgggcuauc

SEQ ID NO: 2247909 - RNA, 15 nt, Yersinia pestis
gcacggcaacaggcu

SEQ ID NO: 2247910 - RNA, 14 nt, Yersinia pestis
gcacggcagugauc

SEQ ID NO: 2247911 - RNA, 16 nt, Yersinia pestis
gcacggccauuucuua

SEQ ID NO: 2247912 - RNA, 15 nt, Yersinia pestis
gcacgcuuucugcaa

SEQ ID NO: 2247913 - RNA, 20 nt, Yersinia pestis
gcccuuaucuacugggccaa

SEQ ID NO: 2247914 - RNA, 15 nt, Yersinia pestis
gcccuguuucauuuc

SEQ ID NO: 2247915 - RNA, 21 nt, Yersinia pestis
gcccuucagaugaauccagcc

SEQ ID NO: 2247916 - RNA, 19 nt, Yersinia pestis
gcccuucgggucaacgcug

SEQ ID NO: 2247917 - RNA, 14 nt, Yersinia pestis
gcccuuguaagaua

SEQ ID NO: 2247918 - RNA, 16 nt, Yersinia pestis
gcccuuuuugccuccc

SEQ ID NO: 2247919 - RNA, 18 nt, Yersinia pestis
gcccuuucgcagcccaau

SEQ ID NO: 2247920 - RNA, 17 nt, Yersinia pestis
gcccuuuugugcaucca

SEQ ID NO: 2247921 - RNA, 15 nt, Yersinia pestis
gccgaaaucucacca

SEQ ID NO: 2247922 - RNA, 14 nt, Yersinia pestis
gccgaaccugcaug

SEQ ID NO: 2247923 - RNA, 22 nt, Yersinia pestis
gccgacaauaccgccacacaau

SEQ ID NO: 2247924 - RNA, 18 nt, Yersinia pestis
gccgagcaagugaauaac

SEQ ID NO: 2247925 - RNA, 14 nt, Yersinia pestis
gccgagaacagaau

SEQ ID NO: 2247926 - RNA, 12 nt, Yersinia pestis
gccgacugcuga

SEQ ID NO: 2247927 - RNA, 13 nt, Yersinia pestis
gccgaguaaguca

SEQ ID NO: 2247928 - RNA, 15 nt, Yersinia pestis
gccgaguaaucagag

SEQ ID NO: 2247929 - RNA, 19 nt, Yersinia pestis
gccgauccgggaaaaaaua

SEQ ID NO: 2247930 - RNA, 23 nt, Yersinia pestis
gccgcaacagugacgggugagag

SEQ ID NO: 2247931 - RNA, 18 nt, Yersinia pestis
gcccugaguuaucuguuu

SEQ ID NO: 2247932 - RNA, 15 nt, Yersinia pestis
gcccugugaaucuuu

SEQ ID NO: 2247933 - RNA, 16 nt, Yersinia pestis
gcccuguugcccagca

SEQ ID NO: 2247934 - RNA, 14 nt, Yersinia pestis
gcccuguuucauuu

SEQ ID NO: 2247935 - RNA, 18 nt, Yersinia pestis
gcccuguaaugauggcga

SEQ ID NO: 2247936 - RNA, 12 nt, Yersinia pestis
gcccuacuggcu

SEQ ID NO: 2247937 - RNA, 15 nt, Yersinia pestis
gcccuacuggcugaa

SEQ ID NO: 2247938 - RNA, 20 nt, Yersinia pestis
gcccuaauauccucaaaauu

SEQ ID NO: 2247939 - RNA, 15 nt, Yersinia pestis
gcccgguugagugag

SEQ ID NO: 2247940 - RNA, 16 nt, Yersinia pestis
gcccgauccccugcuu

SEQ ID NO: 2247941 - RNA, 20 nt, Yersinia pestis
gcccgaugguggcagccugc

SEQ ID NO: 2247942 - RNA, 20 nt, Yersinia pestis
gccguuacccccgacgacuu

SEQ ID NO: 2247943 - RNA, 14 nt, Yersinia pestis
gccgugacuacggu

SEQ ID NO: 2247944 - RNA, 12 nt, Yersinia pestis
gccgucuggcua

SEQ ID NO: 2247945 - RNA, 23 nt, Yersinia pestis
gccguaucuucugccagccccaa

SEQ ID NO: 2247946 - RNA, 13 nt, Yersinia pestis
gccguagcauuca

SEQ ID NO: 2247947 - RNA, 13 nt, Yersinia pestis
gccgucaucaucu

SEQ ID NO: 2247948 - RNA, 16 nt, Yersinia pestis
gccguacaacaauaau

SEQ ID NO: 2247949 - RNA, 17 nt, Yersinia pestis
gccgcuaguuugacgcu

SEQ ID NO: 2247950 - RNA, 12 nt, Yersinia pestis
gccgcggcggcc

SEQ ID NO: 2247951 - RNA, 16 nt, Yersinia pestis
gccggauguaaaacac

SEQ ID NO: 2247952 - RNA, 23 nt, Yersinia pestis
gccggaauugcgcuucgcgcagc

SEQ ID NO: 2247953 - RNA, 21 nt, Yersinia pestis
gccgcuucggucucuggaugc

SEQ ID NO: 2247954 - RNA, 15 nt, Yersinia pestis
gccgcacacagcccu

SEQ ID NO: 2247955 - RNA, 14 nt, Yersinia pestis
gcaucuaaucggcu

SEQ ID NO: 2247956 - RNA, 19 nt, Yersinia pestis
gcaucuccgcgaccacaug

SEQ ID NO: 2247957 - RNA, 16 nt, Yersinia pestis
gcaucugaaagcuuca

SEQ ID NO: 2247958 - RNA, 21 nt, Yersinia pestis
gcaucugcaauggcuggcaag

SEQ ID NO: 2247959 - RNA, 13 nt, Yersinia pestis
gcaucugccacac

SEQ ID NO: 2247960 - RNA, 17 nt, Yersinia pestis
gcaucgccuguauuuua

SEQ ID NO: 2247961 - RNA, 12 nt, Yersinia pestis
gcaucgcgggcg

SEQ ID NO: 2247962 - RNA, 23 nt, Yersinia pestis
gcaucgcgggcgcgcugcugcuc

SEQ ID NO: 2247963 - RNA, 18 nt, Yersinia pestis
gcaucuuuugcuauugaa

SEQ ID NO: 2247964 - RNA, 17 nt, Yersinia pestis
gcaugaaugaaauauca

SEQ ID NO: 2247965 - RNA, 16 nt, Yersinia pestis
gcaugaaguuuaacca

SEQ ID NO: 2247966 - RNA, 19 nt, Yersinia pestis
gcaugacccaauggagauc

SEQ ID NO: 2247967 - RNA, 17 nt, Yersinia pestis
gcaugcccggucaugau

SEQ ID NO: 2247968 - RNA, 18 nt, Yersinia pestis
gcaugccaugcacuccac

SEQ ID NO: 2247969 - RNA, 18 nt, Yersinia pestis
gcaugccauccugccaac

SEQ ID NO: 2247970 - RNA, 14 nt, Yersinia pestis
gcaugccauccugc

SEQ ID NO: 2247971 - RNA, 23 nt, Yersinia pestis
gcauguuccuguugcuggccagu

SEQ ID NO: 2247972 - RNA, 15 nt, Yersinia pestis
gcauuaaaauaacaa

SEQ ID NO: 2247973 - RNA, 15 nt, Yersinia pestis
gcauuaaaaucaccc

SEQ ID NO: 2247974 - RNA, 22 nt, Yersinia pestis
gcauuaaggcgcgacugauuga

SEQ ID NO: 2247975 - RNA, 19 nt, Yersinia pestis
gcauuagacauucaagccu

SEQ ID NO: 2247976 - RNA, 15 nt, Yersinia pestis
gcaugggcuugcaua

SEQ ID NO: 2247977 - RNA, 14 nt, Yersinia pestis
gcauggaucacccg

SEQ ID NO: 2247978 - RNA, 21 nt, Yersinia pestis
gcauucauaucguccaaaggg

SEQ ID NO: 2247979 - RNA, 15 nt, Yersinia pestis
gcauucauuucuuug

SEQ ID NO: 2247980 - RNA, 22 nt, Yersinia pestis
gcauucagguguucagccaagu

SEQ ID NO: 2247981 - RNA, 23 nt, Yersinia pestis
gcauugacgauaucaauaaagaa

SEQ ID NO: 2247982 - RNA, 17 nt, Yersinia pestis
gcauugaccgccaaauc

SEQ ID NO: 2247983 - RNA, 24 nt, Yersinia pestis
gcauugugcuuuuuggcaaacuca

SEQ ID NO: 2247984 - RNA, 16 nt, Yersinia pestis
gcauuguuggcccgca

SEQ ID NO: 2247985 - RNA, 22 nt, Yersinia pestis
gcauuguuuggucgguaagcug

SEQ ID NO: 2247986 - RNA, 19 nt, Yersinia pestis
gcauuguuggguaaucauc

SEQ ID NO: 2247987 - RNA, 21 nt, Yersinia pestis
gcauuguuggcccgcaucuuu

SEQ ID NO: 2247988 - RNA, 19 nt, Yersinia pestis
gcauuuaauguucgcugac

SEQ ID NO: 2247989 - RNA, 15 nt, Yersinia pestis
gcauuucauuaaaug

SEQ ID NO: 2247990 - RNA, 20 nt, Yersinia pestis
gcauuggguaauaucaccau

SEQ ID NO: 2247991 - RNA, 22 nt, Yersinia pestis
gcauugauaaucuccauugauu

SEQ ID NO: 2247992 - RNA, 22 nt, Yersinia pestis
gcauuuuucuguucagauuuac

SEQ ID NO: 2247993 - RNA, 15 nt, Yersinia pestis
gccaaaaaaagggcg

SEQ ID NO: 2247994 - RNA, 20 nt, Yersinia pestis
gccaaaaaauaagggccacc

SEQ ID NO: 2247995 - RNA, 22 nt, Yersinia pestis
gcauuuuuuucacaccacggcg

SEQ ID NO: 2247996 - RNA, 18 nt, Yersinia pestis
gcauuuuaucuucuucag

SEQ ID NO: 2247997 - RNA, 23 nt, Yersinia pestis
gcauuugggugagggcaauuaaa

SEQ ID NO: 2247998 - RNA, 18 nt, Yersinia pestis
gcauuucuuuuucaacuc

SEQ ID NO: 2247999 - RNA, 14 nt, Yersinia pestis
gccaaacaaaugaa

SEQ ID NO: 2248000 - RNA, 20 nt, Yersinia pestis
gccaaaauaaacaucaaugu

SEQ ID NO: 2248001 - RNA, 19 nt, Yersinia pestis
gccaaaccauggcucacca

SEQ ID NO: 2248002 - RNA, 19 nt, Yersinia pestis
gccaaaucaucagacagcc

SEQ ID NO: 2248003 - RNA, 20 nt, Yersinia pestis
gccaaauacauauaaccauc

SEQ ID NO: 2248004 - RNA, 20 nt, Yersinia pestis
gccaaauugugaguuaaaaa

SEQ ID NO: 2248005 - RNA, 22 nt, Yersinia pestis
gccaaauugugaguuaaaaaua

SEQ ID NO: 2248006 - RNA, 17 nt, Yersinia pestis
gccaaaugcaaaccagg

SEQ ID NO: 2248007 - RNA, 21 nt, Yersinia pestis
gccaacaacuggguggccagu

SEQ ID NO: 2248008 - RNA, 18 nt, Yersinia pestis
gccaacaauugcuccagu

SEQ ID NO: 2248009 - RNA, 14 nt, Yersinia pestis
gccaacaggccccu

SEQ ID NO: 2248010 - RNA, 15 nt, Yersinia pestis
gccaacaggccccuu

SEQ ID NO: 2248011 - RNA, 18 nt, Yersinia pestis
gccaacagugaauaacug

SEQ ID NO: 2248012 - RNA, 20 nt, Yersinia pestis
gccaaccguagugagucagg

SEQ ID NO: 2248013 - RNA, 22 nt, Yersinia pestis
gccaaccggcgaagggcgcagc

SEQ ID NO: 2248014 - RNA, 22 nt, Yersinia pestis
gccaaccggauaaaacaauagc

SEQ ID NO: 2248015 - RNA, 20 nt, Yersinia pestis
gccaagcaagcggcagcgcu

SEQ ID NO: 2248016 - RNA, 20 nt, Yersinia pestis
gccaagcgccgugcauaaug

SEQ ID NO: 2248017 - RNA, 11 nt, Yersinia pestis
gccaacgugua

SEQ ID NO: 2248018 - RNA, 22 nt, Yersinia pestis
gccaacgauaaugacauaauca

SEQ ID NO: 2248019 - RNA, 23 nt, Yersinia pestis
gccaauggaaccgcuaaagucac

SEQ ID NO: 2248020 - RNA, 23 nt, Yersinia pestis
gccaauggccacugcgggcagua

SEQ ID NO: 2248021 - RNA, 20 nt, Yersinia pestis
gccaaucucuuguuuugcaa

SEQ ID NO: 2248022 - RNA, 22 nt, Yersinia pestis
gccaaugccaagaauaauuacu

SEQ ID NO: 2248023 - RNA, 16 nt, Yersinia pestis
gccaauagcaaaccca

SEQ ID NO: 2248024 - RNA, 20 nt, Yersinia pestis
gccaauagacaaaagugacg

SEQ ID NO: 2248025 - RNA, 18 nt, Yersinia pestis
gccaauauccauauuaaa

SEQ ID NO: 2248026 - RNA, 19 nt, Yersinia pestis
gccaauauguuagcagcac

SEQ ID NO: 2248027 - RNA, 18 nt, Yersinia pestis
gccaauauugccuucacc

SEQ ID NO: 2248028 - RNA, 13 nt, Yersinia pestis
gccaauaggcccc

SEQ ID NO: 2248029 - RNA, 14 nt, Yersinia pestis
gccaauaggccccu

SEQ ID NO: 2248030 - RNA, 20 nt, Yersinia pestis
gccaaggggagccacacacu

SEQ ID NO: 2248031 - RNA, 14 nt, Yersinia pestis
gccaauaaagucca

SEQ ID NO: 2248032 - RNA, 14 nt, Yersinia pestis
gccaccaaaaaacg

SEQ ID NO: 2248033 - RNA, 17 nt, Yersinia pestis
gccaccaaauaaaacaa

SEQ ID NO: 2248034 - RNA, 14 nt, Yersinia pestis
gccacccauugcuc

SEQ ID NO: 2248035 - RNA, 18 nt, Yersinia pestis
gccacccugccaaaaaau

SEQ ID NO: 2248036 - RNA, 23 nt, Yersinia pestis
gccacccgcuuucagacaacgcu

SEQ ID NO: 2248037 - RNA, 16 nt, Yersinia pestis
gccacugggcuacccg

SEQ ID NO: 2248038 - RNA, 19 nt, Yersinia pestis
gccaccggcaguucauucc

SEQ ID NO: 2248039 - RNA, 14 nt, Yersinia pestis
gccagaaagcagcc

SEQ ID NO: 2248040 - RNA, 22 nt, Yersinia pestis
gccagaaacagcccagauggca

SEQ ID NO: 2248041 - RNA, 18 nt, Yersinia pestis
gccacuucgguggcccuu

SEQ ID NO: 2248042 - RNA, 18 nt, Yersinia pestis
gccacuucgguggcccug

SEQ ID NO: 2248043 - RNA, 23 nt, Yersinia pestis
gccagagacauaaagcccgcuuc

SEQ ID NO: 2248044 - RNA, 14 nt, Yersinia pestis
gccagcaaaucaca

SEQ ID NO: 2248045 - RNA, 13 nt, Yersinia pestis
gccagcaaagaca

SEQ ID NO: 2248046 - RNA, 13 nt, Yersinia pestis
gccagacuggccg

SEQ ID NO: 2248047 - RNA, 22 nt, Yersinia pestis
gccagacgaguauuccccacug

SEQ ID NO: 2248048 - RNA, 20 nt, Yersinia pestis
gccagcaaccacgguaucaa

SEQ ID NO: 2248049 - RNA, 21 nt, Yersinia pestis
gccagcaauguguugaaugac

SEQ ID NO: 2248050 - RNA, 18 nt, Yersinia pestis
gccagcagcauaaccagu

SEQ ID NO: 2248051 - RNA, 22 nt, Yersinia pestis
gccagccgcaaauaggggcacc

SEQ ID NO: 2248052 - RNA, 22 nt, Yersinia pestis
gccagccccaaucaccggcugg

SEQ ID NO: 2248053 - RNA, 14 nt, Yersinia pestis
gccagcccaucacc

SEQ ID NO: 2248054 - RNA, 14 nt, Yersinia pestis
gccagcugcaauug

SEQ ID NO: 2248055 - RNA, 18 nt, Yersinia pestis
gccagcugcaauugccgc

SEQ ID NO: 2248056 - RNA, 17 nt, Yersinia pestis
gccagggguaagaucca

SEQ ID NO: 2248057 - RNA, 16 nt, Yersinia pestis
gccaggcucccaaggg

SEQ ID NO: 2248058 - RNA, 19 nt, Yersinia pestis
gccaucuuguucuaauaau

SEQ ID NO: 2248059 - RNA, 12 nt, Yersinia pestis
gccaugagaacc

SEQ ID NO: 2248060 - RNA, 16 nt, Yersinia pestis
gccaugaaucaaauua

SEQ ID NO: 2248061 - RNA, 18 nt, Yersinia pestis
gccaugauaaccacaacg

SEQ ID NO: 2248062 - RNA, 21 nt, Yersinia pestis
gccauggcgaaaauccuucau

SEQ ID NO: 2248063 - RNA, 19 nt, Yersinia pestis
gccauucauuuuuuauauu

SEQ ID NO: 2248064 - RNA, 21 nt, Yersinia pestis
gccauuaaggccacugacggu

SEQ ID NO: 2248065 - RNA, 17 nt, Yersinia pestis
gccauuaugucgggagu

SEQ ID NO: 2248066 - RNA, 15 nt, Yersinia pestis
gccaucaggcaaaag

SEQ ID NO: 2248067 - RNA, 19 nt, Yersinia pestis
gccaucaggccgcugcgca

SEQ ID NO: 2248068 - RNA, 15 nt, Yersinia pestis
gccaucuaacugcac

SEQ ID NO: 2248069 - RNA, 14 nt, Yersinia pestis
gccaucgccaacag

SEQ ID NO: 2248070 - RNA, 17 nt, Yersinia pestis
gccaucgccaacaggcc

SEQ ID NO: 2248071 - RNA, 19 nt, Yersinia pestis
gccauccuuuacuccccug

SEQ ID NO: 2248072 - RNA, 23 nt, Yersinia pestis
gccauccuuuacuccccugccua

SEQ ID NO: 2248073 - RNA, 16 nt, Yersinia pestis
gccauccuuuugacug

SEQ ID NO: 2248074 - RNA, 14 nt, Yersinia pestis
gccaucaauaaagc

SEQ ID NO: 2248075 - RNA, 22 nt, Yersinia pestis
gccaucaauaaagcuggcuaac

SEQ ID NO: 2248076 - RNA, 21 nt, Yersinia pestis
gccaucaccaugccuucugaa

SEQ ID NO: 2248077 - RNA, 19 nt, Yersinia pestis
gccaguauuagccagcaga

SEQ ID NO: 2248078 - RNA, 15 nt, Yersinia pestis
gcccaaaucugccug

SEQ ID NO: 2248079 - RNA, 13 nt, Yersinia pestis
gccauuuuggguu

SEQ ID NO: 2248080 - RNA, 19 nt, Yersinia pestis
gccauuggguauggucagc

SEQ ID NO: 2248081 - RNA, 16 nt, Yersinia pestis
gccauuucaaaacgcc

SEQ ID NO: 2248082 - RNA, 15 nt, Yersinia pestis
gccauuucaccaaua

SEQ ID NO: 2248083 - RNA, 18 nt, Yersinia pestis
gccauuggcaaaggccag

SEQ ID NO: 2248084 - RNA, 19 nt, Yersinia pestis
gccauuggcaaaggccagc

SEQ ID NO: 2248085 - RNA, 12 nt, Yersinia pestis
gccauugcucau

SEQ ID NO: 2248086 - RNA, 20 nt, Yersinia pestis
gccauuuguuaaucgcugaa

SEQ ID NO: 2248087 - RNA, 12 nt, Yersinia pestis
gccauuucuuag

SEQ ID NO: 2248088 - RNA, 18 nt, Yersinia pestis
gcccaaucuaacuggccc

SEQ ID NO: 2248089 - RNA, 12 nt, Yersinia pestis
gcccaacuggcg

SEQ ID NO: 2248090 - RNA, 23 nt, Yersinia pestis
gcccaagauacuggaagaaaccc

SEQ ID NO: 2248091 - RNA, 11 nt, Yersinia pestis
gcccaagccau

SEQ ID NO: 2248092 - RNA, 22 nt, Yersinia pestis
gcccaaggcgacuuugaugcca

SEQ ID NO: 2248093 - RNA, 22 nt, Yersinia pestis
gcccaauaaaaacgccuccagu

SEQ ID NO: 2248094 - RNA, 22 nt, Yersinia pestis
gcccacagggugagucucaggg

SEQ ID NO: 2248095 - RNA, 19 nt, Yersinia pestis
gcccacauaaagauagcca

SEQ ID NO: 2248096 - RNA, 20 nt, Yersinia pestis
gcccacauaaagauagccac

SEQ ID NO: 2248097 - RNA, 20 nt, Yersinia pestis
gcuauuagccagaaauagca

SEQ ID NO: 2248098 - RNA, 18 nt, Yersinia pestis
gcuauuaaacauuuaugu

SEQ ID NO: 2248099 - RNA, 17 nt, Yersinia pestis
gcuauuaaagcccgcuu

SEQ ID NO: 2248100 - RNA, 17 nt, Yersinia pestis
gcuauuaaacauuuaug

SEQ ID NO: 2248101 - RNA, 18 nt, Yersinia pestis
gcuauguuggcaaauaau

SEQ ID NO: 2248102 - RNA, 14 nt, Yersinia pestis
gcuaugcucagcaa

SEQ ID NO: 2248103 - RNA, 15 nt, Yersinia pestis
gcuaugcagcccaga

SEQ ID NO: 2248104 - RNA, 14 nt, Yersinia pestis
gcuaugcaguuaag

SEQ ID NO: 2248105 - RNA, 16 nt, Yersinia pestis
gcuaugccuacuggcc

SEQ ID NO: 2248106 - RNA, 14 nt, Yersinia pestis
gcuaugccggagga

SEQ ID NO: 2248107 - RNA, 20 nt, Yersinia pestis
gcuauugaugucuaaugaca

SEQ ID NO: 2248108 - RNA, 14 nt, Yersinia pestis
gcuauuuaacaaaa

SEQ ID NO: 2248109 - RNA, 18 nt, Yersinia pestis
gcuauugaacauucaucu

SEQ ID NO: 2248110 - RNA, 18 nt, Yersinia pestis
gcucaaauauuugcacaa

SEQ ID NO: 2248111 - RNA, 15 nt, Yersinia pestis
gcucaacugcucaac

SEQ ID NO: 2248112 - RNA, 16 nt, Yersinia pestis
gcucaacugcucaacu

SEQ ID NO: 2248113 - RNA, 17 nt, Yersinia pestis
gcucaacugcucaacug

SEQ ID NO: 2248114 - RNA, 10 nt, Yersinia pestis
gcucaacaug

SEQ ID NO: 2248115 - RNA, 12 nt, Yersinia pestis
gcucaagcuggc

SEQ ID NO: 2248116 - RNA, 12 nt, Yersinia pestis
gcucaagcuggu

SEQ ID NO: 2248117 - RNA, 23 nt, Yersinia pestis
gcucaagggcacaguuuaucucg

SEQ ID NO: 2248118 - RNA, 13 nt, Yersinia pestis
gcucaagccucua

SEQ ID NO: 2248119 - RNA, 17 nt, Yersinia pestis
gcucaccgucaacccac

SEQ ID NO: 2248120 - RNA, 22 nt, Yersinia pestis
gcucacgcaaagggcaacaaua

SEQ ID NO: 2248121 - RNA, 15 nt, Yersinia pestis
gcuaguuugacgcug

SEQ ID NO: 2248122 - RNA, 14 nt, Yersinia pestis
gcuagccccaauca

SEQ ID NO: 2248123 - RNA, 23 nt, Yersinia pestis
gcguuuacucgcuccgagcgugc

SEQ ID NO: 2248124 - RNA, 19 nt, Yersinia pestis
gcuauauacccgucauaaa

SEQ ID NO: 2248125 - RNA, 11 nt, Yersinia pestis
gcuauauagac

SEQ ID NO: 2248126 - RNA, 13 nt, Yersinia pestis
gcuaucauccaua

SEQ ID NO: 2248127 - RNA, 17 nt, Yersinia pestis
gcuauccgcgccgagcg

SEQ ID NO: 2248128 - RNA, 18 nt, Yersinia pestis
gcuaucuuaugacgcugc

SEQ ID NO: 2248129 - RNA, 11 nt, Yersinia pestis
gcuaucuguua

SEQ ID NO: 2248130 - RNA, 21 nt, Yersinia pestis
gcucauuaaacuguucuuauu

SEQ ID NO: 2248131 - RNA, 21 nt, Yersinia pestis
gcucauguucgcacugcucug

SEQ ID NO: 2248132 - RNA, 23 nt, Yersinia pestis
gcucaucuaacucauucauaauu

SEQ ID NO: 2248133 - RNA, 15 nt, Yersinia pestis
gcucacgucaccacg

SEQ ID NO: 2248134 - RNA, 17 nt, Yersinia pestis
gcuccagcgucacuuca

SEQ ID NO: 2248135 - RNA, 16 nt, Yersinia pestis
gcuccagcucgugcca

SEQ ID NO: 2248136 - RNA, 21 nt, Yersinia pestis
gcuccacuacucaguugcagu

SEQ ID NO: 2248137 - RNA, 17 nt, Yersinia pestis
gcucccagacuuugcug

SEQ ID NO: 2248138 - RNA, 22 nt, Yersinia pestis
gcucccaaggguauaacucauc

SEQ ID NO: 2248139 - RNA, 18 nt, Yersinia pestis
gcuccuuacuauuuucau

SEQ ID NO: 2248140 - RNA, 14 nt, Yersinia pestis
gcucgacggccaau

SEQ ID NO: 2248141 - RNA, 20 nt, Yersinia pestis
gcucccccggaucacuggcu

SEQ ID NO: 2248142 - RNA, 18 nt, Yersinia pestis
gcucccggcacuaagugu

SEQ ID NO: 2248143 - RNA, 21 nt, Yersinia pestis
gcucccguaaacguucugcca

SEQ ID NO: 2248144 - RNA, 17 nt, Yersinia pestis
gcuccugccgcauccca

SEQ ID NO: 2248145 - RNA, 11 nt, Yersinia pestis
gcucuacuaau

SEQ ID NO: 2248146 - RNA, 14 nt, Yersinia pestis
gcucuaucgauaaa

SEQ ID NO: 2248147 - RNA, 20 nt, Yersinia pestis
gcucuaucgauaaagucauc

SEQ ID NO: 2248148 - RNA, 22 nt, Yersinia pestis
gcucuauuucaugauucucuau

SEQ ID NO: 2248149 - RNA, 13 nt, Yersinia pestis
gcucuaucucccg

SEQ ID NO: 2248150 - RNA, 20 nt, Yersinia pestis
gcucucacccaauaagauaa

SEQ ID NO: 2248151 - RNA, 22 nt, Yersinia pestis
gcucuccacucggucaaccguu

SEQ ID NO: 2248152 - RNA, 18 nt, Yersinia pestis
gcucucugagccauccag

SEQ ID NO: 2248153 - RNA, 19 nt, Yersinia pestis
gcucucugaguaccagcaa

SEQ ID NO: 2248154 - RNA, 15 nt, Yersinia pestis
gcucgugaucagcag

SEQ ID NO: 2248155 - RNA, 18 nt, Yersinia pestis
gcucgugaucagcagacu

SEQ ID NO: 2248156 - RNA, 19 nt, Yersinia pestis
gcucgugaucagcagacuc

SEQ ID NO: 2248157 - RNA, 16 nt, Yersinia pestis
gcucgguuauuuauca

SEQ ID NO: 2248158 - RNA, 19 nt, Yersinia pestis
gcucuuacguuucauaugu

SEQ ID NO: 2248159 - RNA, 18 nt, Yersinia pestis
gcucuucaauuuccaucu

SEQ ID NO: 2248160 - RNA, 23 nt, Yersinia pestis
gcucuguggauuaacuucuuccg

SEQ ID NO: 2248161 - RNA, 20 nt, Yersinia pestis
gcucuguuggugguggccug

SEQ ID NO: 2248162 - RNA, 15 nt, Yersinia pestis
gcucuggauagcaga

SEQ ID NO: 2248163 - RNA, 15 nt, Yersinia pestis
gcucuggcguacugu

SEQ ID NO: 2248164 - RNA, 14 nt, Yersinia pestis
gcucuggucacuaa

SEQ ID NO: 2248165 - RNA, 21 nt, Yersinia pestis
gcucucuuuuuucucuuucuu

SEQ ID NO: 2248166 - RNA, 17 nt, Yersinia pestis
gcucucuuuuuucucuu

SEQ ID NO: 2248167 - RNA, 16 nt, Yersinia pestis
gcucugacuacugaaa

SEQ ID NO: 2248168 - RNA, 12 nt, Yersinia pestis
gcucugauagua

SEQ ID NO: 2248169 - RNA, 14 nt, Yersinia pestis
gcucugccaauaaa

SEQ ID NO: 2248170 - RNA, 19 nt, Yersinia pestis
gcucugcguuuuucccugu

SEQ ID NO: 2248171 - RNA, 12 nt, Yersinia pestis
gcucuuccagca

SEQ ID NO: 2248172 - RNA, 19 nt, Yersinia pestis
gcucuucaucaucaaauga

SEQ ID NO: 2248173 - RNA, 12 nt, Yersinia pestis
gcucuucacauu

SEQ ID NO: 2248174 - RNA, 22 nt, Yersinia pestis
gcucuucaccaaaggaagccga

SEQ ID NO: 2248175 - RNA, 16 nt, Yersinia pestis
gcugaacccugacggc

SEQ ID NO: 2248176 - RNA, 16 nt, Yersinia pestis
gcugaacaauugccag

SEQ ID NO: 2248177 - RNA, 18 nt, Yersinia pestis
gcugaauaucaucuuuuu

SEQ ID NO: 2248178 - RNA, 21 nt, Yersinia pestis
gcugaauaucaucuuuuucug

SEQ ID NO: 2248179 - RNA, 13 nt, Yersinia pestis
gcugaaggccugc

SEQ ID NO: 2248180 - RNA, 17 nt, Yersinia pestis
gcugaagucuuuagccu

SEQ ID NO: 2248181 - RNA, 23 nt, Yersinia pestis
gcugaaguggcugaauaucaucu

SEQ ID NO: 2248182 - RNA, 15 nt, Yersinia pestis
gcugacaaacagaua

SEQ ID NO: 2248183 - RNA, 16 nt, Yersinia pestis
gcugaauugauuuauu

SEQ ID NO: 2248184 - RNA, 15 nt, Yersinia pestis
gcugaauugcuuauc

SEQ ID NO: 2248185 - RNA, 17 nt, Yersinia pestis
gcugaauuggaagagcc

SEQ ID NO: 2248186 - RNA, 22 nt, Yersinia pestis
gcugaccuguuguaacacuuga

SEQ ID NO: 2248187 - RNA, 17 nt, Yersinia pestis
gcugacagagcggguuu

SEQ ID NO: 2248188 - RNA, 13 nt, Yersinia pestis
gcugacauugccc

SEQ ID NO: 2248189 - RNA, 16 nt, Yersinia pestis
gcugacauuuucuauc

SEQ ID NO: 2248190 - RNA, 16 nt, Yersinia pestis
gcugaccccaaauuug

SEQ ID NO: 2248191 - RNA, 23 nt, Yersinia pestis
gcugauagaaaguugagcagcaa

SEQ ID NO: 2248192 - RNA, 14 nt, Yersinia pestis
gcugaucaucauca

SEQ ID NO: 2248193 - RNA, 15 nt, Yersinia pestis
gcugauaaccagcag

SEQ ID NO: 2248194 - RNA, 18 nt, Yersinia pestis
gcugauaaccagccaacc

SEQ ID NO: 2248195 - RNA, 17 nt, Yersinia pestis
gcugauaacuuccuuug

SEQ ID NO: 2248196 - RNA, 14 nt, Yersinia pestis
gcugauaauuuauu

SEQ ID NO: 2248197 - RNA, 14 nt, Yersinia pestis
gcugagugaagaca

SEQ ID NO: 2248198 - RNA, 15 nt, Yersinia pestis
gcugagugaagacau

SEQ ID NO: 2248199 - RNA, 16 nt, Yersinia pestis
gcugaugaauagagga

SEQ ID NO: 2248200 - RNA, 20 nt, Yersinia pestis
gcugauggucauggagagca

SEQ ID NO: 2248201 - RNA, 17 nt, Yersinia pestis
gcugaugucauucuauc

SEQ ID NO: 2248202 - RNA, 14 nt, Yersinia pestis
gcugauuaaaccga

SEQ ID NO: 2248203 - RNA, 20 nt, Yersinia pestis
gcugagcaacgguuuguauc

SEQ ID NO: 2248204 - RNA, 16 nt, Yersinia pestis
gcugaggggcacacuu

SEQ ID NO: 2248205 - RNA, 15 nt, Yersinia pestis
gcugagcgggcggca

SEQ ID NO: 2248206 - RNA, 16 nt, Yersinia pestis
gcggcuccaggcauua

SEQ ID NO: 2248207 - RNA, 18 nt, Yersinia pestis
gcggcugguaacagagcc

SEQ ID NO: 2248208 - RNA, 15 nt, Yersinia pestis
gcggcuuucauccca

SEQ ID NO: 2248209 - RNA, 20 nt, Yersinia pestis
gcggcgccgucacguacugg

SEQ ID NO: 2248210 - RNA, 17 nt, Yersinia pestis
gcgguacuuuuugugau

SEQ ID NO: 2248211 - RNA, 22 nt, Yersinia pestis
gcgguaauuaauauauaaaaua

SEQ ID NO: 2248212 - RNA, 16 nt, Yersinia pestis
gcgguccuacccuuug

SEQ ID NO: 2248213 - RNA, 13 nt, Yersinia pestis
gcgguaguucagu

SEQ ID NO: 2248214 - RNA, 14 nt, Yersinia pestis
gcgggcgcgcugcu

SEQ ID NO: 2248215 - RNA, 12 nt, Yersinia pestis
gcgggcgcgcug

SEQ ID NO: 2248216 - RNA, 17 nt, Yersinia pestis
gcgggagauagagcagu

SEQ ID NO: 2248217 - RNA, 22 nt, Yersinia pestis
gcgucacuaaauccaaaugccc

SEQ ID NO: 2248218 - RNA, 18 nt, Yersinia pestis
gcgucaccagaucugggu

SEQ ID NO: 2248219 - RNA, 13 nt, Yersinia pestis
gcgucauaccauu

SEQ ID NO: 2248220 - RNA, 18 nt, Yersinia pestis
gcggugaucaccagauca

SEQ ID NO: 2248221 - RNA, 16 nt, Yersinia pestis
gcguccgucauccaau

SEQ ID NO: 2248222 - RNA, 21 nt, Yersinia pestis
gcgucaucgggguuugucagc

SEQ ID NO: 2248223 - RNA, 16 nt, Yersinia pestis
gcguccgcgccaagga

SEQ ID NO: 2248224 - RNA, 19 nt, Yersinia pestis
gcguccgcgccaaggcaag

SEQ ID NO: 2248225 - RNA, 17 nt, Yersinia pestis
gcguccgcgccagggag

SEQ ID NO: 2248226 - RNA, 17 nt, Yersinia pestis
gcgugaguuccagcccc

SEQ ID NO: 2248227 - RNA, 21 nt, Yersinia pestis
gcgugacuauucugccuaucc

SEQ ID NO: 2248228 - RNA, 12 nt, Yersinia pestis
gcgugccgcagu

SEQ ID NO: 2248229 - RNA, 16 nt, Yersinia pestis
gcguugcccuucuuca

SEQ ID NO: 2248230 - RNA, 15 nt, Yersinia pestis
gcguuguaauaacgc

SEQ ID NO: 2248231 - RNA, 19 nt, Yersinia pestis
gcggaaaugccgauaaaaa

SEQ ID NO: 2248232 - RNA, 15 nt, Yersinia pestis
gcggaaauaaacauc

SEQ ID NO: 2248233 - RNA, 13 nt, Yersinia pestis
gcgcuuugcagua

SEQ ID NO: 2248234 - RNA, 16 nt, Yersinia pestis
gcgcuugccacgccag

SEQ ID NO: 2248235 - RNA, 21 nt, Yersinia pestis
gcgcuucgagcccccagggaa

SEQ ID NO: 2248236 - RNA, 16 nt, Yersinia pestis
gcgcuuaauucuggcc

SEQ ID NO: 2248237 - RNA, 19 nt, Yersinia pestis
gcgcuucacccugugcuuu

SEQ ID NO: 2248238 - RNA, 20 nt, Yersinia pestis
gcgcuuacuuacccgaauca

SEQ ID NO: 2248239 - RNA, 23 nt, Yersinia pestis
gcgcuuacuuacccgaaucacuu

SEQ ID NO: 2248240 - RNA, 19 nt, Yersinia pestis
gcgcguaucguccagcagc

SEQ ID NO: 2248241 - RNA, 20 nt, Yersinia pestis
gcgcguaucguccagcagca

SEQ ID NO: 2248242 - RNA, 15 nt, Yersinia pestis
gcggaucaaccgccc

SEQ ID NO: 2248243 - RNA, 22 nt, Yersinia pestis
gcggaauauuuaaccagagauu

SEQ ID NO: 2248244 - RNA, 20 nt, Yersinia pestis
gcggcaccgccgucaaacca

SEQ ID NO: 2248245 - RNA, 16 nt, Yersinia pestis
gcggcaauaagcauua

SEQ ID NO: 2248246 - RNA, 17 nt, Yersinia pestis
gcggcaagcugugccug

SEQ ID NO: 2248247 - RNA, 23 nt, Yersinia pestis
gcgccuuuuauucuuuggugagc

SEQ ID NO: 2248248 - RNA, 21 nt, Yersinia pestis
gcgcgaaauauugcccuacgg

SEQ ID NO: 2248249 - RNA, 19 nt, Yersinia pestis
gcgcgcccagacgccggcc

SEQ ID NO: 2248250 - RNA, 21 nt, Yersinia pestis
gcgcgggaaaagguaaacaga

SEQ ID NO: 2248251 - RNA, 15 nt, Yersinia pestis
gcgcggcugguaaca

SEQ ID NO: 2248252 - RNA, 21 nt, Yersinia pestis
gcgcggcugguaacagagccu

SEQ ID NO: 2248253 - RNA, 17 nt, Yersinia pestis
gcgcggguaauggcggu

SEQ ID NO: 2248254 - RNA, 18 nt, Yersinia pestis
gcgccuccagucccccuc

SEQ ID NO: 2248255 - RNA, 23 nt, Yersinia pestis
gcgccuccagucccccucacaag

SEQ ID NO: 2248256 - RNA, 22 nt, Yersinia pestis
gcgccuccaguuuuccagagcc

SEQ ID NO: 2248257 - RNA, 13 nt, Yersinia pestis
gcgccucacugaa

SEQ ID NO: 2248258 - RNA, 15 nt, Yersinia pestis
gcgccugugggcggc

SEQ ID NO: 2248259 - RNA, 17 nt, Yersinia pestis
gcgccuguuagggcgcg

SEQ ID NO: 2248260 - RNA, 14 nt, Yersinia pestis
gcgcauugauaauc

SEQ ID NO: 2248261 - RNA, 15 nt, Yersinia pestis
gcgcauugauaaucu

SEQ ID NO: 2248262 - RNA, 19 nt, Yersinia pestis
gcgcauugauaaucuccau

SEQ ID NO: 2248263 - RNA, 20 nt, Yersinia pestis
gcgcaucugcugcacuuaac

SEQ ID NO: 2248264 - RNA, 12 nt, Yersinia pestis
gcgcaucgccau

SEQ ID NO: 2248265 - RNA, 19 nt, Yersinia pestis
gcgccaaggauggcgcggc

SEQ ID NO: 2248266 - RNA, 18 nt, Yersinia pestis
gcgccaaugacaaagggu

SEQ ID NO: 2248267 - RNA, 12 nt, Yersinia pestis
gcgccacaaccc

SEQ ID NO: 2248268 - RNA, 14 nt, Yersinia pestis
gcgccacaucggcg

SEQ ID NO: 2248269 - RNA, 16 nt, Yersinia pestis
gcgccacccauugcuc

SEQ ID NO: 2248270 - RNA, 20 nt, Yersinia pestis
gcgccauacaguuaauuuca

SEQ ID NO: 2248271 - RNA, 13 nt, Yersinia pestis
gcgccauacugca

SEQ ID NO: 2248272 - RNA, 14 nt, Yersinia pestis
gcgccauacugcag

SEQ ID NO: 2248273 - RNA, 16 nt, Yersinia pestis
gcgccauauauugauc

SEQ ID NO: 2248274 - RNA, 21 nt, Yersinia pestis
gcgccagcaauuggccuucca

SEQ ID NO: 2248275 - RNA, 16 nt, Yersinia pestis
gcgccacgcuccacac

SEQ ID NO: 2248276 - RNA, 16 nt, Yersinia pestis
gcgcauaugaaaaacc

SEQ ID NO: 2248277 - RNA, 23 nt, Yersinia pestis
gcgcagugcauugcagaaagcug

SEQ ID NO: 2248278 - RNA, 14 nt, Yersinia pestis
gcgcagucaucauu

SEQ ID NO: 2248279 - RNA, 15 nt, Yersinia pestis
gcgcagguucaucag

SEQ ID NO: 2248280 - RNA, 19 nt, Yersinia pestis
gcgcaguaacuguguuuga

SEQ ID NO: 2248281 - RNA, 21 nt, Yersinia pestis
gcgcagaguccucucaccaag

SEQ ID NO: 2248282 - RNA, 14 nt, Yersinia pestis
gcgcaagcgcugcu

SEQ ID NO: 2248283 - RNA, 17 nt, Yersinia pestis
gcgcacauagggcucgg

SEQ ID NO: 2248284 - RNA, 17 nt, Yersinia pestis
gcgcaccggaugccagc

SEQ ID NO: 2248285 - RNA, 19 nt, Yersinia pestis
gcgcaccggaugccagcuu

SEQ ID NO: 2248286 - RNA, 15 nt, Yersinia pestis
gcgacgugaugccag

SEQ ID NO: 2248287 - RNA, 17 nt, Yersinia pestis
gcgacggagagaacagg

SEQ ID NO: 2248288 - RNA, 15 nt, Yersinia pestis
gcgacgguacugauc

SEQ ID NO: 2248289 - RNA, 13 nt, Yersinia pestis
gcgagcaugacac

SEQ ID NO: 2248290 - RNA, 19 nt, Yersinia pestis
gcgagaaagucaaagcgcu

SEQ ID NO: 2248291 - RNA, 22 nt, Yersinia pestis
gcgaugcgccuguuagggcgcg

SEQ ID NO: 2248292 - RNA, 12 nt, Yersinia pestis
gcgauaaaagau

SEQ ID NO: 2248293 - RNA, 17 nt, Yersinia pestis
gcgauaaauuagauaug

SEQ ID NO: 2248294 - RNA, 23 nt, Yersinia pestis
gcgauaaaagauuuccuuucgca

SEQ ID NO: 2248295 - RNA, 17 nt, Yersinia pestis
gcgagugaaccgcgcuc

SEQ ID NO: 2248296 - RNA, 21 nt, Yersinia pestis
gcgagugaaccgcgcucugcu

SEQ ID NO: 2248297 - RNA, 23 nt, Yersinia pestis
gcgaguaguugucaagagugcga

SEQ ID NO: 2248298 - RNA, 17 nt, Yersinia pestis
gcgacauuuugugcucu

SEQ ID NO: 2248299 - RNA, 23 nt, Yersinia pestis
gcgaauuaucauccagauucaga

SEQ ID NO: 2248300 - RNA, 12 nt, Yersinia pestis
gcgaccagcaga

SEQ ID NO: 2248301 - RNA, 12 nt, Yersinia pestis
gccuaaacccca

SEQ ID NO: 2248302 - RNA, 18 nt, Yersinia pestis
gccuaaaaaugauuucag

SEQ ID NO: 2248303 - RNA, 19 nt, Yersinia pestis
gccuaaaaaugauuucagg

SEQ ID NO: 2248304 - RNA, 17 nt, Yersinia pestis
gccguuuaccuugugcg

SEQ ID NO: 2248305 - RNA, 20 nt, Yersinia pestis
gccguuucaggguauaugga

SEQ ID NO: 2248306 - RNA, 11 nt, Yersinia pestis
gcgaacagcag

SEQ ID NO: 2248307 - RNA, 13 nt, Yersinia pestis
gcgaacaucaucc

SEQ ID NO: 2248308 - RNA, 13 nt, Yersinia pestis
gcgaagaagagau

SEQ ID NO: 2248309 - RNA, 16 nt, Yersinia pestis
gcgaauaauggcagcc

SEQ ID NO: 2248310 - RNA, 17 nt, Yersinia pestis
gcuguaaacuggcagau

SEQ ID NO: 2248311 - RNA, 13 nt, Yersinia pestis
gcuguaagcacca

SEQ ID NO: 2248312 - RNA, 16 nt, Yersinia pestis
gcuguaagcaccagca

SEQ ID NO: 2248313 - RNA, 20 nt, Yersinia pestis
gcuguacaacaagaucccaa

SEQ ID NO: 2248314 - RNA, 20 nt, Yersinia pestis
gcugguuaucacagcaaauu

SEQ ID NO: 2248315 - RNA, 17 nt, Yersinia pestis
gcugguuaucacagcaa

SEQ ID NO: 2248316 - RNA, 19 nt, Yersinia pestis
gcugguuaucacagcaaau

SEQ ID NO: 2248317 - RNA, 19 nt, Yersinia pestis
gcugguguaacggcugcug

SEQ ID NO: 2248318 - RNA, 17 nt, Yersinia pestis
gcuggugcggaacagcg

SEQ ID NO: 2248319 - RNA, 16 nt, Yersinia pestis
gcugguggcuugggcu

SEQ ID NO: 2248320 - RNA, 21 nt, Yersinia pestis
gcugucauuccaaccuuguaa

SEQ ID NO: 2248321 - RNA, 15 nt, Yersinia pestis
gcugucagccaccgu

SEQ ID NO: 2248322 - RNA, 22 nt, Yersinia pestis
gcugucacugucaaaaccaaua

SEQ ID NO: 2248323 - RNA, 18 nt, Yersinia pestis
gcuguuacccauggcaac

SEQ ID NO: 2248324 - RNA, 16 nt, Yersinia pestis
gcuguuaccaaacauu

SEQ ID NO: 2248325 - RNA, 20 nt, Yersinia pestis
gcuguucagaugaucaaauu

SEQ ID NO: 2248326 - RNA, 19 nt, Yersinia pestis
gcuguuccaaccaaccuug

SEQ ID NO: 2248327 - RNA, 16 nt, Yersinia pestis
gcuguuguuguugauu

SEQ ID NO: 2248328 - RNA, 22 nt, Yersinia pestis
gcugucggcgaugaaaaacaga

SEQ ID NO: 2248329 - RNA, 22 nt, Yersinia pestis
gcugucuuucauucggcacagc

SEQ ID NO: 2248330 - RNA, 22 nt, Yersinia pestis
gcuguggaaucggccuucaaua

SEQ ID NO: 2248331 - RNA, 18 nt, Yersinia pestis
gcuguggcacuaucuggc

SEQ ID NO: 2248332 - RNA, 18 nt, Yersinia pestis
gcuguggcgauaaaccga

SEQ ID NO: 2248333 - RNA, 16 nt, Yersinia pestis
gcuggcuuuuuuguuu

SEQ ID NO: 2248334 - RNA, 17 nt, Yersinia pestis
gcugggcguaacagccg

SEQ ID NO: 2248335 - RNA, 17 nt, Yersinia pestis
gcugguaggugcucauc

SEQ ID NO: 2248336 - RNA, 20 nt, Yersinia pestis
gcugguaauccacccggcau

SEQ ID NO: 2248337 - RNA, 14 nt, Yersinia pestis
gcuggcauacugac

SEQ ID NO: 2248338 - RNA, 18 nt, Yersinia pestis
gcuggcccccaaugacac

SEQ ID NO: 2248339 - RNA, 16 nt, Yersinia pestis
gcuggccauuuaccug

SEQ ID NO: 2248340 - RNA, 19 nt, Yersinia pestis
gcuggccaacugcgccuuc

SEQ ID NO: 2248341 - RNA, 13 nt, Yersinia pestis
gcuggccuaggcu

SEQ ID NO: 2248342 - RNA, 13 nt, Yersinia pestis
gcuggcgagagcu

SEQ ID NO: 2248343 - RNA, 21 nt, Yersinia pestis
gcugcuaauauuuauaaaaaa

SEQ ID NO: 2248344 - RNA, 22 nt, Yersinia pestis
gcugcugcaagaguccagcacu

SEQ ID NO: 2248345 - RNA, 11 nt, Yersinia pestis
gcugcugcucg

SEQ ID NO: 2248346 - RNA, 14 nt, Yersinia pestis
gcugcuuuuuacaa

SEQ ID NO: 2248347 - RNA, 20 nt, Yersinia pestis
gcugcuuuucagugaaaucg

SEQ ID NO: 2248348 - RNA, 13 nt, Yersinia pestis
gcugcuuccugcu

SEQ ID NO: 2248349 - RNA, 13 nt, Yersinia pestis
gcuggaauccaag

SEQ ID NO: 2248350 - RNA, 17 nt, Yersinia pestis
gcuggaauccaaguuca

SEQ ID NO: 2248351 - RNA, 13 nt, Yersinia pestis
gcuggaucagcag

SEQ ID NO: 2248352 - RNA, 17 nt, Yersinia pestis
gcuggauauaauccaaa

SEQ ID NO: 2248353 - RNA, 21 nt, Yersinia pestis
gcuggcaaccgguaacauaua

SEQ ID NO: 2248354 - RNA, 13 nt, Yersinia pestis
gcuggaggcuggc

SEQ ID NO: 2248355 - RNA, 16 nt, Yersinia pestis
gcugccuugcugcaac

SEQ ID NO: 2248356 - RNA, 17 nt, Yersinia pestis
gcugccuugcugcaacg

SEQ ID NO: 2248357 - RNA, 17 nt, Yersinia pestis
gcugcgcaagcgcugcu

SEQ ID NO: 2248358 - RNA, 18 nt, Yersinia pestis
gcugccugccugcugcuc

SEQ ID NO: 2248359 - RNA, 23 nt, Yersinia pestis
gcugccugccugagguucccaac

SEQ ID NO: 2248360 - RNA, 21 nt, Yersinia pestis
gcugccagugggauaucugcg

SEQ ID NO: 2248361 - RNA, 17 nt, Yersinia pestis
gcugcccacauaaagau

SEQ ID NO: 2248362 - RNA, 23 nt, Yersinia pestis
gcugcccaaccgcaucgugcucc

SEQ ID NO: 2248363 - RNA, 19 nt, Yersinia pestis
gcugccgcaagaaagaaaa

SEQ ID NO: 2248364 - RNA, 21 nt, Yersinia pestis
gcugcccuuugcuggcaugga

SEQ ID NO: 2248365 - RNA, 13 nt, Yersinia pestis
gcugauucaacac

SEQ ID NO: 2248366 - RNA, 13 nt, Yersinia pestis
gcugcaacucauu

SEQ ID NO: 2248367 - RNA, 21 nt, Yersinia pestis
gcugcaagcaauguucaaauc

SEQ ID NO: 2248368 - RNA, 18 nt, Yersinia pestis
gcugcaccucugcugaug

SEQ ID NO: 2248369 - RNA, 12 nt, Yersinia pestis
gcugcacuuuua

SEQ ID NO: 2248370 - RNA, 21 nt, Yersinia pestis
gcugcacaucauuuauuucca

SEQ ID NO: 2248371 - RNA, 19 nt, Yersinia pestis
gcugccagugccgccgccu

SEQ ID NO: 2248372 - RNA, 23 nt, Yersinia pestis
gcugcagccgcgaugccaucgcu

SEQ ID NO: 2248373 - RNA, 19 nt, Yersinia pestis
gcugcagccgggaugauca

SEQ ID NO: 2248374 - RNA, 13 nt, Yersinia pestis
gcugcagcaucaa

SEQ ID NO: 2248375 - RNA, 19 nt, Yersinia pestis
gcugcagcgugauuagcag

SEQ ID NO: 2248376 - RNA, 18 nt, Yersinia pestis
gcugcagcgcuauuugua

SEQ ID NO: 2248377 - RNA, 13 nt, Yersinia pestis
gcuucuggauggg

SEQ ID NO: 2248378 - RNA, 18 nt, Yersinia pestis
gcuucuggcgugucaucu

SEQ ID NO: 2248379 - RNA, 15 nt, Yersinia pestis
gcuucugccaugguu

SEQ ID NO: 2248380 - RNA, 15 nt, Yersinia pestis
gcuucugggccaaag

SEQ ID NO: 2248381 - RNA, 23 nt, Yersinia pestis
gcuucuuguugagugaccaagcc

SEQ ID NO: 2248382 - RNA, 13 nt, Yersinia pestis
gcuucuuuuaaag

SEQ ID NO: 2248383 - RNA, 15 nt, Yersinia pestis
gcuucgagcccccag

SEQ ID NO: 2248384 - RNA, 13 nt, Yersinia pestis
gcuucgauggcuu

SEQ ID NO: 2248385 - RNA, 17 nt, Yersinia pestis
gcuucguagccauuggg

SEQ ID NO: 2248386 - RNA, 21 nt, Yersinia pestis
gcuuccaggacauccagcggu

SEQ ID NO: 2248387 - RNA, 18 nt, Yersinia pestis
gcuuccugcgccacgcuu

SEQ ID NO: 2248388 - RNA, 16 nt, Yersinia pestis
gcuuccgguaaagaag

SEQ ID NO: 2248389 - RNA, 16 nt, Yersinia pestis
gcuuauccagccgcuc

SEQ ID NO: 2248390 - RNA, 18 nt, Yersinia pestis
gcuuauuaugacaacuga

SEQ ID NO: 2248391 - RNA, 12 nt, Yersinia pestis
gcuuauggccuu

SEQ ID NO: 2248392 - RNA, 22 nt, Yersinia pestis
gcuuacuuuuauaccgcagcau

SEQ ID NO: 2248393 - RNA, 11 nt, Yersinia pestis
gcuuagacaga

SEQ ID NO: 2248394 - RNA, 15 nt, Yersinia pestis
gcuuagaguaaguaa

SEQ ID NO: 2248395 - RNA, 17 nt, Yersinia pestis
gcuuacucuuccaacuc

SEQ ID NO: 2248396 - RNA, 16 nt, Yersinia pestis
gcuuaguuacaauaaa

SEQ ID NO: 2248397 - RNA, 13 nt, Yersinia pestis
gcuuaaucauauu

SEQ ID NO: 2248398 - RNA, 22 nt, Yersinia pestis
gcuuaaucaucaucacaaauaa

SEQ ID NO: 2248399 - RNA, 22 nt, Yersinia pestis
gcuuaacauccgaauuuuuacu

SEQ ID NO: 2248400 - RNA, 16 nt, Yersinia pestis
gcuuaaauaaaacacc

SEQ ID NO: 2248401 - RNA, 11 nt, Yersinia pestis
gcuuaaaacag

SEQ ID NO: 2248402 - RNA, 14 nt, Yersinia pestis
gcuuacauaaguaa

SEQ ID NO: 2248403 - RNA, 19 nt, Yersinia pestis
gcuuacaccauguucuuca

SEQ ID NO: 2248404 - RNA, 15 nt, Yersinia pestis
gcuuaccaaaacgcc

SEQ ID NO: 2248405 - RNA, 22 nt, Yersinia pestis
gcuuaccgucugggcuggugga

SEQ ID NO: 2248406 - RNA, 19 nt, Yersinia pestis
gcuuccaauauugagcagu

SEQ ID NO: 2248407 - RNA, 23 nt, Yersinia pestis
gcuucauucguuagcucuucacg

SEQ ID NO: 2248408 - RNA, 19 nt, Yersinia pestis
gcuucaguuuugcggguga

SEQ ID NO: 2248409 - RNA, 18 nt, Yersinia pestis
gcuucaucauggauaaag

SEQ ID NO: 2248410 - RNA, 16 nt, Yersinia pestis
gcuucauccaacuuac

SEQ ID NO: 2248411 - RNA, 15 nt, Yersinia pestis
gcuuauuuauuuuua

SEQ ID NO: 2248412 - RNA, 23 nt, Yersinia pestis
gcuucaaagaagacaucuggcug

SEQ ID NO: 2248413 - RNA, 18 nt, Yersinia pestis
gcuucaauuucaaacucc

SEQ ID NO: 2248414 - RNA, 16 nt, Yersinia pestis
gcuucacggguaaaaa

SEQ ID NO: 2248415 - RNA, 22 nt, Yersinia pestis
gcuucacccuggcucuggccag

SEQ ID NO: 2248416 - RNA, 19 nt, Yersinia pestis
gcuucaccgcuuuucuggu

SEQ ID NO: 2248417 - RNA, 15 nt, Yersinia pestis
gcuucacaucauaau

SEQ ID NO: 2248418 - RNA, 23 nt, Yersinia pestis
gcuuggacagaaaacaaucuggc

SEQ ID NO: 2248419 - RNA, 19 nt, Yersinia pestis
gcuugcuuugcuucaucca

SEQ ID NO: 2248420 - RNA, 17 nt, Yersinia pestis
gcuugcugccuugcugc

SEQ ID NO: 2248421 - RNA, 16 nt, Yersinia pestis
gcuugcgcgccuguuu

SEQ ID NO: 2248422 - RNA, 19 nt, Yersinia pestis
gcuugcgcguuaaucugcu

SEQ ID NO: 2248423 - RNA, 20 nt, Yersinia pestis
gcuugcgcguuaaucugcug

SEQ ID NO: 2248424 - RNA, 14 nt, Yersinia pestis
gcuugaucacaauc

SEQ ID NO: 2248425 - RNA, 18 nt, Yersinia pestis
gcuugagagucgagcggg

SEQ ID NO: 2248426 - RNA, 15 nt, Yersinia pestis
gcuugccaaauauag

SEQ ID NO: 2248427 - RNA, 19 nt, Yersinia pestis
gcuugccgcacgacgagcu

SEQ ID NO: 2248428 - RNA, 17 nt, Yersinia pestis
gcuuguuguugauaguu

SEQ ID NO: 2248429 - RNA, 20 nt, Yersinia pestis
gcuuuaaaggcuucgcuggc

SEQ ID NO: 2248430 - RNA, 20 nt, Yersinia pestis
gcuuuaagauccaguucagu

SEQ ID NO: 2248431 - RNA, 18 nt, Yersinia pestis
gcuuuacgcgcaccggau

SEQ ID NO: 2248432 - RNA, 16 nt, Yersinia pestis
gcuuuaaucugcauca

SEQ ID NO: 2248433 - RNA, 21 nt, Yersinia pestis
gcuuuacggcaaggggcuuga

SEQ ID NO: 2248434 - RNA, 20 nt, Yersinia pestis
gcuuuacuccucugccuauc

SEQ ID NO: 2248435 - RNA, 16 nt, Yersinia pestis
gcuuuacugcuuuucu

SEQ ID NO: 2248436 - RNA, 18 nt, Yersinia pestis
gcuuuacugcuuuucuac

SEQ ID NO: 2248437 - RNA, 14 nt, Yersinia pestis
gcuuuagcauugca

SEQ ID NO: 2248438 - RNA, 16 nt, Yersinia pestis
gcuuuagcuguacuaa

SEQ ID NO: 2248439 - RNA, 16 nt, Yersinia pestis
gcuuguggaaauagaa

SEQ ID NO: 2248440 - RNA, 23 nt, Yersinia pestis
gcuugucaccguaaccauuggca

SEQ ID NO: 2248441 - RNA, 23 nt, Yersinia pestis
gcuuggcgguuuagcgcuaagcc

SEQ ID NO: 2248442 - RNA, 20 nt, Yersinia pestis
gcuugguaaugcgcaccagc

SEQ ID NO: 2248443 - RNA, 17 nt, Yersinia pestis
gcuugggcuucacaucc

SEQ ID NO: 2248444 - RNA, 16 nt, Yersinia pestis
gcuuugacuaauacug

SEQ ID NO: 2248445 - RNA, 19 nt, Yersinia pestis
gcuuugacugacaaguuuu

SEQ ID NO: 2248446 - RNA, 17 nt, Yersinia pestis
gcuuucuugccauaagc

SEQ ID NO: 2248447 - RNA, 18 nt, Yersinia pestis
gcuuucggauuaaaaccu

SEQ ID NO: 2248448 - RNA, 17 nt, Yersinia pestis
gcuuuccgcauucgcca

SEQ ID NO: 2248449 - RNA, 19 nt, Yersinia pestis
gcuuuccagcucuggccag

SEQ ID NO: 2248450 - RNA, 20 nt, Yersinia pestis
gcuuucaucgaaaaaaauac

SEQ ID NO: 2248451 - RNA, 14 nt, Yersinia pestis
gcuuucaucuucuu

SEQ ID NO: 2248452 - RNA, 15 nt, Yersinia pestis
gcuuucaauaaaacu

SEQ ID NO: 2248453 - RNA, 16 nt, Yersinia pestis
gcuuucacgcuccaca

SEQ ID NO: 2248454 - RNA, 20 nt, Yersinia pestis
gcuuucagauaaugccuaag

SEQ ID NO: 2248455 - RNA, 22 nt, Yersinia pestis
gcuuucagcacgcuuuccagcu

SEQ ID NO: 2248456 - RNA, 23 nt, Yersinia pestis
gcuuuauucuucuucauuuucau

SEQ ID NO: 2248457 - RNA, 14 nt, Yersinia pestis
gcuuuaucaccagu

SEQ ID NO: 2248458 - RNA, 18 nt, Yersinia pestis
gcuuuaucgguuguccuu

SEQ ID NO: 2248459 - RNA, 18 nt, Yersinia pestis
gcuuuauaguccuuccau

SEQ ID NO: 2248460 - RNA, 17 nt, Yersinia pestis
gcuuuugcugcaaacug

SEQ ID NO: 2248461 - RNA, 15 nt, Yersinia pestis
gcuuuucugccuauc

SEQ ID NO: 2248462 - RNA, 16 nt, Yersinia pestis
gcuuuucugccuaucu

SEQ ID NO: 2248463 - RNA, 18 nt, Yersinia pestis
gcuuuucgaacugacgau

SEQ ID NO: 2248464 - RNA, 13 nt, Yersinia pestis
gcuuuuucuucca

SEQ ID NO: 2248465 - RNA, 12 nt, Yersinia pestis
gcuuuuugcuuu

SEQ ID NO: 2248466 - RNA, 15 nt, Yersinia pestis
gcuuuuuacgccuau

SEQ ID NO: 2248467 - RNA, 19 nt, Yersinia pestis
gcuuuuuauugucucuacu

SEQ ID NO: 2248468 - RNA, 22 nt, Yersinia pestis
gcuuugguugccagauaauguu

SEQ ID NO: 2248469 - RNA, 19 nt, Yersinia pestis
gcuuugcgauacaccauuu

SEQ ID NO: 2248470 - RNA, 23 nt, Yersinia pestis
gcuuuuagauaaaggcaaaagca

SEQ ID NO: 2248471 - RNA, 13 nt, Yersinia pestis
ggaaaacagcaac

SEQ ID NO: 2248472 - RNA, 20 nt, Yersinia pestis
ggaaaaacugaaaaaggcac

SEQ ID NO: 2248473 - RNA, 14 nt, Yersinia pestis
ggaaaaggcagaga

SEQ ID NO: 2248474 - RNA, 13 nt, Yersinia pestis
gcuuuuuuguuuu

SEQ ID NO: 2248475 - RNA, 11 nt, Yersinia pestis
ggaaaaaauac

SEQ ID NO: 2248476 - RNA, 15 nt, Yersinia pestis
ggaaaaaaucuuccu

SEQ ID NO: 2248477 - RNA, 23 nt, Yersinia pestis
gcuuuuuuaauaaaaaacugacu

SEQ ID NO: 2248478 - RNA, 16 nt, Yersinia pestis
gcuuuuuucuagcugu

SEQ ID NO: 2248479 - RNA, 15 nt, Yersinia pestis
ggaaacgucggccag

SEQ ID NO: 2248480 - RNA, 15 nt, Yersinia pestis
ggaaacaaaaccuaa

SEQ ID NO: 2248481 - RNA, 14 nt, Yersinia pestis
ggaaaguaagcaag

SEQ ID NO: 2248482 - RNA, 12 nt, Yersinia pestis
ggaaacuggcca

SEQ ID NO: 2248483 - RNA, 16 nt, Yersinia pestis
ggaacagcgccuccag

SEQ ID NO: 2248484 - RNA, 21 nt, Yersinia pestis
ggaacaguugcuugagagaac

SEQ ID NO: 2248485 - RNA, 21 nt, Yersinia pestis
ggaacagcucggccagcauuc

SEQ ID NO: 2248486 - RNA, 21 nt, Yersinia pestis
ggaaccaacggcaaugaccau

SEQ ID NO: 2248487 - RNA, 21 nt, Yersinia pestis
ggaaccgcuaaagucacacug

SEQ ID NO: 2248488 - RNA, 20 nt, Yersinia pestis
ggaaauuucccccucacauu

SEQ ID NO: 2248489 - RNA, 14 nt, Yersinia pestis
ggaacaacaggcgc

SEQ ID NO: 2248490 - RNA, 18 nt, Yersinia pestis
ggaaaugccgauaaaaac

SEQ ID NO: 2248491 - RNA, 16 nt, Yersinia pestis
ggaaaguagccauuuu

SEQ ID NO: 2248492 - RNA, 14 nt, Yersinia pestis
ggaacuuacucccu

SEQ ID NO: 2248493 - RNA, 21 nt, Yersinia pestis
ggaacguggguggucauuuaa

SEQ ID NO: 2248494 - RNA, 16 nt, Yersinia pestis
ggaacguugcacccug

SEQ ID NO: 2248495 - RNA, 21 nt, Yersinia pestis
ggaacgucugcaauagcucau

SEQ ID NO: 2248496 - RNA, 15 nt, Yersinia pestis
ggaagcaagaaacug

SEQ ID NO: 2248497 - RNA, 21 nt, Yersinia pestis
ggaagagauaaaucggcggcc

SEQ ID NO: 2248498 - RNA, 20 nt, Yersinia pestis
ggaagccggcgucuuuacga

SEQ ID NO: 2248499 - RNA, 16 nt, Yersinia pestis
ggaagcaagaaacugu

SEQ ID NO: 2248500 - RNA, 13 nt, Yersinia pestis
ggaagcggccagg

SEQ ID NO: 2248501 - RNA, 19 nt, Yersinia pestis
ggaagcgccgacacccagc

SEQ ID NO: 2248502 - RNA, 19 nt, Yersinia pestis
ggaauugugucaucgcgga

SEQ ID NO: 2248503 - RNA, 11 nt, Yersinia pestis
ggaauugacua

SEQ ID NO: 2248504 - RNA, 14 nt, Yersinia pestis
ggaaugcuauauuu

SEQ ID NO: 2248505 - RNA, 20 nt, Yersinia pestis
ggaaucagcguuuuauucgu

SEQ ID NO: 2248506 - RNA, 20 nt, Yersinia pestis
ggaaucauuugaacagcauu

SEQ ID NO: 2248507 - RNA, 18 nt, Yersinia pestis
ggaaucagcguuuuauuc

SEQ ID NO: 2248508 - RNA, 21 nt, Yersinia pestis
ggaaggguuuugugggagagg

SEQ ID NO: 2248509 - RNA, 17 nt, Yersinia pestis
ggaagguaccugaucag

SEQ ID NO: 2248510 - RNA, 12 nt, Yersinia pestis
ggaaucaaagag

SEQ ID NO: 2248511 - RNA, 18 nt, Yersinia pestis
ggauauccacaucacacu

SEQ ID NO: 2248512 - RNA, 17 nt, Yersinia pestis
ggauaaucuaggccugg

SEQ ID NO: 2248513 - RNA, 15 nt, Yersinia pestis
ggauaaugauauucc

SEQ ID NO: 2248514 - RNA, 23 nt, Yersinia pestis
ggauacaaaucaucaucuugaaa

SEQ ID NO: 2248515 - RNA, 23 nt, Yersinia pestis
ggauaccaaucccuacggcaauc

SEQ ID NO: 2248516 - RNA, 20 nt, Yersinia pestis
ggauaugacuaaacugauca

SEQ ID NO: 2248517 - RNA, 15 nt, Yersinia pestis
ggauaucuucaauca

SEQ ID NO: 2248518 - RNA, 18 nt, Yersinia pestis
ggauauucacguuuuucc

SEQ ID NO: 2248519 - RNA, 17 nt, Yersinia pestis
ggaucaggaucaccagc

SEQ ID NO: 2248520 - RNA, 16 nt, Yersinia pestis
ggauccuugggucagu

SEQ ID NO: 2248521 - RNA, 22 nt, Yersinia pestis
ggaucgagcuguuugcuguaaa

SEQ ID NO: 2248522 - RNA, 14 nt, Yersinia pestis
ggauccauaggauc

SEQ ID NO: 2248523 - RNA, 20 nt, Yersinia pestis
ggaucgggcuaucaucaaag

SEQ ID NO: 2248524 - RNA, 16 nt, Yersinia pestis
ggaucgggcugauaaa

SEQ ID NO: 2248525 - RNA, 22 nt, Yersinia pestis
ggauucgugucaauauucuguu

SEQ ID NO: 2248526 - RNA, 14 nt, Yersinia pestis
ggauucuugcugca

SEQ ID NO: 2248527 - RNA, 16 nt, Yersinia pestis
ggcaaaagcaucacca

SEQ ID NO: 2248528 - RNA, 22 nt, Yersinia pestis
ggaguugguggcacaaggcugg

SEQ ID NO: 2248529 - RNA, 19 nt, Yersinia pestis
ggaguuuugauauugcgug

SEQ ID NO: 2248530 - RNA, 17 nt, Yersinia pestis
ggauaaaucgcccaacc

SEQ ID NO: 2248531 - RNA, 19 nt, Yersinia pestis
ggauaaccgcauucccugc

SEQ ID NO: 2248532 - RNA, 12 nt, Yersinia pestis
ggagcguacacg

SEQ ID NO: 2248533 - RNA, 22 nt, Yersinia pestis
ggagaagguuccccuucuucuc

SEQ ID NO: 2248534 - RNA, 23 nt, Yersinia pestis
ggagacgccuucacggguucgcg

SEQ ID NO: 2248535 - RNA, 18 nt, Yersinia pestis
ggagagcagggcccgcca

SEQ ID NO: 2248536 - RNA, 15 nt, Yersinia pestis
ggagagaaauaggca

SEQ ID NO: 2248537 - RNA, 14 nt, Yersinia pestis
ggagagaacaggca

SEQ ID NO: 2248538 - RNA, 15 nt, Yersinia pestis
ggagcaagugcuuca

SEQ ID NO: 2248539 - RNA, 18 nt, Yersinia pestis
ggagauuucagacugcug

SEQ ID NO: 2248540 - RNA, 19 nt, Yersinia pestis
ggagauuucagacugcuga

SEQ ID NO: 2248541 - RNA, 19 nt, Yersinia pestis
ggacuaauacggguuucug

SEQ ID NO: 2248542 - RNA, 18 nt, Yersinia pestis
ggcagugacaguagugag

SEQ ID NO: 2248543 - RNA, 21 nt, Yersinia pestis
ggcauaaucaacgcucaauca

SEQ ID NO: 2248544 - RNA, 16 nt, Yersinia pestis
ggcaguaacgccauaa

SEQ ID NO: 2248545 - RNA, 23 nt, Yersinia pestis
ggcaugccaauuauucucugaac

SEQ ID NO: 2248546 - RNA, 16 nt, Yersinia pestis
ggcaugcauuggaaaa

SEQ ID NO: 2248547 - RNA, 18 nt, Yersinia pestis
ggcaggcccgcuucccua

SEQ ID NO: 2248548 - RNA, 17 nt, Yersinia pestis
ggcagccugcggcggcu

SEQ ID NO: 2248549 - RNA, 14 nt, Yersinia pestis
ggcagcgagcacug

SEQ ID NO: 2248550 - RNA, 12 nt, Yersinia pestis
ggcaaagaagaa

SEQ ID NO: 2248551 - RNA, 22 nt, Yersinia pestis
ggcaaagaauugagguaaacca

SEQ ID NO: 2248552 - RNA, 20 nt, Yersinia pestis
ggcaaacgcuuuuaacugug

SEQ ID NO: 2248553 - RNA, 17 nt, Yersinia pestis
ggcacaccgcuacaggc

SEQ ID NO: 2248554 - RNA, 15 nt, Yersinia pestis
ggcacauaacguuau

SEQ ID NO: 2248555 - RNA, 21 nt, Yersinia pestis
ggcacaucuccagaauauaaa

SEQ ID NO: 2248556 - RNA, 14 nt, Yersinia pestis
ggcacaguuuaucu

SEQ ID NO: 2248557 - RNA, 19 nt, Yersinia pestis
ggcagauaugccaggcauc

SEQ ID NO: 2248558 - RNA, 21 nt, Yersinia pestis
ggcagauaugccaggcaucau

SEQ ID NO: 2248559 - RNA, 20 nt, Yersinia pestis
ggcagauuggauugaaauca

SEQ ID NO: 2248560 - RNA, 23 nt, Yersinia pestis
ggcacuaaaaucugcucccggca

SEQ ID NO: 2248561 - RNA, 20 nt, Yersinia pestis
ggcacugcccugccugguau

SEQ ID NO: 2248562 - RNA, 15 nt, Yersinia pestis
ggcacugcagaaaau

SEQ ID NO: 2248563 - RNA, 14 nt, Yersinia pestis
ggccccagcccagc

SEQ ID NO: 2248564 - RNA, 19 nt, Yersinia pestis
ggccccaauccaccacuga

SEQ ID NO: 2248565 - RNA, 20 nt, Yersinia pestis
ggcccgcuagugauagcggg

SEQ ID NO: 2248566 - RNA, 14 nt, Yersinia pestis
ggcccgcuucccua

SEQ ID NO: 2248567 - RNA, 13 nt, Yersinia pestis
ggcccggccaggc

SEQ ID NO: 2248568 - RNA, 20 nt, Yersinia pestis
ggccgaucaacaggccaccu

SEQ ID NO: 2248569 - RNA, 21 nt, Yersinia pestis
ggccgauacgcgccgcagcag

SEQ ID NO: 2248570 - RNA, 15 nt, Yersinia pestis
ggccauuagcgcggg

SEQ ID NO: 2248571 - RNA, 18 nt, Yersinia pestis
ggccaugucgaucauggc

SEQ ID NO: 2248572 - RNA, 14 nt, Yersinia pestis
ggccaguguuuucu

SEQ ID NO: 2248573 - RNA, 17 nt, Yersinia pestis
ggccaguugccacucau

SEQ ID NO: 2248574 - RNA, 23 nt, Yersinia pestis
ggccauacuggguuuaaaggugg

SEQ ID NO: 2248575 - RNA, 21 nt, Yersinia pestis
ggccagcgcuaacgguggcau

SEQ ID NO: 2248576 - RNA, 22 nt, Yersinia pestis
ggccagcgcuaacgguggcauu

SEQ ID NO: 2248577 - RNA, 20 nt, Yersinia pestis
ggccagcuuuuuaucauuua

SEQ ID NO: 2248578 - RNA, 19 nt, Yersinia pestis
ggccagcuugcaaguguau

SEQ ID NO: 2248579 - RNA, 14 nt, Yersinia pestis
ggccaccacgaaaa

SEQ ID NO: 2248580 - RNA, 14 nt, Yersinia pestis
ggcauuaaacugaa

SEQ ID NO: 2248581 - RNA, 16 nt, Yersinia pestis
ggccaccagacugaca

SEQ ID NO: 2248582 - RNA, 17 nt, Yersinia pestis
ggccaccacgaaaaaau

SEQ ID NO: 2248583 - RNA, 19 nt, Yersinia pestis
ggccacccugccaaaaaau

SEQ ID NO: 2248584 - RNA, 18 nt, Yersinia pestis
ggccacccugccaaaaaa

SEQ ID NO: 2248585 - RNA, 14 nt, Yersinia pestis
ggccagagcauaga

SEQ ID NO: 2248586 - RNA, 21 nt, Yersinia pestis
ggccacggcucacacacuaau

SEQ ID NO: 2248587 - RNA, 15 nt, Yersinia pestis
uaaugagaauguaaa

SEQ ID NO: 2248588 - RNA, 14 nt, Yersinia pestis
uaaugacauaauca

SEQ ID NO: 2248589 - RNA, 15 nt, Yersinia pestis
uaaugaguuggcauu

SEQ ID NO: 2248590 - RNA, 22 nt, Yersinia pestis
uaaugaguaagcgcggucauau

SEQ ID NO: 2248591 - RNA, 22 nt, Yersinia pestis
uaaugauacgugcuauagaaaa

SEQ ID NO: 2248592 - RNA, 13 nt, Yersinia pestis
uaaugaaaaggca

SEQ ID NO: 2248593 - RNA, 20 nt, Yersinia pestis
uaaugaaaauagccaaccag

SEQ ID NO: 2248594 - RNA, 14 nt, Yersinia pestis
uaaugauugauuau

SEQ ID NO: 2248595 - RNA, 23 nt, Yersinia pestis
uaaugauugauuaucaaguuaaa

SEQ ID NO: 2248596 - RNA, 20 nt, Yersinia pestis
uaaugaugagguaauacuca

SEQ ID NO: 2248597 - RNA, 15 nt, Yersinia pestis
uaaugcaccaaucaa

SEQ ID NO: 2248598 - RNA, 18 nt, Yersinia pestis
uaaugccccuuuuuuacc

SEQ ID NO: 2248599 - RNA, 18 nt, Yersinia pestis
uaaugcauucugcugguu

SEQ ID NO: 2248600 - RNA, 18 nt, Yersinia pestis
uaaugcccgucauauuua

SEQ ID NO: 2248601 - RNA, 21 nt, Yersinia pestis
uaaugccgaaugauucauuga

SEQ ID NO: 2248602 - RNA, 18 nt, Yersinia pestis
uaaugcgaagcuuuuauu

SEQ ID NO: 2248603 - RNA, 12 nt, Yersinia pestis
uaaugcggcucu

SEQ ID NO: 2248604 - RNA, 13 nt, Yersinia pestis
uaaugcgaaaaaa

SEQ ID NO: 2248605 - RNA, 14 nt, Yersinia pestis
uaaugcgaaaaaag

SEQ ID NO: 2248606 - RNA, 18 nt, Yersinia pestis
uaaugccuggugcaaccg

SEQ ID NO: 2248607 - RNA, 14 nt, Yersinia pestis
uaauucaaaaugua

SEQ ID NO: 2248608 - RNA, 22 nt, Yersinia pestis
uaauucaauauauacaauccaa

SEQ ID NO: 2248609 - RNA, 19 nt, Yersinia pestis
uaauucagcaucaaauuau

SEQ ID NO: 2248610 - RNA, 21 nt, Yersinia pestis
uaauucagcaucaaauuauuu

SEQ ID NO: 2248611 - RNA, 17 nt, Yersinia pestis
uaauucacugcuuaauc

SEQ ID NO: 2248612 - RNA, 18 nt, Yersinia pestis
uaauucacugcuuaaucc

SEQ ID NO: 2248613 - RNA, 19 nt, Yersinia pestis
uaauucaggcaaauucuca

SEQ ID NO: 2248614 - RNA, 13 nt, Yersinia pestis
uaauuauuucucu

SEQ ID NO: 2248615 - RNA, 23 nt, Yersinia pestis
uaauuacacccaacuuuuuuacc

SEQ ID NO: 2248616 - RNA, 15 nt, Yersinia pestis
uaauuauauuuaauu

SEQ ID NO: 2248617 - RNA, 15 nt, Yersinia pestis
uaauuauagugaaaa

SEQ ID NO: 2248618 - RNA, 10 nt, Yersinia pestis
uaauuaaaaa

SEQ ID NO: 2248619 - RNA, 14 nt, Yersinia pestis
uaauuaauauauaa

SEQ ID NO: 2248620 - RNA, 13 nt, Yersinia pestis
uaauuaauuuaaa

SEQ ID NO: 2248621 - RNA, 14 nt, Yersinia pestis
uaauuaauuauuca

SEQ ID NO: 2248622 - RNA, 22 nt, Yersinia pestis
uaauuaauucaaucggcagauu

SEQ ID NO: 2248623 - RNA, 15 nt, Yersinia pestis
uaauggucaagguga

SEQ ID NO: 2248624 - RNA, 21 nt, Yersinia pestis
uaauggucaaggugauuucaa

SEQ ID NO: 2248625 - RNA, 20 nt, Yersinia pestis
uaaugguuaccaaaaagcaa

SEQ ID NO: 2248626 - RNA, 16 nt, Yersinia pestis
uaauggugaaccagau

SEQ ID NO: 2248627 - RNA, 19 nt, Yersinia pestis
uaauggugcuauuucuggc

SEQ ID NO: 2248628 - RNA, 19 nt, Yersinia pestis
uaaugcuauccacaaacuc

SEQ ID NO: 2248629 - RNA, 15 nt, Yersinia pestis
uaauggcauuuucag

SEQ ID NO: 2248630 - RNA, 12 nt, Yersinia pestis
uaauauaauuca

SEQ ID NO: 2248631 - RNA, 18 nt, Yersinia pestis
uaauauaauucaauauau

SEQ ID NO: 2248632 - RNA, 19 nt, Yersinia pestis
uaauauaauucaauauaua

SEQ ID NO: 2248633 - RNA, 16 nt, Yersinia pestis
uaauauauaaaauaaa

SEQ ID NO: 2248634 - RNA, 11 nt, Yersinia pestis
uaauaucugcc

SEQ ID NO: 2248635 - RNA, 12 nt, Yersinia pestis
uaauaucaccau

SEQ ID NO: 2248636 - RNA, 13 nt, Yersinia pestis
uaauaucagcgau

SEQ ID NO: 2248637 - RNA, 12 nt, Yersinia pestis
uaauaguucauu

SEQ ID NO: 2248638 - RNA, 16 nt, Yersinia pestis
uaauaguucauuuugu

SEQ ID NO: 2248639 - RNA, 19 nt, Yersinia pestis
uaauaguguuguaagauuu

SEQ ID NO: 2248640 - RNA, 17 nt, Yersinia pestis
uaauagcuuaaucauca

SEQ ID NO: 2248641 - RNA, 17 nt, Yersinia pestis
uaacguugcaaaugcua

SEQ ID NO: 2248642 - RNA, 14 nt, Yersinia pestis
uaacggaaaaucau

SEQ ID NO: 2248643 - RNA, 20 nt, Yersinia pestis
uaacggaauuucgauaaaag

SEQ ID NO: 2248644 - RNA, 14 nt, Yersinia pestis
uaauauuuauaaaa

SEQ ID NO: 2248645 - RNA, 21 nt, Yersinia pestis
uaauauuuaucugcauuaaaa

SEQ ID NO: 2248646 - RNA, 16 nt, Yersinia pestis
uaauauuuauaaaaaa

SEQ ID NO: 2248647 - RNA, 16 nt, Yersinia pestis
uaauaucuuuaaauua

SEQ ID NO: 2248648 - RNA, 15 nt, Yersinia pestis
uaauauugaauaacc

SEQ ID NO: 2248649 - RNA, 18 nt, Yersinia pestis
uaaucaucuacaacauca

SEQ ID NO: 2248650 - RNA, 20 nt, Yersinia pestis
uaaucaucagggaauugacu

SEQ ID NO: 2248651 - RNA, 18 nt, Yersinia pestis
uaaucagacugcugacaa

SEQ ID NO: 2248652 - RNA, 23 nt, Yersinia pestis
uaaucacgauacgacuucuuauu

SEQ ID NO: 2248653 - RNA, 19 nt, Yersinia pestis
uaaucaccucaaccugcca

SEQ ID NO: 2248654 - RNA, 12 nt, Yersinia pestis
uaaucaccuuca

SEQ ID NO: 2248655 - RNA, 18 nt, Yersinia pestis
uaauccaaaauaauauaa

SEQ ID NO: 2248656 - RNA, 19 nt, Yersinia pestis
uaauccuaaugaacacuua

SEQ ID NO: 2248657 - RNA, 20 nt, Yersinia pestis
uaauccucucuugaaaugau

SEQ ID NO: 2248658 - RNA, 15 nt, Yersinia pestis
uacaagacaagcccg

SEQ ID NO: 2248659 - RNA, 20 nt, Yersinia pestis
uacaagccgugaccaaagug

SEQ ID NO: 2248660 - RNA, 23 nt, Yersinia pestis
uacaagcagcguucaaaucugcu

SEQ ID NO: 2248661 - RNA, 18 nt, Yersinia pestis
uacaagcacucaauguca

SEQ ID NO: 2248662 - RNA, 12 nt, Yersinia pestis
uacaaggggcau

SEQ ID NO: 2248663 - RNA, 20 nt, Yersinia pestis
uacaagugccaaauggaaua

SEQ ID NO: 2248664 - RNA, 22 nt, Yersinia pestis
uacaacuucuucauaacgcuuu

SEQ ID NO: 2248665 - RNA, 16 nt, Yersinia pestis
uacaaaccguuugccg

SEQ ID NO: 2248666 - RNA, 18 nt, Yersinia pestis
uacaccauuuccaggcua

SEQ ID NO: 2248667 - RNA, 19 nt, Yersinia pestis
uacacccaacuuuuuuacc

SEQ ID NO: 2248668 - RNA, 14 nt, Yersinia pestis
uacaccccaucagc

SEQ ID NO: 2248669 - RNA, 18 nt, Yersinia pestis
uacaccuuaaaacagcag

SEQ ID NO: 2248670 - RNA, 15 nt, Yersinia pestis
uacacaugaaaauca

SEQ ID NO: 2248671 - RNA, 22 nt, Yersinia pestis
uacaccaccgccgcaacaauaa

SEQ ID NO: 2248672 - RNA, 14 nt, Yersinia pestis
uacaccauguucuu

SEQ ID NO: 2248673 - RNA, 17 nt, Yersinia pestis
uacacaguuauucccau

SEQ ID NO: 2248674 - RNA, 21 nt, Yersinia pestis
uacaauucgaccguuuuuaca

SEQ ID NO: 2248675 - RNA, 23 nt, Yersinia pestis
uacacagcacggcaacaggcuuu

SEQ ID NO: 2248676 - RNA, 15 nt, Yersinia pestis
uacaauaaaucaauu

SEQ ID NO: 2248677 - RNA, 16 nt, Yersinia pestis
uacagucgcugcuguu

SEQ ID NO: 2248678 - RNA, 17 nt, Yersinia pestis
uacagucgcugcuguug

SEQ ID NO: 2248679 - RNA, 22 nt, Yersinia pestis
uacaguaagguauugauacagu

SEQ ID NO: 2248680 - RNA, 15 nt, Yersinia pestis
uacaguuaauuucaa

SEQ ID NO: 2248681 - RNA, 23 nt, Yersinia pestis
uacaguggcgagcgcagggucag

SEQ ID NO: 2248682 - RNA, 15 nt, Yersinia pestis
uacagugauaaucac

SEQ ID NO: 2248683 - RNA, 15 nt, Yersinia pestis
uacagcacucaguac

SEQ ID NO: 2248684 - RNA, 20 nt, Yersinia pestis
uacagcagggauucugucag

SEQ ID NO: 2248685 - RNA, 12 nt, Yersinia pestis
uacagccacgau

SEQ ID NO: 2248686 - RNA, 19 nt, Yersinia pestis
uacaccuucuuuaucuguc

SEQ ID NO: 2248687 - RNA, 21 nt, Yersinia pestis
uaauuuaggugaaaauaauaa

SEQ ID NO: 2248688 - RNA, 18 nt, Yersinia pestis
uaauuuaucaguagucaa

SEQ ID NO: 2248689 - RNA, 22 nt, Yersinia pestis
uaauuuauacauaucagaacag

SEQ ID NO: 2248690 - RNA, 17 nt, Yersinia pestis
uaauuucaaaguaaaau

SEQ ID NO: 2248691 - RNA, 11 nt, Yersinia pestis
uaauuuaaacu

SEQ ID NO: 2248692 - RNA, 13 nt, Yersinia pestis
uaauuuaaauaaa

SEQ ID NO: 2248693 - RNA, 20 nt, Yersinia pestis
uaauuuaaauaaaauaaauu

SEQ ID NO: 2248694 - RNA, 12 nt, Yersinia pestis
uaauuuggcuua

SEQ ID NO: 2248695 - RNA, 9 nt, Yersinia pestis
uaauuugua

SEQ ID NO: 2248696 - RNA, 12 nt, Yersinia pestis
uaauuuguaaau

SEQ ID NO: 2248697 - RNA, 15 nt, Yersinia pestis
uaauuugccuucauc

SEQ ID NO: 2248698 - RNA, 19 nt, Yersinia pestis
uaauuucggaucagcgccu

SEQ ID NO: 2248699 - RNA, 12 nt, Yersinia pestis
uaauuuuucaua

SEQ ID NO: 2248700 - RNA, 19 nt, Yersinia pestis
uaauuuuucuuccaccauc

SEQ ID NO: 2248701 - RNA, 16 nt, Yersinia pestis
uacaaaaaacaaaccg

SEQ ID NO: 2248702 - RNA, 21 nt, Yersinia pestis
uacaaaccacauuuuuuaaaa

SEQ ID NO: 2248703 - RNA, 22 nt, Yersinia pestis
uacaaacagggcagccaauuac

SEQ ID NO: 2248704 - RNA, 23 nt, Yersinia pestis
uaccuaaccaaacauugucaccu

SEQ ID NO: 2248705 - RNA, 15 nt, Yersinia pestis
uaccuaaccaaacau

SEQ ID NO: 2248706 - RNA, 18 nt, Yersinia pestis
uaccgguuugggcaucaa

SEQ ID NO: 2248707 - RNA, 21 nt, Yersinia pestis
uaccuucaggccuuuacuguu

SEQ ID NO: 2248708 - RNA, 15 nt, Yersinia pestis
uaccuauuuuaaaac

SEQ ID NO: 2248709 - RNA, 19 nt, Yersinia pestis
uaccuuuaacuguuuuaua

SEQ ID NO: 2248710 - RNA, 18 nt, Yersinia pestis
uaccuuuaacuguuuuau

SEQ ID NO: 2248711 - RNA, 15 nt, Yersinia pestis
uaccuugugucacca

SEQ ID NO: 2248712 - RNA, 20 nt, Yersinia pestis
uaccuuuugcauauuucucu

SEQ ID NO: 2248713 - RNA, 17 nt, Yersinia pestis
uacgauccgcuauuuuc

SEQ ID NO: 2248714 - RNA, 20 nt, Yersinia pestis
uacgauccgcuauuuucucu

SEQ ID NO: 2248715 - RNA, 21 nt, Yersinia pestis
uacgauccgcuauuuucucug

SEQ ID NO: 2248716 - RNA, 17 nt, Yersinia pestis
uacguagacauaaauuu

SEQ ID NO: 2248717 - RNA, 16 nt, Yersinia pestis
uacggguauagcggcg

SEQ ID NO: 2248718 - RNA, 18 nt, Yersinia pestis
uacgucagaaauaaauuc

SEQ ID NO: 2248719 - RNA, 16 nt, Yersinia pestis
uacgucaggaauaaag

SEQ ID NO: 2248720 - RNA, 21 nt, Yersinia pestis
uacguauuucgugauuuucuu

SEQ ID NO: 2248721 - RNA, 14 nt, Yersinia pestis
uacggagaagagga

SEQ ID NO: 2248722 - RNA, 21 nt, Yersinia pestis
uacggauucagcgucagucaa

SEQ ID NO: 2248723 - RNA, 15 nt, Yersinia pestis
uacggcggccaucau

SEQ ID NO: 2248724 - RNA, 14 nt, Yersinia pestis
uacgcaucacgccc

SEQ ID NO: 2248725 - RNA, 23 nt, Yersinia pestis
uacgcaugaucccugguuugcca

SEQ ID NO: 2248726 - RNA, 20 nt, Yersinia pestis
uacgaucugccuguucucuc

SEQ ID NO: 2248727 - RNA, 19 nt, Yersinia pestis
uacgcuaugaauaagcauu

SEQ ID NO: 2248728 - RNA, 22 nt, Yersinia pestis
uaccagaaaguuuaaucaguuc

SEQ ID NO: 2248729 - RNA, 20 nt, Yersinia pestis
uaccauuuucagacugaaau

SEQ ID NO: 2248730 - RNA, 22 nt, Yersinia pestis
uaccauuuucagacugaaauga

SEQ ID NO: 2248731 - RNA, 14 nt, Yersinia pestis
uacccaaagccagu

SEQ ID NO: 2248732 - RNA, 14 nt, Yersinia pestis
uacccaaaccaaca

SEQ ID NO: 2248733 - RNA, 13 nt, Yersinia pestis
uacccaaaccaac

SEQ ID NO: 2248734 - RNA, 17 nt, Yersinia pestis
uaccaggaagcggccag

SEQ ID NO: 2248735 - RNA, 22 nt, Yersinia pestis
uacauaccacuuaguggcauug

SEQ ID NO: 2248736 - RNA, 16 nt, Yersinia pestis
uacauagaagcucaua

SEQ ID NO: 2248737 - RNA, 22 nt, Yersinia pestis
uacauagaagcucauaugcagc

SEQ ID NO: 2248738 - RNA, 17 nt, Yersinia pestis
uacauaaguaagugauu

SEQ ID NO: 2248739 - RNA, 14 nt, Yersinia pestis
uaccacugcucacu

SEQ ID NO: 2248740 - RNA, 22 nt, Yersinia pestis
uaccacuagcagagcacgcaga

SEQ ID NO: 2248741 - RNA, 17 nt, Yersinia pestis
uaccacgucuaauugcu

SEQ ID NO: 2248742 - RNA, 12 nt, Yersinia pestis
uacauagaugua

SEQ ID NO: 2248743 - RNA, 15 nt, Yersinia pestis
uacauagauguauuu

SEQ ID NO: 2248744 - RNA, 19 nt, Yersinia pestis
uaccaccuacaaccuacca

SEQ ID NO: 2248745 - RNA, 20 nt, Yersinia pestis
uaccaccuacaaccuaccac

SEQ ID NO: 2248746 - RNA, 13 nt, Yersinia pestis
uaccaccuaccac

SEQ ID NO: 2248747 - RNA, 16 nt, Yersinia pestis
uaccaccuaccaccua

SEQ ID NO: 2248748 - RNA, 18 nt, Yersinia pestis
uaccaccuaccaccuacc

SEQ ID NO: 2248749 - RNA, 16 nt, Yersinia pestis
uaccgccaauaucugu

SEQ ID NO: 2248750 - RNA, 23 nt, Yersinia pestis
uaccgcaaccgggccggguugau

SEQ ID NO: 2248751 - RNA, 17 nt, Yersinia pestis
uaccgccauaguacaua

SEQ ID NO: 2248752 - RNA, 17 nt, Yersinia pestis
uaccgccacuuuaacug

SEQ ID NO: 2248753 - RNA, 13 nt, Yersinia pestis
uaccgcccguuga

SEQ ID NO: 2248754 - RNA, 22 nt, Yersinia pestis
uaccgcugcccggcucaucaag

SEQ ID NO: 2248755 - RNA, 15 nt, Yersinia pestis
uaccgcuaugcuaaa

SEQ ID NO: 2248756 - RNA, 23 nt, Yersinia pestis
uaccgguaaaauuauugccgcag

SEQ ID NO: 2248757 - RNA, 18 nt, Yersinia pestis
uaccgggcgaacagaaau

SEQ ID NO: 2248758 - RNA, 21 nt, Yersinia pestis
uacccaccagagaccacagau

SEQ ID NO: 2248759 - RNA, 16 nt, Yersinia pestis
uacccgaguaugguua

SEQ ID NO: 2248760 - RNA, 13 nt, Yersinia pestis
uacccugcaccau

SEQ ID NO: 2248761 - RNA, 14 nt, Yersinia pestis
uacccugcaccaua

SEQ ID NO: 2248762 - RNA, 15 nt, Yersinia pestis
uacccucgacaccaa

SEQ ID NO: 2248763 - RNA, 16 nt, Yersinia pestis
uacccucgacaccaaa

SEQ ID NO: 2248764 - RNA, 17 nt, Yersinia pestis
uacccucgacaccaaaa

SEQ ID NO: 2248765 - RNA, 19 nt, Yersinia pestis
uacccucgacaccaaaacu

SEQ ID NO: 2248766 - RNA, 23 nt, Yersinia pestis
uacccuaaauaauaucugucuga

SEQ ID NO: 2248767 - RNA, 21 nt, Yersinia pestis
uacccuaacucuuuggauggg

SEQ ID NO: 2248768 - RNA, 22 nt, Yersinia pestis
uaccgaugcaaucgcauugcgu

SEQ ID NO: 2248769 - RNA, 13 nt, Yersinia pestis
uacccuuugagaa

SEQ ID NO: 2248770 - RNA, 20 nt, Yersinia pestis
uacccuuaacggucagaucc

SEQ ID NO: 2248771 - RNA, 23 nt, Yersinia pestis
uaccgaaauauucgucucaucaa

SEQ ID NO: 2248772 - RNA, 15 nt, Yersinia pestis
uacucagcauccucc

SEQ ID NO: 2248773 - RNA, 20 nt, Yersinia pestis
uacuauuuuuuauauugcuc

SEQ ID NO: 2248774 - RNA, 13 nt, Yersinia pestis
uacuauuuguagu

SEQ ID NO: 2248775 - RNA, 20 nt, Yersinia pestis
uacuauuuguaguuuuucau

SEQ ID NO: 2248776 - RNA, 13 nt, Yersinia pestis
uacuauuuucauu

SEQ ID NO: 2248777 - RNA, 17 nt, Yersinia pestis
uacuauuuucauuguuc

SEQ ID NO: 2248778 - RNA, 22 nt, Yersinia pestis
uacgugacggcggcgagcacug

SEQ ID NO: 2248779 - RNA, 22 nt, Yersinia pestis
uacgugacggcagcgagcacug

SEQ ID NO: 2248780 - RNA, 22 nt, Yersinia pestis
uacucaggauuagcuucugcua

SEQ ID NO: 2248781 - RNA, 22 nt, Yersinia pestis
uacucauauuguccaaaggaag

SEQ ID NO: 2248782 - RNA, 19 nt, Yersinia pestis
uacucauauuguccaaagg

SEQ ID NO: 2248783 - RNA, 14 nt, Yersinia pestis
uacucauuauggau

SEQ ID NO: 2248784 - RNA, 16 nt, Yersinia pestis
uacucccggcagcacu

SEQ ID NO: 2248785 - RNA, 19 nt, Yersinia pestis
uacuccauuugaacugugg

SEQ ID NO: 2248786 - RNA, 19 nt, Yersinia pestis
uacuccauccccaacucuu

SEQ ID NO: 2248787 - RNA, 12 nt, Yersinia pestis
uacuccucugcc

SEQ ID NO: 2248788 - RNA, 20 nt, Yersinia pestis
uacuccuuaaucguccgguc

SEQ ID NO: 2248789 - RNA, 16 nt, Yersinia pestis
uacucguauaaaaaau

SEQ ID NO: 2248790 - RNA, 20 nt, Yersinia pestis
uacucucgccaaacaaaugu

SEQ ID NO: 2248791 - RNA, 23 nt, Yersinia pestis
uacucugcggcaggcugaucuuc

SEQ ID NO: 2248792 - RNA, 17 nt, Yersinia pestis
uacucuuccuguacguu

SEQ ID NO: 2248793 - RNA, 18 nt, Yersinia pestis
uacucuucgaucauucua

SEQ ID NO: 2248794 - RNA, 21 nt, Yersinia pestis
uacugaaauauacacaaguca

SEQ ID NO: 2248795 - RNA, 14 nt, Yersinia pestis
uacugauacaacaa

SEQ ID NO: 2248796 - RNA, 19 nt, Yersinia pestis
uacugaugaagccgccgga

SEQ ID NO: 2248797 - RNA, 13 nt, Yersinia pestis
uacugcuuuucua

SEQ ID NO: 2248798 - RNA, 18 nt, Yersinia pestis
uacugcgguccuacccuu

SEQ ID NO: 2248799 - RNA, 20 nt, Yersinia pestis
uacuuugauucaaaaugcca

SEQ ID NO: 2248800 - RNA, 18 nt, Yersinia pestis
uacuuugcgcgcuguggc

SEQ ID NO: 2248801 - RNA, 22 nt, Yersinia pestis
uacuuucccauagcuggcuuca

SEQ ID NO: 2248802 - RNA, 13 nt, Yersinia pestis
uacuuuuuauuaa

SEQ ID NO: 2248803 - RNA, 20 nt, Yersinia pestis
uacuugauaaggcaaggccg

SEQ ID NO: 2248804 - RNA, 23 nt, Yersinia pestis
uacuuuauuuaaaauuaauaguu

SEQ ID NO: 2248805 - RNA, 20 nt, Yersinia pestis
uacuucgaugauuauuuugu

SEQ ID NO: 2248806 - RNA, 16 nt, Yersinia pestis
uacuuccaauaaguca

SEQ ID NO: 2248807 - RNA, 18 nt, Yersinia pestis
uacuucaaaacuaauauu

SEQ ID NO: 2248808 - RNA, 24 nt, Yersinia pestis
uacuuauugggcgcgauaaaagau

SEQ ID NO: 2248809 - RNA, 18 nt, Yersinia pestis
uacuuacccgaaucacuu

SEQ ID NO: 2248810 - RNA, 13 nt, Yersinia pestis
uacuguuuugguu

SEQ ID NO: 2248811 - RNA, 18 nt, Yersinia pestis
uacuuaacaaucagugca

SEQ ID NO: 2248812 - RNA, 14 nt, Yersinia pestis
uacugucaaugcuc

SEQ ID NO: 2248813 - RNA, 16 nt, Yersinia pestis
uacugucauuuccucc

SEQ ID NO: 2248814 - RNA, 22 nt, Yersinia pestis
uacuguucugggggugauauuu

SEQ ID NO: 2248815 - RNA, 18 nt, Yersinia pestis
uacuguuggcaauuucac

SEQ ID NO: 2248816 - RNA, 21 nt, Yersinia pestis
uacuguuuucauuauuuucac

SEQ ID NO: 2248817 - RNA, 13 nt, Yersinia pestis
uacuguuuucauu

SEQ ID NO: 2248818 - RNA, 14 nt, Yersinia pestis
uacuguuuucauua

SEQ ID NO: 2248819 - RNA, 14 nt, Yersinia pestis
uacugguaccaaac

SEQ ID NO: 2248820 - RNA, 18 nt, Yersinia pestis
uacuggguaacaauucaa

SEQ ID NO: 2248821 - RNA, 18 nt, Yersinia pestis
uacugcuuuucuaccuga

SEQ ID NO: 2248822 - RNA, 21 nt, Yersinia pestis
uacuggccuggcauuuuacug

SEQ ID NO: 2248823 - RNA, 17 nt, Yersinia pestis
uaugaaaaaccuccggc

SEQ ID NO: 2248824 - RNA, 18 nt, Yersinia pestis
uaucuuuuauuuaugaua

SEQ ID NO: 2248825 - RNA, 13 nt, Yersinia pestis
uaugaauuaauuu

SEQ ID NO: 2248826 - RNA, 16 nt, Yersinia pestis
uaugaauuaauuuauu

SEQ ID NO: 2248827 - RNA, 19 nt, Yersinia pestis
uaugaaugagguuuacauu

SEQ ID NO: 2248828 - RNA, 20 nt, Yersinia pestis
uaugaaugagguuuacauuu

SEQ ID NO: 2248829 - RNA, 16 nt, Yersinia pestis
uaucuuuaauuuuucc

SEQ ID NO: 2248830 - RNA, 19 nt, Yersinia pestis
uaucuuguaaauagucaua

SEQ ID NO: 2248831 - RNA, 13 nt, Yersinia pestis
uaucuuuaauuuu

SEQ ID NO: 2248832 - RNA, 14 nt, Yersinia pestis
uaucuugcauacaa

SEQ ID NO: 2248833 - RNA, 18 nt, Yersinia pestis
uaucugcucuugcucagu

SEQ ID NO: 2248834 - RNA, 23 nt, Yersinia pestis
uaucugcggugaucaccagauca

SEQ ID NO: 2248835 - RNA, 19 nt, Yersinia pestis
uaugcaguuaagguuagcu

SEQ ID NO: 2248836 - RNA, 12 nt, Yersinia pestis
uaugcagcucaa

SEQ ID NO: 2248837 - RNA, 17 nt, Yersinia pestis
uaugcagcucaaucaca

SEQ ID NO: 2248838 - RNA, 18 nt, Yersinia pestis
uaugcaaaauaauauuaa

SEQ ID NO: 2248839 - RNA, 18 nt, Yersinia pestis
uaugaucuugauaaacau

SEQ ID NO: 2248840 - RNA, 16 nt, Yersinia pestis
uaugacagcauacauc

SEQ ID NO: 2248841 - RNA, 21 nt, Yersinia pestis
uaugacaaguugucuguaaua

SEQ ID NO: 2248842 - RNA, 21 nt, Yersinia pestis
uaugacgccaacuucaagccg

SEQ ID NO: 2248843 - RNA, 14 nt, Yersinia pestis
uaugacgcgcugcu

SEQ ID NO: 2248844 - RNA, 15 nt, Yersinia pestis
uaugauaauaguuca

SEQ ID NO: 2248845 - RNA, 15 nt, Yersinia pestis
uaugugccaaaaaaa

SEQ ID NO: 2248846 - RNA, 16 nt, Yersinia pestis
uaugugccaaaaaaag

SEQ ID NO: 2248847 - RNA, 13 nt, Yersinia pestis
uauguuaaaucag

SEQ ID NO: 2248848 - RNA, 17 nt, Yersinia pestis
uauguuuuuaacaaaau

SEQ ID NO: 2248849 - RNA, 15 nt, Yersinia pestis
uauguccucaccauu

SEQ ID NO: 2248850 - RNA, 16 nt, Yersinia pestis
uauguacacauuauuu

SEQ ID NO: 2248851 - RNA, 19 nt, Yersinia pestis
uauggggaugauuguuuua

SEQ ID NO: 2248852 - RNA, 15 nt, Yersinia pestis
uauggggauuuuauu

SEQ ID NO: 2248853 - RNA, 13 nt, Yersinia pestis
uauggucagcaau

SEQ ID NO: 2248854 - RNA, 21 nt, Yersinia pestis
uaugguauagacuguuuuauu

SEQ ID NO: 2248855 - RNA, 16 nt, Yersinia pestis
uaugguuaaucuaccc

SEQ ID NO: 2248856 - RNA, 15 nt, Yersinia pestis
uauggauaauuuaau

SEQ ID NO: 2248857 - RNA, 15 nt, Yersinia pestis
uauggauacacggcu

SEQ ID NO: 2248858 - RNA, 20 nt, Yersinia pestis
uauggacaagggcuauuuuu

SEQ ID NO: 2248859 - RNA, 15 nt, Yersinia pestis
uaugcugauaaaauu

SEQ ID NO: 2248860 - RNA, 23 nt, Yersinia pestis
uaugcucaccgcccccaauaagg

SEQ ID NO: 2248861 - RNA, 13 nt, Yersinia pestis
uaugcucagcaac

SEQ ID NO: 2248862 - RNA, 12 nt, Yersinia pestis
uaugcucugcug

SEQ ID NO: 2248863 - RNA, 20 nt, Yersinia pestis
uaugcugaauaaacggcaag

SEQ ID NO: 2248864 - RNA, 17 nt, Yersinia pestis
uauggaaguaauccaga

SEQ ID NO: 2248865 - RNA, 16 nt, Yersinia pestis
uaugcuucacaucaua

SEQ ID NO: 2248866 - RNA, 15 nt, Yersinia pestis
uaugcuuaauuuggc

SEQ ID NO: 2248867 - RNA, 20 nt, Yersinia pestis
uaugccuuggcaaagagacu

SEQ ID NO: 2248868 - RNA, 13 nt, Yersinia pestis
uaugccuuuucuu

SEQ ID NO: 2248869 - RNA, 16 nt, Yersinia pestis
uaugccuuuucuuccg

SEQ ID NO: 2248870 - RNA, 16 nt, Yersinia pestis
uaugcgcgucaaucca

SEQ ID NO: 2248871 - RNA, 15 nt, Yersinia pestis
uaugcgcuggcucua

SEQ ID NO: 2248872 - RNA, 19 nt, Yersinia pestis
uaugcguggguucuucaaa

SEQ ID NO: 2248873 - RNA, 16 nt, Yersinia pestis
uaugcguguugccacc

SEQ ID NO: 2248874 - RNA, 19 nt, Yersinia pestis
uaugccggaggauauuuau

SEQ ID NO: 2248875 - RNA, 19 nt, Yersinia pestis
uaugccggggauauuuugc

SEQ ID NO: 2248876 - RNA, 14 nt, Yersinia pestis
uaugcauuauugau

SEQ ID NO: 2248877 - RNA, 22 nt, Yersinia pestis
uaugcauuauugauguuauuaa

SEQ ID NO: 2248878 - RNA, 16 nt, Yersinia pestis
uaugccaguuauuauu

SEQ ID NO: 2248879 - RNA, 16 nt, Yersinia pestis
uaugccauaacaucgu

SEQ ID NO: 2248880 - RNA, 16 nt, Yersinia pestis
uauaugcugauaaaau

SEQ ID NO: 2248881 - RNA, 20 nt, Yersinia pestis
uauaugcgcuggcucuauuu

SEQ ID NO: 2248882 - RNA, 13 nt, Yersinia pestis
uauauuuuucuuu

SEQ ID NO: 2248883 - RNA, 23 nt, Yersinia pestis
uauauuuuuggggucugaauaua

SEQ ID NO: 2248884 - RNA, 22 nt, Yersinia pestis
uauauuuugaauauuuuuaauc

SEQ ID NO: 2248885 - RNA, 14 nt, Yersinia pestis
uaucaaaaggauaa

SEQ ID NO: 2248886 - RNA, 16 nt, Yersinia pestis
uaucaaaacgccagau

SEQ ID NO: 2248887 - RNA, 15 nt, Yersinia pestis
uaucaaaauaaaaau

SEQ ID NO: 2248888 - RNA, 11 nt, Yersinia pestis
uaucaaaucag

SEQ ID NO: 2248889 - RNA, 22 nt, Yersinia pestis
uaucaacguagcugaauugcuu

SEQ ID NO: 2248890 - RNA, 19 nt, Yersinia pestis
uaucaacguagcugaauug

SEQ ID NO: 2248891 - RNA, 17 nt, Yersinia pestis
uaucacuauaauuauuu

SEQ ID NO: 2248892 - RNA, 21 nt, Yersinia pestis
uaucagaaacaauaaauaucc

SEQ ID NO: 2248893 - RNA, 15 nt, Yersinia pestis
uaucagaaacagcag

SEQ ID NO: 2248894 - RNA, 16 nt, Yersinia pestis
uaucagaaacagcagg

SEQ ID NO: 2248895 - RNA, 19 nt, Yersinia pestis
uaucacucgggauaugacu

SEQ ID NO: 2248896 - RNA, 15 nt, Yersinia pestis
uaucacuauuucagg

SEQ ID NO: 2248897 - RNA, 21 nt, Yersinia pestis
uaucacuggaggcguuuuuau

SEQ ID NO: 2248898 - RNA, 16 nt, Yersinia pestis
uaucacuugggcauga

SEQ ID NO: 2248899 - RNA, 14 nt, Yersinia pestis
uauaguaucacugc

SEQ ID NO: 2248900 - RNA, 14 nt, Yersinia pestis
uauaguuaaacuga

SEQ ID NO: 2248901 - RNA, 22 nt, Yersinia pestis
uauaaugcagggcgacauuaau

SEQ ID NO: 2248902 - RNA, 20 nt, Yersinia pestis
uauaguaacuauuuacauaa

SEQ ID NO: 2248903 - RNA, 15 nt, Yersinia pestis
uauaaucaucuacaa

SEQ ID NO: 2248904 - RNA, 14 nt, Yersinia pestis
uauaauccaaaaua

SEQ ID NO: 2248905 - RNA, 21 nt, Yersinia pestis
uauaauccaaaauaauauaau

SEQ ID NO: 2248906 - RNA, 15 nt, Yersinia pestis
uauauaagagaugaa

SEQ ID NO: 2248907 - RNA, 23 nt, Yersinia pestis
uauauaagagaugaaauuuuauu

SEQ ID NO: 2248908 - RNA, 21 nt, Yersinia pestis
uauaguuuauuuuauuuaauc

SEQ ID NO: 2248909 - RNA, 16 nt, Yersinia pestis
uauaguuuuuacgcau

SEQ ID NO: 2248910 - RNA, 16 nt, Yersinia pestis
uauauauuuugaauau

SEQ ID NO: 2248911 - RNA, 13 nt, Yersinia pestis
uauauauuuugaa

SEQ ID NO: 2248912 - RNA, 13 nt, Yersinia pestis
uauauacagucaa

SEQ ID NO: 2248913 - RNA, 20 nt, Yersinia pestis
uauauacagucaauugagaa

SEQ ID NO: 2248914 - RNA, 14 nt, Yersinia pestis
uauauccaaaauaa

SEQ ID NO: 2248915 - RNA, 19 nt, Yersinia pestis
uauaucccaauaauagcua

SEQ ID NO: 2248916 - RNA, 24 nt, Yersinia pestis
uauaucaaggcggcagagccaauc

SEQ ID NO: 2248917 - RNA, 15 nt, Yersinia pestis
uauaucacuucugcu

SEQ ID NO: 2248918 - RNA, 17 nt, Yersinia pestis
uauaucacuucugcugu

SEQ ID NO: 2248919 - RNA, 19 nt, Yersinia pestis
uauaucaguugugggucgc

SEQ ID NO: 2248920 - RNA, 15 nt, Yersinia pestis
uauaucaaggcggca

SEQ ID NO: 2248921 - RNA, 17 nt, Yersinia pestis
uauaucacuauuucagg

SEQ ID NO: 2248922 - RNA, 18 nt, Yersinia pestis
uauccauauuaaaugcau

SEQ ID NO: 2248923 - RNA, 15 nt, Yersinia pestis
uauccaccugaucau

SEQ ID NO: 2248924 - RNA, 14 nt, Yersinia pestis
uauccacuuggcua

SEQ ID NO: 2248925 - RNA, 11 nt, Yersinia pestis
uaucccaccac

SEQ ID NO: 2248926 - RNA, 15 nt, Yersinia pestis
uauccggauuaaauu

SEQ ID NO: 2248927 - RNA, 16 nt, Yersinia pestis
uauccguuaacccaaa

SEQ ID NO: 2248928 - RNA, 18 nt, Yersinia pestis
uauccggguggcuuggca

SEQ ID NO: 2248929 - RNA, 13 nt, Yersinia pestis
uauccaacuucuu

SEQ ID NO: 2248930 - RNA, 13 nt, Yersinia pestis
uauccaaaauaau

SEQ ID NO: 2248931 - RNA, 23 nt, Yersinia pestis
uaucauuuuccugcauauuauuu

SEQ ID NO: 2248932 - RNA, 14 nt, Yersinia pestis
uaucagaaauacgc

SEQ ID NO: 2248933 - RNA, 20 nt, Yersinia pestis
uaucagaaauacgcuuucca

SEQ ID NO: 2248934 - RNA, 18 nt, Yersinia pestis
uaucagaaccaagcaaua

SEQ ID NO: 2248935 - RNA, 19 nt, Yersinia pestis
uaucuccaccaacggccca

SEQ ID NO: 2248936 - RNA, 17 nt, Yersinia pestis
uaucucaucgcuugcca

SEQ ID NO: 2248937 - RNA, 19 nt, Yersinia pestis
uaucucccauuaauuaauc

SEQ ID NO: 2248938 - RNA, 20 nt, Yersinia pestis
uaucucccauuaauuaauca

SEQ ID NO: 2248939 - RNA, 21 nt, Yersinia pestis
uaucuccguugaaaccuacau

SEQ ID NO: 2248940 - RNA, 19 nt, Yersinia pestis
uaucuauuuuuauuucucc

SEQ ID NO: 2248941 - RNA, 12 nt, Yersinia pestis
uaucuauuucca

SEQ ID NO: 2248942 - RNA, 18 nt, Yersinia pestis
uaucguuaucaacgccca

SEQ ID NO: 2248943 - RNA, 13 nt, Yersinia pestis
uaucguccagcag

SEQ ID NO: 2248944 - RNA, 15 nt, Yersinia pestis
uaucguccagcagca

SEQ ID NO: 2248945 - RNA, 23 nt, Yersinia pestis
uaucgugaacaggccccaaaaua

SEQ ID NO: 2248946 - RNA, 19 nt, Yersinia pestis
uaucggugcugacaaacag

SEQ ID NO: 2248947 - RNA, 17 nt, Yersinia pestis
uaucgggauucacaccg

SEQ ID NO: 2248948 - RNA, 23 nt, Yersinia pestis
uaucgccaacacuauuguggaua

SEQ ID NO: 2248949 - RNA, 15 nt, Yersinia pestis
uaucgccaagccagu

SEQ ID NO: 2248950 - RNA, 12 nt, Yersinia pestis
uauccucggcca

SEQ ID NO: 2248951 - RNA, 17 nt, Yersinia pestis
uauccucggccaguguu

SEQ ID NO: 2248952 - RNA, 14 nt, Yersinia pestis
uauccuccauucug

SEQ ID NO: 2248953 - RNA, 21 nt, Yersinia pestis
uauccucuacgucaaucucac

SEQ ID NO: 2248954 - RNA, 20 nt, Yersinia pestis
uaucgcuacguacuaucuau

SEQ ID NO: 2248955 - RNA, 15 nt, Yersinia pestis
uaucgcuuuuagaua

SEQ ID NO: 2248956 - RNA, 21 nt, Yersinia pestis
uaguucgccacgcugauacau

SEQ ID NO: 2248957 - RNA, 14 nt, Yersinia pestis
uagugccuaauaaa

SEQ ID NO: 2248958 - RNA, 13 nt, Yersinia pestis
uagugccacaaca

SEQ ID NO: 2248959 - RNA, 22 nt, Yersinia pestis
uaguucacgauggaaaaaauac

SEQ ID NO: 2248960 - RNA, 19 nt, Yersinia pestis
uaguucuucugauaaaaca

SEQ ID NO: 2248961 - RNA, 22 nt, Yersinia pestis
uaguuuagauagaaaucacuga

SEQ ID NO: 2248962 - RNA, 15 nt, Yersinia pestis
uauaaacuugauuca

SEQ ID NO: 2248963 - RNA, 21 nt, Yersinia pestis
uauaaaagcacagacaaacaa

SEQ ID NO: 2248964 - RNA, 22 nt, Yersinia pestis
uauaaaauaauaagauucagcu

SEQ ID NO: 2248965 - RNA, 20 nt, Yersinia pestis
uauaaaacacgcauaugaau

SEQ ID NO: 2248966 - RNA, 18 nt, Yersinia pestis
uauaaccgucaccaaaau

SEQ ID NO: 2248967 - RNA, 21 nt, Yersinia pestis
uauaaccauuaacaauauuau

SEQ ID NO: 2248968 - RNA, 17 nt, Yersinia pestis
uauaaccaugaugacaa

SEQ ID NO: 2248969 - RNA, 19 nt, Yersinia pestis
uauaacauaauaaauuaau

SEQ ID NO: 2248970 - RNA, 14 nt, Yersinia pestis
uauaaagcauuuau

SEQ ID NO: 2248971 - RNA, 23 nt, Yersinia pestis
uauaaagccauuggucaaucuag

SEQ ID NO: 2248972 - RNA, 15 nt, Yersinia pestis
uauaaauuuuaaguu

SEQ ID NO: 2248973 - RNA, 19 nt, Yersinia pestis
uauaaauuuaauaaaaacc

SEQ ID NO: 2248974 - RNA, 14 nt, Yersinia pestis
uauaaccaaaguca

SEQ ID NO: 2248975 - RNA, 18 nt, Yersinia pestis
uauaacauaauaaauuaa

SEQ ID NO: 2248976 - RNA, 14 nt, Yersinia pestis
uauaaggaauauac

SEQ ID NO: 2248977 - RNA, 17 nt, Yersinia pestis
uauaaggaauauacuuu

SEQ ID NO: 2248978 - RNA, 17 nt, Yersinia pestis
uaguaggucacauagcu

SEQ ID NO: 2248979 - RNA, 13 nt, Yersinia pestis
uaguauaaauacc

SEQ ID NO: 2248980 - RNA, 22 nt, Yersinia pestis
uagucacgucuucaccaaugau

SEQ ID NO: 2248981 - RNA, 21 nt, Yersinia pestis
uaguauugcggaauggcaacg

SEQ ID NO: 2248982 - RNA, 16 nt, Yersinia pestis
uagucacucaagccag

SEQ ID NO: 2248983 - RNA, 14 nt, Yersinia pestis
uagucagcuucacu

SEQ ID NO: 2248984 - RNA, 15 nt, Yersinia pestis
uagucauauauuuuu

SEQ ID NO: 2248985 - RNA, 21 nt, Yersinia pestis
uagugaguuauucgccccuua

SEQ ID NO: 2248986 - RNA, 20 nt, Yersinia pestis
uagugcaaaauuccaccauu

SEQ ID NO: 2248987 - RNA, 21 nt, Yersinia pestis
uagugaugcaguaaauagucu

SEQ ID NO: 2248988 - RNA, 19 nt, Yersinia pestis
uagucccucaagaccugcc

SEQ ID NO: 2248989 - RNA, 15 nt, Yersinia pestis
uagucccccuccggc

SEQ ID NO: 2248990 - RNA, 19 nt, Yersinia pestis
uaggugguaccugcacuga

SEQ ID NO: 2248991 - RNA, 14 nt, Yersinia pestis
uaggcucgagccgc

SEQ ID NO: 2248992 - RNA, 17 nt, Yersinia pestis
uaggucaucccagcaca

SEQ ID NO: 2248993 - RNA, 19 nt, Yersinia pestis
uaguaacuauuuacauaau

SEQ ID NO: 2248994 - RNA, 20 nt, Yersinia pestis
uaguaagcaugccauccugc

SEQ ID NO: 2248995 - RNA, 22 nt, Yersinia pestis
uaguaacuguaaggccaaaccc

SEQ ID NO: 2248996 - RNA, 14 nt, Yersinia pestis
uaguaauaauuuuu

SEQ ID NO: 2248997 - RNA, 15 nt, Yersinia pestis
uaggcagaauaguca

SEQ ID NO: 2248998 - RNA, 22 nt, Yersinia pestis
uaggcaagaacauuuccacaau

SEQ ID NO: 2248999 - RNA, 20 nt, Yersinia pestis
uaggcaucuuucaguuuuau

SEQ ID NO: 2249000 - RNA, 15 nt, Yersinia pestis
uaggacggugccaug

SEQ ID NO: 2249001 - RNA, 23 nt, Yersinia pestis
uagcuuauccccugagaaacauc

SEQ ID NO: 2249002 - RNA, 18 nt, Yersinia pestis
uagcuggcggauaaaaau

SEQ ID NO: 2249003 - RNA, 12 nt, Yersinia pestis
uagcuaugcagu

SEQ ID NO: 2249004 - RNA, 19 nt, Yersinia pestis
uagcuauuggcugauucaa

SEQ ID NO: 2249005 - RNA, 19 nt, Yersinia pestis
uagcgcuucagugauuuua

SEQ ID NO: 2249006 - RNA, 18 nt, Yersinia pestis
uagcgcugcaucagcagu

SEQ ID NO: 2249007 - RNA, 22 nt, Yersinia pestis
uagcgcuuuuacaucaaccccu

SEQ ID NO: 2249008 - RNA, 18 nt, Yersinia pestis
uagcggaaggguuuugug

SEQ ID NO: 2249009 - RNA, 13 nt, Yersinia pestis
uagcccuucagca

SEQ ID NO: 2249010 - RNA, 18 nt, Yersinia pestis
uagccgaaccccuagcca

SEQ ID NO: 2249011 - RNA, 13 nt, Yersinia pestis
uagcgccuuuuuu

SEQ ID NO: 2249012 - RNA, 23 nt, Yersinia pestis
uagcgcgggugaucgucaucagc

SEQ ID NO: 2249013 - RNA, 20 nt, Yersinia pestis
uagcgcgcguuuaaucgaua

SEQ ID NO: 2249014 - RNA, 13 nt, Yersinia pestis
uagcaacugccaa

SEQ ID NO: 2249015 - RNA, 19 nt, Yersinia pestis
uagcaagccaaaacagccu

SEQ ID NO: 2249016 - RNA, 12 nt, Yersinia pestis
uagcagcaccau

SEQ ID NO: 2249017 - RNA, 19 nt, Yersinia pestis
uagcagccacaugguuuca

SEQ ID NO: 2249018 - RNA, 15 nt, Yersinia pestis
uagcaacacaucggu

SEQ ID NO: 2249019 - RNA, 14 nt, Yersinia pestis
uagcaaaaaaaaag

SEQ ID NO: 2249020 - RNA, 18 nt, Yersinia pestis
uagcaaacccaccugaau

SEQ ID NO: 2249021 - RNA, 19 nt, Yersinia pestis
uagcaaaaggauuaauaau

SEQ ID NO: 2249022 - RNA, 22 nt, Yersinia pestis
uagcaaagcgauaucguuauca

SEQ ID NO: 2249023 - RNA, 20 nt, Yersinia pestis
uagcauugcagauuucuucu

SEQ ID NO: 2249024 - RNA, 16 nt, Yersinia pestis
uagcauggucaucgcu

SEQ ID NO: 2249025 - RNA, 21 nt, Yersinia pestis
uagcauggacgcuuuacucuu

SEQ ID NO: 2249026 - RNA, 18 nt, Yersinia pestis
uagcauggcuuuaugacc

SEQ ID NO: 2249027 - RNA, 13 nt, Yersinia pestis
uagcaucauccag

SEQ ID NO: 2249028 - RNA, 16 nt, Yersinia pestis
uagcaucaucgcacug

SEQ ID NO: 2249029 - RNA, 17 nt, Yersinia pestis
uagcccaguaccgcugg

SEQ ID NO: 2249030 - RNA, 12 nt, Yersinia pestis
uagcccagugcg

SEQ ID NO: 2249031 - RNA, 12 nt, Yersinia pestis
uagcccaaggcg

SEQ ID NO: 2249032 - RNA, 16 nt, Yersinia pestis
uagcccaaggcgacuu

SEQ ID NO: 2249033 - RNA, 14 nt, Yersinia pestis
uagcccaaaauaga

SEQ ID NO: 2249034 - RNA, 14 nt, Yersinia pestis
uagaaaacaaaaag

SEQ ID NO: 2249035 - RNA, 16 nt, Yersinia pestis
uagauggaaaucacac

SEQ ID NO: 2249036 - RNA, 19 nt, Yersinia pestis
uagauuuuaugaauuaauu

SEQ ID NO: 2249037 - RNA, 18 nt, Yersinia pestis
uagauuuaaccccaauuc

SEQ ID NO: 2249038 - RNA, 15 nt, Yersinia pestis
uagauuucacugccg

SEQ ID NO: 2249039 - RNA, 16 nt, Yersinia pestis
uagauuucacuuuccc

SEQ ID NO: 2249040 - RNA, 13 nt, Yersinia pestis
uagauuaaucgaa

SEQ ID NO: 2249041 - RNA, 17 nt, Yersinia pestis
uagauucaucaccaguc

SEQ ID NO: 2249042 - RNA, 13 nt, Yersinia pestis
uagauuauuuucu

SEQ ID NO: 2249043 - RNA, 23 nt, Yersinia pestis
uagauucggugacuaaaaucgau

SEQ ID NO: 2249044 - RNA, 12 nt, Yersinia pestis
uagauuggcauc

SEQ ID NO: 2249045 - RNA, 13 nt, Yersinia pestis
ucagcauaucccu

SEQ ID NO: 2249046 - RNA, 20 nt, Yersinia pestis
ucagcauaucccuguuuucu

SEQ ID NO: 2249047 - RNA, 16 nt, Yersinia pestis
ucagcaggggcaaccu

SEQ ID NO: 2249048 - RNA, 11 nt, Yersinia pestis
ucagcagucug

SEQ ID NO: 2249049 - RNA, 12 nt, Yersinia pestis
ucagcagucuga

SEQ ID NO: 2249050 - RNA, 15 nt, Yersinia pestis
ucagcagucugaaau

SEQ ID NO: 2249051 - RNA, 21 nt, Yersinia pestis
ucagcagucugaaaucuccuc

SEQ ID NO: 2249052 - RNA, 17 nt, Yersinia pestis
ucagcagucugaggccc

SEQ ID NO: 2249053 - RNA, 22 nt, Yersinia pestis
ucagcagucugaggcccgcuag

SEQ ID NO: 2249054 - RNA, 18 nt, Yersinia pestis
ucagcagucugaggggcg

SEQ ID NO: 2249055 - RNA, 11 nt, Yersinia pestis
ucagcagagag

SEQ ID NO: 2249056 - RNA, 17 nt, Yersinia pestis
ucagcagcgcgcuacuc

SEQ ID NO: 2249057 - RNA, 13 nt, Yersinia pestis
ucagcaauaugaa

SEQ ID NO: 2249058 - RNA, 15 nt, Yersinia pestis
ucagcaagcugcuca

SEQ ID NO: 2249059 - RNA, 15 nt, Yersinia pestis
ucagcaaauuuugca

SEQ ID NO: 2249060 - RNA, 22 nt, Yersinia pestis
ucagcaaauuuugcaggaguug

SEQ ID NO: 2249061 - RNA, 14 nt, Yersinia pestis
ucagcaacuuggua

SEQ ID NO: 2249062 - RNA, 22 nt, Yersinia pestis
ucagcaacgguuucaacuucaa

SEQ ID NO: 2249063 - RNA, 13 nt, Yersinia pestis
ucagcaauuuuua

SEQ ID NO: 2249064 - RNA, 12 nt, Yersinia pestis
ucagcaccuauc

SEQ ID NO: 2249065 - RNA, 18 nt, Yersinia pestis
ucagcacgcuuuccagcu

SEQ ID NO: 2249066 - RNA, 15 nt, Yersinia pestis
ucagcacugcuuuuu

SEQ ID NO: 2249067 - RNA, 16 nt, Yersinia pestis
ucagcaucuucaauca

SEQ ID NO: 2249068 - RNA, 20 nt, Yersinia pestis
ucagcaucccagccaccaug

SEQ ID NO: 2249069 - RNA, 23 nt, Yersinia pestis
ucagccaagucagggaucaccuc

SEQ ID NO: 2249070 - RNA, 13 nt, Yersinia pestis
ucagccacaucaa

SEQ ID NO: 2249071 - RNA, 13 nt, Yersinia pestis
ucagccaccagau

SEQ ID NO: 2249072 - RNA, 12 nt, Yersinia pestis
ucagccaccauu

SEQ ID NO: 2249073 - RNA, 16 nt, Yersinia pestis
ucagcccaucuuugau

SEQ ID NO: 2249074 - RNA, 14 nt, Yersinia pestis
ucagccaugggcug

SEQ ID NO: 2249075 - RNA, 12 nt, Yersinia pestis
ucagccuuuuuu

SEQ ID NO: 2249076 - RNA, 15 nt, Yersinia pestis
ucagcgaaaaauuuc

SEQ ID NO: 2249077 - RNA, 19 nt, Yersinia pestis
ucagccgcgaaaaaccaug

SEQ ID NO: 2249078 - RNA, 13 nt, Yersinia pestis
ucagccuauccuc

SEQ ID NO: 2249079 - RNA, 15 nt, Yersinia pestis
ucagccuauccucac

SEQ ID NO: 2249080 - RNA, 19 nt, Yersinia pestis
ucagccuauccucaccguu

SEQ ID NO: 2249081 - RNA, 21 nt, Yersinia pestis
ucagccucuaaaggguaggua

SEQ ID NO: 2249082 - RNA, 11 nt, Yersinia pestis
ucagccucuga

SEQ ID NO: 2249083 - RNA, 15 nt, Yersinia pestis
ucagccucauucaug

SEQ ID NO: 2249084 - RNA, 20 nt, Yersinia pestis
ucagccucauucaugaggcu

SEQ ID NO: 2249085 - RNA, 17 nt, Yersinia pestis
ucagcccgauccccugc

SEQ ID NO: 2249086 - RNA, 19 nt, Yersinia pestis
ucagcccuaauauccucaa

SEQ ID NO: 2249087 - RNA, 21 nt, Yersinia pestis
ucagccggagugaugaaacca

SEQ ID NO: 2249088 - RNA, 20 nt, Yersinia pestis
ucagaaccuguuacaucaga

SEQ ID NO: 2249089 - RNA, 17 nt, Yersinia pestis
ucagaaacggugaaaau

SEQ ID NO: 2249090 - RNA, 22 nt, Yersinia pestis
ucagaaaggacaguaauauuuu

SEQ ID NO: 2249091 - RNA, 17 nt, Yersinia pestis
ucagacggcagcaacga

SEQ ID NO: 2249092 - RNA, 15 nt, Yersinia pestis
ucagaccuuuaggaa

SEQ ID NO: 2249093 - RNA, 18 nt, Yersinia pestis
ucagacggaauaccaccc

SEQ ID NO: 2249094 - RNA, 14 nt, Yersinia pestis
ucagacaacgcuug

SEQ ID NO: 2249095 - RNA, 22 nt, Yersinia pestis
ucagaaugaaguucaccagcuu

SEQ ID NO: 2249096 - RNA, 17 nt, Yersinia pestis
ucagacacguaaaacag

SEQ ID NO: 2249097 - RNA, 15 nt, Yersinia pestis
ucagacagcacgggc

SEQ ID NO: 2249098 - RNA, 20 nt, Yersinia pestis
ucagacauuuuucuauuucu

SEQ ID NO: 2249099 - RNA, 16 nt, Yersinia pestis
ucagacccuaauauca

SEQ ID NO: 2249100 - RNA, 23 nt, Yersinia pestis
ucagacauuuuucuauuucuggu

SEQ ID NO: 2249101 - RNA, 21 nt, Yersinia pestis
ucagacugcugacaacccuca

SEQ ID NO: 2249102 - RNA, 18 nt, Yersinia pestis
ucagacuucuuccaucuu

SEQ ID NO: 2249103 - RNA, 22 nt, Yersinia pestis
ucagagcucgcuagucaucacu

SEQ ID NO: 2249104 - RNA, 22 nt, Yersinia pestis
ucagauaaaaaaggguaaucag

SEQ ID NO: 2249105 - RNA, 15 nt, Yersinia pestis
ucagauacggcucca

SEQ ID NO: 2249106 - RNA, 22 nt, Yersinia pestis
ucagaucauugccgagguuaua

SEQ ID NO: 2249107 - RNA, 22 nt, Yersinia pestis
ucagaucaacagauuuuccauc

SEQ ID NO: 2249108 - RNA, 14 nt, Yersinia pestis
ucagaucgcgucau

SEQ ID NO: 2249109 - RNA, 17 nt, Yersinia pestis
ucagaugaucaaauuau

SEQ ID NO: 2249110 - RNA, 17 nt, Yersinia pestis
ucagaugccgcuuuagu

SEQ ID NO: 2249111 - RNA, 17 nt, Yersinia pestis
ucagauugucagacacg

SEQ ID NO: 2249112 - RNA, 12 nt, Yersinia pestis
ucagauugucag

SEQ ID NO: 2249113 - RNA, 21 nt, Yersinia pestis
ucagauuaguuuuagacguca

SEQ ID NO: 2249114 - RNA, 19 nt, Yersinia pestis
ucagauuaguuuuagacgu

SEQ ID NO: 2249115 - RNA, 22 nt, Yersinia pestis
ucagauuuagcgauauaacuca

SEQ ID NO: 2249116 - RNA, 19 nt, Yersinia pestis
ucagauuguuuauaaauua

SEQ ID NO: 2249117 - RNA, 13 nt, Yersinia pestis
ucagcaaaucuug

SEQ ID NO: 2249118 - RNA, 16 nt, Yersinia pestis
ucagcaaaguauuuau

SEQ ID NO: 2249119 - RNA, 17 nt, Yersinia pestis
ucagcaaaguauuuaua

SEQ ID NO: 2249120 - RNA, 15 nt, Yersinia pestis
ucacgaauaguaucu

SEQ ID NO: 2249121 - RNA, 17 nt, Yersinia pestis
ucaccuuggaaaacagc

SEQ ID NO: 2249122 - RNA, 14 nt, Yersinia pestis
ucaccuuugaucau

SEQ ID NO: 2249123 - RNA, 18 nt, Yersinia pestis
ucacgagugaacguagcc

SEQ ID NO: 2249124 - RNA, 20 nt, Yersinia pestis
ucacgagcuaacgcgucaau

SEQ ID NO: 2249125 - RNA, 17 nt, Yersinia pestis
ucacgauacgacuucuu

SEQ ID NO: 2249126 - RNA, 21 nt, Yersinia pestis
ucacgauagcaaugaccuuac

SEQ ID NO: 2249127 - RNA, 22 nt, Yersinia pestis
ucaccuuccgucccaagaaaag

SEQ ID NO: 2249128 - RNA, 17 nt, Yersinia pestis
ucaccuuccaaacuuug

SEQ ID NO: 2249129 - RNA, 16 nt, Yersinia pestis
ucaccugucaccuacc

SEQ ID NO: 2249130 - RNA, 18 nt, Yersinia pestis
ucaccugucaccuaccac

SEQ ID NO: 2249131 - RNA, 17 nt, Yersinia pestis
ucaccugucaccuguca

SEQ ID NO: 2249132 - RNA, 23 nt, Yersinia pestis
ucaccugcgggauagcauaaaua

SEQ ID NO: 2249133 - RNA, 20 nt, Yersinia pestis
ucaccucgaugcuuucaucg

SEQ ID NO: 2249134 - RNA, 15 nt, Yersinia pestis
ucaccuccacuucaa

SEQ ID NO: 2249135 - RNA, 18 nt, Yersinia pestis
ucaccugaaugccauuca

SEQ ID NO: 2249136 - RNA, 15 nt, Yersinia pestis
ucaccugaguaauau

SEQ ID NO: 2249137 - RNA, 23 nt, Yersinia pestis
ucaccucuugcauacucaggccc

SEQ ID NO: 2249138 - RNA, 21 nt, Yersinia pestis
ucaccucuucagguaagccuu

SEQ ID NO: 2249139 - RNA, 20 nt, Yersinia pestis
ucacgggcuuccaucaggaa

SEQ ID NO: 2249140 - RNA, 21 nt, Yersinia pestis
ucacgggcuuccaucaggaag

SEQ ID NO: 2249141 - RNA, 17 nt, Yersinia pestis
ucacggcuuugcugugc

SEQ ID NO: 2249142 - RNA, 21 nt, Yersinia pestis
ucacggagaauaaaaaugaua

SEQ ID NO: 2249143 - RNA, 20 nt, Yersinia pestis
ucacggaaaucugcggcacu

SEQ ID NO: 2249144 - RNA, 22 nt, Yersinia pestis
ucacgcugguuaucacagcaaa

SEQ ID NO: 2249145 - RNA, 15 nt, Yersinia pestis
ucacgcuaccggaac

SEQ ID NO: 2249146 - RNA, 17 nt, Yersinia pestis
ucacgcucuugcucuuc

SEQ ID NO: 2249147 - RNA, 18 nt, Yersinia pestis
ucacgccaugccgguuga

SEQ ID NO: 2249148 - RNA, 12 nt, Yersinia pestis
ucacgccuaucu

SEQ ID NO: 2249149 - RNA, 13 nt, Yersinia pestis
ucacgcacccacc

SEQ ID NO: 2249150 - RNA, 19 nt, Yersinia pestis
ucacgcacccaccaagggu

SEQ ID NO: 2249151 - RNA, 20 nt, Yersinia pestis
ucacgcacgguacagagggc

SEQ ID NO: 2249152 - RNA, 23 nt, Yersinia pestis
ucacgcagguaguuaguggcuuu

SEQ ID NO: 2249153 - RNA, 16 nt, Yersinia pestis
ucacguaccaaaucag

SEQ ID NO: 2249154 - RNA, 19 nt, Yersinia pestis
ucacguaccaaaucagcaa

SEQ ID NO: 2249155 - RNA, 20 nt, Yersinia pestis
ucacguaaacaaugaccauc

SEQ ID NO: 2249156 - RNA, 15 nt, Yersinia pestis
ucacgucaguaauga

SEQ ID NO: 2249157 - RNA, 20 nt, Yersinia pestis
ucacgucgauaguccuucgu

SEQ ID NO: 2249158 - RNA, 13 nt, Yersinia pestis
ucacguuuuucca

SEQ ID NO: 2249159 - RNA, 16 nt, Yersinia pestis
ucacucgggauaugac

SEQ ID NO: 2249160 - RNA, 20 nt, Yersinia pestis
ucacucuucgugcuuauuuu

SEQ ID NO: 2249161 - RNA, 22 nt, Yersinia pestis
ucacuauaauuauuucucugau

SEQ ID NO: 2249162 - RNA, 15 nt, Yersinia pestis
ucacuauaauuauuu

SEQ ID NO: 2249163 - RNA, 13 nt, Yersinia pestis
ucacuauucccau

SEQ ID NO: 2249164 - RNA, 15 nt, Yersinia pestis
ucacuuuuugucaau

SEQ ID NO: 2249165 - RNA, 13 nt, Yersinia pestis
ucacuuucuuuug

SEQ ID NO: 2249166 - RNA, 19 nt, Yersinia pestis
ucacuuuuaugacggcauc

SEQ ID NO: 2249167 - RNA, 18 nt, Yersinia pestis
ucacuuggguagcagccc

SEQ ID NO: 2249168 - RNA, 18 nt, Yersinia pestis
ucacuucgauucaucaua

SEQ ID NO: 2249169 - RNA, 13 nt, Yersinia pestis
ucacuuaaauaac

SEQ ID NO: 2249170 - RNA, 23 nt, Yersinia pestis
ucacugucaaaaccaauagauuu

SEQ ID NO: 2249171 - RNA, 15 nt, Yersinia pestis
ucacugucagacagu

SEQ ID NO: 2249172 - RNA, 19 nt, Yersinia pestis
ucacugucaaaaagcaccu

SEQ ID NO: 2249173 - RNA, 14 nt, Yersinia pestis
ucacugucuauuuu

SEQ ID NO: 2249174 - RNA, 15 nt, Yersinia pestis
ucacuggcaccgcuu

SEQ ID NO: 2249175 - RNA, 15 nt, Yersinia pestis
ucacuggcaccauuu

SEQ ID NO: 2249176 - RNA, 19 nt, Yersinia pestis
ucacuggugaguagcugug

SEQ ID NO: 2249177 - RNA, 20 nt, Yersinia pestis
ucacugaugagcuggcaaaa

SEQ ID NO: 2249178 - RNA, 13 nt, Yersinia pestis
ucacuggaaaaag

SEQ ID NO: 2249179 - RNA, 21 nt, Yersinia pestis
ucacuggaguuaaaucccugu

SEQ ID NO: 2249180 - RNA, 22 nt, Yersinia pestis
ucacuggaguuaaaucccugug

SEQ ID NO: 2249181 - RNA, 16 nt, Yersinia pestis
ucacugccaucucaug

SEQ ID NO: 2249182 - RNA, 23 nt, Yersinia pestis
ucaauaugaacuuguucaucugg

SEQ ID NO: 2249183 - RNA, 15 nt, Yersinia pestis
ucaaucacauccccu

SEQ ID NO: 2249184 - RNA, 23 nt, Yersinia pestis
ucaaucacuggcaauaauucaga

SEQ ID NO: 2249185 - RNA, 19 nt, Yersinia pestis
ucaauagggcagaccaguu

SEQ ID NO: 2249186 - RNA, 18 nt, Yersinia pestis
ucaauaggguaauaccac

SEQ ID NO: 2249187 - RNA, 15 nt, Yersinia pestis
ucaauaggauuuuca

SEQ ID NO: 2249188 - RNA, 23 nt, Yersinia pestis
ucaauagcuaauaauuguucaua

SEQ ID NO: 2249189 - RNA, 16 nt, Yersinia pestis
ucaauauaagagaaau

SEQ ID NO: 2249190 - RNA, 13 nt, Yersinia pestis
ucaauauaccuuu

SEQ ID NO: 2249191 - RNA, 17 nt, Yersinia pestis
ucaauaacauuaccacc

SEQ ID NO: 2249192 - RNA, 13 nt, Yersinia pestis
ucaauaacauuac

SEQ ID NO: 2249193 - RNA, 15 nt, Yersinia pestis
ucaauaacauuacca

SEQ ID NO: 2249194 - RNA, 22 nt, Yersinia pestis
ucaauaacuauuuuugacuuua

SEQ ID NO: 2249195 - RNA, 23 nt, Yersinia pestis
ucaauaaccucagccucauucau

SEQ ID NO: 2249196 - RNA, 16 nt, Yersinia pestis
ucaauaaccucagggc

SEQ ID NO: 2249197 - RNA, 19 nt, Yersinia pestis
ucaauaaccucacacgauu

SEQ ID NO: 2249198 - RNA, 20 nt, Yersinia pestis
ucaauaaccucacacgauuu

SEQ ID NO: 2249199 - RNA, 13 nt, Yersinia pestis
ucaauaaccucag

SEQ ID NO: 2249200 - RNA, 16 nt, Yersinia pestis
ucaauaaccucagccu

SEQ ID NO: 2249201 - RNA, 18 nt, Yersinia pestis
ucaauaaccucagccuca

SEQ ID NO: 2249202 - RNA, 19 nt, Yersinia pestis
ucaauaaccucagccucau

SEQ ID NO: 2249203 - RNA, 18 nt, Yersinia pestis
ucaauaaguucgucuaau

SEQ ID NO: 2249204 - RNA, 19 nt, Yersinia pestis
ucaauaagugcaaacuuaa

SEQ ID NO: 2249205 - RNA, 20 nt, Yersinia pestis
ucaauaccuuacugcaucaa

SEQ ID NO: 2249206 - RNA, 14 nt, Yersinia pestis
ucaauaccuuacug

SEQ ID NO: 2249207 - RNA, 17 nt, Yersinia pestis
ucaauaccuuacugcau

SEQ ID NO: 2249208 - RNA, 18 nt, Yersinia pestis
ucaauacguugaauuaaa

SEQ ID NO: 2249209 - RNA, 22 nt, Yersinia pestis
ucaauacguugaauuaaaaacc

SEQ ID NO: 2249210 - RNA, 15 nt, Yersinia pestis
ucaauaauuucacua

SEQ ID NO: 2249211 - RNA, 14 nt, Yersinia pestis
ucaauaauuucacu

SEQ ID NO: 2249212 - RNA, 17 nt, Yersinia pestis
ucaaggcuuucuggcga

SEQ ID NO: 2249213 - RNA, 16 nt, Yersinia pestis
ucaaggcuuuaauauc

SEQ ID NO: 2249214 - RNA, 15 nt, Yersinia pestis
ucaagcguacaucag

SEQ ID NO: 2249215 - RNA, 13 nt, Yersinia pestis
ucaauaaauucau

SEQ ID NO: 2249216 - RNA, 15 nt, Yersinia pestis
ucaauaaagaacgcg

SEQ ID NO: 2249217 - RNA, 20 nt, Yersinia pestis
ucaauaaacauugaucaggu

SEQ ID NO: 2249218 - RNA, 17 nt, Yersinia pestis
ucaauaaaacucacuug

SEQ ID NO: 2249219 - RNA, 14 nt, Yersinia pestis
ucaagucccucccu

SEQ ID NO: 2249220 - RNA, 20 nt, Yersinia pestis
ucaaguuagcaggcagcacg

SEQ ID NO: 2249221 - RNA, 20 nt, Yersinia pestis
ucaaguggucuaucauuuac

SEQ ID NO: 2249222 - RNA, 18 nt, Yersinia pestis
ucaagugcucacucggua

SEQ ID NO: 2249223 - RNA, 12 nt, Yersinia pestis
ucaauggccagc

SEQ ID NO: 2249224 - RNA, 19 nt, Yersinia pestis
ucaauggcguuauguaaaa

SEQ ID NO: 2249225 - RNA, 16 nt, Yersinia pestis
ucaaugauaaaauccu

SEQ ID NO: 2249226 - RNA, 14 nt, Yersinia pestis
ucaaugagcauacc

SEQ ID NO: 2249227 - RNA, 17 nt, Yersinia pestis
ucaaugaugucaucuuc

SEQ ID NO: 2249228 - RNA, 18 nt, Yersinia pestis
ucaaugacuccugaaaua

SEQ ID NO: 2249229 - RNA, 15 nt, Yersinia pestis
ucaaugaccacuaaa

SEQ ID NO: 2249230 - RNA, 19 nt, Yersinia pestis
ucaaugcauuguaaaauaa

SEQ ID NO: 2249231 - RNA, 22 nt, Yersinia pestis
ucaaucagcugauaugaaaaau

SEQ ID NO: 2249232 - RNA, 20 nt, Yersinia pestis
ucaauccgggcaaacgccag

SEQ ID NO: 2249233 - RNA, 20 nt, Yersinia pestis
ucaaucucuucauggcgcuu

SEQ ID NO: 2249234 - RNA, 21 nt, Yersinia pestis
ucaaucucuugcggcgcaccc

SEQ ID NO: 2249235 - RNA, 19 nt, Yersinia pestis
ucaaucgccugcugaacuu

SEQ ID NO: 2249236 - RNA, 13 nt, Yersinia pestis
ucaaucgugcacc

SEQ ID NO: 2249237 - RNA, 20 nt, Yersinia pestis
ucaaucggaacucagacuuc

SEQ ID NO: 2249238 - RNA, 23 nt, Yersinia pestis
ucaaucuagaggacggcggccuu

SEQ ID NO: 2249239 - RNA, 15 nt, Yersinia pestis
ucaaucguuuuaauu

SEQ ID NO: 2249240 - RNA, 13 nt, Yersinia pestis
ucaaucucaucaa

SEQ ID NO: 2249241 - RNA, 18 nt, Yersinia pestis
ucaauuuccaucugcaau

SEQ ID NO: 2249242 - RNA, 21 nt, Yersinia pestis
ucaauguuggcccaagauacu

SEQ ID NO: 2249243 - RNA, 18 nt, Yersinia pestis
ucaauuaaucaauuaauc

SEQ ID NO: 2249244 - RNA, 16 nt, Yersinia pestis
ucaauucgaugauuua

SEQ ID NO: 2249245 - RNA, 15 nt, Yersinia pestis
ucaauugagaauaac

SEQ ID NO: 2249246 - RNA, 14 nt, Yersinia pestis
ucaauucucccauu

SEQ ID NO: 2249247 - RNA, 21 nt, Yersinia pestis
ucaauugugcaaaaucagcau

SEQ ID NO: 2249248 - RNA, 23 nt, Yersinia pestis
ucaauugugcaaaaucagcauaa

SEQ ID NO: 2249249 - RNA, 19 nt, Yersinia pestis
ucacagcggcggauaaauu

SEQ ID NO: 2249250 - RNA, 19 nt, Yersinia pestis
ucacagccacguaauacca

SEQ ID NO: 2249251 - RNA, 22 nt, Yersinia pestis
ucacaggcuucgacaggcaauu

SEQ ID NO: 2249252 - RNA, 18 nt, Yersinia pestis
ucacagauaaacaaggca

SEQ ID NO: 2249253 - RNA, 16 nt, Yersinia pestis
ucacagcaauugagua

SEQ ID NO: 2249254 - RNA, 18 nt, Yersinia pestis
ucacagcagaacaaaaca

SEQ ID NO: 2249255 - RNA, 14 nt, Yersinia pestis
ucacagcauucaga

SEQ ID NO: 2249256 - RNA, 19 nt, Yersinia pestis
ucacacuguuuaguucacg

SEQ ID NO: 2249257 - RNA, 23 nt, Yersinia pestis
ucacacuggguaaggcaaacuuu

SEQ ID NO: 2249258 - RNA, 16 nt, Yersinia pestis
ucacacuggugcugcc

SEQ ID NO: 2249259 - RNA, 17 nt, Yersinia pestis
ucacacuguuuaguuca

SEQ ID NO: 2249260 - RNA, 16 nt, Yersinia pestis
ucacacgcccaggcca

SEQ ID NO: 2249261 - RNA, 16 nt, Yersinia pestis
ucacaacuuucccagu

SEQ ID NO: 2249262 - RNA, 22 nt, Yersinia pestis
ucacaacuuucccagucauaaa

SEQ ID NO: 2249263 - RNA, 13 nt, Yersinia pestis
ucacaacuuuuau

SEQ ID NO: 2249264 - RNA, 15 nt, Yersinia pestis
ucacaacuuuuauug

SEQ ID NO: 2249265 - RNA, 15 nt, Yersinia pestis
ucacaacagugcaac

SEQ ID NO: 2249266 - RNA, 19 nt, Yersinia pestis
ucacaacccccccgaccca

SEQ ID NO: 2249267 - RNA, 17 nt, Yersinia pestis
ucacaacuuuuauuggc

SEQ ID NO: 2249268 - RNA, 17 nt, Yersinia pestis
ucacacagccagccuua

SEQ ID NO: 2249269 - RNA, 22 nt, Yersinia pestis
ucacacacuaauaauaauuaau

SEQ ID NO: 2249270 - RNA, 14 nt, Yersinia pestis
ucacaccaacacug

SEQ ID NO: 2249271 - RNA, 22 nt, Yersinia pestis
ucacaccagacagaauauccag

SEQ ID NO: 2249272 - RNA, 18 nt, Yersinia pestis
ucacaaucucuggcaacg

SEQ ID NO: 2249273 - RNA, 21 nt, Yersinia pestis
ucacaaucucuggcaacggca

SEQ ID NO: 2249274 - RNA, 12 nt, Yersinia pestis
ucacaauuucac

SEQ ID NO: 2249275 - RNA, 20 nt, Yersinia pestis
ucacauagugcaaaauucca

SEQ ID NO: 2249276 - RNA, 14 nt, Yersinia pestis
ucacaguuaaaaau

SEQ ID NO: 2249277 - RNA, 21 nt, Yersinia pestis
ucacaucacagugccaaaaga

SEQ ID NO: 2249278 - RNA, 20 nt, Yersinia pestis
ucacauccaauggcaaugga

SEQ ID NO: 2249279 - RNA, 16 nt, Yersinia pestis
ucacaucauaaucggu

SEQ ID NO: 2249280 - RNA, 17 nt, Yersinia pestis
ucacauccgaucagcca

SEQ ID NO: 2249281 - RNA, 15 nt, Yersinia pestis
ucacauccccugccg

SEQ ID NO: 2249282 - RNA, 19 nt, Yersinia pestis
ucacaucgcccugcucuuc

SEQ ID NO: 2249283 - RNA, 22 nt, Yersinia pestis
ucacauucagucaaucgcucuu

SEQ ID NO: 2249284 - RNA, 16 nt, Yersinia pestis
ucacaugugcaauuaa

SEQ ID NO: 2249285 - RNA, 19 nt, Yersinia pestis
ucacaugcucaguuguauu

SEQ ID NO: 2249286 - RNA, 21 nt, Yersinia pestis
ucacauuugaaaugcauuggu

SEQ ID NO: 2249287 - RNA, 14 nt, Yersinia pestis
ucacauuuuuaaua

SEQ ID NO: 2249288 - RNA, 18 nt, Yersinia pestis
ucacauuuuuaauaaugu

SEQ ID NO: 2249289 - RNA, 14 nt, Yersinia pestis
ucaccaaaauccca

SEQ ID NO: 2249290 - RNA, 15 nt, Yersinia pestis
ucaccaaccaaccau

SEQ ID NO: 2249291 - RNA, 18 nt, Yersinia pestis
ucaccaagaggaaaugcc

SEQ ID NO: 2249292 - RNA, 20 nt, Yersinia pestis
ucaccaauauguucaucagg

SEQ ID NO: 2249293 - RNA, 12 nt, Yersinia pestis
ucaccaccacca

SEQ ID NO: 2249294 - RNA, 15 nt, Yersinia pestis
ucaccacacauacca

SEQ ID NO: 2249295 - RNA, 17 nt, Yersinia pestis
ucaccaagauaccgagu

SEQ ID NO: 2249296 - RNA, 15 nt, Yersinia pestis
ucaccaagcuuuuau

SEQ ID NO: 2249297 - RNA, 16 nt, Yersinia pestis
ucaccguauacgcuga

SEQ ID NO: 2249298 - RNA, 22 nt, Yersinia pestis
ucaccgugacuguuaacaucca

SEQ ID NO: 2249299 - RNA, 13 nt, Yersinia pestis
ucaccguagaacg

SEQ ID NO: 2249300 - RNA, 18 nt, Yersinia pestis
ucaccguaaccauuggca

SEQ ID NO: 2249301 - RNA, 18 nt, Yersinia pestis
ucaccgccuuucauucug

SEQ ID NO: 2249302 - RNA, 23 nt, Yersinia pestis
ucaccgcccccaauaagggccac

SEQ ID NO: 2249303 - RNA, 14 nt, Yersinia pestis
ucaccgagaucacc

SEQ ID NO: 2249304 - RNA, 22 nt, Yersinia pestis
ucacccuuuugaauucaccaaa

SEQ ID NO: 2249305 - RNA, 12 nt, Yersinia pestis
ucacccucugca

SEQ ID NO: 2249306 - RNA, 15 nt, Yersinia pestis
ucacccucugcagcu

SEQ ID NO: 2249307 - RNA, 12 nt, Yersinia pestis
ucacccucugcg

SEQ ID NO: 2249308 - RNA, 14 nt, Yersinia pestis
ucacccuggcucug

SEQ ID NO: 2249309 - RNA, 15 nt, Yersinia pestis
ucacccccacaucag

SEQ ID NO: 2249310 - RNA, 19 nt, Yersinia pestis
ucaccccagucacugacuu

SEQ ID NO: 2249311 - RNA, 19 nt, Yersinia pestis
ucacccgcaaaacugaagc

SEQ ID NO: 2249312 - RNA, 20 nt, Yersinia pestis
ucaccaggccacuugggcug

SEQ ID NO: 2249313 - RNA, 18 nt, Yersinia pestis
ucaccaguagcccagccg

SEQ ID NO: 2249314 - RNA, 22 nt, Yersinia pestis
ucaccaguggucaucaccguuu

SEQ ID NO: 2249315 - RNA, 18 nt, Yersinia pestis
ucaccagacaaccaauac

SEQ ID NO: 2249316 - RNA, 21 nt, Yersinia pestis
ucaccagacaaccaauacaca

SEQ ID NO: 2249317 - RNA, 21 nt, Yersinia pestis
ucaccagaugccgcacacauc

SEQ ID NO: 2249318 - RNA, 18 nt, Yersinia pestis
ucaccaccgcauuuucaa

SEQ ID NO: 2249319 - RNA, 12 nt, Yersinia pestis
ucaccaccauua

SEQ ID NO: 2249320 - RNA, 24 nt, Yersinia pestis
ucaccaccauuaacaagcgaccau

SEQ ID NO: 2249321 - RNA, 21 nt, Yersinia pestis
ucaccacgauuagccauaaga

SEQ ID NO: 2249322 - RNA, 18 nt, Yersinia pestis
ucaccccaacgcuggcug

SEQ ID NO: 2249323 - RNA, 15 nt, Yersinia pestis
ucaccccacuuucca

SEQ ID NO: 2249324 - RNA, 12 nt, Yersinia pestis
ucaccccagcaa

SEQ ID NO: 2249325 - RNA, 16 nt, Yersinia pestis
ucacccauaccaacca

SEQ ID NO: 2249326 - RNA, 14 nt, Yersinia pestis
ucaccauugaccag

SEQ ID NO: 2249327 - RNA, 21 nt, Yersinia pestis
ucaccauccggguuuauccca

SEQ ID NO: 2249328 - RNA, 13 nt, Yersinia pestis
uauucauuaaaaa

SEQ ID NO: 2249329 - RNA, 20 nt, Yersinia pestis
uauucauuaaaaaauaauuu

SEQ ID NO: 2249330 - RNA, 16 nt, Yersinia pestis
uauucaguaacaacau

SEQ ID NO: 2249331 - RNA, 14 nt, Yersinia pestis
uauuccucugccua

SEQ ID NO: 2249332 - RNA, 15 nt, Yersinia pestis
uauuccucgcaggcu

SEQ ID NO: 2249333 - RNA, 18 nt, Yersinia pestis
uauucacuauuuauuaau

SEQ ID NO: 2249334 - RNA, 16 nt, Yersinia pestis
uauucacguuuuucca

SEQ ID NO: 2249335 - RNA, 18 nt, Yersinia pestis
uauucaaugacuccugaa

SEQ ID NO: 2249336 - RNA, 21 nt, Yersinia pestis
uauucaaugacuccugaaaua

SEQ ID NO: 2249337 - RNA, 21 nt, Yersinia pestis
uauucacagcagaacaaaaca

SEQ ID NO: 2249338 - RNA, 16 nt, Yersinia pestis
uauucaacgccaauac

SEQ ID NO: 2249339 - RNA, 21 nt, Yersinia pestis
uauucaacagccuuucccuga

SEQ ID NO: 2249340 - RNA, 18 nt, Yersinia pestis
uauucaaccgccagugcc

SEQ ID NO: 2249341 - RNA, 16 nt, Yersinia pestis
uauucaauacuggcca

SEQ ID NO: 2249342 - RNA, 13 nt, Yersinia pestis
uauucaagugcuc

SEQ ID NO: 2249343 - RNA, 18 nt, Yersinia pestis
uauucuuaucaaucaaaa

SEQ ID NO: 2249344 - RNA, 22 nt, Yersinia pestis
uauucuucuucauuuucaucac

SEQ ID NO: 2249345 - RNA, 21 nt, Yersinia pestis
uauucuuuauuuauuuuacug

SEQ ID NO: 2249346 - RNA, 20 nt, Yersinia pestis
uauugaccaccuuauuggcc

SEQ ID NO: 2249347 - RNA, 15 nt, Yersinia pestis
uauugacaaagugcc

SEQ ID NO: 2249348 - RNA, 21 nt, Yersinia pestis
uauugaagggcaaaacgugaa

SEQ ID NO: 2249349 - RNA, 23 nt, Yersinia pestis
uauucucugaacgcacuucaauc

SEQ ID NO: 2249350 - RNA, 16 nt, Yersinia pestis
uauucuccaacaacug

SEQ ID NO: 2249351 - RNA, 15 nt, Yersinia pestis
uauucugauaccugc

SEQ ID NO: 2249352 - RNA, 20 nt, Yersinia pestis
uauucuaauugauauuauuu

SEQ ID NO: 2249353 - RNA, 23 nt, Yersinia pestis
uauucuaauugauauuauuuaua

SEQ ID NO: 2249354 - RNA, 22 nt, Yersinia pestis
uauucuaauugauauuauuuau

SEQ ID NO: 2249355 - RNA, 23 nt, Yersinia pestis
uauucgggcaacuaauucuuagg

SEQ ID NO: 2249356 - RNA, 16 nt, Yersinia pestis
uauucgcuuuauaucc

SEQ ID NO: 2249357 - RNA, 15 nt, Yersinia pestis
uauucgcgcuuuaac

SEQ ID NO: 2249358 - RNA, 21 nt, Yersinia pestis
uauuaaccuacugacauuucu

SEQ ID NO: 2249359 - RNA, 18 nt, Yersinia pestis
uauuaacugcagugaaaa

SEQ ID NO: 2249360 - RNA, 13 nt, Yersinia pestis
uauuaacugcagu

SEQ ID NO: 2249361 - RNA, 12 nt, Yersinia pestis
uauuaauauaau

SEQ ID NO: 2249362 - RNA, 18 nt, Yersinia pestis
uauuaauauaauacuuaa

SEQ ID NO: 2249363 - RNA, 20 nt, Yersinia pestis
uauuaauauaauacuuaagu

SEQ ID NO: 2249364 - RNA, 20 nt, Yersinia pestis
uauuaaagccauucagcagc

SEQ ID NO: 2249365 - RNA, 22 nt, Yersinia pestis
uauuaaagcccgcuuaaauacg

SEQ ID NO: 2249366 - RNA, 18 nt, Yersinia pestis
uauuaaacuugcucuuuc

SEQ ID NO: 2249367 - RNA, 22 nt, Yersinia pestis
uauuaaacgggccgcgcagauu

SEQ ID NO: 2249368 - RNA, 18 nt, Yersinia pestis
uauuaaaugcauuauaag

SEQ ID NO: 2249369 - RNA, 13 nt, Yersinia pestis
uauuaaugaaauu

SEQ ID NO: 2249370 - RNA, 15 nt, Yersinia pestis
uauuaaugaaauuag

SEQ ID NO: 2249371 - RNA, 22 nt, Yersinia pestis
uauuaaugaaauuaguuaauuu

SEQ ID NO: 2249372 - RNA, 19 nt, Yersinia pestis
uauuacaccuuaaaacagc

SEQ ID NO: 2249373 - RNA, 15 nt, Yersinia pestis
uauuaccaauaugaa

SEQ ID NO: 2249374 - RNA, 13 nt, Yersinia pestis
uauuacggcccca

SEQ ID NO: 2249375 - RNA, 14 nt, Yersinia pestis
uauuaucaucuuuc

SEQ ID NO: 2249376 - RNA, 15 nt, Yersinia pestis
uauuaucaugaagaa

SEQ ID NO: 2249377 - RNA, 19 nt, Yersinia pestis
uauuaucccaguuuuuaau

SEQ ID NO: 2249378 - RNA, 11 nt, Yersinia pestis
uauuauuuauu

SEQ ID NO: 2249379 - RNA, 12 nt, Yersinia pestis
uauuauuuauuu

SEQ ID NO: 2249380 - RNA, 14 nt, Yersinia pestis
uauuauuauuuaua

SEQ ID NO: 2249381 - RNA, 16 nt, Yersinia pestis
uauuauuaaauuuuau

SEQ ID NO: 2249382 - RNA, 14 nt, Yersinia pestis
uauuauguauuuuu

SEQ ID NO: 2249383 - RNA, 18 nt, Yersinia pestis
uauuaguccguagaaauc

SEQ ID NO: 2249384 - RNA, 20 nt, Yersinia pestis
uauuaggugcuuguucuguu

SEQ ID NO: 2249385 - RNA, 16 nt, Yersinia pestis
uauuagggcugacaga

SEQ ID NO: 2249386 - RNA, 15 nt, Yersinia pestis
uauuaguuucaaaua

SEQ ID NO: 2249387 - RNA, 13 nt, Yersinia pestis
uauuacuugauau

SEQ ID NO: 2249388 - RNA, 13 nt, Yersinia pestis
uauuacuucuuuu

SEQ ID NO: 2249389 - RNA, 15 nt, Yersinia pestis
uauuacugucauugc

SEQ ID NO: 2249390 - RNA, 16 nt, Yersinia pestis
uauuacugucauugcu

SEQ ID NO: 2249391 - RNA, 21 nt, Yersinia pestis
uauuacucagcacauuuuuau

SEQ ID NO: 2249392 - RNA, 12 nt, Yersinia pestis
uauuacugucaa

SEQ ID NO: 2249393 - RNA, 13 nt, Yersinia pestis
uauuacugucaau

SEQ ID NO: 2249394 - RNA, 15 nt, Yersinia pestis
uauuacugucacugu

SEQ ID NO: 2249395 - RNA, 14 nt, Yersinia pestis
uauuagccaaauac

SEQ ID NO: 2249396 - RNA, 18 nt, Yersinia pestis
uauuagccagcagaaacc

SEQ ID NO: 2249397 - RNA, 20 nt, Yersinia pestis
uauuagcgcugcucaaucac

SEQ ID NO: 2249398 - RNA, 18 nt, Yersinia pestis
uauuagccaaauacccua

SEQ ID NO: 2249399 - RNA, 22 nt, Yersinia pestis
uauuucacgcuaauuauuuuau

SEQ ID NO: 2249400 - RNA, 19 nt, Yersinia pestis
uauuucacgcuaauuauuu

SEQ ID NO: 2249401 - RNA, 20 nt, Yersinia pestis
uauuucacgcuaauuauuuu

SEQ ID NO: 2249402 - RNA, 14 nt, Yersinia pestis
uauuucagccaugg

SEQ ID NO: 2249403 - RNA, 16 nt, Yersinia pestis
uauuucagauuuauuu

SEQ ID NO: 2249404 - RNA, 23 nt, Yersinia pestis
uauuuccgaauuaaaaaucagag

SEQ ID NO: 2249405 - RNA, 16 nt, Yersinia pestis
uauuuccgcugacuua

SEQ ID NO: 2249406 - RNA, 13 nt, Yersinia pestis
uauuuauuccaca

SEQ ID NO: 2249407 - RNA, 19 nt, Yersinia pestis
uauuuauggggauuuugcu

SEQ ID NO: 2249408 - RNA, 16 nt, Yersinia pestis
uauuuauuaaaacaca

SEQ ID NO: 2249409 - RNA, 21 nt, Yersinia pestis
uauuuaucugcauuaaaauaa

SEQ ID NO: 2249410 - RNA, 17 nt, Yersinia pestis
uauuuaucgccaacaua

SEQ ID NO: 2249411 - RNA, 17 nt, Yersinia pestis
uauuuauuuacagccac

SEQ ID NO: 2249412 - RNA, 20 nt, Yersinia pestis
uauuuauuggucaauaaaau

SEQ ID NO: 2249413 - RNA, 13 nt, Yersinia pestis
uauuuauuuccga

SEQ ID NO: 2249414 - RNA, 17 nt, Yersinia pestis
uauuuauuuauuuccgc

SEQ ID NO: 2249415 - RNA, 19 nt, Yersinia pestis
uauuucacacuguuuaguu

SEQ ID NO: 2249416 - RNA, 22 nt, Yersinia pestis
uauuucaagcuacaugugcauu

SEQ ID NO: 2249417 - RNA, 13 nt, Yersinia pestis
uauuuuaaauaug

SEQ ID NO: 2249418 - RNA, 17 nt, Yersinia pestis
uauuugggguauauauu

SEQ ID NO: 2249419 - RNA, 18 nt, Yersinia pestis
uauuugggguauauauuu

SEQ ID NO: 2249420 - RNA, 19 nt, Yersinia pestis
uauuugggguauauauuuu

SEQ ID NO: 2249421 - RNA, 19 nt, Yersinia pestis
uauuuggugaguaaaugcc

SEQ ID NO: 2249422 - RNA, 17 nt, Yersinia pestis
uauuuguagugacguaa

SEQ ID NO: 2249423 - RNA, 16 nt, Yersinia pestis
uauuuuacuugccauu

SEQ ID NO: 2249424 - RNA, 11 nt, Yersinia pestis
uauuuuacuug

SEQ ID NO: 2249425 - RNA, 13 nt, Yersinia pestis
uauuuuacuugcc

SEQ ID NO: 2249426 - RNA, 22 nt, Yersinia pestis
uauuuuaucuuuuagugagggg

SEQ ID NO: 2249427 - RNA, 13 nt, Yersinia pestis
uauuuuaugcccc

SEQ ID NO: 2249428 - RNA, 16 nt, Yersinia pestis
uauuugaacuucaaau

SEQ ID NO: 2249429 - RNA, 15 nt, Yersinia pestis
uauuucuuagagaga

SEQ ID NO: 2249430 - RNA, 22 nt, Yersinia pestis
uauuugcagcggaugauaaaua

SEQ ID NO: 2249431 - RNA, 15 nt, Yersinia pestis
uauuugagauauagg

SEQ ID NO: 2249432 - RNA, 14 nt, Yersinia pestis
uauuugaguuuuag

SEQ ID NO: 2249433 - RNA, 19 nt, Yersinia pestis
uauuuaaccgcccucuuga

SEQ ID NO: 2249434 - RNA, 18 nt, Yersinia pestis
uauuuaaauuuuuauaua

SEQ ID NO: 2249435 - RNA, 11 nt, Yersinia pestis
uauuuaacaaa

SEQ ID NO: 2249436 - RNA, 21 nt, Yersinia pestis
uauuuaaauuacagacaaauc

SEQ ID NO: 2249437 - RNA, 19 nt, Yersinia pestis
uauuuaaaauuaauaguuu

SEQ ID NO: 2249438 - RNA, 19 nt, Yersinia pestis
uauuguuuugacuaaaauu

SEQ ID NO: 2249439 - RNA, 17 nt, Yersinia pestis
uauuguggauaguaaac

SEQ ID NO: 2249440 - RNA, 17 nt, Yersinia pestis
uauugucucuacucucu

SEQ ID NO: 2249441 - RNA, 17 nt, Yersinia pestis
uauuguauauaccuguc

SEQ ID NO: 2249442 - RNA, 14 nt, Yersinia pestis
uauuguggcuacca

SEQ ID NO: 2249443 - RNA, 20 nt, Yersinia pestis
uauuguggggccuuuauuca

SEQ ID NO: 2249444 - RNA, 20 nt, Yersinia pestis
uauugugucaauaccuuacu

SEQ ID NO: 2249445 - RNA, 12 nt, Yersinia pestis
uauuuacgguga

SEQ ID NO: 2249446 - RNA, 20 nt, Yersinia pestis
uauuuaccugcucaacugcu

SEQ ID NO: 2249447 - RNA, 17 nt, Yersinia pestis
uauuuauaaaaaaugga

SEQ ID NO: 2249448 - RNA, 16 nt, Yersinia pestis
uauuuauaaaaccacu

SEQ ID NO: 2249449 - RNA, 23 nt, Yersinia pestis
uauuuaauuaaauguauaaaaaa

SEQ ID NO: 2249450 - RNA, 12 nt, Yersinia pestis
uauuuaauuuaa

SEQ ID NO: 2249451 - RNA, 14 nt, Yersinia pestis
uauuuaauuuaaau

SEQ ID NO: 2249452 - RNA, 20 nt, Yersinia pestis
uauuuaauuuaaauaaaaua

SEQ ID NO: 2249453 - RNA, 21 nt, Yersinia pestis
uauuuaauuuaaauaaaauaa

SEQ ID NO: 2249454 - RNA, 16 nt, Yersinia pestis
uauuuacauaauaacc

SEQ ID NO: 2249455 - RNA, 22 nt, Yersinia pestis
uauuuacauaauaaccauuuau

SEQ ID NO: 2249456 - RNA, 14 nt, Yersinia pestis
uauuuacaaaccac

SEQ ID NO: 2249457 - RNA, 21 nt, Yersinia pestis
uauugauaaaaauauccagca

SEQ ID NO: 2249458 - RNA, 12 nt, Yersinia pestis
uauugauaaaac

SEQ ID NO: 2249459 - RNA, 16 nt, Yersinia pestis
uauugauaaaaccacu

SEQ ID NO: 2249460 - RNA, 16 nt, Yersinia pestis
uauugauaaaaccgcu

SEQ ID NO: 2249461 - RNA, 17 nt, Yersinia pestis
uauugagcgaugacaau

SEQ ID NO: 2249462 - RNA, 13 nt, Yersinia pestis
uauugauagccac

SEQ ID NO: 2249463 - RNA, 20 nt, Yersinia pestis
uauugauaaaaccgcuuauc

SEQ ID NO: 2249464 - RNA, 14 nt, Yersinia pestis
uauugauagccaca

SEQ ID NO: 2249465 - RNA, 19 nt, Yersinia pestis
uauugauagccacaucauu

SEQ ID NO: 2249466 - RNA, 19 nt, Yersinia pestis
uauugaugacgcuaaccac

SEQ ID NO: 2249467 - RNA, 13 nt, Yersinia pestis
uauugaugcagug

SEQ ID NO: 2249468 - RNA, 19 nt, Yersinia pestis
uauugauuaauuuuucaua

SEQ ID NO: 2249469 - RNA, 15 nt, Yersinia pestis
uauugcacugagaga

SEQ ID NO: 2249470 - RNA, 19 nt, Yersinia pestis
uauugcacgguguaaauaa

SEQ ID NO: 2249471 - RNA, 19 nt, Yersinia pestis
uauuggccgacugacacaa

SEQ ID NO: 2249472 - RNA, 17 nt, Yersinia pestis
uauuggccgucagcaga

SEQ ID NO: 2249473 - RNA, 22 nt, Yersinia pestis
uauuggaaaaaucaguauuaua

SEQ ID NO: 2249474 - RNA, 18 nt, Yersinia pestis
uauuggucguaccaaugg

SEQ ID NO: 2249475 - RNA, 21 nt, Yersinia pestis
uauuggccgucagcagauaag

SEQ ID NO: 2249476 - RNA, 14 nt, Yersinia pestis
uauugggaaccccu

SEQ ID NO: 2249477 - RNA, 22 nt, Yersinia pestis
uauugccgcaguccaaaaaacu

SEQ ID NO: 2249478 - RNA, 18 nt, Yersinia pestis
uauugcugugguugaucc

SEQ ID NO: 2249479 - RNA, 16 nt, Yersinia pestis
uauugcucagggccac

SEQ ID NO: 2249480 - RNA, 13 nt, Yersinia pestis
uauugcuccagag

SEQ ID NO: 2249481 - RNA, 21 nt, Yersinia pestis
uauugcuccgacaauaacgcu

SEQ ID NO: 2249482 - RNA, 16 nt, Yersinia pestis
uauugcucugccgcag

SEQ ID NO: 2249483 - RNA, 22 nt, Yersinia pestis
uauugcgcaguaaauucaucac

SEQ ID NO: 2249484 - RNA, 18 nt, Yersinia pestis
uauugcuaaguacuaucu

SEQ ID NO: 2249485 - RNA, 19 nt, Yersinia pestis
uauugcuaaguacuaucua

SEQ ID NO: 2249486 - RNA, 14 nt, Yersinia pestis
ucaacuuccgcguu

SEQ ID NO: 2249487 - RNA, 13 nt, Yersinia pestis
ucaacuuucucuu

SEQ ID NO: 2249488 - RNA, 18 nt, Yersinia pestis
ucaagaaauuuaaaaacc

SEQ ID NO: 2249489 - RNA, 14 nt, Yersinia pestis
ucaagaauauaaua

SEQ ID NO: 2249490 - RNA, 22 nt, Yersinia pestis
ucaagagggcgguuaaauacag

SEQ ID NO: 2249491 - RNA, 13 nt, Yersinia pestis
ucaagauaaaguu

SEQ ID NO: 2249492 - RNA, 22 nt, Yersinia pestis
ucaagacucaguaaauauaauu

SEQ ID NO: 2249493 - RNA, 18 nt, Yersinia pestis
ucaagauagcugucagcg

SEQ ID NO: 2249494 - RNA, 16 nt, Yersinia pestis
ucaagaucaaaagcag

SEQ ID NO: 2249495 - RNA, 12 nt, Yersinia pestis
ucaagaugcaua

SEQ ID NO: 2249496 - RNA, 18 nt, Yersinia pestis
ucaagauggucauaaaua

SEQ ID NO: 2249497 - RNA, 18 nt, Yersinia pestis
ucaagaucaaaagcagag

SEQ ID NO: 2249498 - RNA, 15 nt, Yersinia pestis
ucaagaucgcgucau

SEQ ID NO: 2249499 - RNA, 13 nt, Yersinia pestis
ucaagaugcaggg

SEQ ID NO: 2249500 - RNA, 18 nt, Yersinia pestis
ucaagccgauaaucccug

SEQ ID NO: 2249501 - RNA, 16 nt, Yersinia pestis
ucaagccaacccccau

SEQ ID NO: 2249502 - RNA, 20 nt, Yersinia pestis
ucaagcauucagcuuucucu

SEQ ID NO: 2249503 - RNA, 13 nt, Yersinia pestis
ucaagcaauaauu

SEQ ID NO: 2249504 - RNA, 11 nt, Yersinia pestis
ucaagcaaugg

SEQ ID NO: 2249505 - RNA, 16 nt, Yersinia pestis
ucaacucaaaacaauu

SEQ ID NO: 2249506 - RNA, 18 nt, Yersinia pestis
ucaacugcucaacugcuc

SEQ ID NO: 2249507 - RNA, 22 nt, Yersinia pestis
ucaacuaccccacauucaguac

SEQ ID NO: 2249508 - RNA, 16 nt, Yersinia pestis
ucaacguguuguuuuc

SEQ ID NO: 2249509 - RNA, 22 nt, Yersinia pestis
ucaacgcuccgguuuucacccc

SEQ ID NO: 2249510 - RNA, 13 nt, Yersinia pestis
ucaacgcuucagu

SEQ ID NO: 2249511 - RNA, 19 nt, Yersinia pestis
ucaacgcccagcuuuagca

SEQ ID NO: 2249512 - RNA, 22 nt, Yersinia pestis
ucaacgcccagcuuuuuacgca

SEQ ID NO: 2249513 - RNA, 21 nt, Yersinia pestis
ucaacgcccgcggccaauagc

SEQ ID NO: 2249514 - RNA, 22 nt, Yersinia pestis
ucaacgcccgcggccaauagca

SEQ ID NO: 2249515 - RNA, 20 nt, Yersinia pestis
ucaacgccauagcaaaucac

SEQ ID NO: 2249516 - RNA, 18 nt, Yersinia pestis
ucaacgcaccauccagca

SEQ ID NO: 2249517 - RNA, 19 nt, Yersinia pestis
ucaacgcaccauccagcaa

SEQ ID NO: 2249518 - RNA, 20 nt, Yersinia pestis
ucaacgcaccauccagcaaa

SEQ ID NO: 2249519 - RNA, 14 nt, Yersinia pestis
ucaaccucagccuc

SEQ ID NO: 2249520 - RNA, 15 nt, Yersinia pestis
ucaaccucagccuca

SEQ ID NO: 2249521 - RNA, 20 nt, Yersinia pestis
ucaaccucagccucauucau

SEQ ID NO: 2249522 - RNA, 16 nt, Yersinia pestis
ucaaccucuuguaaac

SEQ ID NO: 2249523 - RNA, 23 nt, Yersinia pestis
ucaaccuggcaccggacaaacca

SEQ ID NO: 2249524 - RNA, 16 nt, Yersinia pestis
ucaaccugaucaucaa

SEQ ID NO: 2249525 - RNA, 11 nt, Yersinia pestis
ucaaccugaau

SEQ ID NO: 2249526 - RNA, 22 nt, Yersinia pestis
ucaaaucagaggcuucauucgu

SEQ ID NO: 2249527 - RNA, 17 nt, Yersinia pestis
ucaaauaguagaucuau

SEQ ID NO: 2249528 - RNA, 20 nt, Yersinia pestis
ucaaauaguagaucuauuag

SEQ ID NO: 2249529 - RNA, 21 nt, Yersinia pestis
ucaaaucugcuccaucaauaa

SEQ ID NO: 2249530 - RNA, 21 nt, Yersinia pestis
ucaaaugauucagugauaaca

SEQ ID NO: 2249531 - RNA, 20 nt, Yersinia pestis
ucaacaaaacgaacacugca

SEQ ID NO: 2249532 - RNA, 21 nt, Yersinia pestis
ucaacaaaacgaacacugcaa

SEQ ID NO: 2249533 - RNA, 21 nt, Yersinia pestis
ucaacaaaaaagggggcccug

SEQ ID NO: 2249534 - RNA, 15 nt, Yersinia pestis
ucaacaaucaaucac

SEQ ID NO: 2249535 - RNA, 21 nt, Yersinia pestis
ucaaauuugcaguauucaggu

SEQ ID NO: 2249536 - RNA, 16 nt, Yersinia pestis
ucaaauuuaaaguuuu

SEQ ID NO: 2249537 - RNA, 12 nt, Yersinia pestis
ucaacagccuuu

SEQ ID NO: 2249538 - RNA, 22 nt, Yersinia pestis
ucaacagauaugcauuauugau

SEQ ID NO: 2249539 - RNA, 17 nt, Yersinia pestis
ucaacagcaaaagaacc

SEQ ID NO: 2249540 - RNA, 19 nt, Yersinia pestis
ucaacagaugaugauuuuu

SEQ ID NO: 2249541 - RNA, 12 nt, Yersinia pestis
ucaacaggagca

SEQ ID NO: 2249542 - RNA, 19 nt, Yersinia pestis
ucaacaggagcaaccauuu

SEQ ID NO: 2249543 - RNA, 19 nt, Yersinia pestis
ucaacacugccugaugcua

SEQ ID NO: 2249544 - RNA, 14 nt, Yersinia pestis
ucaacaucgcaccg

SEQ ID NO: 2249545 - RNA, 17 nt, Yersinia pestis
ucaacaucgcaccgaug

SEQ ID NO: 2249546 - RNA, 22 nt, Yersinia pestis
ucaacauuuaagugcuaaucau

SEQ ID NO: 2249547 - RNA, 18 nt, Yersinia pestis
ucaacauugcucggcuga

SEQ ID NO: 2249548 - RNA, 22 nt, Yersinia pestis
ucaacauugcucggcugacgau

SEQ ID NO: 2249549 - RNA, 22 nt, Yersinia pestis
ucaaccaauuauccaucccuau

SEQ ID NO: 2249550 - RNA, 17 nt, Yersinia pestis
ucaaccacgguaauagc

SEQ ID NO: 2249551 - RNA, 21 nt, Yersinia pestis
ucaaccauucauacugacuua

SEQ ID NO: 2249552 - RNA, 14 nt, Yersinia pestis
ucaaccaguugaug

SEQ ID NO: 2249553 - RNA, 17 nt, Yersinia pestis
ucaaacugauaaagcaa

SEQ ID NO: 2249554 - RNA, 17 nt, Yersinia pestis
ucaaacagguugguaua

SEQ ID NO: 2249555 - RNA, 20 nt, Yersinia pestis
ucaaaccaagcccuuuggca

SEQ ID NO: 2249556 - RNA, 15 nt, Yersinia pestis
ucaaaccagagaaag

SEQ ID NO: 2249557 - RNA, 13 nt, Yersinia pestis
ucaaacaaaucuu

SEQ ID NO: 2249558 - RNA, 19 nt, Yersinia pestis
ucaaaauuagguuuucccu

SEQ ID NO: 2249559 - RNA, 13 nt, Yersinia pestis
ucaaaaucaaaaa

SEQ ID NO: 2249560 - RNA, 13 nt, Yersinia pestis
ucaaaauacauaa

SEQ ID NO: 2249561 - RNA, 11 nt, Yersinia pestis
ucaaaauaccc

SEQ ID NO: 2249562 - RNA, 18 nt, Yersinia pestis
ucaaaauagaggaaauaa

SEQ ID NO: 2249563 - RNA, 21 nt, Yersinia pestis
ucaaaauaaaaauucacaaca

SEQ ID NO: 2249564 - RNA, 15 nt, Yersinia pestis
ucaaaaucuucggca

SEQ ID NO: 2249565 - RNA, 17 nt, Yersinia pestis
ucaaaaucugauacuga

SEQ ID NO: 2249566 - RNA, 17 nt, Yersinia pestis
ucaaauaaguguuucaa

SEQ ID NO: 2249567 - RNA, 12 nt, Yersinia pestis
ucaaauacugug

SEQ ID NO: 2249568 - RNA, 20 nt, Yersinia pestis
ucaaauacgaccgucaccaa

SEQ ID NO: 2249569 - RNA, 20 nt, Yersinia pestis
ucaaauaaguguuucaaaua

SEQ ID NO: 2249570 - RNA, 16 nt, Yersinia pestis
ucaaagaccacaucaa

SEQ ID NO: 2249571 - RNA, 14 nt, Yersinia pestis
ucaaagaauaacug

SEQ ID NO: 2249572 - RNA, 16 nt, Yersinia pestis
ucaaacuggcccagcu

SEQ ID NO: 2249573 - RNA, 19 nt, Yersinia pestis
uauuuuggaguauacauua

SEQ ID NO: 2249574 - RNA, 18 nt, Yersinia pestis
uauuuugaauauuuuuaa

SEQ ID NO: 2249575 - RNA, 19 nt, Yersinia pestis
uauuuugaauauuuuuaau

SEQ ID NO: 2249576 - RNA, 21 nt, Yersinia pestis
uauuuugaaccguaugcuuuc

SEQ ID NO: 2249577 - RNA, 14 nt, Yersinia pestis
uauuuucccuuucu

SEQ ID NO: 2249578 - RNA, 22 nt, Yersinia pestis
uauuuuccgggucaaacucagc

SEQ ID NO: 2249579 - RNA, 20 nt, Yersinia pestis
uauuuuccugaucaacugcu

SEQ ID NO: 2249580 - RNA, 15 nt, Yersinia pestis
uauuuucuaaccagg

SEQ ID NO: 2249581 - RNA, 14 nt, Yersinia pestis
uauuuucaucccaa

SEQ ID NO: 2249582 - RNA, 21 nt, Yersinia pestis
uauuuucaucccaagagaacg

SEQ ID NO: 2249583 - RNA, 14 nt, Yersinia pestis
uauuuucauuauuu

SEQ ID NO: 2249584 - RNA, 23 nt, Yersinia pestis
uauuuuuucuuucaccagugguc

SEQ ID NO: 2249585 - RNA, 16 nt, Yersinia pestis
uauuuuugacuuuaau

SEQ ID NO: 2249586 - RNA, 19 nt, Yersinia pestis
uauuuuugacuuuaauuaa

SEQ ID NO: 2249587 - RNA, 20 nt, Yersinia pestis
uauuuuugacuuuaauuaaa

SEQ ID NO: 2249588 - RNA, 12 nt, Yersinia pestis
ucaaaaaugaua

SEQ ID NO: 2249589 - RNA, 16 nt, Yersinia pestis
ucaaaacaaucacuga

SEQ ID NO: 2249590 - RNA, 14 nt, Yersinia pestis
ucaaaacaaucacu

SEQ ID NO: 2249591 - RNA, 23 nt, Yersinia pestis
ucaaaaccgaugagugaaaucuc

SEQ ID NO: 2249592 - RNA, 16 nt, Yersinia pestis
ucaaaaccaauagauu

SEQ ID NO: 2249593 - RNA, 14 nt, Yersinia pestis
ucaaaagauaaucu

SEQ ID NO: 2249594 - RNA, 14 nt, Yersinia pestis
ucaaaagcggcucu

SEQ ID NO: 2249595 - RNA, 15 nt, Yersinia pestis
ucaaaacuaauauuu

SEQ ID NO: 2249596 - RNA, 19 nt, Yersinia pestis
ucaaaaggauggcccaagc

SEQ ID NO: 2249597 - RNA, 20 nt, Yersinia pestis
ucaaaaggauggcccaagcc

SEQ ID NO: 2249598 - RNA, 21 nt, Yersinia pestis
ucaaaaggauggcccaagcca

SEQ ID NO: 2249599 - RNA, 12 nt, Yersinia pestis
ucaaaaaccugu

SEQ ID NO: 2249600 - RNA, 11 nt, Yersinia pestis
ucaaaaaauag

SEQ ID NO: 2249601 - RNA, 16 nt, Yersinia pestis
ucaaaaaaaauacauu

SEQ ID NO: 2249602 - RNA, 16 nt, Yersinia pestis
uauuuuuuuggcagau

SEQ ID NO: 2249603 - RNA, 16 nt, Yersinia pestis
guucuguagcugacac

SEQ ID NO: 2249604 - RNA, 20 nt, Yersinia pestis
guucuuauugcuaucuguua

SEQ ID NO: 2249605 - RNA, 13 nt, Yersinia pestis
guucugcugccag

SEQ ID NO: 2249606 - RNA, 22 nt, Yersinia pestis
guucuggaucggcauacuccau

SEQ ID NO: 2249607 - RNA, 21 nt, Yersinia pestis
guuuaauuucacuuccauucc

SEQ ID NO: 2249608 - RNA, 12 nt, Yersinia pestis
guuuaauuucac

SEQ ID NO: 2249609 - RNA, 15 nt, Yersinia pestis
guuuaauuucacuuc

SEQ ID NO: 2249610 - RNA, 14 nt, Yersinia pestis
guuuaaugccccug

SEQ ID NO: 2249611 - RNA, 13 nt, Yersinia pestis
guuuacguaaaua

SEQ ID NO: 2249612 - RNA, 20 nt, Yersinia pestis
guuuaacucaaauaaaccaa

SEQ ID NO: 2249613 - RNA, 17 nt, Yersinia pestis
guuguuauuucuguucc

SEQ ID NO: 2249614 - RNA, 16 nt, Yersinia pestis
guuucguuuacugccu

SEQ ID NO: 2249615 - RNA, 17 nt, Yersinia pestis
guuucauuugcuguggc

SEQ ID NO: 2249616 - RNA, 18 nt, Yersinia pestis
guuucaucgacucuuuuu

SEQ ID NO: 2249617 - RNA, 17 nt, Yersinia pestis
guuucagcuugcaacaa

SEQ ID NO: 2249618 - RNA, 18 nt, Yersinia pestis
guuucaguauuguauaca

SEQ ID NO: 2249619 - RNA, 17 nt, Yersinia pestis
guuuauuuaacacauuc

SEQ ID NO: 2249620 - RNA, 17 nt, Yersinia pestis
guuucaaauaaguauuu

SEQ ID NO: 2249621 - RNA, 15 nt, Yersinia pestis
guuucuuacuaaaau

SEQ ID NO: 2249622 - RNA, 16 nt, Yersinia pestis
guuucuuacuaaaaua

SEQ ID NO: 2249623 - RNA, 21 nt, Yersinia pestis
guuucuggaaugagaugaaca

SEQ ID NO: 2249624 - RNA, 17 nt, Yersinia pestis
guuugccagugcaugca

SEQ ID NO: 2249625 - RNA, 20 nt, Yersinia pestis
guuugccguuuccagugcgg

SEQ ID NO: 2249626 - RNA, 18 nt, Yersinia pestis
guuugcgccguaaacugc

SEQ ID NO: 2249627 - RNA, 23 nt, Yersinia pestis
guuugucggacuguugcaaccag

SEQ ID NO: 2249628 - RNA, 17 nt, Yersinia pestis
guuuguaucgaugauca

SEQ ID NO: 2249629 - RNA, 19 nt, Yersinia pestis
guuuguuucucugccgcca

SEQ ID NO: 2249630 - RNA, 15 nt, Yersinia pestis
guuuguuuggauaaa

SEQ ID NO: 2249631 - RNA, 16 nt, Yersinia pestis
guuuucguuuaaaaaa

SEQ ID NO: 2249632 - RNA, 23 nt, Yersinia pestis
guuuuauacccguuauaccucaa

SEQ ID NO: 2249633 - RNA, 17 nt, Yersinia pestis
guuuuauugcaacuggg

SEQ ID NO: 2249634 - RNA, 18 nt, Yersinia pestis
guuuuauucaagugcuca

SEQ ID NO: 2249635 - RNA, 20 nt, Yersinia pestis
guuuuaacguacccucccag

SEQ ID NO: 2249636 - RNA, 22 nt, Yersinia pestis
guuuuacgcgaccauucauccc

SEQ ID NO: 2249637 - RNA, 21 nt, Yersinia pestis
uaaaagaaaaccuugacucuu

SEQ ID NO: 2249638 - RNA, 18 nt, Yersinia pestis
uaaaacgcacacugcaga

SEQ ID NO: 2249639 - RNA, 19 nt, Yersinia pestis
uaaaaccuuuacaauuaca

SEQ ID NO: 2249640 - RNA, 20 nt, Yersinia pestis
uaaaaccugcuugaaagcac

SEQ ID NO: 2249641 - RNA, 15 nt, Yersinia pestis
uaaaacgaguaaaua

SEQ ID NO: 2249642 - RNA, 19 nt, Yersinia pestis
uaaaaccuaauaacgcuca

SEQ ID NO: 2249643 - RNA, 20 nt, Yersinia pestis
uaaaaccuaaucucuacauu

SEQ ID NO: 2249644 - RNA, 21 nt, Yersinia pestis
uaaaaccuaaucucuacauuu

SEQ ID NO: 2249645 - RNA, 14 nt, Yersinia pestis
uaaaacagcucacu

SEQ ID NO: 2249646 - RNA, 14 nt, Yersinia pestis
uaaaacagccacga

SEQ ID NO: 2249647 - RNA, 13 nt, Yersinia pestis
uaaaaaauuauua

SEQ ID NO: 2249648 - RNA, 22 nt, Yersinia pestis
uaaaaaauuauuaaauaagaag

SEQ ID NO: 2249649 - RNA, 12 nt, Yersinia pestis
uaaaaacauuga

SEQ ID NO: 2249650 - RNA, 20 nt, Yersinia pestis
uaaaaaucccggcauauuau

SEQ ID NO: 2249651 - RNA, 21 nt, Yersinia pestis
uaaaacagcagccaccaaaaa

SEQ ID NO: 2249652 - RNA, 20 nt, Yersinia pestis
uaaaacacaucacgcuuaag

SEQ ID NO: 2249653 - RNA, 18 nt, Yersinia pestis
uaaaagcacagacaaaca

SEQ ID NO: 2249654 - RNA, 19 nt, Yersinia pestis
uaaaagcacagacaaacaa

SEQ ID NO: 2249655 - RNA, 14 nt, Yersinia pestis
uaaaagccagucag

SEQ ID NO: 2249656 - RNA, 15 nt, Yersinia pestis
uaaaagccagucagg

SEQ ID NO: 2249657 - RNA, 19 nt, Yersinia pestis
uaaaaucacccgcaagaau

SEQ ID NO: 2249658 - RNA, 14 nt, Yersinia pestis
uaaaaucaaaacag

SEQ ID NO: 2249659 - RNA, 14 nt, Yersinia pestis
uaaaauauuuugcu

SEQ ID NO: 2249660 - RNA, 14 nt, Yersinia pestis
uaaaauagcccagu

SEQ ID NO: 2249661 - RNA, 15 nt, Yersinia pestis
uaaaaaacgggcuug

SEQ ID NO: 2249662 - RNA, 20 nt, Yersinia pestis
uaaaaaacgggcuuggcggu

SEQ ID NO: 2249663 - RNA, 18 nt, Yersinia pestis
uaaaaaaauuaaaauaau

SEQ ID NO: 2249664 - RNA, 19 nt, Yersinia pestis
uaaaaaaauuaaaauaaug

SEQ ID NO: 2249665 - RNA, 16 nt, Yersinia pestis
uaaaaaaggguaauca

SEQ ID NO: 2249666 - RNA, 17 nt, Yersinia pestis
uaaaaaaucuauugauu

SEQ ID NO: 2249667 - RNA, 22 nt, Yersinia pestis
uaaaaaaucuauugauugcuua

SEQ ID NO: 2249668 - RNA, 21 nt, Yersinia pestis
guuuuuuuacauauaauccaa

SEQ ID NO: 2249669 - RNA, 12 nt, Yersinia pestis
guuuuuuugcca

SEQ ID NO: 2249670 - RNA, 23 nt, Yersinia pestis
guuuuuuuuauuauuuuuugggg

SEQ ID NO: 2249671 - RNA, 17 nt, Yersinia pestis
guuuuuuuuaucagccc

SEQ ID NO: 2249672 - RNA, 13 nt, Yersinia pestis
uaaaaaaaaauaa

SEQ ID NO: 2249673 - RNA, 16 nt, Yersinia pestis
uaaaaaaaaauaaaau

SEQ ID NO: 2249674 - RNA, 18 nt, Yersinia pestis
guuuucuggcaauuucug

SEQ ID NO: 2249675 - RNA, 18 nt, Yersinia pestis
guuuucuccacaccaacg

SEQ ID NO: 2249676 - RNA, 15 nt, Yersinia pestis
guuuugacuaaaauu

SEQ ID NO: 2249677 - RNA, 17 nt, Yersinia pestis
guuuugcaucaagcucu

SEQ ID NO: 2249678 - RNA, 13 nt, Yersinia pestis
guuuugcucugca

SEQ ID NO: 2249679 - RNA, 20 nt, Yersinia pestis
guuuuuacgugauauaccac

SEQ ID NO: 2249680 - RNA, 13 nt, Yersinia pestis
guuuuuaacaaaa

SEQ ID NO: 2249681 - RNA, 12 nt, Yersinia pestis
guuuuuaaggac

SEQ ID NO: 2249682 - RNA, 14 nt, Yersinia pestis
guuuuuaucccccu

SEQ ID NO: 2249683 - RNA, 21 nt, Yersinia pestis
guuuuuauauauccaaaauaa

SEQ ID NO: 2249684 - RNA, 20 nt, Yersinia pestis
guuuuucccguaggcugacc

SEQ ID NO: 2249685 - RNA, 23 nt, Yersinia pestis
guuuuugaccaugcuuauugcca

SEQ ID NO: 2249686 - RNA, 21 nt, Yersinia pestis
guuuuugucauuuaauuaaau

SEQ ID NO: 2249687 - RNA, 13 nt, Yersinia pestis
uaaccaguugagu

SEQ ID NO: 2249688 - RNA, 11 nt, Yersinia pestis
uaacauuuuuu

SEQ ID NO: 2249689 - RNA, 14 nt, Yersinia pestis
uaacauuuuuucuu

SEQ ID NO: 2249690 - RNA, 13 nt, Yersinia pestis
uaaccauaaaaua

SEQ ID NO: 2249691 - RNA, 15 nt, Yersinia pestis
uaaccaugaugacaa

SEQ ID NO: 2249692 - RNA, 13 nt, Yersinia pestis
uaacauguagcac

SEQ ID NO: 2249693 - RNA, 21 nt, Yersinia pestis
uaacauuacuuugaauagcac

SEQ ID NO: 2249694 - RNA, 16 nt, Yersinia pestis
uaacaugcugauagca

SEQ ID NO: 2249695 - RNA, 12 nt, Yersinia pestis
uaacaugccaca

SEQ ID NO: 2249696 - RNA, 18 nt, Yersinia pestis
uaacaugccacauagcgu

SEQ ID NO: 2249697 - RNA, 16 nt, Yersinia pestis
uaacacccaauaauaa

SEQ ID NO: 2249698 - RNA, 20 nt, Yersinia pestis
uaacacccaauaauaaaaaa

SEQ ID NO: 2249699 - RNA, 21 nt, Yersinia pestis
uaacaccagcaggugauacau

SEQ ID NO: 2249700 - RNA, 21 nt, Yersinia pestis
uaacacccaauaauaaaaaaa

SEQ ID NO: 2249701 - RNA, 21 nt, Yersinia pestis
uaacagagcagaaagcagcag

SEQ ID NO: 2249702 - RNA, 16 nt, Yersinia pestis
uaacagagcagaaagc

SEQ ID NO: 2249703 - RNA, 14 nt, Yersinia pestis
uaacagccccgucu

SEQ ID NO: 2249704 - RNA, 23 nt, Yersinia pestis
uaacagagcagaaagcagcagcu

SEQ ID NO: 2249705 - RNA, 21 nt, Yersinia pestis
uaacgauaaccaaaucaccug

SEQ ID NO: 2249706 - RNA, 20 nt, Yersinia pestis
uaaccucagccucauucaug

SEQ ID NO: 2249707 - RNA, 14 nt, Yersinia pestis
uaacgaauuucauu

SEQ ID NO: 2249708 - RNA, 21 nt, Yersinia pestis
uaacgaauuucauuuuaaaau

SEQ ID NO: 2249709 - RNA, 17 nt, Yersinia pestis
uaacgaauucagcagcg

SEQ ID NO: 2249710 - RNA, 19 nt, Yersinia pestis
uaacgcuggauaagugaau

SEQ ID NO: 2249711 - RNA, 14 nt, Yersinia pestis
uaacgcucuuguag

SEQ ID NO: 2249712 - RNA, 21 nt, Yersinia pestis
uaacgcuaauaacauggggua

SEQ ID NO: 2249713 - RNA, 19 nt, Yersinia pestis
uaacgauuauuaaacuauu

SEQ ID NO: 2249714 - RNA, 15 nt, Yersinia pestis
uaacgcagauaaauc

SEQ ID NO: 2249715 - RNA, 13 nt, Yersinia pestis
uaacgcagaaaua

SEQ ID NO: 2249716 - RNA, 23 nt, Yersinia pestis
uaacgcaauaggcuauuuuacuu

SEQ ID NO: 2249717 - RNA, 13 nt, Yersinia pestis
uaaccuacuccaa

SEQ ID NO: 2249718 - RNA, 14 nt, Yersinia pestis
uaaccuacugacau

SEQ ID NO: 2249719 - RNA, 15 nt, Yersinia pestis
uaaccucaaaaggau

SEQ ID NO: 2249720 - RNA, 18 nt, Yersinia pestis
uaaccucacgggcuucca

SEQ ID NO: 2249721 - RNA, 22 nt, Yersinia pestis
uaaccucacgggcuuccaucag

SEQ ID NO: 2249722 - RNA, 22 nt, Yersinia pestis
uaaccguuuuuucaacuggcug

SEQ ID NO: 2249723 - RNA, 16 nt, Yersinia pestis
uaaccuaaaaacguca

SEQ ID NO: 2249724 - RNA, 15 nt, Yersinia pestis
uaaccggguggccca

SEQ ID NO: 2249725 - RNA, 23 nt, Yersinia pestis
uaaccgucaugcuucaagcugcc

SEQ ID NO: 2249726 - RNA, 15 nt, Yersinia pestis
uaaccgccgcaggcc

SEQ ID NO: 2249727 - RNA, 19 nt, Yersinia pestis
uaaccggguaaauuccgua

SEQ ID NO: 2249728 - RNA, 23 nt, Yersinia pestis
uaaccgccgauauucaagcagug

SEQ ID NO: 2249729 - RNA, 17 nt, Yersinia pestis
uaaccgaagauaaccgg

SEQ ID NO: 2249730 - RNA, 14 nt, Yersinia pestis
uaaccgaauaaaac

SEQ ID NO: 2249731 - RNA, 16 nt, Yersinia pestis
uaaccgaauaaaaccu

SEQ ID NO: 2249732 - RNA, 15 nt, Yersinia pestis
uaaauucuagcaaca

SEQ ID NO: 2249733 - RNA, 16 nt, Yersinia pestis
uaaauuccguggcuua

SEQ ID NO: 2249734 - RNA, 17 nt, Yersinia pestis
uaaauuccguaccaguu

SEQ ID NO: 2249735 - RNA, 18 nt, Yersinia pestis
uaaauuuaauaaaaacca

SEQ ID NO: 2249736 - RNA, 14 nt, Yersinia pestis
uaaauuuaauauga

SEQ ID NO: 2249737 - RNA, 19 nt, Yersinia pestis
uaaauuauugaguaacauu

SEQ ID NO: 2249738 - RNA, 23 nt, Yersinia pestis
uaaauuauugaguaacauuaauc

SEQ ID NO: 2249739 - RNA, 19 nt, Yersinia pestis
uaaauuaucccguucaaua

SEQ ID NO: 2249740 - RNA, 20 nt, Yersinia pestis
uaaauuaucccguucaauaa

SEQ ID NO: 2249741 - RNA, 15 nt, Yersinia pestis
uaaauucaaauauca

SEQ ID NO: 2249742 - RNA, 23 nt, Yersinia pestis
uaaauucaaaauagaggaaauaa

SEQ ID NO: 2249743 - RNA, 15 nt, Yersinia pestis
uaaauucaaaauaga

SEQ ID NO: 2249744 - RNA, 15 nt, Yersinia pestis
uaaauuauuuuaggu

SEQ ID NO: 2249745 - RNA, 15 nt, Yersinia pestis
uaaauucacuuuccc

SEQ ID NO: 2249746 - RNA, 20 nt, Yersinia pestis
uaaauucaacuucuccugua

SEQ ID NO: 2249747 - RNA, 19 nt, Yersinia pestis
uaaauucauuagcucaaau

SEQ ID NO: 2249748 - RNA, 19 nt, Yersinia pestis
uaaauuacucguauaaaaa

SEQ ID NO: 2249749 - RNA, 20 nt, Yersinia pestis
uaaauuacucguauaaaaaa

SEQ ID NO: 2249750 - RNA, 15 nt, Yersinia pestis
uaaauuaaauuuuaa

SEQ ID NO: 2249751 - RNA, 16 nt, Yersinia pestis
uaaauuaaauuuuaau

SEQ ID NO: 2249752 - RNA, 13 nt, Yersinia pestis
uaaauuaauaucu

SEQ ID NO: 2249753 - RNA, 15 nt, Yersinia pestis
uaaauuaauaucuuu

SEQ ID NO: 2249754 - RNA, 21 nt, Yersinia pestis
uaaauuaauaucuuuaaauua

SEQ ID NO: 2249755 - RNA, 20 nt, Yersinia pestis
uaaauguacagucauuuacu

SEQ ID NO: 2249756 - RNA, 13 nt, Yersinia pestis
uaaauuaauauuu

SEQ ID NO: 2249757 - RNA, 15 nt, Yersinia pestis
uaacaaaauggaaua

SEQ ID NO: 2249758 - RNA, 20 nt, Yersinia pestis
uaacaaaauggaauaagcca

SEQ ID NO: 2249759 - RNA, 20 nt, Yersinia pestis
uaacaauggccggacucauu

SEQ ID NO: 2249760 - RNA, 14 nt, Yersinia pestis
uaacaauuuaucag

SEQ ID NO: 2249761 - RNA, 12 nt, Yersinia pestis
uaacaauucucu

SEQ ID NO: 2249762 - RNA, 14 nt, Yersinia pestis
uaacaauucucucg

SEQ ID NO: 2249763 - RNA, 17 nt, Yersinia pestis
uaacaauuacuuuggca

SEQ ID NO: 2249764 - RNA, 18 nt, Yersinia pestis
uaacaauuaauuggcuca

SEQ ID NO: 2249765 - RNA, 21 nt, Yersinia pestis
uaacaaagccgcuuaauuuau

SEQ ID NO: 2249766 - RNA, 18 nt, Yersinia pestis
uaacacauuccaguaaaa

SEQ ID NO: 2249767 - RNA, 20 nt, Yersinia pestis
uaacacauuccaguaaaaaa

SEQ ID NO: 2249768 - RNA, 21 nt, Yersinia pestis
uaacacauuccaguaaaaaaa

SEQ ID NO: 2249769 - RNA, 22 nt, Yersinia pestis
uaacacauuccaguaaaaaaau

SEQ ID NO: 2249770 - RNA, 23 nt, Yersinia pestis
uaacacauuccaguaaaaaaaua

SEQ ID NO: 2249771 - RNA, 17 nt, Yersinia pestis
uaacaauuuuauuguuu

SEQ ID NO: 2249772 - RNA, 20 nt, Yersinia pestis
uaacaauuuuauuguuuucg

SEQ ID NO: 2249773 - RNA, 15 nt, Yersinia pestis
uaacaauuuuauugu

SEQ ID NO: 2249774 - RNA, 22 nt, Yersinia pestis
uaacaauuuuauuguuuucguu

SEQ ID NO: 2249775 - RNA, 23 nt, Yersinia pestis
uaaacgguaaccauccauauuug

SEQ ID NO: 2249776 - RNA, 18 nt, Yersinia pestis
uaaacgucucuuuuucau

SEQ ID NO: 2249777 - RNA, 19 nt, Yersinia pestis
uaaacuaauaucuuucaua

SEQ ID NO: 2249778 - RNA, 19 nt, Yersinia pestis
uaaacguggcccuuucgca

SEQ ID NO: 2249779 - RNA, 20 nt, Yersinia pestis
uaaaccuugaauaucaccau

SEQ ID NO: 2249780 - RNA, 17 nt, Yersinia pestis
uaaacgaccauuucucu

SEQ ID NO: 2249781 - RNA, 16 nt, Yersinia pestis
uaaaccuacagccauc

SEQ ID NO: 2249782 - RNA, 15 nt, Yersinia pestis
uaaaccagccaguga

SEQ ID NO: 2249783 - RNA, 16 nt, Yersinia pestis
uaaaccagccagugau

SEQ ID NO: 2249784 - RNA, 14 nt, Yersinia pestis
uaaaccagccagug

SEQ ID NO: 2249785 - RNA, 16 nt, Yersinia pestis
uaaaccguacauuaaa

SEQ ID NO: 2249786 - RNA, 13 nt, Yersinia pestis
uaaaaucuuaauc

SEQ ID NO: 2249787 - RNA, 23 nt, Yersinia pestis
uaaaaugagcacggacagcagca

SEQ ID NO: 2249788 - RNA, 14 nt, Yersinia pestis
uaaagcaucagacu

SEQ ID NO: 2249789 - RNA, 16 nt, Yersinia pestis
uaaagcauuuaucaua

SEQ ID NO: 2249790 - RNA, 15 nt, Yersinia pestis
uaaagccaucgccau

SEQ ID NO: 2249791 - RNA, 13 nt, Yersinia pestis
uaaagcccgcuua

SEQ ID NO: 2249792 - RNA, 14 nt, Yersinia pestis
uaaagcccgcuuca

SEQ ID NO: 2249793 - RNA, 13 nt, Yersinia pestis
uaaagccauuuca

SEQ ID NO: 2249794 - RNA, 15 nt, Yersinia pestis
uaaagccauuucagu

SEQ ID NO: 2249795 - RNA, 16 nt, Yersinia pestis
uaaagcgguaaauggc

SEQ ID NO: 2249796 - RNA, 15 nt, Yersinia pestis
uaaagcgccuuccuu

SEQ ID NO: 2249797 - RNA, 23 nt, Yersinia pestis
uaaagcguccgcgccaaggaagg

SEQ ID NO: 2249798 - RNA, 13 nt, Yersinia pestis
uaaagacuucagc

SEQ ID NO: 2249799 - RNA, 17 nt, Yersinia pestis
uaaagacgccguaaaua

SEQ ID NO: 2249800 - RNA, 21 nt, Yersinia pestis
uaaagacgccguaaauacauc

SEQ ID NO: 2249801 - RNA, 18 nt, Yersinia pestis
uaaagacgcuaauuaaag

SEQ ID NO: 2249802 - RNA, 17 nt, Yersinia pestis
uaaagacgucauaaaua

SEQ ID NO: 2249803 - RNA, 23 nt, Yersinia pestis
uaaagacgccguaaauacaucca

SEQ ID NO: 2249804 - RNA, 13 nt, Yersinia pestis
uaaagacccaaua

SEQ ID NO: 2249805 - RNA, 15 nt, Yersinia pestis
uaaagaauaaugggu

SEQ ID NO: 2249806 - RNA, 16 nt, Yersinia pestis
uaaauaaaauaauaau

SEQ ID NO: 2249807 - RNA, 20 nt, Yersinia pestis
uaaaggugaucgcucaggcg

SEQ ID NO: 2249808 - RNA, 14 nt, Yersinia pestis
uaaagguuugccag

SEQ ID NO: 2249809 - RNA, 20 nt, Yersinia pestis
uaaaguaaaagccagucagg

SEQ ID NO: 2249810 - RNA, 15 nt, Yersinia pestis
uaaaguugaaccaau

SEQ ID NO: 2249811 - RNA, 14 nt, Yersinia pestis
uaaauaaauuuaau

SEQ ID NO: 2249812 - RNA, 13 nt, Yersinia pestis
uaaauaauugggg

SEQ ID NO: 2249813 - RNA, 23 nt, Yersinia pestis
uaaauagagugaaguaucaccac

SEQ ID NO: 2249814 - RNA, 21 nt, Yersinia pestis
uaaauagagugaaguaucacc

SEQ ID NO: 2249815 - RNA, 19 nt, Yersinia pestis
uaaaugaccaacuguaaaa

SEQ ID NO: 2249816 - RNA, 21 nt, Yersinia pestis
uaaaugacuaucccuucaauc

SEQ ID NO: 2249817 - RNA, 14 nt, Yersinia pestis
uaaaugaacgugcc

SEQ ID NO: 2249818 - RNA, 21 nt, Yersinia pestis
uaaaugaagcaguucacugag

SEQ ID NO: 2249819 - RNA, 14 nt, Yersinia pestis
uaaaucuuucucca

SEQ ID NO: 2249820 - RNA, 13 nt, Yersinia pestis
uaaauuaaaaaga

SEQ ID NO: 2249821 - RNA, 14 nt, Yersinia pestis
uaaauuaaaacuga

SEQ ID NO: 2249822 - RNA, 16 nt, Yersinia pestis
uaaaugguuuauuuaa

SEQ ID NO: 2249823 - RNA, 16 nt, Yersinia pestis
uaaauggucaguuuaa

SEQ ID NO: 2249824 - RNA, 19 nt, Yersinia pestis
uaaaugcucucgagaaaua

SEQ ID NO: 2249825 - RNA, 18 nt, Yersinia pestis
uaaauggcgaaaggaaca

SEQ ID NO: 2249826 - RNA, 21 nt, Yersinia pestis
uaaauggcgaaaggaacaaaa

SEQ ID NO: 2249827 - RNA, 17 nt, Yersinia pestis
uaaauggcuaaacucug

SEQ ID NO: 2249828 - RNA, 13 nt, Yersinia pestis
uaaauggcuagau

SEQ ID NO: 2249829 - RNA, 21 nt, Yersinia pestis
uaaauaugcugaccacugcuu

SEQ ID NO: 2249830 - RNA, 18 nt, Yersinia pestis
uaaauauggcggcaucag

SEQ ID NO: 2249831 - RNA, 18 nt, Yersinia pestis
uaaaucuuguuuaaucac

SEQ ID NO: 2249832 - RNA, 15 nt, Yersinia pestis
uaaaucuuauuuaau

SEQ ID NO: 2249833 - RNA, 22 nt, Yersinia pestis
uaaaucucuuaccccuuucaau

SEQ ID NO: 2249834 - RNA, 18 nt, Yersinia pestis
gucugaauaccgcuggcg

SEQ ID NO: 2249835 - RNA, 14 nt, Yersinia pestis
gucugaauauaaau

SEQ ID NO: 2249836 - RNA, 23 nt, Yersinia pestis
gucugaauauaaauuuaauaaaa

SEQ ID NO: 2249837 - RNA, 16 nt, Yersinia pestis
gucugcaauagcucau

SEQ ID NO: 2249838 - RNA, 21 nt, Yersinia pestis
gucugauaaccguuuuuucaa

SEQ ID NO: 2249839 - RNA, 16 nt, Yersinia pestis
gucugccagaauuuug

SEQ ID NO: 2249840 - RNA, 21 nt, Yersinia pestis
gucugccagaauuuugcagcg

SEQ ID NO: 2249841 - RNA, 15 nt, Yersinia pestis
gucugccauugcuca

SEQ ID NO: 2249842 - RNA, 21 nt, Yersinia pestis
gucugcccacucaccuaaauc

SEQ ID NO: 2249843 - RNA, 18 nt, Yersinia pestis
gucucuuucgggcaaaaa

SEQ ID NO: 2249844 - RNA, 21 nt, Yersinia pestis
gucucuuucgggcaaaaaaau

SEQ ID NO: 2249845 - RNA, 13 nt, Yersinia pestis
gucucuauuggcu

SEQ ID NO: 2249846 - RNA, 15 nt, Yersinia pestis
gucuggcaauccagc

SEQ ID NO: 2249847 - RNA, 18 nt, Yersinia pestis
gucuggcaauccagcgcc

SEQ ID NO: 2249848 - RNA, 21 nt, Yersinia pestis
gucugguggugaacggccauc

SEQ ID NO: 2249849 - RNA, 19 nt, Yersinia pestis
gucuuaucauaauccaacu

SEQ ID NO: 2249850 - RNA, 20 nt, Yersinia pestis
gucuguuugucacggcggcc

SEQ ID NO: 2249851 - RNA, 21 nt, Yersinia pestis
gucuguuugucacggcggccg

SEQ ID NO: 2249852 - RNA, 15 nt, Yersinia pestis
gucuguuucauucug

SEQ ID NO: 2249853 - RNA, 15 nt, Yersinia pestis
gucuucagcuuccgc

SEQ ID NO: 2249854 - RNA, 14 nt, Yersinia pestis
gucuucaacuuuac

SEQ ID NO: 2249855 - RNA, 15 nt, Yersinia pestis
gucuuauuacucauu

SEQ ID NO: 2249856 - RNA, 13 nt, Yersinia pestis
gucuucaucaucc

SEQ ID NO: 2249857 - RNA, 16 nt, Yersinia pestis
gugaauaccauuucac

SEQ ID NO: 2249858 - RNA, 19 nt, Yersinia pestis
gugaauaacugguccaacu

SEQ ID NO: 2249859 - RNA, 14 nt, Yersinia pestis
gugaauaaaaauaa

SEQ ID NO: 2249860 - RNA, 14 nt, Yersinia pestis
gugaauaaaucaaa

SEQ ID NO: 2249861 - RNA, 12 nt, Yersinia pestis
gugaaguuuaua

SEQ ID NO: 2249862 - RNA, 14 nt, Yersinia pestis
gugaaucagccaga

SEQ ID NO: 2249863 - RNA, 17 nt, Yersinia pestis
gugaaagggaaguuucu

SEQ ID NO: 2249864 - RNA, 20 nt, Yersinia pestis
gugaacaggccccaaaauag

SEQ ID NO: 2249865 - RNA, 21 nt, Yersinia pestis
gugaagcaauuugaucaccaa

SEQ ID NO: 2249866 - RNA, 19 nt, Yersinia pestis
gugaacggccaucaauaaa

SEQ ID NO: 2249867 - RNA, 13 nt, Yersinia pestis
gugaacauuuauc

SEQ ID NO: 2249868 - RNA, 21 nt, Yersinia pestis
gugaaccgcgcucugcuggga

SEQ ID NO: 2249869 - RNA, 18 nt, Yersinia pestis
gucuuuaauaaaaucaaa

SEQ ID NO: 2249870 - RNA, 16 nt, Yersinia pestis
gucuuucgggcugaug

SEQ ID NO: 2249871 - RNA, 17 nt, Yersinia pestis
gucuuuaccuccauaua

SEQ ID NO: 2249872 - RNA, 19 nt, Yersinia pestis
gucuuuacgaucugccugu

SEQ ID NO: 2249873 - RNA, 23 nt, Yersinia pestis
gucuuuucaaccaacacuccucu

SEQ ID NO: 2249874 - RNA, 23 nt, Yersinia pestis
gucuuuuugggugacaacgucac

SEQ ID NO: 2249875 - RNA, 15 nt, Yersinia pestis
gugaaacauaauuaa

SEQ ID NO: 2249876 - RNA, 21 nt, Yersinia pestis
gucuugacgguucgaaaauaa

SEQ ID NO: 2249877 - RNA, 21 nt, Yersinia pestis
gucuuggucauaccggcggca

SEQ ID NO: 2249878 - RNA, 20 nt, Yersinia pestis
gugacgcagugacgcaguga

SEQ ID NO: 2249879 - RNA, 21 nt, Yersinia pestis
gugacggcuuuauaguccuuc

SEQ ID NO: 2249880 - RNA, 12 nt, Yersinia pestis
gugacgcugggc

SEQ ID NO: 2249881 - RNA, 18 nt, Yersinia pestis
gugacucaucaaaacaau

SEQ ID NO: 2249882 - RNA, 13 nt, Yersinia pestis
gugacugccggga

SEQ ID NO: 2249883 - RNA, 12 nt, Yersinia pestis
gugacaggcugc

SEQ ID NO: 2249884 - RNA, 15 nt, Yersinia pestis
gugacaggcaaagac

SEQ ID NO: 2249885 - RNA, 18 nt, Yersinia pestis
gugaccaaagcaguaaac

SEQ ID NO: 2249886 - RNA, 17 nt, Yersinia pestis
gugacauguuccagugc

SEQ ID NO: 2249887 - RNA, 18 nt, Yersinia pestis
gugagucagguggcuauu

SEQ ID NO: 2249888 - RNA, 21 nt, Yersinia pestis
gugaguaauucgcagacagau

SEQ ID NO: 2249889 - RNA, 15 nt, Yersinia pestis
gugagguggccgaga

SEQ ID NO: 2249890 - RNA, 18 nt, Yersinia pestis
gugagguuuuugauggug

SEQ ID NO: 2249891 - RNA, 23 nt, Yersinia pestis
gugaguaaacaccuucagacuga

SEQ ID NO: 2249892 - RNA, 13 nt, Yersinia pestis
gugagugagcgca

SEQ ID NO: 2249893 - RNA, 11 nt, Yersinia pestis
gugagugacau

SEQ ID NO: 2249894 - RNA, 14 nt, Yersinia pestis
gugaguggcuggga

SEQ ID NO: 2249895 - RNA, 15 nt, Yersinia pestis
gugagugagcgcagg

SEQ ID NO: 2249896 - RNA, 20 nt, Yersinia pestis
gugaggcucauuaaucccca

SEQ ID NO: 2249897 - RNA, 15 nt, Yersinia pestis
gugagggcaauuaaa

SEQ ID NO: 2249898 - RNA, 21 nt, Yersinia pestis
gugaguuacgugagcaucugg

SEQ ID NO: 2249899 - RNA, 16 nt, Yersinia pestis
gugaguuccagcccca

SEQ ID NO: 2249900 - RNA, 17 nt, Yersinia pestis
gugauaaacuuaucggu

SEQ ID NO: 2249901 - RNA, 16 nt, Yersinia pestis
gugauaaguuuuaaua

SEQ ID NO: 2249902 - RNA, 13 nt, Yersinia pestis
gugauagcgggcc

SEQ ID NO: 2249903 - RNA, 15 nt, Yersinia pestis
gugaucgcucaggcg

SEQ ID NO: 2249904 - RNA, 21 nt, Yersinia pestis
gugauccacuuauaucuccac

SEQ ID NO: 2249905 - RNA, 15 nt, Yersinia pestis
gugaucaucuuuuuu

SEQ ID NO: 2249906 - RNA, 19 nt, Yersinia pestis
gugaucaguccuuagcaug

SEQ ID NO: 2249907 - RNA, 12 nt, Yersinia pestis
gugaucaucgca

SEQ ID NO: 2249908 - RNA, 12 nt, Yersinia pestis
gugauuuuuaua

SEQ ID NO: 2249909 - RNA, 16 nt, Yersinia pestis
gugauuuuaaccacuc

SEQ ID NO: 2249910 - RNA, 23 nt, Yersinia pestis
gugauuuuuuucacccauguauc

SEQ ID NO: 2249911 - RNA, 14 nt, Yersinia pestis
gugcacggcaguga

SEQ ID NO: 2249912 - RNA, 20 nt, Yersinia pestis
gugcaguaauggaaauagcu

SEQ ID NO: 2249913 - RNA, 14 nt, Yersinia pestis
gugcauguagcugc

SEQ ID NO: 2249914 - RNA, 18 nt, Yersinia pestis
gugcccaacggcaaucac

SEQ ID NO: 2249915 - RNA, 14 nt, Yersinia pestis
gugccauggucagu

SEQ ID NO: 2249916 - RNA, 23 nt, Yersinia pestis
gugcccaccguucuuauugaagg

SEQ ID NO: 2249917 - RNA, 18 nt, Yersinia pestis
gugccugaauggaaaaau

SEQ ID NO: 2249918 - RNA, 12 nt, Yersinia pestis
gugccugacuga

SEQ ID NO: 2249919 - RNA, 14 nt, Yersinia pestis
gugccuaauaaaua

SEQ ID NO: 2249920 - RNA, 18 nt, Yersinia pestis
guuccaguucgacauaaa

SEQ ID NO: 2249921 - RNA, 17 nt, Yersinia pestis
guuccaggcaagaaacu

SEQ ID NO: 2249922 - RNA, 17 nt, Yersinia pestis
guucacccgcacgccca

SEQ ID NO: 2249923 - RNA, 15 nt, Yersinia pestis
guucaccccucaccc

SEQ ID NO: 2249924 - RNA, 18 nt, Yersinia pestis
guucacaugaugaaugcg

SEQ ID NO: 2249925 - RNA, 18 nt, Yersinia pestis
guucaucauuuuuuaucu

SEQ ID NO: 2249926 - RNA, 22 nt, Yersinia pestis
guuccacuguaucuuugcuauc

SEQ ID NO: 2249927 - RNA, 19 nt, Yersinia pestis
guucucuggguaagaacag

SEQ ID NO: 2249928 - RNA, 16 nt, Yersinia pestis
guucucuccuaaaauc

SEQ ID NO: 2249929 - RNA, 22 nt, Yersinia pestis
guucugauuccauguucucucc

SEQ ID NO: 2249930 - RNA, 23 nt, Yersinia pestis
guucugccaauuuggggcugcuu

SEQ ID NO: 2249931 - RNA, 21 nt, Yersinia pestis
guucuaucucaucuuaaucac

SEQ ID NO: 2249932 - RNA, 23 nt, Yersinia pestis
guucucacuuggguagcagccca

SEQ ID NO: 2249933 - RNA, 19 nt, Yersinia pestis
guucguauguuuuuaacaa

SEQ ID NO: 2249934 - RNA, 18 nt, Yersinia pestis
guuccuguugcuggccag

SEQ ID NO: 2249935 - RNA, 18 nt, Yersinia pestis
guucaaucggcagugcca

SEQ ID NO: 2249936 - RNA, 13 nt, Yersinia pestis
guucaagagugag

SEQ ID NO: 2249937 - RNA, 19 nt, Yersinia pestis
guucaagauaaaguucuuc

SEQ ID NO: 2249938 - RNA, 12 nt, Yersinia pestis
guuauuuuaauu

SEQ ID NO: 2249939 - RNA, 22 nt, Yersinia pestis
guuauuuaucauaaauaaaaga

SEQ ID NO: 2249940 - RNA, 13 nt, Yersinia pestis
guuauuugcuauc

SEQ ID NO: 2249941 - RNA, 14 nt, Yersinia pestis
guucaaaugauuca

SEQ ID NO: 2249942 - RNA, 13 nt, Yersinia pestis
guucaaaaaauag

SEQ ID NO: 2249943 - RNA, 13 nt, Yersinia pestis
guucaaaaggugc

SEQ ID NO: 2249944 - RNA, 20 nt, Yersinia pestis
guuauuacugucauugcugu

SEQ ID NO: 2249945 - RNA, 12 nt, Yersinia pestis
guuauuaucaug

SEQ ID NO: 2249946 - RNA, 14 nt, Yersinia pestis
guuauuaucaugaa

SEQ ID NO: 2249947 - RNA, 14 nt, Yersinia pestis
guuauuauuaaauu

SEQ ID NO: 2249948 - RNA, 22 nt, Yersinia pestis
guuauugaccaccuuauuggcc

SEQ ID NO: 2249949 - RNA, 17 nt, Yersinia pestis
guuauucuuuauuuauu

SEQ ID NO: 2249950 - RNA, 21 nt, Yersinia pestis
guuauugaauauuuaaauuac

SEQ ID NO: 2249951 - RNA, 14 nt, Yersinia pestis
guuauuggcuaaag

SEQ ID NO: 2249952 - RNA, 20 nt, Yersinia pestis
guuaugaugaguaacauaau

SEQ ID NO: 2249953 - RNA, 18 nt, Yersinia pestis
guuaugaggggaggcugu

SEQ ID NO: 2249954 - RNA, 15 nt, Yersinia pestis
guuaugaauaaacca

SEQ ID NO: 2249955 - RNA, 11 nt, Yersinia pestis
guuaugacacc

SEQ ID NO: 2249956 - RNA, 17 nt, Yersinia pestis
guuaucuuuuauuuaug

SEQ ID NO: 2249957 - RNA, 16 nt, Yersinia pestis
guuaucuauuguaucu

SEQ ID NO: 2249958 - RNA, 15 nt, Yersinia pestis
guuaucuggaauuua

SEQ ID NO: 2249959 - RNA, 18 nt, Yersinia pestis
guuaucuguaaucaccag

SEQ ID NO: 2249960 - RNA, 12 nt, Yersinia pestis
guuagugaguua

SEQ ID NO: 2249961 - RNA, 15 nt, Yersinia pestis
guuagguaauaccaa

SEQ ID NO: 2249962 - RNA, 17 nt, Yersinia pestis
guuagcauuaaacggug

SEQ ID NO: 2249963 - RNA, 19 nt, Yersinia pestis
guuaccagacccugcacca

SEQ ID NO: 2249964 - RNA, 17 nt, Yersinia pestis
guuaaugggcguauuug

SEQ ID NO: 2249965 - RNA, 14 nt, Yersinia pestis
guuaccaaaaagca

SEQ ID NO: 2249966 - RNA, 20 nt, Yersinia pestis
guuauagaucuccugcaacg

SEQ ID NO: 2249967 - RNA, 23 nt, Yersinia pestis
guuauaacuauauucucauugcc

SEQ ID NO: 2249968 - RNA, 20 nt, Yersinia pestis
guuaucggccauauuaccgc

SEQ ID NO: 2249969 - RNA, 20 nt, Yersinia pestis
guuaucaucccuugacugac

SEQ ID NO: 2249970 - RNA, 15 nt, Yersinia pestis
guuaucacaucaucc

SEQ ID NO: 2249971 - RNA, 22 nt, Yersinia pestis
guuaucaaauacgaccgucacc

SEQ ID NO: 2249972 - RNA, 23 nt, Yersinia pestis
guuaucaagaucaaaagcagaga

SEQ ID NO: 2249973 - RNA, 18 nt, Yersinia pestis
gugucucuggagcuucug

SEQ ID NO: 2249974 - RNA, 15 nt, Yersinia pestis
gugucucgcccacag

SEQ ID NO: 2249975 - RNA, 17 nt, Yersinia pestis
gugugcuguaagaaaaa

SEQ ID NO: 2249976 - RNA, 23 nt, Yersinia pestis
gugucaccgagagauucaugggc

SEQ ID NO: 2249977 - RNA, 15 nt, Yersinia pestis
gugucagaccaaaua

SEQ ID NO: 2249978 - RNA, 21 nt, Yersinia pestis
gugucagggcaauaacaaaca

SEQ ID NO: 2249979 - RNA, 19 nt, Yersinia pestis
gugucccaaacucuggaug

SEQ ID NO: 2249980 - RNA, 21 nt, Yersinia pestis
gugucccaaacucuggauggg

SEQ ID NO: 2249981 - RNA, 16 nt, Yersinia pestis
guguagauagccuugc

SEQ ID NO: 2249982 - RNA, 21 nt, Yersinia pestis
guguucauaaauuaaaacuga

SEQ ID NO: 2249983 - RNA, 18 nt, Yersinia pestis
guuaaauucacuuucccc

SEQ ID NO: 2249984 - RNA, 11 nt, Yersinia pestis
guuaaaugaag

SEQ ID NO: 2249985 - RNA, 16 nt, Yersinia pestis
guuaaugccaccccca

SEQ ID NO: 2249986 - RNA, 15 nt, Yersinia pestis
guuaaugacauaucu

SEQ ID NO: 2249987 - RNA, 20 nt, Yersinia pestis
guuaauguguuuuugucauu

SEQ ID NO: 2249988 - RNA, 14 nt, Yersinia pestis
guuaauauuuaucu

SEQ ID NO: 2249989 - RNA, 15 nt, Yersinia pestis
guuaaucaagccauc

SEQ ID NO: 2249990 - RNA, 16 nt, Yersinia pestis
guuaaucaagcgccau

SEQ ID NO: 2249991 - RNA, 19 nt, Yersinia pestis
guuaagagaucccgugcca

SEQ ID NO: 2249992 - RNA, 13 nt, Yersinia pestis
guuaagacaauua

SEQ ID NO: 2249993 - RNA, 20 nt, Yersinia pestis
guuaacugcaguaaaaauau

SEQ ID NO: 2249994 - RNA, 18 nt, Yersinia pestis
guuaacugcaguaaaaau

SEQ ID NO: 2249995 - RNA, 16 nt, Yersinia pestis
guuaacucauuuaucu

SEQ ID NO: 2249996 - RNA, 20 nt, Yersinia pestis
guuaacaccaucaacauggg

SEQ ID NO: 2249997 - RNA, 11 nt, Yersinia pestis
guuaacccaaa

SEQ ID NO: 2249998 - RNA, 12 nt, Yersinia pestis
gugggauagaga

SEQ ID NO: 2249999 - RNA, 20 nt, Yersinia pestis
gugggccuguuugcagcgaa

SEQ ID NO: 2250000 - RNA, 14 nt, Yersinia pestis
guggucauuuuguu

SEQ ID NO: 2250001 - RNA, 14 nt, Yersinia pestis
gugguccccagagc

SEQ ID NO: 2250002 - RNA, 20 nt, Yersinia pestis
guggucaugcucacaaucau

SEQ ID NO: 2250003 - RNA, 13 nt, Yersinia pestis
gugggcuauaggg

SEQ ID NO: 2250004 - RNA, 16 nt, Yersinia pestis
guggccgccgcgguga

SEQ ID NO: 2250005 - RNA, 14 nt, Yersinia pestis
guggcgggaacacg

SEQ ID NO: 2250006 - RNA, 15 nt, Yersinia pestis
guggauaaacaaaua

SEQ ID NO: 2250007 - RNA, 19 nt, Yersinia pestis
guggauaauuucagcagca

SEQ ID NO: 2250008 - RNA, 13 nt, Yersinia pestis
guggauaaacaaa

SEQ ID NO: 2250009 - RNA, 16 nt, Yersinia pestis
guggcaguacaaauug

SEQ ID NO: 2250010 - RNA, 16 nt, Yersinia pestis
guggcagauuggcuug

SEQ ID NO: 2250011 - RNA, 15 nt, Yersinia pestis
guggcacgcugcaug

SEQ ID NO: 2250012 - RNA, 22 nt, Yersinia pestis
guggagagaaaggcuuugccug

SEQ ID NO: 2250013 - RNA, 17 nt, Yersinia pestis
guggaguaguucuuggg

SEQ ID NO: 2250014 - RNA, 14 nt, Yersinia pestis
guggaacaacaggc

SEQ ID NO: 2250015 - RNA, 19 nt, Yersinia pestis
gugcuuuauccaauggcuc

SEQ ID NO: 2250016 - RNA, 12 nt, Yersinia pestis
gugcuuugccau

SEQ ID NO: 2250017 - RNA, 13 nt, Yersinia pestis
gugcgccaaccgc

SEQ ID NO: 2250018 - RNA, 14 nt, Yersinia pestis
gugcgcaucaauga

SEQ ID NO: 2250019 - RNA, 14 nt, Yersinia pestis
guagcccuuugcuu

SEQ ID NO: 2250020 - RNA, 21 nt, Yersinia pestis
guagcauggcuuuaugaccaa

SEQ ID NO: 2250021 - RNA, 17 nt, Yersinia pestis
guagccaauagacaaaa

SEQ ID NO: 2250022 - RNA, 17 nt, Yersinia pestis
guagauuuaaccccaau

SEQ ID NO: 2250023 - RNA, 18 nt, Yersinia pestis
guagauggccaucucaau

SEQ ID NO: 2250024 - RNA, 20 nt, Yersinia pestis
guagauuuucucaggcacau

SEQ ID NO: 2250025 - RNA, 14 nt, Yersinia pestis
guagcacuccagau

SEQ ID NO: 2250026 - RNA, 18 nt, Yersinia pestis
guaccaccaccaacagca

SEQ ID NO: 2250027 - RNA, 15 nt, Yersinia pestis
guacaucguagucua

SEQ ID NO: 2250028 - RNA, 15 nt, Yersinia pestis
guacauaucgagcug

SEQ ID NO: 2250029 - RNA, 15 nt, Yersinia pestis
guacauauaucacua

SEQ ID NO: 2250030 - RNA, 16 nt, Yersinia pestis
guaccugcaucaucac

SEQ ID NO: 2250031 - RNA, 18 nt, Yersinia pestis
guaccugaucagcauuuc

SEQ ID NO: 2250032 - RNA, 17 nt, Yersinia pestis
guaccugcacugagcca

SEQ ID NO: 2250033 - RNA, 20 nt, Yersinia pestis
guaccuguaagguugaccug

SEQ ID NO: 2250034 - RNA, 20 nt, Yersinia pestis
guaccuugacgccgaugaau

SEQ ID NO: 2250035 - RNA, 24 nt, Yersinia pestis
guacugaucauuauuauccuccca

SEQ ID NO: 2250036 - RNA, 16 nt, Yersinia pestis
guacugcugcaacuca

SEQ ID NO: 2250037 - RNA, 17 nt, Yersinia pestis
guacgccgaacuucauc

SEQ ID NO: 2250038 - RNA, 11 nt, Yersinia pestis
guaaucaccag

SEQ ID NO: 2250039 - RNA, 17 nt, Yersinia pestis
guaauaccggcaccaau

SEQ ID NO: 2250040 - RNA, 20 nt, Yersinia pestis
guaauacccucgacaccaaa

SEQ ID NO: 2250041 - RNA, 20 nt, Yersinia pestis
guaaaagaauaaaugucacu

SEQ ID NO: 2250042 - RNA, 16 nt, Yersinia pestis
guaauaaguagaaaaa

SEQ ID NO: 2250043 - RNA, 15 nt, Yersinia pestis
guaauaaggucacug

SEQ ID NO: 2250044 - RNA, 17 nt, Yersinia pestis
guaauaaggucacuguu

SEQ ID NO: 2250045 - RNA, 22 nt, Yersinia pestis
guaaaagcagccgugcuugauu

SEQ ID NO: 2250046 - RNA, 17 nt, Yersinia pestis
guaaaagauagauaacu

SEQ ID NO: 2250047 - RNA, 14 nt, Yersinia pestis
guaauucgcagaca

SEQ ID NO: 2250048 - RNA, 18 nt, Yersinia pestis
guaauucagauaagaucu

SEQ ID NO: 2250049 - RNA, 18 nt, Yersinia pestis
guaauuacgcaauaccga

SEQ ID NO: 2250050 - RNA, 20 nt, Yersinia pestis
guaaugacgcccgcagcggc

SEQ ID NO: 2250051 - RNA, 21 nt, Yersinia pestis
guaaugagccgcauugauccu

SEQ ID NO: 2250052 - RNA, 17 nt, Yersinia pestis
guaaugaccuacacacu

SEQ ID NO: 2250053 - RNA, 11 nt, Yersinia pestis
guaaugaaauc

SEQ ID NO: 2250054 - RNA, 20 nt, Yersinia pestis
guaauuaauauauaaaauaa

SEQ ID NO: 2250055 - RNA, 20 nt, Yersinia pestis
guaauuaauuaguaauaaga

SEQ ID NO: 2250056 - RNA, 13 nt, Yersinia pestis
guaaugcgcacca

SEQ ID NO: 2250057 - RNA, 19 nt, Yersinia pestis
guaaugauuugcggcauga

SEQ ID NO: 2250058 - RNA, 16 nt, Yersinia pestis
guaauuuacugacggu

SEQ ID NO: 2250059 - RNA, 20 nt, Yersinia pestis
guaauuucagauaaaaauaa

SEQ ID NO: 2250060 - RNA, 23 nt, Yersinia pestis
guacaaaaauaaacgggcuucca

SEQ ID NO: 2250061 - RNA, 14 nt, Yersinia pestis
guacaaauugugga

SEQ ID NO: 2250062 - RNA, 18 nt, Yersinia pestis
guacaaucucugggugcu

SEQ ID NO: 2250063 - RNA, 18 nt, Yersinia pestis
guauacuggcuagccugc

SEQ ID NO: 2250064 - RNA, 13 nt, Yersinia pestis
guauagcggcggg

SEQ ID NO: 2250065 - RNA, 20 nt, Yersinia pestis
guaucaacucugaugaaauc

SEQ ID NO: 2250066 - RNA, 19 nt, Yersinia pestis
guaggaaaauagcggaaga

SEQ ID NO: 2250067 - RNA, 16 nt, Yersinia pestis
guauacgugucacauu

SEQ ID NO: 2250068 - RNA, 23 nt, Yersinia pestis
guauacuaaaacagcucacucgg

SEQ ID NO: 2250069 - RNA, 17 nt, Yersinia pestis
guauacggucaaaagcu

SEQ ID NO: 2250070 - RNA, 13 nt, Yersinia pestis
guagcuuaucccc

SEQ ID NO: 2250071 - RNA, 23 nt, Yersinia pestis
guaucagccccuaaauccugcaa

SEQ ID NO: 2250072 - RNA, 13 nt, Yersinia pestis
guauccagcagcg

SEQ ID NO: 2250073 - RNA, 16 nt, Yersinia pestis
guauccagcagcgcug

SEQ ID NO: 2250074 - RNA, 19 nt, Yersinia pestis
guauccagugucaugcgca

SEQ ID NO: 2250075 - RNA, 20 nt, Yersinia pestis
guaucauuuuccugcauauu

SEQ ID NO: 2250076 - RNA, 14 nt, Yersinia pestis
guaucauggaagac

SEQ ID NO: 2250077 - RNA, 19 nt, Yersinia pestis
guauccguuaucgcgccuu

SEQ ID NO: 2250078 - RNA, 19 nt, Yersinia pestis
guauuaagacaaggaaaag

SEQ ID NO: 2250079 - RNA, 16 nt, Yersinia pestis
guauuaccaaucagcg

SEQ ID NO: 2250080 - RNA, 15 nt, Yersinia pestis
guaugcuuucaucuu

SEQ ID NO: 2250081 - RNA, 19 nt, Yersinia pestis
guaucggccaauucagcaa

SEQ ID NO: 2250082 - RNA, 16 nt, Yersinia pestis
guaucguccagcagca

SEQ ID NO: 2250083 - RNA, 14 nt, Yersinia pestis
guauccuuagccaa

SEQ ID NO: 2250084 - RNA, 19 nt, Yersinia pestis
guaucgcaguuaaagacau

SEQ ID NO: 2250085 - RNA, 21 nt, Yersinia pestis
guaucgcccuggcuaauuuua

SEQ ID NO: 2250086 - RNA, 21 nt, Yersinia pestis
guaucuguuuuuuaucccuac

SEQ ID NO: 2250087 - RNA, 11 nt, Yersinia pestis
guaugauccuu

SEQ ID NO: 2250088 - RNA, 19 nt, Yersinia pestis
guaugagcgcagaguccuc

SEQ ID NO: 2250089 - RNA, 15 nt, Yersinia pestis
gucaauauaacguuu

SEQ ID NO: 2250090 - RNA, 21 nt, Yersinia pestis
gucaauauaccuuuguaucca

SEQ ID NO: 2250091 - RNA, 14 nt, Yersinia pestis
gucaauaccuuacu

SEQ ID NO: 2250092 - RNA, 22 nt, Yersinia pestis
gucaaucacuggcaauaauuca

SEQ ID NO: 2250093 - RNA, 16 nt, Yersinia pestis
gucaaucauuuuuuua

SEQ ID NO: 2250094 - RNA, 14 nt, Yersinia pestis
gucacaauagucuc

SEQ ID NO: 2250095 - RNA, 10 nt, Yersinia pestis
gucacagcau

SEQ ID NO: 2250096 - RNA, 16 nt, Yersinia pestis
gucaaauuuaaaguuu

SEQ ID NO: 2250097 - RNA, 17 nt, Yersinia pestis
gucaauaaccucagccu

SEQ ID NO: 2250098 - RNA, 20 nt, Yersinia pestis
gucaauaaaacagagcgcga

SEQ ID NO: 2250099 - RNA, 21 nt, Yersinia pestis
gucacccaaccgaccaaaggc

SEQ ID NO: 2250100 - RNA, 12 nt, Yersinia pestis
gucaccaucuug

SEQ ID NO: 2250101 - RNA, 13 nt, Yersinia pestis
gucaccuaccacc

SEQ ID NO: 2250102 - RNA, 14 nt, Yersinia pestis
gucaccuaccaccu

SEQ ID NO: 2250103 - RNA, 16 nt, Yersinia pestis
gucaccugaaccugac

SEQ ID NO: 2250104 - RNA, 16 nt, Yersinia pestis
gucaccugucaccugu

SEQ ID NO: 2250105 - RNA, 18 nt, Yersinia pestis
gucaccugucaccuguca

SEQ ID NO: 2250106 - RNA, 21 nt, Yersinia pestis
gucaccugucaccugucaccu

SEQ ID NO: 2250107 - RNA, 15 nt, Yersinia pestis
gucacaggggcaauu

SEQ ID NO: 2250108 - RNA, 23 nt, Yersinia pestis
gucaccaaaaucccaaaauauga

SEQ ID NO: 2250109 - RNA, 13 nt, Yersinia pestis
gucacauuuuuaa

SEQ ID NO: 2250110 - RNA, 22 nt, Yersinia pestis
gucaccaaaaucccaaaauaug

SEQ ID NO: 2250111 - RNA, 18 nt, Yersinia pestis
guauucuuaucaaucaaa

SEQ ID NO: 2250112 - RNA, 18 nt, Yersinia pestis
guauucgacauggauggu

SEQ ID NO: 2250113 - RNA, 22 nt, Yersinia pestis
guauugacacaauagaugcagu

SEQ ID NO: 2250114 - RNA, 15 nt, Yersinia pestis
guauugaugcaguga

SEQ ID NO: 2250115 - RNA, 16 nt, Yersinia pestis
guauuaguuucaaaua

SEQ ID NO: 2250116 - RNA, 19 nt, Yersinia pestis
guauucauaucgcuaaaac

SEQ ID NO: 2250117 - RNA, 11 nt, Yersinia pestis
guauuuccugu

SEQ ID NO: 2250118 - RNA, 13 nt, Yersinia pestis
guauuuccuguau

SEQ ID NO: 2250119 - RNA, 19 nt, Yersinia pestis
guauuuccuguauuuccug

SEQ ID NO: 2250120 - RNA, 20 nt, Yersinia pestis
guauuuguagugaaugacag

SEQ ID NO: 2250121 - RNA, 13 nt, Yersinia pestis
guauuuguauuua

SEQ ID NO: 2250122 - RNA, 16 nt, Yersinia pestis
guauuuugucaugaaa

SEQ ID NO: 2250123 - RNA, 13 nt, Yersinia pestis
guauuuauuccac

SEQ ID NO: 2250124 - RNA, 19 nt, Yersinia pestis
guauugguaacgcagaaau

SEQ ID NO: 2250125 - RNA, 22 nt, Yersinia pestis
guauugguaacgcagaaauauu

SEQ ID NO: 2250126 - RNA, 21 nt, Yersinia pestis
guauugcuguucgccagauua

SEQ ID NO: 2250127 - RNA, 17 nt, Yersinia pestis
guauuggaaaaaucagu

SEQ ID NO: 2250128 - RNA, 17 nt, Yersinia pestis
guccaacucccaaauau

SEQ ID NO: 2250129 - RNA, 20 nt, Yersinia pestis
gucaucgccuucuggcaaac

SEQ ID NO: 2250130 - RNA, 20 nt, Yersinia pestis
gucaucgcggcgcacaucau

SEQ ID NO: 2250131 - RNA, 13 nt, Yersinia pestis
gucaugcggccuu

SEQ ID NO: 2250132 - RNA, 17 nt, Yersinia pestis
gucaugcggccuuccaa

SEQ ID NO: 2250133 - RNA, 17 nt, Yersinia pestis
gucauggagagcagggc

SEQ ID NO: 2250134 - RNA, 16 nt, Yersinia pestis
gucaugguacaacugc

SEQ ID NO: 2250135 - RNA, 22 nt, Yersinia pestis
gucaugucgcuguagcgccagg

SEQ ID NO: 2250136 - RNA, 22 nt, Yersinia pestis
gucauaucgaucaaccauucau

SEQ ID NO: 2250137 - RNA, 21 nt, Yersinia pestis
gucaucacuaacgacagauua

SEQ ID NO: 2250138 - RNA, 17 nt, Yersinia pestis
gucauccuucaaguugu

SEQ ID NO: 2250139 - RNA, 14 nt, Yersinia pestis
guccagcccaccau

SEQ ID NO: 2250140 - RNA, 12 nt, Yersinia pestis
guccagaugcca

SEQ ID NO: 2250141 - RNA, 22 nt, Yersinia pestis
guccagaacaauaccgccaaua

SEQ ID NO: 2250142 - RNA, 20 nt, Yersinia pestis
guccaugggccucaucugcg

SEQ ID NO: 2250143 - RNA, 21 nt, Yersinia pestis
guccaguuuuucccguaacuu

SEQ ID NO: 2250144 - RNA, 15 nt, Yersinia pestis
guccuuuaacucaau

SEQ ID NO: 2250145 - RNA, 20 nt, Yersinia pestis
gucgaaggguaucagcgacc

SEQ ID NO: 2250146 - RNA, 16 nt, Yersinia pestis
gucgaccgcucuucac

SEQ ID NO: 2250147 - RNA, 16 nt, Yersinia pestis
gucgacaaaaugugaa

SEQ ID NO: 2250148 - RNA, 14 nt, Yersinia pestis
gucccugauggggc

SEQ ID NO: 2250149 - RNA, 11 nt, Yersinia pestis
gucuaaacgcc

SEQ ID NO: 2250150 - RNA, 14 nt, Yersinia pestis
gucuaacaacuggu

SEQ ID NO: 2250151 - RNA, 18 nt, Yersinia pestis
gucuaagugccaguuaau

SEQ ID NO: 2250152 - RNA, 20 nt, Yersinia pestis
gucguggaguagagcuucca

SEQ ID NO: 2250153 - RNA, 22 nt, Yersinia pestis
gucgguaaccugaaagucagga

SEQ ID NO: 2250154 - RNA, 14 nt, Yersinia pestis
gucgguaagcuggc

SEQ ID NO: 2250155 - RNA, 13 nt, Yersinia pestis
gucgcucaagccu

SEQ ID NO: 2250156 - RNA, 19 nt, Yersinia pestis
gucggcauuaaaagcaugc

SEQ ID NO: 2250157 - RNA, 23 nt, Yersinia pestis
gucggccagcgcuaacgguggca

SEQ ID NO: 2250158 - RNA, 19 nt, Yersinia pestis
ggggcacaauucugaaagu

SEQ ID NO: 2250159 - RNA, 15 nt, Yersinia pestis
gggcuugagcagugc

SEQ ID NO: 2250160 - RNA, 16 nt, Yersinia pestis
gggcuucggucaggug

SEQ ID NO: 2250161 - RNA, 16 nt, Yersinia pestis
gggcuuccaucaggaa

SEQ ID NO: 2250162 - RNA, 17 nt, Yersinia pestis
gggcuuccaucaggaag

SEQ ID NO: 2250163 - RNA, 11 nt, Yersinia pestis
gggcugaucau

SEQ ID NO: 2250164 - RNA, 13 nt, Yersinia pestis
ggggcaucugcug

SEQ ID NO: 2250165 - RNA, 19 nt, Yersinia pestis
ggggcgagguuaccguuag

SEQ ID NO: 2250166 - RNA, 21 nt, Yersinia pestis
gggcuaaaagggaguucauca

SEQ ID NO: 2250167 - RNA, 14 nt, Yersinia pestis
gggcggccagcaag

SEQ ID NO: 2250168 - RNA, 20 nt, Yersinia pestis
gggccguuuacucgcaauac

SEQ ID NO: 2250169 - RNA, 14 nt, Yersinia pestis
gggguaagauccac

SEQ ID NO: 2250170 - RNA, 17 nt, Yersinia pestis
ggggguugucagcaguc

SEQ ID NO: 2250171 - RNA, 19 nt, Yersinia pestis
ggggguugucagcagucug

SEQ ID NO: 2250172 - RNA, 19 nt, Yersinia pestis
gggggcgcucggcagcugu

SEQ ID NO: 2250173 - RNA, 16 nt, Yersinia pestis
gggggcaauugauuga

SEQ ID NO: 2250174 - RNA, 23 nt, Yersinia pestis
ggggcguuuaaugccccugaggu

SEQ ID NO: 2250175 - RNA, 12 nt, Yersinia pestis
ggggcgguuggg

SEQ ID NO: 2250176 - RNA, 23 nt, Yersinia pestis
ggguaacgccgcuaaaucaucaa

SEQ ID NO: 2250177 - RNA, 16 nt, Yersinia pestis
ggguaagauccaccac

SEQ ID NO: 2250178 - RNA, 14 nt, Yersinia pestis
ggguaagaacagag

SEQ ID NO: 2250179 - RNA, 17 nt, Yersinia pestis
ggguaauccccaccaac

SEQ ID NO: 2250180 - RNA, 13 nt, Yersinia pestis
ggguaaaaucccc

SEQ ID NO: 2250181 - RNA, 17 nt, Yersinia pestis
gggguuagcagaccggu

SEQ ID NO: 2250182 - RNA, 18 nt, Yersinia pestis
gggguucgcuauccccac

SEQ ID NO: 2250183 - RNA, 19 nt, Yersinia pestis
gggugauggcugucugaug

SEQ ID NO: 2250184 - RNA, 13 nt, Yersinia pestis
gggaagggcgccg

SEQ ID NO: 2250185 - RNA, 22 nt, Yersinia pestis
gggaauaacgacgaaggauaca

SEQ ID NO: 2250186 - RNA, 14 nt, Yersinia pestis
ggcuuucugccugu

SEQ ID NO: 2250187 - RNA, 18 nt, Yersinia pestis
ggcugucggcgaugaaaa

SEQ ID NO: 2250188 - RNA, 20 nt, Yersinia pestis
ggcugucggcgaugaaaaac

SEQ ID NO: 2250189 - RNA, 21 nt, Yersinia pestis
ggcugucggcgaugaaaaaca

SEQ ID NO: 2250190 - RNA, 17 nt, Yersinia pestis
ggcuuucaggugacuga

SEQ ID NO: 2250191 - RNA, 19 nt, Yersinia pestis
ggcuugcgcgaaauauugc

SEQ ID NO: 2250192 - RNA, 15 nt, Yersinia pestis
ggcuucuuaauuccc

SEQ ID NO: 2250193 - RNA, 17 nt, Yersinia pestis
ggcuugcaaucagaggc

SEQ ID NO: 2250194 - RNA, 17 nt, Yersinia pestis
ggcuuagucauuaagaa

SEQ ID NO: 2250195 - RNA, 13 nt, Yersinia pestis
ggcuucuggaugg

SEQ ID NO: 2250196 - RNA, 19 nt, Yersinia pestis
gggcaacuccccacucaaa

SEQ ID NO: 2250197 - RNA, 11 nt, Yersinia pestis
gggcagaaaau

SEQ ID NO: 2250198 - RNA, 23 nt, Yersinia pestis
gggcagaccaguugacagguugg

SEQ ID NO: 2250199 - RNA, 12 nt, Yersinia pestis
gggcaaaaaaau

SEQ ID NO: 2250200 - RNA, 12 nt, Yersinia pestis
gggaucgcgcag

SEQ ID NO: 2250201 - RNA, 15 nt, Yersinia pestis
gggaucaccucuuca

SEQ ID NO: 2250202 - RNA, 20 nt, Yersinia pestis
ggucauugcgugcaauaaag

SEQ ID NO: 2250203 - RNA, 19 nt, Yersinia pestis
ggucauugcgugcaauaaa

SEQ ID NO: 2250204 - RNA, 15 nt, Yersinia pestis
ggucauuuuucccuu

SEQ ID NO: 2250205 - RNA, 13 nt, Yersinia pestis
ggucaugcggccu

SEQ ID NO: 2250206 - RNA, 14 nt, Yersinia pestis
ggucaugcacaguu

SEQ ID NO: 2250207 - RNA, 16 nt, Yersinia pestis
ggucaguugaauauuc

SEQ ID NO: 2250208 - RNA, 23 nt, Yersinia pestis
ggucaguugaauauuccauuugu

SEQ ID NO: 2250209 - RNA, 22 nt, Yersinia pestis
ggucauauacaccgcaccacga

SEQ ID NO: 2250210 - RNA, 16 nt, Yersinia pestis
ggucauaccggcggca

SEQ ID NO: 2250211 - RNA, 21 nt, Yersinia pestis
ggucauauucccuacgggaaa

SEQ ID NO: 2250212 - RNA, 17 nt, Yersinia pestis
ggucagaaccuguuaca

SEQ ID NO: 2250213 - RNA, 12 nt, Yersinia pestis
ggucacuuaaau

SEQ ID NO: 2250214 - RNA, 22 nt, Yersinia pestis
ggucagagauauaaacgacuuc

SEQ ID NO: 2250215 - RNA, 19 nt, Yersinia pestis
ggucaaccguuguguauca

SEQ ID NO: 2250216 - RNA, 14 nt, Yersinia pestis
ggucaagaugcaua

SEQ ID NO: 2250217 - RNA, 20 nt, Yersinia pestis
ggucaauaucaccagugaua

SEQ ID NO: 2250218 - RNA, 13 nt, Yersinia pestis
ggucaauaccaua

SEQ ID NO: 2250219 - RNA, 15 nt, Yersinia pestis
ggucaauaaaauuaa

SEQ ID NO: 2250220 - RNA, 11 nt, Yersinia pestis
gguaucaguca

SEQ ID NO: 2250221 - RNA, 22 nt, Yersinia pestis
gguauccauugaugcaguacuc

SEQ ID NO: 2250222 - RNA, 16 nt, Yersinia pestis
gguauuuuacugauga

SEQ ID NO: 2250223 - RNA, 13 nt, Yersinia pestis
gguauaugacugu

SEQ ID NO: 2250224 - RNA, 19 nt, Yersinia pestis
gguauauuuaccaaaagca

SEQ ID NO: 2250225 - RNA, 21 nt, Yersinia pestis
gguauagcuaucacgacuacc

SEQ ID NO: 2250226 - RNA, 14 nt, Yersinia pestis
gguauagcggcggg

SEQ ID NO: 2250227 - RNA, 23 nt, Yersinia pestis
gguauagcgauagaguugauaaa

SEQ ID NO: 2250228 - RNA, 20 nt, Yersinia pestis
gggugguuagcagauaauaa

SEQ ID NO: 2250229 - RNA, 16 nt, Yersinia pestis
ggugagcugaucugcc

SEQ ID NO: 2250230 - RNA, 15 nt, Yersinia pestis
ggugaaguucuauaa

SEQ ID NO: 2250231 - RNA, 20 nt, Yersinia pestis
ggugaauacguucaaaugau

SEQ ID NO: 2250232 - RNA, 19 nt, Yersinia pestis
ggugcaguuucacccucug

SEQ ID NO: 2250233 - RNA, 12 nt, Yersinia pestis
ggugccaacgca

SEQ ID NO: 2250234 - RNA, 16 nt, Yersinia pestis
ggugccaacgcaauuc

SEQ ID NO: 2250235 - RNA, 12 nt, Yersinia pestis
ggugccacacag

SEQ ID NO: 2250236 - RNA, 23 nt, Yersinia pestis
ggugccacacagaaucaccaaca

SEQ ID NO: 2250237 - RNA, 13 nt, Yersinia pestis
ggugccagcagca

SEQ ID NO: 2250238 - RNA, 14 nt, Yersinia pestis
ggugagugagcgcg

SEQ ID NO: 2250239 - RNA, 15 nt, Yersinia pestis
ggugagugagcgcgg

SEQ ID NO: 2250240 - RNA, 23 nt, Yersinia pestis
ggugaugccccgcuauugcccau

SEQ ID NO: 2250241 - RNA, 24 nt, Yersinia pestis
ggugaugugacgucacugaugcuu

SEQ ID NO: 2250242 - RNA, 17 nt, Yersinia pestis
ggucccuaacgcaauac

SEQ ID NO: 2250243 - RNA, 20 nt, Yersinia pestis
ggucucuuucgggcaaaaaa

SEQ ID NO: 2250244 - RNA, 19 nt, Yersinia pestis
ggucucuuugaccagggcu

SEQ ID NO: 2250245 - RNA, 20 nt, Yersinia pestis
gguuucacaugugcaauuaa

SEQ ID NO: 2250246 - RNA, 14 nt, Yersinia pestis
gguuugaauccagu

SEQ ID NO: 2250247 - RNA, 15 nt, Yersinia pestis
gguuugacggcggcg

SEQ ID NO: 2250248 - RNA, 20 nt, Yersinia pestis
gguuuuaucaauaggucagu

SEQ ID NO: 2250249 - RNA, 14 nt, Yersinia pestis
gguuuucaccccca

SEQ ID NO: 2250250 - RNA, 20 nt, Yersinia pestis
guaaaacaagggguuucaga

SEQ ID NO: 2250251 - RNA, 14 nt, Yersinia pestis
guaaaacagggagc

SEQ ID NO: 2250252 - RNA, 19 nt, Yersinia pestis
guaaaacagggagccgccc

SEQ ID NO: 2250253 - RNA, 19 nt, Yersinia pestis
guaaaaaaccuuauuuuug

SEQ ID NO: 2250254 - RNA, 15 nt, Yersinia pestis
gguuuuuaacagcuu

SEQ ID NO: 2250255 - RNA, 17 nt, Yersinia pestis
gguuuuguuaauauuua

SEQ ID NO: 2250256 - RNA, 16 nt, Yersinia pestis
gguuuuuguaacaggc

SEQ ID NO: 2250257 - RNA, 23 nt, Yersinia pestis
gguuuuuauauuuaccugcucaa

SEQ ID NO: 2250258 - RNA, 18 nt, Yersinia pestis
gguuuucugcggcaagcu

SEQ ID NO: 2250259 - RNA, 15 nt, Yersinia pestis
gguugaaauaaauaa

SEQ ID NO: 2250260 - RNA, 20 nt, Yersinia pestis
gguugagcaucugaaagcuu

SEQ ID NO: 2250261 - RNA, 13 nt, Yersinia pestis
gguugcuguaaug

SEQ ID NO: 2250262 - RNA, 14 nt, Yersinia pestis
gguugcuguaaugc

SEQ ID NO: 2250263 - RNA, 19 nt, Yersinia pestis
gguugccauuaauuggccg

SEQ ID NO: 2250264 - RNA, 17 nt, Yersinia pestis
gguuuaacaauguggua

SEQ ID NO: 2250265 - RNA, 20 nt, Yersinia pestis
gguuuaccuauuuuaaaacu

SEQ ID NO: 2250266 - RNA, 13 nt, Yersinia pestis
ggugcuguuccaa

SEQ ID NO: 2250267 - RNA, 20 nt, Yersinia pestis
ggugcuggugggccugcugc

SEQ ID NO: 2250268 - RNA, 14 nt, Yersinia pestis
ggugcugacaaaca

SEQ ID NO: 2250269 - RNA, 23 nt, Yersinia pestis
gguguaccgcuucgcgcccgccc

SEQ ID NO: 2250270 - RNA, 18 nt, Yersinia pestis
gguguaaaugcccgucgg

SEQ ID NO: 2250271 - RNA, 15 nt, Yersinia pestis
gguguaaauuucaaa

SEQ ID NO: 2250272 - RNA, 16 nt, Yersinia pestis
gguuacgucauauccc

SEQ ID NO: 2250273 - RNA, 12 nt, Yersinia pestis
gguuagcgccuu

SEQ ID NO: 2250274 - RNA, 23 nt, Yersinia pestis
gguuacgauacguugcaggucaa

SEQ ID NO: 2250275 - RNA, 17 nt, Yersinia pestis
gguguugcagucuccau

SEQ ID NO: 2250276 - RNA, 17 nt, Yersinia pestis
gguuaacuuuuucuauc

SEQ ID NO: 2250277 - RNA, 14 nt, Yersinia pestis
gguuaucacagcaa

SEQ ID NO: 2250278 - RNA, 16 nt, Yersinia pestis
gguuaucacaucaucc

SEQ ID NO: 2250279 - RNA, 15 nt, Yersinia pestis
gguucaguaaaacca

SEQ ID NO: 2250280 - RNA, 13 nt, Yersinia pestis
gguucaauucccg

SEQ ID NO: 2250281 - RNA, 14 nt, Yersinia pestis
gguucaccccucac

SEQ ID NO: 2250282 - RNA, 20 nt, Yersinia pestis
gguucaccuuucgguugcau

SEQ ID NO: 2250283 - RNA, 11 nt, Yersinia pestis
gguucacggaa

SEQ ID NO: 2250284 - RNA, 16 nt, Yersinia pestis
gguucaagucccuccc

SEQ ID NO: 2250285 - RNA, 18 nt, Yersinia pestis
gguucaaguccaguaggg

SEQ ID NO: 2250286 - RNA, 18 nt, Yersinia pestis
gguucgagacaacguuuc

SEQ ID NO: 2250287 - RNA, 15 nt, Yersinia pestis
gguuccaaagcacca

SEQ ID NO: 2250288 - RNA, 13 nt, Yersinia pestis
cuccuaaaaucua

SEQ ID NO: 2250289 - RNA, 13 nt, Yersinia pestis
cuccuacaccauu

SEQ ID NO: 2250290 - RNA, 19 nt, Yersinia pestis
cuccguaaucuguucgggc

SEQ ID NO: 2250291 - RNA, 13 nt, Yersinia pestis
cuccguugaaacc

SEQ ID NO: 2250292 - RNA, 12 nt, Yersinia pestis
cuccggaaucag

SEQ ID NO: 2250293 - RNA, 20 nt, Yersinia pestis
cuccggcgggagaguggcgg

SEQ ID NO: 2250294 - RNA, 14 nt, Yersinia pestis
cucccauuuauuac

SEQ ID NO: 2250295 - RNA, 15 nt, Yersinia pestis
cucccauuaauuaau

SEQ ID NO: 2250296 - RNA, 13 nt, Yersinia pestis
cucccauuaauua

SEQ ID NO: 2250297 - RNA, 17 nt, Yersinia pestis
cucccauucgcgcccca

SEQ ID NO: 2250298 - RNA, 17 nt, Yersinia pestis
cuccauuuuuuugaugc

SEQ ID NO: 2250299 - RNA, 14 nt, Yersinia pestis
cuccauucagagcg

SEQ ID NO: 2250300 - RNA, 17 nt, Yersinia pestis
cucccccacucgcccca

SEQ ID NO: 2250301 - RNA, 17 nt, Yersinia pestis
cuccccgcucggcccgc

SEQ ID NO: 2250302 - RNA, 13 nt, Yersinia pestis
cucccggcagcac

SEQ ID NO: 2250303 - RNA, 17 nt, Yersinia pestis
cuccaagaugauaaaua

SEQ ID NO: 2250304 - RNA, 18 nt, Yersinia pestis
cuccaacaacugccccuc

SEQ ID NO: 2250305 - RNA, 20 nt, Yersinia pestis
cucauuuaaaauacucauuu

SEQ ID NO: 2250306 - RNA, 14 nt, Yersinia pestis
cucauuuaaaauac

SEQ ID NO: 2250307 - RNA, 22 nt, Yersinia pestis
cucauuugaccuccguaggcca

SEQ ID NO: 2250308 - RNA, 17 nt, Yersinia pestis
cucauugcgucagguaa

SEQ ID NO: 2250309 - RNA, 23 nt, Yersinia pestis
cucauuggcaaauugcuggcggu

SEQ ID NO: 2250310 - RNA, 16 nt, Yersinia pestis
cucauucaugaggcuc

SEQ ID NO: 2250311 - RNA, 17 nt, Yersinia pestis
cucauucaugaggcuca

SEQ ID NO: 2250312 - RNA, 18 nt, Yersinia pestis
cucauucaugaggcuucu

SEQ ID NO: 2250313 - RNA, 14 nt, Yersinia pestis
cucauuaauaauga

SEQ ID NO: 2250314 - RNA, 12 nt, Yersinia pestis
cucauuacucag

SEQ ID NO: 2250315 - RNA, 19 nt, Yersinia pestis
cucaggcacauagcuggcu

SEQ ID NO: 2250316 - RNA, 18 nt, Yersinia pestis
cucaggauuagcuucugc

SEQ ID NO: 2250317 - RNA, 12 nt, Yersinia pestis
cucaggccuugc

SEQ ID NO: 2250318 - RNA, 12 nt, Yersinia pestis
cuccagaagcau

SEQ ID NO: 2250319 - RNA, 14 nt, Yersinia pestis
cuccagaagcauau

SEQ ID NO: 2250320 - RNA, 18 nt, Yersinia pestis
cuccagaauauaaaagca

SEQ ID NO: 2250321 - RNA, 16 nt, Yersinia pestis
cuccagaauaucuuca

SEQ ID NO: 2250322 - RNA, 15 nt, Yersinia pestis
cuccacgccccaacg

SEQ ID NO: 2250323 - RNA, 13 nt, Yersinia pestis
cuccaauaacuaa

SEQ ID NO: 2250324 - RNA, 17 nt, Yersinia pestis
cuccaauaauucgugaa

SEQ ID NO: 2250325 - RNA, 19 nt, Yersinia pestis
cuccaauaaaaaauccagu

SEQ ID NO: 2250326 - RNA, 23 nt, Yersinia pestis
cuccacaccuccgcccucuugcu

SEQ ID NO: 2250327 - RNA, 15 nt, Yersinia pestis
cuccaccaaugauuu

SEQ ID NO: 2250328 - RNA, 17 nt, Yersinia pestis
cuccacacccgccaaac

SEQ ID NO: 2250329 - RNA, 14 nt, Yersinia pestis
cuccacauauugug

SEQ ID NO: 2250330 - RNA, 19 nt, Yersinia pestis
cuccacauuuuggccuuca

SEQ ID NO: 2250331 - RNA, 12 nt, Yersinia pestis
cuccuccagaau

SEQ ID NO: 2250332 - RNA, 16 nt, Yersinia pestis
cucgaacgauuuucuu

SEQ ID NO: 2250333 - RNA, 18 nt, Yersinia pestis
cucgaagcgcgcccuccc

SEQ ID NO: 2250334 - RNA, 18 nt, Yersinia pestis
cucgaaccgcgccauccu

SEQ ID NO: 2250335 - RNA, 22 nt, Yersinia pestis
cucgcaaugaaaguggccacuc

SEQ ID NO: 2250336 - RNA, 19 nt, Yersinia pestis
cucgcacccuuacccuggu

SEQ ID NO: 2250337 - RNA, 16 nt, Yersinia pestis
cucgcacucaucuuug

SEQ ID NO: 2250338 - RNA, 12 nt, Yersinia pestis
cucgccacccgc

SEQ ID NO: 2250339 - RNA, 14 nt, Yersinia pestis
cucgccacccgcuu

SEQ ID NO: 2250340 - RNA, 17 nt, Yersinia pestis
cucgccacccgcuuuca

SEQ ID NO: 2250341 - RNA, 16 nt, Yersinia pestis
cucgccgacaacuuca

SEQ ID NO: 2250342 - RNA, 19 nt, Yersinia pestis
cucgcggaaaucagcuuca

SEQ ID NO: 2250343 - RNA, 13 nt, Yersinia pestis
cucgcgcccugcc

SEQ ID NO: 2250344 - RNA, 17 nt, Yersinia pestis
cucgccguggcgacagc

SEQ ID NO: 2250345 - RNA, 17 nt, Yersinia pestis
cucguuguauuuuccug

SEQ ID NO: 2250346 - RNA, 22 nt, Yersinia pestis
cucguuggaucaucgggaacag

SEQ ID NO: 2250347 - RNA, 15 nt, Yersinia pestis
cucgcugugcccuuu

SEQ ID NO: 2250348 - RNA, 15 nt, Yersinia pestis
cucggcgcauccaug

SEQ ID NO: 2250349 - RNA, 17 nt, Yersinia pestis
cucggcgcgcuugccac

SEQ ID NO: 2250350 - RNA, 22 nt, Yersinia pestis
cucggcgcgcuugccacgccag

SEQ ID NO: 2250351 - RNA, 15 nt, Yersinia pestis
cucggcucgaaccug

SEQ ID NO: 2250352 - RNA, 21 nt, Yersinia pestis
cucggggcacuccgguggcuu

SEQ ID NO: 2250353 - RNA, 16 nt, Yersinia pestis
cucgguaacuuaucga

SEQ ID NO: 2250354 - RNA, 16 nt, Yersinia pestis
cucgguaaugagccgc

SEQ ID NO: 2250355 - RNA, 22 nt, Yersinia pestis
cucgggucagugaaaaaugaga

SEQ ID NO: 2250356 - RNA, 12 nt, Yersinia pestis
cuauuuuacuug

SEQ ID NO: 2250357 - RNA, 23 nt, Yersinia pestis
cuauuuuauaucgaucugauauc

SEQ ID NO: 2250358 - RNA, 23 nt, Yersinia pestis
cuauuucggcuuggcucaaugug

SEQ ID NO: 2250359 - RNA, 13 nt, Yersinia pestis
cuauuucuucaua

SEQ ID NO: 2250360 - RNA, 17 nt, Yersinia pestis
cuauuuccgaaagcgcc

SEQ ID NO: 2250361 - RNA, 19 nt, Yersinia pestis
cuauuuuugacuuuaauua

SEQ ID NO: 2250362 - RNA, 18 nt, Yersinia pestis
cuauuuuuauuucuccuu

SEQ ID NO: 2250363 - RNA, 19 nt, Yersinia pestis
cuauuuuuauaaucaucua

SEQ ID NO: 2250364 - RNA, 13 nt, Yersinia pestis
cuauugaaaaaau

SEQ ID NO: 2250365 - RNA, 15 nt, Yersinia pestis
cuauugaaaaaauaa

SEQ ID NO: 2250366 - RNA, 20 nt, Yersinia pestis
cuauucugccuauccucacc

SEQ ID NO: 2250367 - RNA, 13 nt, Yersinia pestis
cuauucucaaacu

SEQ ID NO: 2250368 - RNA, 16 nt, Yersinia pestis
cuauucucuguaaugg

SEQ ID NO: 2250369 - RNA, 17 nt, Yersinia pestis
cuauugauaaaaccacu

SEQ ID NO: 2250370 - RNA, 15 nt, Yersinia pestis
cuauugauaaaaccg

SEQ ID NO: 2250371 - RNA, 19 nt, Yersinia pestis
cuauuggcuuaucacuugc

SEQ ID NO: 2250372 - RNA, 18 nt, Yersinia pestis
cuauugugucaauaccuu

SEQ ID NO: 2250373 - RNA, 17 nt, Yersinia pestis
cuauuguuacuuuuaau

SEQ ID NO: 2250374 - RNA, 15 nt, Yersinia pestis
cuauuuacauaauaa

SEQ ID NO: 2250375 - RNA, 14 nt, Yersinia pestis
cuauuuaacaaaaa

SEQ ID NO: 2250376 - RNA, 16 nt, Yersinia pestis
cuauuuaacaaaaaau

SEQ ID NO: 2250377 - RNA, 21 nt, Yersinia pestis
cuauuuauuuauaaaaccacu

SEQ ID NO: 2250378 - RNA, 22 nt, Yersinia pestis
cuauuuacugcauucugagcac

SEQ ID NO: 2250379 - RNA, 19 nt, Yersinia pestis
cuaucugcucuugcucagu

SEQ ID NO: 2250380 - RNA, 14 nt, Yersinia pestis
cuaucuguucaccg

SEQ ID NO: 2250381 - RNA, 17 nt, Yersinia pestis
cuaucugguuuaaauuc

SEQ ID NO: 2250382 - RNA, 19 nt, Yersinia pestis
cuaucugguuuaaauucua

SEQ ID NO: 2250383 - RNA, 15 nt, Yersinia pestis
cuaucucacccuucu

SEQ ID NO: 2250384 - RNA, 21 nt, Yersinia pestis
cuaucuauuuuuauuucuccu

SEQ ID NO: 2250385 - RNA, 23 nt, Yersinia pestis
cuauggcgguuccaaagcaccaa

SEQ ID NO: 2250386 - RNA, 13 nt, Yersinia pestis
cuauggauaaauc

SEQ ID NO: 2250387 - RNA, 19 nt, Yersinia pestis
cuauucaaugacuccugaa

SEQ ID NO: 2250388 - RNA, 18 nt, Yersinia pestis
cuauuauuaaagaugaug

SEQ ID NO: 2250389 - RNA, 18 nt, Yersinia pestis
cuauucacuauuuauuaa

SEQ ID NO: 2250390 - RNA, 22 nt, Yersinia pestis
cucacaacuuuuauuggcauua

SEQ ID NO: 2250391 - RNA, 17 nt, Yersinia pestis
cucacacacuaauaaua

SEQ ID NO: 2250392 - RNA, 15 nt, Yersinia pestis
cucaauggcuuuuuu

SEQ ID NO: 2250393 - RNA, 12 nt, Yersinia pestis
cucaauugacug

SEQ ID NO: 2250394 - RNA, 23 nt, Yersinia pestis
cucaauugucuuuggacagucug

SEQ ID NO: 2250395 - RNA, 12 nt, Yersinia pestis
cucacccauuuu

SEQ ID NO: 2250396 - RNA, 21 nt, Yersinia pestis
cucacccauuuuauccucuuc

SEQ ID NO: 2250397 - RNA, 13 nt, Yersinia pestis
cucaccacgccca

SEQ ID NO: 2250398 - RNA, 16 nt, Yersinia pestis
cucaaaaggauggccc

SEQ ID NO: 2250399 - RNA, 17 nt, Yersinia pestis
cucaaagaccacaucaa

SEQ ID NO: 2250400 - RNA, 18 nt, Yersinia pestis
cucaaacugacuuuacuu

SEQ ID NO: 2250401 - RNA, 20 nt, Yersinia pestis
cucaaacaugagcgcaugcc

SEQ ID NO: 2250402 - RNA, 16 nt, Yersinia pestis
cucaaauacuucaaau

SEQ ID NO: 2250403 - RNA, 19 nt, Yersinia pestis
cucaaauacuucaaaugac

SEQ ID NO: 2250404 - RNA, 19 nt, Yersinia pestis
cucaaacugauaaagcaaa

SEQ ID NO: 2250405 - RNA, 15 nt, Yersinia pestis
cucaaucucugccug

SEQ ID NO: 2250406 - RNA, 22 nt, Yersinia pestis
cucaaucggcugguaacugagu

SEQ ID NO: 2250407 - RNA, 21 nt, Yersinia pestis
cucaaugccaagucuuauugc

SEQ ID NO: 2250408 - RNA, 16 nt, Yersinia pestis
cucaaugccgcugucu

SEQ ID NO: 2250409 - RNA, 14 nt, Yersinia pestis
cucaaugcagaugc

SEQ ID NO: 2250410 - RNA, 18 nt, Yersinia pestis
cucaaugcaguaaagauu

SEQ ID NO: 2250411 - RNA, 16 nt, Yersinia pestis
cucaaugcgaaaaaau

SEQ ID NO: 2250412 - RNA, 13 nt, Yersinia pestis
cucaaugauaaaa

SEQ ID NO: 2250413 - RNA, 17 nt, Yersinia pestis
cucaaugcguuggcuca

SEQ ID NO: 2250414 - RNA, 20 nt, Yersinia pestis
cucacgguagugacucauca

SEQ ID NO: 2250415 - RNA, 18 nt, Yersinia pestis
cucacgggcuuccaucag

SEQ ID NO: 2250416 - RNA, 20 nt, Yersinia pestis
cucacgguuucuaaaaaaug

SEQ ID NO: 2250417 - RNA, 18 nt, Yersinia pestis
cucacguauuuucauuuu

SEQ ID NO: 2250418 - RNA, 21 nt, Yersinia pestis
cucacuuuuauauccgccauc

SEQ ID NO: 2250419 - RNA, 14 nt, Yersinia pestis
cucacuuuuaucca

SEQ ID NO: 2250420 - RNA, 21 nt, Yersinia pestis
cucacgucaccacgcagucag

SEQ ID NO: 2250421 - RNA, 17 nt, Yersinia pestis
cucacugucgggguaga

SEQ ID NO: 2250422 - RNA, 14 nt, Yersinia pestis
cucagcauccuccu

SEQ ID NO: 2250423 - RNA, 15 nt, Yersinia pestis
cucagcaucaccgcc

SEQ ID NO: 2250424 - RNA, 15 nt, Yersinia pestis
cucagcauccuccug

SEQ ID NO: 2250425 - RNA, 13 nt, Yersinia pestis
cucagcaucuuca

SEQ ID NO: 2250426 - RNA, 23 nt, Yersinia pestis
cucagcagagucgcaaaaaauau

SEQ ID NO: 2250427 - RNA, 13 nt, Yersinia pestis
cucagaaaauaaa

SEQ ID NO: 2250428 - RNA, 21 nt, Yersinia pestis
cucacuuuuugucaauaaaau

SEQ ID NO: 2250429 - RNA, 23 nt, Yersinia pestis
cucagcgcuggcgagguaccgcu

SEQ ID NO: 2250430 - RNA, 22 nt, Yersinia pestis
cucagcgucacggaaagcaggu

SEQ ID NO: 2250431 - RNA, 18 nt, Yersinia pestis
cucagcgggcuaaaugcu

SEQ ID NO: 2250432 - RNA, 15 nt, Yersinia pestis
cucagcgucacggaa

SEQ ID NO: 2250433 - RNA, 17 nt, Yersinia pestis
cucagccucauucauga

SEQ ID NO: 2250434 - RNA, 18 nt, Yersinia pestis
cucagccucauucaugag

SEQ ID NO: 2250435 - RNA, 14 nt, Yersinia pestis
cucagccucauuca

SEQ ID NO: 2250436 - RNA, 16 nt, Yersinia pestis
cucagccuuuuuugcu

SEQ ID NO: 2250437 - RNA, 13 nt, Yersinia pestis
cucagccaucucu

SEQ ID NO: 2250438 - RNA, 13 nt, Yersinia pestis
cuaccgcucagau

SEQ ID NO: 2250439 - RNA, 20 nt, Yersinia pestis
cuaccggcauuggcugguaa

SEQ ID NO: 2250440 - RNA, 17 nt, Yersinia pestis
cuaccugccugcugcug

SEQ ID NO: 2250441 - RNA, 23 nt, Yersinia pestis
cuaccuccggggccugcggccau

SEQ ID NO: 2250442 - RNA, 21 nt, Yersinia pestis
cuaccugcaccaaucauuaca

SEQ ID NO: 2250443 - RNA, 17 nt, Yersinia pestis
cuaccguaucagccccu

SEQ ID NO: 2250444 - RNA, 14 nt, Yersinia pestis
cuaccguucucugc

SEQ ID NO: 2250445 - RNA, 18 nt, Yersinia pestis
cuacccgaaucacugacu

SEQ ID NO: 2250446 - RNA, 21 nt, Yersinia pestis
cuaccaguuuuuuccugcugc

SEQ ID NO: 2250447 - RNA, 15 nt, Yersinia pestis
cuacauuuagucuac

SEQ ID NO: 2250448 - RNA, 22 nt, Yersinia pestis
cuaccacguuuaucugacacaa

SEQ ID NO: 2250449 - RNA, 11 nt, Yersinia pestis
cuaccaccuac

SEQ ID NO: 2250450 - RNA, 17 nt, Yersinia pestis
cuaccaccuacaaccua

SEQ ID NO: 2250451 - RNA, 21 nt, Yersinia pestis
cuaccaccuacaaccuaccac

SEQ ID NO: 2250452 - RNA, 13 nt, Yersinia pestis
cuaccaccuacca

SEQ ID NO: 2250453 - RNA, 14 nt, Yersinia pestis
cuaccaccuaccac

SEQ ID NO: 2250454 - RNA, 17 nt, Yersinia pestis
cuaccaccuaccaccua

SEQ ID NO: 2250455 - RNA, 18 nt, Yersinia pestis
cuacaggcgcaacugcca

SEQ ID NO: 2250456 - RNA, 15 nt, Yersinia pestis
cuacaauaucuuccc

SEQ ID NO: 2250457 - RNA, 14 nt, Yersinia pestis
cuacagaaaaauaa

SEQ ID NO: 2250458 - RNA, 22 nt, Yersinia pestis
cuacagaaaaauaacauccaug

SEQ ID NO: 2250459 - RNA, 20 nt, Yersinia pestis
cuaguuaacccuaccuaggc

SEQ ID NO: 2250460 - RNA, 12 nt, Yersinia pestis
cuagugaugggg

SEQ ID NO: 2250461 - RNA, 14 nt, Yersinia pestis
cuaguagauaauca

SEQ ID NO: 2250462 - RNA, 21 nt, Yersinia pestis
cuaguuuuaaacgucagauua

SEQ ID NO: 2250463 - RNA, 17 nt, Yersinia pestis
cuauaagcgcucaaaua

SEQ ID NO: 2250464 - RNA, 14 nt, Yersinia pestis
cuauaaggcucugu

SEQ ID NO: 2250465 - RNA, 15 nt, Yersinia pestis
cuauaaggcucuguu

SEQ ID NO: 2250466 - RNA, 22 nt, Yersinia pestis
cuauaaggcucuguuaccagcc

SEQ ID NO: 2250467 - RNA, 23 nt, Yersinia pestis
cuauaaggcucuguuaccagccg

SEQ ID NO: 2250468 - RNA, 17 nt, Yersinia pestis
cuauagaaaacaaaaag

SEQ ID NO: 2250469 - RNA, 22 nt, Yersinia pestis
cuauaaauuuuaaguuaauguu

SEQ ID NO: 2250470 - RNA, 21 nt, Yersinia pestis
cuacggcugaucugccccugg

SEQ ID NO: 2250471 - RNA, 14 nt, Yersinia pestis
cuacggcuucccau

SEQ ID NO: 2250472 - RNA, 17 nt, Yersinia pestis
cuacggcugaucugccc

SEQ ID NO: 2250473 - RNA, 23 nt, Yersinia pestis
cuacgccgucaucaucuucuuca

SEQ ID NO: 2250474 - RNA, 15 nt, Yersinia pestis
cuacguacuaucuau

SEQ ID NO: 2250475 - RNA, 17 nt, Yersinia pestis
cuacguacuaucuauua

SEQ ID NO: 2250476 - RNA, 21 nt, Yersinia pestis
cuacguuguuaucaucaccac

SEQ ID NO: 2250477 - RNA, 20 nt, Yersinia pestis
cuagcccaguaccgcuggug

SEQ ID NO: 2250478 - RNA, 16 nt, Yersinia pestis
cuagcgccagcaauug

SEQ ID NO: 2250479 - RNA, 19 nt, Yersinia pestis
cuagcagugauuucagugu

SEQ ID NO: 2250480 - RNA, 22 nt, Yersinia pestis
cuagaaauaaguugaaccauaa

SEQ ID NO: 2250481 - RNA, 17 nt, Yersinia pestis
cuagaacuauuggucaa

SEQ ID NO: 2250482 - RNA, 18 nt, Yersinia pestis
cguauuuucauuuuaaca

SEQ ID NO: 2250483 - RNA, 17 nt, Yersinia pestis
cguaucguccagcagca

SEQ ID NO: 2250484 - RNA, 15 nt, Yersinia pestis
cgucacuggccaccc

SEQ ID NO: 2250485 - RNA, 19 nt, Yersinia pestis
cgucaccgccaaaauaaac

SEQ ID NO: 2250486 - RNA, 18 nt, Yersinia pestis
cgucaccgccaaaauaaa

SEQ ID NO: 2250487 - RNA, 14 nt, Yersinia pestis
cgucacuucucuga

SEQ ID NO: 2250488 - RNA, 18 nt, Yersinia pestis
cgucacuucucugacaca

SEQ ID NO: 2250489 - RNA, 14 nt, Yersinia pestis
cgucauccagcacu

SEQ ID NO: 2250490 - RNA, 20 nt, Yersinia pestis
cgucagguaaguagaaugca

SEQ ID NO: 2250491 - RNA, 12 nt, Yersinia pestis
cguccagaugcc

SEQ ID NO: 2250492 - RNA, 19 nt, Yersinia pestis
cgucccuaaagccaucgcc

SEQ ID NO: 2250493 - RNA, 21 nt, Yersinia pestis
cgucccuaaagccaucgccau

SEQ ID NO: 2250494 - RNA, 21 nt, Yersinia pestis
cgucauugaggguugucagca

SEQ ID NO: 2250495 - RNA, 17 nt, Yersinia pestis
cguaggcuuggcgggcu

SEQ ID NO: 2250496 - RNA, 14 nt, Yersinia pestis
cguagggauaaauc

SEQ ID NO: 2250497 - RNA, 20 nt, Yersinia pestis
cguagguaauuaaacgcuca

SEQ ID NO: 2250498 - RNA, 12 nt, Yersinia pestis
cguagguaauua

SEQ ID NO: 2250499 - RNA, 18 nt, Yersinia pestis
cguagguuucagccucug

SEQ ID NO: 2250500 - RNA, 14 nt, Yersinia pestis
cguaggcugaccac

SEQ ID NO: 2250501 - RNA, 12 nt, Yersinia pestis
cguaggcugacc

SEQ ID NO: 2250502 - RNA, 12 nt, Yersinia pestis
cguaggccaacc

SEQ ID NO: 2250503 - RNA, 19 nt, Yersinia pestis
cguagguuucagccucuga

SEQ ID NO: 2250504 - RNA, 22 nt, Yersinia pestis
cguagccauuggguauggucag

SEQ ID NO: 2250505 - RNA, 20 nt, Yersinia pestis
cguacuuugguugugaucca

SEQ ID NO: 2250506 - RNA, 13 nt, Yersinia pestis
cguacauuaaaug

SEQ ID NO: 2250507 - RNA, 21 nt, Yersinia pestis
cguacauauaucacuauuuca

SEQ ID NO: 2250508 - RNA, 19 nt, Yersinia pestis
cguacaacaauaauaagcc

SEQ ID NO: 2250509 - RNA, 19 nt, Yersinia pestis
cguaauucagauaagaucu

SEQ ID NO: 2250510 - RNA, 12 nt, Yersinia pestis
cguacuuuccuu

SEQ ID NO: 2250511 - RNA, 13 nt, Yersinia pestis
cguacgacgucca

SEQ ID NO: 2250512 - RNA, 21 nt, Yersinia pestis
cgucuuugaccgaaccaccgc

SEQ ID NO: 2250513 - RNA, 23 nt, Yersinia pestis
cgucuuuacgaucugccuguucu

SEQ ID NO: 2250514 - RNA, 17 nt, Yersinia pestis
cgucuuuagauuucacc

SEQ ID NO: 2250515 - RNA, 21 nt, Yersinia pestis
cgucuuuaucgccagcugcaa

SEQ ID NO: 2250516 - RNA, 23 nt, Yersinia pestis
cgucuuguuggucaccacuugca

SEQ ID NO: 2250517 - RNA, 20 nt, Yersinia pestis
cgucuuuacgaucugccugu

SEQ ID NO: 2250518 - RNA, 16 nt, Yersinia pestis
cgucuugaucaacuca

SEQ ID NO: 2250519 - RNA, 19 nt, Yersinia pestis
cgugacguuaucucaacca

SEQ ID NO: 2250520 - RNA, 13 nt, Yersinia pestis
cgugagcaucugg

SEQ ID NO: 2250521 - RNA, 15 nt, Yersinia pestis
cgugagcaucuggcg

SEQ ID NO: 2250522 - RNA, 21 nt, Yersinia pestis
cgucuggcuaauacugccaau

SEQ ID NO: 2250523 - RNA, 16 nt, Yersinia pestis
cgucucaaggccuugu

SEQ ID NO: 2250524 - RNA, 17 nt, Yersinia pestis
cgucuccauuucaacgu

SEQ ID NO: 2250525 - RNA, 19 nt, Yersinia pestis
cgucuccauuucaacguca

SEQ ID NO: 2250526 - RNA, 22 nt, Yersinia pestis
cgugauugguaaacugccaaua

SEQ ID NO: 2250527 - RNA, 16 nt, Yersinia pestis
cgugauugguuuaucc

SEQ ID NO: 2250528 - RNA, 16 nt, Yersinia pestis
cgugauggcgcagacc

SEQ ID NO: 2250529 - RNA, 18 nt, Yersinia pestis
cgugaugccaguaauuca

SEQ ID NO: 2250530 - RNA, 17 nt, Yersinia pestis
cgugauuuuuauauuuu

SEQ ID NO: 2250531 - RNA, 21 nt, Yersinia pestis
cgugauuuuuauauuuugaga

SEQ ID NO: 2250532 - RNA, 23 nt, Yersinia pestis
cgugcucaucaaccucagccuca

SEQ ID NO: 2250533 - RNA, 18 nt, Yersinia pestis
cgucuacgcucuccucuc

SEQ ID NO: 2250534 - RNA, 13 nt, Yersinia pestis
cgucgcuguuacc

SEQ ID NO: 2250535 - RNA, 15 nt, Yersinia pestis
cgucgccgcagaaga

SEQ ID NO: 2250536 - RNA, 15 nt, Yersinia pestis
cuaagacuauuaauu

SEQ ID NO: 2250537 - RNA, 23 nt, Yersinia pestis
cuaagcgucucaaggccuugugg

SEQ ID NO: 2250538 - RNA, 17 nt, Yersinia pestis
cuaaguccaagacagaa

SEQ ID NO: 2250539 - RNA, 23 nt, Yersinia pestis
cuaauaaauaauuuguauucuca

SEQ ID NO: 2250540 - RNA, 15 nt, Yersinia pestis
cuaaggggccaauag

SEQ ID NO: 2250541 - RNA, 20 nt, Yersinia pestis
cuaaggaacccgaugaauuu

SEQ ID NO: 2250542 - RNA, 17 nt, Yersinia pestis
cuaagucacgcacccac

SEQ ID NO: 2250543 - RNA, 21 nt, Yersinia pestis
cuaagucacgcacccaccaag

SEQ ID NO: 2250544 - RNA, 20 nt, Yersinia pestis
cuaaguacuaucuauuauua

SEQ ID NO: 2250545 - RNA, 14 nt, Yersinia pestis
cuaaguaaaacaaa

SEQ ID NO: 2250546 - RNA, 18 nt, Yersinia pestis
cuaaggguaaaaucccca

SEQ ID NO: 2250547 - RNA, 20 nt, Yersinia pestis
cuaacaacagucaauauacc

SEQ ID NO: 2250548 - RNA, 16 nt, Yersinia pestis
cuaacaacuuccacac

SEQ ID NO: 2250549 - RNA, 13 nt, Yersinia pestis
cuaaaccacauaa

SEQ ID NO: 2250550 - RNA, 13 nt, Yersinia pestis
cuaacaauauuac

SEQ ID NO: 2250551 - RNA, 24 nt, Yersinia pestis
cuaaccgcacugggucaucaccca

SEQ ID NO: 2250552 - RNA, 12 nt, Yersinia pestis
cuaacucuucug

SEQ ID NO: 2250553 - RNA, 17 nt, Yersinia pestis
cuaacucuucuggcaaa

SEQ ID NO: 2250554 - RNA, 20 nt, Yersinia pestis
cuaacuggcccucuuuuuug

SEQ ID NO: 2250555 - RNA, 20 nt, Yersinia pestis
cuaacgaaucccacacucug

SEQ ID NO: 2250556 - RNA, 20 nt, Yersinia pestis
cuaacgguggcauugaccaa

SEQ ID NO: 2250557 - RNA, 18 nt, Yersinia pestis
cuaacgaggcauaaucag

SEQ ID NO: 2250558 - RNA, 18 nt, Yersinia pestis
cuaacgcuucggcgcggu

SEQ ID NO: 2250559 - RNA, 12 nt, Yersinia pestis
cuaacguccccu

SEQ ID NO: 2250560 - RNA, 21 nt, Yersinia pestis
cuaauucuggguacaacacaa

SEQ ID NO: 2250561 - RNA, 14 nt, Yersinia pestis
cuaauuucaaauga

SEQ ID NO: 2250562 - RNA, 17 nt, Yersinia pestis
cuaauuucaaaugaacu

SEQ ID NO: 2250563 - RNA, 19 nt, Yersinia pestis
cuaauuuauaaccuuuuuc

SEQ ID NO: 2250564 - RNA, 23 nt, Yersinia pestis
cuaauuuaucccgagcuaacgcu

SEQ ID NO: 2250565 - RNA, 13 nt, Yersinia pestis
cuaauugauauua

SEQ ID NO: 2250566 - RNA, 16 nt, Yersinia pestis
cuaaugucucuauuca

SEQ ID NO: 2250567 - RNA, 14 nt, Yersinia pestis
cuaauguaauaauc

SEQ ID NO: 2250568 - RNA, 18 nt, Yersinia pestis
cuaauguuuguuucucug

SEQ ID NO: 2250569 - RNA, 18 nt, Yersinia pestis
cuaauuaaagacgcauga

SEQ ID NO: 2250570 - RNA, 16 nt, Yersinia pestis
cuaauguuuguuucuc

SEQ ID NO: 2250571 - RNA, 20 nt, Yersinia pestis
cuaauuaauuuaaacaacca

SEQ ID NO: 2250572 - RNA, 20 nt, Yersinia pestis
cuaauuagugacaguagaau

SEQ ID NO: 2250573 - RNA, 16 nt, Yersinia pestis
cuaauucaccaauugc

SEQ ID NO: 2250574 - RNA, 18 nt, Yersinia pestis
cuaauucaggcaaauucu

SEQ ID NO: 2250575 - RNA, 16 nt, Yersinia pestis
cuacaagcaugugaug

SEQ ID NO: 2250576 - RNA, 16 nt, Yersinia pestis
cuaauacgcuaucaac

SEQ ID NO: 2250577 - RNA, 14 nt, Yersinia pestis
cuaauaccacaaca

SEQ ID NO: 2250578 - RNA, 16 nt, Yersinia pestis
cuaauaccauuucuua

SEQ ID NO: 2250579 - RNA, 12 nt, Yersinia pestis
cuaauauucucu

SEQ ID NO: 2250580 - RNA, 15 nt, Yersinia pestis
cuaauagcauuuuuc

SEQ ID NO: 2250581 - RNA, 14 nt, Yersinia pestis
cuaauagcauuuuu

SEQ ID NO: 2250582 - RNA, 17 nt, Yersinia pestis
cuaauauuuauaaaaaa

SEQ ID NO: 2250583 - RNA, 11 nt, Yersinia pestis
cuaaucccuuu

SEQ ID NO: 2250584 - RNA, 16 nt, Yersinia pestis
cuaaucuccucuccgg

SEQ ID NO: 2250585 - RNA, 14 nt, Yersinia pestis
cuaaucuccucucc

SEQ ID NO: 2250586 - RNA, 22 nt, Yersinia pestis
cuaaugccgcgcccccagccau

SEQ ID NO: 2250587 - RNA, 18 nt, Yersinia pestis
cuaaugccagacacaaga

SEQ ID NO: 2250588 - RNA, 17 nt, Yersinia pestis
cuaaugccgagaacaga

SEQ ID NO: 2250589 - RNA, 16 nt, Yersinia pestis
cuaaucucuacauuua

SEQ ID NO: 2250590 - RNA, 14 nt, Yersinia pestis
cuaaugaacgagua

SEQ ID NO: 2250591 - RNA, 19 nt, Yersinia pestis
cguuuuugguuaaagaaga

SEQ ID NO: 2250592 - RNA, 13 nt, Yersinia pestis
cuaaaaaaaacaa

SEQ ID NO: 2250593 - RNA, 18 nt, Yersinia pestis
cguuuucuuucaggccac

SEQ ID NO: 2250594 - RNA, 19 nt, Yersinia pestis
cguuuugggcuugagcagu

SEQ ID NO: 2250595 - RNA, 23 nt, Yersinia pestis
cguuuugggcuugagcagugcgc

SEQ ID NO: 2250596 - RNA, 12 nt, Yersinia pestis
cguuuuagcauu

SEQ ID NO: 2250597 - RNA, 12 nt, Yersinia pestis
cuaaaacugaag

SEQ ID NO: 2250598 - RNA, 18 nt, Yersinia pestis
cuaaaauucaaacaaaua

SEQ ID NO: 2250599 - RNA, 20 nt, Yersinia pestis
cuaaaagggaguucaucaaa

SEQ ID NO: 2250600 - RNA, 15 nt, Yersinia pestis
cguugcacccugcuu

SEQ ID NO: 2250601 - RNA, 13 nt, Yersinia pestis
cguugcaggucaa

SEQ ID NO: 2250602 - RNA, 20 nt, Yersinia pestis
cguugccccaucagcacucc

SEQ ID NO: 2250603 - RNA, 15 nt, Yersinia pestis
cguugucagccaugc

SEQ ID NO: 2250604 - RNA, 20 nt, Yersinia pestis
cguuugggcuaagacuauua

SEQ ID NO: 2250605 - RNA, 16 nt, Yersinia pestis
cguuucuacaauggcc

SEQ ID NO: 2250606 - RNA, 18 nt, Yersinia pestis
cguuguuaucaucaccac

SEQ ID NO: 2250607 - RNA, 15 nt, Yersinia pestis
cguuuaaaaaauauc

SEQ ID NO: 2250608 - RNA, 22 nt, Yersinia pestis
cguuuccagugcggcauguaca

SEQ ID NO: 2250609 - RNA, 20 nt, Yersinia pestis
cguuuccagcggcguaucaa

SEQ ID NO: 2250610 - RNA, 21 nt, Yersinia pestis
cguuucccccuguaaaacaag

SEQ ID NO: 2250611 - RNA, 18 nt, Yersinia pestis
cguuaugaauaaaccagc

SEQ ID NO: 2250612 - RNA, 22 nt, Yersinia pestis
cguuaugaauaaaccagcaagc

SEQ ID NO: 2250613 - RNA, 23 nt, Yersinia pestis
cguuaugaauaaaccagcaagcc

SEQ ID NO: 2250614 - RNA, 15 nt, Yersinia pestis
cguuaugccaaccgg

SEQ ID NO: 2250615 - RNA, 15 nt, Yersinia pestis
cguuauuaaacaguc

SEQ ID NO: 2250616 - RNA, 13 nt, Yersinia pestis
cguuaucaauaag

SEQ ID NO: 2250617 - RNA, 20 nt, Yersinia pestis
cguuaucaauaaguucgucu

SEQ ID NO: 2250618 - RNA, 22 nt, Yersinia pestis
cguuaucaaauacgaccgucac

SEQ ID NO: 2250619 - RNA, 17 nt, Yersinia pestis
cguuauaccucaagcug

SEQ ID NO: 2250620 - RNA, 17 nt, Yersinia pestis
cguuagaggauuuaacu

SEQ ID NO: 2250621 - RNA, 16 nt, Yersinia pestis
cguuaauuacacccaa

SEQ ID NO: 2250622 - RNA, 19 nt, Yersinia pestis
cguuaauuauagugaaaac

SEQ ID NO: 2250623 - RNA, 17 nt, Yersinia pestis
cguuacagaugggaaga

SEQ ID NO: 2250624 - RNA, 18 nt, Yersinia pestis
cguuacaacgagggcuca

SEQ ID NO: 2250625 - RNA, 22 nt, Yersinia pestis
cguuacccccuucaccaauaca

SEQ ID NO: 2250626 - RNA, 16 nt, Yersinia pestis
cguuacccacauuaaa

SEQ ID NO: 2250627 - RNA, 17 nt, Yersinia pestis
cguucuaucaaugccuu

SEQ ID NO: 2250628 - RNA, 16 nt, Yersinia pestis
cguucguuuacugccu

SEQ ID NO: 2250629 - RNA, 18 nt, Yersinia pestis
cguucguuuacugccuug

SEQ ID NO: 2250630 - RNA, 15 nt, Yersinia pestis
cguucagcaauauga

SEQ ID NO: 2250631 - RNA, 23 nt, Yersinia pestis
cguucaacaguaucaaccaccgc

SEQ ID NO: 2250632 - RNA, 17 nt, Yersinia pestis
cguucaagagugaguca

SEQ ID NO: 2250633 - RNA, 13 nt, Yersinia pestis
cugacgcagcagg

SEQ ID NO: 2250634 - RNA, 13 nt, Yersinia pestis
cugacgaugacuc

SEQ ID NO: 2250635 - RNA, 18 nt, Yersinia pestis
cugacgaugauaaaucag

SEQ ID NO: 2250636 - RNA, 16 nt, Yersinia pestis
cugacggguauaucac

SEQ ID NO: 2250637 - RNA, 15 nt, Yersinia pestis
cugacuguggcugcu

SEQ ID NO: 2250638 - RNA, 14 nt, Yersinia pestis
cugacuguuuugcu

SEQ ID NO: 2250639 - RNA, 17 nt, Yersinia pestis
cugacguaguguauuca

SEQ ID NO: 2250640 - RNA, 19 nt, Yersinia pestis
cugacaggcucuuuauacu

SEQ ID NO: 2250641 - RNA, 22 nt, Yersinia pestis
cugacauuauuggcguaacugc

SEQ ID NO: 2250642 - RNA, 12 nt, Yersinia pestis
cugacaucauca

SEQ ID NO: 2250643 - RNA, 22 nt, Yersinia pestis
cugaccgauaaacgccagucag

SEQ ID NO: 2250644 - RNA, 18 nt, Yersinia pestis
cugaccggaagcaaucag

SEQ ID NO: 2250645 - RNA, 18 nt, Yersinia pestis
cugaauaucaucuuuuuc

SEQ ID NO: 2250646 - RNA, 16 nt, Yersinia pestis
cugaauauaaauuuaa

SEQ ID NO: 2250647 - RNA, 18 nt, Yersinia pestis
cugaauauaaauuuaaua

SEQ ID NO: 2250648 - RNA, 19 nt, Yersinia pestis
cugaauauaaauuuaauaa

SEQ ID NO: 2250649 - RNA, 20 nt, Yersinia pestis
cugaauauaaauuuaauaaa

SEQ ID NO: 2250650 - RNA, 15 nt, Yersinia pestis
cugaaucgauaaacc

SEQ ID NO: 2250651 - RNA, 17 nt, Yersinia pestis
cugaaucguacuucuua

SEQ ID NO: 2250652 - RNA, 18 nt, Yersinia pestis
cugaaucuguaagucauu

SEQ ID NO: 2250653 - RNA, 15 nt, Yersinia pestis
cugaaugccauucaa

SEQ ID NO: 2250654 - RNA, 16 nt, Yersinia pestis
cugaauggaucacauc

SEQ ID NO: 2250655 - RNA, 19 nt, Yersinia pestis
cugaauuggaagagccuga

SEQ ID NO: 2250656 - RNA, 18 nt, Yersinia pestis
cugaauugauuuauuccu

SEQ ID NO: 2250657 - RNA, 16 nt, Yersinia pestis
cugaauugauuuauuc

SEQ ID NO: 2250658 - RNA, 15 nt, Yersinia pestis
cugaaugucucuggc

SEQ ID NO: 2250659 - RNA, 12 nt, Yersinia pestis
cucuacuuucua

SEQ ID NO: 2250660 - RNA, 20 nt, Yersinia pestis
cucuagaccugaggauaaaa

SEQ ID NO: 2250661 - RNA, 17 nt, Yersinia pestis
cucuacauugacuaauu

SEQ ID NO: 2250662 - RNA, 21 nt, Yersinia pestis
cugaauaggggaauuuuuagc

SEQ ID NO: 2250663 - RNA, 14 nt, Yersinia pestis
cugaauaccauaac

SEQ ID NO: 2250664 - RNA, 23 nt, Yersinia pestis
cugaauaaaaaauuauuaaauaa

SEQ ID NO: 2250665 - RNA, 16 nt, Yersinia pestis
cugaauaaacggcaag

SEQ ID NO: 2250666 - RNA, 19 nt, Yersinia pestis
cugauucgcgaccagcaga

SEQ ID NO: 2250667 - RNA, 14 nt, Yersinia pestis
cugauucacuggca

SEQ ID NO: 2250668 - RNA, 17 nt, Yersinia pestis
cugauucagauuuacuc

SEQ ID NO: 2250669 - RNA, 22 nt, Yersinia pestis
cugauucaacacggugaauaaa

SEQ ID NO: 2250670 - RNA, 19 nt, Yersinia pestis
cugauguuuugcugccauu

SEQ ID NO: 2250671 - RNA, 11 nt, Yersinia pestis
cugauuaauag

SEQ ID NO: 2250672 - RNA, 15 nt, Yersinia pestis
cugauuaauauccaa

SEQ ID NO: 2250673 - RNA, 21 nt, Yersinia pestis
cugaugucaucaagugaacca

SEQ ID NO: 2250674 - RNA, 18 nt, Yersinia pestis
cugaugucagugcuccau

SEQ ID NO: 2250675 - RNA, 16 nt, Yersinia pestis
cugauguguauauuuu

SEQ ID NO: 2250676 - RNA, 16 nt, Yersinia pestis
cugauguucgcuggug

SEQ ID NO: 2250677 - RNA, 14 nt, Yersinia pestis
cugauggucaugga

SEQ ID NO: 2250678 - RNA, 14 nt, Yersinia pestis
cugaugcuuuucuu

SEQ ID NO: 2250679 - RNA, 21 nt, Yersinia pestis
cugaugacgccguacaaauau

SEQ ID NO: 2250680 - RNA, 23 nt, Yersinia pestis
cugaugacgccguacaaauauaa

SEQ ID NO: 2250681 - RNA, 12 nt, Yersinia pestis
cugaugagaggg

SEQ ID NO: 2250682 - RNA, 14 nt, Yersinia pestis
cugauagccaauaa

SEQ ID NO: 2250683 - RNA, 22 nt, Yersinia pestis
cugauauaacaaguuacauuuu

SEQ ID NO: 2250684 - RNA, 15 nt, Yersinia pestis
cugauaucucuuuau

SEQ ID NO: 2250685 - RNA, 14 nt, Yersinia pestis
cugaugaaaaaguc

SEQ ID NO: 2250686 - RNA, 15 nt, Yersinia pestis
cugagcgggcggcaa

SEQ ID NO: 2250687 - RNA, 22 nt, Yersinia pestis
cugagcguccgucauccaauga

SEQ ID NO: 2250688 - RNA, 22 nt, Yersinia pestis
cugagcgaucaauacaccagac

SEQ ID NO: 2250689 - RNA, 14 nt, Yersinia pestis
cugagcgaucaaua

SEQ ID NO: 2250690 - RNA, 21 nt, Yersinia pestis
cugagcgaucaauacaccaga

SEQ ID NO: 2250691 - RNA, 19 nt, Yersinia pestis
cugagccucaugaaugagg

SEQ ID NO: 2250692 - RNA, 15 nt, Yersinia pestis
cugagcgaacugaau

SEQ ID NO: 2250693 - RNA, 21 nt, Yersinia pestis
cugagcgacauuucggccacc

SEQ ID NO: 2250694 - RNA, 15 nt, Yersinia pestis
cugaggauaaaaacu

SEQ ID NO: 2250695 - RNA, 21 nt, Yersinia pestis
cugagcuguaaauauaaaaua

SEQ ID NO: 2250696 - RNA, 19 nt, Yersinia pestis
cugaguaaauuaaauuuua

SEQ ID NO: 2250697 - RNA, 21 nt, Yersinia pestis
cugaggguuagcgaugacuga

SEQ ID NO: 2250698 - RNA, 14 nt, Yersinia pestis
cugagguuccacuc

SEQ ID NO: 2250699 - RNA, 23 nt, Yersinia pestis
cugagguucccaacggcagaagu

SEQ ID NO: 2250700 - RNA, 23 nt, Yersinia pestis
cugauaaaauuaccgccccuguu

SEQ ID NO: 2250701 - RNA, 12 nt, Yersinia pestis
cugaguaauauu

SEQ ID NO: 2250702 - RNA, 16 nt, Yersinia pestis
cugaguaauauuauuc

SEQ ID NO: 2250703 - RNA, 18 nt, Yersinia pestis
cugauaaggagagaggcc

SEQ ID NO: 2250704 - RNA, 22 nt, Yersinia pestis
cugauaaaccgcuauaucauca

SEQ ID NO: 2250705 - RNA, 15 nt, Yersinia pestis
cugcauagcuaaccu

SEQ ID NO: 2250706 - RNA, 18 nt, Yersinia pestis
cugcauagcuaaccuuaa

SEQ ID NO: 2250707 - RNA, 17 nt, Yersinia pestis
cugcagaaucacuggca

SEQ ID NO: 2250708 - RNA, 21 nt, Yersinia pestis
cugcagaaaaugcggcggcug

SEQ ID NO: 2250709 - RNA, 20 nt, Yersinia pestis
cugcagcgauauacaucacg

SEQ ID NO: 2250710 - RNA, 17 nt, Yersinia pestis
cugcaccuaacaaacgu

SEQ ID NO: 2250711 - RNA, 20 nt, Yersinia pestis
cugcaccucugcugauguca

SEQ ID NO: 2250712 - RNA, 13 nt, Yersinia pestis
cugcaccacgccg

SEQ ID NO: 2250713 - RNA, 16 nt, Yersinia pestis
cugcaccacgccgaac

SEQ ID NO: 2250714 - RNA, 18 nt, Yersinia pestis
cugcaccaaugacuaauu

SEQ ID NO: 2250715 - RNA, 13 nt, Yersinia pestis
cugcaccagugcc

SEQ ID NO: 2250716 - RNA, 14 nt, Yersinia pestis
cugcacaucaagua

SEQ ID NO: 2250717 - RNA, 13 nt, Yersinia pestis
cugauuuuuauca

SEQ ID NO: 2250718 - RNA, 19 nt, Yersinia pestis
cugauuuuuuguucuuaau

SEQ ID NO: 2250719 - RNA, 19 nt, Yersinia pestis
cugcaaauuaaccugcugg

SEQ ID NO: 2250720 - RNA, 20 nt, Yersinia pestis
cugccgucuaucugccagau

SEQ ID NO: 2250721 - RNA, 20 nt, Yersinia pestis
cugccggcguuaaugccacc

SEQ ID NO: 2250722 - RNA, 17 nt, Yersinia pestis
cugccgaaccuuuugcc

SEQ ID NO: 2250723 - RNA, 19 nt, Yersinia pestis
cugccgcgccagauucuag

SEQ ID NO: 2250724 - RNA, 14 nt, Yersinia pestis
cugccgccucugcu

SEQ ID NO: 2250725 - RNA, 15 nt, Yersinia pestis
cugcccaagaauaau

SEQ ID NO: 2250726 - RNA, 14 nt, Yersinia pestis
cugcccaaaaucaa

SEQ ID NO: 2250727 - RNA, 12 nt, Yersinia pestis
cugcccaauucg

SEQ ID NO: 2250728 - RNA, 23 nt, Yersinia pestis
cugcccacagggugagucucagg

SEQ ID NO: 2250729 - RNA, 13 nt, Yersinia pestis
cugccauugcuca

SEQ ID NO: 2250730 - RNA, 21 nt, Yersinia pestis
cugcccccccgaugacacgau

SEQ ID NO: 2250731 - RNA, 22 nt, Yersinia pestis
cugcccccccggguggcgcuga

SEQ ID NO: 2250732 - RNA, 15 nt, Yersinia pestis
cugcccccccuuuca

SEQ ID NO: 2250733 - RNA, 19 nt, Yersinia pestis
cugcccccccuuucaccaa

SEQ ID NO: 2250734 - RNA, 18 nt, Yersinia pestis
cugccccgaagcucaagc

SEQ ID NO: 2250735 - RNA, 21 nt, Yersinia pestis
cugccccgaagcucaagcugg

SEQ ID NO: 2250736 - RNA, 16 nt, Yersinia pestis
cugccccucuuuucuu

SEQ ID NO: 2250737 - RNA, 20 nt, Yersinia pestis
cugcaucagcagugacguca

SEQ ID NO: 2250738 - RNA, 15 nt, Yersinia pestis
cugcaucaagccgcu

SEQ ID NO: 2250739 - RNA, 18 nt, Yersinia pestis
cugccaccgucgcagaac

SEQ ID NO: 2250740 - RNA, 21 nt, Yersinia pestis
cugccaccgucgcagaaccca

SEQ ID NO: 2250741 - RNA, 22 nt, Yersinia pestis
cugccaguaaaaucaucagccu

SEQ ID NO: 2250742 - RNA, 18 nt, Yersinia pestis
cugccaggcgacaugguc

SEQ ID NO: 2250743 - RNA, 13 nt, Yersinia pestis
aaacuauucugcu

SEQ ID NO: 2250744 - RNA, 15 nt, Yersinia pestis
cugcugacaaacccc

SEQ ID NO: 2250745 - RNA, 22 nt, Yersinia pestis
cugcuaccaggaagcggccagg

SEQ ID NO: 2250746 - RNA, 15 nt, Yersinia pestis
cugcucauaaagcau

SEQ ID NO: 2250747 - RNA, 19 nt, Yersinia pestis
cugcuccaaagcuuccaau

SEQ ID NO: 2250748 - RNA, 23 nt, Yersinia pestis
cugcucccguaaacguucugcca

SEQ ID NO: 2250749 - RNA, 15 nt, Yersinia pestis
cugcucgcccaagcg

SEQ ID NO: 2250750 - RNA, 22 nt, Yersinia pestis
cugcgugaaacgauaugcucca

SEQ ID NO: 2250751 - RNA, 18 nt, Yersinia pestis
cugcgaccaaaagccacc

SEQ ID NO: 2250752 - RNA, 15 nt, Yersinia pestis
cugcgaccaaggcuc

SEQ ID NO: 2250753 - RNA, 22 nt, Yersinia pestis
cugcgaccaaggcucuggcaau

SEQ ID NO: 2250754 - RNA, 17 nt, Yersinia pestis
cugcggcaagcugugcc

SEQ ID NO: 2250755 - RNA, 13 nt, Yersinia pestis
cugcggcaauaag

SEQ ID NO: 2250756 - RNA, 20 nt, Yersinia pestis
cugcgagcguuuaaauaccc

SEQ ID NO: 2250757 - RNA, 20 nt, Yersinia pestis
cugcugugucgcuauuuccg

SEQ ID NO: 2250758 - RNA, 21 nt, Yersinia pestis
cugcugugucgcuauuuccga

SEQ ID NO: 2250759 - RNA, 18 nt, Yersinia pestis
cugcuguggcacuaucug

SEQ ID NO: 2250760 - RNA, 15 nt, Yersinia pestis
cugcugguuuuacug

SEQ ID NO: 2250761 - RNA, 17 nt, Yersinia pestis
cuggauauauuuacaaa

SEQ ID NO: 2250762 - RNA, 11 nt, Yersinia pestis
cuggauaaacu

SEQ ID NO: 2250763 - RNA, 19 nt, Yersinia pestis
cuggauauucauauuucuu

SEQ ID NO: 2250764 - RNA, 16 nt, Yersinia pestis
cuggcaauggcuagcu

SEQ ID NO: 2250765 - RNA, 16 nt, Yersinia pestis
cuggcacccgaagagu

SEQ ID NO: 2250766 - RNA, 14 nt, Yersinia pestis
cuggagcuucuggc

SEQ ID NO: 2250767 - RNA, 16 nt, Yersinia pestis
cuggagcuauggaaga

SEQ ID NO: 2250768 - RNA, 15 nt, Yersinia pestis
cuggaggcuggcagg

SEQ ID NO: 2250769 - RNA, 17 nt, Yersinia pestis
cuggaauccaaguucaa

SEQ ID NO: 2250770 - RNA, 22 nt, Yersinia pestis
cuggaagccgacgaucuugccc

SEQ ID NO: 2250771 - RNA, 15 nt, Yersinia pestis
cuggcuucuuuuucg

SEQ ID NO: 2250772 - RNA, 22 nt, Yersinia pestis
cuggcuggcauauuucucuuuc

SEQ ID NO: 2250773 - RNA, 22 nt, Yersinia pestis
cuggcuggcccaaugcugucac

SEQ ID NO: 2250774 - RNA, 24 nt, Yersinia pestis
cuggcuuuuucacacgcccaggcc

SEQ ID NO: 2250775 - RNA, 13 nt, Yersinia pestis
cuggcuuucgcuu

SEQ ID NO: 2250776 - RNA, 17 nt, Yersinia pestis
cugggauccauaggauc

SEQ ID NO: 2250777 - RNA, 15 nt, Yersinia pestis
cugggcacaacaagc

SEQ ID NO: 2250778 - RNA, 19 nt, Yersinia pestis
cugggcacaacaagcggcc

SEQ ID NO: 2250779 - RNA, 15 nt, Yersinia pestis
cugggcgacccaaag

SEQ ID NO: 2250780 - RNA, 22 nt, Yersinia pestis
cugggccgcuggcgauccccuu

SEQ ID NO: 2250781 - RNA, 20 nt, Yersinia pestis
cugggccacgaugugaagca

SEQ ID NO: 2250782 - RNA, 14 nt, Yersinia pestis
cuggcucuauuuuc

SEQ ID NO: 2250783 - RNA, 15 nt, Yersinia pestis
cuggcucugcgacca

SEQ ID NO: 2250784 - RNA, 20 nt, Yersinia pestis
cuggcucugcgaccaaggcu

SEQ ID NO: 2250785 - RNA, 19 nt, Yersinia pestis
cuggcugaaauaguuaucc

SEQ ID NO: 2250786 - RNA, 18 nt, Yersinia pestis
cuggcuaacguggccuua

SEQ ID NO: 2250787 - RNA, 16 nt, Yersinia pestis
cuggcuaauuuuauua

SEQ ID NO: 2250788 - RNA, 15 nt, Yersinia pestis
cuggcuauccugaaa

SEQ ID NO: 2250789 - RNA, 22 nt, Yersinia pestis
aaacuccuuggaacuuacuccc

SEQ ID NO: 2250790 - RNA, 20 nt, Yersinia pestis
aaacucggccgggcugacau

SEQ ID NO: 2250791 - RNA, 19 nt, Yersinia pestis
aaacucaugacaucccagc

SEQ ID NO: 2250792 - RNA, 11 nt, Yersinia pestis
cuggcagccgg

SEQ ID NO: 2250793 - RNA, 17 nt, Yersinia pestis
cuggcacuggcaauaaa

SEQ ID NO: 2250794 - RNA, 16 nt, Yersinia pestis
cuggccugagaaccca

SEQ ID NO: 2250795 - RNA, 14 nt, Yersinia pestis
cuggccuauuaaga

SEQ ID NO: 2250796 - RNA, 19 nt, Yersinia pestis
cuggccuggcauuuuacug

SEQ ID NO: 2250797 - RNA, 22 nt, Yersinia pestis
aaacucacgguuucuaaaaaau

SEQ ID NO: 2250798 - RNA, 18 nt, Yersinia pestis
aaacucagccaauccagc

SEQ ID NO: 2250799 - RNA, 17 nt, Yersinia pestis
aaacucagcgaauaaau

SEQ ID NO: 2250800 - RNA, 14 nt, Yersinia pestis
cuggcggaagcacg

SEQ ID NO: 2250801 - RNA, 14 nt, Yersinia pestis
cuggcgcaggguca

SEQ ID NO: 2250802 - RNA, 14 nt, Yersinia pestis
cuggcgcgcuuugg

SEQ ID NO: 2250803 - RNA, 23 nt, Yersinia pestis
cuggcgauccagugaaaucauca

SEQ ID NO: 2250804 - RNA, 14 nt, Yersinia pestis
cuggcgcaaagacu

SEQ ID NO: 2250805 - RNA, 15 nt, Yersinia pestis
cuggcgcagaguauc

SEQ ID NO: 2250806 - RNA, 17 nt, Yersinia pestis
cuguucaucgcaauuca

SEQ ID NO: 2250807 - RNA, 16 nt, Yersinia pestis
cuguuaccaaacauuu

SEQ ID NO: 2250808 - RNA, 22 nt, Yersinia pestis
cuguucagauuuaccaugucca

SEQ ID NO: 2250809 - RNA, 13 nt, Yersinia pestis
cuguuccaaccaa

SEQ ID NO: 2250810 - RNA, 15 nt, Yersinia pestis
cuguuccaacgagug

SEQ ID NO: 2250811 - RNA, 12 nt, Yersinia pestis
cuguuccaggca

SEQ ID NO: 2250812 - RNA, 19 nt, Yersinia pestis
cuguuacaucagagcucaa

SEQ ID NO: 2250813 - RNA, 14 nt, Yersinia pestis
cuguucagaugauc

SEQ ID NO: 2250814 - RNA, 15 nt, Yersinia pestis
cuguuaccaaacauu

SEQ ID NO: 2250815 - RNA, 16 nt, Yersinia pestis
cuguucucucccguug

SEQ ID NO: 2250816 - RNA, 15 nt, Yersinia pestis
cuguugaucugaguu

SEQ ID NO: 2250817 - RNA, 15 nt, Yersinia pestis
cuguugaugaguaaa

SEQ ID NO: 2250818 - RNA, 14 nt, Yersinia pestis
cugugguggcgguc

SEQ ID NO: 2250819 - RNA, 17 nt, Yersinia pestis
cugugucgcuauuuccg

SEQ ID NO: 2250820 - RNA, 13 nt, Yersinia pestis
cuguuaacucaug

SEQ ID NO: 2250821 - RNA, 19 nt, Yersinia pestis
cuguguuuugagcaucacu

SEQ ID NO: 2250822 - RNA, 16 nt, Yersinia pestis
cuuaacuacaccgcua

SEQ ID NO: 2250823 - RNA, 18 nt, Yersinia pestis
cuuaacgguaugacgggu

SEQ ID NO: 2250824 - RNA, 13 nt, Yersinia pestis
cuuaacugcauag

SEQ ID NO: 2250825 - RNA, 14 nt, Yersinia pestis
aaacugugcaaaug

SEQ ID NO: 2250826 - RNA, 17 nt, Yersinia pestis
cuuaaaauacugccaau

SEQ ID NO: 2250827 - RNA, 17 nt, Yersinia pestis
cuuaaaauauggcaggu

SEQ ID NO: 2250828 - RNA, 14 nt, Yersinia pestis
cuguugcuggccag

SEQ ID NO: 2250829 - RNA, 15 nt, Yersinia pestis
cuguugccacagacg

SEQ ID NO: 2250830 - RNA, 20 nt, Yersinia pestis
cuguuggugguggccuguga

SEQ ID NO: 2250831 - RNA, 16 nt, Yersinia pestis
cuguuugcuguaaaca

SEQ ID NO: 2250832 - RNA, 19 nt, Yersinia pestis
cuuaugagcagcccagucu

SEQ ID NO: 2250833 - RNA, 16 nt, Yersinia pestis
cuuauuaugacaacug

SEQ ID NO: 2250834 - RNA, 17 nt, Yersinia pestis
cuuauaggcgcauauga

SEQ ID NO: 2250835 - RNA, 20 nt, Yersinia pestis
cuuauaggcgcauaugaaaa

SEQ ID NO: 2250836 - RNA, 21 nt, Yersinia pestis
cuuauaggcgcauaugaaaaa

SEQ ID NO: 2250837 - RNA, 20 nt, Yersinia pestis
cuuaucagcgguaucuagag

SEQ ID NO: 2250838 - RNA, 14 nt, Yersinia pestis
cuuauccacagcau

SEQ ID NO: 2250839 - RNA, 23 nt, Yersinia pestis
cuuacuuuuuacggcuuaucaau

SEQ ID NO: 2250840 - RNA, 15 nt, Yersinia pestis
cuuacuuuuuacggc

SEQ ID NO: 2250841 - RNA, 22 nt, Yersinia pestis
cuuagucgccagaagaaaauca

SEQ ID NO: 2250842 - RNA, 15 nt, Yersinia pestis
cuuagucauuaagaa

SEQ ID NO: 2250843 - RNA, 23 nt, Yersinia pestis
cuuaguuacaauaaaucaauucu

SEQ ID NO: 2250844 - RNA, 15 nt, Yersinia pestis
cuuaguuggugcuuu

SEQ ID NO: 2250845 - RNA, 14 nt, Yersinia pestis
cuuaguuucuacgg

SEQ ID NO: 2250846 - RNA, 18 nt, Yersinia pestis
cuuauacuaaagaaauaa

SEQ ID NO: 2250847 - RNA, 18 nt, Yersinia pestis
cuuacuaaaauaucacua

SEQ ID NO: 2250848 - RNA, 16 nt, Yersinia pestis
cuuacuaaaauaucac

SEQ ID NO: 2250849 - RNA, 15 nt, Yersinia pestis
cuuacuucacuucca

SEQ ID NO: 2250850 - RNA, 23 nt, Yersinia pestis
cuuacguuuugagguuuuaccaa

SEQ ID NO: 2250851 - RNA, 18 nt, Yersinia pestis
cuuacggugauacaucuc

SEQ ID NO: 2250852 - RNA, 22 nt, Yersinia pestis
cuuaauuggcggaagacuucca

SEQ ID NO: 2250853 - RNA, 23 nt, Yersinia pestis
cuuaauuggcggaagacuuccag

SEQ ID NO: 2250854 - RNA, 18 nt, Yersinia pestis
cuuaauuuggcuauugag

SEQ ID NO: 2250855 - RNA, 13 nt, Yersinia pestis
cuuaauuuuauca

SEQ ID NO: 2250856 - RNA, 11 nt, Yersinia pestis
cuuaauuuuau

SEQ ID NO: 2250857 - RNA, 12 nt, Yersinia pestis
cuuaauaaugac

SEQ ID NO: 2250858 - RNA, 15 nt, Yersinia pestis
cuuaauaauaucaaa

SEQ ID NO: 2250859 - RNA, 10 nt, Yersinia pestis
cuuaauaaua

SEQ ID NO: 2250860 - RNA, 16 nt, Yersinia pestis
cuucaucuacagacuc

SEQ ID NO: 2250861 - RNA, 14 nt, Yersinia pestis
cuuccaaaggaagg

SEQ ID NO: 2250862 - RNA, 16 nt, Yersinia pestis
cuucaucuuucaagug

SEQ ID NO: 2250863 - RNA, 17 nt, Yersinia pestis
cuucaugacgaaaaaca

SEQ ID NO: 2250864 - RNA, 16 nt, Yersinia pestis
cuucacuuuuaaaacu

SEQ ID NO: 2250865 - RNA, 20 nt, Yersinia pestis
cuucacuugcaugccuggcu

SEQ ID NO: 2250866 - RNA, 13 nt, Yersinia pestis
cuucacuucuggg

SEQ ID NO: 2250867 - RNA, 14 nt, Yersinia pestis
cuucacuucugggg

SEQ ID NO: 2250868 - RNA, 22 nt, Yersinia pestis
cuucagacaguaaauccugaug

SEQ ID NO: 2250869 - RNA, 15 nt, Yersinia pestis
cuucagcccauggcu

SEQ ID NO: 2250870 - RNA, 18 nt, Yersinia pestis
cuucagccuauccucacc

SEQ ID NO: 2250871 - RNA, 18 nt, Yersinia pestis
cuucauaucggccaaguu

SEQ ID NO: 2250872 - RNA, 20 nt, Yersinia pestis
cuucauaucggccaaguuua

SEQ ID NO: 2250873 - RNA, 20 nt, Yersinia pestis
cuucauauauugcauuuaug

SEQ ID NO: 2250874 - RNA, 13 nt, Yersinia pestis
cuucagcgguggc

SEQ ID NO: 2250875 - RNA, 13 nt, Yersinia pestis
cuucaagcugccu

SEQ ID NO: 2250876 - RNA, 14 nt, Yersinia pestis
cuucaagguacuga

SEQ ID NO: 2250877 - RNA, 14 nt, Yersinia pestis
cuucaauaauuuuu

SEQ ID NO: 2250878 - RNA, 17 nt, Yersinia pestis
cuucaauaccaaauuua

SEQ ID NO: 2250879 - RNA, 17 nt, Yersinia pestis
cuucaaguugucuguag

SEQ ID NO: 2250880 - RNA, 21 nt, Yersinia pestis
cuucaaagaagacaucuggcu

SEQ ID NO: 2250881 - RNA, 23 nt, Yersinia pestis
cuuauucuaauugauauuauuua

SEQ ID NO: 2250882 - RNA, 21 nt, Yersinia pestis
cuuauucccacuuauuauaaa

SEQ ID NO: 2250883 - RNA, 14 nt, Yersinia pestis
cuucaauuuugugg

SEQ ID NO: 2250884 - RNA, 16 nt, Yersinia pestis
cuucaauuuccaucug

SEQ ID NO: 2250885 - RNA, 14 nt, Yersinia pestis
cuucaauaccuugc

SEQ ID NO: 2250886 - RNA, 12 nt, Yersinia pestis
cuucacaucaua

SEQ ID NO: 2250887 - RNA, 16 nt, Yersinia pestis
cuucaccgcuuuucug

SEQ ID NO: 2250888 - RNA, 19 nt, Yersinia pestis
cuucaccgcuuuucuggua

SEQ ID NO: 2250889 - RNA, 18 nt, Yersinia pestis
cuucacuuccauaccuuu

SEQ ID NO: 2250890 - RNA, 17 nt, Yersinia pestis
aaacuuaucuaaaaaac

SEQ ID NO: 2250891 - RNA, 13 nt, Yersinia pestis
cuuccaacucauu

SEQ ID NO: 2250892 - RNA, 14 nt, Yersinia pestis
cuuccaacucauua

SEQ ID NO: 2250893 - RNA, 22 nt, Yersinia pestis
cuuccaauguugccgcuucaua

SEQ ID NO: 2250894 - RNA, 14 nt, Yersinia pestis
cuuccaauucauaa

SEQ ID NO: 2250895 - RNA, 12 nt, Yersinia pestis
cuuccaauuucu

SEQ ID NO: 2250896 - RNA, 22 nt, Yersinia pestis
cuuccaauuggugcuuuaugua

SEQ ID NO: 2250897 - RNA, 23 nt, Yersinia pestis
cuuccacacaaacgcauucauau

SEQ ID NO: 2250898 - RNA, 14 nt, Yersinia pestis
cuuccagcaucagu

SEQ ID NO: 2250899 - RNA, 22 nt, Yersinia pestis
cuuccaucgucagaaccugcau

SEQ ID NO: 2250900 - RNA, 23 nt, Yersinia pestis
cuuccaugacacauauuucaggc

SEQ ID NO: 2250901 - RNA, 22 nt, Yersinia pestis
cuuccauugauggccuugaauc

SEQ ID NO: 2250902 - RNA, 13 nt, Yersinia pestis
cuuccaucaggaa

SEQ ID NO: 2250903 - RNA, 14 nt, Yersinia pestis
cuuccaucaggaag

SEQ ID NO: 2250904 - RNA, 15 nt, Yersinia pestis
cuuccagcgcccggc

SEQ ID NO: 2250905 - RNA, 23 nt, Yersinia pestis
cuuccagcgcccggcugaccugu

SEQ ID NO: 2250906 - RNA, 22 nt, Yersinia pestis
cuucccacggguugccauuaau

SEQ ID NO: 2250907 - RNA, 18 nt, Yersinia pestis
cuucccauagacggcgaa

SEQ ID NO: 2250908 - RNA, 19 nt, Yersinia pestis
cuucgaaacugaucacugg

SEQ ID NO: 2250909 - RNA, 21 nt, Yersinia pestis
cuucgaaagaaauaaaagaaa

SEQ ID NO: 2250910 - RNA, 15 nt, Yersinia pestis
cuucgaucauucuag

SEQ ID NO: 2250911 - RNA, 16 nt, Yersinia pestis
cuucgaucauucuagc

SEQ ID NO: 2250912 - RNA, 14 nt, Yersinia pestis
cuucgcauucuuua

SEQ ID NO: 2250913 - RNA, 23 nt, Yersinia pestis
cuucgccauuuccaucaucucug

SEQ ID NO: 2250914 - RNA, 21 nt, Yersinia pestis
cuucgccaggucaggaagaga

SEQ ID NO: 2250915 - RNA, 20 nt, Yersinia pestis
cuuccuuuuuaugccauaaa

SEQ ID NO: 2250916 - RNA, 19 nt, Yersinia pestis
cuuccuuugcccuuacuau

SEQ ID NO: 2250917 - RNA, 13 nt, Yersinia pestis
cuuccgccgccaa

SEQ ID NO: 2250918 - RNA, 22 nt, Yersinia pestis
cuuccucgccguagcauucauu

SEQ ID NO: 2250919 - RNA, 13 nt, Yersinia pestis
cugguuuuuuaaa

SEQ ID NO: 2250920 - RNA, 22 nt, Yersinia pestis
cugguugugagguuagaaaaca

SEQ ID NO: 2250921 - RNA, 15 nt, Yersinia pestis
cugguugugcuucag

SEQ ID NO: 2250922 - RNA, 21 nt, Yersinia pestis
cugguuggcggcuuaguauua

SEQ ID NO: 2250923 - RNA, 14 nt, Yersinia pestis
cugguugcuguucu

SEQ ID NO: 2250924 - RNA, 14 nt, Yersinia pestis
cugguuggauuggu

SEQ ID NO: 2250925 - RNA, 12 nt, Yersinia pestis
cugguugcuuca

SEQ ID NO: 2250926 - RNA, 15 nt, Yersinia pestis
cugguugcuucauca

SEQ ID NO: 2250927 - RNA, 16 nt, Yersinia pestis
cuggugugagcgagga

SEQ ID NO: 2250928 - RNA, 11 nt, Yersinia pestis
cuggugucaau

SEQ ID NO: 2250929 - RNA, 23 nt, Yersinia pestis
cuggugucacaaucucuggcaac

SEQ ID NO: 2250930 - RNA, 16 nt, Yersinia pestis
cuggugguuuuguuaa

SEQ ID NO: 2250931 - RNA, 20 nt, Yersinia pestis
cuggugguuuuguuaauauu

SEQ ID NO: 2250932 - RNA, 13 nt, Yersinia pestis
cugguggcugaga

SEQ ID NO: 2250933 - RNA, 18 nt, Yersinia pestis
cuggugcuggugaauggu

SEQ ID NO: 2250934 - RNA, 19 nt, Yersinia pestis
cuggugcggaacagcgccc

SEQ ID NO: 2250935 - RNA, 16 nt, Yersinia pestis
cuguaaaaaucaccuc

SEQ ID NO: 2250936 - RNA, 12 nt, Yersinia pestis
cuguaaaacaag

SEQ ID NO: 2250937 - RNA, 13 nt, Yersinia pestis
cuguaaaaucuuu

SEQ ID NO: 2250938 - RNA, 14 nt, Yersinia pestis
cuguaaaggcaaag

SEQ ID NO: 2250939 - RNA, 13 nt, Yersinia pestis
cuguaaucaccag

SEQ ID NO: 2250940 - RNA, 16 nt, Yersinia pestis
cuguaaggcccgcagu

SEQ ID NO: 2250941 - RNA, 15 nt, Yersinia pestis
cuguaaccgcaagga

SEQ ID NO: 2250942 - RNA, 16 nt, Yersinia pestis
cuguaccugacccgca

SEQ ID NO: 2250943 - RNA, 13 nt, Yersinia pestis
cuguaauccggca

SEQ ID NO: 2250944 - RNA, 19 nt, Yersinia pestis
cuguaaucuuggcacucga

SEQ ID NO: 2250945 - RNA, 17 nt, Yersinia pestis
cuguaauugcgucaggg

SEQ ID NO: 2250946 - RNA, 19 nt, Yersinia pestis
cuguaauugcgucagggca

SEQ ID NO: 2250947 - RNA, 16 nt, Yersinia pestis
cuguacauaaauuugu

SEQ ID NO: 2250948 - RNA, 17 nt, Yersinia pestis
cugguagcugcucacga

SEQ ID NO: 2250949 - RNA, 21 nt, Yersinia pestis
cugguaccaaacaacaacaca

SEQ ID NO: 2250950 - RNA, 18 nt, Yersinia pestis
cugguaguuuugcauaau

SEQ ID NO: 2250951 - RNA, 21 nt, Yersinia pestis
cugguagucauauucaggcug

SEQ ID NO: 2250952 - RNA, 21 nt, Yersinia pestis
cuggucacuaaaacugaagca

SEQ ID NO: 2250953 - RNA, 18 nt, Yersinia pestis
cugguccaacuaaacagg

SEQ ID NO: 2250954 - RNA, 16 nt, Yersinia pestis
cuggucgcacccaaac

SEQ ID NO: 2250955 - RNA, 22 nt, Yersinia pestis
cuggugacccgucagcguccug

SEQ ID NO: 2250956 - RNA, 13 nt, Yersinia pestis
cuggugacccuca

SEQ ID NO: 2250957 - RNA, 19 nt, Yersinia pestis
cuggugacuaaauuaaccc

SEQ ID NO: 2250958 - RNA, 14 nt, Yersinia pestis
cuggucucaagguc

SEQ ID NO: 2250959 - RNA, 21 nt, Yersinia pestis
cuggucugccagaauuuugca

SEQ ID NO: 2250960 - RNA, 20 nt, Yersinia pestis
cuggucgggugcaggccauu

SEQ ID NO: 2250961 - RNA, 16 nt, Yersinia pestis
cuggguacaacacaaa

SEQ ID NO: 2250962 - RNA, 18 nt, Yersinia pestis
cuggggucaucaacgcac

SEQ ID NO: 2250963 - RNA, 19 nt, Yersinia pestis
cugggguaucgauuuccau

SEQ ID NO: 2250964 - RNA, 20 nt, Yersinia pestis
cugggucgugagucaggugg

SEQ ID NO: 2250965 - RNA, 21 nt, Yersinia pestis
cugggucgugagucagguggc

SEQ ID NO: 2250966 - RNA, 22 nt, Yersinia pestis
cugggucaucacccagcaaaau

SEQ ID NO: 2250967 - RNA, 17 nt, Yersinia pestis
cugguaacagagccuua

SEQ ID NO: 2250968 - RNA, 13 nt, Yersinia pestis
cugucuuauuuuu

SEQ ID NO: 2250969 - RNA, 12 nt, Yersinia pestis
cugucuguuacc

SEQ ID NO: 2250970 - RNA, 16 nt, Yersinia pestis
cugucugcuguugcca

SEQ ID NO: 2250971 - RNA, 15 nt, Yersinia pestis
cugucugaugauuug

SEQ ID NO: 2250972 - RNA, 19 nt, Yersinia pestis
cugucuaggguuauuuuau

SEQ ID NO: 2250973 - RNA, 17 nt, Yersinia pestis
cuguccuuuaacucaau

SEQ ID NO: 2250974 - RNA, 19 nt, Yersinia pestis
cugucgauaauaaauugcg

SEQ ID NO: 2250975 - RNA, 22 nt, Yersinia pestis
cugucgcagaaaacaggccgcu

SEQ ID NO: 2250976 - RNA, 14 nt, Yersinia pestis
cugucggagccuga

SEQ ID NO: 2250977 - RNA, 19 nt, Yersinia pestis
cugugggacugaucaaguu

SEQ ID NO: 2250978 - RNA, 19 nt, Yersinia pestis
cuguggauuaacuucuucc

SEQ ID NO: 2250979 - RNA, 18 nt, Yersinia pestis
cuguggcgauuuaaucca

SEQ ID NO: 2250980 - RNA, 14 nt, Yersinia pestis
cugugcuuugccau

SEQ ID NO: 2250981 - RNA, 18 nt, Yersinia pestis
cugugcuuugccauucug

SEQ ID NO: 2250982 - RNA, 19 nt, Yersinia pestis
cugugcuaaaucccaggcg

SEQ ID NO: 2250983 - RNA, 17 nt, Yersinia pestis
cugugcgcuuugcagua

SEQ ID NO: 2250984 - RNA, 23 nt, Yersinia pestis
cugugccugcagguaagaaggca

SEQ ID NO: 2250985 - RNA, 17 nt, Yersinia pestis
cugugauuucagccagg

SEQ ID NO: 2250986 - RNA, 20 nt, Yersinia pestis
cugugauuucagccaggcga

SEQ ID NO: 2250987 - RNA, 17 nt, Yersinia pestis
cugugaucgcugccgca

SEQ ID NO: 2250988 - RNA, 21 nt, Yersinia pestis
cugugauaaccaacaguuauu

SEQ ID NO: 2250989 - RNA, 22 nt, Yersinia pestis
cugugaauuuaucaggcuaaua

SEQ ID NO: 2250990 - RNA, 20 nt, Yersinia pestis
cugugcauguagcugcagcc

SEQ ID NO: 2250991 - RNA, 19 nt, Yersinia pestis
cugugccaaugccucuuca

SEQ ID NO: 2250992 - RNA, 16 nt, Yersinia pestis
aaacucucgaaaaugu

SEQ ID NO: 2250993 - RNA, 14 nt, Yersinia pestis
cuguauuuccugua

SEQ ID NO: 2250994 - RNA, 23 nt, Yersinia pestis
cuguauacccgccgcaucuaaac

SEQ ID NO: 2250995 - RNA, 12 nt, Yersinia pestis
cuguauccagca

SEQ ID NO: 2250996 - RNA, 15 nt, Yersinia pestis
cuguagcucagccug

SEQ ID NO: 2250997 - RNA, 13 nt, Yersinia pestis
cuguaguucauca

SEQ ID NO: 2250998 - RNA, 19 nt, Yersinia pestis
cuguacugcugcaacucau

SEQ ID NO: 2250999 - RNA, 19 nt, Yersinia pestis
cuguacuuuaacuuuaguu

SEQ ID NO: 2251000 - RNA, 19 nt, Yersinia pestis
cuguagaacuuguucauau

SEQ ID NO: 2251001 - RNA, 23 nt, Yersinia pestis
cuguacuuugauucaaaaugcca

SEQ ID NO: 2251002 - RNA, 20 nt, Yersinia pestis
cuguagcgccagguaagaaa

SEQ ID NO: 2251003 - RNA, 16 nt, Yersinia pestis
aaacugauaaagcaaa

SEQ ID NO: 2251004 - RNA, 16 nt, Yersinia pestis
aaacugauauaaagca

SEQ ID NO: 2251005 - RNA, 14 nt, Yersinia pestis
aaacugaucaucaa

SEQ ID NO: 2251006 - RNA, 15 nt, Yersinia pestis
aaacugaucaucaac

SEQ ID NO: 2251007 - RNA, 21 nt, Yersinia pestis
aaacugacugccauaauccag

SEQ ID NO: 2251008 - RNA, 22 nt, Yersinia pestis
aaacugaaguuaaaaagccuga

SEQ ID NO: 2251009 - RNA, 23 nt, Yersinia pestis
aaacugaaguuaaaaagccugaa

SEQ ID NO: 2251010 - RNA, 17 nt, Yersinia pestis
aaacugaauaucccccu

SEQ ID NO: 2251011 - RNA, 18 nt, Yersinia pestis
aaacugaaaaaggcacca

SEQ ID NO: 2251012 - RNA, 15 nt, Yersinia pestis
aaacugaaaaguuuc

SEQ ID NO: 2251013 - RNA, 20 nt, Yersinia pestis
aaacugccgccaccauauca

SEQ ID NO: 2251014 - RNA, 23 nt, Yersinia pestis
cugucagcgaaaaaaaucaagua

SEQ ID NO: 2251015 - RNA, 13 nt, Yersinia pestis
cugucagccaccg

SEQ ID NO: 2251016 - RNA, 16 nt, Yersinia pestis
cugucacugucaaaac

SEQ ID NO: 2251017 - RNA, 20 nt, Yersinia pestis
cugucacuguugcgggcauc

SEQ ID NO: 2251018 - RNA, 14 nt, Yersinia pestis
cugucaccugucac

SEQ ID NO: 2251019 - RNA, 16 nt, Yersinia pestis
cugucaccuaccaccu

SEQ ID NO: 2251020 - RNA, 18 nt, Yersinia pestis
cugucaccuaccaccuac

SEQ ID NO: 2251021 - RNA, 17 nt, Yersinia pestis
cuguccaagaagccaag

SEQ ID NO: 2251022 - RNA, 23 nt, Yersinia pestis
cugucauuuccuccgcuuuagcu

SEQ ID NO: 2251023 - RNA, 22 nt, Yersinia pestis
cuguccgucaaaccaucgcucu

SEQ ID NO: 2251024 - RNA, 15 nt, Yersinia pestis
aaagagucgcuuugg

SEQ ID NO: 2251025 - RNA, 15 nt, Yersinia pestis
aaagagguguucuug

SEQ ID NO: 2251026 - RNA, 21 nt, Yersinia pestis
aaagagguguucuugaaaaaa

SEQ ID NO: 2251027 - RNA, 23 nt, Yersinia pestis
gaagagaacaggcagcaaauaaa

SEQ ID NO: 2251028 - RNA, 22 nt, Yersinia pestis
gaagaaaccuaaugccagacac

SEQ ID NO: 2251029 - RNA, 17 nt, Yersinia pestis
gaagaaacggcucgauu

SEQ ID NO: 2251030 - RNA, 22 nt, Yersinia pestis
gaagaaaagagucgcuuuggga

SEQ ID NO: 2251031 - RNA, 13 nt, Yersinia pestis
gaacuucgaaaga

SEQ ID NO: 2251032 - RNA, 19 nt, Yersinia pestis
gaacuucgaaagaaauaaa

SEQ ID NO: 2251033 - RNA, 12 nt, Yersinia pestis
gaacuuacuccc

SEQ ID NO: 2251034 - RNA, 22 nt, Yersinia pestis
gaagaguuugaucauggcucag

SEQ ID NO: 2251035 - RNA, 21 nt, Yersinia pestis
gaagaguugauccgauaaacu

SEQ ID NO: 2251036 - RNA, 16 nt, Yersinia pestis
gaagcaaucaggaaau

SEQ ID NO: 2251037 - RNA, 13 nt, Yersinia pestis
gaagcaagaaacu

SEQ ID NO: 2251038 - RNA, 12 nt, Yersinia pestis
gaagcaagaaac

SEQ ID NO: 2251039 - RNA, 14 nt, Yersinia pestis
gaagcguaaagcac

SEQ ID NO: 2251040 - RNA, 15 nt, Yersinia pestis
gaagcguaaagcacc

SEQ ID NO: 2251041 - RNA, 22 nt, Yersinia pestis
gaagcgggcggccucugcugcu

SEQ ID NO: 2251042 - RNA, 19 nt, Yersinia pestis
gaagcguggaguuuacgca

SEQ ID NO: 2251043 - RNA, 17 nt, Yersinia pestis
gaauaaaaaagcccggu

SEQ ID NO: 2251044 - RNA, 16 nt, Yersinia pestis
gaagugagaagugaaa

SEQ ID NO: 2251045 - RNA, 17 nt, Yersinia pestis
gaagugagaagugaaaa

SEQ ID NO: 2251046 - RNA, 19 nt, Yersinia pestis
gaaguccuggccaaagccg

SEQ ID NO: 2251047 - RNA, 13 nt, Yersinia pestis
gaauaaaccagca

SEQ ID NO: 2251048 - RNA, 17 nt, Yersinia pestis
gaauaacucucaucuau

SEQ ID NO: 2251049 - RNA, 11 nt, Yersinia pestis
gaauaauacug

SEQ ID NO: 2251050 - RNA, 21 nt, Yersinia pestis
gaauaacuucgcgaacacaau

SEQ ID NO: 2251051 - RNA, 20 nt, Yersinia pestis
gaauaagagagacgggauaa

SEQ ID NO: 2251052 - RNA, 17 nt, Yersinia pestis
gaauaagaucccagaga

SEQ ID NO: 2251053 - RNA, 12 nt, Yersinia pestis
gaauaaggguag

SEQ ID NO: 2251054 - RNA, 18 nt, Yersinia pestis
gaauacccaaaauuugcu

SEQ ID NO: 2251055 - RNA, 18 nt, Yersinia pestis
gaauaccauaacgcugcu

SEQ ID NO: 2251056 - RNA, 21 nt, Yersinia pestis
gaauaccguuuaggaugaaga

SEQ ID NO: 2251057 - RNA, 19 nt, Yersinia pestis
gaaggaauuucacggagaa

SEQ ID NO: 2251058 - RNA, 11 nt, Yersinia pestis
gaaggcacggc

SEQ ID NO: 2251059 - RNA, 15 nt, Yersinia pestis
gaagguagucccuca

SEQ ID NO: 2251060 - RNA, 16 nt, Yersinia pestis
gaagguagucccucaa

SEQ ID NO: 2251061 - RNA, 17 nt, Yersinia pestis
gaagguaaucagacugc

SEQ ID NO: 2251062 - RNA, 18 nt, Yersinia pestis
gaagguaaucagacugcu

SEQ ID NO: 2251063 - RNA, 19 nt, Yersinia pestis
gaagguaaucagacugcug

SEQ ID NO: 2251064 - RNA, 22 nt, Yersinia pestis
gaagguaaucagacugcugaca

SEQ ID NO: 2251065 - RNA, 13 nt, Yersinia pestis
gaaguacuuauuu

SEQ ID NO: 2251066 - RNA, 13 nt, Yersinia pestis
gaaguaauccaga

SEQ ID NO: 2251067 - RNA, 15 nt, Yersinia pestis
gaaggguauugaaga

SEQ ID NO: 2251068 - RNA, 16 nt, Yersinia pestis
gaagguaacuuaaaau

SEQ ID NO: 2251069 - RNA, 20 nt, Yersinia pestis
gaaggggcguuuaaugcccc

SEQ ID NO: 2251070 - RNA, 16 nt, Yersinia pestis
gaagggguucuuccaa

SEQ ID NO: 2251071 - RNA, 16 nt, Yersinia pestis
gaagggcggccagcaa

SEQ ID NO: 2251072 - RNA, 22 nt, Yersinia pestis
gaagggcggccagcaagagcag

SEQ ID NO: 2251073 - RNA, 16 nt, Yersinia pestis
gaagggcgccggaggg

SEQ ID NO: 2251074 - RNA, 13 nt, Yersinia pestis
gaagggcgcagcc

SEQ ID NO: 2251075 - RNA, 23 nt, Yersinia pestis
gacaaugucuauuuagucaucau

SEQ ID NO: 2251076 - RNA, 21 nt, Yersinia pestis
gacaauuauagccaaaucugg

SEQ ID NO: 2251077 - RNA, 18 nt, Yersinia pestis
gacaauuuccccugcuuc

SEQ ID NO: 2251078 - RNA, 21 nt, Yersinia pestis
gacaaucuguuccugauucca

SEQ ID NO: 2251079 - RNA, 18 nt, Yersinia pestis
gacacaaaugcugugcca

SEQ ID NO: 2251080 - RNA, 18 nt, Yersinia pestis
gacaaaccccgaugacgc

SEQ ID NO: 2251081 - RNA, 23 nt, Yersinia pestis
gacaaacaaccuaaaaaaaacaa

SEQ ID NO: 2251082 - RNA, 19 nt, Yersinia pestis
gacaaaagugucauuugga

SEQ ID NO: 2251083 - RNA, 16 nt, Yersinia pestis
gaauuuugcagcgcuu

SEQ ID NO: 2251084 - RNA, 19 nt, Yersinia pestis
gaauuuaagauaccagcga

SEQ ID NO: 2251085 - RNA, 20 nt, Yersinia pestis
gaauuuauccuguacauaua

SEQ ID NO: 2251086 - RNA, 12 nt, Yersinia pestis
gaauuaucauau

SEQ ID NO: 2251087 - RNA, 18 nt, Yersinia pestis
gaauuaucauccagauuc

SEQ ID NO: 2251088 - RNA, 20 nt, Yersinia pestis
gaauuauuuuggaguauaca

SEQ ID NO: 2251089 - RNA, 15 nt, Yersinia pestis
gaauugaugucaauu

SEQ ID NO: 2251090 - RNA, 10 nt, Yersinia pestis
gaauuaauaa

SEQ ID NO: 2251091 - RNA, 15 nt, Yersinia pestis
gaauuaauaaaaccu

SEQ ID NO: 2251092 - RNA, 16 nt, Yersinia pestis
gaauuaaggaaacuca

SEQ ID NO: 2251093 - RNA, 17 nt, Yersinia pestis
gaauuaacaauucucuc

SEQ ID NO: 2251094 - RNA, 14 nt, Yersinia pestis
gaauuaacauacaa

SEQ ID NO: 2251095 - RNA, 20 nt, Yersinia pestis
gaauuaagaagccucaugaa

SEQ ID NO: 2251096 - RNA, 14 nt, Yersinia pestis
gaauuaagaagccu

SEQ ID NO: 2251097 - RNA, 17 nt, Yersinia pestis
gaauuaagaagccucau

SEQ ID NO: 2251098 - RNA, 19 nt, Yersinia pestis
gaauuaagaagccucauga

SEQ ID NO: 2251099 - RNA, 12 nt, Yersinia pestis
gaauuaaaacau

SEQ ID NO: 2251100 - RNA, 14 nt, Yersinia pestis
gaauccagccaugc

SEQ ID NO: 2251101 - RNA, 20 nt, Yersinia pestis
gaaucaguggucuuccgccu

SEQ ID NO: 2251102 - RNA, 15 nt, Yersinia pestis
gaaucaucagacgca

SEQ ID NO: 2251103 - RNA, 16 nt, Yersinia pestis
aaagauuucaucauuc

SEQ ID NO: 2251104 - RNA, 17 nt, Yersinia pestis
aaagauuucaucauuca

SEQ ID NO: 2251105 - RNA, 19 nt, Yersinia pestis
gaauagaucccauacccac

SEQ ID NO: 2251106 - RNA, 19 nt, Yersinia pestis
gaauagccagaagccaggg

SEQ ID NO: 2251107 - RNA, 19 nt, Yersinia pestis
gaauagaccugaugacccg

SEQ ID NO: 2251108 - RNA, 22 nt, Yersinia pestis
gaauagagacggaaagagccag

SEQ ID NO: 2251109 - RNA, 20 nt, Yersinia pestis
gaauagagccucuauuaccu

SEQ ID NO: 2251110 - RNA, 19 nt, Yersinia pestis
gaauagcgcugcaucagca

SEQ ID NO: 2251111 - RNA, 20 nt, Yersinia pestis
gaauagcgcugcaucagcag

SEQ ID NO: 2251112 - RNA, 19 nt, Yersinia pestis
gaaugaguugcccuaaaca

SEQ ID NO: 2251113 - RNA, 14 nt, Yersinia pestis
gaaugaggcugagg

SEQ ID NO: 2251114 - RNA, 15 nt, Yersinia pestis
gaaugugaagagcgg

SEQ ID NO: 2251115 - RNA, 12 nt, Yersinia pestis
gaaugugagugu

SEQ ID NO: 2251116 - RNA, 13 nt, Yersinia pestis
gaauguuaaaccc

SEQ ID NO: 2251117 - RNA, 16 nt, Yersinia pestis
gaauguuaaacccccu

SEQ ID NO: 2251118 - RNA, 21 nt, Yersinia pestis
gaaugcgguucuguaucauau

SEQ ID NO: 2251119 - RNA, 20 nt, Yersinia pestis
gaaugguggguuacaggccg

SEQ ID NO: 2251120 - RNA, 12 nt, Yersinia pestis
gaaugagaugaa

SEQ ID NO: 2251121 - RNA, 18 nt, Yersinia pestis
gaaugaaguucaccagcu

SEQ ID NO: 2251122 - RNA, 14 nt, Yersinia pestis
gaaugaauucuaua

SEQ ID NO: 2251123 - RNA, 17 nt, Yersinia pestis
gacuacugaaaccugac

SEQ ID NO: 2251124 - RNA, 15 nt, Yersinia pestis
gacuacuggcugggg

SEQ ID NO: 2251125 - RNA, 20 nt, Yersinia pestis
gacuaccggaaccgccgccu

SEQ ID NO: 2251126 - RNA, 17 nt, Yersinia pestis
gacuaccaaccgcuuua

SEQ ID NO: 2251127 - RNA, 19 nt, Yersinia pestis
gacuauucccuuguuugcg

SEQ ID NO: 2251128 - RNA, 18 nt, Yersinia pestis
gacgugugcuguaagaaa

SEQ ID NO: 2251129 - RNA, 15 nt, Yersinia pestis
gacgucauaaauauu

SEQ ID NO: 2251130 - RNA, 20 nt, Yersinia pestis
gacgugugcuguaagaaaaa

SEQ ID NO: 2251131 - RNA, 17 nt, Yersinia pestis
gacguaucgcaguuaaa

SEQ ID NO: 2251132 - RNA, 19 nt, Yersinia pestis
gacggcggcgagcacugcc

SEQ ID NO: 2251133 - RNA, 14 nt, Yersinia pestis
gacggaaacagcac

SEQ ID NO: 2251134 - RNA, 16 nt, Yersinia pestis
gacgcuugaauauagc

SEQ ID NO: 2251135 - RNA, 16 nt, Yersinia pestis
gacgccguacaaauau

SEQ ID NO: 2251136 - RNA, 20 nt, Yersinia pestis
gacgccguaaauacauccau

SEQ ID NO: 2251137 - RNA, 14 nt, Yersinia pestis
gacgccggccgguu

SEQ ID NO: 2251138 - RNA, 22 nt, Yersinia pestis
gacggacgugaauaugugcuug

SEQ ID NO: 2251139 - RNA, 18 nt, Yersinia pestis
gacgaaaaccuaauacuu

SEQ ID NO: 2251140 - RNA, 21 nt, Yersinia pestis
gaccuguacgugaaagucucu

SEQ ID NO: 2251141 - RNA, 15 nt, Yersinia pestis
gacgaaagauaauuu

SEQ ID NO: 2251142 - RNA, 14 nt, Yersinia pestis
gaccugcugcaccu

SEQ ID NO: 2251143 - RNA, 12 nt, Yersinia pestis
gaccggccgcuu

SEQ ID NO: 2251144 - RNA, 14 nt, Yersinia pestis
gacgauaaauucaa

SEQ ID NO: 2251145 - RNA, 22 nt, Yersinia pestis
gacgagucuauugaaaaaauaa

SEQ ID NO: 2251146 - RNA, 19 nt, Yersinia pestis
gacgacgcguugauccauc

SEQ ID NO: 2251147 - RNA, 21 nt, Yersinia pestis
gacgcagcaggcguagcgugu

SEQ ID NO: 2251148 - RNA, 13 nt, Yersinia pestis
gacgcaguaagau

SEQ ID NO: 2251149 - RNA, 14 nt, Yersinia pestis
gacgcccgcagacu

SEQ ID NO: 2251150 - RNA, 21 nt, Yersinia pestis
gacgcaguaaguuaguggugu

SEQ ID NO: 2251151 - RNA, 15 nt, Yersinia pestis
gacgccaacuucaag

SEQ ID NO: 2251152 - RNA, 20 nt, Yersinia pestis
gaccaccgauacgcgcaccg

SEQ ID NO: 2251153 - RNA, 17 nt, Yersinia pestis
gaccacgcaucaauaau

SEQ ID NO: 2251154 - RNA, 16 nt, Yersinia pestis
gaccauggcgaugcgu

SEQ ID NO: 2251155 - RNA, 13 nt, Yersinia pestis
gaccaugccauca

SEQ ID NO: 2251156 - RNA, 14 nt, Yersinia pestis
gacccauuauauag

SEQ ID NO: 2251157 - RNA, 14 nt, Yersinia pestis
gaccauaaaaggau

SEQ ID NO: 2251158 - RNA, 17 nt, Yersinia pestis
gaccauaaaaggauggc

SEQ ID NO: 2251159 - RNA, 23 nt, Yersinia pestis
gaccaucccccauggggccaccu

SEQ ID NO: 2251160 - RNA, 12 nt, Yersinia pestis
gaccaucugcuu

SEQ ID NO: 2251161 - RNA, 12 nt, Yersinia pestis
gaccgagaagcu

SEQ ID NO: 2251162 - RNA, 24 nt, Yersinia pestis
gaccgagaagcuucaacuuaauuu

SEQ ID NO: 2251163 - RNA, 14 nt, Yersinia pestis
gaccgccagugccg

SEQ ID NO: 2251164 - RNA, 22 nt, Yersinia pestis
gaccgccagugccgcggcggcc

SEQ ID NO: 2251165 - RNA, 20 nt, Yersinia pestis
gaccgcguaagccgugccug

SEQ ID NO: 2251166 - RNA, 20 nt, Yersinia pestis
gaccgcuguuugauuaaaac

SEQ ID NO: 2251167 - RNA, 14 nt, Yersinia pestis
gaccgcucuucaca

SEQ ID NO: 2251168 - RNA, 17 nt, Yersinia pestis
gacaugugaguggugua

SEQ ID NO: 2251169 - RNA, 23 nt, Yersinia pestis
gacauguuccagugcuuuaucca

SEQ ID NO: 2251170 - RNA, 18 nt, Yersinia pestis
gacauguugcccuuaguu

SEQ ID NO: 2251171 - RNA, 14 nt, Yersinia pestis
gacauuucggccac

SEQ ID NO: 2251172 - RNA, 12 nt, Yersinia pestis
gacauuuucuau

SEQ ID NO: 2251173 - RNA, 18 nt, Yersinia pestis
gacauuuuucuauuucug

SEQ ID NO: 2251174 - RNA, 14 nt, Yersinia pestis
gaccaaacauuguc

SEQ ID NO: 2251175 - RNA, 13 nt, Yersinia pestis
gaccaaacagaau

SEQ ID NO: 2251176 - RNA, 21 nt, Yersinia pestis
gaccacagauaaauaaaauaa

SEQ ID NO: 2251177 - RNA, 11 nt, Yersinia pestis
gaccaccaacu

SEQ ID NO: 2251178 - RNA, 17 nt, Yersinia pestis
gacaguauuugcagcgg

SEQ ID NO: 2251179 - RNA, 22 nt, Yersinia pestis
gacauccgcuugcagcaacagg

SEQ ID NO: 2251180 - RNA, 15 nt, Yersinia pestis
gacaucgccagauuc

SEQ ID NO: 2251181 - RNA, 22 nt, Yersinia pestis
gacacccguuccuucagccacc

SEQ ID NO: 2251182 - RNA, 16 nt, Yersinia pestis
gacacccucagaggcc

SEQ ID NO: 2251183 - RNA, 13 nt, Yersinia pestis
gacagcaguuaau

SEQ ID NO: 2251184 - RNA, 21 nt, Yersinia pestis
gacagcaguuaaugcuuaaga

SEQ ID NO: 2251185 - RNA, 21 nt, Yersinia pestis
gacagcauacauccuaaauaa

SEQ ID NO: 2251186 - RNA, 20 nt, Yersinia pestis
gacagauuauuucagcuuca

SEQ ID NO: 2251187 - RNA, 17 nt, Yersinia pestis
gacagauccugccgccu

SEQ ID NO: 2251188 - RNA, 21 nt, Yersinia pestis
gacaguaaccgggcuugauua

SEQ ID NO: 2251189 - RNA, 23 nt, Yersinia pestis
gacaggcuuuauugagcgaugac

SEQ ID NO: 2251190 - RNA, 16 nt, Yersinia pestis
gacaggcucagcacaa

SEQ ID NO: 2251191 - RNA, 22 nt, Yersinia pestis
gacaggcuaacaacuaacgauu

SEQ ID NO: 2251192 - RNA, 15 nt, Yersinia pestis
gaaauaccacggcac

SEQ ID NO: 2251193 - RNA, 20 nt, Yersinia pestis
gaaauacuuauuugaaacag

SEQ ID NO: 2251194 - RNA, 15 nt, Yersinia pestis
gaaauagcaacuaaa

SEQ ID NO: 2251195 - RNA, 17 nt, Yersinia pestis
gaaauagcgccugcccu

SEQ ID NO: 2251196 - RNA, 14 nt, Yersinia pestis
gaaauauucgcauu

SEQ ID NO: 2251197 - RNA, 13 nt, Yersinia pestis
gaaagcuaauauu

SEQ ID NO: 2251198 - RNA, 22 nt, Yersinia pestis
gaaauaauaucaagucuugaag

SEQ ID NO: 2251199 - RNA, 20 nt, Yersinia pestis
gaaauaaucauaucaaaaua

SEQ ID NO: 2251200 - RNA, 19 nt, Yersinia pestis
gaaauaaaugacuaucccu

SEQ ID NO: 2251201 - RNA, 19 nt, Yersinia pestis
gaaaaugaucaucaagcca

SEQ ID NO: 2251202 - RNA, 23 nt, Yersinia pestis
gaaagcaauuagcacauaugcag

SEQ ID NO: 2251203 - RNA, 14 nt, Yersinia pestis
gaaagcaggucgcc

SEQ ID NO: 2251204 - RNA, 18 nt, Yersinia pestis
gaaagcaggucgccaaac

SEQ ID NO: 2251205 - RNA, 14 nt, Yersinia pestis
gaaagcgccugugg

SEQ ID NO: 2251206 - RNA, 21 nt, Yersinia pestis
aaagacuuuuccaacggcucu

SEQ ID NO: 2251207 - RNA, 14 nt, Yersinia pestis
gaaauuaaggaaaa

SEQ ID NO: 2251208 - RNA, 14 nt, Yersinia pestis
gaaaugacaaauca

SEQ ID NO: 2251209 - RNA, 18 nt, Yersinia pestis
gaaaucgcggcgaaggcu

SEQ ID NO: 2251210 - RNA, 18 nt, Yersinia pestis
gaaaucgauggccgcccu

SEQ ID NO: 2251211 - RNA, 14 nt, Yersinia pestis
gaaauuuuuagaaa

SEQ ID NO: 2251212 - RNA, 23 nt, Yersinia pestis
gaaauucuguagaguaaaacuga

SEQ ID NO: 2251213 - RNA, 21 nt, Yersinia pestis
gaaauucuguagaguaaaacu

SEQ ID NO: 2251214 - RNA, 20 nt, Yersinia pestis
gaaauucaaccucuuguaaa

SEQ ID NO: 2251215 - RNA, 19 nt, Yersinia pestis
gaaauucauuaucaggcac

SEQ ID NO: 2251216 - RNA, 23 nt, Yersinia pestis
gaacauagcuauuggcugauuca

SEQ ID NO: 2251217 - RNA, 17 nt, Yersinia pestis
gaacagcauuuaugcug

SEQ ID NO: 2251218 - RNA, 17 nt, Yersinia pestis
gaacaaaacaagcccca

SEQ ID NO: 2251219 - RNA, 14 nt, Yersinia pestis
gaacaaaacaagcc

SEQ ID NO: 2251220 - RNA, 18 nt, Yersinia pestis
gaacucagacuucuucca

SEQ ID NO: 2251221 - RNA, 15 nt, Yersinia pestis
gaacucgauaauaaa

SEQ ID NO: 2251222 - RNA, 16 nt, Yersinia pestis
gaacuagguuaaaauc

SEQ ID NO: 2251223 - RNA, 21 nt, Yersinia pestis
gaacuacuccauccccaacuc

SEQ ID NO: 2251224 - RNA, 20 nt, Yersinia pestis
gaacuaccgugcggcuucuu

SEQ ID NO: 2251225 - RNA, 16 nt, Yersinia pestis
gaacggugaggauagg

SEQ ID NO: 2251226 - RNA, 23 nt, Yersinia pestis
gaacggccaucaauaaagcuggc

SEQ ID NO: 2251227 - RNA, 23 nt, Yersinia pestis
gaacgauuuucuuucaccacugc

SEQ ID NO: 2251228 - RNA, 17 nt, Yersinia pestis
gaacgcgucacuggcca

SEQ ID NO: 2251229 - RNA, 18 nt, Yersinia pestis
gaacgcgucacuggccac

SEQ ID NO: 2251230 - RNA, 18 nt, Yersinia pestis
gaacgccucaaaaaccug

SEQ ID NO: 2251231 - RNA, 14 nt, Yersinia pestis
gaacgcgcgugguu

SEQ ID NO: 2251232 - RNA, 15 nt, Yersinia pestis
gaaccaaggugguau

SEQ ID NO: 2251233 - RNA, 15 nt, Yersinia pestis
gaaccaauuuuucug

SEQ ID NO: 2251234 - RNA, 18 nt, Yersinia pestis
gaacauuuaucuaucugu

SEQ ID NO: 2251235 - RNA, 20 nt, Yersinia pestis
gaacauuuaucuaucuguuc

SEQ ID NO: 2251236 - RNA, 21 nt, Yersinia pestis
gaacauucaucuuuugcuauu

SEQ ID NO: 2251237 - RNA, 16 nt, Yersinia pestis
gaaccagugaaugcug

SEQ ID NO: 2251238 - RNA, 12 nt, Yersinia pestis
gaaccagauaac

SEQ ID NO: 2251239 - RNA, 22 nt, Yersinia pestis
gaaccauuuuuuguagugaaag

SEQ ID NO: 2251240 - RNA, 13 nt, Yersinia pestis
gaaccaucaacaa

SEQ ID NO: 2251241 - RNA, 13 nt, Yersinia pestis
gaacccaaccaga

SEQ ID NO: 2251242 - RNA, 16 nt, Yersinia pestis
gaaccgcuaucugcug

SEQ ID NO: 2251243 - RNA, 20 nt, Yersinia pestis
gaaccgcuaucugcugacca

SEQ ID NO: 2251244 - RNA, 13 nt, Yersinia pestis
gaaccggcugaca

SEQ ID NO: 2251245 - RNA, 20 nt, Yersinia pestis
gaaccggggcgauacaccaa

SEQ ID NO: 2251246 - RNA, 18 nt, Yersinia pestis
gaacccccgcgaacagca

SEQ ID NO: 2251247 - RNA, 17 nt, Yersinia pestis
gaaccccuagccagcca

SEQ ID NO: 2251248 - RNA, 22 nt, Yersinia pestis
gaaccccugcguauugcuguuc

SEQ ID NO: 2251249 - RNA, 13 nt, Yersinia pestis
gaacccuucagca

SEQ ID NO: 2251250 - RNA, 17 nt, Yersinia pestis
gaacccuucagcaucga

SEQ ID NO: 2251251 - RNA, 19 nt, Yersinia pestis
gaaccgcagacauaucuga

SEQ ID NO: 2251252 - RNA, 14 nt, Yersinia pestis
gaacgaaucaggca

SEQ ID NO: 2251253 - RNA, 14 nt, Yersinia pestis
gaaccuucucugca

SEQ ID NO: 2251254 - RNA, 19 nt, Yersinia pestis
gaacgaggcccgauaaacu

SEQ ID NO: 2251255 - RNA, 17 nt, Yersinia pestis
gaacgaggacuuccugc

SEQ ID NO: 2251256 - RNA, 16 nt, Yersinia pestis
gaaccugacgcacagc

SEQ ID NO: 2251257 - RNA, 17 nt, Yersinia pestis
gaaccugacgcacagca

SEQ ID NO: 2251258 - RNA, 16 nt, Yersinia pestis
aaagacgccguaaaua

SEQ ID NO: 2251259 - RNA, 19 nt, Yersinia pestis
aaagacggccaacugcugg

SEQ ID NO: 2251260 - RNA, 18 nt, Yersinia pestis
aaagacgcuaauuaaaga

SEQ ID NO: 2251261 - RNA, 18 nt, Yersinia pestis
aaagacgccguaaauaca

SEQ ID NO: 2251262 - RNA, 23 nt, Yersinia pestis
aaagacgccguaaauacauccau

SEQ ID NO: 2251263 - RNA, 12 nt, Yersinia pestis
cuuuucugccua

SEQ ID NO: 2251264 - RNA, 21 nt, Yersinia pestis
cuuuucugccuaucuuaaaaa

SEQ ID NO: 2251265 - RNA, 19 nt, Yersinia pestis
cuuuucgggcuaaagacac

SEQ ID NO: 2251266 - RNA, 21 nt, Yersinia pestis
aaagacuuuauucacagcaga

SEQ ID NO: 2251267 - RNA, 23 nt, Yersinia pestis
aaagacuuuauucacagcagaac

SEQ ID NO: 2251268 - RNA, 21 nt, Yersinia pestis
cuuuucuuuaugucuuuuucu

SEQ ID NO: 2251269 - RNA, 15 nt, Yersinia pestis
cuuuugcugcacugc

SEQ ID NO: 2251270 - RNA, 14 nt, Yersinia pestis
cuuuugccacauuu

SEQ ID NO: 2251271 - RNA, 16 nt, Yersinia pestis
cuuuugccacauuucc

SEQ ID NO: 2251272 - RNA, 22 nt, Yersinia pestis
cuuuuaaaugaagcaguucacu

SEQ ID NO: 2251273 - RNA, 19 nt, Yersinia pestis
cuuuuacgggccuuuuaau

SEQ ID NO: 2251274 - RNA, 14 nt, Yersinia pestis
cuuuuacugguuca

SEQ ID NO: 2251275 - RNA, 22 nt, Yersinia pestis
cuuuuauuugauucgucugcca

SEQ ID NO: 2251276 - RNA, 22 nt, Yersinia pestis
cuuuuauuggcauuaaacugaa

SEQ ID NO: 2251277 - RNA, 12 nt, Yersinia pestis
cuuuucccgucc

SEQ ID NO: 2251278 - RNA, 15 nt, Yersinia pestis
gaaaaaacaucacac

SEQ ID NO: 2251279 - RNA, 11 nt, Yersinia pestis
gaaaaaaauac

SEQ ID NO: 2251280 - RNA, 16 nt, Yersinia pestis
gaaaaaaaucaaguac

SEQ ID NO: 2251281 - RNA, 19 nt, Yersinia pestis
gaaaaaaaucaaguacacu

SEQ ID NO: 2251282 - RNA, 16 nt, Yersinia pestis
cuuuuuucacauuacg

SEQ ID NO: 2251283 - RNA, 17 nt, Yersinia pestis
gaaaaauuucacuggca

SEQ ID NO: 2251284 - RNA, 19 nt, Yersinia pestis
gaaaacaaaaaguuaaaua

SEQ ID NO: 2251285 - RNA, 19 nt, Yersinia pestis
gaaaaaggcaccagcgcac

SEQ ID NO: 2251286 - RNA, 18 nt, Yersinia pestis
gaaaaaggccgacugaga

SEQ ID NO: 2251287 - RNA, 15 nt, Yersinia pestis
cuuuuuuaauaaaaa

SEQ ID NO: 2251288 - RNA, 17 nt, Yersinia pestis
cuuuuugaaucaagcau

SEQ ID NO: 2251289 - RNA, 19 nt, Yersinia pestis
gaaaaccuucagcaaagag

SEQ ID NO: 2251290 - RNA, 14 nt, Yersinia pestis
gaaaaccuaauacu

SEQ ID NO: 2251291 - RNA, 16 nt, Yersinia pestis
gaaaacagcaacacca

SEQ ID NO: 2251292 - RNA, 21 nt, Yersinia pestis
gaaaacaaguuucacuuucaa

SEQ ID NO: 2251293 - RNA, 22 nt, Yersinia pestis
gaaaacaaguuucacuuucaac

SEQ ID NO: 2251294 - RNA, 23 nt, Yersinia pestis
gaaaacaguuacuccuacaccau

SEQ ID NO: 2251295 - RNA, 20 nt, Yersinia pestis
gaaaagagguguucuugaaa

SEQ ID NO: 2251296 - RNA, 19 nt, Yersinia pestis
gaaaagagucgcuuuggga

SEQ ID NO: 2251297 - RNA, 13 nt, Yersinia pestis
gaaaagcagcagu

SEQ ID NO: 2251298 - RNA, 20 nt, Yersinia pestis
gaaaagcagucgacagugua

SEQ ID NO: 2251299 - RNA, 13 nt, Yersinia pestis
gaaaagcagacuu

SEQ ID NO: 2251300 - RNA, 10 nt, Yersinia pestis
gaaaauaaug

SEQ ID NO: 2251301 - RNA, 21 nt, Yersinia pestis
gaaaauaaugaauuauuagau

SEQ ID NO: 2251302 - RNA, 18 nt, Yersinia pestis
cuucggccuugaaacagc

SEQ ID NO: 2251303 - RNA, 15 nt, Yersinia pestis
cuucgcuuucaucuu

SEQ ID NO: 2251304 - RNA, 19 nt, Yersinia pestis
cuucgcuuucaucuucuuc

SEQ ID NO: 2251305 - RNA, 14 nt, Yersinia pestis
cuucgcucacaacc

SEQ ID NO: 2251306 - RNA, 13 nt, Yersinia pestis
cuuuaauaaaauc

SEQ ID NO: 2251307 - RNA, 16 nt, Yersinia pestis
cuuuaauaaaaucaaa

SEQ ID NO: 2251308 - RNA, 13 nt, Yersinia pestis
cuuuaacaacaac

SEQ ID NO: 2251309 - RNA, 15 nt, Yersinia pestis
cuuuaacaauuuauc

SEQ ID NO: 2251310 - RNA, 21 nt, Yersinia pestis
cuuuaaucccaccggggagca

SEQ ID NO: 2251311 - RNA, 16 nt, Yersinia pestis
cuuuaaucaguuucag

SEQ ID NO: 2251312 - RNA, 19 nt, Yersinia pestis
cuuuaaucaguuucaggcg

SEQ ID NO: 2251313 - RNA, 23 nt, Yersinia pestis
cuuuacgcagcuuguugauauca

SEQ ID NO: 2251314 - RNA, 18 nt, Yersinia pestis
cuuuacccacggguuaau

SEQ ID NO: 2251315 - RNA, 16 nt, Yersinia pestis
cuuuaccccauugcac

SEQ ID NO: 2251316 - RNA, 13 nt, Yersinia pestis
cuuuaauuaaaaa

SEQ ID NO: 2251317 - RNA, 18 nt, Yersinia pestis
cuuuauuuauuuuacugc

SEQ ID NO: 2251318 - RNA, 21 nt, Yersinia pestis
cuuucaccaaaccaucagcga

SEQ ID NO: 2251319 - RNA, 21 nt, Yersinia pestis
cuuucaccaaccaaccaucac

SEQ ID NO: 2251320 - RNA, 15 nt, Yersinia pestis
cuuucaccacugcca

SEQ ID NO: 2251321 - RNA, 15 nt, Yersinia pestis
cuuucauacaucauu

SEQ ID NO: 2251322 - RNA, 14 nt, Yersinia pestis
cuuucaguuaucua

SEQ ID NO: 2251323 - RNA, 21 nt, Yersinia pestis
cuuucaccgcuguagguguca

SEQ ID NO: 2251324 - RNA, 23 nt, Yersinia pestis
cuuucaggccacgcaauucauca

SEQ ID NO: 2251325 - RNA, 12 nt, Yersinia pestis
cuuuauuauaug

SEQ ID NO: 2251326 - RNA, 18 nt, Yersinia pestis
cuuuauucauucagagua

SEQ ID NO: 2251327 - RNA, 13 nt, Yersinia pestis
cuuuauucaauac

SEQ ID NO: 2251328 - RNA, 21 nt, Yersinia pestis
cuuuaucauugaguucugauc

SEQ ID NO: 2251329 - RNA, 14 nt, Yersinia pestis
cuuuaucccaccac

SEQ ID NO: 2251330 - RNA, 21 nt, Yersinia pestis
cuuuaucgccagcugcaauug

SEQ ID NO: 2251331 - RNA, 14 nt, Yersinia pestis
cuuuagcauugcag

SEQ ID NO: 2251332 - RNA, 17 nt, Yersinia pestis
cuuuagccuaccgcuua

SEQ ID NO: 2251333 - RNA, 13 nt, Yersinia pestis
cuuuaggaaagcc

SEQ ID NO: 2251334 - RNA, 18 nt, Yersinia pestis
cuuuagggcggccuuaau

SEQ ID NO: 2251335 - RNA, 14 nt, Yersinia pestis
cuuuauauucaaua

SEQ ID NO: 2251336 - RNA, 23 nt, Yersinia pestis
cuuuauauccccuguaguugcag

SEQ ID NO: 2251337 - RNA, 23 nt, Yersinia pestis
cuuugauuugaacgacaugugag

SEQ ID NO: 2251338 - RNA, 21 nt, Yersinia pestis
cuuugauuuaaauauuauuua

SEQ ID NO: 2251339 - RNA, 18 nt, Yersinia pestis
cuuugcguucugucuguu

SEQ ID NO: 2251340 - RNA, 13 nt, Yersinia pestis
cuuugacagcauc

SEQ ID NO: 2251341 - RNA, 15 nt, Yersinia pestis
cuuugacagcaucug

SEQ ID NO: 2251342 - RNA, 17 nt, Yersinia pestis
cuuugaccauuuguuuu

SEQ ID NO: 2251343 - RNA, 17 nt, Yersinia pestis
cuuugaugccuaauaau

SEQ ID NO: 2251344 - RNA, 17 nt, Yersinia pestis
cuuuguauuuugcacaa

SEQ ID NO: 2251345 - RNA, 20 nt, Yersinia pestis
cuuugucaauaaccucagcc

SEQ ID NO: 2251346 - RNA, 21 nt, Yersinia pestis
cuuugucaauaaccucagccu

SEQ ID NO: 2251347 - RNA, 23 nt, Yersinia pestis
cuuugucaauaaccucauuggcg

SEQ ID NO: 2251348 - RNA, 21 nt, Yersinia pestis
cuuucuuuucgcuauuucucu

SEQ ID NO: 2251349 - RNA, 23 nt, Yersinia pestis
cuuucucgcguuugaucaaauca

SEQ ID NO: 2251350 - RNA, 19 nt, Yersinia pestis
cuuucucgauacaauuuuu

SEQ ID NO: 2251351 - RNA, 22 nt, Yersinia pestis
cuuucucuggcacgcuuucugc

SEQ ID NO: 2251352 - RNA, 22 nt, Yersinia pestis
cuuucucauuagcgucuuuuuu

SEQ ID NO: 2251353 - RNA, 20 nt, Yersinia pestis
cuuucucgacauccaauuca

SEQ ID NO: 2251354 - RNA, 14 nt, Yersinia pestis
cuuucuccuuugau

SEQ ID NO: 2251355 - RNA, 17 nt, Yersinia pestis
cuuucuccuuugauuug

SEQ ID NO: 2251356 - RNA, 22 nt, Yersinia pestis
cuuucucagguguuacacaguu

SEQ ID NO: 2251357 - RNA, 12 nt, Yersinia pestis
cuuuccccagau

SEQ ID NO: 2251358 - RNA, 14 nt, Yersinia pestis
cuuuccauccagaa

SEQ ID NO: 2251359 - RNA, 16 nt, Yersinia pestis
cuuucaucuucuucuu

SEQ ID NO: 2251360 - RNA, 16 nt, Yersinia pestis
cuuucaucgaaaaaaa

SEQ ID NO: 2251361 - RNA, 22 nt, Yersinia pestis
cuuucauuuguuggcaaauuaa

SEQ ID NO: 2251362 - RNA, 15 nt, Yersinia pestis
cuuucguuucugucu

SEQ ID NO: 2251363 - RNA, 23 nt, Yersinia pestis
gauaguaacaccagcauccugca

SEQ ID NO: 2251364 - RNA, 23 nt, Yersinia pestis
gauaguacguagcgauaacagau

SEQ ID NO: 2251365 - RNA, 23 nt, Yersinia pestis
gauagggggcaaccauauuaaac

SEQ ID NO: 2251366 - RNA, 16 nt, Yersinia pestis
gauagcaaucaauaag

SEQ ID NO: 2251367 - RNA, 17 nt, Yersinia pestis
gauagcaaaagaaucag

SEQ ID NO: 2251368 - RNA, 13 nt, Yersinia pestis
gauagcaauguca

SEQ ID NO: 2251369 - RNA, 14 nt, Yersinia pestis
gauauagccuucuu

SEQ ID NO: 2251370 - RNA, 18 nt, Yersinia pestis
gauauaggcaucuuucag

SEQ ID NO: 2251371 - RNA, 14 nt, Yersinia pestis
gauaucugcgguga

SEQ ID NO: 2251372 - RNA, 17 nt, Yersinia pestis
gauaucugcggugauca

SEQ ID NO: 2251373 - RNA, 23 nt, Yersinia pestis
gauaugauguuacggguaaugaa

SEQ ID NO: 2251374 - RNA, 20 nt, Yersinia pestis
gauaugcauuauugauguua

SEQ ID NO: 2251375 - RNA, 22 nt, Yersinia pestis
gauaugagcgaggagguaugac

SEQ ID NO: 2251376 - RNA, 20 nt, Yersinia pestis
gauaucuucggcggcuaaag

SEQ ID NO: 2251377 - RNA, 19 nt, Yersinia pestis
gauaucuugauugccuaca

SEQ ID NO: 2251378 - RNA, 14 nt, Yersinia pestis
gauaacuucauuuu

SEQ ID NO: 2251379 - RNA, 22 nt, Yersinia pestis
gauaacuuuuuauuucuuuuaa

SEQ ID NO: 2251380 - RNA, 20 nt, Yersinia pestis
gauaagcgguuuuaucaaua

SEQ ID NO: 2251381 - RNA, 19 nt, Yersinia pestis
gauacgcauugaggucagc

SEQ ID NO: 2251382 - RNA, 13 nt, Yersinia pestis
gauacgacuucuu

SEQ ID NO: 2251383 - RNA, 20 nt, Yersinia pestis
gauacugccaucaucauuca

SEQ ID NO: 2251384 - RNA, 22 nt, Yersinia pestis
gauacugccaucaucauucaau

SEQ ID NO: 2251385 - RNA, 15 nt, Yersinia pestis
gauacugaaauauac

SEQ ID NO: 2251386 - RNA, 20 nt, Yersinia pestis
gauacuugaaacagcagggg

SEQ ID NO: 2251387 - RNA, 16 nt, Yersinia pestis
gaucaugguagagcug

SEQ ID NO: 2251388 - RNA, 21 nt, Yersinia pestis
gaucauuauuauccucccagc

SEQ ID NO: 2251389 - RNA, 21 nt, Yersinia pestis
gaucauauuaggcaggugaag

SEQ ID NO: 2251390 - RNA, 15 nt, Yersinia pestis
gaucaucaaccagaa

SEQ ID NO: 2251391 - RNA, 16 nt, Yersinia pestis
gaucaucaaccagaaa

SEQ ID NO: 2251392 - RNA, 22 nt, Yersinia pestis
gaucaucugguuuuuuuauaaa

SEQ ID NO: 2251393 - RNA, 16 nt, Yersinia pestis
gaucauaagccgcaga

SEQ ID NO: 2251394 - RNA, 15 nt, Yersinia pestis
gaucaguuugccuug

SEQ ID NO: 2251395 - RNA, 15 nt, Yersinia pestis
gaucaguuaaucaag

SEQ ID NO: 2251396 - RNA, 17 nt, Yersinia pestis
gaucaguuaaucaagcc

SEQ ID NO: 2251397 - RNA, 18 nt, Yersinia pestis
gaucaguuaaucaagcca

SEQ ID NO: 2251398 - RNA, 17 nt, Yersinia pestis
gaucagcgccugcuguu

SEQ ID NO: 2251399 - RNA, 18 nt, Yersinia pestis
gaucaccgugccaaaaau

SEQ ID NO: 2251400 - RNA, 18 nt, Yersinia pestis
gaucaccagcaaaggcca

SEQ ID NO: 2251401 - RNA, 19 nt, Yersinia pestis
gaucaauaaaaaagucacu

SEQ ID NO: 2251402 - RNA, 22 nt, Yersinia pestis
gauauuaccgagcgucaagcca

SEQ ID NO: 2251403 - RNA, 17 nt, Yersinia pestis
aaagcccggucacucaa

SEQ ID NO: 2251404 - RNA, 16 nt, Yersinia pestis
aaagccauuagcguug

SEQ ID NO: 2251405 - RNA, 16 nt, Yersinia pestis
aaagccauucagcagc

SEQ ID NO: 2251406 - RNA, 13 nt, Yersinia pestis
aaagcccagguua

SEQ ID NO: 2251407 - RNA, 20 nt, Yersinia pestis
gauccugccgccucugcucc

SEQ ID NO: 2251408 - RNA, 13 nt, Yersinia pestis
gauccugcaauaa

SEQ ID NO: 2251409 - RNA, 23 nt, Yersinia pestis
gauccugaacgaggacuuccugc

SEQ ID NO: 2251410 - RNA, 23 nt, Yersinia pestis
gauccucguuagucacucaagcc

SEQ ID NO: 2251411 - RNA, 17 nt, Yersinia pestis
gauccucguuagucacu

SEQ ID NO: 2251412 - RNA, 18 nt, Yersinia pestis
gauccuaggcggugaggg

SEQ ID NO: 2251413 - RNA, 20 nt, Yersinia pestis
gauccguuuaaucagugaca

SEQ ID NO: 2251414 - RNA, 21 nt, Yersinia pestis
gaucgaucucuuuauauucaa

SEQ ID NO: 2251415 - RNA, 13 nt, Yersinia pestis
gaucgccaaauaa

SEQ ID NO: 2251416 - RNA, 14 nt, Yersinia pestis
gaucgcacuucaac

SEQ ID NO: 2251417 - RNA, 19 nt, Yersinia pestis
gaucccagagauggcgauc

SEQ ID NO: 2251418 - RNA, 20 nt, Yersinia pestis
gauccaguuucaguggcuuc

SEQ ID NO: 2251419 - RNA, 14 nt, Yersinia pestis
gauccauaggaucc

SEQ ID NO: 2251420 - RNA, 14 nt, Yersinia pestis
gauccauaggaucu

SEQ ID NO: 2251421 - RNA, 20 nt, Yersinia pestis
gaucauuucccccaccugau

SEQ ID NO: 2251422 - RNA, 12 nt, Yersinia pestis
gauccacauuac

SEQ ID NO: 2251423 - RNA, 16 nt, Yersinia pestis
gauccacauucugugu

SEQ ID NO: 2251424 - RNA, 18 nt, Yersinia pestis
gauccagaauuucauugu

SEQ ID NO: 2251425 - RNA, 16 nt, Yersinia pestis
gauccacuccagugcc

SEQ ID NO: 2251426 - RNA, 20 nt, Yersinia pestis
gaucccucggugauaaguuu

SEQ ID NO: 2251427 - RNA, 23 nt, Yersinia pestis
gaucccgguauaaguacuuucaa

SEQ ID NO: 2251428 - RNA, 17 nt, Yersinia pestis
gauccgggaaaaaauac

SEQ ID NO: 2251429 - RNA, 21 nt, Yersinia pestis
gauccgauaaacuucacaaug

SEQ ID NO: 2251430 - RNA, 14 nt, Yersinia pestis
gauccgccugcugg

SEQ ID NO: 2251431 - RNA, 16 nt, Yersinia pestis
gaucucuuuauauuca

SEQ ID NO: 2251432 - RNA, 19 nt, Yersinia pestis
gaucucuucagcaauuuuu

SEQ ID NO: 2251433 - RNA, 20 nt, Yersinia pestis
gaucugccccuggcucagua

SEQ ID NO: 2251434 - RNA, 18 nt, Yersinia pestis
gaucuauuugcuguugua

SEQ ID NO: 2251435 - RNA, 14 nt, Yersinia pestis
gaucuaaaaaauau

SEQ ID NO: 2251436 - RNA, 15 nt, Yersinia pestis
gaucuccuccagaau

SEQ ID NO: 2251437 - RNA, 18 nt, Yersinia pestis
gaucggguggaccuccau

SEQ ID NO: 2251438 - RNA, 16 nt, Yersinia pestis
gaucguaaagacgccg

SEQ ID NO: 2251439 - RNA, 12 nt, Yersinia pestis
gaucguaggcuu

SEQ ID NO: 2251440 - RNA, 17 nt, Yersinia pestis
gaucgcgacgaaaaccu

SEQ ID NO: 2251441 - RNA, 16 nt, Yersinia pestis
gaucgcgaugcgccug

SEQ ID NO: 2251442 - RNA, 18 nt, Yersinia pestis
gaucgcgaugcgccuguu

SEQ ID NO: 2251443 - RNA, 17 nt, Yersinia pestis
gaucgccgccaauguuu

SEQ ID NO: 2251444 - RNA, 20 nt, Yersinia pestis
gaucgcgcccauccgcagga

SEQ ID NO: 2251445 - RNA, 18 nt, Yersinia pestis
gaucgcucucacccugcg

SEQ ID NO: 2251446 - RNA, 11 nt, Yersinia pestis
gaguaaauaca

SEQ ID NO: 2251447 - RNA, 21 nt, Yersinia pestis
gaguaacaaauggucaggaac

SEQ ID NO: 2251448 - RNA, 22 nt, Yersinia pestis
gaguaacacuucagacugaaag

SEQ ID NO: 2251449 - RNA, 23 nt, Yersinia pestis
gaguaaucgccugcugagccaaa

SEQ ID NO: 2251450 - RNA, 13 nt, Yersinia pestis
gaguaaaacugau

SEQ ID NO: 2251451 - RNA, 12 nt, Yersinia pestis
gaguaaacagag

SEQ ID NO: 2251452 - RNA, 13 nt, Yersinia pestis
gaguaaaccguac

SEQ ID NO: 2251453 - RNA, 21 nt, Yersinia pestis
gaguaaagcaggccuucuaac

SEQ ID NO: 2251454 - RNA, 17 nt, Yersinia pestis
gaggguugucagcaguc

SEQ ID NO: 2251455 - RNA, 19 nt, Yersinia pestis
gaggguugucagcagucug

SEQ ID NO: 2251456 - RNA, 17 nt, Yersinia pestis
gagggcuucuggcgugu

SEQ ID NO: 2251457 - RNA, 19 nt, Yersinia pestis
gaggcgcuacugcuuuuua

SEQ ID NO: 2251458 - RNA, 13 nt, Yersinia pestis
gaggaaacugccg

SEQ ID NO: 2251459 - RNA, 12 nt, Yersinia pestis
gaggaaauaaau

SEQ ID NO: 2251460 - RNA, 21 nt, Yersinia pestis
gaggacuuccugcccagcggc

SEQ ID NO: 2251461 - RNA, 14 nt, Yersinia pestis
gaggacuauucaau

SEQ ID NO: 2251462 - RNA, 18 nt, Yersinia pestis
gaggagaauuagcgcggu

SEQ ID NO: 2251463 - RNA, 16 nt, Yersinia pestis
gaggagauuucagacu

SEQ ID NO: 2251464 - RNA, 19 nt, Yersinia pestis
gaggagauuucagacugcu

SEQ ID NO: 2251465 - RNA, 14 nt, Yersinia pestis
gaggcauaaucagc

SEQ ID NO: 2251466 - RNA, 22 nt, Yersinia pestis
gaggcaucaagggcggggucaa

SEQ ID NO: 2251467 - RNA, 13 nt, Yersinia pestis
gaggccaggacuu

SEQ ID NO: 2251468 - RNA, 15 nt, Yersinia pestis
gaguguaaaaagcag

SEQ ID NO: 2251469 - RNA, 13 nt, Yersinia pestis
gagugguuuauaa

SEQ ID NO: 2251470 - RNA, 18 nt, Yersinia pestis
gaguguaaaaagcagugc

SEQ ID NO: 2251471 - RNA, 16 nt, Yersinia pestis
gagugaauuucuuccc

SEQ ID NO: 2251472 - RNA, 21 nt, Yersinia pestis
gagucgguguacguauggcau

SEQ ID NO: 2251473 - RNA, 17 nt, Yersinia pestis
gagugaagacaucgcca

SEQ ID NO: 2251474 - RNA, 17 nt, Yersinia pestis
gagugaagauuuuugau

SEQ ID NO: 2251475 - RNA, 14 nt, Yersinia pestis
gagugaaggguuga

SEQ ID NO: 2251476 - RNA, 14 nt, Yersinia pestis
gagugaauagauaa

SEQ ID NO: 2251477 - RNA, 13 nt, Yersinia pestis
gagugauuauucu

SEQ ID NO: 2251478 - RNA, 17 nt, Yersinia pestis
gagugagucaucggggu

SEQ ID NO: 2251479 - RNA, 16 nt, Yersinia pestis
gagucgcuccucagcc

SEQ ID NO: 2251480 - RNA, 19 nt, Yersinia pestis
gagucgcuccucagccuuu

SEQ ID NO: 2251481 - RNA, 15 nt, Yersinia pestis
gauaaagagugaaau

SEQ ID NO: 2251482 - RNA, 19 nt, Yersinia pestis
gauaaaccgcuauaucauc

SEQ ID NO: 2251483 - RNA, 14 nt, Yersinia pestis
gauaaccuucuuca

SEQ ID NO: 2251484 - RNA, 17 nt, Yersinia pestis
gauaacgggcagguuuu

SEQ ID NO: 2251485 - RNA, 21 nt, Yersinia pestis
gauaacgggcagguuuuucaa

SEQ ID NO: 2251486 - RNA, 14 nt, Yersinia pestis
gaguuuguggggag

SEQ ID NO: 2251487 - RNA, 14 nt, Yersinia pestis
gaguuuuagcccaa

SEQ ID NO: 2251488 - RNA, 18 nt, Yersinia pestis
gaguuuucagucgcaacu

SEQ ID NO: 2251489 - RNA, 21 nt, Yersinia pestis
gaguuuucccugcgccagcag

SEQ ID NO: 2251490 - RNA, 18 nt, Yersinia pestis
gaguuucccuuuuccauc

SEQ ID NO: 2251491 - RNA, 13 nt, Yersinia pestis
gauaaaauacuuc

SEQ ID NO: 2251492 - RNA, 20 nt, Yersinia pestis
gauaaaaggcuauuuaaauu

SEQ ID NO: 2251493 - RNA, 14 nt, Yersinia pestis
gaguuuccaguuca

SEQ ID NO: 2251494 - RNA, 14 nt, Yersinia pestis
gaguuucucugcuc

SEQ ID NO: 2251495 - RNA, 13 nt, Yersinia pestis
gaguucucaccaa

SEQ ID NO: 2251496 - RNA, 21 nt, Yersinia pestis
gagcaauaccaaaaaucucuu

SEQ ID NO: 2251497 - RNA, 19 nt, Yersinia pestis
gagcagccaacacaccugc

SEQ ID NO: 2251498 - RNA, 13 nt, Yersinia pestis
gagcaaucaaaag

SEQ ID NO: 2251499 - RNA, 18 nt, Yersinia pestis
gagcaaucuggcggccgc

SEQ ID NO: 2251500 - RNA, 21 nt, Yersinia pestis
aaagcagaaagggcgcaugua

SEQ ID NO: 2251501 - RNA, 18 nt, Yersinia pestis
aaagcacuaagauucaaa

SEQ ID NO: 2251502 - RNA, 15 nt, Yersinia pestis
gagcagugcgcggcg

SEQ ID NO: 2251503 - RNA, 17 nt, Yersinia pestis
gagcagugcgcggcgcc

SEQ ID NO: 2251504 - RNA, 22 nt, Yersinia pestis
gagaucguaggcuugagguuau

SEQ ID NO: 2251505 - RNA, 20 nt, Yersinia pestis
gagauguucgcagaaaagag

SEQ ID NO: 2251506 - RNA, 15 nt, Yersinia pestis
gagaucguaggcuuu

SEQ ID NO: 2251507 - RNA, 20 nt, Yersinia pestis
gagaucugggcgacccaaag

SEQ ID NO: 2251508 - RNA, 14 nt, Yersinia pestis
gagauugaugggau

SEQ ID NO: 2251509 - RNA, 21 nt, Yersinia pestis
gagcaaaaauauacccgacua

SEQ ID NO: 2251510 - RNA, 23 nt, Yersinia pestis
gagcaaaaauauacccgacuaau

SEQ ID NO: 2251511 - RNA, 12 nt, Yersinia pestis
gacucaagccuc

SEQ ID NO: 2251512 - RNA, 16 nt, Yersinia pestis
gacucaauaaauccau

SEQ ID NO: 2251513 - RNA, 16 nt, Yersinia pestis
gacucaauaauauggg

SEQ ID NO: 2251514 - RNA, 14 nt, Yersinia pestis
gacucacgucagua

SEQ ID NO: 2251515 - RNA, 14 nt, Yersinia pestis
gacuccaaauuagc

SEQ ID NO: 2251516 - RNA, 14 nt, Yersinia pestis
gagaggagauuaga

SEQ ID NO: 2251517 - RNA, 15 nt, Yersinia pestis
gagaggcucgcuggu

SEQ ID NO: 2251518 - RNA, 22 nt, Yersinia pestis
gagaggcugaaggcgcuccccu

SEQ ID NO: 2251519 - RNA, 13 nt, Yersinia pestis
gagagguugcaaa

SEQ ID NO: 2251520 - RNA, 21 nt, Yersinia pestis
gagcuaaugcuauccacaaac

SEQ ID NO: 2251521 - RNA, 24 nt, Yersinia pestis
gagcuaaugcuauccacaaacuca

SEQ ID NO: 2251522 - RNA, 12 nt, Yersinia pestis
gagcguaaucug

SEQ ID NO: 2251523 - RNA, 13 nt, Yersinia pestis
gagcgucaagcca

SEQ ID NO: 2251524 - RNA, 15 nt, Yersinia pestis
gagcgugaagagcga

SEQ ID NO: 2251525 - RNA, 16 nt, Yersinia pestis
gagccucaugaaugag

SEQ ID NO: 2251526 - RNA, 16 nt, Yersinia pestis
gagccuguccauaauu

SEQ ID NO: 2251527 - RNA, 17 nt, Yersinia pestis
gagccuguaucggguga

SEQ ID NO: 2251528 - RNA, 21 nt, Yersinia pestis
gagccuacauggauguauuua

SEQ ID NO: 2251529 - RNA, 12 nt, Yersinia pestis
gagccacacauu

SEQ ID NO: 2251530 - RNA, 22 nt, Yersinia pestis
gagccagagacauaaagcccgc

SEQ ID NO: 2251531 - RNA, 19 nt, Yersinia pestis
gagcgacucaauaauaugg

SEQ ID NO: 2251532 - RNA, 14 nt, Yersinia pestis
gagcgacucaauug

SEQ ID NO: 2251533 - RNA, 12 nt, Yersinia pestis
gaugaaauuuua

SEQ ID NO: 2251534 - RNA, 20 nt, Yersinia pestis
gaugaaauccagaucagcgc

SEQ ID NO: 2251535 - RNA, 17 nt, Yersinia pestis
gaugaacugacacacac

SEQ ID NO: 2251536 - RNA, 18 nt, Yersinia pestis
gaugaauaugcuucauca

SEQ ID NO: 2251537 - RNA, 23 nt, Yersinia pestis
gaugaauaugcuucaucacuugc

SEQ ID NO: 2251538 - RNA, 16 nt, Yersinia pestis
gaugaaucaaugaaau

SEQ ID NO: 2251539 - RNA, 20 nt, Yersinia pestis
gaugaagguaaugcgaaaaa

SEQ ID NO: 2251540 - RNA, 22 nt, Yersinia pestis
gaugacaaccucucaguugaug

SEQ ID NO: 2251541 - RNA, 22 nt, Yersinia pestis
gaugacaaugcguuauaaccau

SEQ ID NO: 2251542 - RNA, 15 nt, Yersinia pestis
gaugacacaauuccc

SEQ ID NO: 2251543 - RNA, 19 nt, Yersinia pestis
gaugaauguuccggacuuc

SEQ ID NO: 2251544 - RNA, 17 nt, Yersinia pestis
gaucuucauugccuucu

SEQ ID NO: 2251545 - RNA, 15 nt, Yersinia pestis
gaucuugauaaacau

SEQ ID NO: 2251546 - RNA, 13 nt, Yersinia pestis
gaugaaacacaac

SEQ ID NO: 2251547 - RNA, 11 nt, Yersinia pestis
gaugaaaaaua

SEQ ID NO: 2251548 - RNA, 20 nt, Yersinia pestis
gaugaaaaauacaaauauaa

SEQ ID NO: 2251549 - RNA, 14 nt, Yersinia pestis
gaucuuuuucauuc

SEQ ID NO: 2251550 - RNA, 16 nt, Yersinia pestis
gaugagcguauucgga

SEQ ID NO: 2251551 - RNA, 20 nt, Yersinia pestis
gaugaccaucgaucugggcu

SEQ ID NO: 2251552 - RNA, 16 nt, Yersinia pestis
gaugacguaauuuuaa

SEQ ID NO: 2251553 - RNA, 20 nt, Yersinia pestis
gaugacgccguacaaauaua

SEQ ID NO: 2251554 - RNA, 20 nt, Yersinia pestis
gaugaccgugacauuuucac

SEQ ID NO: 2251555 - RNA, 12 nt, Yersinia pestis
aaagccugccau

SEQ ID NO: 2251556 - RNA, 16 nt, Yersinia pestis
gaugagucgcugguau

SEQ ID NO: 2251557 - RNA, 20 nt, Yersinia pestis
gaugauauacccaccagaga

SEQ ID NO: 2251558 - RNA, 13 nt, Yersinia pestis
gaugauaucaccu

SEQ ID NO: 2251559 - RNA, 18 nt, Yersinia pestis
gaugauaaguuugaugua

SEQ ID NO: 2251560 - RNA, 20 nt, Yersinia pestis
gaugauuuuuacagcaaacg

SEQ ID NO: 2251561 - RNA, 13 nt, Yersinia pestis
gaugccacuguuc

SEQ ID NO: 2251562 - RNA, 18 nt, Yersinia pestis
gaugcauuaagccucagu

SEQ ID NO: 2251563 - RNA, 21 nt, Yersinia pestis
gaugcauguuauuggcuaaag

SEQ ID NO: 2251564 - RNA, 19 nt, Yersinia pestis
gaugcaguaaauagucuug

SEQ ID NO: 2251565 - RNA, 16 nt, Yersinia pestis
gaugcaguagggcgcu

SEQ ID NO: 2251566 - RNA, 20 nt, Yersinia pestis
gaugcauauuugcagaaagu

SEQ ID NO: 2251567 - RNA, 18 nt, Yersinia pestis
gaugcauccuugaucgcc

SEQ ID NO: 2251568 - RNA, 13 nt, Yersinia pestis
gaugcuaaagcgu

SEQ ID NO: 2251569 - RNA, 17 nt, Yersinia pestis
gaugcuagugauaaacu

SEQ ID NO: 2251570 - RNA, 23 nt, Yersinia pestis
gaugcggguuuuuuuacauauaa

SEQ ID NO: 2251571 - RNA, 23 nt, Yersinia pestis
gaugcgcgacauuuugugcucug

SEQ ID NO: 2251572 - RNA, 21 nt, Yersinia pestis
gaugcuuucaucgaaaaaaau

SEQ ID NO: 2251573 - RNA, 19 nt, Yersinia pestis
gauggaacaggauuuucaa

SEQ ID NO: 2251574 - RNA, 20 nt, Yersinia pestis
gauggauccccguucuagua

SEQ ID NO: 2251575 - RNA, 19 nt, Yersinia pestis
gauggaguaaucauugcca

SEQ ID NO: 2251576 - RNA, 13 nt, Yersinia pestis
gauggagugguca

SEQ ID NO: 2251577 - RNA, 14 nt, Yersinia pestis
gauggaguaaucau

SEQ ID NO: 2251578 - RNA, 20 nt, Yersinia pestis
gauggauuugcacauagccc

SEQ ID NO: 2251579 - RNA, 16 nt, Yersinia pestis
gauggcauucguggug

SEQ ID NO: 2251580 - RNA, 16 nt, Yersinia pestis
gauggcgaucaagccc

SEQ ID NO: 2251581 - RNA, 18 nt, Yersinia pestis
gauggcgaucaagguuuc

SEQ ID NO: 2251582 - RNA, 22 nt, Yersinia pestis
gauggcggcuggaaaaccaauu

SEQ ID NO: 2251583 - RNA, 14 nt, Yersinia pestis
gauggcguuuucuu

SEQ ID NO: 2251584 - RNA, 13 nt, Yersinia pestis
gauggucacccuc

SEQ ID NO: 2251585 - RNA, 22 nt, Yersinia pestis
gaugggcaggguauuuucuccu

SEQ ID NO: 2251586 - RNA, 15 nt, Yersinia pestis
gaugucaucuuccgu

SEQ ID NO: 2251587 - RNA, 20 nt, Yersinia pestis
gauguagcagaucuauuugc

SEQ ID NO: 2251588 - RNA, 13 nt, Yersinia pestis
gauguauccaagg

SEQ ID NO: 2251589 - RNA, 22 nt, Yersinia pestis
gauguagucccccuccggcgcc

SEQ ID NO: 2251590 - RNA, 20 nt, Yersinia pestis
gaugguuaacucauuuaucu

SEQ ID NO: 2251591 - RNA, 17 nt, Yersinia pestis
gaugguuaauccaccug

SEQ ID NO: 2251592 - RNA, 17 nt, Yersinia pestis
gaugguguaacccgccu

SEQ ID NO: 2251593 - RNA, 21 nt, Yersinia pestis
gaugguggcucugccaauaaa

SEQ ID NO: 2251594 - RNA, 23 nt, Yersinia pestis
gaugguggcucugccaauaaagu

SEQ ID NO: 2251595 - RNA, 12 nt, Yersinia pestis
gauguaaaacac

SEQ ID NO: 2251596 - RNA, 16 nt, Yersinia pestis
gauguuuaacccaaug

SEQ ID NO: 2251597 - RNA, 14 nt, Yersinia pestis
gauguucgcuggug

SEQ ID NO: 2251598 - RNA, 15 nt, Yersinia pestis
gauuaagacuuucuc

SEQ ID NO: 2251599 - RNA, 21 nt, Yersinia pestis
gauuaacuuuucuucauugcu

SEQ ID NO: 2251600 - RNA, 15 nt, Yersinia pestis
gauuaauaaguaaau

SEQ ID NO: 2251601 - RNA, 11 nt, Yersinia pestis
gauuaauaaca

SEQ ID NO: 2251602 - RNA, 12 nt, Yersinia pestis
gauuaaccuuau

SEQ ID NO: 2251603 - RNA, 13 nt, Yersinia pestis
gauuaacauccau

SEQ ID NO: 2251604 - RNA, 19 nt, Yersinia pestis
gauguuacggguaaugaau

SEQ ID NO: 2251605 - RNA, 12 nt, Yersinia pestis
gauguuaugagg

SEQ ID NO: 2251606 - RNA, 22 nt, Yersinia pestis
gauguguuuaaaucuuucucca

SEQ ID NO: 2251607 - RNA, 23 nt, Yersinia pestis
gauguggauaauuucagcagcac

SEQ ID NO: 2251608 - RNA, 20 nt, Yersinia pestis
gaugugauccacacagcauu

SEQ ID NO: 2251609 - RNA, 13 nt, Yersinia pestis
gauuaugcugacc

SEQ ID NO: 2251610 - RNA, 12 nt, Yersinia pestis
gauuauuauuca

SEQ ID NO: 2251611 - RNA, 15 nt, Yersinia pestis
gauuauuucagcuuc

SEQ ID NO: 2251612 - RNA, 14 nt, Yersinia pestis
gauuagcuucugcu

SEQ ID NO: 2251613 - RNA, 16 nt, Yersinia pestis
gauuagccauaagaua

SEQ ID NO: 2251614 - RNA, 11 nt, Yersinia pestis
gauuacuggcc

SEQ ID NO: 2251615 - RNA, 18 nt, Yersinia pestis
gauuacuggcuaucuuau

SEQ ID NO: 2251616 - RNA, 15 nt, Yersinia pestis
gauuaccaauaauua

SEQ ID NO: 2251617 - RNA, 23 nt, Yersinia pestis
gauuaauuaacacccaauaauaa

SEQ ID NO: 2251618 - RNA, 13 nt, Yersinia pestis
gauucacaggcga

SEQ ID NO: 2251619 - RNA, 14 nt, Yersinia pestis
gauucacaggcgag

SEQ ID NO: 2251620 - RNA, 20 nt, Yersinia pestis
gauucacaggcgaguuggcu

SEQ ID NO: 2251621 - RNA, 14 nt, Yersinia pestis
gauucagaaaggua

SEQ ID NO: 2251622 - RNA, 19 nt, Yersinia pestis
gauucaccaguagcccagc

SEQ ID NO: 2251623 - RNA, 11 nt, Yersinia pestis
gauucaucaua

SEQ ID NO: 2251624 - RNA, 19 nt, Yersinia pestis
gauucauaccuguacuuug

SEQ ID NO: 2251625 - RNA, 19 nt, Yersinia pestis
gauucagaaagguaugugc

SEQ ID NO: 2251626 - RNA, 19 nt, Yersinia pestis
gauucguagaaacaucgcc

SEQ ID NO: 2251627 - RNA, 18 nt, Yersinia pestis
gauuccgguacugugcug

SEQ ID NO: 2251628 - RNA, 19 nt, Yersinia pestis
gauucgcaaagcgggccag

SEQ ID NO: 2251629 - RNA, 22 nt, Yersinia pestis
gauugcuggcgcugaucaucau

SEQ ID NO: 2251630 - RNA, 20 nt, Yersinia pestis
gauugcaacaacgccagaua

SEQ ID NO: 2251631 - RNA, 16 nt, Yersinia pestis
gauucucggcggggag

SEQ ID NO: 2251632 - RNA, 22 nt, Yersinia pestis
gauugacggaaaauuaacuuau

SEQ ID NO: 2251633 - RNA, 19 nt, Yersinia pestis
gauugacugaaugugaaga

SEQ ID NO: 2251634 - RNA, 17 nt, Yersinia pestis
gauugacugaaugugaa

SEQ ID NO: 2251635 - RNA, 18 nt, Yersinia pestis
gauugaccaucaaccgug

SEQ ID NO: 2251636 - RNA, 15 nt, Yersinia pestis
gauuuuaagcacugc

SEQ ID NO: 2251637 - RNA, 16 nt, Yersinia pestis
gauuugugcaaauaag

SEQ ID NO: 2251638 - RNA, 22 nt, Yersinia pestis
gauuuguugaugaaugauggua

SEQ ID NO: 2251639 - RNA, 19 nt, Yersinia pestis
gauuuucaugauccacaau

SEQ ID NO: 2251640 - RNA, 14 nt, Yersinia pestis
gauuuuccgcagcu

SEQ ID NO: 2251641 - RNA, 16 nt, Yersinia pestis
gauuugcggcaugaua

SEQ ID NO: 2251642 - RNA, 14 nt, Yersinia pestis
gauuucagcugcuu

SEQ ID NO: 2251643 - RNA, 14 nt, Yersinia pestis
gauuucacuuuccc

SEQ ID NO: 2251644 - RNA, 15 nt, Yersinia pestis
gauuucaucauucaa

SEQ ID NO: 2251645 - RNA, 21 nt, Yersinia pestis
gauuucaccuauaauuaacag

SEQ ID NO: 2251646 - RNA, 20 nt, Yersinia pestis
gauuucacggauaucaacau

SEQ ID NO: 2251647 - RNA, 19 nt, Yersinia pestis
gauuuacguguucuuaauu

SEQ ID NO: 2251648 - RNA, 23 nt, Yersinia pestis
gauuuaaauaacagcuaaaauga

SEQ ID NO: 2251649 - RNA, 19 nt, Yersinia pestis
gauuuaaauauuauuuaau

SEQ ID NO: 2251650 - RNA, 19 nt, Yersinia pestis
gauugguacgggugugcug

SEQ ID NO: 2251651 - RNA, 14 nt, Yersinia pestis
gcaaaucaaacaaa

SEQ ID NO: 2251652 - RNA, 14 nt, Yersinia pestis
gcaaagggcaacaa

SEQ ID NO: 2251653 - RNA, 21 nt, Yersinia pestis
gcaaauaaagggccugcaaac

SEQ ID NO: 2251654 - RNA, 14 nt, Yersinia pestis
gcaaauuuauccaa

SEQ ID NO: 2251655 - RNA, 22 nt, Yersinia pestis
gcaacaaacagccgaucaaccc

SEQ ID NO: 2251656 - RNA, 16 nt, Yersinia pestis
gcaaauucccaccaua

SEQ ID NO: 2251657 - RNA, 21 nt, Yersinia pestis
gcaaauugcgagcugagcuua

SEQ ID NO: 2251658 - RNA, 23 nt, Yersinia pestis
gcaaaucgauacugccaucauca

SEQ ID NO: 2251659 - RNA, 15 nt, Yersinia pestis
gcaaauuaccaccac

SEQ ID NO: 2251660 - RNA, 12 nt, Yersinia pestis
gcaaaugucaga

SEQ ID NO: 2251661 - RNA, 12 nt, Yersinia pestis
gcaacagauaau

SEQ ID NO: 2251662 - RNA, 15 nt, Yersinia pestis
gcaacaaccccauga

SEQ ID NO: 2251663 - RNA, 18 nt, Yersinia pestis
gcaacacagucgcacuga

SEQ ID NO: 2251664 - RNA, 16 nt, Yersinia pestis
gcaacauuaaaaauac

SEQ ID NO: 2251665 - RNA, 21 nt, Yersinia pestis
gcaacccuuaugccgugacug

SEQ ID NO: 2251666 - RNA, 15 nt, Yersinia pestis
gcaaccacuuaucca

SEQ ID NO: 2251667 - RNA, 16 nt, Yersinia pestis
gcaaccacuuauccag

SEQ ID NO: 2251668 - RNA, 14 nt, Yersinia pestis
gcaaaaauuacagu

SEQ ID NO: 2251669 - RNA, 15 nt, Yersinia pestis
gcaaaaugcucuuca

SEQ ID NO: 2251670 - RNA, 10 nt, Yersinia pestis
gauuuugcug

SEQ ID NO: 2251671 - RNA, 19 nt, Yersinia pestis
gauuuuuaacgucagauaa

SEQ ID NO: 2251672 - RNA, 15 nt, Yersinia pestis
gauuuuuaucuuucu

SEQ ID NO: 2251673 - RNA, 20 nt, Yersinia pestis
gcaaaaaaauccccggacca

SEQ ID NO: 2251674 - RNA, 14 nt, Yersinia pestis
gauuuuuuugcuuu

SEQ ID NO: 2251675 - RNA, 12 nt, Yersinia pestis
gauuuuuuguuc

SEQ ID NO: 2251676 - RNA, 21 nt, Yersinia pestis
gcaaaaacaaauaauuaggau

SEQ ID NO: 2251677 - RNA, 21 nt, Yersinia pestis
gcaaaaacagucauuaacaca

SEQ ID NO: 2251678 - RNA, 13 nt, Yersinia pestis
gcaaagaagaaua

SEQ ID NO: 2251679 - RNA, 19 nt, Yersinia pestis
gcaaacuuaaaaaucaaaa

SEQ ID NO: 2251680 - RNA, 15 nt, Yersinia pestis
gcaaagcaucaauca

SEQ ID NO: 2251681 - RNA, 13 nt, Yersinia pestis
gcaaagagucgca

SEQ ID NO: 2251682 - RNA, 15 nt, Yersinia pestis
gcaaagaagaauaag

SEQ ID NO: 2251683 - RNA, 22 nt, Yersinia pestis
gcaaagacuacacacagcaaua

SEQ ID NO: 2251684 - RNA, 17 nt, Yersinia pestis
gcaaagcgggccagcaa

SEQ ID NO: 2251685 - RNA, 13 nt, Yersinia pestis
gcaaacucagcca

SEQ ID NO: 2251686 - RNA, 17 nt, Yersinia pestis
gcaaacgcauuugagua

SEQ ID NO: 2251687 - RNA, 18 nt, Yersinia pestis
gcaaacgcugcacaucau

SEQ ID NO: 2251688 - RNA, 18 nt, Yersinia pestis
gccauuguugaauaccaa

SEQ ID NO: 2251689 - RNA, 19 nt, Yersinia pestis
gccauuuacccgucauccu

SEQ ID NO: 2251690 - RNA, 20 nt, Yersinia pestis
gccauuucaccaauauguuc

SEQ ID NO: 2251691 - RNA, 20 nt, Yersinia pestis
gccauugccgaaccugcaug

SEQ ID NO: 2251692 - RNA, 21 nt, Yersinia pestis
gccauugccgaaccugcaugu

SEQ ID NO: 2251693 - RNA, 16 nt, Yersinia pestis
gcccaaaugagcagca

SEQ ID NO: 2251694 - RNA, 20 nt, Yersinia pestis
gcccaaugcugucacuguca

SEQ ID NO: 2251695 - RNA, 20 nt, Yersinia pestis
gccaucuuguucuaauaaua

SEQ ID NO: 2251696 - RNA, 22 nt, Yersinia pestis
gccauuacaucccgccauggca

SEQ ID NO: 2251697 - RNA, 21 nt, Yersinia pestis
gccauuaaccuaaaaacguca

SEQ ID NO: 2251698 - RNA, 12 nt, Yersinia pestis
gccauuacccuc

SEQ ID NO: 2251699 - RNA, 21 nt, Yersinia pestis
gccauguguuuguuuggauaa

SEQ ID NO: 2251700 - RNA, 23 nt, Yersinia pestis
gccauguguuuguuuggauaaaa

SEQ ID NO: 2251701 - RNA, 15 nt, Yersinia pestis
gccaugcuggaugaa

SEQ ID NO: 2251702 - RNA, 21 nt, Yersinia pestis
gccauauguugccaccagcgu

SEQ ID NO: 2251703 - RNA, 13 nt, Yersinia pestis
gccauauccaacu

SEQ ID NO: 2251704 - RNA, 17 nt, Yersinia pestis
gccaggcgacaugguca

SEQ ID NO: 2251705 - RNA, 20 nt, Yersinia pestis
gccaucaucuucaaccugga

SEQ ID NO: 2251706 - RNA, 16 nt, Yersinia pestis
gccaucaggcaaaagc

SEQ ID NO: 2251707 - RNA, 21 nt, Yersinia pestis
gccaucgcaccaaacggaaug

SEQ ID NO: 2251708 - RNA, 21 nt, Yersinia pestis
gccauccuucagacugcugac

SEQ ID NO: 2251709 - RNA, 19 nt, Yersinia pestis
gcccacuggccugagaacc

SEQ ID NO: 2251710 - RNA, 20 nt, Yersinia pestis
gcccaucaugccagcaauau

SEQ ID NO: 2251711 - RNA, 21 nt, Yersinia pestis
gcccagcguuggcagaaagug

SEQ ID NO: 2251712 - RNA, 21 nt, Yersinia pestis
gcccaggcaaucucuccccaa

SEQ ID NO: 2251713 - RNA, 13 nt, Yersinia pestis
gcccccucccgau

SEQ ID NO: 2251714 - RNA, 18 nt, Yersinia pestis
gcccccuagugauggggg

SEQ ID NO: 2251715 - RNA, 14 nt, Yersinia pestis
gccccgccuaucag

SEQ ID NO: 2251716 - RNA, 16 nt, Yersinia pestis
gccccauggcuaacau

SEQ ID NO: 2251717 - RNA, 22 nt, Yersinia pestis
gccccaugguuacgccagcagc

SEQ ID NO: 2251718 - RNA, 21 nt, Yersinia pestis
gcccccaauaagggccacccu

SEQ ID NO: 2251719 - RNA, 23 nt, Yersinia pestis
gcccccgccuguauccagcagcg

SEQ ID NO: 2251720 - RNA, 20 nt, Yersinia pestis
gcccauggcugaaauaacuu

SEQ ID NO: 2251721 - RNA, 12 nt, Yersinia pestis
gcccauugcgcu

SEQ ID NO: 2251722 - RNA, 17 nt, Yersinia pestis
gcccgcgacgagagaac

SEQ ID NO: 2251723 - RNA, 17 nt, Yersinia pestis
gccccuguuugcgcagc

SEQ ID NO: 2251724 - RNA, 23 nt, Yersinia pestis
gccccuuguugccgguaggguuc

SEQ ID NO: 2251725 - RNA, 13 nt, Yersinia pestis
gccccuucuggug

SEQ ID NO: 2251726 - RNA, 15 nt, Yersinia pestis
gccccuugcuucagu

SEQ ID NO: 2251727 - RNA, 20 nt, Yersinia pestis
gccccuugcuucaguuuugc

SEQ ID NO: 2251728 - RNA, 23 nt, Yersinia pestis
gcccggcuaaacgcucaaacaau

SEQ ID NO: 2251729 - RNA, 18 nt, Yersinia pestis
gcccggcucauccgccaa

SEQ ID NO: 2251730 - RNA, 22 nt, Yersinia pestis
gcccggcugauauaacaaguua

SEQ ID NO: 2251731 - RNA, 14 nt, Yersinia pestis
gcccgcgcauauag

SEQ ID NO: 2251732 - RNA, 22 nt, Yersinia pestis
gcccgcggccaauagcaaaccc

SEQ ID NO: 2251733 - RNA, 14 nt, Yersinia pestis
gcccggaagguuuc

SEQ ID NO: 2251734 - RNA, 14 nt, Yersinia pestis
gcccgcuucccuac

SEQ ID NO: 2251735 - RNA, 22 nt, Yersinia pestis
gcccgcuaucacuagcgggccu

SEQ ID NO: 2251736 - RNA, 21 nt, Yersinia pestis
gcccgcuagugauagcgggcc

SEQ ID NO: 2251737 - RNA, 15 nt, Yersinia pestis
gcccgcuaucacuag

SEQ ID NO: 2251738 - RNA, 21 nt, Yersinia pestis
gcccgcuaucacuagcgggcc

SEQ ID NO: 2251739 - RNA, 20 nt, Yersinia pestis
gcccugccugguauuuucua

SEQ ID NO: 2251740 - RNA, 14 nt, Yersinia pestis
gcccugccuggcag

SEQ ID NO: 2251741 - RNA, 21 nt, Yersinia pestis
gcccuguaacuuuauugacug

SEQ ID NO: 2251742 - RNA, 17 nt, Yersinia pestis
gcccuugccauaaaugg

SEQ ID NO: 2251743 - RNA, 20 nt, Yersinia pestis
gcccuugagggucgcccgga

SEQ ID NO: 2251744 - RNA, 17 nt, Yersinia pestis
gccgaaccccuagccag

SEQ ID NO: 2251745 - RNA, 19 nt, Yersinia pestis
gccgaaccccuagccagcc

SEQ ID NO: 2251746 - RNA, 22 nt, Yersinia pestis
gccgaaccuuuugccaguaacg

SEQ ID NO: 2251747 - RNA, 17 nt, Yersinia pestis
gccgacaaaauccccca

SEQ ID NO: 2251748 - RNA, 12 nt, Yersinia pestis
gccgacaaaccc

SEQ ID NO: 2251749 - RNA, 13 nt, Yersinia pestis
gccgacaauacug

SEQ ID NO: 2251750 - RNA, 13 nt, Yersinia pestis
gccgagaacagaa

SEQ ID NO: 2251751 - RNA, 15 nt, Yersinia pestis
gccgcacugccacca

SEQ ID NO: 2251752 - RNA, 13 nt, Yersinia pestis
gccgcagauaaac

SEQ ID NO: 2251753 - RNA, 18 nt, Yersinia pestis
gccgcagcagugccuggu

SEQ ID NO: 2251754 - RNA, 14 nt, Yersinia pestis
gccgcagccagcgu

SEQ ID NO: 2251755 - RNA, 14 nt, Yersinia pestis
gccgcaucaaagcg

SEQ ID NO: 2251756 - RNA, 17 nt, Yersinia pestis
gccgcaugcaacagaua

SEQ ID NO: 2251757 - RNA, 15 nt, Yersinia pestis
gccgcauucaccacc

SEQ ID NO: 2251758 - RNA, 14 nt, Yersinia pestis
gccgcauuguucuc

SEQ ID NO: 2251759 - RNA, 15 nt, Yersinia pestis
gccgauaaucccugc

SEQ ID NO: 2251760 - RNA, 16 nt, Yersinia pestis
gccgauauacacccca

SEQ ID NO: 2251761 - RNA, 15 nt, Yersinia pestis
aaagcugauaaccug

SEQ ID NO: 2251762 - RNA, 18 nt, Yersinia pestis
aaagcugaacuuuacuuu

SEQ ID NO: 2251763 - RNA, 21 nt, Yersinia pestis
aaagcugaacuuuacuuuaau

SEQ ID NO: 2251764 - RNA, 14 nt, Yersinia pestis
gccgccgccagccc

SEQ ID NO: 2251765 - RNA, 20 nt, Yersinia pestis
gccgcgcccuaacaggcgca

SEQ ID NO: 2251766 - RNA, 17 nt, Yersinia pestis
gccgcgcccuaacaggc

SEQ ID NO: 2251767 - RNA, 18 nt, Yersinia pestis
gccgccuucaacugugga

SEQ ID NO: 2251768 - RNA, 14 nt, Yersinia pestis
gccgcgaaaaacca

SEQ ID NO: 2251769 - RNA, 19 nt, Yersinia pestis
gccgcuggcgauccccuuc

SEQ ID NO: 2251770 - RNA, 17 nt, Yersinia pestis
gccgcugcgcaagcgcu

SEQ ID NO: 2251771 - RNA, 17 nt, Yersinia pestis
gccgcucgguagcaaaa

SEQ ID NO: 2251772 - RNA, 15 nt, Yersinia pestis
gccgcucaugcccca

SEQ ID NO: 2251773 - RNA, 14 nt, Yersinia pestis
gccgcuccagcacu

SEQ ID NO: 2251774 - RNA, 16 nt, Yersinia pestis
gccgcuagugagugaa

SEQ ID NO: 2251775 - RNA, 18 nt, Yersinia pestis
gccgcuaauuuucccugu

SEQ ID NO: 2251776 - RNA, 17 nt, Yersinia pestis
gccgcggugaagaacag

SEQ ID NO: 2251777 - RNA, 17 nt, Yersinia pestis
gccgcgguuaagcuagc

SEQ ID NO: 2251778 - RNA, 14 nt, Yersinia pestis
gccgcggcggccag

SEQ ID NO: 2251779 - RNA, 20 nt, Yersinia pestis
gccagagacauaaagcccgc

SEQ ID NO: 2251780 - RNA, 23 nt, Yersinia pestis
gccagaaucacugucaaaaagca

SEQ ID NO: 2251781 - RNA, 15 nt, Yersinia pestis
gccagaaucaaccac

SEQ ID NO: 2251782 - RNA, 16 nt, Yersinia pestis
gccagaaucagcccca

SEQ ID NO: 2251783 - RNA, 20 nt, Yersinia pestis
gccagacacugacaucauca

SEQ ID NO: 2251784 - RNA, 18 nt, Yersinia pestis
gccacuuguagguuaaau

SEQ ID NO: 2251785 - RNA, 16 nt, Yersinia pestis
gccagauuauccagcc

SEQ ID NO: 2251786 - RNA, 21 nt, Yersinia pestis
gccagauucgcaaagcgggcc

SEQ ID NO: 2251787 - RNA, 13 nt, Yersinia pestis
gccagauucuagc

SEQ ID NO: 2251788 - RNA, 20 nt, Yersinia pestis
gccagauugccaaucagaac

SEQ ID NO: 2251789 - RNA, 19 nt, Yersinia pestis
gccagauugugcggcuggc

SEQ ID NO: 2251790 - RNA, 15 nt, Yersinia pestis
gccagauuuaaauca

SEQ ID NO: 2251791 - RNA, 17 nt, Yersinia pestis
gccagauagaccccuuc

SEQ ID NO: 2251792 - RNA, 19 nt, Yersinia pestis
gccagauccguaccaccac

SEQ ID NO: 2251793 - RNA, 19 nt, Yersinia pestis
gccagauccucuuuauugg

SEQ ID NO: 2251794 - RNA, 21 nt, Yersinia pestis
gccagcaauauauugcucuau

SEQ ID NO: 2251795 - RNA, 20 nt, Yersinia pestis
gccagcaauuggccuuccau

SEQ ID NO: 2251796 - RNA, 22 nt, Yersinia pestis
gccagcacguuuuaaugccaau

SEQ ID NO: 2251797 - RNA, 15 nt, Yersinia pestis
gccaaauuauucauc

SEQ ID NO: 2251798 - RNA, 15 nt, Yersinia pestis
gccacacacucaggc

SEQ ID NO: 2251799 - RNA, 20 nt, Yersinia pestis
gccacacagaaucaccaaca

SEQ ID NO: 2251800 - RNA, 13 nt, Yersinia pestis
gccacacaauaca

SEQ ID NO: 2251801 - RNA, 18 nt, Yersinia pestis
gccacacaauacauagaa

SEQ ID NO: 2251802 - RNA, 12 nt, Yersinia pestis
gccaaauguaga

SEQ ID NO: 2251803 - RNA, 19 nt, Yersinia pestis
gccaccaaaugcucagcca

SEQ ID NO: 2251804 - RNA, 17 nt, Yersinia pestis
gccaccagaaucaucag

SEQ ID NO: 2251805 - RNA, 14 nt, Yersinia pestis
gccaccucuuccuc

SEQ ID NO: 2251806 - RNA, 15 nt, Yersinia pestis
gccacgaugugaagc

SEQ ID NO: 2251807 - RNA, 17 nt, Yersinia pestis
gccacgccaguaaacag

SEQ ID NO: 2251808 - RNA, 22 nt, Yersinia pestis
gccacgccaguaaacagccagc

SEQ ID NO: 2251809 - RNA, 19 nt, Yersinia pestis
gccacgccaguaaacagcc

SEQ ID NO: 2251810 - RNA, 13 nt, Yersinia pestis
gccaccagcgcca

SEQ ID NO: 2251811 - RNA, 13 nt, Yersinia pestis
gccaccagacuga

SEQ ID NO: 2251812 - RNA, 13 nt, Yersinia pestis
gccaccgcuggug

SEQ ID NO: 2251813 - RNA, 19 nt, Yersinia pestis
gccagcgccccaucaauuu

SEQ ID NO: 2251814 - RNA, 20 nt, Yersinia pestis
gccagccggugauuggggcu

SEQ ID NO: 2251815 - RNA, 18 nt, Yersinia pestis
gccagccccaauccgccu

SEQ ID NO: 2251816 - RNA, 21 nt, Yersinia pestis
gccagccccaaucaccggcug

SEQ ID NO: 2251817 - RNA, 23 nt, Yersinia pestis
gccagcauucaggcuuuuuucua

SEQ ID NO: 2251818 - RNA, 18 nt, Yersinia pestis
gccagcagaguaaagcag

SEQ ID NO: 2251819 - RNA, 19 nt, Yersinia pestis
gccaggauagccgccgcuu

SEQ ID NO: 2251820 - RNA, 23 nt, Yersinia pestis
gccaggcacuguccgucaaacca

SEQ ID NO: 2251821 - RNA, 20 nt, Yersinia pestis
gccagcgcuaacgguggcau

SEQ ID NO: 2251822 - RNA, 20 nt, Yersinia pestis
gccagcgggaaucaaacucu

SEQ ID NO: 2251823 - RNA, 20 nt, Yersinia pestis
gcauucauaucuuuaccugu

SEQ ID NO: 2251824 - RNA, 22 nt, Yersinia pestis
gcauucccugcgguuauuugcu

SEQ ID NO: 2251825 - RNA, 23 nt, Yersinia pestis
gcauucauaucguccaaagggag

SEQ ID NO: 2251826 - RNA, 14 nt, Yersinia pestis
gcauuggauaauuu

SEQ ID NO: 2251827 - RNA, 16 nt, Yersinia pestis
gcauugagguuuucug

SEQ ID NO: 2251828 - RNA, 21 nt, Yersinia pestis
gcauucgugccauaaaguuuu

SEQ ID NO: 2251829 - RNA, 16 nt, Yersinia pestis
gcauuuuaucgugaau

SEQ ID NO: 2251830 - RNA, 12 nt, Yersinia pestis
gcauuuucagua

SEQ ID NO: 2251831 - RNA, 19 nt, Yersinia pestis
gccaaacgugcuacuuaau

SEQ ID NO: 2251832 - RNA, 23 nt, Yersinia pestis
gccaaacgugcuacuuaauaucu

SEQ ID NO: 2251833 - RNA, 14 nt, Yersinia pestis
gcauuucaacaaaa

SEQ ID NO: 2251834 - RNA, 17 nt, Yersinia pestis
gcauuucauuaaaugcu

SEQ ID NO: 2251835 - RNA, 20 nt, Yersinia pestis
gcauuuaucauauuaacaua

SEQ ID NO: 2251836 - RNA, 13 nt, Yersinia pestis
gcauuucacccuc

SEQ ID NO: 2251837 - RNA, 21 nt, Yersinia pestis
gcauuucacccucugcagcuu

SEQ ID NO: 2251838 - RNA, 16 nt, Yersinia pestis
gcauuuaugaugcauu

SEQ ID NO: 2251839 - RNA, 19 nt, Yersinia pestis
gcaucuuucaguuuuauug

SEQ ID NO: 2251840 - RNA, 14 nt, Yersinia pestis
gcaugcccagccuc

SEQ ID NO: 2251841 - RNA, 21 nt, Yersinia pestis
gcaucuuuaccccauugcacc

SEQ ID NO: 2251842 - RNA, 18 nt, Yersinia pestis
gcaucuuccaaaggaagg

SEQ ID NO: 2251843 - RNA, 11 nt, Yersinia pestis
gcaucuuccaa

SEQ ID NO: 2251844 - RNA, 15 nt, Yersinia pestis
gcaucuuccaaagga

SEQ ID NO: 2251845 - RNA, 22 nt, Yersinia pestis
gcauguagcugcagccgcgaug

SEQ ID NO: 2251846 - RNA, 23 nt, Yersinia pestis
gcauuaauaccguuuucuuucaa

SEQ ID NO: 2251847 - RNA, 20 nt, Yersinia pestis
gcauggaagauaucuaauuu

SEQ ID NO: 2251848 - RNA, 23 nt, Yersinia pestis
gcaugguguagcugaacaaacuu

SEQ ID NO: 2251849 - RNA, 16 nt, Yersinia pestis
gcauggucccuacggu

SEQ ID NO: 2251850 - RNA, 21 nt, Yersinia pestis
gcauaacuggcgguuucaccu

SEQ ID NO: 2251851 - RNA, 13 nt, Yersinia pestis
gcauaaucagcgg

SEQ ID NO: 2251852 - RNA, 20 nt, Yersinia pestis
gcauaaucgcguucagagca

SEQ ID NO: 2251853 - RNA, 21 nt, Yersinia pestis
gcauaaucgcguucagagcag

SEQ ID NO: 2251854 - RNA, 15 nt, Yersinia pestis
gcauaugaaaaaccu

SEQ ID NO: 2251855 - RNA, 16 nt, Yersinia pestis
gcauaugaaaaaccuc

SEQ ID NO: 2251856 - RNA, 19 nt, Yersinia pestis
gcauaugaaaaaccuccgg

SEQ ID NO: 2251857 - RNA, 16 nt, Yersinia pestis
gcauagcuaaccuuaa

SEQ ID NO: 2251858 - RNA, 22 nt, Yersinia pestis
gcauagcuaaccuuaacuacac

SEQ ID NO: 2251859 - RNA, 18 nt, Yersinia pestis
gcauauugagcauacugu

SEQ ID NO: 2251860 - RNA, 19 nt, Yersinia pestis
gcauauuacccaguacugu

SEQ ID NO: 2251861 - RNA, 17 nt, Yersinia pestis
gcauauuacccaguacu

SEQ ID NO: 2251862 - RNA, 19 nt, Yersinia pestis
gcauauguagccagauaaa

SEQ ID NO: 2251863 - RNA, 21 nt, Yersinia pestis
gcaucaaacggcaacuucuac

SEQ ID NO: 2251864 - RNA, 17 nt, Yersinia pestis
gcauauuauuuugcaca

SEQ ID NO: 2251865 - RNA, 19 nt, Yersinia pestis
gcauauuuuggcaacucag

SEQ ID NO: 2251866 - RNA, 13 nt, Yersinia pestis
gcauauuucucuu

SEQ ID NO: 2251867 - RNA, 18 nt, Yersinia pestis
gcauauuguaaacuucca

SEQ ID NO: 2251868 - RNA, 15 nt, Yersinia pestis
gcaucaaccaagaca

SEQ ID NO: 2251869 - RNA, 22 nt, Yersinia pestis
gcaucauccagcucaacgaccc

SEQ ID NO: 2251870 - RNA, 15 nt, Yersinia pestis
gcaucgagaacgggc

SEQ ID NO: 2251871 - RNA, 17 nt, Yersinia pestis
gcauccuugaucgccaa

SEQ ID NO: 2251872 - RNA, 22 nt, Yersinia pestis
gcauccuugaucgccaaauaaa

SEQ ID NO: 2251873 - RNA, 18 nt, Yersinia pestis
gcauccaagccaucauua

SEQ ID NO: 2251874 - RNA, 16 nt, Yersinia pestis
gcaggcugucaggaac

SEQ ID NO: 2251875 - RNA, 14 nt, Yersinia pestis
gcagggcgacauua

SEQ ID NO: 2251876 - RNA, 16 nt, Yersinia pestis
gcaggauaaagcugaa

SEQ ID NO: 2251877 - RNA, 22 nt, Yersinia pestis
gcagcguuuuuagugcugccag

SEQ ID NO: 2251878 - RNA, 20 nt, Yersinia pestis
gcaaccgagaagucggcuuu

SEQ ID NO: 2251879 - RNA, 11 nt, Yersinia pestis
gcaggaagcaa

SEQ ID NO: 2251880 - RNA, 14 nt, Yersinia pestis
gcagcuuguugaua

SEQ ID NO: 2251881 - RNA, 14 nt, Yersinia pestis
gcaguuaaugacau

SEQ ID NO: 2251882 - RNA, 18 nt, Yersinia pestis
gcaguuaagguuagcuau

SEQ ID NO: 2251883 - RNA, 22 nt, Yersinia pestis
gcaguuaagguuagcuaugcag

SEQ ID NO: 2251884 - RNA, 20 nt, Yersinia pestis
gcaguuaacgacgccccacu

SEQ ID NO: 2251885 - RNA, 21 nt, Yersinia pestis
gcagugucagggcaauaacaa

SEQ ID NO: 2251886 - RNA, 19 nt, Yersinia pestis
gcagugcauugcagaaagc

SEQ ID NO: 2251887 - RNA, 19 nt, Yersinia pestis
gcagugccaucgccaacag

SEQ ID NO: 2251888 - RNA, 17 nt, Yersinia pestis
gcaguuugaaguaugac

SEQ ID NO: 2251889 - RNA, 12 nt, Yersinia pestis
gcauaaacugaa

SEQ ID NO: 2251890 - RNA, 21 nt, Yersinia pestis
gcauaaccgguaccggcuggg

SEQ ID NO: 2251891 - RNA, 21 nt, Yersinia pestis
gcauaaauauucauuaaaaaa

SEQ ID NO: 2251892 - RNA, 21 nt, Yersinia pestis
gcauaaaaauagcccucccug

SEQ ID NO: 2251893 - RNA, 15 nt, Yersinia pestis
gcauaaagcuauuca

SEQ ID NO: 2251894 - RNA, 16 nt, Yersinia pestis
gcauaaagguuugcca

SEQ ID NO: 2251895 - RNA, 21 nt, Yersinia pestis
gcauaaauacgguucaaauca

SEQ ID NO: 2251896 - RNA, 15 nt, Yersinia pestis
gcaggguauuuucuc

SEQ ID NO: 2251897 - RNA, 15 nt, Yersinia pestis
gcagggucaguaaua

SEQ ID NO: 2251898 - RNA, 20 nt, Yersinia pestis
gcaguaacggaauucagaac

SEQ ID NO: 2251899 - RNA, 18 nt, Yersinia pestis
gcaguaucccuggcucau

SEQ ID NO: 2251900 - RNA, 20 nt, Yersinia pestis
gcagucaccuuuuuagcgag

SEQ ID NO: 2251901 - RNA, 21 nt, Yersinia pestis
gcagucagcaugguagccugc

SEQ ID NO: 2251902 - RNA, 13 nt, Yersinia pestis
gcaguccaaaaaa

SEQ ID NO: 2251903 - RNA, 15 nt, Yersinia pestis
gcagucgauaaacau

SEQ ID NO: 2251904 - RNA, 12 nt, Yersinia pestis
gcagucugaggg

SEQ ID NO: 2251905 - RNA, 15 nt, Yersinia pestis
gcagucugagggcca

SEQ ID NO: 2251906 - RNA, 21 nt, Yersinia pestis
gcagucugaaacgccagccuc

SEQ ID NO: 2251907 - RNA, 16 nt, Yersinia pestis
gcagucugagccucau

SEQ ID NO: 2251908 - RNA, 20 nt, Yersinia pestis
gcagucugagccucaugaau

SEQ ID NO: 2251909 - RNA, 23 nt, Yersinia pestis
gcagucuccaucacucuucgugc

SEQ ID NO: 2251910 - RNA, 17 nt, Yersinia pestis
gcagucugaggagccau

SEQ ID NO: 2251911 - RNA, 15 nt, Yersinia pestis
gcagugacgcaguga

SEQ ID NO: 2251912 - RNA, 22 nt, Yersinia pestis
gcagugauaaggccuuuuucug

SEQ ID NO: 2251913 - RNA, 20 nt, Yersinia pestis
gcagugccacggauauccaa

SEQ ID NO: 2251914 - RNA, 23 nt, Yersinia pestis
gcagugcaucuuccaauucauaa

SEQ ID NO: 2251915 - RNA, 19 nt, Yersinia pestis
gcgcgcauuacccgaauca

SEQ ID NO: 2251916 - RNA, 17 nt, Yersinia pestis
gcgccuuccuuuuauuu

SEQ ID NO: 2251917 - RNA, 18 nt, Yersinia pestis
gcgccuguuagggcgcgg

SEQ ID NO: 2251918 - RNA, 19 nt, Yersinia pestis
gcgccuguuagggcgcggc

SEQ ID NO: 2251919 - RNA, 23 nt, Yersinia pestis
gcgccuguuagggcgcggcuggu

SEQ ID NO: 2251920 - RNA, 16 nt, Yersinia pestis
gcgcgcuucgagcccc

SEQ ID NO: 2251921 - RNA, 16 nt, Yersinia pestis
gcgccuguuagggcgc

SEQ ID NO: 2251922 - RNA, 17 nt, Yersinia pestis
gcgccgaaauaaaacca

SEQ ID NO: 2251923 - RNA, 14 nt, Yersinia pestis
gcgccgacugcuga

SEQ ID NO: 2251924 - RNA, 17 nt, Yersinia pestis
gcgccagggagggcgcg

SEQ ID NO: 2251925 - RNA, 20 nt, Yersinia pestis
gcgcccaagcuuggccccuu

SEQ ID NO: 2251926 - RNA, 16 nt, Yersinia pestis
gcgcccauccgcagga

SEQ ID NO: 2251927 - RNA, 14 nt, Yersinia pestis
gcgcccauccgcag

SEQ ID NO: 2251928 - RNA, 18 nt, Yersinia pestis
gcgcccaugccggauggu

SEQ ID NO: 2251929 - RNA, 21 nt, Yersinia pestis
gcggcuuucugccugugggcu

SEQ ID NO: 2251930 - RNA, 12 nt, Yersinia pestis
gcgggagucagu

SEQ ID NO: 2251931 - RNA, 15 nt, Yersinia pestis
gcgggccagcaacca

SEQ ID NO: 2251932 - RNA, 18 nt, Yersinia pestis
gcgguaaccccggcggcu

SEQ ID NO: 2251933 - RNA, 17 nt, Yersinia pestis
gcggcggcuaugugccg

SEQ ID NO: 2251934 - RNA, 16 nt, Yersinia pestis
gcggcuaaagcugcuu

SEQ ID NO: 2251935 - RNA, 15 nt, Yersinia pestis
gcggcggccauccca

SEQ ID NO: 2251936 - RNA, 17 nt, Yersinia pestis
gcgcugaucaucaucaa

SEQ ID NO: 2251937 - RNA, 13 nt, Yersinia pestis
gcgcugcaaagcc

SEQ ID NO: 2251938 - RNA, 21 nt, Yersinia pestis
gcgcugcaucagcagugacgu

SEQ ID NO: 2251939 - RNA, 13 nt, Yersinia pestis
gcgcugcagcgau

SEQ ID NO: 2251940 - RNA, 22 nt, Yersinia pestis
gcgcugcugguuuuacugaaac

SEQ ID NO: 2251941 - RNA, 16 nt, Yersinia pestis
gcggaaauaaggcgca

SEQ ID NO: 2251942 - RNA, 16 nt, Yersinia pestis
gcgcuuacaugaugaa

SEQ ID NO: 2251943 - RNA, 18 nt, Yersinia pestis
gcgcuuaccgucugggcu

SEQ ID NO: 2251944 - RNA, 15 nt, Yersinia pestis
gcgcuggcuuuuuca

SEQ ID NO: 2251945 - RNA, 17 nt, Yersinia pestis
gcgcuggcguaaaauau

SEQ ID NO: 2251946 - RNA, 18 nt, Yersinia pestis
gcggacgcuuuacuccuc

SEQ ID NO: 2251947 - RNA, 23 nt, Yersinia pestis
gcggcaggcaugguaagaauaaa

SEQ ID NO: 2251948 - RNA, 20 nt, Yersinia pestis
gcggcacugacacuccccug

SEQ ID NO: 2251949 - RNA, 23 nt, Yersinia pestis
gcggcaagaacaccgucaguaug

SEQ ID NO: 2251950 - RNA, 18 nt, Yersinia pestis
gcggccaugucaggccac

SEQ ID NO: 2251951 - RNA, 11 nt, Yersinia pestis
gcggccaauag

SEQ ID NO: 2251952 - RNA, 12 nt, Yersinia pestis
gcggcauccagu

SEQ ID NO: 2251953 - RNA, 23 nt, Yersinia pestis
gcggcaggcugaucuucuuguga

SEQ ID NO: 2251954 - RNA, 13 nt, Yersinia pestis
gcggcaucaccaa

SEQ ID NO: 2251955 - RNA, 21 nt, Yersinia pestis
gccucuucugucggagccuga

SEQ ID NO: 2251956 - RNA, 16 nt, Yersinia pestis
gccucuggugccaacg

SEQ ID NO: 2251957 - RNA, 12 nt, Yersinia pestis
gccucugcuccg

SEQ ID NO: 2251958 - RNA, 17 nt, Yersinia pestis
gccucugcugcugcccg

SEQ ID NO: 2251959 - RNA, 18 nt, Yersinia pestis
gccucuggccucgcccuu

SEQ ID NO: 2251960 - RNA, 20 nt, Yersinia pestis
gccucugaucauucgauccu

SEQ ID NO: 2251961 - RNA, 21 nt, Yersinia pestis
gccucugaucauucgauccua

SEQ ID NO: 2251962 - RNA, 14 nt, Yersinia pestis
gccugcugagccaa

SEQ ID NO: 2251963 - RNA, 16 nt, Yersinia pestis
gccuguauccagcagc

SEQ ID NO: 2251964 - RNA, 23 nt, Yersinia pestis
gccugucccuaucauucaacacu

SEQ ID NO: 2251965 - RNA, 18 nt, Yersinia pestis
gccuguuagggcgcggcu

SEQ ID NO: 2251966 - RNA, 13 nt, Yersinia pestis
gccuguucucucc

SEQ ID NO: 2251967 - RNA, 20 nt, Yersinia pestis
gccuguuuacguaaauagau

SEQ ID NO: 2251968 - RNA, 22 nt, Yersinia pestis
gccuuaacccgcgggagucagu

SEQ ID NO: 2251969 - RNA, 16 nt, Yersinia pestis
gccuggcuugaccuug

SEQ ID NO: 2251970 - RNA, 22 nt, Yersinia pestis
gccuggcgcauaguuucaauau

SEQ ID NO: 2251971 - RNA, 14 nt, Yersinia pestis
gcgaaaggaacaaa

SEQ ID NO: 2251972 - RNA, 15 nt, Yersinia pestis
gcgaaagacggauga

SEQ ID NO: 2251973 - RNA, 21 nt, Yersinia pestis
gcgaacgaagucgauaugagu

SEQ ID NO: 2251974 - RNA, 13 nt, Yersinia pestis
gccuugaaucaaa

SEQ ID NO: 2251975 - RNA, 14 nt, Yersinia pestis
gccuugaaucaaaa

SEQ ID NO: 2251976 - RNA, 15 nt, Yersinia pestis
gccuugaaacagcag

SEQ ID NO: 2251977 - RNA, 18 nt, Yersinia pestis
gccuugaaacagcagggg

SEQ ID NO: 2251978 - RNA, 21 nt, Yersinia pestis
gccuucagcgauacaaccggc

SEQ ID NO: 2251979 - RNA, 16 nt, Yersinia pestis
gccuuuuaauuuucag

SEQ ID NO: 2251980 - RNA, 15 nt, Yersinia pestis
gccuuggcauguuca

SEQ ID NO: 2251981 - RNA, 20 nt, Yersinia pestis
gccucgcggaaaucagcuuc

SEQ ID NO: 2251982 - RNA, 17 nt, Yersinia pestis
gccucgaugcucaggcc

SEQ ID NO: 2251983 - RNA, 22 nt, Yersinia pestis
gccucgaccugaauaucaccca

SEQ ID NO: 2251984 - RNA, 16 nt, Yersinia pestis
gccucgcuuacuggua

SEQ ID NO: 2251985 - RNA, 18 nt, Yersinia pestis
gccucaucguaaccccca

SEQ ID NO: 2251986 - RNA, 17 nt, Yersinia pestis
gccucaucucaugacaa

SEQ ID NO: 2251987 - RNA, 19 nt, Yersinia pestis
gccucaugaaugaggcuga

SEQ ID NO: 2251988 - RNA, 20 nt, Yersinia pestis
gccuccaacuuaucacugga

SEQ ID NO: 2251989 - RNA, 19 nt, Yersinia pestis
gccucacggcuaccagcag

SEQ ID NO: 2251990 - RNA, 14 nt, Yersinia pestis
gccuauccucaccg

SEQ ID NO: 2251991 - RNA, 16 nt, Yersinia pestis
gccuccagucccccuc

SEQ ID NO: 2251992 - RNA, 17 nt, Yersinia pestis
gccucccaauuagggga

SEQ ID NO: 2251993 - RNA, 18 nt, Yersinia pestis
gccguaucuuguaguaac

SEQ ID NO: 2251994 - RNA, 20 nt, Yersinia pestis
gccguauaaacgccuccgau

SEQ ID NO: 2251995 - RNA, 17 nt, Yersinia pestis
gccgcuuguugccaccc

SEQ ID NO: 2251996 - RNA, 18 nt, Yersinia pestis
gccgcuuguugccacccu

SEQ ID NO: 2251997 - RNA, 16 nt, Yersinia pestis
gccuacaacuugcugg

SEQ ID NO: 2251998 - RNA, 21 nt, Yersinia pestis
gccguuggcuaaauaaccaga

SEQ ID NO: 2251999 - RNA, 19 nt, Yersinia pestis
gccguuauagaucuccugc

SEQ ID NO: 2252000 - RNA, 18 nt, Yersinia pestis
gccguuacccccuucacc

SEQ ID NO: 2252001 - RNA, 17 nt, Yersinia pestis
gccgugacugccgggau

SEQ ID NO: 2252002 - RNA, 22 nt, Yersinia pestis
gccgugagcaaucuggcggccg

SEQ ID NO: 2252003 - RNA, 11 nt, Yersinia pestis
gccgugcuuga

SEQ ID NO: 2252004 - RNA, 17 nt, Yersinia pestis
gcgcauuucacccucug

SEQ ID NO: 2252005 - RNA, 18 nt, Yersinia pestis
gcgccaaauguagagcgu

SEQ ID NO: 2252006 - RNA, 20 nt, Yersinia pestis
gcgccaaaacgcgcgccagu

SEQ ID NO: 2252007 - RNA, 18 nt, Yersinia pestis
gcgcaucuuucgaugccc

SEQ ID NO: 2252008 - RNA, 22 nt, Yersinia pestis
gcgcauauaggcgaaaggcgca

SEQ ID NO: 2252009 - RNA, 20 nt, Yersinia pestis
gcgccacuucuuucacuaau

SEQ ID NO: 2252010 - RNA, 11 nt, Yersinia pestis
gcgccagcagc

SEQ ID NO: 2252011 - RNA, 18 nt, Yersinia pestis
gcgcagauuauggguggu

SEQ ID NO: 2252012 - RNA, 15 nt, Yersinia pestis
gcgcagaguauccag

SEQ ID NO: 2252013 - RNA, 13 nt, Yersinia pestis
gcgcagccacaug

SEQ ID NO: 2252014 - RNA, 16 nt, Yersinia pestis
gcgcacucauccucug

SEQ ID NO: 2252015 - RNA, 22 nt, Yersinia pestis
gcgcagcccccuuauggcacau

SEQ ID NO: 2252016 - RNA, 20 nt, Yersinia pestis
gcgcagguaaugucacugcc

SEQ ID NO: 2252017 - RNA, 18 nt, Yersinia pestis
gcgcaggguuuccaagcu

SEQ ID NO: 2252018 - RNA, 23 nt, Yersinia pestis
gcgcagguuaugcagcucaauca

SEQ ID NO: 2252019 - RNA, 23 nt, Yersinia pestis
gcgcagugcucgggugccucacg

SEQ ID NO: 2252020 - RNA, 23 nt, Yersinia pestis
gcgcagugccgucaauuaucaaa

SEQ ID NO: 2252021 - RNA, 12 nt, Yersinia pestis
gcgauauuuauc

SEQ ID NO: 2252022 - RNA, 13 nt, Yersinia pestis
gcgauauuuauca

SEQ ID NO: 2252023 - RNA, 14 nt, Yersinia pestis
gcgaucacaauaca

SEQ ID NO: 2252024 - RNA, 20 nt, Yersinia pestis
gcgaucuauucucuguaaug

SEQ ID NO: 2252025 - RNA, 15 nt, Yersinia pestis
gcgaugaaaaacaga

SEQ ID NO: 2252026 - RNA, 19 nt, Yersinia pestis
gcgauaaagagugaaauau

SEQ ID NO: 2252027 - RNA, 12 nt, Yersinia pestis
gcgacucauccg

SEQ ID NO: 2252028 - RNA, 15 nt, Yersinia pestis
gcgacuaauggccag

SEQ ID NO: 2252029 - RNA, 12 nt, Yersinia pestis
gcgaagggcgca

SEQ ID NO: 2252030 - RNA, 16 nt, Yersinia pestis
gcgauuaaaauaaagc

SEQ ID NO: 2252031 - RNA, 20 nt, Yersinia pestis
gcgaugaggcucuucugggc

SEQ ID NO: 2252032 - RNA, 17 nt, Yersinia pestis
gcgcaacugccauggaa

SEQ ID NO: 2252033 - RNA, 14 nt, Yersinia pestis
gcgcaccagcucaa

SEQ ID NO: 2252034 - RNA, 15 nt, Yersinia pestis
gcgcaccagcucaau

SEQ ID NO: 2252035 - RNA, 18 nt, Yersinia pestis
gcgcaccgaaauagucgc

SEQ ID NO: 2252036 - RNA, 19 nt, Yersinia pestis
aaauaaccagagacagcaa

SEQ ID NO: 2252037 - RNA, 20 nt, Yersinia pestis
aaauaaccagagacagcaac

SEQ ID NO: 2252038 - RNA, 13 nt, Yersinia pestis
aaauaaauuuauu

SEQ ID NO: 2252039 - RNA, 21 nt, Yersinia pestis
aaauaacaauucacucauaau

SEQ ID NO: 2252040 - RNA, 14 nt, Yersinia pestis
aaauaaauucuuua

SEQ ID NO: 2252041 - RNA, 16 nt, Yersinia pestis
aaauaacugccagggc

SEQ ID NO: 2252042 - RNA, 15 nt, Yersinia pestis
aaauaacguaguacu

SEQ ID NO: 2252043 - RNA, 17 nt, Yersinia pestis
ggcgacugugcuuugcc

SEQ ID NO: 2252044 - RNA, 11 nt, Yersinia pestis
ggcgagcacug

SEQ ID NO: 2252045 - RNA, 18 nt, Yersinia pestis
ggccuuucggcaaauuaa

SEQ ID NO: 2252046 - RNA, 13 nt, Yersinia pestis
ggcgaaaggcgca

SEQ ID NO: 2252047 - RNA, 12 nt, Yersinia pestis
ggcgaacagaaa

SEQ ID NO: 2252048 - RNA, 16 nt, Yersinia pestis
ggcgaacagaaaucaa

SEQ ID NO: 2252049 - RNA, 21 nt, Yersinia pestis
ggcgacaaucaauggccagcg

SEQ ID NO: 2252050 - RNA, 20 nt, Yersinia pestis
aaauaaucauaucaaaauaa

SEQ ID NO: 2252051 - RNA, 23 nt, Yersinia pestis
aaauaaucauaucaaaauaaaaa

SEQ ID NO: 2252052 - RNA, 15 nt, Yersinia pestis
aaauaaugaauuauu

SEQ ID NO: 2252053 - RNA, 16 nt, Yersinia pestis
aaauaauggccaagcg

SEQ ID NO: 2252054 - RNA, 22 nt, Yersinia pestis
aaauaauaucaagucuugaaga

SEQ ID NO: 2252055 - RNA, 13 nt, Yersinia pestis
aaauaauaucaau

SEQ ID NO: 2252056 - RNA, 12 nt, Yersinia pestis
aaauaagccagu

SEQ ID NO: 2252057 - RNA, 17 nt, Yersinia pestis
aaauaaggcgaauauga

SEQ ID NO: 2252058 - RNA, 22 nt, Yersinia pestis
aaauaaggcgaauaugauuaau

SEQ ID NO: 2252059 - RNA, 14 nt, Yersinia pestis
aaauaaguaacauu

SEQ ID NO: 2252060 - RNA, 22 nt, Yersinia pestis
aaauaaguauuucaaauaagug

SEQ ID NO: 2252061 - RNA, 14 nt, Yersinia pestis
ggcgauaucacuga

SEQ ID NO: 2252062 - RNA, 14 nt, Yersinia pestis
aaauaauuuguauu

SEQ ID NO: 2252063 - RNA, 22 nt, Yersinia pestis
aaauaauuuguauucucaucau

SEQ ID NO: 2252064 - RNA, 22 nt, Yersinia pestis
aaauaauguccccuugaguauc

SEQ ID NO: 2252065 - RNA, 21 nt, Yersinia pestis
ggcgcacauuacaagugccaa

SEQ ID NO: 2252066 - RNA, 16 nt, Yersinia pestis
aaauacccgguuucca

SEQ ID NO: 2252067 - RNA, 20 nt, Yersinia pestis
aaauacccagcuucuuuuaa

SEQ ID NO: 2252068 - RNA, 12 nt, Yersinia pestis
aaauacauauca

SEQ ID NO: 2252069 - RNA, 16 nt, Yersinia pestis
aaauacauccauguag

SEQ ID NO: 2252070 - RNA, 14 nt, Yersinia pestis
ggcgcacugauucu

SEQ ID NO: 2252071 - RNA, 19 nt, Yersinia pestis
ggcgcgucaucgcggcgca

SEQ ID NO: 2252072 - RNA, 15 nt, Yersinia pestis
ggcggaagacuucca

SEQ ID NO: 2252073 - RNA, 20 nt, Yersinia pestis
aaauaccgccaaauacaaac

SEQ ID NO: 2252074 - RNA, 18 nt, Yersinia pestis
aaauaccgcgaucaacaa

SEQ ID NO: 2252075 - RNA, 13 nt, Yersinia pestis
aaauaccgcugcu

SEQ ID NO: 2252076 - RNA, 24 nt, Yersinia pestis
aaauacggcgaaauauaaaacagu

SEQ ID NO: 2252077 - RNA, 18 nt, Yersinia pestis
ggcgccgucacguacugg

SEQ ID NO: 2252078 - RNA, 20 nt, Yersinia pestis
ggcgguaaccccggcggcug

SEQ ID NO: 2252079 - RNA, 20 nt, Yersinia pestis
ggcgguuaaucggaugguca

SEQ ID NO: 2252080 - RNA, 20 nt, Yersinia pestis
ggcgguuaauaacugccaau

SEQ ID NO: 2252081 - RNA, 20 nt, Yersinia pestis
ggcgguucauauuggccagu

SEQ ID NO: 2252082 - RNA, 21 nt, Yersinia pestis
ggcggucaaacuccccuggca

SEQ ID NO: 2252083 - RNA, 16 nt, Yersinia pestis
ggcgggagaguggcgg

SEQ ID NO: 2252084 - RNA, 20 nt, Yersinia pestis
ggcggcaaaagaacgugcug

SEQ ID NO: 2252085 - RNA, 14 nt, Yersinia pestis
ggcuguugacauaa

SEQ ID NO: 2252086 - RNA, 19 nt, Yersinia pestis
ggcuuaacucgccacucac

SEQ ID NO: 2252087 - RNA, 12 nt, Yersinia pestis
ggcuuagccacu

SEQ ID NO: 2252088 - RNA, 15 nt, Yersinia pestis
ggcuuagucauuaag

SEQ ID NO: 2252089 - RNA, 19 nt, Yersinia pestis
ggcuucaaaaucaccuggc

SEQ ID NO: 2252090 - RNA, 22 nt, Yersinia pestis
ggcuugcaaucagaggccauca

SEQ ID NO: 2252091 - RNA, 18 nt, Yersinia pestis
ggcuucuccugcgguggc

SEQ ID NO: 2252092 - RNA, 12 nt, Yersinia pestis
ggcuucuggaug

SEQ ID NO: 2252093 - RNA, 23 nt, Yersinia pestis
ggcuugagcgacaaaagugucau

SEQ ID NO: 2252094 - RNA, 18 nt, Yersinia pestis
ggcugguugaguuuaugg

SEQ ID NO: 2252095 - RNA, 22 nt, Yersinia pestis
ggcuguauuguugcucaacaua

SEQ ID NO: 2252096 - RNA, 17 nt, Yersinia pestis
ggcuggcauauuucucu

SEQ ID NO: 2252097 - RNA, 20 nt, Yersinia pestis
ggcugcguucuuugauuuga

SEQ ID NO: 2252098 - RNA, 13 nt, Yersinia pestis
ggcucgugaucag

SEQ ID NO: 2252099 - RNA, 18 nt, Yersinia pestis
ggcucucuuuuuucucuu

SEQ ID NO: 2252100 - RNA, 17 nt, Yersinia pestis
ggcucucuucagcgcuu

SEQ ID NO: 2252101 - RNA, 14 nt, Yersinia pestis
ggcucuggagcucu

SEQ ID NO: 2252102 - RNA, 20 nt, Yersinia pestis
ggcucuggcaauggcuagcu

SEQ ID NO: 2252103 - RNA, 20 nt, Yersinia pestis
ggcucuucucgaauaaacgg

SEQ ID NO: 2252104 - RNA, 19 nt, Yersinia pestis
ggcucgcacccuuacccug

SEQ ID NO: 2252105 - RNA, 13 nt, Yersinia pestis
ggcucgagccgcg

SEQ ID NO: 2252106 - RNA, 14 nt, Yersinia pestis
ggcucaugcagcau

SEQ ID NO: 2252107 - RNA, 19 nt, Yersinia pestis
ggcguauaucguuggugcg

SEQ ID NO: 2252108 - RNA, 20 nt, Yersinia pestis
ggcucaucgcuaaccgccag

SEQ ID NO: 2252109 - RNA, 15 nt, Yersinia pestis
ggcgucaagguaccc

SEQ ID NO: 2252110 - RNA, 15 nt, Yersinia pestis
ggcugcauggguaaa

SEQ ID NO: 2252111 - RNA, 21 nt, Yersinia pestis
ggcugacggugccagauagac

SEQ ID NO: 2252112 - RNA, 14 nt, Yersinia pestis
ggcugaagacccaa

SEQ ID NO: 2252113 - RNA, 15 nt, Yersinia pestis
ggcugauucacuggc

SEQ ID NO: 2252114 - RNA, 17 nt, Yersinia pestis
ggcugauguucugccaa

SEQ ID NO: 2252115 - RNA, 21 nt, Yersinia pestis
ggcugagagccgcuauaaccu

SEQ ID NO: 2252116 - RNA, 13 nt, Yersinia pestis
ggcugauagaaag

SEQ ID NO: 2252117 - RNA, 20 nt, Yersinia pestis
gggacugccagaucaaagau

SEQ ID NO: 2252118 - RNA, 16 nt, Yersinia pestis
gggacgcguuugcuug

SEQ ID NO: 2252119 - RNA, 12 nt, Yersinia pestis
gggaaugcccuu

SEQ ID NO: 2252120 - RNA, 14 nt, Yersinia pestis
gggaauaaugguau

SEQ ID NO: 2252121 - RNA, 15 nt, Yersinia pestis
ggcuuucucuugcca

SEQ ID NO: 2252122 - RNA, 13 nt, Yersinia pestis
ggcuuucagcaua

SEQ ID NO: 2252123 - RNA, 16 nt, Yersinia pestis
ggcuuucaauaaaacu

SEQ ID NO: 2252124 - RNA, 20 nt, Yersinia pestis
ggcuuuacggcucaccuggc

SEQ ID NO: 2252125 - RNA, 19 nt, Yersinia pestis
ggcuuuaagauccaguuca

SEQ ID NO: 2252126 - RNA, 14 nt, Yersinia pestis
ggcuuuuucuucca

SEQ ID NO: 2252127 - RNA, 23 nt, Yersinia pestis
ggcuuuuucuuccagcagggcca

SEQ ID NO: 2252128 - RNA, 21 nt, Yersinia pestis
ggcuuuuucacacgcccaggc

SEQ ID NO: 2252129 - RNA, 20 nt, Yersinia pestis
ggcuuuuaucguugcuacca

SEQ ID NO: 2252130 - RNA, 14 nt, Yersinia pestis
ggcuuuuggggcgc

SEQ ID NO: 2252131 - RNA, 21 nt, Yersinia pestis
gggaaccccucugcagcguca

SEQ ID NO: 2252132 - RNA, 20 nt, Yersinia pestis
gggaaaaguggcuaucugaa

SEQ ID NO: 2252133 - RNA, 23 nt, Yersinia pestis
gggaaaaguggcuaucugaaacu

SEQ ID NO: 2252134 - RNA, 22 nt, Yersinia pestis
gggaagagauaaaucggcggcc

SEQ ID NO: 2252135 - RNA, 12 nt, Yersinia pestis
gggaagggcgcc

SEQ ID NO: 2252136 - RNA, 18 nt, Yersinia pestis
gggauagcauaaauacgg

SEQ ID NO: 2252137 - RNA, 21 nt, Yersinia pestis
gggaguuacucagcauccucc

SEQ ID NO: 2252138 - RNA, 14 nt, Yersinia pestis
gggaguucaucaaa

SEQ ID NO: 2252139 - RNA, 12 nt, Yersinia pestis
gggagggcgcgc

SEQ ID NO: 2252140 - RNA, 16 nt, Yersinia pestis
gggauauuaauuccac

SEQ ID NO: 2252141 - RNA, 13 nt, Yersinia pestis
gggaucaacaugg

SEQ ID NO: 2252142 - RNA, 17 nt, Yersinia pestis
gggaucaccucuucagg

SEQ ID NO: 2252143 - RNA, 14 nt, Yersinia pestis
gggauucgaaccug

SEQ ID NO: 2252144 - RNA, 22 nt, Yersinia pestis
gggauucaauaaguugcagagg

SEQ ID NO: 2252145 - RNA, 10 nt, Yersinia pestis
gggauggaaa

SEQ ID NO: 2252146 - RNA, 18 nt, Yersinia pestis
gggaugaaaaauacaaau

SEQ ID NO: 2252147 - RNA, 19 nt, Yersinia pestis
gggaucuccagaagcauau

SEQ ID NO: 2252148 - RNA, 23 nt, Yersinia pestis
gggcaauacguguagccaaagug

SEQ ID NO: 2252149 - RNA, 21 nt, Yersinia pestis
gggcaauaacaaacacaucca

SEQ ID NO: 2252150 - RNA, 12 nt, Yersinia pestis
gggcagaaaaua

SEQ ID NO: 2252151 - RNA, 12 nt, Yersinia pestis
gggcacuuucau

SEQ ID NO: 2252152 - RNA, 17 nt, Yersinia pestis
gggcagguaaauagcca

SEQ ID NO: 2252153 - RNA, 22 nt, Yersinia pestis
gggcagguaaauagccaaacac

SEQ ID NO: 2252154 - RNA, 13 nt, Yersinia pestis
gggcaguauaauu

SEQ ID NO: 2252155 - RNA, 23 nt, Yersinia pestis
gggcuauuuauuuagagcguccu

SEQ ID NO: 2252156 - RNA, 22 nt, Yersinia pestis
gggcuaucaucaaaggcaauac

SEQ ID NO: 2252157 - RNA, 19 nt, Yersinia pestis
gggcguuuaccauccagug

SEQ ID NO: 2252158 - RNA, 17 nt, Yersinia pestis
gggcugacagagcgggu

SEQ ID NO: 2252159 - RNA, 18 nt, Yersinia pestis
gggcgauagcccuacugg

SEQ ID NO: 2252160 - RNA, 15 nt, Yersinia pestis
gggcgauggcaacau

SEQ ID NO: 2252161 - RNA, 20 nt, Yersinia pestis
gggcgauggggaguauucgu

SEQ ID NO: 2252162 - RNA, 12 nt, Yersinia pestis
gggcgcggcugg

SEQ ID NO: 2252163 - RNA, 13 nt, Yersinia pestis
gggcgcagccccc

SEQ ID NO: 2252164 - RNA, 23 nt, Yersinia pestis
gggcauucauuucuuuggcugag

SEQ ID NO: 2252165 - RNA, 19 nt, Yersinia pestis
gggccaauccaauaggaua

SEQ ID NO: 2252166 - RNA, 21 nt, Yersinia pestis
gggccaaggggagccacacac

SEQ ID NO: 2252167 - RNA, 14 nt, Yersinia pestis
gggccaaggucagg

SEQ ID NO: 2252168 - RNA, 21 nt, Yersinia pestis
gggccaccagacugacaacca

SEQ ID NO: 2252169 - RNA, 17 nt, Yersinia pestis
gggccacaggcugcaug

SEQ ID NO: 2252170 - RNA, 13 nt, Yersinia pestis
gggccgugcggga

SEQ ID NO: 2252171 - RNA, 22 nt, Yersinia pestis
gggccuuaaaaaacgauuagcu

SEQ ID NO: 2252172 - RNA, 16 nt, Yersinia pestis
gggccgacucugcaug

SEQ ID NO: 2252173 - RNA, 23 nt, Yersinia pestis
ggggcacacuuuucacuccggca

SEQ ID NO: 2252174 - RNA, 23 nt, Yersinia pestis
ggggaagagauaaaucggcggcc

SEQ ID NO: 2252175 - RNA, 15 nt, Yersinia pestis
gggcuuuaauacaau

SEQ ID NO: 2252176 - RNA, 21 nt, Yersinia pestis
gggcuuuaauacaauagagaa

SEQ ID NO: 2252177 - RNA, 14 nt, Yersinia pestis
gggcuugcugcaac

SEQ ID NO: 2252178 - RNA, 21 nt, Yersinia pestis
gggcuugcauaucagcaauga

SEQ ID NO: 2252179 - RNA, 15 nt, Yersinia pestis
ggggcguuaucacgg

SEQ ID NO: 2252180 - RNA, 12 nt, Yersinia pestis
gggggcaccgca

SEQ ID NO: 2252181 - RNA, 12 nt, Yersinia pestis
gggggcgacgau

SEQ ID NO: 2252182 - RNA, 17 nt, Yersinia pestis
ggggccaucaucuucaa

SEQ ID NO: 2252183 - RNA, 17 nt, Yersinia pestis
ggggccaauaggccccu

SEQ ID NO: 2252184 - RNA, 17 nt, Yersinia pestis
ggggccaacaggccccu

SEQ ID NO: 2252185 - RNA, 15 nt, Yersinia pestis
gggucagggcggcgg

SEQ ID NO: 2252186 - RNA, 18 nt, Yersinia pestis
ggguaucuuugcuucagg

SEQ ID NO: 2252187 - RNA, 20 nt, Yersinia pestis
ggguaucuuugcuucaggca

SEQ ID NO: 2252188 - RNA, 17 nt, Yersinia pestis
ggguauugaagauaccc

SEQ ID NO: 2252189 - RNA, 21 nt, Yersinia pestis
ggguauccguguauuuaucaa

SEQ ID NO: 2252190 - RNA, 11 nt, Yersinia pestis
ggguaucugug

SEQ ID NO: 2252191 - RNA, 14 nt, Yersinia pestis
gggucgguaaccug

SEQ ID NO: 2252192 - RNA, 23 nt, Yersinia pestis
gggguuuaggccuauaaccccca

SEQ ID NO: 2252193 - RNA, 13 nt, Yersinia pestis
gggguugcaguua

SEQ ID NO: 2252194 - RNA, 18 nt, Yersinia pestis
ggguaaaccaaucaagca

SEQ ID NO: 2252195 - RNA, 21 nt, Yersinia pestis
ggguaacucccggcaggcagg

SEQ ID NO: 2252196 - RNA, 12 nt, Yersinia pestis
ggguauccagug

SEQ ID NO: 2252197 - RNA, 20 nt, Yersinia pestis
ggggguugucagcagucuga

SEQ ID NO: 2252198 - RNA, 19 nt, Yersinia pestis
ggguugcccaucagcauca

SEQ ID NO: 2252199 - RNA, 20 nt, Yersinia pestis
ggguuauaggccuaaacccc

SEQ ID NO: 2252200 - RNA, 21 nt, Yersinia pestis
ggguuagcggcauaagccaaa

SEQ ID NO: 2252201 - RNA, 22 nt, Yersinia pestis
gggugagucucagggaugaagc

SEQ ID NO: 2252202 - RNA, 12 nt, Yersinia pestis
gggugagugagc

SEQ ID NO: 2252203 - RNA, 17 nt, Yersinia pestis
gggugagugagcgcagg

SEQ ID NO: 2252204 - RNA, 16 nt, Yersinia pestis
gggugauauuugugau

SEQ ID NO: 2252205 - RNA, 16 nt, Yersinia pestis
gggugagugagcgcgg

SEQ ID NO: 2252206 - RNA, 23 nt, Yersinia pestis
ggguggcagauagccagugggca

SEQ ID NO: 2252207 - RNA, 17 nt, Yersinia pestis
gguaacaaggcaaauag

SEQ ID NO: 2252208 - RNA, 20 nt, Yersinia pestis
gguaaauuccguaccaguug

SEQ ID NO: 2252209 - RNA, 22 nt, Yersinia pestis
gguaacgccgcuguagcgccaa

SEQ ID NO: 2252210 - RNA, 18 nt, Yersinia pestis
gguaacgcagaaauauuc

SEQ ID NO: 2252211 - RNA, 17 nt, Yersinia pestis
gguaaccaaucacauca

SEQ ID NO: 2252212 - RNA, 13 nt, Yersinia pestis
gguaacauauaaa

SEQ ID NO: 2252213 - RNA, 21 nt, Yersinia pestis
gguaaaaucacguuuccaaaa

SEQ ID NO: 2252214 - RNA, 23 nt, Yersinia pestis
gguaaaaucacguuuccaaaacu

SEQ ID NO: 2252215 - RNA, 15 nt, Yersinia pestis
gguaagaauaaauaa

SEQ ID NO: 2252216 - RNA, 11 nt, Yersinia pestis
gguaagcuggc

SEQ ID NO: 2252217 - RNA, 13 nt, Yersinia pestis
gguaagccuuucu

SEQ ID NO: 2252218 - RNA, 16 nt, Yersinia pestis
gguaagccuuucucca

SEQ ID NO: 2252219 - RNA, 16 nt, Yersinia pestis
gguaauaagugaucag

SEQ ID NO: 2252220 - RNA, 12 nt, Yersinia pestis
gguaauaaauca

SEQ ID NO: 2252221 - RNA, 21 nt, Yersinia pestis
gguaaugucacguuaaguuca

SEQ ID NO: 2252222 - RNA, 22 nt, Yersinia pestis
gguaauuaauauauaaaauaaa

SEQ ID NO: 2252223 - RNA, 20 nt, Yersinia pestis
gguaauaugugcuucuuuaa

SEQ ID NO: 2252224 - RNA, 13 nt, Yersinia pestis
gguaauaaaucau

SEQ ID NO: 2252225 - RNA, 21 nt, Yersinia pestis
gguaaucccgauauaaauaaa

SEQ ID NO: 2252226 - RNA, 16 nt, Yersinia pestis
gguaaucccgaaucaa

SEQ ID NO: 2252227 - RNA, 22 nt, Yersinia pestis
ggucaaaaacacagguucucca

SEQ ID NO: 2252228 - RNA, 12 nt, Yersinia pestis
gguauuuucuau

SEQ ID NO: 2252229 - RNA, 14 nt, Yersinia pestis
gguauucggcggcu

SEQ ID NO: 2252230 - RNA, 15 nt, Yersinia pestis
gguauuggagcugaa

SEQ ID NO: 2252231 - RNA, 20 nt, Yersinia pestis
gguauuugaacuucaaaucg

SEQ ID NO: 2252232 - RNA, 18 nt, Yersinia pestis
gguaucuaggugcaguaa

SEQ ID NO: 2252233 - RNA, 13 nt, Yersinia pestis
gguagugacucau

SEQ ID NO: 2252234 - RNA, 15 nt, Yersinia pestis
gguagugacucauca

SEQ ID NO: 2252235 - RNA, 15 nt, Yersinia pestis
gguagucauauucag

SEQ ID NO: 2252236 - RNA, 17 nt, Yersinia pestis
gguaguaggcaaagaga

SEQ ID NO: 2252237 - RNA, 16 nt, Yersinia pestis
gguagguauaauuauu

SEQ ID NO: 2252238 - RNA, 17 nt, Yersinia pestis
gguauagagugcaucca

SEQ ID NO: 2252239 - RNA, 15 nt, Yersinia pestis
gguaucgauguggug

SEQ ID NO: 2252240 - RNA, 23 nt, Yersinia pestis
gguauccaccuuccacaaguaac

SEQ ID NO: 2252241 - RNA, 18 nt, Yersinia pestis
gguacuuaacuggccaau

SEQ ID NO: 2252242 - RNA, 15 nt, Yersinia pestis
gguacuugacgcugc

SEQ ID NO: 2252243 - RNA, 18 nt, Yersinia pestis
gguacccauuauucuuua

SEQ ID NO: 2252244 - RNA, 16 nt, Yersinia pestis
gguaccugcaucauca

SEQ ID NO: 2252245 - RNA, 15 nt, Yersinia pestis
gguaccgcaggucag

SEQ ID NO: 2252246 - RNA, 16 nt, Yersinia pestis
gguaccgcaggucaga

SEQ ID NO: 2252247 - RNA, 14 nt, Yersinia pestis
ggucaucaaggugc

SEQ ID NO: 2252248 - RNA, 17 nt, Yersinia pestis
ggucaucacccagcaaa

SEQ ID NO: 2252249 - RNA, 19 nt, Yersinia pestis
ggucauauaccgccacuuu

SEQ ID NO: 2252250 - RNA, 21 nt, Yersinia pestis
ggucaguuuagcgagaaaguc

SEQ ID NO: 2252251 - RNA, 23 nt, Yersinia pestis
ggucauacacaugaaaaucaagu

SEQ ID NO: 2252252 - RNA, 14 nt, Yersinia pestis
ggucauggagagca

SEQ ID NO: 2252253 - RNA, 14 nt, Yersinia pestis
ggucauuagccguu

SEQ ID NO: 2252254 - RNA, 19 nt, Yersinia pestis
gguccccagagcgcaaaag

SEQ ID NO: 2252255 - RNA, 17 nt, Yersinia pestis
gguccucuuaugguagc

SEQ ID NO: 2252256 - RNA, 20 nt, Yersinia pestis
ggucacuuuaauacuggcau

SEQ ID NO: 2252257 - RNA, 18 nt, Yersinia pestis
ggucaauaccauauccac

SEQ ID NO: 2252258 - RNA, 14 nt, Yersinia pestis
ggucaacugugcca

SEQ ID NO: 2252259 - RNA, 14 nt, Yersinia pestis
ggugaaaauaauaa

SEQ ID NO: 2252260 - RNA, 17 nt, Yersinia pestis
ggugaaagcuaauauuc

SEQ ID NO: 2252261 - RNA, 13 nt, Yersinia pestis
ggucuugaaaacc

SEQ ID NO: 2252262 - RNA, 14 nt, Yersinia pestis
ggucucaaugcagu

SEQ ID NO: 2252263 - RNA, 16 nt, Yersinia pestis
ggucuauugguuucua

SEQ ID NO: 2252264 - RNA, 19 nt, Yersinia pestis
ggucgggcgcugagcgggc

SEQ ID NO: 2252265 - RNA, 18 nt, Yersinia pestis
ggucgggcgcugagcggg

SEQ ID NO: 2252266 - RNA, 23 nt, Yersinia pestis
ggucgggcugucggcgaugaaaa

SEQ ID NO: 2252267 - RNA, 15 nt, Yersinia pestis
ggucgguaaccugaa

SEQ ID NO: 2252268 - RNA, 16 nt, Yersinia pestis
ggucgguaagcuggcu

SEQ ID NO: 2252269 - RNA, 15 nt, Yersinia pestis
ggucgcacccaaacu

SEQ ID NO: 2252270 - RNA, 19 nt, Yersinia pestis
ggucgcacccaaacugucu

SEQ ID NO: 2252271 - RNA, 22 nt, Yersinia pestis
ggucgacaaaaugugaaaagca

SEQ ID NO: 2252272 - RNA, 21 nt, Yersinia pestis
ggucgcugggccuacuggugc

SEQ ID NO: 2252273 - RNA, 21 nt, Yersinia pestis
ggaauuaagaagccucaugaa

SEQ ID NO: 2252274 - RNA, 12 nt, Yersinia pestis
ggaauuaauauc

SEQ ID NO: 2252275 - RNA, 18 nt, Yersinia pestis
ggaaugaguugcccuaaa

SEQ ID NO: 2252276 - RNA, 22 nt, Yersinia pestis
ggaagucugcuuuauuggagug

SEQ ID NO: 2252277 - RNA, 21 nt, Yersinia pestis
ggaauaaucaauuaaucaauu

SEQ ID NO: 2252278 - RNA, 15 nt, Yersinia pestis
ggacaaaccagcccu

SEQ ID NO: 2252279 - RNA, 15 nt, Yersinia pestis
gcuuucgacccgccc

SEQ ID NO: 2252280 - RNA, 15 nt, Yersinia pestis
ggaacagcucggcca

SEQ ID NO: 2252281 - RNA, 22 nt, Yersinia pestis
ggaacgguugcccguuaauauu

SEQ ID NO: 2252282 - RNA, 15 nt, Yersinia pestis
aaaggguaaucagaa

SEQ ID NO: 2252283 - RNA, 15 nt, Yersinia pestis
ggacgcuuuacuccu

SEQ ID NO: 2252284 - RNA, 21 nt, Yersinia pestis
ggacgcuuuacuccccugccu

SEQ ID NO: 2252285 - RNA, 16 nt, Yersinia pestis
ggacgacggguauauu

SEQ ID NO: 2252286 - RNA, 19 nt, Yersinia pestis
ggacagauuauuucagcuu

SEQ ID NO: 2252287 - RNA, 19 nt, Yersinia pestis
ggacagcgcgcagccaacg

SEQ ID NO: 2252288 - RNA, 15 nt, Yersinia pestis
ggacaggcuccuccu

SEQ ID NO: 2252289 - RNA, 18 nt, Yersinia pestis
ggacaggcuccuccuugg

SEQ ID NO: 2252290 - RNA, 15 nt, Yersinia pestis
aaaggcuauuuaaau

SEQ ID NO: 2252291 - RNA, 14 nt, Yersinia pestis
ggagaaacauuaaa

SEQ ID NO: 2252292 - RNA, 12 nt, Yersinia pestis
ggagaaacauua

SEQ ID NO: 2252293 - RNA, 15 nt, Yersinia pestis
ggagagaacaggcag

SEQ ID NO: 2252294 - RNA, 15 nt, Yersinia pestis
ggagaggagauuaga

SEQ ID NO: 2252295 - RNA, 18 nt, Yersinia pestis
aaagguaugugccaaaaa

SEQ ID NO: 2252296 - RNA, 19 nt, Yersinia pestis
aaaggucguugccuguagc

SEQ ID NO: 2252297 - RNA, 16 nt, Yersinia pestis
aaagguuaacugcagu

SEQ ID NO: 2252298 - RNA, 17 nt, Yersinia pestis
aaagguuaacugcagug

SEQ ID NO: 2252299 - RNA, 17 nt, Yersinia pestis
ggauauucucaacuuca

SEQ ID NO: 2252300 - RNA, 21 nt, Yersinia pestis
ggauauuuauuguuaucaaau

SEQ ID NO: 2252301 - RNA, 13 nt, Yersinia pestis
ggaucaacauggu

SEQ ID NO: 2252302 - RNA, 17 nt, Yersinia pestis
ggaucaaguuagcaggc

SEQ ID NO: 2252303 - RNA, 18 nt, Yersinia pestis
ggaucaacgcccgcggcc

SEQ ID NO: 2252304 - RNA, 14 nt, Yersinia pestis
ggauagcaacugcc

SEQ ID NO: 2252305 - RNA, 13 nt, Yersinia pestis
ggauaauuucagc

SEQ ID NO: 2252306 - RNA, 18 nt, Yersinia pestis
ggauaaguuccggcagau

SEQ ID NO: 2252307 - RNA, 16 nt, Yersinia pestis
ggauaaggugaugaau

SEQ ID NO: 2252308 - RNA, 19 nt, Yersinia pestis
ggauaacguuucagggugg

SEQ ID NO: 2252309 - RNA, 13 nt, Yersinia pestis
ggauaaccuauua

SEQ ID NO: 2252310 - RNA, 14 nt, Yersinia pestis
ggaguugguggcac

SEQ ID NO: 2252311 - RNA, 18 nt, Yersinia pestis
ggaguuuuacugauaugg

SEQ ID NO: 2252312 - RNA, 13 nt, Yersinia pestis
ggaguuuuuauuu

SEQ ID NO: 2252313 - RNA, 17 nt, Yersinia pestis
ggauaaauuaauaacgc

SEQ ID NO: 2252314 - RNA, 13 nt, Yersinia pestis
ggauaaaaaugca

SEQ ID NO: 2252315 - RNA, 18 nt, Yersinia pestis
ggaugaucaacagugagg

SEQ ID NO: 2252316 - RNA, 14 nt, Yersinia pestis
ggaucucacccaca

SEQ ID NO: 2252317 - RNA, 21 nt, Yersinia pestis
ggaucucacccacacgacaug

SEQ ID NO: 2252318 - RNA, 17 nt, Yersinia pestis
ggaucucaggugugagg

SEQ ID NO: 2252319 - RNA, 13 nt, Yersinia pestis
ggaucgggcugau

SEQ ID NO: 2252320 - RNA, 16 nt, Yersinia pestis
ggaucaggaucaccag

SEQ ID NO: 2252321 - RNA, 13 nt, Yersinia pestis
ggauccauaggau

SEQ ID NO: 2252322 - RNA, 15 nt, Yersinia pestis
aaaguaagcaagcau

SEQ ID NO: 2252323 - RNA, 13 nt, Yersinia pestis
aaaguaauuuauc

SEQ ID NO: 2252324 - RNA, 12 nt, Yersinia pestis
ggaugcccacac

SEQ ID NO: 2252325 - RNA, 13 nt, Yersinia pestis
ggaugcccacacu

SEQ ID NO: 2252326 - RNA, 19 nt, Yersinia pestis
ggaugccuuguuucuggca

SEQ ID NO: 2252327 - RNA, 20 nt, Yersinia pestis
ggaugcgcucgcuugcugcc

SEQ ID NO: 2252328 - RNA, 22 nt, Yersinia pestis
ggaugcgcucgcuugcugccuu

SEQ ID NO: 2252329 - RNA, 14 nt, Yersinia pestis
ggauggcccaagcc

SEQ ID NO: 2252330 - RNA, 19 nt, Yersinia pestis
ggauggcccaagccauccu

SEQ ID NO: 2252331 - RNA, 21 nt, Yersinia pestis
ggcaacagcauggaaacggug

SEQ ID NO: 2252332 - RNA, 17 nt, Yersinia pestis
ggcaaaauaaucggcaa

SEQ ID NO: 2252333 - RNA, 22 nt, Yersinia pestis
ggcaaccagcguucuaucaaug

SEQ ID NO: 2252334 - RNA, 18 nt, Yersinia pestis
ggcaagacgguaucuagg

SEQ ID NO: 2252335 - RNA, 13 nt, Yersinia pestis
ggcaagaaacuuc

SEQ ID NO: 2252336 - RNA, 21 nt, Yersinia pestis
ggcaagaaacuucauuucagg

SEQ ID NO: 2252337 - RNA, 18 nt, Yersinia pestis
ggcaacuuuuuucauccu

SEQ ID NO: 2252338 - RNA, 19 nt, Yersinia pestis
ggcaaccgguaacauauaa

SEQ ID NO: 2252339 - RNA, 12 nt, Yersinia pestis
ggauuucuucau

SEQ ID NO: 2252340 - RNA, 15 nt, Yersinia pestis
ggauuuuccgcagcu

SEQ ID NO: 2252341 - RNA, 15 nt, Yersinia pestis
ggauuaugugcggca

SEQ ID NO: 2252342 - RNA, 16 nt, Yersinia pestis
ggauuagcuucugcua

SEQ ID NO: 2252343 - RNA, 23 nt, Yersinia pestis
ggauuaacuuuucuucauugcug

SEQ ID NO: 2252344 - RNA, 22 nt, Yersinia pestis
ggcaggaagcccguuauggcaa

SEQ ID NO: 2252345 - RNA, 12 nt, Yersinia pestis
ggcaggccccau

SEQ ID NO: 2252346 - RNA, 17 nt, Yersinia pestis
ggcaggccccaucauaa

SEQ ID NO: 2252347 - RNA, 15 nt, Yersinia pestis
ggcagcgacaaccug

SEQ ID NO: 2252348 - RNA, 16 nt, Yersinia pestis
ggcagcgacaaccugu

SEQ ID NO: 2252349 - RNA, 15 nt, Yersinia pestis
ggcagccuuuaucca

SEQ ID NO: 2252350 - RNA, 12 nt, Yersinia pestis
ggcagcaagcaa

SEQ ID NO: 2252351 - RNA, 18 nt, Yersinia pestis
ggcagauguaaccaccca

SEQ ID NO: 2252352 - RNA, 15 nt, Yersinia pestis
ggcaaggcacgagcg

SEQ ID NO: 2252353 - RNA, 14 nt, Yersinia pestis
ggcagaaguccuga

SEQ ID NO: 2252354 - RNA, 22 nt, Yersinia pestis
aaagucagcaaaucaaacaaau

SEQ ID NO: 2252355 - RNA, 13 nt, Yersinia pestis
aaagucacacugu

SEQ ID NO: 2252356 - RNA, 16 nt, Yersinia pestis
aaagucaucaaaacug

SEQ ID NO: 2252357 - RNA, 22 nt, Yersinia pestis
aaaguauucuuaucaaucaaaa

SEQ ID NO: 2252358 - RNA, 12 nt, Yersinia pestis
ggcaucaccaaa

SEQ ID NO: 2252359 - RNA, 23 nt, Yersinia pestis
ggcaucaccgcuaucacugauau

SEQ ID NO: 2252360 - RNA, 17 nt, Yersinia pestis
ggcagguagggcggccc

SEQ ID NO: 2252361 - RNA, 18 nt, Yersinia pestis
ggcaggguauuuucuccu

SEQ ID NO: 2252362 - RNA, 14 nt, Yersinia pestis
ggccaauaggcccc

SEQ ID NO: 2252363 - RNA, 19 nt, Yersinia pestis
ggccaaggggagccacaca

SEQ ID NO: 2252364 - RNA, 22 nt, Yersinia pestis
ggccaauuggcuuaacucgcca

SEQ ID NO: 2252365 - RNA, 19 nt, Yersinia pestis
ggccaauuuggccaauaau

SEQ ID NO: 2252366 - RNA, 22 nt, Yersinia pestis
ggcauuggauaauuugccuggc

SEQ ID NO: 2252367 - RNA, 21 nt, Yersinia pestis
ggcauucuaguuugugcugcu

SEQ ID NO: 2252368 - RNA, 17 nt, Yersinia pestis
ggcauugaccaaagcgg

SEQ ID NO: 2252369 - RNA, 23 nt, Yersinia pestis
ggcauuccgguucgcacauaucg

SEQ ID NO: 2252370 - RNA, 20 nt, Yersinia pestis
ggcauggauggucauaaaau

SEQ ID NO: 2252371 - RNA, 22 nt, Yersinia pestis
ggccacuucgguggcccuuauu

SEQ ID NO: 2252372 - RNA, 15 nt, Yersinia pestis
ggccaccucuuccuc

SEQ ID NO: 2252373 - RNA, 23 nt, Yersinia pestis
ggcccccuccaacugagugagcg

SEQ ID NO: 2252374 - RNA, 15 nt, Yersinia pestis
ggccccagcccagca

SEQ ID NO: 2252375 - RNA, 18 nt, Yersinia pestis
ggccccuuaaauaugaug

SEQ ID NO: 2252376 - RNA, 19 nt, Yersinia pestis
ggccccuaaugcgcucacc

SEQ ID NO: 2252377 - RNA, 18 nt, Yersinia pestis
ggccaucuaacugcacaa

SEQ ID NO: 2252378 - RNA, 23 nt, Yersinia pestis
aaagugagaaggguauugaagau

SEQ ID NO: 2252379 - RNA, 14 nt, Yersinia pestis
aaagucuuaaucuu

SEQ ID NO: 2252380 - RNA, 23 nt, Yersinia pestis
ggcccgcuagugauagcgggccu

SEQ ID NO: 2252381 - RNA, 13 nt, Yersinia pestis
ggcccgcuaguga

SEQ ID NO: 2252382 - RNA, 14 nt, Yersinia pestis
ggcccgcuagugau

SEQ ID NO: 2252383 - RNA, 23 nt, Yersinia pestis
ggcccgcuaucacuagcgggccu

SEQ ID NO: 2252384 - RNA, 23 nt, Yersinia pestis
ggcccugagguugcucagcgggc

SEQ ID NO: 2252385 - RNA, 15 nt, Yersinia pestis
gcuuaccgccugccc

SEQ ID NO: 2252386 - RNA, 18 nt, Yersinia pestis
gcuuaccaaaacgccacc

SEQ ID NO: 2252387 - RNA, 23 nt, Yersinia pestis
gcuuagcaggcccuuucaccgcu

SEQ ID NO: 2252388 - RNA, 17 nt, Yersinia pestis
gcuuaucaaagugcuua

SEQ ID NO: 2252389 - RNA, 23 nt, Yersinia pestis
gcuuaucucggggccacgguugg

SEQ ID NO: 2252390 - RNA, 18 nt, Yersinia pestis
gcuucacauccaauggca

SEQ ID NO: 2252391 - RNA, 12 nt, Yersinia pestis
gcuucagccacu

SEQ ID NO: 2252392 - RNA, 20 nt, Yersinia pestis
gcuucaaaaucaccuggcca

SEQ ID NO: 2252393 - RNA, 13 nt, Yersinia pestis
gcuuaucuuccag

SEQ ID NO: 2252394 - RNA, 13 nt, Yersinia pestis
gcuucauauccua

SEQ ID NO: 2252395 - RNA, 18 nt, Yersinia pestis
gcuucauggcuaaaucca

SEQ ID NO: 2252396 - RNA, 17 nt, Yersinia pestis
gcuuccgguaaagaagc

SEQ ID NO: 2252397 - RNA, 19 nt, Yersinia pestis
gcuucccuguauaaaaaua

SEQ ID NO: 2252398 - RNA, 15 nt, Yersinia pestis
gcuuccaucacaaau

SEQ ID NO: 2252399 - RNA, 15 nt, Yersinia pestis
gcuguugcguaccau

SEQ ID NO: 2252400 - RNA, 13 nt, Yersinia pestis
gcuguuguucugg

SEQ ID NO: 2252401 - RNA, 16 nt, Yersinia pestis
gcuuaauaccgcucuc

SEQ ID NO: 2252402 - RNA, 20 nt, Yersinia pestis
gcuuaaucgccagcaaauca

SEQ ID NO: 2252403 - RNA, 21 nt, Yersinia pestis
gcuguuauuacugucauugcu

SEQ ID NO: 2252404 - RNA, 14 nt, Yersinia pestis
gcuguuagaugcua

SEQ ID NO: 2252405 - RNA, 12 nt, Yersinia pestis
gcuguuccaacc

SEQ ID NO: 2252406 - RNA, 16 nt, Yersinia pestis
gcugucauuggugcug

SEQ ID NO: 2252407 - RNA, 15 nt, Yersinia pestis
gcugugguugccaaa

SEQ ID NO: 2252408 - RNA, 21 nt, Yersinia pestis
gcuguauuuuucgcaguaacg

SEQ ID NO: 2252409 - RNA, 15 nt, Yersinia pestis
gcuguauacccgccg

SEQ ID NO: 2252410 - RNA, 23 nt, Yersinia pestis
aaaggauggcccaagccauccuu

SEQ ID NO: 2252411 - RNA, 14 nt, Yersinia pestis
gcuggucgcaccca

SEQ ID NO: 2252412 - RNA, 16 nt, Yersinia pestis
aaaggaacaaaagaga

SEQ ID NO: 2252413 - RNA, 11 nt, Yersinia pestis
aaaggaaggga

SEQ ID NO: 2252414 - RNA, 11 nt, Yersinia pestis
aaaggaagggg

SEQ ID NO: 2252415 - RNA, 21 nt, Yersinia pestis
aaaggaauaucugugauaacc

SEQ ID NO: 2252416 - RNA, 15 nt, Yersinia pestis
gcuggugaaugguca

SEQ ID NO: 2252417 - RNA, 19 nt, Yersinia pestis
gcuugcggaauuucuucua

SEQ ID NO: 2252418 - RNA, 18 nt, Yersinia pestis
gcuugauuugcuggcgca

SEQ ID NO: 2252419 - RNA, 18 nt, Yersinia pestis
gcuugcaggucugcaugg

SEQ ID NO: 2252420 - RNA, 22 nt, Yersinia pestis
gcuugcauacgcuuaaccagca

SEQ ID NO: 2252421 - RNA, 17 nt, Yersinia pestis
gcuugacuaacacgacu

SEQ ID NO: 2252422 - RNA, 13 nt, Yersinia pestis
gcuucuuuaauca

SEQ ID NO: 2252423 - RNA, 19 nt, Yersinia pestis
gcuugaaguacggugccag

SEQ ID NO: 2252424 - RNA, 16 nt, Yersinia pestis
gcuucuuuuguauaug

SEQ ID NO: 2252425 - RNA, 16 nt, Yersinia pestis
gcuucucgcaccagau

SEQ ID NO: 2252426 - RNA, 17 nt, Yersinia pestis
gcuucugggccaaagcg

SEQ ID NO: 2252427 - RNA, 21 nt, Yersinia pestis
gcuucuggaugggcauagaaa

SEQ ID NO: 2252428 - RNA, 17 nt, Yersinia pestis
gcuucuguggcggcaag

SEQ ID NO: 2252429 - RNA, 23 nt, Yersinia pestis
gcuucugucaguguuaccaagag

SEQ ID NO: 2252430 - RNA, 22 nt, Yersinia pestis
gcuucugaaccaccguaaacga

SEQ ID NO: 2252431 - RNA, 20 nt, Yersinia pestis
gcuucguccagaugccaaau

SEQ ID NO: 2252432 - RNA, 14 nt, Yersinia pestis
gcuucgcuggcuuu

SEQ ID NO: 2252433 - RNA, 23 nt, Yersinia pestis
gcuucgcucggcucgaaccugaa

SEQ ID NO: 2252434 - RNA, 14 nt, Yersinia pestis
gcuucgccacggca

SEQ ID NO: 2252435 - RNA, 16 nt, Yersinia pestis
aaaggcaaaaauugac

SEQ ID NO: 2252436 - RNA, 15 nt, Yersinia pestis
gcuuggcucaaugug

SEQ ID NO: 2252437 - RNA, 20 nt, Yersinia pestis
aaaggccaccaaauugcggc

SEQ ID NO: 2252438 - RNA, 15 nt, Yersinia pestis
aaaggcaaagaagaa

SEQ ID NO: 2252439 - RNA, 13 nt, Yersinia pestis
aaaggcaaagaag

SEQ ID NO: 2252440 - RNA, 21 nt, Yersinia pestis
aaaggcaacgaaggcaacaac

SEQ ID NO: 2252441 - RNA, 14 nt, Yersinia pestis
gcuuggcaaccgag

SEQ ID NO: 2252442 - RNA, 15 nt, Yersinia pestis
gcuugcugccugccu

SEQ ID NO: 2252443 - RNA, 13 nt, Yersinia pestis
gcuuggcgggcug

SEQ ID NO: 2252444 - RNA, 18 nt, Yersinia pestis
gcuuggcgggcuggccac

SEQ ID NO: 2252445 - RNA, 16 nt, Yersinia pestis
gcuuggcccgauggug

SEQ ID NO: 2252446 - RNA, 20 nt, Yersinia pestis
gcuugugcucacgucaccac

SEQ ID NO: 2252447 - RNA, 18 nt, Yersinia pestis
gcuugucguauuuccagu

SEQ ID NO: 2252448 - RNA, 18 nt, Yersinia pestis
aaaggccccguaaucaug

SEQ ID NO: 2252449 - RNA, 23 nt, Yersinia pestis
gcuuguugccacccuaucugcuc

SEQ ID NO: 2252450 - RNA, 19 nt, Yersinia pestis
gcuuguucuguuagcgacu

SEQ ID NO: 2252451 - RNA, 17 nt, Yersinia pestis
gcuuuaagcuaauucug

SEQ ID NO: 2252452 - RNA, 19 nt, Yersinia pestis
gcuuuaagauccauguaua

SEQ ID NO: 2252453 - RNA, 13 nt, Yersinia pestis
gcuuuaaugaguu

SEQ ID NO: 2252454 - RNA, 19 nt, Yersinia pestis
gcuuuacucuucugccuac

SEQ ID NO: 2252455 - RNA, 17 nt, Yersinia pestis
gcuuuacucuucagccu

SEQ ID NO: 2252456 - RNA, 16 nt, Yersinia pestis
gcuuuagccagucacc

SEQ ID NO: 2252457 - RNA, 13 nt, Yersinia pestis
gcuuuacuccucu

SEQ ID NO: 2252458 - RNA, 14 nt, Yersinia pestis
gcuuuacuccucug

SEQ ID NO: 2252459 - RNA, 15 nt, Yersinia pestis
gcuuuacuccucugc

SEQ ID NO: 2252460 - RNA, 16 nt, Yersinia pestis
gcuuuacuccucugcc

SEQ ID NO: 2252461 - RNA, 15 nt, Yersinia pestis
gcuuuacgcaacuca

SEQ ID NO: 2252462 - RNA, 23 nt, Yersinia pestis
gcuuuaccuguuucgauccagcu

SEQ ID NO: 2252463 - RNA, 21 nt, Yersinia pestis
gcuuucaggagugaauuucuu

SEQ ID NO: 2252464 - RNA, 15 nt, Yersinia pestis
gcuuucaucuucuuc

SEQ ID NO: 2252465 - RNA, 14 nt, Yersinia pestis
gcuuucaauaaaac

SEQ ID NO: 2252466 - RNA, 16 nt, Yersinia pestis
gcuuucaauaaaacuc

SEQ ID NO: 2252467 - RNA, 15 nt, Yersinia pestis
gcuuuaucccaccac

SEQ ID NO: 2252468 - RNA, 16 nt, Yersinia pestis
gcuuuaucgccaacac

SEQ ID NO: 2252469 - RNA, 14 nt, Yersinia pestis
gcuuuauuauauga

SEQ ID NO: 2252470 - RNA, 19 nt, Yersinia pestis
gcucuaucucccgcuacac

SEQ ID NO: 2252471 - RNA, 20 nt, Yersinia pestis
gcucuacaacguccagaaca

SEQ ID NO: 2252472 - RNA, 21 nt, Yersinia pestis
gcucuacacaggcguaauaug

SEQ ID NO: 2252473 - RNA, 13 nt, Yersinia pestis
gcucgcuugcugc

SEQ ID NO: 2252474 - RNA, 16 nt, Yersinia pestis
gcuccugauaaugcuu

SEQ ID NO: 2252475 - RNA, 13 nt, Yersinia pestis
gcucgaaccugaa

SEQ ID NO: 2252476 - RNA, 13 nt, Yersinia pestis
gcucgaagcgcgc

SEQ ID NO: 2252477 - RNA, 15 nt, Yersinia pestis
gcucgauucuauaua

SEQ ID NO: 2252478 - RNA, 17 nt, Yersinia pestis
gcucgagccgcgccauc

SEQ ID NO: 2252479 - RNA, 15 nt, Yersinia pestis
gcuccagcaacugaa

SEQ ID NO: 2252480 - RNA, 16 nt, Yersinia pestis
gcucaucauaaaaaua

SEQ ID NO: 2252481 - RNA, 17 nt, Yersinia pestis
gcucaucauaaaaauac

SEQ ID NO: 2252482 - RNA, 18 nt, Yersinia pestis
gcucaucaaccucagccu

SEQ ID NO: 2252483 - RNA, 20 nt, Yersinia pestis
gcgguauuccgagcaaucaa

SEQ ID NO: 2252484 - RNA, 21 nt, Yersinia pestis
gcgguauugaucacgcucugu

SEQ ID NO: 2252485 - RNA, 14 nt, Yersinia pestis
gcgguagugaugca

SEQ ID NO: 2252486 - RNA, 21 nt, Yersinia pestis
gcuccauuucugguugugcuu

SEQ ID NO: 2252487 - RNA, 21 nt, Yersinia pestis
gcuccaucuuuuacaaauuug

SEQ ID NO: 2252488 - RNA, 18 nt, Yersinia pestis
gcucccuccgccagcaag

SEQ ID NO: 2252489 - RNA, 22 nt, Yersinia pestis
gcuccuauagcucagaaaauaa

SEQ ID NO: 2252490 - RNA, 23 nt, Yersinia pestis
gcuccuauagcucagaaaauaaa

SEQ ID NO: 2252491 - RNA, 14 nt, Yersinia pestis
gcuccuauagcuca

SEQ ID NO: 2252492 - RNA, 21 nt, Yersinia pestis
gcuccuauagcucagaaaaua

SEQ ID NO: 2252493 - RNA, 14 nt, Yersinia pestis
gcuccucaaccccu

SEQ ID NO: 2252494 - RNA, 9 nt, Yersinia pestis
gcugcucac

SEQ ID NO: 2252495 - RNA, 18 nt, Yersinia pestis
gcugcguucuuugauuug

SEQ ID NO: 2252496 - RNA, 18 nt, Yersinia pestis
gcuggaauccaaguucaa

SEQ ID NO: 2252497 - RNA, 16 nt, Yersinia pestis
gcuggaucagcagacu

SEQ ID NO: 2252498 - RNA, 18 nt, Yersinia pestis
gcugcgcaagcgcugcuu

SEQ ID NO: 2252499 - RNA, 17 nt, Yersinia pestis
gcugcgauaauccgcca

SEQ ID NO: 2252500 - RNA, 21 nt, Yersinia pestis
gcugcgcaccacugucagggc

SEQ ID NO: 2252501 - RNA, 17 nt, Yersinia pestis
gcugcgccaauacccgu

SEQ ID NO: 2252502 - RNA, 23 nt, Yersinia pestis
gcugccuaugcguuggcugccuu

SEQ ID NO: 2252503 - RNA, 12 nt, Yersinia pestis
gcugccugccug

SEQ ID NO: 2252504 - RNA, 16 nt, Yersinia pestis
gcugccugccugcugc

SEQ ID NO: 2252505 - RNA, 15 nt, Yersinia pestis
gcugagagccgcuau

SEQ ID NO: 2252506 - RNA, 23 nt, Yersinia pestis
gcugagcauauacagcccgguau

SEQ ID NO: 2252507 - RNA, 17 nt, Yersinia pestis
gcugauagccaauaacc

SEQ ID NO: 2252508 - RNA, 13 nt, Yersinia pestis
gcugaucaggaag

SEQ ID NO: 2252509 - RNA, 16 nt, Yersinia pestis
gcugauucacuggcaa

SEQ ID NO: 2252510 - RNA, 15 nt, Yersinia pestis
gcugauuaauaucaa

SEQ ID NO: 2252511 - RNA, 17 nt, Yersinia pestis
gcugauuaauaucaaaa

SEQ ID NO: 2252512 - RNA, 20 nt, Yersinia pestis
gcugauuaauaucaaaacug

SEQ ID NO: 2252513 - RNA, 21 nt, Yersinia pestis
gcugauuaccugcaucaagcc

SEQ ID NO: 2252514 - RNA, 20 nt, Yersinia pestis
gcugcaaacaggcccacugc

SEQ ID NO: 2252515 - RNA, 17 nt, Yersinia pestis
gcugcaagcaauguuca

SEQ ID NO: 2252516 - RNA, 16 nt, Yersinia pestis
gcugcaagaguccagc

SEQ ID NO: 2252517 - RNA, 21 nt, Yersinia pestis
gcugcaacucauuaacaauua

SEQ ID NO: 2252518 - RNA, 19 nt, Yersinia pestis
gcugcaacuccuuaccacu

SEQ ID NO: 2252519 - RNA, 21 nt, Yersinia pestis
gcugcaacuccuuaccacugc

SEQ ID NO: 2252520 - RNA, 23 nt, Yersinia pestis
gcugcaacuccuuaccacugcuc

SEQ ID NO: 2252521 - RNA, 23 nt, Yersinia pestis
gcugcagccgggaugaucaacag

SEQ ID NO: 2252522 - RNA, 13 nt, Yersinia pestis
gcugaagacccaa

SEQ ID NO: 2252523 - RNA, 15 nt, Yersinia pestis
gcugaacuucuggga

SEQ ID NO: 2252524 - RNA, 19 nt, Yersinia pestis
gcugaauaaacggcaagcg

SEQ ID NO: 2252525 - RNA, 12 nt, Yersinia pestis
gcugaaaugcua

SEQ ID NO: 2252526 - RNA, 14 nt, Yersinia pestis
gcucucgacaaccu

SEQ ID NO: 2252527 - RNA, 16 nt, Yersinia pestis
gcucucgcuccagcuc

SEQ ID NO: 2252528 - RNA, 18 nt, Yersinia pestis
uaaacugugcccuugagc

SEQ ID NO: 2252529 - RNA, 18 nt, Yersinia pestis
uaaacugacauuaucgcc

SEQ ID NO: 2252530 - RNA, 18 nt, Yersinia pestis
uaaacugaauaucccccu

SEQ ID NO: 2252531 - RNA, 23 nt, Yersinia pestis
uaaacugaauaucccccuccgga

SEQ ID NO: 2252532 - RNA, 15 nt, Yersinia pestis
uaaacugaucaucaa

SEQ ID NO: 2252533 - RNA, 17 nt, Yersinia pestis
uaaacugccguaaacaa

SEQ ID NO: 2252534 - RNA, 21 nt, Yersinia pestis
uaaagacauaucacaguuaaa

SEQ ID NO: 2252535 - RNA, 16 nt, Yersinia pestis
uaaagauaauuaauuc

SEQ ID NO: 2252536 - RNA, 19 nt, Yersinia pestis
uaaagauaauuaauucaau

SEQ ID NO: 2252537 - RNA, 13 nt, Yersinia pestis
uaaacgggccgcg

SEQ ID NO: 2252538 - RNA, 16 nt, Yersinia pestis
uaaacuauuagcgcuu

SEQ ID NO: 2252539 - RNA, 15 nt, Yersinia pestis
uaaaccgugcggcua

SEQ ID NO: 2252540 - RNA, 17 nt, Yersinia pestis
uaaaccggucauacauu

SEQ ID NO: 2252541 - RNA, 15 nt, Yersinia pestis
uaaaccgugauuggu

SEQ ID NO: 2252542 - RNA, 16 nt, Yersinia pestis
uaaaccgugauugguu

SEQ ID NO: 2252543 - RNA, 20 nt, Yersinia pestis
uaaacgcgaguuaggaaaaa

SEQ ID NO: 2252544 - RNA, 20 nt, Yersinia pestis
uaaacgccugggauccauag

SEQ ID NO: 2252545 - RNA, 15 nt, Yersinia pestis
uaaacacucaauaag

SEQ ID NO: 2252546 - RNA, 13 nt, Yersinia pestis
uaaacauuuugac

SEQ ID NO: 2252547 - RNA, 17 nt, Yersinia pestis
uaaacauuguuauauua

SEQ ID NO: 2252548 - RNA, 15 nt, Yersinia pestis
uaaacagcuuaucag

SEQ ID NO: 2252549 - RNA, 22 nt, Yersinia pestis
uaaacagccguauaucuuaccu

SEQ ID NO: 2252550 - RNA, 14 nt, Yersinia pestis
uaaacagccagcau

SEQ ID NO: 2252551 - RNA, 16 nt, Yersinia pestis
uaaacagacacagcaa

SEQ ID NO: 2252552 - RNA, 13 nt, Yersinia pestis
uaaaccaaauggu

SEQ ID NO: 2252553 - RNA, 11 nt, Yersinia pestis
uaaaccaauau

SEQ ID NO: 2252554 - RNA, 16 nt, Yersinia pestis
uaaaccaaucaagcau

SEQ ID NO: 2252555 - RNA, 21 nt, Yersinia pestis
uaaaccgggccuaauuuaacu

SEQ ID NO: 2252556 - RNA, 12 nt, Yersinia pestis
uaaaccagcaag

SEQ ID NO: 2252557 - RNA, 16 nt, Yersinia pestis
guuuuuauuacagagu

SEQ ID NO: 2252558 - RNA, 23 nt, Yersinia pestis
guuuuuauauuuaccugcucaac

SEQ ID NO: 2252559 - RNA, 16 nt, Yersinia pestis
guuuuuagcuuaacau

SEQ ID NO: 2252560 - RNA, 18 nt, Yersinia pestis
uaaacaacgcugaaaaau

SEQ ID NO: 2252561 - RNA, 20 nt, Yersinia pestis
uaaacaaccaaaaaucuugu

SEQ ID NO: 2252562 - RNA, 18 nt, Yersinia pestis
uaaacaaccaaaaaucuu

SEQ ID NO: 2252563 - RNA, 19 nt, Yersinia pestis
uaaacaaccaaaaaucuug

SEQ ID NO: 2252564 - RNA, 14 nt, Yersinia pestis
uaaacaaauaugac

SEQ ID NO: 2252565 - RNA, 20 nt, Yersinia pestis
guuuuucaucugugccugca

SEQ ID NO: 2252566 - RNA, 20 nt, Yersinia pestis
uaaagcauuuaucauauuaa

SEQ ID NO: 2252567 - RNA, 15 nt, Yersinia pestis
uaaagccauucagca

SEQ ID NO: 2252568 - RNA, 18 nt, Yersinia pestis
uaaagccauucagcagca

SEQ ID NO: 2252569 - RNA, 11 nt, Yersinia pestis
uaaagcccagg

SEQ ID NO: 2252570 - RNA, 13 nt, Yersinia pestis
uaaagcuggagcc

SEQ ID NO: 2252571 - RNA, 16 nt, Yersinia pestis
uaaagcuauucaucug

SEQ ID NO: 2252572 - RNA, 15 nt, Yersinia pestis
uaaagugcguaggca

SEQ ID NO: 2252573 - RNA, 14 nt, Yersinia pestis
uaaauauaaaauaa

SEQ ID NO: 2252574 - RNA, 19 nt, Yersinia pestis
uaaauauaaccaaagucau

SEQ ID NO: 2252575 - RNA, 15 nt, Yersinia pestis
uaaauauaauuucaa

SEQ ID NO: 2252576 - RNA, 16 nt, Yersinia pestis
uaaauaauaucaauga

SEQ ID NO: 2252577 - RNA, 14 nt, Yersinia pestis
uaaauaauaaauua

SEQ ID NO: 2252578 - RNA, 18 nt, Yersinia pestis
uaaauagugggcuaaaac

SEQ ID NO: 2252579 - RNA, 20 nt, Yersinia pestis
uaaauaguuagugaguuauu

SEQ ID NO: 2252580 - RNA, 14 nt, Yersinia pestis
uaaauaaguaggca

SEQ ID NO: 2252581 - RNA, 22 nt, Yersinia pestis
uaaauaaccagagacagcaaca

SEQ ID NO: 2252582 - RNA, 18 nt, Yersinia pestis
uaaauaacacccauuugc

SEQ ID NO: 2252583 - RNA, 15 nt, Yersinia pestis
uaaauaacagcuaaa

SEQ ID NO: 2252584 - RNA, 21 nt, Yersinia pestis
uaaaguuuuuuauuuauagaa

SEQ ID NO: 2252585 - RNA, 12 nt, Yersinia pestis
uaaaguuuuucc

SEQ ID NO: 2252586 - RNA, 20 nt, Yersinia pestis
uaaauaaaaagcguuucaga

SEQ ID NO: 2252587 - RNA, 20 nt, Yersinia pestis
uaaauauccugcucagcuaa

SEQ ID NO: 2252588 - RNA, 21 nt, Yersinia pestis
uaaauauccugcucagcuaaa

SEQ ID NO: 2252589 - RNA, 18 nt, Yersinia pestis
uaaauauuaacauuaauc

SEQ ID NO: 2252590 - RNA, 11 nt, Yersinia pestis
uaaaucaucaa

SEQ ID NO: 2252591 - RNA, 13 nt, Yersinia pestis
uaaaucaucaaau

SEQ ID NO: 2252592 - RNA, 14 nt, Yersinia pestis
uaaaucaucaaauu

SEQ ID NO: 2252593 - RNA, 20 nt, Yersinia pestis
uaaaucaugucccuauuaga

SEQ ID NO: 2252594 - RNA, 16 nt, Yersinia pestis
uaaaucaucaaauuca

SEQ ID NO: 2252595 - RNA, 19 nt, Yersinia pestis
uaacgcuucaucauggaua

SEQ ID NO: 2252596 - RNA, 22 nt, Yersinia pestis
uaacggccgccuguauuauuaa

SEQ ID NO: 2252597 - RNA, 23 nt, Yersinia pestis
uaacggccgccuguauuauuaau

SEQ ID NO: 2252598 - RNA, 14 nt, Yersinia pestis
uaacggauccugcc

SEQ ID NO: 2252599 - RNA, 13 nt, Yersinia pestis
uaacgggcggcug

SEQ ID NO: 2252600 - RNA, 18 nt, Yersinia pestis
uaacgguaauuauuuugg

SEQ ID NO: 2252601 - RNA, 22 nt, Yersinia pestis
uaacgcucccuccgccagcaag

SEQ ID NO: 2252602 - RNA, 14 nt, Yersinia pestis
uaacgcugaauaag

SEQ ID NO: 2252603 - RNA, 15 nt, Yersinia pestis
uaacgcuucaucaug

SEQ ID NO: 2252604 - RNA, 20 nt, Yersinia pestis
uaacgcuggauaagugaaua

SEQ ID NO: 2252605 - RNA, 19 nt, Yersinia pestis
uaacgccggauaaauuaau

SEQ ID NO: 2252606 - RNA, 21 nt, Yersinia pestis
uaacgccggauaaauuaauaa

SEQ ID NO: 2252607 - RNA, 19 nt, Yersinia pestis
uaacgcccggcaauaauag

SEQ ID NO: 2252608 - RNA, 21 nt, Yersinia pestis
uaacgccgcuaaaucaucaaa

SEQ ID NO: 2252609 - RNA, 13 nt, Yersinia pestis
uaaccucagccuc

SEQ ID NO: 2252610 - RNA, 21 nt, Yersinia pestis
uaaccgacuugcccaauggca

SEQ ID NO: 2252611 - RNA, 21 nt, Yersinia pestis
uaaccgggcuugauuaaauga

SEQ ID NO: 2252612 - RNA, 17 nt, Yersinia pestis
uaaccgguauauuggcc

SEQ ID NO: 2252613 - RNA, 16 nt, Yersinia pestis
uaacgcaaaacgcccu

SEQ ID NO: 2252614 - RNA, 22 nt, Yersinia pestis
uaacccuuuggcaaccagcuua

SEQ ID NO: 2252615 - RNA, 16 nt, Yersinia pestis
uaacccgauaaugccc

SEQ ID NO: 2252616 - RNA, 19 nt, Yersinia pestis
uaacccgccuugcggaagg

SEQ ID NO: 2252617 - RNA, 14 nt, Yersinia pestis
uaaccaucaaauac

SEQ ID NO: 2252618 - RNA, 16 nt, Yersinia pestis
uaaccaucaaauacac

SEQ ID NO: 2252619 - RNA, 17 nt, Yersinia pestis
uaaccauaaaauaaaua

SEQ ID NO: 2252620 - RNA, 20 nt, Yersinia pestis
uaaccauccauauuuggcau

SEQ ID NO: 2252621 - RNA, 20 nt, Yersinia pestis
uaacccccaagcuuuugcca

SEQ ID NO: 2252622 - RNA, 19 nt, Yersinia pestis
uaaccccguagcacacaca

SEQ ID NO: 2252623 - RNA, 20 nt, Yersinia pestis
uaaccagacgcaaccaaaac

SEQ ID NO: 2252624 - RNA, 20 nt, Yersinia pestis
uaaccaccgucaccaaauau

SEQ ID NO: 2252625 - RNA, 18 nt, Yersinia pestis
uaaccagugccgcccagc

SEQ ID NO: 2252626 - RNA, 19 nt, Yersinia pestis
uaaccaggugcagauaaac

SEQ ID NO: 2252627 - RNA, 17 nt, Yersinia pestis
uaaccagccaaccauca

SEQ ID NO: 2252628 - RNA, 13 nt, Yersinia pestis
uaacagagcagaa

SEQ ID NO: 2252629 - RNA, 23 nt, Yersinia pestis
uaacacggccuauugaauaacag

SEQ ID NO: 2252630 - RNA, 15 nt, Yersinia pestis
uaacacggcuuuuau

SEQ ID NO: 2252631 - RNA, 16 nt, Yersinia pestis
uaacacuuauuaaccu

SEQ ID NO: 2252632 - RNA, 21 nt, Yersinia pestis
uaacacuucagacugaaagua

SEQ ID NO: 2252633 - RNA, 21 nt, Yersinia pestis
uaacacuugaccaaccuguuu

SEQ ID NO: 2252634 - RNA, 15 nt, Yersinia pestis
uaacauccuaaaaag

SEQ ID NO: 2252635 - RNA, 22 nt, Yersinia pestis
uaacagagccuuauaggcgcau

SEQ ID NO: 2252636 - RNA, 11 nt, Yersinia pestis
uaaccacagca

SEQ ID NO: 2252637 - RNA, 12 nt, Yersinia pestis
uaaccacccacg

SEQ ID NO: 2252638 - RNA, 16 nt, Yersinia pestis
uaacaugccacauagc

SEQ ID NO: 2252639 - RNA, 13 nt, Yersinia pestis
uaacaugcugaua

SEQ ID NO: 2252640 - RNA, 14 nt, Yersinia pestis
uaacauguagcaca

SEQ ID NO: 2252641 - RNA, 15 nt, Yersinia pestis
uaacaaaaaauuaau

SEQ ID NO: 2252642 - RNA, 19 nt, Yersinia pestis
uaacaaaaaauuaaugagu

SEQ ID NO: 2252643 - RNA, 12 nt, Yersinia pestis
uaacaaacacau

SEQ ID NO: 2252644 - RNA, 15 nt, Yersinia pestis
uaacaaacacaucca

SEQ ID NO: 2252645 - RNA, 22 nt, Yersinia pestis
uaacaaaaugcgguggcacuga

SEQ ID NO: 2252646 - RNA, 15 nt, Yersinia pestis
uaacaaacguucauu

SEQ ID NO: 2252647 - RNA, 18 nt, Yersinia pestis
uaacaaacugaauggauu

SEQ ID NO: 2252648 - RNA, 19 nt, Yersinia pestis
uaacaaacuguuuuuuaaa

SEQ ID NO: 2252649 - RNA, 17 nt, Yersinia pestis
uaacaacuuccacacaa

SEQ ID NO: 2252650 - RNA, 17 nt, Yersinia pestis
uaaauuuuuauauaauu

SEQ ID NO: 2252651 - RNA, 22 nt, Yersinia pestis
uaaauuuuguacaacuucuuca

SEQ ID NO: 2252652 - RNA, 21 nt, Yersinia pestis
uaacaauucaaugcuuuccgc

SEQ ID NO: 2252653 - RNA, 21 nt, Yersinia pestis
uaacaagcgaccaucaugaau

SEQ ID NO: 2252654 - RNA, 15 nt, Yersinia pestis
uaacaauaaaaucuu

SEQ ID NO: 2252655 - RNA, 15 nt, Yersinia pestis
uaacaaguuacauuu

SEQ ID NO: 2252656 - RNA, 18 nt, Yersinia pestis
uaacacgaaaagcagcag

SEQ ID NO: 2252657 - RNA, 19 nt, Yersinia pestis
uaacacgaaaagcagcagu

SEQ ID NO: 2252658 - RNA, 20 nt, Yersinia pestis
uaacaccaauugcaggcuuu

SEQ ID NO: 2252659 - RNA, 18 nt, Yersinia pestis
uaacaccagcauccugca

SEQ ID NO: 2252660 - RNA, 19 nt, Yersinia pestis
uaacaccagcauccugcaa

SEQ ID NO: 2252661 - RNA, 22 nt, Yersinia pestis
uaaauuauugaguaacauuaau

SEQ ID NO: 2252662 - RNA, 14 nt, Yersinia pestis
uaaauucaaaauag

SEQ ID NO: 2252663 - RNA, 13 nt, Yersinia pestis
uaaauucaaaaua

SEQ ID NO: 2252664 - RNA, 15 nt, Yersinia pestis
uaaauuaauauuuaa

SEQ ID NO: 2252665 - RNA, 16 nt, Yersinia pestis
uaaauuaauauuuaaa

SEQ ID NO: 2252666 - RNA, 17 nt, Yersinia pestis
uaaauuaauauuuaaag

SEQ ID NO: 2252667 - RNA, 18 nt, Yersinia pestis
uaaauuaauauuuaaagc

SEQ ID NO: 2252668 - RNA, 13 nt, Yersinia pestis
uaaauguucaccg

SEQ ID NO: 2252669 - RNA, 17 nt, Yersinia pestis
uaaauuaaaaagagugu

SEQ ID NO: 2252670 - RNA, 17 nt, Yersinia pestis
uaaauuaaaacugaaaa

SEQ ID NO: 2252671 - RNA, 21 nt, Yersinia pestis
uaaauucauuagcucaaauau

SEQ ID NO: 2252672 - RNA, 16 nt, Yersinia pestis
uaaauucaaauaucau

SEQ ID NO: 2252673 - RNA, 17 nt, Yersinia pestis
uaaauucuugcgcuuca

SEQ ID NO: 2252674 - RNA, 18 nt, Yersinia pestis
uaaauucuaccuggcuca

SEQ ID NO: 2252675 - RNA, 21 nt, Yersinia pestis
uaaauuccuauaaauuuuaag

SEQ ID NO: 2252676 - RNA, 21 nt, Yersinia pestis
uaaauucuaccuggcucaaau

SEQ ID NO: 2252677 - RNA, 20 nt, Yersinia pestis
uaaauccgcuaguuaacccu

SEQ ID NO: 2252678 - RNA, 13 nt, Yersinia pestis
uaaauccuucugg

SEQ ID NO: 2252679 - RNA, 12 nt, Yersinia pestis
uaaauccaaaug

SEQ ID NO: 2252680 - RNA, 15 nt, Yersinia pestis
uaaauccaaaugccc

SEQ ID NO: 2252681 - RNA, 16 nt, Yersinia pestis
uaaauccaaaugccca

SEQ ID NO: 2252682 - RNA, 13 nt, Yersinia pestis
uaaauccagccca

SEQ ID NO: 2252683 - RNA, 15 nt, Yersinia pestis
uaaauccaucaauag

SEQ ID NO: 2252684 - RNA, 22 nt, Yersinia pestis
uaaaucgcuuaucuugguuuca

SEQ ID NO: 2252685 - RNA, 16 nt, Yersinia pestis
uaaaugcuguaagaau

SEQ ID NO: 2252686 - RNA, 18 nt, Yersinia pestis
uaaaugcuggcggaaaua

SEQ ID NO: 2252687 - RNA, 16 nt, Yersinia pestis
uaaauggcuaaacucu

SEQ ID NO: 2252688 - RNA, 22 nt, Yersinia pestis
uaaauggcacuggaaacaaaac

SEQ ID NO: 2252689 - RNA, 15 nt, Yersinia pestis
uaaauggcauuuuuu

SEQ ID NO: 2252690 - RNA, 18 nt, Yersinia pestis
uaagugaaacaaauacac

SEQ ID NO: 2252691 - RNA, 17 nt, Yersinia pestis
uaagugcaaacuuaaaa

SEQ ID NO: 2252692 - RNA, 16 nt, Yersinia pestis
uaaguuaacaccauca

SEQ ID NO: 2252693 - RNA, 22 nt, Yersinia pestis
uaaguguauucgcaucuuccaa

SEQ ID NO: 2252694 - RNA, 13 nt, Yersinia pestis
uaaguuaguggug

SEQ ID NO: 2252695 - RNA, 16 nt, Yersinia pestis
uaaguuacgucagaaa

SEQ ID NO: 2252696 - RNA, 13 nt, Yersinia pestis
uaauaaauaauuu

SEQ ID NO: 2252697 - RNA, 22 nt, Yersinia pestis
uaauaaauaauuuguauucuca

SEQ ID NO: 2252698 - RNA, 14 nt, Yersinia pestis
uaauaacaguaaua

SEQ ID NO: 2252699 - RNA, 17 nt, Yersinia pestis
uaauaacaguaauaccc

SEQ ID NO: 2252700 - RNA, 23 nt, Yersinia pestis
uaauaaaaacacaauuuuuagag

SEQ ID NO: 2252701 - RNA, 14 nt, Yersinia pestis
uaauaaaaaaaaau

SEQ ID NO: 2252702 - RNA, 15 nt, Yersinia pestis
uaauaaaaaaaaaua

SEQ ID NO: 2252703 - RNA, 12 nt, Yersinia pestis
uaauaaaacucu

SEQ ID NO: 2252704 - RNA, 14 nt, Yersinia pestis
uaaguagucagcaa

SEQ ID NO: 2252705 - RNA, 23 nt, Yersinia pestis
uaaguagucagcaacgcgaugca

SEQ ID NO: 2252706 - RNA, 13 nt, Yersinia pestis
uaaguacuuucaa

SEQ ID NO: 2252707 - RNA, 12 nt, Yersinia pestis
uaagucaaauuu

SEQ ID NO: 2252708 - RNA, 16 nt, Yersinia pestis
uaagucaaauuuaaag

SEQ ID NO: 2252709 - RNA, 19 nt, Yersinia pestis
uaagucaaugcauuguaaa

SEQ ID NO: 2252710 - RNA, 14 nt, Yersinia pestis
uaaggugccacaca

SEQ ID NO: 2252711 - RNA, 15 nt, Yersinia pestis
uaaggucacuguuuc

SEQ ID NO: 2252712 - RNA, 21 nt, Yersinia pestis
uaaggugaugaaugacuggcu

SEQ ID NO: 2252713 - RNA, 13 nt, Yersinia pestis
uaagggggacccc

SEQ ID NO: 2252714 - RNA, 19 nt, Yersinia pestis
uaagccagugcuauucaua

SEQ ID NO: 2252715 - RNA, 12 nt, Yersinia pestis
uaagccagugug

SEQ ID NO: 2252716 - RNA, 15 nt, Yersinia pestis
uaagccgucagcuua

SEQ ID NO: 2252717 - RNA, 18 nt, Yersinia pestis
uaagccgcagaugccaga

SEQ ID NO: 2252718 - RNA, 23 nt, Yersinia pestis
uaagccuaauggugcuauuucug

SEQ ID NO: 2252719 - RNA, 17 nt, Yersinia pestis
uaagcaugccgccagau

SEQ ID NO: 2252720 - RNA, 18 nt, Yersinia pestis
uaagcaugaaacacagug

SEQ ID NO: 2252721 - RNA, 21 nt, Yersinia pestis
uaagcaccagcaccaacaaua

SEQ ID NO: 2252722 - RNA, 15 nt, Yersinia pestis
uaaggauuuggaaug

SEQ ID NO: 2252723 - RNA, 13 nt, Yersinia pestis
uaaggcccauuug

SEQ ID NO: 2252724 - RNA, 23 nt, Yersinia pestis
uaaggccgcgauaaaaaauaaag

SEQ ID NO: 2252725 - RNA, 22 nt, Yersinia pestis
uaaggcccauuugucgcgccug

SEQ ID NO: 2252726 - RNA, 22 nt, Yersinia pestis
uaagcugaaauuuuuuaauuug

SEQ ID NO: 2252727 - RNA, 15 nt, Yersinia pestis
uaagcucuuccaaua

SEQ ID NO: 2252728 - RNA, 18 nt, Yersinia pestis
uaagcucaucuaacucau

SEQ ID NO: 2252729 - RNA, 20 nt, Yersinia pestis
uaagcuguuggcuuuaucuc

SEQ ID NO: 2252730 - RNA, 20 nt, Yersinia pestis
uaagcuggcgcacucauccu

SEQ ID NO: 2252731 - RNA, 12 nt, Yersinia pestis
uaagcuggcuuc

SEQ ID NO: 2252732 - RNA, 16 nt, Yersinia pestis
uaagcuggcuucuuuu

SEQ ID NO: 2252733 - RNA, 14 nt, Yersinia pestis
uaagcgguuucaug

SEQ ID NO: 2252734 - RNA, 18 nt, Yersinia pestis
uaagcgggcuuuaauagc

SEQ ID NO: 2252735 - RNA, 13 nt, Yersinia pestis
uaacuuuucuuca

SEQ ID NO: 2252736 - RNA, 15 nt, Yersinia pestis
uaacuuuucuucauu

SEQ ID NO: 2252737 - RNA, 16 nt, Yersinia pestis
uaacuuuucuucauug

SEQ ID NO: 2252738 - RNA, 16 nt, Yersinia pestis
uaacuuuuuauuucuu

SEQ ID NO: 2252739 - RNA, 17 nt, Yersinia pestis
uaacuuuuuauuucuuu

SEQ ID NO: 2252740 - RNA, 17 nt, Yersinia pestis
uaacuuuccauccagaa

SEQ ID NO: 2252741 - RNA, 13 nt, Yersinia pestis
uaacuuuauugac

SEQ ID NO: 2252742 - RNA, 21 nt, Yersinia pestis
uaacuugccguaaaauuuaaa

SEQ ID NO: 2252743 - RNA, 22 nt, Yersinia pestis
uaacuugccguaaaauuuaaag

SEQ ID NO: 2252744 - RNA, 22 nt, Yersinia pestis
uaagaauaaggguagguucaau

SEQ ID NO: 2252745 - RNA, 15 nt, Yersinia pestis
uaagaauaaauaaua

SEQ ID NO: 2252746 - RNA, 13 nt, Yersinia pestis
uaagaagacuucg

SEQ ID NO: 2252747 - RNA, 17 nt, Yersinia pestis
uaagaagccucaugaau

SEQ ID NO: 2252748 - RNA, 16 nt, Yersinia pestis
uaagaaaucaucagca

SEQ ID NO: 2252749 - RNA, 18 nt, Yersinia pestis
uaagauaauuauccauuu

SEQ ID NO: 2252750 - RNA, 14 nt, Yersinia pestis
uaagauaccagcga

SEQ ID NO: 2252751 - RNA, 15 nt, Yersinia pestis
uaagauacuugcguu

SEQ ID NO: 2252752 - RNA, 24 nt, Yersinia pestis
uaagaugcaucccacgcagauacu

SEQ ID NO: 2252753 - RNA, 23 nt, Yersinia pestis
uaagauuacguagacauaaauuu

SEQ ID NO: 2252754 - RNA, 21 nt, Yersinia pestis
uaagauucgccgcaaggcaaa

SEQ ID NO: 2252755 - RNA, 14 nt, Yersinia pestis
uaagauccaccaca

SEQ ID NO: 2252756 - RNA, 16 nt, Yersinia pestis
uaagaucaauauguuu

SEQ ID NO: 2252757 - RNA, 20 nt, Yersinia pestis
uaagacguaucgcaguuaaa

SEQ ID NO: 2252758 - RNA, 18 nt, Yersinia pestis
uaagacuauuaauuuuau

SEQ ID NO: 2252759 - RNA, 15 nt, Yersinia pestis
uaagagucacagcau

SEQ ID NO: 2252760 - RNA, 16 nt, Yersinia pestis
uaacucgccacucaca

SEQ ID NO: 2252761 - RNA, 14 nt, Yersinia pestis
uaacucaaauuauu

SEQ ID NO: 2252762 - RNA, 18 nt, Yersinia pestis
uaacucaauaaauucauu

SEQ ID NO: 2252763 - RNA, 15 nt, Yersinia pestis
uaacucaagcguuau

SEQ ID NO: 2252764 - RNA, 20 nt, Yersinia pestis
uaacucauuuaucuaaaacu

SEQ ID NO: 2252765 - RNA, 18 nt, Yersinia pestis
uaacucaggauccucguc

SEQ ID NO: 2252766 - RNA, 15 nt, Yersinia pestis
uaacguuucagggug

SEQ ID NO: 2252767 - RNA, 15 nt, Yersinia pestis
uaacuaacaucagcg

SEQ ID NO: 2252768 - RNA, 18 nt, Yersinia pestis
uaacuaagagucacagca

SEQ ID NO: 2252769 - RNA, 18 nt, Yersinia pestis
uaacguggagccugugca

SEQ ID NO: 2252770 - RNA, 23 nt, Yersinia pestis
uaacguguccccgagaggcuauu

SEQ ID NO: 2252771 - RNA, 21 nt, Yersinia pestis
uaacgucgcugaaaugcuaug

SEQ ID NO: 2252772 - RNA, 19 nt, Yersinia pestis
uaacgucgcugaaaugcua

SEQ ID NO: 2252773 - RNA, 15 nt, Yersinia pestis
uaacguaaauagacu

SEQ ID NO: 2252774 - RNA, 14 nt, Yersinia pestis
uaacguagagagac

SEQ ID NO: 2252775 - RNA, 10 nt, Yersinia pestis
uaacuggucu

SEQ ID NO: 2252776 - RNA, 15 nt, Yersinia pestis
uaacugguggcaggc

SEQ ID NO: 2252777 - RNA, 17 nt, Yersinia pestis
uaacuuaaaauauggca

SEQ ID NO: 2252778 - RNA, 16 nt, Yersinia pestis
uaacugugcaguaucu

SEQ ID NO: 2252779 - RNA, 14 nt, Yersinia pestis
uaacuguuuuauau

SEQ ID NO: 2252780 - RNA, 15 nt, Yersinia pestis
uaacuguaaggccaa

SEQ ID NO: 2252781 - RNA, 16 nt, Yersinia pestis
uaacugugcagcccau

SEQ ID NO: 2252782 - RNA, 23 nt, Yersinia pestis
uaacuuccuaacaauauuaccaa

SEQ ID NO: 2252783 - RNA, 14 nt, Yersinia pestis
uaacuucauuuuuc

SEQ ID NO: 2252784 - RNA, 15 nt, Yersinia pestis
uaacuucauuuuucu

SEQ ID NO: 2252785 - RNA, 15 nt, Yersinia pestis
uaacuuccaauuucu

SEQ ID NO: 2252786 - RNA, 23 nt, Yersinia pestis
uaacuuauuacaccuuaaaacag

SEQ ID NO: 2252787 - RNA, 22 nt, Yersinia pestis
uaacuuaucgaccaacuggcaa

SEQ ID NO: 2252788 - RNA, 17 nt, Yersinia pestis
uaacuuacgguaagcac

SEQ ID NO: 2252789 - RNA, 18 nt, Yersinia pestis
aaaucccgggaauaauca

SEQ ID NO: 2252790 - RNA, 21 nt, Yersinia pestis
aaaucccgggaauaaucaauu

SEQ ID NO: 2252791 - RNA, 23 nt, Yersinia pestis
aaaucccgggaauaaucaauuaa

SEQ ID NO: 2252792 - RNA, 17 nt, Yersinia pestis
uaacugcagugaaaagg

SEQ ID NO: 2252793 - RNA, 22 nt, Yersinia pestis
aaaucccgcuggaagucugcuu

SEQ ID NO: 2252794 - RNA, 20 nt, Yersinia pestis
aaaucccccacgaucuccuc

SEQ ID NO: 2252795 - RNA, 21 nt, Yersinia pestis
uaacugaguuggaaaugacaa

SEQ ID NO: 2252796 - RNA, 19 nt, Yersinia pestis
uaacugagccgcauacaua

SEQ ID NO: 2252797 - RNA, 20 nt, Yersinia pestis
uaauaguucauuuuguauuu

SEQ ID NO: 2252798 - RNA, 21 nt, Yersinia pestis
uaauaguuucuggcaagguaa

SEQ ID NO: 2252799 - RNA, 15 nt, Yersinia pestis
uaauauaccaacucu

SEQ ID NO: 2252800 - RNA, 15 nt, Yersinia pestis
uaauauaauucaaua

SEQ ID NO: 2252801 - RNA, 21 nt, Yersinia pestis
uaauaguuaaucgcagcagag

SEQ ID NO: 2252802 - RNA, 13 nt, Yersinia pestis
uaauagcaaaaaa

SEQ ID NO: 2252803 - RNA, 15 nt, Yersinia pestis
uaauagccucugucu

SEQ ID NO: 2252804 - RNA, 14 nt, Yersinia pestis
uaauaccuaaaauu

SEQ ID NO: 2252805 - RNA, 22 nt, Yersinia pestis
uaauacggcuugcaauuggggu

SEQ ID NO: 2252806 - RNA, 13 nt, Yersinia pestis
uaauacugccaau

SEQ ID NO: 2252807 - RNA, 20 nt, Yersinia pestis
uaauacuuucccauagcugg

SEQ ID NO: 2252808 - RNA, 18 nt, Yersinia pestis
uaauacuuaagucaaauu

SEQ ID NO: 2252809 - RNA, 14 nt, Yersinia pestis
uaauagauaguacg

SEQ ID NO: 2252810 - RNA, 14 nt, Yersinia pestis
uaauaauagauagu

SEQ ID NO: 2252811 - RNA, 22 nt, Yersinia pestis
uaauaaugccguuaauugugau

SEQ ID NO: 2252812 - RNA, 16 nt, Yersinia pestis
uaauaaugauuauuga

SEQ ID NO: 2252813 - RNA, 16 nt, Yersinia pestis
uaauaaucuuaaguaa

SEQ ID NO: 2252814 - RNA, 19 nt, Yersinia pestis
uaauaaucuuaaguaaauu

SEQ ID NO: 2252815 - RNA, 18 nt, Yersinia pestis
uaauaaucuaaauuaaua

SEQ ID NO: 2252816 - RNA, 21 nt, Yersinia pestis
uaauaagccgcaggcaaacaa

SEQ ID NO: 2252817 - RNA, 23 nt, Yersinia pestis
uaauaagccgcaggcaaacaaug

SEQ ID NO: 2252818 - RNA, 22 nt, Yersinia pestis
uaauaagacguuauuauugauu

SEQ ID NO: 2252819 - RNA, 18 nt, Yersinia pestis
uaauaaccauuuauauaa

SEQ ID NO: 2252820 - RNA, 20 nt, Yersinia pestis
uaauaacgccgaguaaguca

SEQ ID NO: 2252821 - RNA, 16 nt, Yersinia pestis
uaauaacgguuuuaac

SEQ ID NO: 2252822 - RNA, 22 nt, Yersinia pestis
uaauacaggcugacauuucuuu

SEQ ID NO: 2252823 - RNA, 22 nt, Yersinia pestis
uaauacacuaggagaaacauua

SEQ ID NO: 2252824 - RNA, 18 nt, Yersinia pestis
uaauacacccgaaggcca

SEQ ID NO: 2252825 - RNA, 15 nt, Yersinia pestis
uaauacaauagagaa

SEQ ID NO: 2252826 - RNA, 15 nt, Yersinia pestis
uaauaccacaacauu

SEQ ID NO: 2252827 - RNA, 16 nt, Yersinia pestis
uaauacaucaucaaaa

SEQ ID NO: 2252828 - RNA, 20 nt, Yersinia pestis
uaauaauuuuucuuccacca

SEQ ID NO: 2252829 - RNA, 21 nt, Yersinia pestis
uaauaauucugcuauuaauua

SEQ ID NO: 2252830 - RNA, 22 nt, Yersinia pestis
uaauaauuuauacauaucagaa

SEQ ID NO: 2252831 - RNA, 21 nt, Yersinia pestis
uaauaauuccaugaaaacccg

SEQ ID NO: 2252832 - RNA, 20 nt, Yersinia pestis
uaauaauucagguugagcau

SEQ ID NO: 2252833 - RNA, 20 nt, Yersinia pestis
uaaucagcaaaaacaaauaa

SEQ ID NO: 2252834 - RNA, 22 nt, Yersinia pestis
uaaucagcaaaaacaaauaauu

SEQ ID NO: 2252835 - RNA, 16 nt, Yersinia pestis
uaaucagccuucaggg

SEQ ID NO: 2252836 - RNA, 20 nt, Yersinia pestis
uaaucaauccuacauucagu

SEQ ID NO: 2252837 - RNA, 18 nt, Yersinia pestis
uaaucaaugugcguuuau

SEQ ID NO: 2252838 - RNA, 18 nt, Yersinia pestis
uaaucaauuaaucaauua

SEQ ID NO: 2252839 - RNA, 20 nt, Yersinia pestis
uaaucaccagacaaccaaua

SEQ ID NO: 2252840 - RNA, 23 nt, Yersinia pestis
uaaucaugggguuuauugguuau

SEQ ID NO: 2252841 - RNA, 11 nt, Yersinia pestis
uaauccaaggc

SEQ ID NO: 2252842 - RNA, 11 nt, Yersinia pestis
uaaucaugggg

SEQ ID NO: 2252843 - RNA, 13 nt, Yersinia pestis
uaaucaucgcccu

SEQ ID NO: 2252844 - RNA, 17 nt, Yersinia pestis
uaaucaucuacaacauc

SEQ ID NO: 2252845 - RNA, 19 nt, Yersinia pestis
uaaucaaacgaucaguuaa

SEQ ID NO: 2252846 - RNA, 19 nt, Yersinia pestis
uaauauuacguaauaucag

SEQ ID NO: 2252847 - RNA, 12 nt, Yersinia pestis
uaauauuauuca

SEQ ID NO: 2252848 - RNA, 14 nt, Yersinia pestis
uaauauugccgcag

SEQ ID NO: 2252849 - RNA, 22 nt, Yersinia pestis
uaauauucaauaggguaauacc

SEQ ID NO: 2252850 - RNA, 15 nt, Yersinia pestis
uaauauuuaucugca

SEQ ID NO: 2252851 - RNA, 23 nt, Yersinia pestis
uaauauuucaagcuguauaugcg

SEQ ID NO: 2252852 - RNA, 17 nt, Yersinia pestis
uaauauuuccguggguu

SEQ ID NO: 2252853 - RNA, 14 nt, Yersinia pestis
uaauauuaaaaucc

SEQ ID NO: 2252854 - RNA, 17 nt, Yersinia pestis
uaauaucuuuaaauuau

SEQ ID NO: 2252855 - RNA, 16 nt, Yersinia pestis
uaauaucgguaaaaaa

SEQ ID NO: 2252856 - RNA, 15 nt, Yersinia pestis
uaauaucaaaacuga

SEQ ID NO: 2252857 - RNA, 16 nt, Yersinia pestis
uaauauccaauuguuu

SEQ ID NO: 2252858 - RNA, 21 nt, Yersinia pestis
uaaucgccaggcgcuacgcaa

SEQ ID NO: 2252859 - RNA, 17 nt, Yersinia pestis
uaaucgccaauaaccgc

SEQ ID NO: 2252860 - RNA, 19 nt, Yersinia pestis
uaaugaggguaagugaaua

SEQ ID NO: 2252861 - RNA, 20 nt, Yersinia pestis
uaaugagccgcauugauccu

SEQ ID NO: 2252862 - RNA, 22 nt, Yersinia pestis
uaaugagucucacaaaauaaua

SEQ ID NO: 2252863 - RNA, 19 nt, Yersinia pestis
uaaugauuauugaccagau

SEQ ID NO: 2252864 - RNA, 14 nt, Yersinia pestis
uaaugauuauugac

SEQ ID NO: 2252865 - RNA, 23 nt, Yersinia pestis
uaaugucauuuccuguauuuccu

SEQ ID NO: 2252866 - RNA, 17 nt, Yersinia pestis
uaaugucgccauaacgc

SEQ ID NO: 2252867 - RNA, 16 nt, Yersinia pestis
uaaugcaauggcucca

SEQ ID NO: 2252868 - RNA, 15 nt, Yersinia pestis
uaaugcgcaccagcu

SEQ ID NO: 2252869 - RNA, 21 nt, Yersinia pestis
uaaugcgaagcuuuuauugau

SEQ ID NO: 2252870 - RNA, 20 nt, Yersinia pestis
uaaugcggugguuaacagcg

SEQ ID NO: 2252871 - RNA, 22 nt, Yersinia pestis
uaauuauuguggcuaccaauua

SEQ ID NO: 2252872 - RNA, 18 nt, Yersinia pestis
uaauguguuuuugucauu

SEQ ID NO: 2252873 - RNA, 23 nt, Yersinia pestis
uaauguguuuuugucauuuaauu

SEQ ID NO: 2252874 - RNA, 14 nt, Yersinia pestis
uaauuaaaaauaga

SEQ ID NO: 2252875 - RNA, 16 nt, Yersinia pestis
uacaagcagcguucaa

SEQ ID NO: 2252876 - RNA, 17 nt, Yersinia pestis
uacaacuucuucauaac

SEQ ID NO: 2252877 - RNA, 16 nt, Yersinia pestis
uacaacuugcuggagg

SEQ ID NO: 2252878 - RNA, 16 nt, Yersinia pestis
uacaacaagaucccaa

SEQ ID NO: 2252879 - RNA, 14 nt, Yersinia pestis
uacaacaauaauaa

SEQ ID NO: 2252880 - RNA, 23 nt, Yersinia pestis
uacaacacaucgaagcugucuuu

SEQ ID NO: 2252881 - RNA, 19 nt, Yersinia pestis
uacaaauuugacauuuccu

SEQ ID NO: 2252882 - RNA, 12 nt, Yersinia pestis
uacaaauuuuuu

SEQ ID NO: 2252883 - RNA, 23 nt, Yersinia pestis
uacaaauuuuuuauauuccacau

SEQ ID NO: 2252884 - RNA, 22 nt, Yersinia pestis
uacaaaccacauuuuuuaaaac

SEQ ID NO: 2252885 - RNA, 21 nt, Yersinia pestis
uacaaacagggcagccaauua

SEQ ID NO: 2252886 - RNA, 21 nt, Yersinia pestis
uacaaagcagcguuuuuagug

SEQ ID NO: 2252887 - RNA, 16 nt, Yersinia pestis
uacaaaucaucaucuu

SEQ ID NO: 2252888 - RNA, 14 nt, Yersinia pestis
uacaaauaguaaua

SEQ ID NO: 2252889 - RNA, 23 nt, Yersinia pestis
uacaaauaguaauaauuaaucua

SEQ ID NO: 2252890 - RNA, 20 nt, Yersinia pestis
uaauuucaaguggucuauca

SEQ ID NO: 2252891 - RNA, 22 nt, Yersinia pestis
uaauuucaucucaauaacuauu

SEQ ID NO: 2252892 - RNA, 23 nt, Yersinia pestis
uaauuucaucucaauaacuauuu

SEQ ID NO: 2252893 - RNA, 18 nt, Yersinia pestis
uaauuucagauaaaaaua

SEQ ID NO: 2252894 - RNA, 21 nt, Yersinia pestis
uaauuucacuuccauuccguu

SEQ ID NO: 2252895 - RNA, 22 nt, Yersinia pestis
uaauuugcuccuggcaugcauu

SEQ ID NO: 2252896 - RNA, 12 nt, Yersinia pestis
uaauuugccugg

SEQ ID NO: 2252897 - RNA, 13 nt, Yersinia pestis
uaauuuuucccuu

SEQ ID NO: 2252898 - RNA, 13 nt, Yersinia pestis
uaauuuuucuucc

SEQ ID NO: 2252899 - RNA, 14 nt, Yersinia pestis
uaauuuugaugcua

SEQ ID NO: 2252900 - RNA, 21 nt, Yersinia pestis
uaauuuggcuuaaaaaaugau

SEQ ID NO: 2252901 - RNA, 14 nt, Yersinia pestis
uaauuugucaguaa

SEQ ID NO: 2252902 - RNA, 14 nt, Yersinia pestis
uaauuuguaaauuu

SEQ ID NO: 2252903 - RNA, 13 nt, Yersinia pestis
uacaguaagguau

SEQ ID NO: 2252904 - RNA, 18 nt, Yersinia pestis
uacagucauuuacugaug

SEQ ID NO: 2252905 - RNA, 21 nt, Yersinia pestis
uacagucccugugcgcccacg

SEQ ID NO: 2252906 - RNA, 22 nt, Yersinia pestis
uacagugaaaaugguuuccagc

SEQ ID NO: 2252907 - RNA, 14 nt, Yersinia pestis
uacaggguaaauua

SEQ ID NO: 2252908 - RNA, 16 nt, Yersinia pestis
uacaucaaaucagagg

SEQ ID NO: 2252909 - RNA, 22 nt, Yersinia pestis
uacauaaucuuuacugcauuga

SEQ ID NO: 2252910 - RNA, 14 nt, Yersinia pestis
uacaucaucuucua

SEQ ID NO: 2252911 - RNA, 15 nt, Yersinia pestis
uacaucaucuucuau

SEQ ID NO: 2252912 - RNA, 13 nt, Yersinia pestis
uacaucagacacg

SEQ ID NO: 2252913 - RNA, 16 nt, Yersinia pestis
uacaucguagucuaua

SEQ ID NO: 2252914 - RNA, 16 nt, Yersinia pestis
uacauccuaaauaauu

SEQ ID NO: 2252915 - RNA, 16 nt, Yersinia pestis
uaccaaaucagcaagc

SEQ ID NO: 2252916 - RNA, 17 nt, Yersinia pestis
uaccaaaucagcaagcu

SEQ ID NO: 2252917 - RNA, 23 nt, Yersinia pestis
uacauuccacaaauuuuuaccuu

SEQ ID NO: 2252918 - RNA, 15 nt, Yersinia pestis
uacauuacuggucuc

SEQ ID NO: 2252919 - RNA, 20 nt, Yersinia pestis
uaccagccgcgcccuaacag

SEQ ID NO: 2252920 - RNA, 17 nt, Yersinia pestis
uaccagcgucaaaccau

SEQ ID NO: 2252921 - RNA, 16 nt, Yersinia pestis
uaccagacccugcacc

SEQ ID NO: 2252922 - RNA, 13 nt, Yersinia pestis
uaccaccaccaac

SEQ ID NO: 2252923 - RNA, 15 nt, Yersinia pestis
uaccaccaccaacag

SEQ ID NO: 2252924 - RNA, 18 nt, Yersinia pestis
uaccaccaccacaaacag

SEQ ID NO: 2252925 - RNA, 20 nt, Yersinia pestis
uaccacauuuccuaugugau

SEQ ID NO: 2252926 - RNA, 21 nt, Yersinia pestis
uacccauaacuugagcacaua

SEQ ID NO: 2252927 - RNA, 20 nt, Yersinia pestis
uacccccgacgacuuguuca

SEQ ID NO: 2252928 - RNA, 21 nt, Yersinia pestis
uaccauuucacgguucacccc

SEQ ID NO: 2252929 - RNA, 17 nt, Yersinia pestis
uacccacauucaggccg

SEQ ID NO: 2252930 - RNA, 18 nt, Yersinia pestis
uaccauccagugccaacc

SEQ ID NO: 2252931 - RNA, 22 nt, Yersinia pestis
uaccauauggaugaugcacagc

SEQ ID NO: 2252932 - RNA, 22 nt, Yersinia pestis
uaccaugagugaaaauauguag

SEQ ID NO: 2252933 - RNA, 16 nt, Yersinia pestis
uaccauaacaauggcc

SEQ ID NO: 2252934 - RNA, 18 nt, Yersinia pestis
uaccauaguuuuucuccu

SEQ ID NO: 2252935 - RNA, 20 nt, Yersinia pestis
uaccagggcaccuaauucac

SEQ ID NO: 2252936 - RNA, 13 nt, Yersinia pestis
uaccagugccaug

SEQ ID NO: 2252937 - RNA, 16 nt, Yersinia pestis
uacccgaaucacugac

SEQ ID NO: 2252938 - RNA, 19 nt, Yersinia pestis
uacccgaaucacugacuga

SEQ ID NO: 2252939 - RNA, 22 nt, Yersinia pestis
uacccgacaccggcugauuacc

SEQ ID NO: 2252940 - RNA, 18 nt, Yersinia pestis
uacccuccgacuuugaua

SEQ ID NO: 2252941 - RNA, 20 nt, Yersinia pestis
uacccuaucgucacagcaau

SEQ ID NO: 2252942 - RNA, 17 nt, Yersinia pestis
uacccugcaccauaucc

SEQ ID NO: 2252943 - RNA, 17 nt, Yersinia pestis
uaccgaacgaacacagu

SEQ ID NO: 2252944 - RNA, 17 nt, Yersinia pestis
uaccgauuucaggucgc

SEQ ID NO: 2252945 - RNA, 13 nt, Yersinia pestis
uaccgauuucagg

SEQ ID NO: 2252946 - RNA, 19 nt, Yersinia pestis
uaccgauaauaaauauccu

SEQ ID NO: 2252947 - RNA, 17 nt, Yersinia pestis
uaccgaguucucaccaa

SEQ ID NO: 2252948 - RNA, 14 nt, Yersinia pestis
uaccgccagaauaa

SEQ ID NO: 2252949 - RNA, 22 nt, Yersinia pestis
uaccgcauaagacaccacauca

SEQ ID NO: 2252950 - RNA, 18 nt, Yersinia pestis
uaccgccaaucucuccua

SEQ ID NO: 2252951 - RNA, 20 nt, Yersinia pestis
uacuucaaaugacauucuuu

SEQ ID NO: 2252952 - RNA, 22 nt, Yersinia pestis
uacuucauaauucagcaaacuc

SEQ ID NO: 2252953 - RNA, 17 nt, Yersinia pestis
uacuucaggccaauagc

SEQ ID NO: 2252954 - RNA, 17 nt, Yersinia pestis
uacugccgcacugccac

SEQ ID NO: 2252955 - RNA, 16 nt, Yersinia pestis
uacugcucuaucucuu

SEQ ID NO: 2252956 - RNA, 15 nt, Yersinia pestis
uacugcggcuuucug

SEQ ID NO: 2252957 - RNA, 20 nt, Yersinia pestis
uacugcggcuuucugccugu

SEQ ID NO: 2252958 - RNA, 16 nt, Yersinia pestis
uacugcguucuucuug

SEQ ID NO: 2252959 - RNA, 16 nt, Yersinia pestis
uacuguuccggcgcga

SEQ ID NO: 2252960 - RNA, 14 nt, Yersinia pestis
uacuguuaguucag

SEQ ID NO: 2252961 - RNA, 20 nt, Yersinia pestis
uacuguuaguucagacguac

SEQ ID NO: 2252962 - RNA, 17 nt, Yersinia pestis
uacuguggucaguggug

SEQ ID NO: 2252963 - RNA, 23 nt, Yersinia pestis
uacuggcauacagcucaucacca

SEQ ID NO: 2252964 - RNA, 18 nt, Yersinia pestis
uacugucgauaauaaauu

SEQ ID NO: 2252965 - RNA, 14 nt, Yersinia pestis
uacucucuguuuug

SEQ ID NO: 2252966 - RNA, 15 nt, Yersinia pestis
uacucuauugcucau

SEQ ID NO: 2252967 - RNA, 14 nt, Yersinia pestis
uacucuugagaaau

SEQ ID NO: 2252968 - RNA, 20 nt, Yersinia pestis
uacucuucugccuacacuca

SEQ ID NO: 2252969 - RNA, 17 nt, Yersinia pestis
uacucuguguagugggg

SEQ ID NO: 2252970 - RNA, 14 nt, Yersinia pestis
uacucguuuuacau

SEQ ID NO: 2252971 - RNA, 12 nt, Yersinia pestis
uacuacuucaua

SEQ ID NO: 2252972 - RNA, 13 nt, Yersinia pestis
uacugauaaagug

SEQ ID NO: 2252973 - RNA, 22 nt, Yersinia pestis
uacugauaaagugcccaccguu

SEQ ID NO: 2252974 - RNA, 17 nt, Yersinia pestis
uacugcauuucaacaaa

SEQ ID NO: 2252975 - RNA, 20 nt, Yersinia pestis
uacugccaaucgcugccaaa

SEQ ID NO: 2252976 - RNA, 22 nt, Yersinia pestis
uacugcauugagacccguuacu

SEQ ID NO: 2252977 - RNA, 15 nt, Yersinia pestis
uacugaaauauacac

SEQ ID NO: 2252978 - RNA, 16 nt, Yersinia pestis
uacgaccgucaccaaa

SEQ ID NO: 2252979 - RNA, 21 nt, Yersinia pestis
uacgacgggcacgaauagucu

SEQ ID NO: 2252980 - RNA, 20 nt, Yersinia pestis
uacgagagaucguaggcuug

SEQ ID NO: 2252981 - RNA, 15 nt, Yersinia pestis
uacgagcuaaugcua

SEQ ID NO: 2252982 - RNA, 13 nt, Yersinia pestis
uacgcaacaagcc

SEQ ID NO: 2252983 - RNA, 23 nt, Yersinia pestis
uaccgguucauuuagcagcgcac

SEQ ID NO: 2252984 - RNA, 22 nt, Yersinia pestis
uaccgucgaacauaaaaaugca

SEQ ID NO: 2252985 - RNA, 13 nt, Yersinia pestis
uacgcauuuuacc

SEQ ID NO: 2252986 - RNA, 22 nt, Yersinia pestis
uacgcauuuuaccggagauaug

SEQ ID NO: 2252987 - RNA, 15 nt, Yersinia pestis
uacgccaugcagcua

SEQ ID NO: 2252988 - RNA, 15 nt, Yersinia pestis
uacgccauccacuca

SEQ ID NO: 2252989 - RNA, 13 nt, Yersinia pestis
uacgccugggcau

SEQ ID NO: 2252990 - RNA, 16 nt, Yersinia pestis
uacgccuggcuaacgu

SEQ ID NO: 2252991 - RNA, 20 nt, Yersinia pestis
uacgccgacaauacugccaa

SEQ ID NO: 2252992 - RNA, 20 nt, Yersinia pestis
uacguaacgaauucagcagc

SEQ ID NO: 2252993 - RNA, 20 nt, Yersinia pestis
uacggcugcgcgacaaaacc

SEQ ID NO: 2252994 - RNA, 20 nt, Yersinia pestis
uacggcgacuugccguggcu

SEQ ID NO: 2252995 - RNA, 20 nt, Yersinia pestis
uacggcgaaauauaaaacag

SEQ ID NO: 2252996 - RNA, 16 nt, Yersinia pestis
uacgcgccgcagcagu

SEQ ID NO: 2252997 - RNA, 16 nt, Yersinia pestis
uacuaccuuuugcaua

SEQ ID NO: 2252998 - RNA, 19 nt, Yersinia pestis
uacuaaagguguacucucc

SEQ ID NO: 2252999 - RNA, 16 nt, Yersinia pestis
uacguauggcaugacu

SEQ ID NO: 2253000 - RNA, 16 nt, Yersinia pestis
gucaauguucucuggg

SEQ ID NO: 2253001 - RNA, 18 nt, Yersinia pestis
gucaauugagaauaacgc

SEQ ID NO: 2253002 - RNA, 21 nt, Yersinia pestis
gucaauguguugaauauccaa

SEQ ID NO: 2253003 - RNA, 18 nt, Yersinia pestis
gucaaugcucaaguguaa

SEQ ID NO: 2253004 - RNA, 18 nt, Yersinia pestis
gucaaucuuauugaaaac

SEQ ID NO: 2253005 - RNA, 17 nt, Yersinia pestis
gucaccgccaaaugaaa

SEQ ID NO: 2253006 - RNA, 22 nt, Yersinia pestis
gucacccuuuugaauucaccaa

SEQ ID NO: 2253007 - RNA, 17 nt, Yersinia pestis
gucacggaaagcagguc

SEQ ID NO: 2253008 - RNA, 22 nt, Yersinia pestis
gucacgcggcggcgucaaauua

SEQ ID NO: 2253009 - RNA, 17 nt, Yersinia pestis
gucaagacaacaaacag

SEQ ID NO: 2253010 - RNA, 15 nt, Yersinia pestis
gucaagaugcauauu

SEQ ID NO: 2253011 - RNA, 20 nt, Yersinia pestis
gucaaucauuuuuuuauuaa

SEQ ID NO: 2253012 - RNA, 18 nt, Yersinia pestis
gucaauccaaucauucug

SEQ ID NO: 2253013 - RNA, 18 nt, Yersinia pestis
gucaagcgacccggcugc

SEQ ID NO: 2253014 - RNA, 15 nt, Yersinia pestis
gucaagccaaccccc

SEQ ID NO: 2253015 - RNA, 10 nt, Yersinia pestis
ggugaacaga

SEQ ID NO: 2253016 - RNA, 17 nt, Yersinia pestis
ggugaaguguuuaccac

SEQ ID NO: 2253017 - RNA, 17 nt, Yersinia pestis
gucacuauucccauggu

SEQ ID NO: 2253018 - RNA, 21 nt, Yersinia pestis
gucacucaagccaguaacuac

SEQ ID NO: 2253019 - RNA, 14 nt, Yersinia pestis
gucacucagaaaac

SEQ ID NO: 2253020 - RNA, 15 nt, Yersinia pestis
gucacguacugggug

SEQ ID NO: 2253021 - RNA, 19 nt, Yersinia pestis
gucagcagucugacaccgg

SEQ ID NO: 2253022 - RNA, 16 nt, Yersinia pestis
gucagcagucugagcc

SEQ ID NO: 2253023 - RNA, 18 nt, Yersinia pestis
gucagcagacgaaccgcu

SEQ ID NO: 2253024 - RNA, 17 nt, Yersinia pestis
gucagccaccguguccg

SEQ ID NO: 2253025 - RNA, 18 nt, Yersinia pestis
gucaggccaccaaucaca

SEQ ID NO: 2253026 - RNA, 22 nt, Yersinia pestis
gucaggccaccaaucacacugg

SEQ ID NO: 2253027 - RNA, 16 nt, Yersinia pestis
gucagggcuaagcagg

SEQ ID NO: 2253028 - RNA, 16 nt, Yersinia pestis
gucagguaaguagaau

SEQ ID NO: 2253029 - RNA, 15 nt, Yersinia pestis
gucagggugaaagcc

SEQ ID NO: 2253030 - RNA, 12 nt, Yersinia pestis
guccauaauucu

SEQ ID NO: 2253031 - RNA, 16 nt, Yersinia pestis
guccauaauucugugu

SEQ ID NO: 2253032 - RNA, 15 nt, Yersinia pestis
guccaaguaauaaaa

SEQ ID NO: 2253033 - RNA, 20 nt, Yersinia pestis
gucauuuuauuuaggcuaca

SEQ ID NO: 2253034 - RNA, 21 nt, Yersinia pestis
guccaacauguugaaaucuau

SEQ ID NO: 2253035 - RNA, 20 nt, Yersinia pestis
guccaagaagauaacuuuuu

SEQ ID NO: 2253036 - RNA, 14 nt, Yersinia pestis
guccaagaagccaa

SEQ ID NO: 2253037 - RNA, 12 nt, Yersinia pestis
gucauuaacaca

SEQ ID NO: 2253038 - RNA, 18 nt, Yersinia pestis
gucauguugaccaaacag

SEQ ID NO: 2253039 - RNA, 17 nt, Yersinia pestis
gucaucggguuuugucg

SEQ ID NO: 2253040 - RNA, 23 nt, Yersinia pestis
gucaucggggguugucugcagaa

SEQ ID NO: 2253041 - RNA, 18 nt, Yersinia pestis
gucaucgggguuugucag

SEQ ID NO: 2253042 - RNA, 15 nt, Yersinia pestis
gucagguuuaucagg

SEQ ID NO: 2253043 - RNA, 14 nt, Yersinia pestis
gucaucagcauccg

SEQ ID NO: 2253044 - RNA, 13 nt, Yersinia pestis
gucaucaaccucg

SEQ ID NO: 2253045 - RNA, 18 nt, Yersinia pestis
gucaucaccguuucuaug

SEQ ID NO: 2253046 - RNA, 17 nt, Yersinia pestis
gucaucacccagcaaaa

SEQ ID NO: 2253047 - RNA, 17 nt, Yersinia pestis
gucaucaugacgaugac

SEQ ID NO: 2253048 - RNA, 23 nt, Yersinia pestis
gucaucgaacccgcuaacaugcc

SEQ ID NO: 2253049 - RNA, 20 nt, Yersinia pestis
gucaucgaagagugcauuga

SEQ ID NO: 2253050 - RNA, 19 nt, Yersinia pestis
gucgcgggcacuuugucaa

SEQ ID NO: 2253051 - RNA, 17 nt, Yersinia pestis
gucgaucgcuuuuuaca

SEQ ID NO: 2253052 - RNA, 13 nt, Yersinia pestis
gucgcagaaccca

SEQ ID NO: 2253053 - RNA, 16 nt, Yersinia pestis
gucgcagaacccaggg

SEQ ID NO: 2253054 - RNA, 20 nt, Yersinia pestis
gucgcagaacccagggcgau

SEQ ID NO: 2253055 - RNA, 21 nt, Yersinia pestis
gucggcagaaaucguauuauc

SEQ ID NO: 2253056 - RNA, 19 nt, Yersinia pestis
gucgcuguagcgccaggua

SEQ ID NO: 2253057 - RNA, 16 nt, Yersinia pestis
gucggcauuaaaagca

SEQ ID NO: 2253058 - RNA, 22 nt, Yersinia pestis
gucgggcgcugagcgggcggca

SEQ ID NO: 2253059 - RNA, 21 nt, Yersinia pestis
gucggugacucgggucaguga

SEQ ID NO: 2253060 - RNA, 14 nt, Yersinia pestis
gucgggccaauaaa

SEQ ID NO: 2253061 - RNA, 15 nt, Yersinia pestis
guccucaaacccaca

SEQ ID NO: 2253062 - RNA, 17 nt, Yersinia pestis
guccggguuuacccagc

SEQ ID NO: 2253063 - RNA, 11 nt, Yersinia pestis
guccuccugcc

SEQ ID NO: 2253064 - RNA, 19 nt, Yersinia pestis
guccuuuaacucaauuuug

SEQ ID NO: 2253065 - RNA, 19 nt, Yersinia pestis
gucgauaaccagagucagu

SEQ ID NO: 2253066 - RNA, 20 nt, Yersinia pestis
gucgauaagcacuccacugg

SEQ ID NO: 2253067 - RNA, 18 nt, Yersinia pestis
gucgauccgauaauaauu

SEQ ID NO: 2253068 - RNA, 14 nt, Yersinia pestis
gucucgcaaugaaa

SEQ ID NO: 2253069 - RNA, 16 nt, Yersinia pestis
gucucuuuuucaucuu

SEQ ID NO: 2253070 - RNA, 17 nt, Yersinia pestis
gucucuguggauugcca

SEQ ID NO: 2253071 - RNA, 14 nt, Yersinia pestis
gucucuauucacua

SEQ ID NO: 2253072 - RNA, 20 nt, Yersinia pestis
gucguuauaaaccaaauggu

SEQ ID NO: 2253073 - RNA, 19 nt, Yersinia pestis
gucugggacuuuaucugcc

SEQ ID NO: 2253074 - RNA, 22 nt, Yersinia pestis
gucuguagcguuggccacgugc

SEQ ID NO: 2253075 - RNA, 12 nt, Yersinia pestis
gucugcggccua

SEQ ID NO: 2253076 - RNA, 13 nt, Yersinia pestis
gucugacagauac

SEQ ID NO: 2253077 - RNA, 20 nt, Yersinia pestis
gucugacggguauaucacuu

SEQ ID NO: 2253078 - RNA, 13 nt, Yersinia pestis
gucugauaaccgu

SEQ ID NO: 2253079 - RNA, 15 nt, Yersinia pestis
gucugagccucauga

SEQ ID NO: 2253080 - RNA, 16 nt, Yersinia pestis
gucugagccucaugaa

SEQ ID NO: 2253081 - RNA, 14 nt, Yersinia pestis
gucucuuugccaag

SEQ ID NO: 2253082 - RNA, 15 nt, Yersinia pestis
gucugcgacaauaac

SEQ ID NO: 2253083 - RNA, 16 nt, Yersinia pestis
gucuguuaugcccaac

SEQ ID NO: 2253084 - RNA, 14 nt, Yersinia pestis
gucuuacggagaag

SEQ ID NO: 2253085 - RNA, 12 nt, Yersinia pestis
gucuucagcuuc

SEQ ID NO: 2253086 - RNA, 23 nt, Yersinia pestis
gucuucaguggcuggaaaggaau

SEQ ID NO: 2253087 - RNA, 17 nt, Yersinia pestis
gucuugcaccugaucgu

SEQ ID NO: 2253088 - RNA, 22 nt, Yersinia pestis
gucuugacgguucgaaaauaau

SEQ ID NO: 2253089 - RNA, 16 nt, Yersinia pestis
gucuugaucaacucac

SEQ ID NO: 2253090 - RNA, 17 nt, Yersinia pestis
gucuuuuuaauauguga

SEQ ID NO: 2253091 - RNA, 17 nt, Yersinia pestis
gucuuucgggcugauga

SEQ ID NO: 2253092 - RNA, 17 nt, Yersinia pestis
gucuuuaaaaucuugug

SEQ ID NO: 2253093 - RNA, 18 nt, Yersinia pestis
gucuuguuggucaccacu

SEQ ID NO: 2253094 - RNA, 22 nt, Yersinia pestis
gugaaacccgcgcagccuaaaa

SEQ ID NO: 2253095 - RNA, 14 nt, Yersinia pestis
gugaaacaaauaca

SEQ ID NO: 2253096 - RNA, 20 nt, Yersinia pestis
gugaaacgauaugcuccaga

SEQ ID NO: 2253097 - RNA, 21 nt, Yersinia pestis
gugaaaccauuaacaauguua

SEQ ID NO: 2253098 - RNA, 15 nt, Yersinia pestis
aaauagcaagccaaa

SEQ ID NO: 2253099 - RNA, 22 nt, Yersinia pestis
aaauagccaaccagauuaaaua

SEQ ID NO: 2253100 - RNA, 15 nt, Yersinia pestis
gugaaccagauaaca

SEQ ID NO: 2253101 - RNA, 14 nt, Yersinia pestis
gugaacaugaugaa

SEQ ID NO: 2253102 - RNA, 14 nt, Yersinia pestis
gugaaaucaucaca

SEQ ID NO: 2253103 - RNA, 16 nt, Yersinia pestis
gugaaaucgguagaca

SEQ ID NO: 2253104 - RNA, 20 nt, Yersinia pestis
gugaguuaacgaguguacag

SEQ ID NO: 2253105 - RNA, 13 nt, Yersinia pestis
gugagugagcgcg

SEQ ID NO: 2253106 - RNA, 22 nt, Yersinia pestis
gugaguaucuucauccgcucca

SEQ ID NO: 2253107 - RNA, 23 nt, Yersinia pestis
gugacuauucugccuauccucac

SEQ ID NO: 2253108 - RNA, 15 nt, Yersinia pestis
gugacuaaaacaagc

SEQ ID NO: 2253109 - RNA, 12 nt, Yersinia pestis
gugagcgucauu

SEQ ID NO: 2253110 - RNA, 15 nt, Yersinia pestis
gugauuucagccagg

SEQ ID NO: 2253111 - RNA, 12 nt, Yersinia pestis
gugauuccagcu

SEQ ID NO: 2253112 - RNA, 21 nt, Yersinia pestis
gugaucauauuaggcagguga

SEQ ID NO: 2253113 - RNA, 13 nt, Yersinia pestis
gugcaaugcagau

SEQ ID NO: 2253114 - RNA, 18 nt, Yersinia pestis
gugcacggcagugaucaa

SEQ ID NO: 2253115 - RNA, 15 nt, Yersinia pestis
aaauaguaauaauua

SEQ ID NO: 2253116 - RNA, 19 nt, Yersinia pestis
aaauaguaauaauuaaucu

SEQ ID NO: 2253117 - RNA, 15 nt, Yersinia pestis
aaauaggcuaauuua

SEQ ID NO: 2253118 - RNA, 22 nt, Yersinia pestis
aaauagucagugggcuauuuau

SEQ ID NO: 2253119 - RNA, 20 nt, Yersinia pestis
aaauaggugcgccaguggca

SEQ ID NO: 2253120 - RNA, 16 nt, Yersinia pestis
aaauagguauaaaacu

SEQ ID NO: 2253121 - RNA, 13 nt, Yersinia pestis
gugacauuuucac

SEQ ID NO: 2253122 - RNA, 21 nt, Yersinia pestis
gugaccaaagcaguaaacauu

SEQ ID NO: 2253123 - RNA, 23 nt, Yersinia pestis
gugacaguagaauaccucacugg

SEQ ID NO: 2253124 - RNA, 13 nt, Yersinia pestis
gugacaggcaaag

SEQ ID NO: 2253125 - RNA, 23 nt, Yersinia pestis
gugacgcuugaauauagcguuca

SEQ ID NO: 2253126 - RNA, 17 nt, Yersinia pestis
gugaccccguggcggcg

SEQ ID NO: 2253127 - RNA, 15 nt, Yersinia pestis
aaauagcccucccug

SEQ ID NO: 2253128 - RNA, 15 nt, Yersinia pestis
aaauagccuucccug

SEQ ID NO: 2253129 - RNA, 23 nt, Yersinia pestis
aaauagcggccaacauaaucaau

SEQ ID NO: 2253130 - RNA, 21 nt, Yersinia pestis
aaauagcggccaacauaauca

SEQ ID NO: 2253131 - RNA, 20 nt, Yersinia pestis
gugaagagcgauugacugaa

SEQ ID NO: 2253132 - RNA, 18 nt, Yersinia pestis
gugaagaacagcaguggg

SEQ ID NO: 2253133 - RNA, 22 nt, Yersinia pestis
gugaagauuuuugauaauuuca

SEQ ID NO: 2253134 - RNA, 19 nt, Yersinia pestis
gugaacguacuuugguugu

SEQ ID NO: 2253135 - RNA, 12 nt, Yersinia pestis
gugaagaacagc

SEQ ID NO: 2253136 - RNA, 14 nt, Yersinia pestis
gugaagaacagcag

SEQ ID NO: 2253137 - RNA, 18 nt, Yersinia pestis
gugaaggggggcggauca

SEQ ID NO: 2253138 - RNA, 11 nt, Yersinia pestis
gugaauaacgc

SEQ ID NO: 2253139 - RNA, 16 nt, Yersinia pestis
gugaauucacucagau

SEQ ID NO: 2253140 - RNA, 13 nt, Yersinia pestis
gugaauuagguaa

SEQ ID NO: 2253141 - RNA, 22 nt, Yersinia pestis
guuucuauccgaaaaauauucu

SEQ ID NO: 2253142 - RNA, 20 nt, Yersinia pestis
guuucucugccgccagauuu

SEQ ID NO: 2253143 - RNA, 15 nt, Yersinia pestis
aaaucaccgccggau

SEQ ID NO: 2253144 - RNA, 18 nt, Yersinia pestis
aaaucacccgcaagaaua

SEQ ID NO: 2253145 - RNA, 14 nt, Yersinia pestis
aaaucaccccccug

SEQ ID NO: 2253146 - RNA, 18 nt, Yersinia pestis
guuucgccuucccacaaa

SEQ ID NO: 2253147 - RNA, 20 nt, Yersinia pestis
guuucgcaucaggcuuauau

SEQ ID NO: 2253148 - RNA, 16 nt, Yersinia pestis
guuucguuaaauauga

SEQ ID NO: 2253149 - RNA, 14 nt, Yersinia pestis
aaaucaaagugaga

SEQ ID NO: 2253150 - RNA, 17 nt, Yersinia pestis
guuuccucuucaucuac

SEQ ID NO: 2253151 - RNA, 23 nt, Yersinia pestis
guuucccuucgcgcaguaaacca

SEQ ID NO: 2253152 - RNA, 17 nt, Yersinia pestis
guuuccaguacugacca

SEQ ID NO: 2253153 - RNA, 14 nt, Yersinia pestis
guuuugacuaaaau

SEQ ID NO: 2253154 - RNA, 18 nt, Yersinia pestis
guuuugcuaacugugcca

SEQ ID NO: 2253155 - RNA, 21 nt, Yersinia pestis
guuuugcaaugcuuauuucac

SEQ ID NO: 2253156 - RNA, 18 nt, Yersinia pestis
guuuugcagaucaaucgc

SEQ ID NO: 2253157 - RNA, 17 nt, Yersinia pestis
aaaucagaggcuucauu

SEQ ID NO: 2253158 - RNA, 15 nt, Yersinia pestis
aaaucauagccagcg

SEQ ID NO: 2253159 - RNA, 18 nt, Yersinia pestis
aaauccaagccaccacca

SEQ ID NO: 2253160 - RNA, 22 nt, Yersinia pestis
aaauccagaucacggaaguaag

SEQ ID NO: 2253161 - RNA, 14 nt, Yersinia pestis
aaauccacuacucg

SEQ ID NO: 2253162 - RNA, 14 nt, Yersinia pestis
guuucuucuggaau

SEQ ID NO: 2253163 - RNA, 14 nt, Yersinia pestis
guuugacggcggcg

SEQ ID NO: 2253164 - RNA, 12 nt, Yersinia pestis
guuugacgcugu

SEQ ID NO: 2253165 - RNA, 18 nt, Yersinia pestis
guuuguaucgaugaucaa

SEQ ID NO: 2253166 - RNA, 16 nt, Yersinia pestis
guuugcugggcugacc

SEQ ID NO: 2253167 - RNA, 16 nt, Yersinia pestis
guuugcgccguaaacu

SEQ ID NO: 2253168 - RNA, 16 nt, Yersinia pestis
aaauaugcugaccacu

SEQ ID NO: 2253169 - RNA, 15 nt, Yersinia pestis
guuucagacuccugc

SEQ ID NO: 2253170 - RNA, 12 nt, Yersinia pestis
guuucagggugg

SEQ ID NO: 2253171 - RNA, 16 nt, Yersinia pestis
guuucaguaagauacu

SEQ ID NO: 2253172 - RNA, 13 nt, Yersinia pestis
guuucacccucug

SEQ ID NO: 2253173 - RNA, 18 nt, Yersinia pestis
guuucaguggcuucucuu

SEQ ID NO: 2253174 - RNA, 21 nt, Yersinia pestis
aaauauucuaaguaaaacaaa

SEQ ID NO: 2253175 - RNA, 22 nt, Yersinia pestis
aaauauucucaauauuaauaau

SEQ ID NO: 2253176 - RNA, 18 nt, Yersinia pestis
guuucauuugcuguggcg

SEQ ID NO: 2253177 - RNA, 21 nt, Yersinia pestis
guuuccaaaacucauguccag

SEQ ID NO: 2253178 - RNA, 16 nt, Yersinia pestis
aaauauggguuaaaaa

SEQ ID NO: 2253179 - RNA, 19 nt, Yersinia pestis
aaauauucgucucaucaau

SEQ ID NO: 2253180 - RNA, 22 nt, Yersinia pestis
aaauauucauuaaaaaauaauu

SEQ ID NO: 2253181 - RNA, 18 nt, Yersinia pestis
aaauauucauuaaaaaau

SEQ ID NO: 2253182 - RNA, 14 nt, Yersinia pestis
aaauauuaauccau

SEQ ID NO: 2253183 - RNA, 14 nt, Yersinia pestis
guuuaaugccccuu

SEQ ID NO: 2253184 - RNA, 14 nt, Yersinia pestis
guuuacucgcuccg

SEQ ID NO: 2253185 - RNA, 12 nt, Yersinia pestis
guuuacugcuua

SEQ ID NO: 2253186 - RNA, 20 nt, Yersinia pestis
guuuacuggcgggcauuuuc

SEQ ID NO: 2253187 - RNA, 15 nt, Yersinia pestis
guuuaacuaggcgag

SEQ ID NO: 2253188 - RNA, 14 nt, Yersinia pestis
guuuaacucaaaua

SEQ ID NO: 2253189 - RNA, 16 nt, Yersinia pestis
guuuaacucaaauaaa

SEQ ID NO: 2253190 - RNA, 18 nt, Yersinia pestis
guuuaucucgcugugccc

SEQ ID NO: 2253191 - RNA, 19 nt, Yersinia pestis
guuuaucccauuaaugagu

SEQ ID NO: 2253192 - RNA, 21 nt, Yersinia pestis
guuuauccuuuuuauuuaagc

SEQ ID NO: 2253193 - RNA, 17 nt, Yersinia pestis
guuuaucacccgccauc

SEQ ID NO: 2253194 - RNA, 15 nt, Yersinia pestis
guuuaucaaacagca

SEQ ID NO: 2253195 - RNA, 22 nt, Yersinia pestis
guuuaucaaacagcacaucgcc

SEQ ID NO: 2253196 - RNA, 16 nt, Yersinia pestis
guuucaaauaguagau

SEQ ID NO: 2253197 - RNA, 18 nt, Yersinia pestis
guuucaacauccaguucg

SEQ ID NO: 2253198 - RNA, 17 nt, Yersinia pestis
guuucaacaucgcaccg

SEQ ID NO: 2253199 - RNA, 13 nt, Yersinia pestis
guugcacccugcu

SEQ ID NO: 2253200 - RNA, 15 nt, Yersinia pestis
guugcacccugcuug

SEQ ID NO: 2253201 - RNA, 19 nt, Yersinia pestis
guugcacugacggcagaca

SEQ ID NO: 2253202 - RNA, 23 nt, Yersinia pestis
guugcacgugaggauucaagaac

SEQ ID NO: 2253203 - RNA, 18 nt, Yersinia pestis
guugccgccuuccuacaa

SEQ ID NO: 2253204 - RNA, 19 nt, Yersinia pestis
guugccugugcgcuggucg

SEQ ID NO: 2253205 - RNA, 19 nt, Yersinia pestis
guugaggagaucgauaaag

SEQ ID NO: 2253206 - RNA, 20 nt, Yersinia pestis
guugaguaauuuucgcccua

SEQ ID NO: 2253207 - RNA, 14 nt, Yersinia pestis
guugaguauacuaa

SEQ ID NO: 2253208 - RNA, 15 nt, Yersinia pestis
guucuaucucaucuu

SEQ ID NO: 2253209 - RNA, 18 nt, Yersinia pestis
guucuauauagacuuuua

SEQ ID NO: 2253210 - RNA, 18 nt, Yersinia pestis
guucucaaccaaauagcg

SEQ ID NO: 2253211 - RNA, 18 nt, Yersinia pestis
guugcuauuuccccgccg

SEQ ID NO: 2253212 - RNA, 19 nt, Yersinia pestis
guugcucccguagcaaaua

SEQ ID NO: 2253213 - RNA, 19 nt, Yersinia pestis
guugcuggagcauugcgcu

SEQ ID NO: 2253214 - RNA, 17 nt, Yersinia pestis
guuggucaccacuugca

SEQ ID NO: 2253215 - RNA, 13 nt, Yersinia pestis
guuggucagcacu

SEQ ID NO: 2253216 - RNA, 17 nt, Yersinia pestis
guuggucagcacuucca

SEQ ID NO: 2253217 - RNA, 15 nt, Yersinia pestis
guuggugacgcuggg

SEQ ID NO: 2253218 - RNA, 18 nt, Yersinia pestis
guuggcuaaauaaccaga

SEQ ID NO: 2253219 - RNA, 13 nt, Yersinia pestis
guuguaugucaau

SEQ ID NO: 2253220 - RNA, 19 nt, Yersinia pestis
guuggcguuucguaaugac

SEQ ID NO: 2253221 - RNA, 14 nt, Yersinia pestis
guuaacuuuuucua

SEQ ID NO: 2253222 - RNA, 13 nt, Yersinia pestis
guuaacuuuuucu

SEQ ID NO: 2253223 - RNA, 21 nt, Yersinia pestis
guuaacuggcuccgcacggcu

SEQ ID NO: 2253224 - RNA, 12 nt, Yersinia pestis
guuaacccaaag

SEQ ID NO: 2253225 - RNA, 14 nt, Yersinia pestis
guuaacccaaagcc

SEQ ID NO: 2253226 - RNA, 21 nt, Yersinia pestis
guuaauuuaauuuaugauuaa

SEQ ID NO: 2253227 - RNA, 15 nt, Yersinia pestis
guuaauugaauugcc

SEQ ID NO: 2253228 - RNA, 14 nt, Yersinia pestis
guuaauuuaaacag

SEQ ID NO: 2253229 - RNA, 22 nt, Yersinia pestis
guuaaaaaauucaucuuuaaca

SEQ ID NO: 2253230 - RNA, 16 nt, Yersinia pestis
guguuggaguaucaga

SEQ ID NO: 2253231 - RNA, 14 nt, Yersinia pestis
guguuuuucaucug

SEQ ID NO: 2253232 - RNA, 15 nt, Yersinia pestis
guuaaaaaauucauc

SEQ ID NO: 2253233 - RNA, 17 nt, Yersinia pestis
guuaaaaacugugccug

SEQ ID NO: 2253234 - RNA, 13 nt, Yersinia pestis
guguugaaugacg

SEQ ID NO: 2253235 - RNA, 22 nt, Yersinia pestis
guguugacucaccggcugccug

SEQ ID NO: 2253236 - RNA, 15 nt, Yersinia pestis
guuaucacagcaaau

SEQ ID NO: 2253237 - RNA, 21 nt, Yersinia pestis
guuaucacauaaauaaguuca

SEQ ID NO: 2253238 - RNA, 17 nt, Yersinia pestis
guuaucaauaaguucgu

SEQ ID NO: 2253239 - RNA, 14 nt, Yersinia pestis
guuaucuuugacuc

SEQ ID NO: 2253240 - RNA, 15 nt, Yersinia pestis
guuaugccaaccgga

SEQ ID NO: 2253241 - RNA, 17 nt, Yersinia pestis
guuauaggccuaaaccc

SEQ ID NO: 2253242 - RNA, 22 nt, Yersinia pestis
guuaguaacuguaaggccaaac

SEQ ID NO: 2253243 - RNA, 16 nt, Yersinia pestis
guuaccuaaccaaaca

SEQ ID NO: 2253244 - RNA, 17 nt, Yersinia pestis
guuagggcgcggcuggu

SEQ ID NO: 2253245 - RNA, 19 nt, Yersinia pestis
guuacuguaagauaauucg

SEQ ID NO: 2253246 - RNA, 20 nt, Yersinia pestis
guuacugcgcaaauccugaa

SEQ ID NO: 2253247 - RNA, 15 nt, Yersinia pestis
guuacuguaagauaa

SEQ ID NO: 2253248 - RNA, 18 nt, Yersinia pestis
guuacuuccauaaacgga

SEQ ID NO: 2253249 - RNA, 16 nt, Yersinia pestis
guuccuucagccacca

SEQ ID NO: 2253250 - RNA, 19 nt, Yersinia pestis
guuccuucagccaccagau

SEQ ID NO: 2253251 - RNA, 15 nt, Yersinia pestis
guuccuguuuuugaa

SEQ ID NO: 2253252 - RNA, 13 nt, Yersinia pestis
guucgguaaauaa

SEQ ID NO: 2253253 - RNA, 15 nt, Yersinia pestis
guuauuucuguucca

SEQ ID NO: 2253254 - RNA, 22 nt, Yersinia pestis
guuauuucugaccguuguaugu

SEQ ID NO: 2253255 - RNA, 19 nt, Yersinia pestis
guuauuugccguauucagc

SEQ ID NO: 2253256 - RNA, 16 nt, Yersinia pestis
guucaccagcuugggu

SEQ ID NO: 2253257 - RNA, 15 nt, Yersinia pestis
guucaccgcaucgcc

SEQ ID NO: 2253258 - RNA, 16 nt, Yersinia pestis
guucaccaaagcaaug

SEQ ID NO: 2253259 - RNA, 13 nt, Yersinia pestis
guuauuuucuaua

SEQ ID NO: 2253260 - RNA, 14 nt, Yersinia pestis
guucaccccagcaa

SEQ ID NO: 2253261 - RNA, 20 nt, Yersinia pestis
guucacgauggaaaaaauac

SEQ ID NO: 2253262 - RNA, 17 nt, Yersinia pestis
guucagcauaaauauuc

SEQ ID NO: 2253263 - RNA, 22 nt, Yersinia pestis
guuccacaauguugauacucca

SEQ ID NO: 2253264 - RNA, 15 nt, Yersinia pestis
aaauaucacgacuuu

SEQ ID NO: 2253265 - RNA, 17 nt, Yersinia pestis
aaauaucacgacuuuaa

SEQ ID NO: 2253266 - RNA, 22 nt, Yersinia pestis
aaauaucacuauaauuauuucu

SEQ ID NO: 2253267 - RNA, 18 nt, Yersinia pestis
aaauaucauuauuuugaa

SEQ ID NO: 2253268 - RNA, 18 nt, Yersinia pestis
aaauaucauuaacaaacu

SEQ ID NO: 2253269 - RNA, 18 nt, Yersinia pestis
aaauauccccugcaagug

SEQ ID NO: 2253270 - RNA, 21 nt, Yersinia pestis
aaauauccuccggcauagccg

SEQ ID NO: 2253271 - RNA, 10 nt, Yersinia pestis
aaauauccug

SEQ ID NO: 2253272 - RNA, 15 nt, Yersinia pestis
gugugacuuucaauc

SEQ ID NO: 2253273 - RNA, 17 nt, Yersinia pestis
gugugcagcaagaacaa

SEQ ID NO: 2253274 - RNA, 15 nt, Yersinia pestis
gugugcguacaggua

SEQ ID NO: 2253275 - RNA, 16 nt, Yersinia pestis
gugugcucacaaucuu

SEQ ID NO: 2253276 - RNA, 18 nt, Yersinia pestis
guguggcaccaugcugcu

SEQ ID NO: 2253277 - RNA, 13 nt, Yersinia pestis
gugugcugggugu

SEQ ID NO: 2253278 - RNA, 11 nt, Yersinia pestis
guguuagcauc

SEQ ID NO: 2253279 - RNA, 21 nt, Yersinia pestis
guguuauuuuucucuuucagc

SEQ ID NO: 2253280 - RNA, 15 nt, Yersinia pestis
guguucgguaaauaa

SEQ ID NO: 2253281 - RNA, 18 nt, Yersinia pestis
guguuaaccgccccaaca

SEQ ID NO: 2253282 - RNA, 19 nt, Yersinia pestis
guguguggcaauaaaggca

SEQ ID NO: 2253283 - RNA, 14 nt, Yersinia pestis
guguguaauuuuua

SEQ ID NO: 2253284 - RNA, 19 nt, Yersinia pestis
gugucuggcaauccagcgc

SEQ ID NO: 2253285 - RNA, 18 nt, Yersinia pestis
gugucaugcgcagaaaac

SEQ ID NO: 2253286 - RNA, 18 nt, Yersinia pestis
gugucauuugcgcaauac

SEQ ID NO: 2253287 - RNA, 18 nt, Yersinia pestis
gugucagaccaaauagca

SEQ ID NO: 2253288 - RNA, 17 nt, Yersinia pestis
gugucaggaugaugaau

SEQ ID NO: 2253289 - RNA, 19 nt, Yersinia pestis
gugucagggcaauaacaaa

SEQ ID NO: 2253290 - RNA, 18 nt, Yersinia pestis
gugucacaguaaaucagg

SEQ ID NO: 2253291 - RNA, 12 nt, Yersinia pestis
gugguguuaucc

SEQ ID NO: 2253292 - RNA, 15 nt, Yersinia pestis
guguacucauauugu

SEQ ID NO: 2253293 - RNA, 19 nt, Yersinia pestis
guguacucucccuuuucca

SEQ ID NO: 2253294 - RNA, 18 nt, Yersinia pestis
gugguuuccuggaacgaa

SEQ ID NO: 2253295 - RNA, 15 nt, Yersinia pestis
gugguucaaccaccg

SEQ ID NO: 2253296 - RNA, 17 nt, Yersinia pestis
gugguguuggcuguggu

SEQ ID NO: 2253297 - RNA, 21 nt, Yersinia pestis
gugguucuggcccuaaauggg

SEQ ID NO: 2253298 - RNA, 22 nt, Yersinia pestis
aaauauaagauuccuuaccuga

SEQ ID NO: 2253299 - RNA, 13 nt, Yersinia pestis
aaauauaaaauaa

SEQ ID NO: 2253300 - RNA, 15 nt, Yersinia pestis
aaauauaauuucaaa

SEQ ID NO: 2253301 - RNA, 20 nt, Yersinia pestis
aaauauaauuucaaaguaaa

SEQ ID NO: 2253302 - RNA, 22 nt, Yersinia pestis
aaauauaauuucaaaguaaaau

SEQ ID NO: 2253303 - RNA, 12 nt, Yersinia pestis
gugcuguauuua

SEQ ID NO: 2253304 - RNA, 20 nt, Yersinia pestis
gugcuguuggugauauaaau

SEQ ID NO: 2253305 - RNA, 18 nt, Yersinia pestis
gugcuguuccaaccaacc

SEQ ID NO: 2253306 - RNA, 13 nt, Yersinia pestis
guggauccagcac

SEQ ID NO: 2253307 - RNA, 14 nt, Yersinia pestis
guggauugccaaau

SEQ ID NO: 2253308 - RNA, 12 nt, Yersinia pestis
guggcacaaggc

SEQ ID NO: 2253309 - RNA, 22 nt, Yersinia pestis
guggcuaauaaugcaccaauca

SEQ ID NO: 2253310 - RNA, 22 nt, Yersinia pestis
guggcucaauccaaaugacacu

SEQ ID NO: 2253311 - RNA, 14 nt, Yersinia pestis
guggcuaucugaaa

SEQ ID NO: 2253312 - RNA, 22 nt, Yersinia pestis
gugggaaugcccuuuugugcau

SEQ ID NO: 2253313 - RNA, 18 nt, Yersinia pestis
guggcguucccgcaggcg

SEQ ID NO: 2253314 - RNA, 14 nt, Yersinia pestis
guggcagagaacau

SEQ ID NO: 2253315 - RNA, 23 nt, Yersinia pestis
guggcagauuggcuugcuugaug

SEQ ID NO: 2253316 - RNA, 19 nt, Yersinia pestis
guggcagccugcggcggcu

SEQ ID NO: 2253317 - RNA, 21 nt, Yersinia pestis
guggccaguaacgcuucauca

SEQ ID NO: 2253318 - RNA, 23 nt, Yersinia pestis
guggccugguugcccugaagcaa

SEQ ID NO: 2253319 - RNA, 17 nt, Yersinia pestis
ucaggcauaucacuauu

SEQ ID NO: 2253320 - RNA, 14 nt, Yersinia pestis
ucaggccaccaauc

SEQ ID NO: 2253321 - RNA, 21 nt, Yersinia pestis
aaaucuacuuuauucaauacu

SEQ ID NO: 2253322 - RNA, 16 nt, Yersinia pestis
aaaucuagcccuucag

SEQ ID NO: 2253323 - RNA, 20 nt, Yersinia pestis
ucaggccgguauucagccaa

SEQ ID NO: 2253324 - RNA, 13 nt, Yersinia pestis
ucaggcccugaga

SEQ ID NO: 2253325 - RNA, 13 nt, Yersinia pestis
ucaguauaaauug

SEQ ID NO: 2253326 - RNA, 18 nt, Yersinia pestis
ucaguaguggcuccacua

SEQ ID NO: 2253327 - RNA, 18 nt, Yersinia pestis
ucaguagucaauacaauu

SEQ ID NO: 2253328 - RNA, 23 nt, Yersinia pestis
ucaguggugguagauacaauuca

SEQ ID NO: 2253329 - RNA, 16 nt, Yersinia pestis
ucagugucaguucgac

SEQ ID NO: 2253330 - RNA, 21 nt, Yersinia pestis
ucagugucaguucgacaccuu

SEQ ID NO: 2253331 - RNA, 22 nt, Yersinia pestis
ucagugugugugcgcugaguga

SEQ ID NO: 2253332 - RNA, 18 nt, Yersinia pestis
ucagugauuuuaaccacu

SEQ ID NO: 2253333 - RNA, 21 nt, Yersinia pestis
ucaggugaacgcacaaguaca

SEQ ID NO: 2253334 - RNA, 18 nt, Yersinia pestis
ucaggcuguugacauaaa

SEQ ID NO: 2253335 - RNA, 19 nt, Yersinia pestis
ucaggcucaucaccuucca

SEQ ID NO: 2253336 - RNA, 13 nt, Yersinia pestis
ucaggcucaucac

SEQ ID NO: 2253337 - RNA, 22 nt, Yersinia pestis
ucagcagucugagccucaugaa

SEQ ID NO: 2253338 - RNA, 20 nt, Yersinia pestis
ucagcagucugauuaccuuc

SEQ ID NO: 2253339 - RNA, 19 nt, Yersinia pestis
ucagcagucugaggcccgc

SEQ ID NO: 2253340 - RNA, 14 nt, Yersinia pestis
ucagcaucuucaau

SEQ ID NO: 2253341 - RNA, 14 nt, Yersinia pestis
ucagcaucccagcc

SEQ ID NO: 2253342 - RNA, 15 nt, Yersinia pestis
ucagcauauuaccca

SEQ ID NO: 2253343 - RNA, 14 nt, Yersinia pestis
ucagcauggaagau

SEQ ID NO: 2253344 - RNA, 18 nt, Yersinia pestis
ucagcauugauggccuug

SEQ ID NO: 2253345 - RNA, 13 nt, Yersinia pestis
ucagcauuaauac

SEQ ID NO: 2253346 - RNA, 21 nt, Yersinia pestis
ucagcagacgaaccgcuuuga

SEQ ID NO: 2253347 - RNA, 17 nt, Yersinia pestis
ucagcagacucaagcau

SEQ ID NO: 2253348 - RNA, 20 nt, Yersinia pestis
ucagcagagucgcaaaaaau

SEQ ID NO: 2253349 - RNA, 17 nt, Yersinia pestis
ucagcaagcugcucaau

SEQ ID NO: 2253350 - RNA, 21 nt, Yersinia pestis
ucagcaagcugcucaaugcgu

SEQ ID NO: 2253351 - RNA, 18 nt, Yersinia pestis
ucagcaagguucucgcug

SEQ ID NO: 2253352 - RNA, 17 nt, Yersinia pestis
ucagcccaucuuugauu

SEQ ID NO: 2253353 - RNA, 15 nt, Yersinia pestis
ucagcccauggcuga

SEQ ID NO: 2253354 - RNA, 18 nt, Yersinia pestis
ucagccacaaaaguucac

SEQ ID NO: 2253355 - RNA, 17 nt, Yersinia pestis
ucagcccuaccaguucu

SEQ ID NO: 2253356 - RNA, 14 nt, Yersinia pestis
ucagcgucagcaga

SEQ ID NO: 2253357 - RNA, 15 nt, Yersinia pestis
ucagcguauugugau

SEQ ID NO: 2253358 - RNA, 20 nt, Yersinia pestis
ucagcucauuaaacuguucu

SEQ ID NO: 2253359 - RNA, 22 nt, Yersinia pestis
ucagcgugacguuaucucaacc

SEQ ID NO: 2253360 - RNA, 14 nt, Yersinia pestis
ucagcgcuuggcuc

SEQ ID NO: 2253361 - RNA, 23 nt, Yersinia pestis
ucagcgcuuuuucgggaaaaaau

SEQ ID NO: 2253362 - RNA, 14 nt, Yersinia pestis
ucagcgcuggcuuu

SEQ ID NO: 2253363 - RNA, 14 nt, Yersinia pestis
aaaucuaaguucag

SEQ ID NO: 2253364 - RNA, 16 nt, Yersinia pestis
aaaucguauaacauaa

SEQ ID NO: 2253365 - RNA, 22 nt, Yersinia pestis
ucagauuguuuauaaauuaaaa

SEQ ID NO: 2253366 - RNA, 20 nt, Yersinia pestis
ucagauuuagcgauauaacu

SEQ ID NO: 2253367 - RNA, 20 nt, Yersinia pestis
ucagcaacuugguaccaguc

SEQ ID NO: 2253368 - RNA, 23 nt, Yersinia pestis
ucagcaaaucuugugaugcauau

SEQ ID NO: 2253369 - RNA, 14 nt, Yersinia pestis
ucagcaaaucaaac

SEQ ID NO: 2253370 - RNA, 16 nt, Yersinia pestis
ucagauacggcuccag

SEQ ID NO: 2253371 - RNA, 18 nt, Yersinia pestis
ucagauacggcuccagaa

SEQ ID NO: 2253372 - RNA, 13 nt, Yersinia pestis
ucagauaagaucu

SEQ ID NO: 2253373 - RNA, 21 nt, Yersinia pestis
ucagauaaaaauaaucaauga

SEQ ID NO: 2253374 - RNA, 20 nt, Yersinia pestis
ucagauaaauucaacuucuc

SEQ ID NO: 2253375 - RNA, 13 nt, Yersinia pestis
ucagauaucugcu

SEQ ID NO: 2253376 - RNA, 14 nt, Yersinia pestis
ucagaucaacagau

SEQ ID NO: 2253377 - RNA, 18 nt, Yersinia pestis
ucagauaucugcucauua

SEQ ID NO: 2253378 - RNA, 21 nt, Yersinia pestis
ucagauaucugcucauuacca

SEQ ID NO: 2253379 - RNA, 19 nt, Yersinia pestis
ucagauuagucuuagacgu

SEQ ID NO: 2253380 - RNA, 21 nt, Yersinia pestis
ucagauuagucuuagacguca

SEQ ID NO: 2253381 - RNA, 21 nt, Yersinia pestis
ucagauuguuuauaaauuaaa

SEQ ID NO: 2253382 - RNA, 16 nt, Yersinia pestis
ucagaugaaaaacugu

SEQ ID NO: 2253383 - RNA, 16 nt, Yersinia pestis
ucagaugcugacgggc

SEQ ID NO: 2253384 - RNA, 14 nt, Yersinia pestis
ucagacagccauca

SEQ ID NO: 2253385 - RNA, 21 nt, Yersinia pestis
ucagaccaaauagcaagccaa

SEQ ID NO: 2253386 - RNA, 13 nt, Yersinia pestis
ucagacauuuuuc

SEQ ID NO: 2253387 - RNA, 20 nt, Yersinia pestis
ucagagauucagaggaaaga

SEQ ID NO: 2253388 - RNA, 23 nt, Yersinia pestis
ucagaggaaagagagccauaauu

SEQ ID NO: 2253389 - RNA, 12 nt, Yersinia pestis
ucagagcagcau

SEQ ID NO: 2253390 - RNA, 23 nt, Yersinia pestis
ucagagucugucauggcacgcuu

SEQ ID NO: 2253391 - RNA, 20 nt, Yersinia pestis
ucagacgacgugcagcgcgc

SEQ ID NO: 2253392 - RNA, 22 nt, Yersinia pestis
ucagacgagucuauugaaaaaa

SEQ ID NO: 2253393 - RNA, 19 nt, Yersinia pestis
ucagacuaccaaaauuuaa

SEQ ID NO: 2253394 - RNA, 17 nt, Yersinia pestis
ucagacugaaaguagaa

SEQ ID NO: 2253395 - RNA, 19 nt, Yersinia pestis
ucagacugcucuuucccuu

SEQ ID NO: 2253396 - RNA, 15 nt, Yersinia pestis
ucagacugcugacaa

SEQ ID NO: 2253397 - RNA, 13 nt, Yersinia pestis
ucacuagcgggcc

SEQ ID NO: 2253398 - RNA, 18 nt, Yersinia pestis
ucacuagcgggccuuuua

SEQ ID NO: 2253399 - RNA, 21 nt, Yersinia pestis
ucacuagcgggccuuuuaccu

SEQ ID NO: 2253400 - RNA, 15 nt, Yersinia pestis
ucacguuuuuccauu

SEQ ID NO: 2253401 - RNA, 17 nt, Yersinia pestis
ucacguuuaccggcaac

SEQ ID NO: 2253402 - RNA, 16 nt, Yersinia pestis
ucacguuuagcccacu

SEQ ID NO: 2253403 - RNA, 18 nt, Yersinia pestis
ucacuauaauuauuucuc

SEQ ID NO: 2253404 - RNA, 20 nt, Yersinia pestis
ucacuauaauuauuucucug

SEQ ID NO: 2253405 - RNA, 13 nt, Yersinia pestis
ucacuauaauuau

SEQ ID NO: 2253406 - RNA, 22 nt, Yersinia pestis
ucacgucuucaccaaugauuaa

SEQ ID NO: 2253407 - RNA, 20 nt, Yersinia pestis
ucacguucauccgcagcaaa

SEQ ID NO: 2253408 - RNA, 23 nt, Yersinia pestis
ucacguauuuucauuuuaacaac

SEQ ID NO: 2253409 - RNA, 21 nt, Yersinia pestis
ucacccuuuaaaucuagcccu

SEQ ID NO: 2253410 - RNA, 12 nt, Yersinia pestis
ucacccucuuuc

SEQ ID NO: 2253411 - RNA, 20 nt, Yersinia pestis
ucacccgucaggaugcggau

SEQ ID NO: 2253412 - RNA, 19 nt, Yersinia pestis
ucacugcuauuuaccccca

SEQ ID NO: 2253413 - RNA, 19 nt, Yersinia pestis
ucacugcuuuaucaccagu

SEQ ID NO: 2253414 - RNA, 18 nt, Yersinia pestis
ucacuucaauguuuuuau

SEQ ID NO: 2253415 - RNA, 21 nt, Yersinia pestis
ucacugucaaaaagcaccuuu

SEQ ID NO: 2253416 - RNA, 16 nt, Yersinia pestis
ucacuggccgcaggcg

SEQ ID NO: 2253417 - RNA, 14 nt, Yersinia pestis
ucacuggcuuuauu

SEQ ID NO: 2253418 - RNA, 14 nt, Yersinia pestis
ucacuggcaccauu

SEQ ID NO: 2253419 - RNA, 14 nt, Yersinia pestis
ucacuucugcugcc

SEQ ID NO: 2253420 - RNA, 21 nt, Yersinia pestis
ucacuucugcuguucagauga

SEQ ID NO: 2253421 - RNA, 15 nt, Yersinia pestis
ucacuucgcggacgc

SEQ ID NO: 2253422 - RNA, 11 nt, Yersinia pestis
ucagaaaacag

SEQ ID NO: 2253423 - RNA, 20 nt, Yersinia pestis
ucagaaaacagccaccagcc

SEQ ID NO: 2253424 - RNA, 17 nt, Yersinia pestis
ucagaaaacccccugcu

SEQ ID NO: 2253425 - RNA, 14 nt, Yersinia pestis
ucagaaacaucuuc

SEQ ID NO: 2253426 - RNA, 23 nt, Yersinia pestis
ucagaaccuguuacaucagagcu

SEQ ID NO: 2253427 - RNA, 21 nt, Yersinia pestis
ucagaaaggacaguaauauuu

SEQ ID NO: 2253428 - RNA, 20 nt, Yersinia pestis
ucagaaauaaauucaucuca

SEQ ID NO: 2253429 - RNA, 16 nt, Yersinia pestis
ucagaaacaucuucau

SEQ ID NO: 2253430 - RNA, 13 nt, Yersinia pestis
ucaaacuauucau

SEQ ID NO: 2253431 - RNA, 21 nt, Yersinia pestis
ucaaaccaucgcucuccugcc

SEQ ID NO: 2253432 - RNA, 17 nt, Yersinia pestis
ucaaacucagcgaauaa

SEQ ID NO: 2253433 - RNA, 19 nt, Yersinia pestis
ucaaacucagcgaauaaau

SEQ ID NO: 2253434 - RNA, 18 nt, Yersinia pestis
ucaaacuccccuggcagg

SEQ ID NO: 2253435 - RNA, 19 nt, Yersinia pestis
ucaaacucggccgggcuga

SEQ ID NO: 2253436 - RNA, 21 nt, Yersinia pestis
ucaaacucuucagccauaacu

SEQ ID NO: 2253437 - RNA, 13 nt, Yersinia pestis
ucaaacauagaca

SEQ ID NO: 2253438 - RNA, 15 nt, Yersinia pestis
ucaaacagguaaaac

SEQ ID NO: 2253439 - RNA, 23 nt, Yersinia pestis
ucaaacaaaucuuaaauugaaga

SEQ ID NO: 2253440 - RNA, 11 nt, Yersinia pestis
ucaaacaaaua

SEQ ID NO: 2253441 - RNA, 20 nt, Yersinia pestis
ucaaaagcagagaaugagua

SEQ ID NO: 2253442 - RNA, 16 nt, Yersinia pestis
ucaaaacugauuaaua

SEQ ID NO: 2253443 - RNA, 16 nt, Yersinia pestis
uauuuaauuuaaauaa

SEQ ID NO: 2253444 - RNA, 17 nt, Yersinia pestis
uauuuacaaauaaccgc

SEQ ID NO: 2253445 - RNA, 13 nt, Yersinia pestis
ucaaaacuaauau

SEQ ID NO: 2253446 - RNA, 19 nt, Yersinia pestis
ucaaaacuccaucaaaauu

SEQ ID NO: 2253447 - RNA, 23 nt, Yersinia pestis
ucaaaauuccgcuucacauuuga

SEQ ID NO: 2253448 - RNA, 17 nt, Yersinia pestis
ucaaaaugccagucaau

SEQ ID NO: 2253449 - RNA, 23 nt, Yersinia pestis
ucaaaaggauggcccaagccauc

SEQ ID NO: 2253450 - RNA, 22 nt, Yersinia pestis
ucaaauuuaaaguuuuuuauuu

SEQ ID NO: 2253451 - RNA, 22 nt, Yersinia pestis
ucaaauugcacaugcagcauuu

SEQ ID NO: 2253452 - RNA, 15 nt, Yersinia pestis
ucaacaaacaguuca

SEQ ID NO: 2253453 - RNA, 14 nt, Yersinia pestis
ucaaaugauucagu

SEQ ID NO: 2253454 - RNA, 12 nt, Yersinia pestis
ucaaaugucccc

SEQ ID NO: 2253455 - RNA, 23 nt, Yersinia pestis
ucaaauagccugguugaucucaa

SEQ ID NO: 2253456 - RNA, 21 nt, Yersinia pestis
ucaaauagauagcaaucaaua

SEQ ID NO: 2253457 - RNA, 17 nt, Yersinia pestis
ucaaauaucauuauuuu

SEQ ID NO: 2253458 - RNA, 16 nt, Yersinia pestis
ucaaaucauacgcagc

SEQ ID NO: 2253459 - RNA, 16 nt, Yersinia pestis
ucaaaucaguuccuga

SEQ ID NO: 2253460 - RNA, 13 nt, Yersinia pestis
ucaaagauuucau

SEQ ID NO: 2253461 - RNA, 15 nt, Yersinia pestis
ucaacgcucaaucac

SEQ ID NO: 2253462 - RNA, 14 nt, Yersinia pestis
ucaacggcaccaca

SEQ ID NO: 2253463 - RNA, 13 nt, Yersinia pestis
ucaacuaauauua

SEQ ID NO: 2253464 - RNA, 18 nt, Yersinia pestis
ucaacuauugcaucuuua

SEQ ID NO: 2253465 - RNA, 21 nt, Yersinia pestis
ucaacuauugcaucuuuaauu

SEQ ID NO: 2253466 - RNA, 14 nt, Yersinia pestis
ucaacucaaaacaa

SEQ ID NO: 2253467 - RNA, 12 nt, Yersinia pestis
ucaacuucaacg

SEQ ID NO: 2253468 - RNA, 14 nt, Yersinia pestis
ucaacuucugcaaa

SEQ ID NO: 2253469 - RNA, 16 nt, Yersinia pestis
ucaacuuuaauaugca

SEQ ID NO: 2253470 - RNA, 21 nt, Yersinia pestis
ucaacuuuaauaugcaaaaaa

SEQ ID NO: 2253471 - RNA, 16 nt, Yersinia pestis
ucaacuuucucuggca

SEQ ID NO: 2253472 - RNA, 17 nt, Yersinia pestis
ucaaccccuucuucacc

SEQ ID NO: 2253473 - RNA, 21 nt, Yersinia pestis
ucaacccgcagacugaaauaa

SEQ ID NO: 2253474 - RNA, 13 nt, Yersinia pestis
ucaaccucagccu

SEQ ID NO: 2253475 - RNA, 17 nt, Yersinia pestis
ucaaccugaucaucaaa

SEQ ID NO: 2253476 - RNA, 17 nt, Yersinia pestis
ucaaccugccagccuga

SEQ ID NO: 2253477 - RNA, 14 nt, Yersinia pestis
ucaacgacggauga

SEQ ID NO: 2253478 - RNA, 13 nt, Yersinia pestis
ucaaccuuuuccg

SEQ ID NO: 2253479 - RNA, 19 nt, Yersinia pestis
ucaacgcaccccacaaccu

SEQ ID NO: 2253480 - RNA, 19 nt, Yersinia pestis
ucaacauacugauacaaca

SEQ ID NO: 2253481 - RNA, 15 nt, Yersinia pestis
ucaaccaagacauaa

SEQ ID NO: 2253482 - RNA, 20 nt, Yersinia pestis
ucaaccacgaagagcgccuc

SEQ ID NO: 2253483 - RNA, 15 nt, Yersinia pestis
ucaacauuccauacc

SEQ ID NO: 2253484 - RNA, 23 nt, Yersinia pestis
ucaacagauaugcauuauugaug

SEQ ID NO: 2253485 - RNA, 16 nt, Yersinia pestis
ucaacagcaucaucaa

SEQ ID NO: 2253486 - RNA, 18 nt, Yersinia pestis
ucaacacggugaauaaac

SEQ ID NO: 2253487 - RNA, 14 nt, Yersinia pestis
ucaacacauaaaau

SEQ ID NO: 2253488 - RNA, 18 nt, Yersinia pestis
ucaacaaauucaccagca

SEQ ID NO: 2253489 - RNA, 16 nt, Yersinia pestis
ucaacaaucaaucacc

SEQ ID NO: 2253490 - RNA, 16 nt, Yersinia pestis
ucaauugauccugugc

SEQ ID NO: 2253491 - RNA, 22 nt, Yersinia pestis
ucaauuggacuaaccccaauau

SEQ ID NO: 2253492 - RNA, 19 nt, Yersinia pestis
ucaaugugcggaaauaaac

SEQ ID NO: 2253493 - RNA, 22 nt, Yersinia pestis
ucaaugugcggaaauaaacauc

SEQ ID NO: 2253494 - RNA, 22 nt, Yersinia pestis
ucaauguaagcaucuuuucaug

SEQ ID NO: 2253495 - RNA, 14 nt, Yersinia pestis
ucaaucauuuuuuu

SEQ ID NO: 2253496 - RNA, 17 nt, Yersinia pestis
ucaauccaaaugacacu

SEQ ID NO: 2253497 - RNA, 16 nt, Yersinia pestis
ucaauccaaucauucu

SEQ ID NO: 2253498 - RNA, 15 nt, Yersinia pestis
ucaaucacuggcaau

SEQ ID NO: 2253499 - RNA, 19 nt, Yersinia pestis
ucaaucacgacaagucaug

SEQ ID NO: 2253500 - RNA, 23 nt, Yersinia pestis
ucaaugacuccugaaauaaagaa

SEQ ID NO: 2253501 - RNA, 23 nt, Yersinia pestis
ucaaugacgacuggcauuuuuau

SEQ ID NO: 2253502 - RNA, 18 nt, Yersinia pestis
ucaaugagcauaccgguu

SEQ ID NO: 2253503 - RNA, 21 nt, Yersinia pestis
ucaauggucaugcacaguugu

SEQ ID NO: 2253504 - RNA, 12 nt, Yersinia pestis
ucaauaaccuca

SEQ ID NO: 2253505 - RNA, 19 nt, Yersinia pestis
ucaauaaccucaaaaggau

SEQ ID NO: 2253506 - RNA, 20 nt, Yersinia pestis
ucaauaaccucaggggccaa

SEQ ID NO: 2253507 - RNA, 21 nt, Yersinia pestis
ucaauaaguagccacuuaaua

SEQ ID NO: 2253508 - RNA, 23 nt, Yersinia pestis
ucaauaaguagccacuuaauaau

SEQ ID NO: 2253509 - RNA, 22 nt, Yersinia pestis
ucaauaagugcaaacuuaaaaa

SEQ ID NO: 2253510 - RNA, 22 nt, Yersinia pestis
ucaauaauaacgaauuucauuu

SEQ ID NO: 2253511 - RNA, 22 nt, Yersinia pestis
ucaauaaaaugggccugagugg

SEQ ID NO: 2253512 - RNA, 17 nt, Yersinia pestis
ucaauaaacucuuucau

SEQ ID NO: 2253513 - RNA, 18 nt, Yersinia pestis
ucaauaaacucuuucauc

SEQ ID NO: 2253514 - RNA, 19 nt, Yersinia pestis
ucaauaaagccauuucagu

SEQ ID NO: 2253515 - RNA, 14 nt, Yersinia pestis
ucaauaaacgcuuu

SEQ ID NO: 2253516 - RNA, 19 nt, Yersinia pestis
ucaauaaauccaucaauag

SEQ ID NO: 2253517 - RNA, 19 nt, Yersinia pestis
ucaauacuguuaucacuga

SEQ ID NO: 2253518 - RNA, 19 nt, Yersinia pestis
ucaauaccuuacugcauca

SEQ ID NO: 2253519 - RNA, 19 nt, Yersinia pestis
ucaauagcauaaauaucag

SEQ ID NO: 2253520 - RNA, 16 nt, Yersinia pestis
ucaauaccaaauuuac

SEQ ID NO: 2253521 - RNA, 18 nt, Yersinia pestis
ucaauacccugccaccuu

SEQ ID NO: 2253522 - RNA, 15 nt, Yersinia pestis
ucaauauaagagaaa

SEQ ID NO: 2253523 - RNA, 16 nt, Yersinia pestis
ucaauaggucaguggu

SEQ ID NO: 2253524 - RNA, 22 nt, Yersinia pestis
ucaauagcguuaacgauauaau

SEQ ID NO: 2253525 - RNA, 21 nt, Yersinia pestis
ucaauaggauuuucaugaucc

SEQ ID NO: 2253526 - RNA, 19 nt, Yersinia pestis
ucaauaggccagcaaugcu

SEQ ID NO: 2253527 - RNA, 22 nt, Yersinia pestis
ucaauagcauaaauaucaguga

SEQ ID NO: 2253528 - RNA, 20 nt, Yersinia pestis
ucaauaggucagugguuuua

SEQ ID NO: 2253529 - RNA, 22 nt, Yersinia pestis
ucacaucucggcguaaacaauc

SEQ ID NO: 2253530 - RNA, 17 nt, Yersinia pestis
ucacaucggucaauacc

SEQ ID NO: 2253531 - RNA, 14 nt, Yersinia pestis
ucacaucauccacu

SEQ ID NO: 2253532 - RNA, 14 nt, Yersinia pestis
ucacaucaucuuuu

SEQ ID NO: 2253533 - RNA, 15 nt, Yersinia pestis
ucacaugacugaaca

SEQ ID NO: 2253534 - RNA, 24 nt, Yersinia pestis
ucacaugcggauugaacugcgcua

SEQ ID NO: 2253535 - RNA, 13 nt, Yersinia pestis
ucaccaccacuuu

SEQ ID NO: 2253536 - RNA, 15 nt, Yersinia pestis
ucaccagguccgccc

SEQ ID NO: 2253537 - RNA, 18 nt, Yersinia pestis
ucaccagguuucgguacu

SEQ ID NO: 2253538 - RNA, 22 nt, Yersinia pestis
ucaccacggcuuucaauaaaac

SEQ ID NO: 2253539 - RNA, 18 nt, Yersinia pestis
ucaccacgauuagccaua

SEQ ID NO: 2253540 - RNA, 15 nt, Yersinia pestis
ucaccaucgccccug

SEQ ID NO: 2253541 - RNA, 20 nt, Yersinia pestis
ucaccaucgccuuuagcuuu

SEQ ID NO: 2253542 - RNA, 18 nt, Yersinia pestis
ucaccaucggcaauaaua

SEQ ID NO: 2253543 - RNA, 20 nt, Yersinia pestis
ucaccaucugguucgguaua

SEQ ID NO: 2253544 - RNA, 19 nt, Yersinia pestis
ucaccauccggguuuaucc

SEQ ID NO: 2253545 - RNA, 13 nt, Yersinia pestis
ucaccauaaauuc

SEQ ID NO: 2253546 - RNA, 14 nt, Yersinia pestis
ucaccauaacugcu

SEQ ID NO: 2253547 - RNA, 16 nt, Yersinia pestis
ucaccauaacugcugc

SEQ ID NO: 2253548 - RNA, 14 nt, Yersinia pestis
ucaccauauucauc

SEQ ID NO: 2253549 - RNA, 17 nt, Yersinia pestis
ucaccauaacugcugcu

SEQ ID NO: 2253550 - RNA, 19 nt, Yersinia pestis
ucaccaguagcccagccgg

SEQ ID NO: 2253551 - RNA, 15 nt, Yersinia pestis
ucacauaaauaaguu

SEQ ID NO: 2253552 - RNA, 14 nt, Yersinia pestis
ucacaggggcaauu

SEQ ID NO: 2253553 - RNA, 13 nt, Yersinia pestis
ucacaaaauaaua

SEQ ID NO: 2253554 - RNA, 21 nt, Yersinia pestis
ucacaaaauaauaauucugcu

SEQ ID NO: 2253555 - RNA, 13 nt, Yersinia pestis
ucacaaaauaacu

SEQ ID NO: 2253556 - RNA, 12 nt, Yersinia pestis
ucacagauaaac

SEQ ID NO: 2253557 - RNA, 13 nt, Yersinia pestis
ucacagauaaaca

SEQ ID NO: 2253558 - RNA, 20 nt, Yersinia pestis
ucacagcggcggauaaauuc

SEQ ID NO: 2253559 - RNA, 14 nt, Yersinia pestis
uauuaacauaucaa

SEQ ID NO: 2253560 - RNA, 16 nt, Yersinia pestis
uauuaacugcagugaa

SEQ ID NO: 2253561 - RNA, 12 nt, Yersinia pestis
uauuaacauuaa

SEQ ID NO: 2253562 - RNA, 17 nt, Yersinia pestis
uauuaacgauuauuaaa

SEQ ID NO: 2253563 - RNA, 12 nt, Yersinia pestis
uauuaaagccau

SEQ ID NO: 2253564 - RNA, 11 nt, Yersinia pestis
uauuaaauaag

SEQ ID NO: 2253565 - RNA, 17 nt, Yersinia pestis
uauuaaucaacagauau

SEQ ID NO: 2253566 - RNA, 22 nt, Yersinia pestis
uauuaauaucgagguucgacua

SEQ ID NO: 2253567 - RNA, 22 nt, Yersinia pestis
uauuaauaggaggguguuuuuu

SEQ ID NO: 2253568 - RNA, 17 nt, Yersinia pestis
uauuaaucuauuaauau

SEQ ID NO: 2253569 - RNA, 22 nt, Yersinia pestis
uauuaccaauaugaaauuucac

SEQ ID NO: 2253570 - RNA, 13 nt, Yersinia pestis
uauuacaacggcu

SEQ ID NO: 2253571 - RNA, 16 nt, Yersinia pestis
uauguaacacauauuu

SEQ ID NO: 2253572 - RNA, 13 nt, Yersinia pestis
uaugguuaaucua

SEQ ID NO: 2253573 - RNA, 23 nt, Yersinia pestis
uauguagggguacagcagggauu

SEQ ID NO: 2253574 - RNA, 15 nt, Yersinia pestis
uauguaguuaaucua

SEQ ID NO: 2253575 - RNA, 18 nt, Yersinia pestis
uauguagccagauaaaac

SEQ ID NO: 2253576 - RNA, 17 nt, Yersinia pestis
uaugugauauuuuacug

SEQ ID NO: 2253577 - RNA, 20 nt, Yersinia pestis
uaugucagauagaccaauga

SEQ ID NO: 2253578 - RNA, 23 nt, Yersinia pestis
uaugucaccuccacuucaagccg

SEQ ID NO: 2253579 - RNA, 19 nt, Yersinia pestis
uaugugcugguuauuggcc

SEQ ID NO: 2253580 - RNA, 21 nt, Yersinia pestis
uaugugcuugcggaauuucuu

SEQ ID NO: 2253581 - RNA, 14 nt, Yersinia pestis
uauguugcacugac

SEQ ID NO: 2253582 - RNA, 13 nt, Yersinia pestis
uauguuccaucag

SEQ ID NO: 2253583 - RNA, 17 nt, Yersinia pestis
uauguucuuccugugcg

SEQ ID NO: 2253584 - RNA, 15 nt, Yersinia pestis
uauguuucuuuaaua

SEQ ID NO: 2253585 - RNA, 12 nt, Yersinia pestis
uauguuuuuaac

SEQ ID NO: 2253586 - RNA, 15 nt, Yersinia pestis
uauguuuuuaacaaa

SEQ ID NO: 2253587 - RNA, 16 nt, Yersinia pestis
uauguuuuuaacaaaa

SEQ ID NO: 2253588 - RNA, 13 nt, Yersinia pestis
uauuaaaacacau

SEQ ID NO: 2253589 - RNA, 18 nt, Yersinia pestis
uauucaaacggugugcaa

SEQ ID NO: 2253590 - RNA, 22 nt, Yersinia pestis
uauucaaacggugugcaaugca

SEQ ID NO: 2253591 - RNA, 20 nt, Yersinia pestis
uauucaacauuuaagugcua

SEQ ID NO: 2253592 - RNA, 18 nt, Yersinia pestis
uauuccccaccauugcaa

SEQ ID NO: 2253593 - RNA, 16 nt, Yersinia pestis
uauuccucucugucug

SEQ ID NO: 2253594 - RNA, 17 nt, Yersinia pestis
uauuccgcaccuuuguc

SEQ ID NO: 2253595 - RNA, 19 nt, Yersinia pestis
uauuccgagcaaucaaaag

SEQ ID NO: 2253596 - RNA, 18 nt, Yersinia pestis
uauucuacaaugucacgc

SEQ ID NO: 2253597 - RNA, 21 nt, Yersinia pestis
uauucgucuucgcauucuuua

SEQ ID NO: 2253598 - RNA, 15 nt, Yersinia pestis
uauucgucauucguu

SEQ ID NO: 2253599 - RNA, 17 nt, Yersinia pestis
uauucgguucaagaguu

SEQ ID NO: 2253600 - RNA, 12 nt, Yersinia pestis
uauuccuaauua

SEQ ID NO: 2253601 - RNA, 18 nt, Yersinia pestis
uauucgggcaacuaauuc

SEQ ID NO: 2253602 - RNA, 16 nt, Yersinia pestis
uauucuuaucaaucaa

SEQ ID NO: 2253603 - RNA, 16 nt, Yersinia pestis
uauuggccaguugcca

SEQ ID NO: 2253604 - RNA, 22 nt, Yersinia pestis
uauuggcuaaaguguacuguua

SEQ ID NO: 2253605 - RNA, 15 nt, Yersinia pestis
uauuggguuauuaac

SEQ ID NO: 2253606 - RNA, 19 nt, Yersinia pestis
uauuggagcugaaaauagu

SEQ ID NO: 2253607 - RNA, 20 nt, Yersinia pestis
uauuggucauuuuucccuuc

SEQ ID NO: 2253608 - RNA, 17 nt, Yersinia pestis
uauuguucaaaaacgca

SEQ ID NO: 2253609 - RNA, 17 nt, Yersinia pestis
uauuggucaauaaaauu

SEQ ID NO: 2253610 - RNA, 17 nt, Yersinia pestis
uauuggggacaggcucc

SEQ ID NO: 2253611 - RNA, 22 nt, Yersinia pestis
uauuggggacaggcuccuccuu

SEQ ID NO: 2253612 - RNA, 20 nt, Yersinia pestis
uauuguugccaauguugcug

SEQ ID NO: 2253613 - RNA, 21 nt, Yersinia pestis
uauuuaagcugaaauuuuuua

SEQ ID NO: 2253614 - RNA, 22 nt, Yersinia pestis
uauuuaagcaguucacucuguu

SEQ ID NO: 2253615 - RNA, 22 nt, Yersinia pestis
aaauccuguagcucagccuguu

SEQ ID NO: 2253616 - RNA, 20 nt, Yersinia pestis
aaauccugaauaauacuguc

SEQ ID NO: 2253617 - RNA, 16 nt, Yersinia pestis
uauugcaucuuuaauu

SEQ ID NO: 2253618 - RNA, 13 nt, Yersinia pestis
uauugaacauuca

SEQ ID NO: 2253619 - RNA, 23 nt, Yersinia pestis
uauugaaccuacccuuauucuua

SEQ ID NO: 2253620 - RNA, 16 nt, Yersinia pestis
uaucuuuauugcuccu

SEQ ID NO: 2253621 - RNA, 21 nt, Yersinia pestis
uaucuuucaaguccugcuuca

SEQ ID NO: 2253622 - RNA, 22 nt, Yersinia pestis
uaucuuucaaguccugcuucaa

SEQ ID NO: 2253623 - RNA, 15 nt, Yersinia pestis
uaucuuuauuaucaa

SEQ ID NO: 2253624 - RNA, 13 nt, Yersinia pestis
uaugaaaguaaga

SEQ ID NO: 2253625 - RNA, 13 nt, Yersinia pestis
uaugaaauuucac

SEQ ID NO: 2253626 - RNA, 16 nt, Yersinia pestis
uaucuuauccacagca

SEQ ID NO: 2253627 - RNA, 13 nt, Yersinia pestis
uaucuuuacccac

SEQ ID NO: 2253628 - RNA, 18 nt, Yersinia pestis
uaucuuguaaauagucau

SEQ ID NO: 2253629 - RNA, 15 nt, Yersinia pestis
uaucuuccauagaua

SEQ ID NO: 2253630 - RNA, 15 nt, Yersinia pestis
uaucuugaaccaauu

SEQ ID NO: 2253631 - RNA, 21 nt, Yersinia pestis
uaucuugaaccaauuuuucug

SEQ ID NO: 2253632 - RNA, 21 nt, Yersinia pestis
uaucugccaauucaaggccag

SEQ ID NO: 2253633 - RNA, 13 nt, Yersinia pestis
uaucugaugaaaa

SEQ ID NO: 2253634 - RNA, 17 nt, Yersinia pestis
uaucugacugcuugcca

SEQ ID NO: 2253635 - RNA, 14 nt, Yersinia pestis
uaucugcguuuucu

SEQ ID NO: 2253636 - RNA, 15 nt, Yersinia pestis
uaucuggcuuuccug

SEQ ID NO: 2253637 - RNA, 14 nt, Yersinia pestis
uaucucauccagca

SEQ ID NO: 2253638 - RNA, 15 nt, Yersinia pestis
uaucucauccagcaa

SEQ ID NO: 2253639 - RNA, 22 nt, Yersinia pestis
uaucucuuuuccggcuuucuau

SEQ ID NO: 2253640 - RNA, 16 nt, Yersinia pestis
uaucgugaauaaaaau

SEQ ID NO: 2253641 - RNA, 18 nt, Yersinia pestis
uaucgugaccaauaauaa

SEQ ID NO: 2253642 - RNA, 15 nt, Yersinia pestis
uaucuaaaacugccu

SEQ ID NO: 2253643 - RNA, 17 nt, Yersinia pestis
uaucuagcguccaugua

SEQ ID NO: 2253644 - RNA, 16 nt, Yersinia pestis
uaucuaggugcaguaa

SEQ ID NO: 2253645 - RNA, 18 nt, Yersinia pestis
uaucuagcaacacaucgg

SEQ ID NO: 2253646 - RNA, 14 nt, Yersinia pestis
uaucuauuuccauc

SEQ ID NO: 2253647 - RNA, 20 nt, Yersinia pestis
uaugaggaucccuucugaaa

SEQ ID NO: 2253648 - RNA, 20 nt, Yersinia pestis
uaugacaacugaaaauacua

SEQ ID NO: 2253649 - RNA, 19 nt, Yersinia pestis
uaugacagaaaaaucacau

SEQ ID NO: 2253650 - RNA, 23 nt, Yersinia pestis
uaugaauuaauuuauuuucauua

SEQ ID NO: 2253651 - RNA, 23 nt, Yersinia pestis
uaugcaguuaagguuagcuaugc

SEQ ID NO: 2253652 - RNA, 18 nt, Yersinia pestis
uaugcugaccacugcuuc

SEQ ID NO: 2253653 - RNA, 13 nt, Yersinia pestis
uaugcguggguuc

SEQ ID NO: 2253654 - RNA, 20 nt, Yersinia pestis
uaugccggaggauauuuauu

SEQ ID NO: 2253655 - RNA, 14 nt, Yersinia pestis
uaugccgacaacca

SEQ ID NO: 2253656 - RNA, 22 nt, Yersinia pestis
uaugggcuuuuuuugcauuggu

SEQ ID NO: 2253657 - RNA, 22 nt, Yersinia pestis
uauggcgaugaugauuauuuua

SEQ ID NO: 2253658 - RNA, 13 nt, Yersinia pestis
uauggcgaagaga

SEQ ID NO: 2253659 - RNA, 19 nt, Yersinia pestis
uauggaaauuauuuagaaa

SEQ ID NO: 2253660 - RNA, 16 nt, Yersinia pestis
uauggaaguaauccag

SEQ ID NO: 2253661 - RNA, 22 nt, Yersinia pestis
uauggcauaaacugaaguuaaa

SEQ ID NO: 2253662 - RNA, 20 nt, Yersinia pestis
uauggcagaaaucagccaua

SEQ ID NO: 2253663 - RNA, 14 nt, Yersinia pestis
uauggauaaauccu

SEQ ID NO: 2253664 - RNA, 17 nt, Yersinia pestis
uauggauaauuuaauua

SEQ ID NO: 2253665 - RNA, 16 nt, Yersinia pestis
uauggaugaugcacag

SEQ ID NO: 2253666 - RNA, 18 nt, Yersinia pestis
uaucagccccuaaauccu

SEQ ID NO: 2253667 - RNA, 22 nt, Yersinia pestis
uaucagccccuaaauccugcaa

SEQ ID NO: 2253668 - RNA, 15 nt, Yersinia pestis
uaucagcgaaaaauu

SEQ ID NO: 2253669 - RNA, 14 nt, Yersinia pestis
uaucauauuaacau

SEQ ID NO: 2253670 - RNA, 15 nt, Yersinia pestis
uaucauaauccaacu

SEQ ID NO: 2253671 - RNA, 14 nt, Yersinia pestis
uauccaggcacugc

SEQ ID NO: 2253672 - RNA, 15 nt, Yersinia pestis
uaucaucaccaaaca

SEQ ID NO: 2253673 - RNA, 15 nt, Yersinia pestis
uaucaucauaaaugg

SEQ ID NO: 2253674 - RNA, 12 nt, Yersinia pestis
uaucaucaccac

SEQ ID NO: 2253675 - RNA, 14 nt, Yersinia pestis
uaucaucaccaccc

SEQ ID NO: 2253676 - RNA, 11 nt, Yersinia pestis
uauccuccggc

SEQ ID NO: 2253677 - RNA, 15 nt, Yersinia pestis
uauccuaacagacca

SEQ ID NO: 2253678 - RNA, 17 nt, Yersinia pestis
uauccuaucuuuaccca

SEQ ID NO: 2253679 - RNA, 15 nt, Yersinia pestis
uauccguuaacccaa

SEQ ID NO: 2253680 - RNA, 16 nt, Yersinia pestis
uaucccuauuuuuucc

SEQ ID NO: 2253681 - RNA, 12 nt, Yersinia pestis
uauccccuguag

SEQ ID NO: 2253682 - RNA, 21 nt, Yersinia pestis
uauccuguacauauauaauac

SEQ ID NO: 2253683 - RNA, 20 nt, Yersinia pestis
uauccuggccguguuuuucc

SEQ ID NO: 2253684 - RNA, 13 nt, Yersinia pestis
uaucgaaacacau

SEQ ID NO: 2253685 - RNA, 20 nt, Yersinia pestis
uaucgaauugaucugauauu

SEQ ID NO: 2253686 - RNA, 15 nt, Yersinia pestis
uaucgaccaugaaua

SEQ ID NO: 2253687 - RNA, 13 nt, Yersinia pestis
uaucgacaccaau

SEQ ID NO: 2253688 - RNA, 13 nt, Yersinia pestis
uaucgauuucuac

SEQ ID NO: 2253689 - RNA, 13 nt, Yersinia pestis
uaucgcagugcac

SEQ ID NO: 2253690 - RNA, 16 nt, Yersinia pestis
uaucgauaugaacugu

SEQ ID NO: 2253691 - RNA, 14 nt, Yersinia pestis
uaucggcggagaga

SEQ ID NO: 2253692 - RNA, 22 nt, Yersinia pestis
uaucggugcugacaaacagaua

SEQ ID NO: 2253693 - RNA, 12 nt, Yersinia pestis
uaucgucacugg

SEQ ID NO: 2253694 - RNA, 21 nt, Yersinia pestis
uaucggccauauuaccgcuga

SEQ ID NO: 2253695 - RNA, 19 nt, Yersinia pestis
uaucgcgaaaaugaagcga

SEQ ID NO: 2253696 - RNA, 14 nt, Yersinia pestis
uaucgcaauuucag

SEQ ID NO: 2253697 - RNA, 16 nt, Yersinia pestis
uaucgcuaccuccggg

SEQ ID NO: 2253698 - RNA, 13 nt, Yersinia pestis
uaucgcucuugag

SEQ ID NO: 2253699 - RNA, 17 nt, Yersinia pestis
uaucgcuguaugguaua

SEQ ID NO: 2253700 - RNA, 18 nt, Yersinia pestis
uaucaaggcggcagagcc

SEQ ID NO: 2253701 - RNA, 16 nt, Yersinia pestis
uaucaaguuaaauacu

SEQ ID NO: 2253702 - RNA, 21 nt, Yersinia pestis
uaucaacgcccagcuuuagca

SEQ ID NO: 2253703 - RNA, 21 nt, Yersinia pestis
uauauuuugaauauuuuuaau

SEQ ID NO: 2253704 - RNA, 13 nt, Yersinia pestis
uauauuuugagau

SEQ ID NO: 2253705 - RNA, 15 nt, Yersinia pestis
uaucacaucauccac

SEQ ID NO: 2253706 - RNA, 14 nt, Yersinia pestis
uaucacaucgcccu

SEQ ID NO: 2253707 - RNA, 19 nt, Yersinia pestis
uaucacaguuaaaaauaga

SEQ ID NO: 2253708 - RNA, 22 nt, Yersinia pestis
uaucacccgccaucgccccaaa

SEQ ID NO: 2253709 - RNA, 18 nt, Yersinia pestis
uauauguugggaaauaac

SEQ ID NO: 2253710 - RNA, 21 nt, Yersinia pestis
uauaugcgcuggcucuauuuu

SEQ ID NO: 2253711 - RNA, 16 nt, Yersinia pestis
uauaugaucagugggg

SEQ ID NO: 2253712 - RNA, 14 nt, Yersinia pestis
uauaugauaauagu

SEQ ID NO: 2253713 - RNA, 18 nt, Yersinia pestis
uauaauuucuugucaccu

SEQ ID NO: 2253714 - RNA, 19 nt, Yersinia pestis
uauacaauccaaccuauau

SEQ ID NO: 2253715 - RNA, 19 nt, Yersinia pestis
uauacaaggcacaucucca

SEQ ID NO: 2253716 - RNA, 22 nt, Yersinia pestis
uauacaauugccugauuuuuau

SEQ ID NO: 2253717 - RNA, 16 nt, Yersinia pestis
uauaggcaucuuucag

SEQ ID NO: 2253718 - RNA, 21 nt, Yersinia pestis
uauaggcaucuuucaguuuua

SEQ ID NO: 2253719 - RNA, 14 nt, Yersinia pestis
uauaggcuauuuua

SEQ ID NO: 2253720 - RNA, 23 nt, Yersinia pestis
uauaggcucaaugcgaaaaaaua

SEQ ID NO: 2253721 - RNA, 19 nt, Yersinia pestis
uauaucggcucauuuuuug

SEQ ID NO: 2253722 - RNA, 17 nt, Yersinia pestis
uauaucguguuuaguug

SEQ ID NO: 2253723 - RNA, 20 nt, Yersinia pestis
uauaucgaucugauaucucu

SEQ ID NO: 2253724 - RNA, 16 nt, Yersinia pestis
uauaucuccaccaacg

SEQ ID NO: 2253725 - RNA, 18 nt, Yersinia pestis
uauauagcccagcguucu

SEQ ID NO: 2253726 - RNA, 22 nt, Yersinia pestis
uauauaacagccauuuauauaa

SEQ ID NO: 2253727 - RNA, 11 nt, Yersinia pestis
uauauaaaaua

SEQ ID NO: 2253728 - RNA, 16 nt, Yersinia pestis
uauauaaaauaaauuu

SEQ ID NO: 2253729 - RNA, 19 nt, Yersinia pestis
uauaauacgaaauacuuau

SEQ ID NO: 2253730 - RNA, 11 nt, Yersinia pestis
uauaauaaugg

SEQ ID NO: 2253731 - RNA, 14 nt, Yersinia pestis
uauaauauuaaaau

SEQ ID NO: 2253732 - RNA, 22 nt, Yersinia pestis
uauaauagcuggcggauaaaaa

SEQ ID NO: 2253733 - RNA, 23 nt, Yersinia pestis
uauaauagcuggcggauaaaaau

SEQ ID NO: 2253734 - RNA, 16 nt, Yersinia pestis
uauaaggaauauacuu

SEQ ID NO: 2253735 - RNA, 19 nt, Yersinia pestis
uauaaguacuuucaaagaa

SEQ ID NO: 2253736 - RNA, 20 nt, Yersinia pestis
uauaaugagaauguaaauuu

SEQ ID NO: 2253737 - RNA, 22 nt, Yersinia pestis
uauaaugaugagguaauacuca

SEQ ID NO: 2253738 - RNA, 18 nt, Yersinia pestis
uauaaucaucuacaacau

SEQ ID NO: 2253739 - RNA, 13 nt, Yersinia pestis
uauaauuauugaa

SEQ ID NO: 2253740 - RNA, 15 nt, Yersinia pestis
uauaauuauuucucu

SEQ ID NO: 2253741 - RNA, 18 nt, Yersinia pestis
uauaauuucaaaguaaaa

SEQ ID NO: 2253742 - RNA, 23 nt, Yersinia pestis
uauaauugaagauuuaaauaaca

SEQ ID NO: 2253743 - RNA, 21 nt, Yersinia pestis
uaguugaccuugguaaauacc

SEQ ID NO: 2253744 - RNA, 21 nt, Yersinia pestis
uaguucuucugauaaaacagu

SEQ ID NO: 2253745 - RNA, 18 nt, Yersinia pestis
uaguugaacucgccuuca

SEQ ID NO: 2253746 - RNA, 18 nt, Yersinia pestis
uaguuggcaagacgguau

SEQ ID NO: 2253747 - RNA, 20 nt, Yersinia pestis
uauaaagauuuuaagcacug

SEQ ID NO: 2253748 - RNA, 23 nt, Yersinia pestis
uauaaagcauuuaucauauuaac

SEQ ID NO: 2253749 - RNA, 12 nt, Yersinia pestis
uauaacauaaua

SEQ ID NO: 2253750 - RNA, 21 nt, Yersinia pestis
uauaacauaauaaauuaauag

SEQ ID NO: 2253751 - RNA, 15 nt, Yersinia pestis
uauaagcaauaccga

SEQ ID NO: 2253752 - RNA, 16 nt, Yersinia pestis
uauaagcgcucaaaua

SEQ ID NO: 2253753 - RNA, 17 nt, Yersinia pestis
uauaaccauuaacaaua

SEQ ID NO: 2253754 - RNA, 19 nt, Yersinia pestis
uauaaccccccugcugaua

SEQ ID NO: 2253755 - RNA, 22 nt, Yersinia pestis
uagucacgcggcggcgucaaau

SEQ ID NO: 2253756 - RNA, 20 nt, Yersinia pestis
uagucacgggguguguggca

SEQ ID NO: 2253757 - RNA, 14 nt, Yersinia pestis
uagucaucacuaac

SEQ ID NO: 2253758 - RNA, 18 nt, Yersinia pestis
uagucauauauuuuucuu

SEQ ID NO: 2253759 - RNA, 20 nt, Yersinia pestis
uaguaaugacgcuauggaua

SEQ ID NO: 2253760 - RNA, 11 nt, Yersinia pestis
uaguaauaauu

SEQ ID NO: 2253761 - RNA, 23 nt, Yersinia pestis
uaguacguagcgauaacagauau

SEQ ID NO: 2253762 - RNA, 14 nt, Yersinia pestis
uaguaacuauuuac

SEQ ID NO: 2253763 - RNA, 15 nt, Yersinia pestis
uaguaagcaugccau

SEQ ID NO: 2253764 - RNA, 17 nt, Yersinia pestis
uaguaagcuucgaccca

SEQ ID NO: 2253765 - RNA, 14 nt, Yersinia pestis
uaguaacaccagca

SEQ ID NO: 2253766 - RNA, 20 nt, Yersinia pestis
uaggugguaccugcacugag

SEQ ID NO: 2253767 - RNA, 15 nt, Yersinia pestis
uagguuaaauucacu

SEQ ID NO: 2253768 - RNA, 18 nt, Yersinia pestis
uagguuacgucauauccc

SEQ ID NO: 2253769 - RNA, 16 nt, Yersinia pestis
uaggugcgcaaaccug

SEQ ID NO: 2253770 - RNA, 15 nt, Yersinia pestis
uacuuuauuuaaaau

SEQ ID NO: 2253771 - RNA, 17 nt, Yersinia pestis
uaguggcacaaauaaaa

SEQ ID NO: 2253772 - RNA, 15 nt, Yersinia pestis
uaguggcacaaauaa

SEQ ID NO: 2253773 - RNA, 23 nt, Yersinia pestis
uaguggugagcgccaugcgcuuu

SEQ ID NO: 2253774 - RNA, 15 nt, Yersinia pestis
uagugagucaggaaa

SEQ ID NO: 2253775 - RNA, 21 nt, Yersinia pestis
uagugagccgugagaauagac

SEQ ID NO: 2253776 - RNA, 15 nt, Yersinia pestis
uagugacucaucaaa

SEQ ID NO: 2253777 - RNA, 21 nt, Yersinia pestis
uaguuaucucccauuaauuaa

SEQ ID NO: 2253778 - RNA, 23 nt, Yersinia pestis
uaguuaucucccauuaauuaauc

SEQ ID NO: 2253779 - RNA, 23 nt, Yersinia pestis
uaguuaucugggcggauaaggau

SEQ ID NO: 2253780 - RNA, 17 nt, Yersinia pestis
uaguuaaucgcagcaga

SEQ ID NO: 2253781 - RNA, 15 nt, Yersinia pestis
uaguuaauuuaauuu

SEQ ID NO: 2253782 - RNA, 16 nt, Yersinia pestis
uaguuacaauaaauca

SEQ ID NO: 2253783 - RNA, 14 nt, Yersinia pestis
uaguuauauaaggu

SEQ ID NO: 2253784 - RNA, 18 nt, Yersinia pestis
uagucuuuuuaauaugug

SEQ ID NO: 2253785 - RNA, 15 nt, Yersinia pestis
uagucuucaucaucc

SEQ ID NO: 2253786 - RNA, 18 nt, Yersinia pestis
uagugaaguaauaaaaau

SEQ ID NO: 2253787 - RNA, 22 nt, Yersinia pestis
uagugaaaacguuaacugcagu

SEQ ID NO: 2253788 - RNA, 17 nt, Yersinia pestis
uagucuccaaauucauu

SEQ ID NO: 2253789 - RNA, 21 nt, Yersinia pestis
ucgacaaucucggcauugguu

SEQ ID NO: 2253790 - RNA, 17 nt, Yersinia pestis
ucgacaccaagacugaa

SEQ ID NO: 2253791 - RNA, 17 nt, Yersinia pestis
ucgacaccauguccaug

SEQ ID NO: 2253792 - RNA, 22 nt, Yersinia pestis
ucgacaccauguccauguuagg

SEQ ID NO: 2253793 - RNA, 14 nt, Yersinia pestis
ucgacaccuucaau

SEQ ID NO: 2253794 - RNA, 19 nt, Yersinia pestis
ucgacaccuucaaucauug

SEQ ID NO: 2253795 - RNA, 21 nt, Yersinia pestis
ucgacaccuucaaucauugag

SEQ ID NO: 2253796 - RNA, 17 nt, Yersinia pestis
ucgacaaaaaagcggcu

SEQ ID NO: 2253797 - RNA, 23 nt, Yersinia pestis
ucgaauuauuuagagucuauaau

SEQ ID NO: 2253798 - RNA, 21 nt, Yersinia pestis
ucgaagggauaucucaccgcc

SEQ ID NO: 2253799 - RNA, 21 nt, Yersinia pestis
ucgaauaaacggauuugucug

SEQ ID NO: 2253800 - RNA, 12 nt, Yersinia pestis
ucgaaccugaac

SEQ ID NO: 2253801 - RNA, 18 nt, Yersinia pestis
ucgaaccugaacgcagga

SEQ ID NO: 2253802 - RNA, 17 nt, Yersinia pestis
ucgaacuaucuuuucga

SEQ ID NO: 2253803 - RNA, 16 nt, Yersinia pestis
ucgacaggcaauuauc

SEQ ID NO: 2253804 - RNA, 15 nt, Yersinia pestis
ucgacaguguaaaaa

SEQ ID NO: 2253805 - RNA, 17 nt, Yersinia pestis
ucgacaguguaaaaagc

SEQ ID NO: 2253806 - RNA, 17 nt, Yersinia pestis
ucgacggccaauuucag

SEQ ID NO: 2253807 - RNA, 21 nt, Yersinia pestis
uccuugguaccgauuaugcca

SEQ ID NO: 2253808 - RNA, 17 nt, Yersinia pestis
uccuuuacuccccugcc

SEQ ID NO: 2253809 - RNA, 20 nt, Yersinia pestis
uccuuuacuccccugccuau

SEQ ID NO: 2253810 - RNA, 22 nt, Yersinia pestis
uccuuuacuccccugccuauuc

SEQ ID NO: 2253811 - RNA, 18 nt, Yersinia pestis
uccuucucgaugccuucu

SEQ ID NO: 2253812 - RNA, 13 nt, Yersinia pestis
ucgaaaauaauga

SEQ ID NO: 2253813 - RNA, 21 nt, Yersinia pestis
ucgaaacacccuccuauuaau

SEQ ID NO: 2253814 - RNA, 13 nt, Yersinia pestis
ucgaaagaaauaa

SEQ ID NO: 2253815 - RNA, 19 nt, Yersinia pestis
ucgaacauaaaaaugcacu

SEQ ID NO: 2253816 - RNA, 14 nt, Yersinia pestis
ucgaacccaaccag

SEQ ID NO: 2253817 - RNA, 17 nt, Yersinia pestis
ucgaacccauucaucaa

SEQ ID NO: 2253818 - RNA, 15 nt, Yersinia pestis
uccuuuuuucugcaa

SEQ ID NO: 2253819 - RNA, 21 nt, Yersinia pestis
uccuuuuuucugcaaaucagc

SEQ ID NO: 2253820 - RNA, 18 nt, Yersinia pestis
ucgaaaagcgccuuuuau

SEQ ID NO: 2253821 - RNA, 22 nt, Yersinia pestis
ucgaaaacucaaagauuucauc

SEQ ID NO: 2253822 - RNA, 22 nt, Yersinia pestis
uccuuucuuuucgcuauuucuc

SEQ ID NO: 2253823 - RNA, 18 nt, Yersinia pestis
uccuuucuguuccaugau

SEQ ID NO: 2253824 - RNA, 14 nt, Yersinia pestis
uccuuuuauuuaga

SEQ ID NO: 2253825 - RNA, 15 nt, Yersinia pestis
ucgacucugggccgu

SEQ ID NO: 2253826 - RNA, 14 nt, Yersinia pestis
ucgacucaauaaau

SEQ ID NO: 2253827 - RNA, 20 nt, Yersinia pestis
ucgacucaauaaauccauca

SEQ ID NO: 2253828 - RNA, 14 nt, Yersinia pestis
ucgacuacuggcug

SEQ ID NO: 2253829 - RNA, 16 nt, Yersinia pestis
ucgacuaaggcaaccu

SEQ ID NO: 2253830 - RNA, 23 nt, Yersinia pestis
ucgacucugggccgugaguuuuc

SEQ ID NO: 2253831 - RNA, 23 nt, Yersinia pestis
ucgacucuuuuugugcuucauau

SEQ ID NO: 2253832 - RNA, 19 nt, Yersinia pestis
ucgagaacgggcacagcau

SEQ ID NO: 2253833 - RNA, 19 nt, Yersinia pestis
ucgagauguauccaaggca

SEQ ID NO: 2253834 - RNA, 20 nt, Yersinia pestis
ucgagcuguuugcuguaaac

SEQ ID NO: 2253835 - RNA, 17 nt, Yersinia pestis
ucgagcggggcaaaaau

SEQ ID NO: 2253836 - RNA, 14 nt, Yersinia pestis
ucgagcaucaccgg

SEQ ID NO: 2253837 - RNA, 21 nt, Yersinia pestis
ucgagccgcgccauccuuggc

SEQ ID NO: 2253838 - RNA, 20 nt, Yersinia pestis
ucgaucaaaacaauaaaaag

SEQ ID NO: 2253839 - RNA, 16 nt, Yersinia pestis
ucgauaugagucaguu

SEQ ID NO: 2253840 - RNA, 17 nt, Yersinia pestis
ucgauauggaugguauu

SEQ ID NO: 2253841 - RNA, 13 nt, Yersinia pestis
ucgaucaaaccag

SEQ ID NO: 2253842 - RNA, 17 nt, Yersinia pestis
ucgaucacaugcucagu

SEQ ID NO: 2253843 - RNA, 22 nt, Yersinia pestis
ucgauagagaacuccacauuuu

SEQ ID NO: 2253844 - RNA, 15 nt, Yersinia pestis
ucgauacccuucauc

SEQ ID NO: 2253845 - RNA, 21 nt, Yersinia pestis
ucgauacccuucaucuuucaa

SEQ ID NO: 2253846 - RNA, 16 nt, Yersinia pestis
ucgauagucagcuuca

SEQ ID NO: 2253847 - RNA, 17 nt, Yersinia pestis
ucgaguccguuaaaaaa

SEQ ID NO: 2253848 - RNA, 12 nt, Yersinia pestis
ucgaguuuauau

SEQ ID NO: 2253849 - RNA, 20 nt, Yersinia pestis
ucgauaaaaggcuauuuaaa

SEQ ID NO: 2253850 - RNA, 21 nt, Yersinia pestis
ucgauaaaaggcuauuuaaau

SEQ ID NO: 2253851 - RNA, 22 nt, Yersinia pestis
ucgauacaaaccguugcucagc

SEQ ID NO: 2253852 - RNA, 13 nt, Yersinia pestis
ucgauacaauuuu

SEQ ID NO: 2253853 - RNA, 15 nt, Yersinia pestis
ucgaucgcuuuuuac

SEQ ID NO: 2253854 - RNA, 18 nt, Yersinia pestis
ucgaugccuucuuucaaa

SEQ ID NO: 2253855 - RNA, 11 nt, Yersinia pestis
ucgauggcuuu

SEQ ID NO: 2253856 - RNA, 22 nt, Yersinia pestis
ucgaugggugaaagcuaauauu

SEQ ID NO: 2253857 - RNA, 20 nt, Yersinia pestis
ucgauucaucauaccuuacu

SEQ ID NO: 2253858 - RNA, 15 nt, Yersinia pestis
ucgauuuccauauua

SEQ ID NO: 2253859 - RNA, 14 nt, Yersinia pestis
ucgauuugcucuuu

SEQ ID NO: 2253860 - RNA, 13 nt, Yersinia pestis
ucgauuuuuauuu

SEQ ID NO: 2253861 - RNA, 21 nt, Yersinia pestis
ucgcacugauagcaaucccaa

SEQ ID NO: 2253862 - RNA, 16 nt, Yersinia pestis
ucgcacugaguucugc

SEQ ID NO: 2253863 - RNA, 22 nt, Yersinia pestis
ucgcacuucaagcagcaugugu

SEQ ID NO: 2253864 - RNA, 18 nt, Yersinia pestis
ucgcacuuuaaauaccca

SEQ ID NO: 2253865 - RNA, 22 nt, Yersinia pestis
ucgcacugugagcggcauccag

SEQ ID NO: 2253866 - RNA, 15 nt, Yersinia pestis
ucgcagaacccaggg

SEQ ID NO: 2253867 - RNA, 16 nt, Yersinia pestis
ucgcauaggccaauag

SEQ ID NO: 2253868 - RNA, 19 nt, Yersinia pestis
ucgcaccgaugucuaacaa

SEQ ID NO: 2253869 - RNA, 15 nt, Yersinia pestis
ucgcacaguuuucuu

SEQ ID NO: 2253870 - RNA, 13 nt, Yersinia pestis
ucgcaaaaugcca

SEQ ID NO: 2253871 - RNA, 21 nt, Yersinia pestis
ucgcaaccagcguugagaaga

SEQ ID NO: 2253872 - RNA, 23 nt, Yersinia pestis
uccggcaaaaacgccaucaauaa

SEQ ID NO: 2253873 - RNA, 15 nt, Yersinia pestis
uccgcuugcagcaac

SEQ ID NO: 2253874 - RNA, 19 nt, Yersinia pestis
uccggauuaaauucuaccu

SEQ ID NO: 2253875 - RNA, 20 nt, Yersinia pestis
uccgguaaagaagcauagaa

SEQ ID NO: 2253876 - RNA, 21 nt, Yersinia pestis
uccgggucaaacucagcgaau

SEQ ID NO: 2253877 - RNA, 15 nt, Yersinia pestis
uccgguacugugcug

SEQ ID NO: 2253878 - RNA, 13 nt, Yersinia pestis
uccgggacgcgcc

SEQ ID NO: 2253879 - RNA, 16 nt, Yersinia pestis
uccggcuaugccggag

SEQ ID NO: 2253880 - RNA, 16 nt, Yersinia pestis
uccgucuaccucgguu

SEQ ID NO: 2253881 - RNA, 16 nt, Yersinia pestis
uccgucuauccuauuc

SEQ ID NO: 2253882 - RNA, 12 nt, Yersinia pestis
uccgucgccaac

SEQ ID NO: 2253883 - RNA, 20 nt, Yersinia pestis
uccgucgcgggcacuuuguc

SEQ ID NO: 2253884 - RNA, 14 nt, Yersinia pestis
uccgugcugguccu

SEQ ID NO: 2253885 - RNA, 18 nt, Yersinia pestis
uccgugcugguccuuuug

SEQ ID NO: 2253886 - RNA, 19 nt, Yersinia pestis
uccguguuggcaaaaauaa

SEQ ID NO: 2253887 - RNA, 15 nt, Yersinia pestis
uccguuaucaucccu

SEQ ID NO: 2253888 - RNA, 14 nt, Yersinia pestis
uccguuuaaucagu

SEQ ID NO: 2253889 - RNA, 13 nt, Yersinia pestis
uccguugaaaccu

SEQ ID NO: 2253890 - RNA, 20 nt, Yersinia pestis
uccguaaaucauagccagcg

SEQ ID NO: 2253891 - RNA, 13 nt, Yersinia pestis
uccguaaaaaacc

SEQ ID NO: 2253892 - RNA, 15 nt, Yersinia pestis
uccggucugaagaga

SEQ ID NO: 2253893 - RNA, 14 nt, Yersinia pestis
uccucaaacccaca

SEQ ID NO: 2253894 - RNA, 13 nt, Yersinia pestis
uccucaccguuca

SEQ ID NO: 2253895 - RNA, 13 nt, Yersinia pestis
uccuauagcucag

SEQ ID NO: 2253896 - RNA, 15 nt, Yersinia pestis
uccuauauacaaggc

SEQ ID NO: 2253897 - RNA, 13 nt, Yersinia pestis
uccuauaaauuuu

SEQ ID NO: 2253898 - RNA, 15 nt, Yersinia pestis
uccuauaaauuuuaa

SEQ ID NO: 2253899 - RNA, 16 nt, Yersinia pestis
uccuauucagcagcau

SEQ ID NO: 2253900 - RNA, 14 nt, Yersinia pestis
uccuauucagcagc

SEQ ID NO: 2253901 - RNA, 19 nt, Yersinia pestis
uccuaaugaacacuuaauu

SEQ ID NO: 2253902 - RNA, 19 nt, Yersinia pestis
uccuaagguagugagauga

SEQ ID NO: 2253903 - RNA, 19 nt, Yersinia pestis
uccuacccuuugagaaagg

SEQ ID NO: 2253904 - RNA, 14 nt, Yersinia pestis
uccuacauucagua

SEQ ID NO: 2253905 - RNA, 12 nt, Yersinia pestis
uccuagaggcuu

SEQ ID NO: 2253906 - RNA, 21 nt, Yersinia pestis
uccuagcguuucuacaauggc

SEQ ID NO: 2253907 - RNA, 15 nt, Yersinia pestis
uccuggauauucaua

SEQ ID NO: 2253908 - RNA, 18 nt, Yersinia pestis
uccuggauauucauauuu

SEQ ID NO: 2253909 - RNA, 15 nt, Yersinia pestis
uccuggcgauccagu

SEQ ID NO: 2253910 - RNA, 19 nt, Yersinia pestis
uccuggccguguuuuuccc

SEQ ID NO: 2253911 - RNA, 21 nt, Yersinia pestis
uccuggcgguaauaaaucaug

SEQ ID NO: 2253912 - RNA, 15 nt, Yersinia pestis
uccuggcuauuuauu

SEQ ID NO: 2253913 - RNA, 19 nt, Yersinia pestis
uccuggaacgaagccgcag

SEQ ID NO: 2253914 - RNA, 20 nt, Yersinia pestis
uccuggaacgaagccgcaga

SEQ ID NO: 2253915 - RNA, 16 nt, Yersinia pestis
uccuggaaccagugaa

SEQ ID NO: 2253916 - RNA, 16 nt, Yersinia pestis
uccugcucaaacauga

SEQ ID NO: 2253917 - RNA, 16 nt, Yersinia pestis
uccugcaauaacacca

SEQ ID NO: 2253918 - RNA, 17 nt, Yersinia pestis
uccugcaaugcauaagc

SEQ ID NO: 2253919 - RNA, 20 nt, Yersinia pestis
uccugcauauuauuuugcac

SEQ ID NO: 2253920 - RNA, 20 nt, Yersinia pestis
uccugcgguggccagagcau

SEQ ID NO: 2253921 - RNA, 19 nt, Yersinia pestis
uccuuaccacugcucacuu

SEQ ID NO: 2253922 - RNA, 13 nt, Yersinia pestis
uccuuauacuaaa

SEQ ID NO: 2253923 - RNA, 14 nt, Yersinia pestis
uccuucaaguuguc

SEQ ID NO: 2253924 - RNA, 13 nt, Yersinia pestis
uccuucaauggca

SEQ ID NO: 2253925 - RNA, 23 nt, Yersinia pestis
uccuucacuuacucucuccgcaa

SEQ ID NO: 2253926 - RNA, 17 nt, Yersinia pestis
uccuucaguucuuuauc

SEQ ID NO: 2253927 - RNA, 15 nt, Yersinia pestis
uccuguugugguggc

SEQ ID NO: 2253928 - RNA, 21 nt, Yersinia pestis
uccuguugcuggccaguuuua

SEQ ID NO: 2253929 - RNA, 15 nt, Yersinia pestis
uccugugcaaagugc

SEQ ID NO: 2253930 - RNA, 11 nt, Yersinia pestis
uccuguauuuc

SEQ ID NO: 2253931 - RNA, 22 nt, Yersinia pestis
uccucugaauaaaaaauuauua

SEQ ID NO: 2253932 - RNA, 13 nt, Yersinia pestis
uccucugccuauc

SEQ ID NO: 2253933 - RNA, 14 nt, Yersinia pestis
uccucugccuaucc

SEQ ID NO: 2253934 - RNA, 17 nt, Yersinia pestis
uccucuuaugguagcaa

SEQ ID NO: 2253935 - RNA, 19 nt, Yersinia pestis
uccucuucuccguaagaca

SEQ ID NO: 2253936 - RNA, 23 nt, Yersinia pestis
uccucugccuauucucaccguuu

SEQ ID NO: 2253937 - RNA, 14 nt, Yersinia pestis
uccucuuucuuaau

SEQ ID NO: 2253938 - RNA, 17 nt, Yersinia pestis
uccucuuucuuaauaau

SEQ ID NO: 2253939 - RNA, 19 nt, Yersinia pestis
uccucuuucuuaauaauau

SEQ ID NO: 2253940 - RNA, 14 nt, Yersinia pestis
uccugaaauaaaga

SEQ ID NO: 2253941 - RNA, 13 nt, Yersinia pestis
uccugaaauaaag

SEQ ID NO: 2253942 - RNA, 19 nt, Yersinia pestis
uccugaucuucauugccuu

SEQ ID NO: 2253943 - RNA, 21 nt, Yersinia pestis
uccugauucgcgaccagcaga

SEQ ID NO: 2253944 - RNA, 17 nt, Yersinia pestis
uccugauuacucaggaa

SEQ ID NO: 2253945 - RNA, 18 nt, Yersinia pestis
uccugauauuccggugau

SEQ ID NO: 2253946 - RNA, 12 nt, Yersinia pestis
uccugaucaacu

SEQ ID NO: 2253947 - RNA, 16 nt, Yersinia pestis
uccugaucaacugcug

SEQ ID NO: 2253948 - RNA, 18 nt, Yersinia pestis
uccugaucuucauugccu

SEQ ID NO: 2253949 - RNA, 14 nt, Yersinia pestis
uccugauuuaaccu

SEQ ID NO: 2253950 - RNA, 14 nt, Yersinia pestis
uccugcaacgccuu

SEQ ID NO: 2253951 - RNA, 21 nt, Yersinia pestis
uccugaaucgccgaaaucuca

SEQ ID NO: 2253952 - RNA, 23 nt, Yersinia pestis
uccugaauaauacugucaaaauc

SEQ ID NO: 2253953 - RNA, 20 nt, Yersinia pestis
uccugacgaugauaaaucag

SEQ ID NO: 2253954 - RNA, 23 nt, Yersinia pestis
uccucggguuuuauaccggggcc

SEQ ID NO: 2253955 - RNA, 21 nt, Yersinia pestis
uccucuacguauuucgugauu

SEQ ID NO: 2253956 - RNA, 16 nt, Yersinia pestis
uccucuacgucaaucu

SEQ ID NO: 2253957 - RNA, 22 nt, Yersinia pestis
uccucuacgucaaucucaccgc

SEQ ID NO: 2253958 - RNA, 19 nt, Yersinia pestis
uccuccuuggggccucacu

SEQ ID NO: 2253959 - RNA, 18 nt, Yersinia pestis
uccucgccguagcauuca

SEQ ID NO: 2253960 - RNA, 18 nt, Yersinia pestis
uccuccugaucuucauug

SEQ ID NO: 2253961 - RNA, 21 nt, Yersinia pestis
uccuccauauccucaagaccg

SEQ ID NO: 2253962 - RNA, 12 nt, Yersinia pestis
uccucagccuuu

SEQ ID NO: 2253963 - RNA, 11 nt, Yersinia pestis
ucccagccacu

SEQ ID NO: 2253964 - RNA, 15 nt, Yersinia pestis
ucccagcacagccug

SEQ ID NO: 2253965 - RNA, 18 nt, Yersinia pestis
ucccacuuauuauaaagc

SEQ ID NO: 2253966 - RNA, 13 nt, Yersinia pestis
ucccaucccucac

SEQ ID NO: 2253967 - RNA, 13 nt, Yersinia pestis
ucccauacccacu

SEQ ID NO: 2253968 - RNA, 22 nt, Yersinia pestis
ucccauagcuggcuucaaaauc

SEQ ID NO: 2253969 - RNA, 14 nt, Yersinia pestis
ucccaguuuuuaau

SEQ ID NO: 2253970 - RNA, 16 nt, Yersinia pestis
ucccagucgucuucag

SEQ ID NO: 2253971 - RNA, 14 nt, Yersinia pestis
ucccaggccuccgc

SEQ ID NO: 2253972 - RNA, 14 nt, Yersinia pestis
ucccauuaauuaau

SEQ ID NO: 2253973 - RNA, 15 nt, Yersinia pestis
ucccauuaauuaauc

SEQ ID NO: 2253974 - RNA, 16 nt, Yersinia pestis
ucccauucaccguguu

SEQ ID NO: 2253975 - RNA, 14 nt, Yersinia pestis
ucccauuuauggca

SEQ ID NO: 2253976 - RNA, 15 nt, Yersinia pestis
uccccacucaaaauu

SEQ ID NO: 2253977 - RNA, 18 nt, Yersinia pestis
uccccacggcgacguuca

SEQ ID NO: 2253978 - RNA, 15 nt, Yersinia pestis
uccccagaacagcua

SEQ ID NO: 2253979 - RNA, 16 nt, Yersinia pestis
uccccaacucuuucaa

SEQ ID NO: 2253980 - RNA, 13 nt, Yersinia pestis
uccccaacucuuu

SEQ ID NO: 2253981 - RNA, 20 nt, Yersinia pestis
uccccaccauugcaaacauc

SEQ ID NO: 2253982 - RNA, 21 nt, Yersinia pestis
uccccauaagcgggguauuuu

SEQ ID NO: 2253983 - RNA, 17 nt, Yersinia pestis
ucccccacgaucuccuc

SEQ ID NO: 2253984 - RNA, 23 nt, Yersinia pestis
ucccccauggggccaccuaaucc

SEQ ID NO: 2253985 - RNA, 21 nt, Yersinia pestis
ucccgauaauuauaaauuccu

SEQ ID NO: 2253986 - RNA, 18 nt, Yersinia pestis
ucccgauacucauugcac

SEQ ID NO: 2253987 - RNA, 19 nt, Yersinia pestis
uccccuaauucuccuuucu

SEQ ID NO: 2253988 - RNA, 14 nt, Yersinia pestis
uccccucagagaca

SEQ ID NO: 2253989 - RNA, 16 nt, Yersinia pestis
uccccuaauucuccuu

SEQ ID NO: 2253990 - RNA, 20 nt, Yersinia pestis
uccccggcaucccaccuuca

SEQ ID NO: 2253991 - RNA, 20 nt, Yersinia pestis
ucccgucagguucaauuccc

SEQ ID NO: 2253992 - RNA, 20 nt, Yersinia pestis
ucccgugccagauccucuuu

SEQ ID NO: 2253993 - RNA, 23 nt, Yersinia pestis
ucccgugugauuuccaucuagcu

SEQ ID NO: 2253994 - RNA, 16 nt, Yersinia pestis
ucccgguugcgauaca

SEQ ID NO: 2253995 - RNA, 17 nt, Yersinia pestis
ucccguaggccuuaacc

SEQ ID NO: 2253996 - RNA, 15 nt, Yersinia pestis
ucccgggaauaauca

SEQ ID NO: 2253997 - RNA, 13 nt, Yersinia pestis
ucccgcuggaagu

SEQ ID NO: 2253998 - RNA, 19 nt, Yersinia pestis
ucccgcuggaagucugcuu

SEQ ID NO: 2253999 - RNA, 14 nt, Yersinia pestis
ucccuuuccucucu

SEQ ID NO: 2254000 - RNA, 16 nt, Yersinia pestis
uccgaaaaauauucuc

SEQ ID NO: 2254001 - RNA, 22 nt, Yersinia pestis
uccgaauuaucauauucaucaa

SEQ ID NO: 2254002 - RNA, 18 nt, Yersinia pestis
aaaucucuugauuaccaa

SEQ ID NO: 2254003 - RNA, 18 nt, Yersinia pestis
aaaucuggauaaugucgu

SEQ ID NO: 2254004 - RNA, 19 nt, Yersinia pestis
aaaucugcuccaucaauaa

SEQ ID NO: 2254005 - RNA, 12 nt, Yersinia pestis
aaaucugcuccc

SEQ ID NO: 2254006 - RNA, 19 nt, Yersinia pestis
aaaucuggaauaggggaaa

SEQ ID NO: 2254007 - RNA, 21 nt, Yersinia pestis
aaaucugacucuguaaaaauc

SEQ ID NO: 2254008 - RNA, 19 nt, Yersinia pestis
uccgagccuguugaaaccu

SEQ ID NO: 2254009 - RNA, 11 nt, Yersinia pestis
ucccucggcuu

SEQ ID NO: 2254010 - RNA, 15 nt, Yersinia pestis
ucccugaacgccuug

SEQ ID NO: 2254011 - RNA, 21 nt, Yersinia pestis
ucccucuguauugauccccaa

SEQ ID NO: 2254012 - RNA, 12 nt, Yersinia pestis
ucccucagugag

SEQ ID NO: 2254013 - RNA, 19 nt, Yersinia pestis
ucccucaccgccauuuacu

SEQ ID NO: 2254014 - RNA, 20 nt, Yersinia pestis
ucccucaauagcuaauaauu

SEQ ID NO: 2254015 - RNA, 18 nt, Yersinia pestis
ucccuacgggaaauaacu

SEQ ID NO: 2254016 - RNA, 21 nt, Yersinia pestis
ucccuacgguaccgcagguca

SEQ ID NO: 2254017 - RNA, 21 nt, Yersinia pestis
uccgcagugauauuauuuauu

SEQ ID NO: 2254018 - RNA, 17 nt, Yersinia pestis
uccgccaaggccagcgc

SEQ ID NO: 2254019 - RNA, 16 nt, Yersinia pestis
uccgcacggcuacugc

SEQ ID NO: 2254020 - RNA, 13 nt, Yersinia pestis
uccgcaggaagca

SEQ ID NO: 2254021 - RNA, 21 nt, Yersinia pestis
uccgcagcuaauguuggcaac

SEQ ID NO: 2254022 - RNA, 24 nt, Yersinia pestis
uccgccagcaaguuaucaaucaga

SEQ ID NO: 2254023 - RNA, 14 nt, Yersinia pestis
uccgcaauagccaa

SEQ ID NO: 2254024 - RNA, 15 nt, Yersinia pestis
uccgaguuauugaua

SEQ ID NO: 2254025 - RNA, 15 nt, Yersinia pestis
uccgcuauuuuccac

SEQ ID NO: 2254026 - RNA, 19 nt, Yersinia pestis
uccgcuccugauuuaaccu

SEQ ID NO: 2254027 - RNA, 15 nt, Yersinia pestis
uccgcccucuugcug

SEQ ID NO: 2254028 - RNA, 17 nt, Yersinia pestis
uccgccuguuuucaggc

SEQ ID NO: 2254029 - RNA, 22 nt, Yersinia pestis
uccgccucuuuuuccacacccu

SEQ ID NO: 2254030 - RNA, 23 nt, Yersinia pestis
uccgccugaccgacgagggcuuc

SEQ ID NO: 2254031 - RNA, 20 nt, Yersinia pestis
uccauuccguuauuaaacag

SEQ ID NO: 2254032 - RNA, 18 nt, Yersinia pestis
uccauuuucaucguauga

SEQ ID NO: 2254033 - RNA, 20 nt, Yersinia pestis
uccauuguauugcucagggc

SEQ ID NO: 2254034 - RNA, 17 nt, Yersinia pestis
uccauuuuauuuaacgu

SEQ ID NO: 2254035 - RNA, 17 nt, Yersinia pestis
uccauuucaaucacugc

SEQ ID NO: 2254036 - RNA, 14 nt, Yersinia pestis
ucccaaugaauauu

SEQ ID NO: 2254037 - RNA, 19 nt, Yersinia pestis
ucccaagaaaagcaccgca

SEQ ID NO: 2254038 - RNA, 15 nt, Yersinia pestis
ucccaacggcagaag

SEQ ID NO: 2254039 - RNA, 15 nt, Yersinia pestis
ucccaaacucuggau

SEQ ID NO: 2254040 - RNA, 23 nt, Yersinia pestis
uccaucuaauagaauagauccca

SEQ ID NO: 2254041 - RNA, 17 nt, Yersinia pestis
uccaugacacauauuuc

SEQ ID NO: 2254042 - RNA, 22 nt, Yersinia pestis
uccaugacacauauuucaggcu

SEQ ID NO: 2254043 - RNA, 16 nt, Yersinia pestis
uccaugacacauauuu

SEQ ID NO: 2254044 - RNA, 13 nt, Yersinia pestis
uccaucccugggu

SEQ ID NO: 2254045 - RNA, 11 nt, Yersinia pestis
uccaucaggaa

SEQ ID NO: 2254046 - RNA, 21 nt, Yersinia pestis
uccaucacgcagcuuuuucuc

SEQ ID NO: 2254047 - RNA, 18 nt, Yersinia pestis
uccauuagcguauuaaac

SEQ ID NO: 2254048 - RNA, 15 nt, Yersinia pestis
uccauuacagcaccu

SEQ ID NO: 2254049 - RNA, 18 nt, Yersinia pestis
uccauguucucuccuaaa

SEQ ID NO: 2254050 - RNA, 15 nt, Yersinia pestis
uccauguaggcucga

SEQ ID NO: 2254051 - RNA, 13 nt, Yersinia pestis
uccauguaggcuc

SEQ ID NO: 2254052 - RNA, 14 nt, Yersinia pestis
uccaugcaaaauau

SEQ ID NO: 2254053 - RNA, 22 nt, Yersinia pestis
uccaugccagcccaucaccauu

SEQ ID NO: 2254054 - RNA, 13 nt, Yersinia pestis
uccauggcugaga

SEQ ID NO: 2254055 - RNA, 21 nt, Yersinia pestis
uccauagaugcaaaugucaga

SEQ ID NO: 2254056 - RNA, 22 nt, Yersinia pestis
uccauagaugcaaaugucagau

SEQ ID NO: 2254057 - RNA, 12 nt, Yersinia pestis
uccauauuuaau

SEQ ID NO: 2254058 - RNA, 15 nt, Yersinia pestis
uccauauagccccaa

SEQ ID NO: 2254059 - RNA, 17 nt, Yersinia pestis
uccaguaaaagaauaaa

SEQ ID NO: 2254060 - RNA, 13 nt, Yersinia pestis
uccaguaaaaaaa

SEQ ID NO: 2254061 - RNA, 14 nt, Yersinia pestis
uccaguaaaaaaau

SEQ ID NO: 2254062 - RNA, 22 nt, Yersinia pestis
uccaguaaaagaauaaauguca

SEQ ID NO: 2254063 - RNA, 14 nt, Yersinia pestis
uccaguaacggccu

SEQ ID NO: 2254064 - RNA, 14 nt, Yersinia pestis
uccagugccaaaau

SEQ ID NO: 2254065 - RNA, 16 nt, Yersinia pestis
uccagugcaaauuuau

SEQ ID NO: 2254066 - RNA, 22 nt, Yersinia pestis
uccagugauaaguuggaggcgu

SEQ ID NO: 2254067 - RNA, 15 nt, Yersinia pestis
uccagugaaaucauc

SEQ ID NO: 2254068 - RNA, 16 nt, Yersinia pestis
uccaggucaaucaauu

SEQ ID NO: 2254069 - RNA, 13 nt, Yersinia pestis
uccagaagccauu

SEQ ID NO: 2254070 - RNA, 12 nt, Yersinia pestis
uccacuuucacc

SEQ ID NO: 2254071 - RNA, 20 nt, Yersinia pestis
uccacuugugguaaccccgu

SEQ ID NO: 2254072 - RNA, 17 nt, Yersinia pestis
uccacuuuuucucuccu

SEQ ID NO: 2254073 - RNA, 21 nt, Yersinia pestis
uccacuuuucagauagcccau

SEQ ID NO: 2254074 - RNA, 13 nt, Yersinia pestis
uccagaacaccaa

SEQ ID NO: 2254075 - RNA, 18 nt, Yersinia pestis
uccaggacauccagcggu

SEQ ID NO: 2254076 - RNA, 20 nt, Yersinia pestis
uccagcguaaacaguagcag

SEQ ID NO: 2254077 - RNA, 23 nt, Yersinia pestis
uccagcgguguuaccagacccug

SEQ ID NO: 2254078 - RNA, 16 nt, Yersinia pestis
uccagcgccaucagcg

SEQ ID NO: 2254079 - RNA, 19 nt, Yersinia pestis
uccagcgccuguuccaacg

SEQ ID NO: 2254080 - RNA, 16 nt, Yersinia pestis
uccagcgcuuccagcg

SEQ ID NO: 2254081 - RNA, 23 nt, Yersinia pestis
uccaaugaauaucuugcauacaa

SEQ ID NO: 2254082 - RNA, 23 nt, Yersinia pestis
uccaaucuugguuaauagcauuu

SEQ ID NO: 2254083 - RNA, 22 nt, Yersinia pestis
uccaaugacuauucccuuguuu

SEQ ID NO: 2254084 - RNA, 23 nt, Yersinia pestis
uccaagcacacugguugaaaccu

SEQ ID NO: 2254085 - RNA, 23 nt, Yersinia pestis
uccaauaaugccgaaugauucau

SEQ ID NO: 2254086 - RNA, 12 nt, Yersinia pestis
uccaauaacuaa

SEQ ID NO: 2254087 - RNA, 20 nt, Yersinia pestis
uccaauaagucacuuuccuu

SEQ ID NO: 2254088 - RNA, 12 nt, Yersinia pestis
uccaagaugaua

SEQ ID NO: 2254089 - RNA, 14 nt, Yersinia pestis
uccaagaugauaaa

SEQ ID NO: 2254090 - RNA, 14 nt, Yersinia pestis
uccaagacggacgu

SEQ ID NO: 2254091 - RNA, 15 nt, Yersinia pestis
uccaacuuuucauug

SEQ ID NO: 2254092 - RNA, 14 nt, Yersinia pestis
uccaacuucuucca

SEQ ID NO: 2254093 - RNA, 22 nt, Yersinia pestis
uccaacuucgcacgcccaucaa

SEQ ID NO: 2254094 - RNA, 17 nt, Yersinia pestis
uccaacugauaauucag

SEQ ID NO: 2254095 - RNA, 14 nt, Yersinia pestis
uccaacugacgcca

SEQ ID NO: 2254096 - RNA, 20 nt, Yersinia pestis
uccaaccagagauuguuuuc

SEQ ID NO: 2254097 - RNA, 23 nt, Yersinia pestis
uccaacccgcacguucagcagcg

SEQ ID NO: 2254098 - RNA, 17 nt, Yersinia pestis
uccaacgcacaccccca

SEQ ID NO: 2254099 - RNA, 17 nt, Yersinia pestis
uccaacgcacugguugc

SEQ ID NO: 2254100 - RNA, 16 nt, Yersinia pestis
uccaacguaaacauug

SEQ ID NO: 2254101 - RNA, 18 nt, Yersinia pestis
uccaacucauuacucagc

SEQ ID NO: 2254102 - RNA, 16 nt, Yersinia pestis
uccaacucaccauuua

SEQ ID NO: 2254103 - RNA, 15 nt, Yersinia pestis
uccaacucaccuaaa

SEQ ID NO: 2254104 - RNA, 16 nt, Yersinia pestis
uccaauucauaauagc

SEQ ID NO: 2254105 - RNA, 18 nt, Yersinia pestis
uccacaagcguucgagga

SEQ ID NO: 2254106 - RNA, 13 nt, Yersinia pestis
uccacacccgcca

SEQ ID NO: 2254107 - RNA, 17 nt, Yersinia pestis
uccacgcccaacucuuu

SEQ ID NO: 2254108 - RNA, 19 nt, Yersinia pestis
uccacgcugaaacuuuuca

SEQ ID NO: 2254109 - RNA, 22 nt, Yersinia pestis
uccacgcugaaacuuuucaguu

SEQ ID NO: 2254110 - RNA, 22 nt, Yersinia pestis
uccacgcuuuaagcuaauucug

SEQ ID NO: 2254111 - RNA, 21 nt, Yersinia pestis
uccacgcuuuaagcuaauucu

SEQ ID NO: 2254112 - RNA, 15 nt, Yersinia pestis
uccacgggcucaugc

SEQ ID NO: 2254113 - RNA, 19 nt, Yersinia pestis
uccacuagcaucacccgcc

SEQ ID NO: 2254114 - RNA, 23 nt, Yersinia pestis
uccacguuuguagcaaacccaca

SEQ ID NO: 2254115 - RNA, 19 nt, Yersinia pestis
uccacgugcuuacuggccu

SEQ ID NO: 2254116 - RNA, 20 nt, Yersinia pestis
uccacgugcuuacuggccug

SEQ ID NO: 2254117 - RNA, 19 nt, Yersinia pestis
ucauuguagauggccaucu

SEQ ID NO: 2254118 - RNA, 13 nt, Yersinia pestis
ucauugcccccuu

SEQ ID NO: 2254119 - RNA, 21 nt, Yersinia pestis
ucauugauauuaacuggucua

SEQ ID NO: 2254120 - RNA, 16 nt, Yersinia pestis
ucauuuuccugcauau

SEQ ID NO: 2254121 - RNA, 20 nt, Yersinia pestis
ucauuugaccuccguaggcc

SEQ ID NO: 2254122 - RNA, 13 nt, Yersinia pestis
ucauuuaauuaaa

SEQ ID NO: 2254123 - RNA, 16 nt, Yersinia pestis
ucauuuaauuaaauga

SEQ ID NO: 2254124 - RNA, 22 nt, Yersinia pestis
uccaaagcaccaacuaagcaga

SEQ ID NO: 2254125 - RNA, 15 nt, Yersinia pestis
uccaaacuuugugga

SEQ ID NO: 2254126 - RNA, 18 nt, Yersinia pestis
ucauuuuuaaguggcauc

SEQ ID NO: 2254127 - RNA, 19 nt, Yersinia pestis
ucauuuuccugcauauuau

SEQ ID NO: 2254128 - RNA, 13 nt, Yersinia pestis
ucaguugaaaccc

SEQ ID NO: 2254129 - RNA, 23 nt, Yersinia pestis
ucaguguuucuauuuucagcaua

SEQ ID NO: 2254130 - RNA, 14 nt, Yersinia pestis
ucaguuuagcgaga

SEQ ID NO: 2254131 - RNA, 15 nt, Yersinia pestis
ucaguuuacaugauu

SEQ ID NO: 2254132 - RNA, 18 nt, Yersinia pestis
ucaguugugggucgccuu

SEQ ID NO: 2254133 - RNA, 17 nt, Yersinia pestis
ucauuaaaaaauaauuu

SEQ ID NO: 2254134 - RNA, 13 nt, Yersinia pestis
ucauuaaaaccac

SEQ ID NO: 2254135 - RNA, 18 nt, Yersinia pestis
ucauuacucagcuuggua

SEQ ID NO: 2254136 - RNA, 13 nt, Yersinia pestis
ucauuagucugag

SEQ ID NO: 2254137 - RNA, 15 nt, Yersinia pestis
ucauucaugaggcuc

SEQ ID NO: 2254138 - RNA, 11 nt, Yersinia pestis
ucauuaucaug

SEQ ID NO: 2254139 - RNA, 21 nt, Yersinia pestis
ucauucccgauaauuauaaau

SEQ ID NO: 2254140 - RNA, 17 nt, Yersinia pestis
ucauuccgccuguuuuc

SEQ ID NO: 2254141 - RNA, 14 nt, Yersinia pestis
ucauuccgccuguu

SEQ ID NO: 2254142 - RNA, 20 nt, Yersinia pestis
ucauugaggguugucagcag

SEQ ID NO: 2254143 - RNA, 23 nt, Yersinia pestis
ucauugaggagcgauaacauuuu

SEQ ID NO: 2254144 - RNA, 12 nt, Yersinia pestis
ugaugauaucac

SEQ ID NO: 2254145 - RNA, 21 nt, Yersinia pestis
ugaugaugagaaguaaaacgu

SEQ ID NO: 2254146 - RNA, 16 nt, Yersinia pestis
ugaugagcuguagaac

SEQ ID NO: 2254147 - RNA, 15 nt, Yersinia pestis
ugaugacuuuuauua

SEQ ID NO: 2254148 - RNA, 16 nt, Yersinia pestis
ugaugacuauccucgu

SEQ ID NO: 2254149 - RNA, 22 nt, Yersinia pestis
ugaugacgccguacaaauauaa

SEQ ID NO: 2254150 - RNA, 14 nt, Yersinia pestis
ugaugaugagcgca

SEQ ID NO: 2254151 - RNA, 23 nt, Yersinia pestis
ugauuguuuuuauuacagaguaa

SEQ ID NO: 2254152 - RNA, 17 nt, Yersinia pestis
ugauuguugugcauaua

SEQ ID NO: 2254153 - RNA, 12 nt, Yersinia pestis
ugauuuaaauau

SEQ ID NO: 2254154 - RNA, 15 nt, Yersinia pestis
ugauugcaucaucag

SEQ ID NO: 2254155 - RNA, 13 nt, Yersinia pestis
ugauugauuauca

SEQ ID NO: 2254156 - RNA, 18 nt, Yersinia pestis
ugauucgggugagugagc

SEQ ID NO: 2254157 - RNA, 19 nt, Yersinia pestis
ugauucgguuauucuucua

SEQ ID NO: 2254158 - RNA, 14 nt, Yersinia pestis
ugauuuuuuucaug

SEQ ID NO: 2254159 - RNA, 22 nt, Yersinia pestis
ugcaaaaaaagacacuaaccag

SEQ ID NO: 2254160 - RNA, 14 nt, Yersinia pestis
ugauuuuuauauuu

SEQ ID NO: 2254161 - RNA, 11 nt, Yersinia pestis
ugauuuuuaac

SEQ ID NO: 2254162 - RNA, 14 nt, Yersinia pestis
ugauuuuguagaau

SEQ ID NO: 2254163 - RNA, 17 nt, Yersinia pestis
ugauuuuagccucugua

SEQ ID NO: 2254164 - RNA, 19 nt, Yersinia pestis
ugcaaaucauaagugcauu

SEQ ID NO: 2254165 - RNA, 21 nt, Yersinia pestis
ugcaaaauacaaaguaaacuu

SEQ ID NO: 2254166 - RNA, 21 nt, Yersinia pestis
ugcaaaauuccaccauucuca

SEQ ID NO: 2254167 - RNA, 16 nt, Yersinia pestis
ugcaaaaucguuaccg

SEQ ID NO: 2254168 - RNA, 23 nt, Yersinia pestis
ugcaacagauaauuggcaauaau

SEQ ID NO: 2254169 - RNA, 14 nt, Yersinia pestis
ugcaaccaacacca

SEQ ID NO: 2254170 - RNA, 14 nt, Yersinia pestis
ugcaaauggcaggg

SEQ ID NO: 2254171 - RNA, 14 nt, Yersinia pestis
ugcaaauuuaucca

SEQ ID NO: 2254172 - RNA, 21 nt, Yersinia pestis
ugcaaauuuaugcgcuuucuc

SEQ ID NO: 2254173 - RNA, 23 nt, Yersinia pestis
ugcaaauuuaugcgcuuucucga

SEQ ID NO: 2254174 - RNA, 14 nt, Yersinia pestis
ugcaacaacgccag

SEQ ID NO: 2254175 - RNA, 17 nt, Yersinia pestis
ugcaagccguaauucag

SEQ ID NO: 2254176 - RNA, 21 nt, Yersinia pestis
ugcaagcccccaaaguagaac

SEQ ID NO: 2254177 - RNA, 16 nt, Yersinia pestis
ugcaagcaauguucaa

SEQ ID NO: 2254178 - RNA, 13 nt, Yersinia pestis
ugcaacuggcauu

SEQ ID NO: 2254179 - RNA, 15 nt, Yersinia pestis
ugcaacgcaggcacu

SEQ ID NO: 2254180 - RNA, 14 nt, Yersinia pestis
ugcaacgccaauga

SEQ ID NO: 2254181 - RNA, 23 nt, Yersinia pestis
ugcaauuaauuggcccauaacaa

SEQ ID NO: 2254182 - RNA, 20 nt, Yersinia pestis
ugcaauuuuuagccaaauag

SEQ ID NO: 2254183 - RNA, 14 nt, Yersinia pestis
ugcaaugcccagag

SEQ ID NO: 2254184 - RNA, 17 nt, Yersinia pestis
ugcaauggcuggcaagg

SEQ ID NO: 2254185 - RNA, 15 nt, Yersinia pestis
ugcaaucgcauugcg

SEQ ID NO: 2254186 - RNA, 12 nt, Yersinia pestis
ugcaaucaugau

SEQ ID NO: 2254187 - RNA, 16 nt, Yersinia pestis
ugcaaucuaacuaaua

SEQ ID NO: 2254188 - RNA, 18 nt, Yersinia pestis
ugcaauagcucauuuuaa

SEQ ID NO: 2254189 - RNA, 13 nt, Yersinia pestis
ugcaauagcucau

SEQ ID NO: 2254190 - RNA, 16 nt, Yersinia pestis
ugcaauagcuagcccc

SEQ ID NO: 2254191 - RNA, 14 nt, Yersinia pestis
ugcaauaagccaga

SEQ ID NO: 2254192 - RNA, 15 nt, Yersinia pestis
ugcaauaacaccagc

SEQ ID NO: 2254193 - RNA, 14 nt, Yersinia pestis
ugcaauaacaccag

SEQ ID NO: 2254194 - RNA, 23 nt, Yersinia pestis
ugcaaguguaugaguaucaauau

SEQ ID NO: 2254195 - RNA, 24 nt, Yersinia pestis
ugcaaguguaugaguaucaauauu

SEQ ID NO: 2254196 - RNA, 14 nt, Yersinia pestis
ugcagcuaaacacg

SEQ ID NO: 2254197 - RNA, 21 nt, Yersinia pestis
ugcagccguuccuuggcuaua

SEQ ID NO: 2254198 - RNA, 19 nt, Yersinia pestis
ugcagaucggcauuauuau

SEQ ID NO: 2254199 - RNA, 20 nt, Yersinia pestis
ugcagcaacaggguauuggc

SEQ ID NO: 2254200 - RNA, 23 nt, Yersinia pestis
ugcagauuuuugcuuuccacgcc

SEQ ID NO: 2254201 - RNA, 16 nt, Yersinia pestis
ugcagaucaaucgcau

SEQ ID NO: 2254202 - RNA, 21 nt, Yersinia pestis
ugcagaucaaucgcauuguca

SEQ ID NO: 2254203 - RNA, 20 nt, Yersinia pestis
ugcacgugaggauucaagaa

SEQ ID NO: 2254204 - RNA, 19 nt, Yersinia pestis
ugcaccuaacaaacguuca

SEQ ID NO: 2254205 - RNA, 20 nt, Yersinia pestis
ugcaccucugcugaugucag

SEQ ID NO: 2254206 - RNA, 14 nt, Yersinia pestis
ugcaccguaacuuc

SEQ ID NO: 2254207 - RNA, 23 nt, Yersinia pestis
ugcaccgcugauaaccagcagcu

SEQ ID NO: 2254208 - RNA, 13 nt, Yersinia pestis
ugcacaccaucag

SEQ ID NO: 2254209 - RNA, 23 nt, Yersinia pestis
ugcacaaauaugaagaugcuuca

SEQ ID NO: 2254210 - RNA, 16 nt, Yersinia pestis
ugcacagcauuuaugc

SEQ ID NO: 2254211 - RNA, 18 nt, Yersinia pestis
ugcacaguugucugaggc

SEQ ID NO: 2254212 - RNA, 14 nt, Yersinia pestis
ugcacaucaaguac

SEQ ID NO: 2254213 - RNA, 21 nt, Yersinia pestis
ugcacaucaaguacuucaauu

SEQ ID NO: 2254214 - RNA, 20 nt, Yersinia pestis
ugcacagguaguaagcaugc

SEQ ID NO: 2254215 - RNA, 17 nt, Yersinia pestis
ugcauuuaugaugcauu

SEQ ID NO: 2254216 - RNA, 21 nt, Yersinia pestis
ugcauuucaauucguucaaau

SEQ ID NO: 2254217 - RNA, 23 nt, Yersinia pestis
ugccaaucgcucugcguuuuucc

SEQ ID NO: 2254218 - RNA, 13 nt, Yersinia pestis
ugccaauauugcc

SEQ ID NO: 2254219 - RNA, 22 nt, Yersinia pestis
ugccaauuccauauuuaaugua

SEQ ID NO: 2254220 - RNA, 18 nt, Yersinia pestis
ugccaaugccucuucaau

SEQ ID NO: 2254221 - RNA, 20 nt, Yersinia pestis
ugccaaugccucuucaauac

SEQ ID NO: 2254222 - RNA, 17 nt, Yersinia pestis
ugcaucgucaugauuga

SEQ ID NO: 2254223 - RNA, 20 nt, Yersinia pestis
ugcaucuggugacccgucag

SEQ ID NO: 2254224 - RNA, 19 nt, Yersinia pestis
ugcaucaucacauucaaac

SEQ ID NO: 2254225 - RNA, 21 nt, Yersinia pestis
ugcauuaucuuuaauuuuucc

SEQ ID NO: 2254226 - RNA, 22 nt, Yersinia pestis
ugcauuaucuuuaauuuuuccc

SEQ ID NO: 2254227 - RNA, 18 nt, Yersinia pestis
ugcauucaucaugcuguc

SEQ ID NO: 2254228 - RNA, 13 nt, Yersinia pestis
ugcauaaaaauag

SEQ ID NO: 2254229 - RNA, 19 nt, Yersinia pestis
ugcaguuucuaccgcuuca

SEQ ID NO: 2254230 - RNA, 14 nt, Yersinia pestis
ugcauaaucgcguu

SEQ ID NO: 2254231 - RNA, 19 nt, Yersinia pestis
ugcauagcgugauuuuuau

SEQ ID NO: 2254232 - RNA, 18 nt, Yersinia pestis
ugcauacucaggcccuga

SEQ ID NO: 2254233 - RNA, 15 nt, Yersinia pestis
ugcauaauggacgaa

SEQ ID NO: 2254234 - RNA, 22 nt, Yersinia pestis
ugcaguuaagguuagcuaugca

SEQ ID NO: 2254235 - RNA, 14 nt, Yersinia pestis
ugcaguuaaugaca

SEQ ID NO: 2254236 - RNA, 19 nt, Yersinia pestis
ugcaguuaaugacauaucu

SEQ ID NO: 2254237 - RNA, 16 nt, Yersinia pestis
ugcaguaucuggguga

SEQ ID NO: 2254238 - RNA, 16 nt, Yersinia pestis
ugcaguagggcgcuga

SEQ ID NO: 2254239 - RNA, 17 nt, Yersinia pestis
ugcaguagggcgcugau

SEQ ID NO: 2254240 - RNA, 14 nt, Yersinia pestis
ugcaguacagauaa

SEQ ID NO: 2254241 - RNA, 13 nt, Yersinia pestis
ugcaguaaccagu

SEQ ID NO: 2254242 - RNA, 17 nt, Yersinia pestis
ugcagguuuugccagau

SEQ ID NO: 2254243 - RNA, 12 nt, Yersinia pestis
ugcaguaaaaau

SEQ ID NO: 2254244 - RNA, 11 nt, Yersinia pestis
ugcagcucaau

SEQ ID NO: 2254245 - RNA, 22 nt, Yersinia pestis
ugcagcucaaagaccacaucaa

SEQ ID NO: 2254246 - RNA, 19 nt, Yersinia pestis
ugaguggacgauaaauuca

SEQ ID NO: 2254247 - RNA, 14 nt, Yersinia pestis
ugagugaucauauu

SEQ ID NO: 2254248 - RNA, 17 nt, Yersinia pestis
ugaggcuaccugcacca

SEQ ID NO: 2254249 - RNA, 13 nt, Yersinia pestis
ugagggcaauuaa

SEQ ID NO: 2254250 - RNA, 12 nt, Yersinia pestis
ugaggcugaggu

SEQ ID NO: 2254251 - RNA, 15 nt, Yersinia pestis
ugaggguugucagca

SEQ ID NO: 2254252 - RNA, 17 nt, Yersinia pestis
ugaggguugucagcagu

SEQ ID NO: 2254253 - RNA, 18 nt, Yersinia pestis
ugaggguugucagcaguc

SEQ ID NO: 2254254 - RNA, 22 nt, Yersinia pestis
ugaggguugucagcagucugaa

SEQ ID NO: 2254255 - RNA, 23 nt, Yersinia pestis
ugaggguaagugaauaccgcuaa

SEQ ID NO: 2254256 - RNA, 22 nt, Yersinia pestis
ugauaaaacuauucugcuugga

SEQ ID NO: 2254257 - RNA, 14 nt, Yersinia pestis
ugauaaaaaucaau

SEQ ID NO: 2254258 - RNA, 15 nt, Yersinia pestis
ugauaaaaaucaaua

SEQ ID NO: 2254259 - RNA, 21 nt, Yersinia pestis
ugauaaacccuacagcaaaca

SEQ ID NO: 2254260 - RNA, 16 nt, Yersinia pestis
ugauaaacaauaaaca

SEQ ID NO: 2254261 - RNA, 23 nt, Yersinia pestis
ugagugugccuuggucucagaac

SEQ ID NO: 2254262 - RNA, 20 nt, Yersinia pestis
ugaguuacgugagcaucugg

SEQ ID NO: 2254263 - RNA, 12 nt, Yersinia pestis
ugaguuccagcc

SEQ ID NO: 2254264 - RNA, 13 nt, Yersinia pestis
ugaguuaucuccu

SEQ ID NO: 2254265 - RNA, 16 nt, Yersinia pestis
ugaguuaucuccugua

SEQ ID NO: 2254266 - RNA, 17 nt, Yersinia pestis
ugaguuaucuguuucaa

SEQ ID NO: 2254267 - RNA, 22 nt, Yersinia pestis
ugagaucauauuguuaauuuuu

SEQ ID NO: 2254268 - RNA, 16 nt, Yersinia pestis
ugagauuuagaugugc

SEQ ID NO: 2254269 - RNA, 20 nt, Yersinia pestis
ugagcaagggcagcuaaccc

SEQ ID NO: 2254270 - RNA, 18 nt, Yersinia pestis
ugagcgguugaaaaguuu

SEQ ID NO: 2254271 - RNA, 15 nt, Yersinia pestis
ugaggauaggcagaa

SEQ ID NO: 2254272 - RNA, 20 nt, Yersinia pestis
ugaggauaggcagaggagua

SEQ ID NO: 2254273 - RNA, 15 nt, Yersinia pestis
ugaggauaggcagag

SEQ ID NO: 2254274 - RNA, 18 nt, Yersinia pestis
ugagcguucaaaaucaaa

SEQ ID NO: 2254275 - RNA, 13 nt, Yersinia pestis
ugauaggcacggc

SEQ ID NO: 2254276 - RNA, 14 nt, Yersinia pestis
ugauaggucauaua

SEQ ID NO: 2254277 - RNA, 14 nt, Yersinia pestis
ugauagguuuuucc

SEQ ID NO: 2254278 - RNA, 23 nt, Yersinia pestis
ugauagcgacacccucagaggcc

SEQ ID NO: 2254279 - RNA, 21 nt, Yersinia pestis
ugauagccacaucauuaccca

SEQ ID NO: 2254280 - RNA, 15 nt, Yersinia pestis
ugauauaaagcauuu

SEQ ID NO: 2254281 - RNA, 14 nt, Yersinia pestis
ugauauaagcagca

SEQ ID NO: 2254282 - RNA, 22 nt, Yersinia pestis
ugauauaagcagcaccaauauc

SEQ ID NO: 2254283 - RNA, 15 nt, Yersinia pestis
ugauaauaauauuga

SEQ ID NO: 2254284 - RNA, 15 nt, Yersinia pestis
ugauacccagcaggu

SEQ ID NO: 2254285 - RNA, 20 nt, Yersinia pestis
ugauagaaaguugagcagca

SEQ ID NO: 2254286 - RNA, 20 nt, Yersinia pestis
ugauacggccuauuucuuga

SEQ ID NO: 2254287 - RNA, 22 nt, Yersinia pestis
ugauaugccugaaguugaucaa

SEQ ID NO: 2254288 - RNA, 14 nt, Yersinia pestis
ugauaugauuucau

SEQ ID NO: 2254289 - RNA, 14 nt, Yersinia pestis
ugauaucuucacuc

SEQ ID NO: 2254290 - RNA, 17 nt, Yersinia pestis
ugauaucuucacucagc

SEQ ID NO: 2254291 - RNA, 21 nt, Yersinia pestis
ugauaucuucggcggcuaaag

SEQ ID NO: 2254292 - RNA, 19 nt, Yersinia pestis
ugaucaguggcuuaauuga

SEQ ID NO: 2254293 - RNA, 20 nt, Yersinia pestis
ugaucauggcuugugcagca

SEQ ID NO: 2254294 - RNA, 16 nt, Yersinia pestis
ugaucaucgcaccaua

SEQ ID NO: 2254295 - RNA, 14 nt, Yersinia pestis
ugaucaucuuuuuu

SEQ ID NO: 2254296 - RNA, 17 nt, Yersinia pestis
ugauccuggguuuuauu

SEQ ID NO: 2254297 - RNA, 17 nt, Yersinia pestis
ugaucuggcuuucucaa

SEQ ID NO: 2254298 - RNA, 16 nt, Yersinia pestis
ugaugaauaccaccau

SEQ ID NO: 2254299 - RNA, 20 nt, Yersinia pestis
ugaucuugaauaauauucaa

SEQ ID NO: 2254300 - RNA, 13 nt, Yersinia pestis
ugaugacaaugcg

SEQ ID NO: 2254301 - RNA, 15 nt, Yersinia pestis
ugaugacaaugcguu

SEQ ID NO: 2254302 - RNA, 17 nt, Yersinia pestis
ugaugacaaugcguuau

SEQ ID NO: 2254303 - RNA, 13 nt, Yersinia pestis
ugaugaaguuauu

SEQ ID NO: 2254304 - RNA, 17 nt, Yersinia pestis
ugaucgagcaucaccaa

SEQ ID NO: 2254305 - RNA, 15 nt, Yersinia pestis
ugaucgccguacuug

SEQ ID NO: 2254306 - RNA, 19 nt, Yersinia pestis
ugacugaccauaaaaggau

SEQ ID NO: 2254307 - RNA, 15 nt, Yersinia pestis
ugacuugacucaggg

SEQ ID NO: 2254308 - RNA, 21 nt, Yersinia pestis
ugacucgggucagugaaaaau

SEQ ID NO: 2254309 - RNA, 22 nt, Yersinia pestis
ugagaaaggauuugaagacaac

SEQ ID NO: 2254310 - RNA, 17 nt, Yersinia pestis
ugagacccgauuucacg

SEQ ID NO: 2254311 - RNA, 14 nt, Yersinia pestis
ugagaacucgguau

SEQ ID NO: 2254312 - RNA, 18 nt, Yersinia pestis
ugagagcgaauggcaaug

SEQ ID NO: 2254313 - RNA, 18 nt, Yersinia pestis
ugagagcauaaccccaac

SEQ ID NO: 2254314 - RNA, 14 nt, Yersinia pestis
ugagacuccucuuc

SEQ ID NO: 2254315 - RNA, 16 nt, Yersinia pestis
ugagacguccauaauc

SEQ ID NO: 2254316 - RNA, 19 nt, Yersinia pestis
ugagaccuuccauaacuca

SEQ ID NO: 2254317 - RNA, 16 nt, Yersinia pestis
ugacuauucccuuguu

SEQ ID NO: 2254318 - RNA, 22 nt, Yersinia pestis
ugacucacguauuuucauuuua

SEQ ID NO: 2254319 - RNA, 17 nt, Yersinia pestis
ugacuaccuugcuccgc

SEQ ID NO: 2254320 - RNA, 12 nt, Yersinia pestis
ugacuaaauuuc

SEQ ID NO: 2254321 - RNA, 15 nt, Yersinia pestis
ugacguuacagaugg

SEQ ID NO: 2254322 - RNA, 14 nt, Yersinia pestis
ugacgcuugaauau

SEQ ID NO: 2254323 - RNA, 15 nt, Yersinia pestis
ugacgcugcaccgcu

SEQ ID NO: 2254324 - RNA, 21 nt, Yersinia pestis
ugacggaaaauuaacuuauug

SEQ ID NO: 2254325 - RNA, 20 nt, Yersinia pestis
ugacggcagcgagcacugcc

SEQ ID NO: 2254326 - RNA, 17 nt, Yersinia pestis
ugacggcggcggaucaa

SEQ ID NO: 2254327 - RNA, 18 nt, Yersinia pestis
ugacggggaguuuuuauu

SEQ ID NO: 2254328 - RNA, 12 nt, Yersinia pestis
ugacgggucagc

SEQ ID NO: 2254329 - RNA, 17 nt, Yersinia pestis
ugacggugcgauaaaug

SEQ ID NO: 2254330 - RNA, 20 nt, Yersinia pestis
ugacgguuucaacauccagu

SEQ ID NO: 2254331 - RNA, 16 nt, Yersinia pestis
ugacguaaaaaggcag

SEQ ID NO: 2254332 - RNA, 16 nt, Yersinia pestis
ugacgguuuucugaau

SEQ ID NO: 2254333 - RNA, 17 nt, Yersinia pestis
ugaccgaaccaccgcag

SEQ ID NO: 2254334 - RNA, 19 nt, Yersinia pestis
ugaccacaaaaacaguguc

SEQ ID NO: 2254335 - RNA, 15 nt, Yersinia pestis
ugaccagauagcugu

SEQ ID NO: 2254336 - RNA, 20 nt, Yersinia pestis
ugaccacugcuucugucagu

SEQ ID NO: 2254337 - RNA, 20 nt, Yersinia pestis
ugaccacgcaucaauaauaa

SEQ ID NO: 2254338 - RNA, 21 nt, Yersinia pestis
ugaccacgcaucaauaauaac

SEQ ID NO: 2254339 - RNA, 18 nt, Yersinia pestis
ugaccaaagcaguaaaca

SEQ ID NO: 2254340 - RNA, 13 nt, Yersinia pestis
ugacauugcccgc

SEQ ID NO: 2254341 - RNA, 14 nt, Yersinia pestis
ugacauuuccuugu

SEQ ID NO: 2254342 - RNA, 14 nt, Yersinia pestis
ugacauguuccagu

SEQ ID NO: 2254343 - RNA, 17 nt, Yersinia pestis
ugacaugcuuaauuauu

SEQ ID NO: 2254344 - RNA, 13 nt, Yersinia pestis
ugacauccgcuug

SEQ ID NO: 2254345 - RNA, 13 nt, Yersinia pestis
ugaauaaaaauaa

SEQ ID NO: 2254346 - RNA, 13 nt, Yersinia pestis
ugaauaaaucaaa

SEQ ID NO: 2254347 - RNA, 14 nt, Yersinia pestis
ugaauaaaucaaag

SEQ ID NO: 2254348 - RNA, 14 nt, Yersinia pestis
ugaauaaauaugac

SEQ ID NO: 2254349 - RNA, 20 nt, Yersinia pestis
ugaauaacuucgcgaacaca

SEQ ID NO: 2254350 - RNA, 16 nt, Yersinia pestis
ugacgaccaauaucau

SEQ ID NO: 2254351 - RNA, 14 nt, Yersinia pestis
ugacgacaauauaa

SEQ ID NO: 2254352 - RNA, 14 nt, Yersinia pestis
ugacgaauuaaaac

SEQ ID NO: 2254353 - RNA, 20 nt, Yersinia pestis
ugaccuauugauaaaaccac

SEQ ID NO: 2254354 - RNA, 23 nt, Yersinia pestis
ugacgcguagagccuuuacgggc

SEQ ID NO: 2254355 - RNA, 22 nt, Yersinia pestis
ugacgcguugcccuucuucagc

SEQ ID NO: 2254356 - RNA, 22 nt, Yersinia pestis
ugacgcuaaccaccgucaccaa

SEQ ID NO: 2254357 - RNA, 23 nt, Yersinia pestis
ugacgcuaaccaccgucaccaaa

SEQ ID NO: 2254358 - RNA, 20 nt, Yersinia pestis
ugacgauaguauaaauaccu

SEQ ID NO: 2254359 - RNA, 15 nt, Yersinia pestis
ugacgaugauaaauc

SEQ ID NO: 2254360 - RNA, 16 nt, Yersinia pestis
ucucuuuuuuauucaa

SEQ ID NO: 2254361 - RNA, 13 nt, Yersinia pestis
ucucuuuuuucuc

SEQ ID NO: 2254362 - RNA, 21 nt, Yersinia pestis
ucucuuugccuacuaccaaau

SEQ ID NO: 2254363 - RNA, 22 nt, Yersinia pestis
ucucuuugcgcugauaacuucc

SEQ ID NO: 2254364 - RNA, 20 nt, Yersinia pestis
ucucuuucgggcaaaaaaau

SEQ ID NO: 2254365 - RNA, 14 nt, Yersinia pestis
ucucuuucuccaac

SEQ ID NO: 2254366 - RNA, 11 nt, Yersinia pestis
aaaugcugacu

SEQ ID NO: 2254367 - RNA, 19 nt, Yersinia pestis
ucucuuucuucucuucaga

SEQ ID NO: 2254368 - RNA, 14 nt, Yersinia pestis
aaaugcucaucaag

SEQ ID NO: 2254369 - RNA, 17 nt, Yersinia pestis
ucugaagaugccaauca

SEQ ID NO: 2254370 - RNA, 19 nt, Yersinia pestis
ucugaaggguauugaagau

SEQ ID NO: 2254371 - RNA, 12 nt, Yersinia pestis
ucugaauaagag

SEQ ID NO: 2254372 - RNA, 22 nt, Yersinia pestis
ucugaaaucuccuccggagagg

SEQ ID NO: 2254373 - RNA, 16 nt, Yersinia pestis
ucugaaagugcccccu

SEQ ID NO: 2254374 - RNA, 12 nt, Yersinia pestis
ucugagccaucc

SEQ ID NO: 2254375 - RNA, 16 nt, Yersinia pestis
ucugagccucaugaau

SEQ ID NO: 2254376 - RNA, 18 nt, Yersinia pestis
ucugauaucuaaaaaaau

SEQ ID NO: 2254377 - RNA, 15 nt, Yersinia pestis
ucugauaucucuuua

SEQ ID NO: 2254378 - RNA, 20 nt, Yersinia pestis
ucugaugaguguuuauucuc

SEQ ID NO: 2254379 - RNA, 19 nt, Yersinia pestis
ucugaauagcgcugcauca

SEQ ID NO: 2254380 - RNA, 23 nt, Yersinia pestis
ucugaauaccauaacaauggccg

SEQ ID NO: 2254381 - RNA, 15 nt, Yersinia pestis
ucugacucuguaaaa

SEQ ID NO: 2254382 - RNA, 18 nt, Yersinia pestis
ucugacucuguaaaaauc

SEQ ID NO: 2254383 - RNA, 17 nt, Yersinia pestis
ucugacuaacucuucug

SEQ ID NO: 2254384 - RNA, 13 nt, Yersinia pestis
ucugacuaacucu

SEQ ID NO: 2254385 - RNA, 15 nt, Yersinia pestis
ucucggcuuucaggu

SEQ ID NO: 2254386 - RNA, 13 nt, Yersinia pestis
ucgcaucuuccaa

SEQ ID NO: 2254387 - RNA, 19 nt, Yersinia pestis
ucgcaucgucgcuguuacc

SEQ ID NO: 2254388 - RNA, 15 nt, Yersinia pestis
ucgcaugguuaaaac

SEQ ID NO: 2254389 - RNA, 23 nt, Yersinia pestis
ucucuguaauggcgcacauuaca

SEQ ID NO: 2254390 - RNA, 11 nt, Yersinia pestis
ucucuucccac

SEQ ID NO: 2254391 - RNA, 14 nt, Yersinia pestis
ucucuucagagauu

SEQ ID NO: 2254392 - RNA, 19 nt, Yersinia pestis
aaaugcguagagucaguga

SEQ ID NO: 2254393 - RNA, 13 nt, Yersinia pestis
ucucuuccuguuc

SEQ ID NO: 2254394 - RNA, 17 nt, Yersinia pestis
ucugcgaagccgcugca

SEQ ID NO: 2254395 - RNA, 16 nt, Yersinia pestis
ucugcgaccugaucca

SEQ ID NO: 2254396 - RNA, 19 nt, Yersinia pestis
ucugcgagcguuuaaauac

SEQ ID NO: 2254397 - RNA, 21 nt, Yersinia pestis
ucugcgagcguuuaaauaccc

SEQ ID NO: 2254398 - RNA, 20 nt, Yersinia pestis
ucugccgucuaucugccaga

SEQ ID NO: 2254399 - RNA, 13 nt, Yersinia pestis
ucugcgcccuuau

SEQ ID NO: 2254400 - RNA, 15 nt, Yersinia pestis
ucugcgcccuuaucu

SEQ ID NO: 2254401 - RNA, 17 nt, Yersinia pestis
ucugcaacaacuccuuc

SEQ ID NO: 2254402 - RNA, 16 nt, Yersinia pestis
ucugcccagccugguu

SEQ ID NO: 2254403 - RNA, 22 nt, Yersinia pestis
ucugcccagccugguuuuuuaa

SEQ ID NO: 2254404 - RNA, 16 nt, Yersinia pestis
ucugcccccccuuuca

SEQ ID NO: 2254405 - RNA, 19 nt, Yersinia pestis
ucuggccagcgucuucagu

SEQ ID NO: 2254406 - RNA, 14 nt, Yersinia pestis
ucugggugcugcuc

SEQ ID NO: 2254407 - RNA, 15 nt, Yersinia pestis
ucugggugcugcucc

SEQ ID NO: 2254408 - RNA, 13 nt, Yersinia pestis
ucuggguaagaac

SEQ ID NO: 2254409 - RNA, 21 nt, Yersinia pestis
ucugggcugaacgugccuguc

SEQ ID NO: 2254410 - RNA, 18 nt, Yersinia pestis
ucuggcccuaaaugggcu

SEQ ID NO: 2254411 - RNA, 22 nt, Yersinia pestis
ucuggccgaugcgacaauuucc

SEQ ID NO: 2254412 - RNA, 16 nt, Yersinia pestis
ucugcugaaaaucaug

SEQ ID NO: 2254413 - RNA, 17 nt, Yersinia pestis
ucugcucccaugucaga

SEQ ID NO: 2254414 - RNA, 19 nt, Yersinia pestis
ucugcucccggcacuaaaa

SEQ ID NO: 2254415 - RNA, 18 nt, Yersinia pestis
ucugcuaacaacagucaa

SEQ ID NO: 2254416 - RNA, 21 nt, Yersinia pestis
ucugcuaacaacagucaauau

SEQ ID NO: 2254417 - RNA, 15 nt, Yersinia pestis
ucugcguuuuucccu

SEQ ID NO: 2254418 - RNA, 18 nt, Yersinia pestis
ucugcguuuuucccugua

SEQ ID NO: 2254419 - RNA, 16 nt, Yersinia pestis
ucugcgcuguaagcac

SEQ ID NO: 2254420 - RNA, 17 nt, Yersinia pestis
ucugcgcuguaagcacc

SEQ ID NO: 2254421 - RNA, 18 nt, Yersinia pestis
ucugcggcaggcugaucu

SEQ ID NO: 2254422 - RNA, 21 nt, Yersinia pestis
ucuguuuccucuucaucuaca

SEQ ID NO: 2254423 - RNA, 20 nt, Yersinia pestis
ucugguaguuuugcauaauu

SEQ ID NO: 2254424 - RNA, 20 nt, Yersinia pestis
ucugguagucauauucaggc

SEQ ID NO: 2254425 - RNA, 14 nt, Yersinia pestis
ucuguuuuuuuuaa

SEQ ID NO: 2254426 - RNA, 15 nt, Yersinia pestis
ucuguuuuuuuuaaa

SEQ ID NO: 2254427 - RNA, 13 nt, Yersinia pestis
ucuguuuuuuauc

SEQ ID NO: 2254428 - RNA, 18 nt, Yersinia pestis
ucuguuuuguuuccccua

SEQ ID NO: 2254429 - RNA, 20 nt, Yersinia pestis
ucuuaaggacccguuuauaa

SEQ ID NO: 2254430 - RNA, 22 nt, Yersinia pestis
ucuuaaucuuuaauucaucaga

SEQ ID NO: 2254431 - RNA, 21 nt, Yersinia pestis
ucuuaauuuaaauaagaucca

SEQ ID NO: 2254432 - RNA, 15 nt, Yersinia pestis
ucuuaauucccagcc

SEQ ID NO: 2254433 - RNA, 20 nt, Yersinia pestis
ucuuacugguuuucugcgga

SEQ ID NO: 2254434 - RNA, 20 nt, Yersinia pestis
ucuuaauaauaucaaauguc

SEQ ID NO: 2254435 - RNA, 14 nt, Yersinia pestis
ucuuaauaccuaaa

SEQ ID NO: 2254436 - RNA, 21 nt, Yersinia pestis
ucuuacuguuuucauuauuuu

SEQ ID NO: 2254437 - RNA, 22 nt, Yersinia pestis
ucuuagagagagugaagauuuu

SEQ ID NO: 2254438 - RNA, 18 nt, Yersinia pestis
ucuuaggguaaccaaugu

SEQ ID NO: 2254439 - RNA, 21 nt, Yersinia pestis
ucuuagguaaugccacgucau

SEQ ID NO: 2254440 - RNA, 23 nt, Yersinia pestis
ucuuauuaggguugguugguggc

SEQ ID NO: 2254441 - RNA, 14 nt, Yersinia pestis
ucuuauuacucauu

SEQ ID NO: 2254442 - RNA, 19 nt, Yersinia pestis
ucuuauugaagggcaaaac

SEQ ID NO: 2254443 - RNA, 14 nt, Yersinia pestis
ucuuauugcuaucu

SEQ ID NO: 2254444 - RNA, 15 nt, Yersinia pestis
ucuucaguggcugga

SEQ ID NO: 2254445 - RNA, 14 nt, Yersinia pestis
ucuucagccuaucc

SEQ ID NO: 2254446 - RNA, 15 nt, Yersinia pestis
ucuuauuuuuuguag

SEQ ID NO: 2254447 - RNA, 12 nt, Yersinia pestis
ucuucaaaagca

SEQ ID NO: 2254448 - RNA, 18 nt, Yersinia pestis
ucuucaucuacagacucc

SEQ ID NO: 2254449 - RNA, 22 nt, Yersinia pestis
ucuucaucuagcgguuucacga

SEQ ID NO: 2254450 - RNA, 21 nt, Yersinia pestis
ucuuccgacaggcuaacaacu

SEQ ID NO: 2254451 - RNA, 14 nt, Yersinia pestis
ucuucauugccuuc

SEQ ID NO: 2254452 - RNA, 15 nt, Yersinia pestis
ucuucauugccuucu

SEQ ID NO: 2254453 - RNA, 12 nt, Yersinia pestis
ucuucgccgcau

SEQ ID NO: 2254454 - RNA, 18 nt, Yersinia pestis
ucuucgauuuuagcuuug

SEQ ID NO: 2254455 - RNA, 13 nt, Yersinia pestis
ucuucuguugccc

SEQ ID NO: 2254456 - RNA, 18 nt, Yersinia pestis
ucuucugauucaauuucg

SEQ ID NO: 2254457 - RNA, 17 nt, Yersinia pestis
ucuucugauaaaacagu

SEQ ID NO: 2254458 - RNA, 18 nt, Yersinia pestis
ucuugaauaauauucaau

SEQ ID NO: 2254459 - RNA, 12 nt, Yersinia pestis
ucuugaauaaua

SEQ ID NO: 2254460 - RNA, 14 nt, Yersinia pestis
ucuugaacggugag

SEQ ID NO: 2254461 - RNA, 13 nt, Yersinia pestis
ucuucuuuuauug

SEQ ID NO: 2254462 - RNA, 22 nt, Yersinia pestis
ucuugaaccaauuuuucuguau

SEQ ID NO: 2254463 - RNA, 19 nt, Yersinia pestis
ucuucuuuauuguuuugua

SEQ ID NO: 2254464 - RNA, 20 nt, Yersinia pestis
ucuugccagauggccagauu

SEQ ID NO: 2254465 - RNA, 23 nt, Yersinia pestis
ucuugccagcggcggccauccca

SEQ ID NO: 2254466 - RNA, 23 nt, Yersinia pestis
ucuugcaacaacgccucaucuuc

SEQ ID NO: 2254467 - RNA, 21 nt, Yersinia pestis
ucuugauuaccaauaauuaau

SEQ ID NO: 2254468 - RNA, 14 nt, Yersinia pestis
ucuuuauauucaau

SEQ ID NO: 2254469 - RNA, 15 nt, Yersinia pestis
ucuuuauauucaaua

SEQ ID NO: 2254470 - RNA, 18 nt, Yersinia pestis
ucuuuauauucaauauca

SEQ ID NO: 2254471 - RNA, 23 nt, Yersinia pestis
ucuuuauugcuccuuacuauuuu

SEQ ID NO: 2254472 - RNA, 17 nt, Yersinia pestis
ucuuuauuaucaauggc

SEQ ID NO: 2254473 - RNA, 18 nt, Yersinia pestis
ucuuuauuuauuuuacug

SEQ ID NO: 2254474 - RNA, 15 nt, Yersinia pestis
ucuuucaaagugaca

SEQ ID NO: 2254475 - RNA, 16 nt, Yersinia pestis
ucuuucaacugcucau

SEQ ID NO: 2254476 - RNA, 14 nt, Yersinia pestis
ucuuuacaggccac

SEQ ID NO: 2254477 - RNA, 18 nt, Yersinia pestis
ucuuuaauuuuucccuug

SEQ ID NO: 2254478 - RNA, 20 nt, Yersinia pestis
ucuuuaaucaccucaaccug

SEQ ID NO: 2254479 - RNA, 21 nt, Yersinia pestis
ucuuuacgguuaaaacaguaa

SEQ ID NO: 2254480 - RNA, 18 nt, Yersinia pestis
ucuuuagauuucaccuau

SEQ ID NO: 2254481 - RNA, 23 nt, Yersinia pestis
ucuugcucgaucagcgucagcag

SEQ ID NO: 2254482 - RNA, 12 nt, Yersinia pestis
ucuugucgucac

SEQ ID NO: 2254483 - RNA, 22 nt, Yersinia pestis
ucuugggcgggaucuccagaag

SEQ ID NO: 2254484 - RNA, 15 nt, Yersinia pestis
ucuuguaaauaguca

SEQ ID NO: 2254485 - RNA, 12 nt, Yersinia pestis
ucuuguugagug

SEQ ID NO: 2254486 - RNA, 12 nt, Yersinia pestis
ucuuuaauaaua

SEQ ID NO: 2254487 - RNA, 13 nt, Yersinia pestis
ucuuuaaaaucuu

SEQ ID NO: 2254488 - RNA, 14 nt, Yersinia pestis
ucuuugcuucaggc

SEQ ID NO: 2254489 - RNA, 19 nt, Yersinia pestis
ucuuugauuuaaauauuau

SEQ ID NO: 2254490 - RNA, 14 nt, Yersinia pestis
ucuuugaccgaacc

SEQ ID NO: 2254491 - RNA, 22 nt, Yersinia pestis
ucuuucuggcuaaacgaucaga

SEQ ID NO: 2254492 - RNA, 13 nt, Yersinia pestis
ucuuucaggccac

SEQ ID NO: 2254493 - RNA, 17 nt, Yersinia pestis
ucuuucauaucaaaagg

SEQ ID NO: 2254494 - RNA, 18 nt, Yersinia pestis
ucuuucacuaaugaggaa

SEQ ID NO: 2254495 - RNA, 14 nt, Yersinia pestis
ucuuucagcaccau

SEQ ID NO: 2254496 - RNA, 19 nt, Yersinia pestis
ucuuuccggguuuuuaaca

SEQ ID NO: 2254497 - RNA, 13 nt, Yersinia pestis
ucuuucggcuaaa

SEQ ID NO: 2254498 - RNA, 13 nt, Yersinia pestis
ucuuuucugccaa

SEQ ID NO: 2254499 - RNA, 13 nt, Yersinia pestis
ugaagauuuaaau

SEQ ID NO: 2254500 - RNA, 17 nt, Yersinia pestis
ugaagauuuaaauaaca

SEQ ID NO: 2254501 - RNA, 17 nt, Yersinia pestis
ugaagauuuaacggcug

SEQ ID NO: 2254502 - RNA, 14 nt, Yersinia pestis
ugaagccagcaccg

SEQ ID NO: 2254503 - RNA, 15 nt, Yersinia pestis
ugaagacacccguca

SEQ ID NO: 2254504 - RNA, 18 nt, Yersinia pestis
ugaagaauucaguaucac

SEQ ID NO: 2254505 - RNA, 15 nt, Yersinia pestis
ugaagacaacucuuc

SEQ ID NO: 2254506 - RNA, 17 nt, Yersinia pestis
ugaagacaaugccgaua

SEQ ID NO: 2254507 - RNA, 16 nt, Yersinia pestis
ugaagacacacuuauu

SEQ ID NO: 2254508 - RNA, 18 nt, Yersinia pestis
ugaacuucaaaucgccaa

SEQ ID NO: 2254509 - RNA, 13 nt, Yersinia pestis
ugaaggaugaaua

SEQ ID NO: 2254510 - RNA, 14 nt, Yersinia pestis
ugaaggccgucgug

SEQ ID NO: 2254511 - RNA, 15 nt, Yersinia pestis
ugaagucuuuagccu

SEQ ID NO: 2254512 - RNA, 18 nt, Yersinia pestis
ugaaguaucaccacguug

SEQ ID NO: 2254513 - RNA, 18 nt, Yersinia pestis
ugaaccgcuaucugcuga

SEQ ID NO: 2254514 - RNA, 19 nt, Yersinia pestis
ugaaccugacgcacagcac

SEQ ID NO: 2254515 - RNA, 17 nt, Yersinia pestis
ugaacccuuucagcgcu

SEQ ID NO: 2254516 - RNA, 23 nt, Yersinia pestis
ugaaccaucaaggacuucaucac

SEQ ID NO: 2254517 - RNA, 19 nt, Yersinia pestis
ugaacccacgacuauuuag

SEQ ID NO: 2254518 - RNA, 22 nt, Yersinia pestis
ugaacauaacuuugccagugac

SEQ ID NO: 2254519 - RNA, 21 nt, Yersinia pestis
ugaaccaucaacaauucgauc

SEQ ID NO: 2254520 - RNA, 18 nt, Yersinia pestis
ugaaaucuauuguauaua

SEQ ID NO: 2254521 - RNA, 23 nt, Yersinia pestis
ugaacugacacacaccagugauu

SEQ ID NO: 2254522 - RNA, 19 nt, Yersinia pestis
ugaacucgccuucagguaa

SEQ ID NO: 2254523 - RNA, 17 nt, Yersinia pestis
ugaacggugaggauagg

SEQ ID NO: 2254524 - RNA, 16 nt, Yersinia pestis
ugaacggugaggaugg

SEQ ID NO: 2254525 - RNA, 20 nt, Yersinia pestis
ugaaaaaaagaagaaaaaua

SEQ ID NO: 2254526 - RNA, 22 nt, Yersinia pestis
ugaaaaaaaacacgguugaaaa

SEQ ID NO: 2254527 - RNA, 13 nt, Yersinia pestis
ugaaaaaauaaug

SEQ ID NO: 2254528 - RNA, 18 nt, Yersinia pestis
ugaaaacggcgaggaaga

SEQ ID NO: 2254529 - RNA, 21 nt, Yersinia pestis
ugaaaaaucugacucuguaaa

SEQ ID NO: 2254530 - RNA, 20 nt, Yersinia pestis
ugaaaagugauccacuuaua

SEQ ID NO: 2254531 - RNA, 12 nt, Yersinia pestis
ugaaaauaauaa

SEQ ID NO: 2254532 - RNA, 13 nt, Yersinia pestis
ugaaaauaauaac

SEQ ID NO: 2254533 - RNA, 18 nt, Yersinia pestis
ugaaaacguuaacugcag

SEQ ID NO: 2254534 - RNA, 15 nt, Yersinia pestis
ugaaauaaauaaguu

SEQ ID NO: 2254535 - RNA, 16 nt, Yersinia pestis
ugaaaucaucacaccu

SEQ ID NO: 2254536 - RNA, 20 nt, Yersinia pestis
ugaaauaccgauuagaaauc

SEQ ID NO: 2254537 - RNA, 13 nt, Yersinia pestis
ugaaauaaugguu

SEQ ID NO: 2254538 - RNA, 16 nt, Yersinia pestis
ugaaaggcggugaaca

SEQ ID NO: 2254539 - RNA, 20 nt, Yersinia pestis
ugaaagcuaauauucucuau

SEQ ID NO: 2254540 - RNA, 16 nt, Yersinia pestis
ugaaagccaaucucuu

SEQ ID NO: 2254541 - RNA, 18 nt, Yersinia pestis
ugaaacggugaggauagg

SEQ ID NO: 2254542 - RNA, 18 nt, Yersinia pestis
ugaaacauaauuaaauau

SEQ ID NO: 2254543 - RNA, 19 nt, Yersinia pestis
ugaaacauaauuaaauauu

SEQ ID NO: 2254544 - RNA, 18 nt, Yersinia pestis
ugaaacgauaugcuccag

SEQ ID NO: 2254545 - RNA, 19 nt, Yersinia pestis
ugaaacgauaugcuccaga

SEQ ID NO: 2254546 - RNA, 13 nt, Yersinia pestis
ugaaacacuuauu

SEQ ID NO: 2254547 - RNA, 22 nt, Yersinia pestis
ugaaacacaacaacggugaaca

SEQ ID NO: 2254548 - RNA, 16 nt, Yersinia pestis
ugaaaaucaugaaauu

SEQ ID NO: 2254549 - RNA, 14 nt, Yersinia pestis
ugaaaaucaugaaa

SEQ ID NO: 2254550 - RNA, 15 nt, Yersinia pestis
ugcugcccuuugcug

SEQ ID NO: 2254551 - RNA, 21 nt, Yersinia pestis
ugcugaugucagugcuccauc

SEQ ID NO: 2254552 - RNA, 17 nt, Yersinia pestis
ugcugcaagaguccagc

SEQ ID NO: 2254553 - RNA, 22 nt, Yersinia pestis
ugcugcaagaguccagcacugg

SEQ ID NO: 2254554 - RNA, 16 nt, Yersinia pestis
ugcugcaaccacuuau

SEQ ID NO: 2254555 - RNA, 14 nt, Yersinia pestis
ugcugauaaaauuc

SEQ ID NO: 2254556 - RNA, 21 nt, Yersinia pestis
ugcugaucaccgugccaaaaa

SEQ ID NO: 2254557 - RNA, 14 nt, Yersinia pestis
ugcugaugcccauc

SEQ ID NO: 2254558 - RNA, 17 nt, Yersinia pestis
ugcugagugaagacauc

SEQ ID NO: 2254559 - RNA, 16 nt, Yersinia pestis
ugcugagccaaauaau

SEQ ID NO: 2254560 - RNA, 14 nt, Yersinia pestis
ugcugagugaagac

SEQ ID NO: 2254561 - RNA, 18 nt, Yersinia pestis
ugcugaccccaaauuuga

SEQ ID NO: 2254562 - RNA, 17 nt, Yersinia pestis
ugcugaagccagcaccg

SEQ ID NO: 2254563 - RNA, 19 nt, Yersinia pestis
ugcucgcccaagcggcugg

SEQ ID NO: 2254564 - RNA, 20 nt, Yersinia pestis
ugcucuucaccaaaggaagc

SEQ ID NO: 2254565 - RNA, 16 nt, Yersinia pestis
ugcucuucaccaaagg

SEQ ID NO: 2254566 - RNA, 20 nt, Yersinia pestis
ugcucugucaacgcuucagu

SEQ ID NO: 2254567 - RNA, 15 nt, Yersinia pestis
ugcucugcaauacug

SEQ ID NO: 2254568 - RNA, 20 nt, Yersinia pestis
ugcucuugaguguccacaua

SEQ ID NO: 2254569 - RNA, 17 nt, Yersinia pestis
aaauguacagucauuua

SEQ ID NO: 2254570 - RNA, 19 nt, Yersinia pestis
aaauguacagucauuuacu

SEQ ID NO: 2254571 - RNA, 19 nt, Yersinia pestis
aaauguacuacuucauaau

SEQ ID NO: 2254572 - RNA, 15 nt, Yersinia pestis
aaauguccacuguac

SEQ ID NO: 2254573 - RNA, 18 nt, Yersinia pestis
aaauguauaaaaaagaua

SEQ ID NO: 2254574 - RNA, 17 nt, Yersinia pestis
ugcuggcggcuuuuauc

SEQ ID NO: 2254575 - RNA, 15 nt, Yersinia pestis
ugcuggccauuuacc

SEQ ID NO: 2254576 - RNA, 18 nt, Yersinia pestis
ugcuggcauggaugguca

SEQ ID NO: 2254577 - RNA, 21 nt, Yersinia pestis
ugcuggcaguggcggcaaaag

SEQ ID NO: 2254578 - RNA, 13 nt, Yersinia pestis
ugcuggcaacagc

SEQ ID NO: 2254579 - RNA, 16 nt, Yersinia pestis
ugcuggaggcuggcag

SEQ ID NO: 2254580 - RNA, 21 nt, Yersinia pestis
ugcuggagcauugcgcucuga

SEQ ID NO: 2254581 - RNA, 19 nt, Yersinia pestis
ugcugcugcccgcgaauaa

SEQ ID NO: 2254582 - RNA, 13 nt, Yersinia pestis
ugcugcuguuauu

SEQ ID NO: 2254583 - RNA, 16 nt, Yersinia pestis
ugcugcgggcacuauc

SEQ ID NO: 2254584 - RNA, 23 nt, Yersinia pestis
ugcugcucugucaacgcuucagu

SEQ ID NO: 2254585 - RNA, 16 nt, Yersinia pestis
ugcugccugccugcug

SEQ ID NO: 2254586 - RNA, 14 nt, Yersinia pestis
ugcugccuugcugc

SEQ ID NO: 2254587 - RNA, 21 nt, Yersinia pestis
ugcuguuguagcgccagguaa

SEQ ID NO: 2254588 - RNA, 22 nt, Yersinia pestis
ugcuguuguuauuacugucacu

SEQ ID NO: 2254589 - RNA, 13 nt, Yersinia pestis
ugcuuaaaacagg

SEQ ID NO: 2254590 - RNA, 23 nt, Yersinia pestis
ugcuuaaaacaggcgaguuuccc

SEQ ID NO: 2254591 - RNA, 17 nt, Yersinia pestis
ugcuuaaaccauacucc

SEQ ID NO: 2254592 - RNA, 23 nt, Yersinia pestis
ugcuuaaagccuucaacuaauau

SEQ ID NO: 2254593 - RNA, 13 nt, Yersinia pestis
ugcuguuccaacc

SEQ ID NO: 2254594 - RNA, 13 nt, Yersinia pestis
ugcuguugccaca

SEQ ID NO: 2254595 - RNA, 13 nt, Yersinia pestis
aaaugucguacau

SEQ ID NO: 2254596 - RNA, 18 nt, Yersinia pestis
ugcuggucuccgcuggca

SEQ ID NO: 2254597 - RNA, 21 nt, Yersinia pestis
ugcuguagcgauaagugcagc

SEQ ID NO: 2254598 - RNA, 14 nt, Yersinia pestis
ugcuugauguuuuc

SEQ ID NO: 2254599 - RNA, 21 nt, Yersinia pestis
ugcuugaaagcaccgcccccu

SEQ ID NO: 2254600 - RNA, 20 nt, Yersinia pestis
ugcuuacucuuccaacucau

SEQ ID NO: 2254601 - RNA, 13 nt, Yersinia pestis
ugcuuaccuuguu

SEQ ID NO: 2254602 - RNA, 14 nt, Yersinia pestis
ugcuuauuucacac

SEQ ID NO: 2254603 - RNA, 22 nt, Yersinia pestis
ugcuuaccuuguuuguuacugc

SEQ ID NO: 2254604 - RNA, 19 nt, Yersinia pestis
ugcuucaaagaagacaucu

SEQ ID NO: 2254605 - RNA, 19 nt, Yersinia pestis
ugcuucaaauccucggguu

SEQ ID NO: 2254606 - RNA, 13 nt, Yersinia pestis
ugcuucacaucau

SEQ ID NO: 2254607 - RNA, 11 nt, Yersinia pestis
ugcuucagaca

SEQ ID NO: 2254608 - RNA, 12 nt, Yersinia pestis
ugcuuuuaacuc

SEQ ID NO: 2254609 - RNA, 16 nt, Yersinia pestis
ugcuuuuugcgcugcg

SEQ ID NO: 2254610 - RNA, 20 nt, Yersinia pestis
ugcuuuuugcuguucuaucu

SEQ ID NO: 2254611 - RNA, 13 nt, Yersinia pestis
ugcuuuuugcuuu

SEQ ID NO: 2254612 - RNA, 14 nt, Yersinia pestis
ugcuuuucugccua

SEQ ID NO: 2254613 - RNA, 17 nt, Yersinia pestis
ugcuuucagauaaugcc

SEQ ID NO: 2254614 - RNA, 22 nt, Yersinia pestis
ugcuuuaaucgccagacuguuc

SEQ ID NO: 2254615 - RNA, 21 nt, Yersinia pestis
ugcuuuaucagauaaggccug

SEQ ID NO: 2254616 - RNA, 22 nt, Yersinia pestis
ugcuugguuacgggcuugcugc

SEQ ID NO: 2254617 - RNA, 18 nt, Yersinia pestis
ugcuuggacucuggaauu

SEQ ID NO: 2254618 - RNA, 22 nt, Yersinia pestis
ugcuuggauuccgucgccaaca

SEQ ID NO: 2254619 - RNA, 12 nt, Yersinia pestis
ugcuugcugccu

SEQ ID NO: 2254620 - RNA, 14 nt, Yersinia pestis
ugcuugcugccugc

SEQ ID NO: 2254621 - RNA, 21 nt, Yersinia pestis
ugcuugcugccugccugcugc

SEQ ID NO: 2254622 - RNA, 18 nt, Yersinia pestis
uggaacguugcacccugc

SEQ ID NO: 2254623 - RNA, 17 nt, Yersinia pestis
uggaacaggauuuucaa

SEQ ID NO: 2254624 - RNA, 20 nt, Yersinia pestis
uggaagggaguuacucagca

SEQ ID NO: 2254625 - RNA, 20 nt, Yersinia pestis
uggaagaaucaccgaaagaa

SEQ ID NO: 2254626 - RNA, 12 nt, Yersinia pestis
uggaagagccug

SEQ ID NO: 2254627 - RNA, 22 nt, Yersinia pestis
uggaagauagauuucacugccg

SEQ ID NO: 2254628 - RNA, 16 nt, Yersinia pestis
uggaaauuauuuagaa

SEQ ID NO: 2254629 - RNA, 21 nt, Yersinia pestis
uggaaaaauuagccaagcaac

SEQ ID NO: 2254630 - RNA, 13 nt, Yersinia pestis
uggaaaaacugaa

SEQ ID NO: 2254631 - RNA, 13 nt, Yersinia pestis
uggaaaauacacu

SEQ ID NO: 2254632 - RNA, 16 nt, Yersinia pestis
uggaaacaaaaccuaa

SEQ ID NO: 2254633 - RNA, 15 nt, Yersinia pestis
uggaaacgaccugua

SEQ ID NO: 2254634 - RNA, 15 nt, Yersinia pestis
uggacgaacagcuca

SEQ ID NO: 2254635 - RNA, 18 nt, Yersinia pestis
uggacgauaaauucaaau

SEQ ID NO: 2254636 - RNA, 19 nt, Yersinia pestis
uggacccgucaccacaaag

SEQ ID NO: 2254637 - RNA, 16 nt, Yersinia pestis
uggaaugaguuuaagu

SEQ ID NO: 2254638 - RNA, 14 nt, Yersinia pestis
uggaauccaaguuc

SEQ ID NO: 2254639 - RNA, 16 nt, Yersinia pestis
uggaauuuaugcacca

SEQ ID NO: 2254640 - RNA, 16 nt, Yersinia pestis
uggaauucgacaauga

SEQ ID NO: 2254641 - RNA, 15 nt, Yersinia pestis
ugcucaacugcucaa

SEQ ID NO: 2254642 - RNA, 16 nt, Yersinia pestis
ugcucacuuuuaucca

SEQ ID NO: 2254643 - RNA, 23 nt, Yersinia pestis
ugcucacccauuuuauccucuuc

SEQ ID NO: 2254644 - RNA, 19 nt, Yersinia pestis
ugcucacccauuuuauccu

SEQ ID NO: 2254645 - RNA, 18 nt, Yersinia pestis
ugcucacgcguaaaugga

SEQ ID NO: 2254646 - RNA, 15 nt, Yersinia pestis
ugcucacgcaaauaa

SEQ ID NO: 2254647 - RNA, 19 nt, Yersinia pestis
ugcucaucaaccucagccu

SEQ ID NO: 2254648 - RNA, 16 nt, Yersinia pestis
ugcucauaaagcauca

SEQ ID NO: 2254649 - RNA, 14 nt, Yersinia pestis
ugcucaggccuugc

SEQ ID NO: 2254650 - RNA, 20 nt, Yersinia pestis
ugcucagggccacuucggug

SEQ ID NO: 2254651 - RNA, 14 nt, Yersinia pestis
ugcucauuuaaaau

SEQ ID NO: 2254652 - RNA, 13 nt, Yersinia pestis
ugcucccauguca

SEQ ID NO: 2254653 - RNA, 21 nt, Yersinia pestis
ugcuccaguugauacaggaaa

SEQ ID NO: 2254654 - RNA, 16 nt, Yersinia pestis
ugcuccgccuuccgcc

SEQ ID NO: 2254655 - RNA, 19 nt, Yersinia pestis
ugcuccgcagugaucaguc

SEQ ID NO: 2254656 - RNA, 17 nt, Yersinia pestis
ugcuccgcaauuugccc

SEQ ID NO: 2254657 - RNA, 18 nt, Yersinia pestis
ugcucccggcacuaaaau

SEQ ID NO: 2254658 - RNA, 16 nt, Yersinia pestis
ugcuaauaccacaaca

SEQ ID NO: 2254659 - RNA, 20 nt, Yersinia pestis
ugcuaauaccaccaccacac

SEQ ID NO: 2254660 - RNA, 14 nt, Yersinia pestis
ugcuacgauaauaa

SEQ ID NO: 2254661 - RNA, 13 nt, Yersinia pestis
ugcuacagcagca

SEQ ID NO: 2254662 - RNA, 19 nt, Yersinia pestis
ugcuacaggcgacccagca

SEQ ID NO: 2254663 - RNA, 18 nt, Yersinia pestis
ugcguuuuugaaauacca

SEQ ID NO: 2254664 - RNA, 19 nt, Yersinia pestis
ugcuaacaacagucaauau

SEQ ID NO: 2254665 - RNA, 20 nt, Yersinia pestis
ugcuaacaacagucaauaua

SEQ ID NO: 2254666 - RNA, 16 nt, Yersinia pestis
ugcuaaccgaauaaaa

SEQ ID NO: 2254667 - RNA, 15 nt, Yersinia pestis
ugcuauuuuauaucg

SEQ ID NO: 2254668 - RNA, 15 nt, Yersinia pestis
ugcucaaacucagca

SEQ ID NO: 2254669 - RNA, 20 nt, Yersinia pestis
ugcuauggguaauccccacc

SEQ ID NO: 2254670 - RNA, 14 nt, Yersinia pestis
ugcuauuaaacauu

SEQ ID NO: 2254671 - RNA, 16 nt, Yersinia pestis
ugcuauuaaacauuua

SEQ ID NO: 2254672 - RNA, 13 nt, Yersinia pestis
ugcuauucauaaa

SEQ ID NO: 2254673 - RNA, 17 nt, Yersinia pestis
ugcuacuuaauaucuaa

SEQ ID NO: 2254674 - RNA, 23 nt, Yersinia pestis
ugcuagugcugguugagauuauc

SEQ ID NO: 2254675 - RNA, 13 nt, Yersinia pestis
ugcuaguauuauc

SEQ ID NO: 2254676 - RNA, 23 nt, Yersinia pestis
ugcuauagaaaacaaaaaguuaa

SEQ ID NO: 2254677 - RNA, 19 nt, Yersinia pestis
ugcuauccucuuaaugucu

SEQ ID NO: 2254678 - RNA, 18 nt, Yersinia pestis
ugcuaucggcggagagaa

SEQ ID NO: 2254679 - RNA, 14 nt, Yersinia pestis
ugcguuuagcuucc

SEQ ID NO: 2254680 - RNA, 21 nt, Yersinia pestis
ugcguguggucagcacaaaca

SEQ ID NO: 2254681 - RNA, 15 nt, Yersinia pestis
ugcguuggcugccuu

SEQ ID NO: 2254682 - RNA, 23 nt, Yersinia pestis
ugcgugcaauaaagcgauaaaua

SEQ ID NO: 2254683 - RNA, 14 nt, Yersinia pestis
ugcgguugcugugg

SEQ ID NO: 2254684 - RNA, 22 nt, Yersinia pestis
ugcgguucuguaucauauguuc

SEQ ID NO: 2254685 - RNA, 20 nt, Yersinia pestis
ugcgguuuguuugcaucugg

SEQ ID NO: 2254686 - RNA, 15 nt, Yersinia pestis
ugcguaaaugaaauu

SEQ ID NO: 2254687 - RNA, 14 nt, Yersinia pestis
ugcgucaccaggcc

SEQ ID NO: 2254688 - RNA, 15 nt, Yersinia pestis
ugcgguggccagagc

SEQ ID NO: 2254689 - RNA, 15 nt, Yersinia pestis
ugcgguggcacugac

SEQ ID NO: 2254690 - RNA, 13 nt, Yersinia pestis
ugcgggaauagcu

SEQ ID NO: 2254691 - RNA, 18 nt, Yersinia pestis
ugcggcggcugaccacaa

SEQ ID NO: 2254692 - RNA, 19 nt, Yersinia pestis
ugcggcaauaagcauuauu

SEQ ID NO: 2254693 - RNA, 20 nt, Yersinia pestis
ugcggcacgaucuggcaaaa

SEQ ID NO: 2254694 - RNA, 20 nt, Yersinia pestis
ugcgcuucgcgcagcaugga

SEQ ID NO: 2254695 - RNA, 17 nt, Yersinia pestis
ugccugccugcugcucc

SEQ ID NO: 2254696 - RNA, 16 nt, Yersinia pestis
ugccugcaccagugcc

SEQ ID NO: 2254697 - RNA, 13 nt, Yersinia pestis
ugccucggucuga

SEQ ID NO: 2254698 - RNA, 20 nt, Yersinia pestis
ugccucggcaaguuguucau

SEQ ID NO: 2254699 - RNA, 13 nt, Yersinia pestis
ugccuguucucuc

SEQ ID NO: 2254700 - RNA, 15 nt, Yersinia pestis
ugccuuauccccgcc

SEQ ID NO: 2254701 - RNA, 18 nt, Yersinia pestis
ugccuuacaaagcauuuc

SEQ ID NO: 2254702 - RNA, 18 nt, Yersinia pestis
ugccugugcgcuggucgc

SEQ ID NO: 2254703 - RNA, 22 nt, Yersinia pestis
ugccuucuccuuucuguuccau

SEQ ID NO: 2254704 - RNA, 17 nt, Yersinia pestis
ugccuuaucuaaccguc

SEQ ID NO: 2254705 - RNA, 17 nt, Yersinia pestis
ugccagacacaagauaa

SEQ ID NO: 2254706 - RNA, 15 nt, Yersinia pestis
ugccagagcaauaac

SEQ ID NO: 2254707 - RNA, 16 nt, Yersinia pestis
ugccguacaacaauaa

SEQ ID NO: 2254708 - RNA, 15 nt, Yersinia pestis
ugccguaaaauuuaa

SEQ ID NO: 2254709 - RNA, 13 nt, Yersinia pestis
ugccuuuucuucc

SEQ ID NO: 2254710 - RNA, 14 nt, Yersinia pestis
ugccuuuucuuccg

SEQ ID NO: 2254711 - RNA, 16 nt, Yersinia pestis
ugccuuucuguaacuc

SEQ ID NO: 2254712 - RNA, 15 nt, Yersinia pestis
ugccuugccauccau

SEQ ID NO: 2254713 - RNA, 20 nt, Yersinia pestis
ugccuuggucucagaacaag

SEQ ID NO: 2254714 - RNA, 16 nt, Yersinia pestis
ugccuuggucucagaa

SEQ ID NO: 2254715 - RNA, 17 nt, Yersinia pestis
ugccuuggucucagaac

SEQ ID NO: 2254716 - RNA, 14 nt, Yersinia pestis
ugcgaaaaaagaug

SEQ ID NO: 2254717 - RNA, 16 nt, Yersinia pestis
ugcgaaaauuuaacua

SEQ ID NO: 2254718 - RNA, 14 nt, Yersinia pestis
ugcgaaaacggcaa

SEQ ID NO: 2254719 - RNA, 15 nt, Yersinia pestis
ugcgaagaaaaacac

SEQ ID NO: 2254720 - RNA, 13 nt, Yersinia pestis
ugcgaauuaucau

SEQ ID NO: 2254721 - RNA, 20 nt, Yersinia pestis
ugcgacaccaagaggcugcg

SEQ ID NO: 2254722 - RNA, 17 nt, Yersinia pestis
ugcgacacgcucaucca

SEQ ID NO: 2254723 - RNA, 17 nt, Yersinia pestis
ugcgacaccugcuauca

SEQ ID NO: 2254724 - RNA, 19 nt, Yersinia pestis
ugcgaauauugcguuaccu

SEQ ID NO: 2254725 - RNA, 22 nt, Yersinia pestis
ugcgauacaccauuuccaggcu

SEQ ID NO: 2254726 - RNA, 12 nt, Yersinia pestis
ugcgcaccagcu

SEQ ID NO: 2254727 - RNA, 17 nt, Yersinia pestis
ugcgcaagcgcugcuuu

SEQ ID NO: 2254728 - RNA, 19 nt, Yersinia pestis
ugcgcaagcgcugcuuuaa

SEQ ID NO: 2254729 - RNA, 17 nt, Yersinia pestis
ugcgccaaguccuccuu

SEQ ID NO: 2254730 - RNA, 22 nt, Yersinia pestis
ugcgccauuaaggccacugacg

SEQ ID NO: 2254731 - RNA, 13 nt, Yersinia pestis
ugcgccgcuuugc

SEQ ID NO: 2254732 - RNA, 21 nt, Yersinia pestis
ugcgcccuuaucuaucucagg

SEQ ID NO: 2254733 - RNA, 16 nt, Yersinia pestis
ugguugccagauaaug

SEQ ID NO: 2254734 - RNA, 15 nt, Yersinia pestis
ugguuggcaccacgg

SEQ ID NO: 2254735 - RNA, 23 nt, Yersinia pestis
ugguuguuuuuucccagaacaua

SEQ ID NO: 2254736 - RNA, 22 nt, Yersinia pestis
ugguucauuuuccaguuucauc

SEQ ID NO: 2254737 - RNA, 15 nt, Yersinia pestis
ugguugaguuuaugg

SEQ ID NO: 2254738 - RNA, 13 nt, Yersinia pestis
uguaaauauccug

SEQ ID NO: 2254739 - RNA, 14 nt, Yersinia pestis
uguaaaggcaaaga

SEQ ID NO: 2254740 - RNA, 22 nt, Yersinia pestis
uguaaaggcaaagaagaauaag

SEQ ID NO: 2254741 - RNA, 13 nt, Yersinia pestis
uguaaauauaaaa

SEQ ID NO: 2254742 - RNA, 17 nt, Yersinia pestis
ugguuuuaucaauaggu

SEQ ID NO: 2254743 - RNA, 12 nt, Yersinia pestis
ugguuuggccau

SEQ ID NO: 2254744 - RNA, 17 nt, Yersinia pestis
ugguuugauagcaaaac

SEQ ID NO: 2254745 - RNA, 18 nt, Yersinia pestis
ugguuuggugguuuggug

SEQ ID NO: 2254746 - RNA, 16 nt, Yersinia pestis
ugguuugguucuggug

SEQ ID NO: 2254747 - RNA, 15 nt, Yersinia pestis
uguaauuauauuuaa

SEQ ID NO: 2254748 - RNA, 16 nt, Yersinia pestis
uguaauuauauuuaau

SEQ ID NO: 2254749 - RNA, 16 nt, Yersinia pestis
uguacauaaauuugug

SEQ ID NO: 2254750 - RNA, 21 nt, Yersinia pestis
uguacggcgcguuucuuagcu

SEQ ID NO: 2254751 - RNA, 21 nt, Yersinia pestis
uguacauccaauuuuuucauc

SEQ ID NO: 2254752 - RNA, 12 nt, Yersinia pestis
uguacauuauuc

SEQ ID NO: 2254753 - RNA, 14 nt, Yersinia pestis
uguacuacuucaua

SEQ ID NO: 2254754 - RNA, 15 nt, Yersinia pestis
uguacuaaaggugua

SEQ ID NO: 2254755 - RNA, 16 nt, Yersinia pestis
uguacguauggcauga

SEQ ID NO: 2254756 - RNA, 13 nt, Yersinia pestis
uguacgggcagga

SEQ ID NO: 2254757 - RNA, 18 nt, Yersinia pestis
uguaauaaucuaaauuaa

SEQ ID NO: 2254758 - RNA, 19 nt, Yersinia pestis
uguaauaaucuaaauuaau

SEQ ID NO: 2254759 - RNA, 13 nt, Yersinia pestis
uguaaauuaauac

SEQ ID NO: 2254760 - RNA, 14 nt, Yersinia pestis
uguaagauaauucg

SEQ ID NO: 2254761 - RNA, 15 nt, Yersinia pestis
uguaagcaucuuuuc

SEQ ID NO: 2254762 - RNA, 16 nt, Yersinia pestis
uguaagcgugcaaccc

SEQ ID NO: 2254763 - RNA, 15 nt, Yersinia pestis
uggguauggucagca

SEQ ID NO: 2254764 - RNA, 15 nt, Yersinia pestis
uggguaccguuuauu

SEQ ID NO: 2254765 - RNA, 16 nt, Yersinia pestis
ugggucaguuuuauua

SEQ ID NO: 2254766 - RNA, 13 nt, Yersinia pestis
ugggucgccuugc

SEQ ID NO: 2254767 - RNA, 22 nt, Yersinia pestis
ugggucgccuugccgcuguugu

SEQ ID NO: 2254768 - RNA, 19 nt, Yersinia pestis
ugggucguugauauuccua

SEQ ID NO: 2254769 - RNA, 17 nt, Yersinia pestis
uggugaguaaaugcccc

SEQ ID NO: 2254770 - RNA, 15 nt, Yersinia pestis
uggugauacccagca

SEQ ID NO: 2254771 - RNA, 15 nt, Yersinia pestis
uggugaugcugcugg

SEQ ID NO: 2254772 - RNA, 17 nt, Yersinia pestis
ugguuaaucuacccgaa

SEQ ID NO: 2254773 - RNA, 13 nt, Yersinia pestis
ugguuaaucuacc

SEQ ID NO: 2254774 - RNA, 19 nt, Yersinia pestis
uggugguugcagugucagu

SEQ ID NO: 2254775 - RNA, 21 nt, Yersinia pestis
uggugguaccugcaucaucac

SEQ ID NO: 2254776 - RNA, 11 nt, Yersinia pestis
ugguggcugcu

SEQ ID NO: 2254777 - RNA, 22 nt, Yersinia pestis
uguauccuggccguguuuuucc

SEQ ID NO: 2254778 - RNA, 17 nt, Yersinia pestis
uguagcccacugacacu

SEQ ID NO: 2254779 - RNA, 19 nt, Yersinia pestis
uguagccaaaguggcauaa

SEQ ID NO: 2254780 - RNA, 17 nt, Yersinia pestis
uguagcgauaagugcag

SEQ ID NO: 2254781 - RNA, 17 nt, Yersinia pestis
uguacugcugcaacuca

SEQ ID NO: 2254782 - RNA, 15 nt, Yersinia pestis
uguacugggaugaag

SEQ ID NO: 2254783 - RNA, 23 nt, Yersinia pestis
uguagaucccgugugauuuccau

SEQ ID NO: 2254784 - RNA, 17 nt, Yersinia pestis
uguagcaaacccacaau

SEQ ID NO: 2254785 - RNA, 12 nt, Yersinia pestis
uguauugcucca

SEQ ID NO: 2254786 - RNA, 15 nt, Yersinia pestis
uguauuuaacauuag

SEQ ID NO: 2254787 - RNA, 19 nt, Yersinia pestis
uguauuuaaccgcccucuu

SEQ ID NO: 2254788 - RNA, 15 nt, Yersinia pestis
uguauuucucaaacu

SEQ ID NO: 2254789 - RNA, 14 nt, Yersinia pestis
uguauuugaugguu

SEQ ID NO: 2254790 - RNA, 19 nt, Yersinia pestis
uguauuuggguuaaauagu

SEQ ID NO: 2254791 - RNA, 16 nt, Yersinia pestis
ugucaauaccuuacug

SEQ ID NO: 2254792 - RNA, 17 nt, Yersinia pestis
ugucaauaaccucagcc

SEQ ID NO: 2254793 - RNA, 19 nt, Yersinia pestis
uguauuuuguuuuuuugau

SEQ ID NO: 2254794 - RNA, 20 nt, Yersinia pestis
uguauuuuguuuuuuugaua

SEQ ID NO: 2254795 - RNA, 22 nt, Yersinia pestis
ugucaccacggcuuucaauaaa

SEQ ID NO: 2254796 - RNA, 18 nt, Yersinia pestis
ugucaauguguugaauau

SEQ ID NO: 2254797 - RNA, 20 nt, Yersinia pestis
ugucaauaaccucauuggcg

SEQ ID NO: 2254798 - RNA, 20 nt, Yersinia pestis
uguccggguuuacccagcca

SEQ ID NO: 2254799 - RNA, 18 nt, Yersinia pestis
ugucaggcgugucgaucc

SEQ ID NO: 2254800 - RNA, 20 nt, Yersinia pestis
ugucaggaaaugcagacucu

SEQ ID NO: 2254801 - RNA, 20 nt, Yersinia pestis
ugucagcagucugaagggua

SEQ ID NO: 2254802 - RNA, 23 nt, Yersinia pestis
ugucagcagucugagggccacuu

SEQ ID NO: 2254803 - RNA, 13 nt, Yersinia pestis
ugucagcagucug

SEQ ID NO: 2254804 - RNA, 21 nt, Yersinia pestis
ugucagauggugcgccauuaa

SEQ ID NO: 2254805 - RNA, 12 nt, Yersinia pestis
ugucagauuagu

SEQ ID NO: 2254806 - RNA, 21 nt, Yersinia pestis
ugucguuucugcuuaacucaa

SEQ ID NO: 2254807 - RNA, 12 nt, Yersinia pestis
ugucgaaagacg

SEQ ID NO: 2254808 - RNA, 14 nt, Yersinia pestis
uguccuuuuuucug

SEQ ID NO: 2254809 - RNA, 18 nt, Yersinia pestis
uguccuuuuuucugcaaa

SEQ ID NO: 2254810 - RNA, 14 nt, Yersinia pestis
ugugaucgcugccg

SEQ ID NO: 2254811 - RNA, 16 nt, Yersinia pestis
ugugauccagguaucc

SEQ ID NO: 2254812 - RNA, 23 nt, Yersinia pestis
ugugauccacacaguauucugcu

SEQ ID NO: 2254813 - RNA, 15 nt, Yersinia pestis
ugugauuauggcaau

SEQ ID NO: 2254814 - RNA, 15 nt, Yersinia pestis
ugugcaaaauacaaa

SEQ ID NO: 2254815 - RNA, 17 nt, Yersinia pestis
ugugccaguagcaauaa

SEQ ID NO: 2254816 - RNA, 20 nt, Yersinia pestis
ugugcacucguuguauuuuc

SEQ ID NO: 2254817 - RNA, 17 nt, Yersinia pestis
ugugaacguacuuuggu

SEQ ID NO: 2254818 - RNA, 21 nt, Yersinia pestis
ugugaacguacuuugguugug

SEQ ID NO: 2254819 - RNA, 24 nt, Yersinia pestis
ugugaacguacuuugguugugauc

SEQ ID NO: 2254820 - RNA, 22 nt, Yersinia pestis
ugugaaacauaauuaaauauua

SEQ ID NO: 2254821 - RNA, 13 nt, Yersinia pestis
ugugaucagugug

SEQ ID NO: 2254822 - RNA, 24 nt, Yersinia pestis
ugugaagugugcaaauaaacgcga

SEQ ID NO: 2254823 - RNA, 18 nt, Yersinia pestis
ugucuuuaauaaaaucaa

SEQ ID NO: 2254824 - RNA, 16 nt, Yersinia pestis
ugucuuuaauaaaauc

SEQ ID NO: 2254825 - RNA, 15 nt, Yersinia pestis
uggcuaauuuuauua

SEQ ID NO: 2254826 - RNA, 16 nt, Yersinia pestis
uggcuaauuaauuuaa

SEQ ID NO: 2254827 - RNA, 14 nt, Yersinia pestis
uggcguuuucuucg

SEQ ID NO: 2254828 - RNA, 17 nt, Yersinia pestis
uggcguuuuuguuacau

SEQ ID NO: 2254829 - RNA, 17 nt, Yersinia pestis
uggcguuucaucuucau

SEQ ID NO: 2254830 - RNA, 17 nt, Yersinia pestis
uggcguaaguacugaug

SEQ ID NO: 2254831 - RNA, 14 nt, Yersinia pestis
uggcgguuccaaag

SEQ ID NO: 2254832 - RNA, 19 nt, Yersinia pestis
uggcggcguaaaucaugca

SEQ ID NO: 2254833 - RNA, 13 nt, Yersinia pestis
uggcggcuaucua

SEQ ID NO: 2254834 - RNA, 23 nt, Yersinia pestis
uggcgccauuuuuauaucagauu

SEQ ID NO: 2254835 - RNA, 18 nt, Yersinia pestis
uggcgcgucaucgcggcg

SEQ ID NO: 2254836 - RNA, 13 nt, Yersinia pestis
uggcccgcugguc

SEQ ID NO: 2254837 - RNA, 19 nt, Yersinia pestis
uggcccugauuguuuuuau

SEQ ID NO: 2254838 - RNA, 20 nt, Yersinia pestis
uggccuugaugugcucugcu

SEQ ID NO: 2254839 - RNA, 22 nt, Yersinia pestis
uggccuugaugugcucugcucc

SEQ ID NO: 2254840 - RNA, 11 nt, Yersinia pestis
uggccuucauc

SEQ ID NO: 2254841 - RNA, 21 nt, Yersinia pestis
uggccuuagcacguuuuucag

SEQ ID NO: 2254842 - RNA, 13 nt, Yersinia pestis
uggcgcaauggcg

SEQ ID NO: 2254843 - RNA, 20 nt, Yersinia pestis
uggcgcacaacugcgauaac

SEQ ID NO: 2254844 - RNA, 23 nt, Yersinia pestis
uggcgcauccccacuuguaccug

SEQ ID NO: 2254845 - RNA, 22 nt, Yersinia pestis
uggcgauuuaauguauucaagc

SEQ ID NO: 2254846 - RNA, 13 nt, Yersinia pestis
uggguaauaucac

SEQ ID NO: 2254847 - RNA, 19 nt, Yersinia pestis
uggguaauccccaccaaca

SEQ ID NO: 2254848 - RNA, 19 nt, Yersinia pestis
uggguaaucgguguagccc

SEQ ID NO: 2254849 - RNA, 16 nt, Yersinia pestis
uggggugccugguugg

SEQ ID NO: 2254850 - RNA, 22 nt, Yersinia pestis
uggggugucacaaaguagguua

SEQ ID NO: 2254851 - RNA, 22 nt, Yersinia pestis
ugggcgacaaucaauggccagc

SEQ ID NO: 2254852 - RNA, 21 nt, Yersinia pestis
ugggccacgaugugaagcaau

SEQ ID NO: 2254853 - RNA, 14 nt, Yersinia pestis
ugggccucaucugc

SEQ ID NO: 2254854 - RNA, 22 nt, Yersinia pestis
ugggaaaaguggcuaucugaaa

SEQ ID NO: 2254855 - RNA, 23 nt, Yersinia pestis
ugggaaccccucugcagcgucaa

SEQ ID NO: 2254856 - RNA, 19 nt, Yersinia pestis
uggcuuaacaacguuaguu

SEQ ID NO: 2254857 - RNA, 18 nt, Yersinia pestis
uggcuuaaucgccagcaa

SEQ ID NO: 2254858 - RNA, 21 nt, Yersinia pestis
ugggaaaaguggcuaucugaa

SEQ ID NO: 2254859 - RNA, 13 nt, Yersinia pestis
uggcugucugaug

SEQ ID NO: 2254860 - RNA, 23 nt, Yersinia pestis
uggcuguauuguugcucaacaua

SEQ ID NO: 2254861 - RNA, 13 nt, Yersinia pestis
uggcugagagccg

SEQ ID NO: 2254862 - RNA, 16 nt, Yersinia pestis
uggcucugccaauaaa

SEQ ID NO: 2254863 - RNA, 22 nt, Yersinia pestis
uggcugaauaucaucuuuuucu

SEQ ID NO: 2254864 - RNA, 14 nt, Yersinia pestis
uggcucgugaucag

SEQ ID NO: 2254865 - RNA, 17 nt, Yersinia pestis
uggauuaaguccaagaa

SEQ ID NO: 2254866 - RNA, 14 nt, Yersinia pestis
uggauguuccuggc

SEQ ID NO: 2254867 - RNA, 17 nt, Yersinia pestis
uggauguuccuggcccu

SEQ ID NO: 2254868 - RNA, 14 nt, Yersinia pestis
uggcaacgacuggg

SEQ ID NO: 2254869 - RNA, 15 nt, Yersinia pestis
uggcagggccgauaa

SEQ ID NO: 2254870 - RNA, 17 nt, Yersinia pestis
uggcaagguaaacgggu

SEQ ID NO: 2254871 - RNA, 21 nt, Yersinia pestis
uggcaacuuaaaaguaggcuu

SEQ ID NO: 2254872 - RNA, 16 nt, Yersinia pestis
uggcacugauuuuuuc

SEQ ID NO: 2254873 - RNA, 18 nt, Yersinia pestis
uggcacucucuucaucag

SEQ ID NO: 2254874 - RNA, 23 nt, Yersinia pestis
uggcacuggaaacaaaaccuaac

SEQ ID NO: 2254875 - RNA, 19 nt, Yersinia pestis
uggcacuggaaacaaaacc

SEQ ID NO: 2254876 - RNA, 14 nt, Yersinia pestis
uggcaugccaauua

SEQ ID NO: 2254877 - RNA, 12 nt, Yersinia pestis
uggcaugacuga

SEQ ID NO: 2254878 - RNA, 19 nt, Yersinia pestis
uggcauuagacauucaagc

SEQ ID NO: 2254879 - RNA, 15 nt, Yersinia pestis
uggcauaaccaauca

SEQ ID NO: 2254880 - RNA, 17 nt, Yersinia pestis
uggcauccucaggaugg

SEQ ID NO: 2254881 - RNA, 16 nt, Yersinia pestis
uggcaucacagaacau

SEQ ID NO: 2254882 - RNA, 22 nt, Yersinia pestis
uggcaucaccgcuaucacugau

SEQ ID NO: 2254883 - RNA, 18 nt, Yersinia pestis
uggccacuuccugauggc

SEQ ID NO: 2254884 - RNA, 16 nt, Yersinia pestis
uggccacucaccucag

SEQ ID NO: 2254885 - RNA, 21 nt, Yersinia pestis
uggccagacacugacaucauc

SEQ ID NO: 2254886 - RNA, 18 nt, Yersinia pestis
uggccauuaaccuaaaaa

SEQ ID NO: 2254887 - RNA, 15 nt, Yersinia pestis
uggccauuacgccac

SEQ ID NO: 2254888 - RNA, 20 nt, Yersinia pestis
uggcccaaaugagcagcaau

SEQ ID NO: 2254889 - RNA, 12 nt, Yersinia pestis
uggcccaagcca

SEQ ID NO: 2254890 - RNA, 16 nt, Yersinia pestis
uggcccaaugcuguca

SEQ ID NO: 2254891 - RNA, 23 nt, Yersinia pestis
uggcccaaugcugucacugucaa

SEQ ID NO: 2254892 - RNA, 15 nt, Yersinia pestis
uggcccaguagagca

SEQ ID NO: 2254893 - RNA, 14 nt, Yersinia pestis
uggcccaucuaugg

SEQ ID NO: 2254894 - RNA, 18 nt, Yersinia pestis
uggcccauaacaauuaau

SEQ ID NO: 2254895 - RNA, 21 nt, Yersinia pestis
uggcccaucuauggaccucac

SEQ ID NO: 2254896 - RNA, 23 nt, Yersinia pestis
uggccccuaaugcgcucaccaag

SEQ ID NO: 2254897 - RNA, 14 nt, Yersinia pestis
uggaggaaggcggu

SEQ ID NO: 2254898 - RNA, 23 nt, Yersinia pestis
uggaggaaggcgguuaucuggaa

SEQ ID NO: 2254899 - RNA, 13 nt, Yersinia pestis
uggagcuauggaa

SEQ ID NO: 2254900 - RNA, 21 nt, Yersinia pestis
uggagagcagggcccgccauu

SEQ ID NO: 2254901 - RNA, 11 nt, Yersinia pestis
uggagccugua

SEQ ID NO: 2254902 - RNA, 13 nt, Yersinia pestis
uggagccugugca

SEQ ID NO: 2254903 - RNA, 21 nt, Yersinia pestis
uggagccagcgccgugccaga

SEQ ID NO: 2254904 - RNA, 20 nt, Yersinia pestis
uggagccauaaguaaagcga

SEQ ID NO: 2254905 - RNA, 15 nt, Yersinia pestis
uggacguuugcugcu

SEQ ID NO: 2254906 - RNA, 18 nt, Yersinia pestis
uggacgcuggcagccuuu

SEQ ID NO: 2254907 - RNA, 18 nt, Yersinia pestis
uggacggaacacguuuaa

SEQ ID NO: 2254908 - RNA, 19 nt, Yersinia pestis
uggaugagccgcagccagc

SEQ ID NO: 2254909 - RNA, 18 nt, Yersinia pestis
uggaucucuccagccugc

SEQ ID NO: 2254910 - RNA, 14 nt, Yersinia pestis
uggaucauggcuuu

SEQ ID NO: 2254911 - RNA, 19 nt, Yersinia pestis
uggauacugcauuucaaca

SEQ ID NO: 2254912 - RNA, 22 nt, Yersinia pestis
uggauacugcauuucaacaaaa

SEQ ID NO: 2254913 - RNA, 14 nt, Yersinia pestis
uggauagcagagaa

SEQ ID NO: 2254914 - RNA, 22 nt, Yersinia pestis
uggaguuaaaucccugugcuga

SEQ ID NO: 2254915 - RNA, 19 nt, Yersinia pestis
uggagucgcauguaggcag

SEQ ID NO: 2254916 - RNA, 14 nt, Yersinia pestis
uggauaaaaacauu

SEQ ID NO: 2254917 - RNA, 17 nt, Yersinia pestis
uuaacccggcgacgauc

SEQ ID NO: 2254918 - RNA, 13 nt, Yersinia pestis
uuaacccauauua

SEQ ID NO: 2254919 - RNA, 15 nt, Yersinia pestis
uuaacccaaagccau

SEQ ID NO: 2254920 - RNA, 15 nt, Yersinia pestis
uuaacccaccaauag

SEQ ID NO: 2254921 - RNA, 17 nt, Yersinia pestis
ugugcuuuuuggcaaac

SEQ ID NO: 2254922 - RNA, 21 nt, Yersinia pestis
uuaagccgcaaggauaaacga

SEQ ID NO: 2254923 - RNA, 20 nt, Yersinia pestis
uuaagacguaucgcaguuaa

SEQ ID NO: 2254924 - RNA, 17 nt, Yersinia pestis
uuaagcgggcuuuaaua

SEQ ID NO: 2254925 - RNA, 22 nt, Yersinia pestis
uuaagaauccucugaauaaaaa

SEQ ID NO: 2254926 - RNA, 14 nt, Yersinia pestis
uuaagaagccucau

SEQ ID NO: 2254927 - RNA, 13 nt, Yersinia pestis
uuaacucaaauaa

SEQ ID NO: 2254928 - RNA, 15 nt, Yersinia pestis
uuaacucaauuuugg

SEQ ID NO: 2254929 - RNA, 20 nt, Yersinia pestis
uuaacucauuuaucuaaaac

SEQ ID NO: 2254930 - RNA, 13 nt, Yersinia pestis
uuaauauuuaucu

SEQ ID NO: 2254931 - RNA, 22 nt, Yersinia pestis
uuaauauuuaucugcauuaaaa

SEQ ID NO: 2254932 - RNA, 22 nt, Yersinia pestis
uuaauaugcaaaaaaagacacu

SEQ ID NO: 2254933 - RNA, 17 nt, Yersinia pestis
uuaauaugcaaaaaaag

SEQ ID NO: 2254934 - RNA, 15 nt, Yersinia pestis
uuaaucaauuaaaua

SEQ ID NO: 2254935 - RNA, 15 nt, Yersinia pestis
uuaaucaauuaauca

SEQ ID NO: 2254936 - RNA, 13 nt, Yersinia pestis
uuaauccuucacu

SEQ ID NO: 2254937 - RNA, 22 nt, Yersinia pestis
uuaauccuaaugaacacuuaau

SEQ ID NO: 2254938 - RNA, 22 nt, Yersinia pestis
uuaaucgcucauccauaaguau

SEQ ID NO: 2254939 - RNA, 23 nt, Yersinia pestis
uuaaucgcucauccauaaguauu

SEQ ID NO: 2254940 - RNA, 19 nt, Yersinia pestis
uuaaucggauggucaucca

SEQ ID NO: 2254941 - RNA, 15 nt, Yersinia pestis
uuaaucguuauaaua

SEQ ID NO: 2254942 - RNA, 14 nt, Yersinia pestis
uuaauaauaucaaa

SEQ ID NO: 2254943 - RNA, 20 nt, Yersinia pestis
uuaauaagcccaguauugca

SEQ ID NO: 2254944 - RNA, 14 nt, Yersinia pestis
uuaauaacuuaucu

SEQ ID NO: 2254945 - RNA, 18 nt, Yersinia pestis
uuaauaaccauaaaauaa

SEQ ID NO: 2254946 - RNA, 19 nt, Yersinia pestis
uuaaggagcccucugucau

SEQ ID NO: 2254947 - RNA, 21 nt, Yersinia pestis
uuaaggaaaaguagccaauag

SEQ ID NO: 2254948 - RNA, 15 nt, Yersinia pestis
uuaaggaaacucaug

SEQ ID NO: 2254949 - RNA, 22 nt, Yersinia pestis
uuaaguguugccaaccggauaa

SEQ ID NO: 2254950 - RNA, 23 nt, Yersinia pestis
uuacauuuaaacacucaauaagu

SEQ ID NO: 2254951 - RNA, 10 nt, Yersinia pestis
uuacauuuug

SEQ ID NO: 2254952 - RNA, 19 nt, Yersinia pestis
uuacaggccccuucuggug

SEQ ID NO: 2254953 - RNA, 20 nt, Yersinia pestis
uuaccaaaacgccaccagcg

SEQ ID NO: 2254954 - RNA, 13 nt, Yersinia pestis
uuaccaaaaagca

SEQ ID NO: 2254955 - RNA, 16 nt, Yersinia pestis
uuaccaaacauuuuca

SEQ ID NO: 2254956 - RNA, 18 nt, Yersinia pestis
uuaccaacagacucacuc

SEQ ID NO: 2254957 - RNA, 11 nt, Yersinia pestis
uuaccacaccu

SEQ ID NO: 2254958 - RNA, 18 nt, Yersinia pestis
uuacagcaaggcagcaag

SEQ ID NO: 2254959 - RNA, 17 nt, Yersinia pestis
uuacaggaacguucaau

SEQ ID NO: 2254960 - RNA, 15 nt, Yersinia pestis
uuacaauuacacacc

SEQ ID NO: 2254961 - RNA, 22 nt, Yersinia pestis
uuaauucaucagauuguuuaua

SEQ ID NO: 2254962 - RNA, 12 nt, Yersinia pestis
uuaauuccaugc

SEQ ID NO: 2254963 - RNA, 21 nt, Yersinia pestis
uuaauuacuuuauuuaaaauu

SEQ ID NO: 2254964 - RNA, 18 nt, Yersinia pestis
uuaaugagucucacaaaa

SEQ ID NO: 2254965 - RNA, 22 nt, Yersinia pestis
uuaaugagucucacaaaauaau

SEQ ID NO: 2254966 - RNA, 20 nt, Yersinia pestis
uuaaugcaggggggcguuau

SEQ ID NO: 2254967 - RNA, 16 nt, Yersinia pestis
uuaaugucuuuacuaa

SEQ ID NO: 2254968 - RNA, 15 nt, Yersinia pestis
uuaauguuuauauug

SEQ ID NO: 2254969 - RNA, 21 nt, Yersinia pestis
uuaauggcaccguggauaaac

SEQ ID NO: 2254970 - RNA, 18 nt, Yersinia pestis
uuaaugguuuccauaaug

SEQ ID NO: 2254971 - RNA, 19 nt, Yersinia pestis
uuagucacuaaagcggaau

SEQ ID NO: 2254972 - RNA, 21 nt, Yersinia pestis
uuagucagcgcggcccauaua

SEQ ID NO: 2254973 - RNA, 23 nt, Yersinia pestis
uuagucccauugacgaauuaaaa

SEQ ID NO: 2254974 - RNA, 16 nt, Yersinia pestis
uuagguaauaccaaug

SEQ ID NO: 2254975 - RNA, 18 nt, Yersinia pestis
uuagguaauaccaaugcu

SEQ ID NO: 2254976 - RNA, 13 nt, Yersinia pestis
uuaguggcuuuaa

SEQ ID NO: 2254977 - RNA, 16 nt, Yersinia pestis
uuauaaggaauauacu

SEQ ID NO: 2254978 - RNA, 16 nt, Yersinia pestis
uuauaaacaaucugau

SEQ ID NO: 2254979 - RNA, 16 nt, Yersinia pestis
uuauaauucauuuuuu

SEQ ID NO: 2254980 - RNA, 19 nt, Yersinia pestis
uuauaauccacugaaauaa

SEQ ID NO: 2254981 - RNA, 20 nt, Yersinia pestis
uuauaaugagaauguaaauu

SEQ ID NO: 2254982 - RNA, 13 nt, Yersinia pestis
uuauaauauuaaa

SEQ ID NO: 2254983 - RNA, 14 nt, Yersinia pestis
uuauacauauguug

SEQ ID NO: 2254984 - RNA, 21 nt, Yersinia pestis
uuauacauaucuuuauuauca

SEQ ID NO: 2254985 - RNA, 20 nt, Yersinia pestis
uuauacccauacaaauagua

SEQ ID NO: 2254986 - RNA, 22 nt, Yersinia pestis
uuauacccauacaaauaguaau

SEQ ID NO: 2254987 - RNA, 20 nt, Yersinia pestis
uuauagaauacaggguaaau

SEQ ID NO: 2254988 - RNA, 18 nt, Yersinia pestis
uuacucagcacauuuuua

SEQ ID NO: 2254989 - RNA, 13 nt, Yersinia pestis
uuacuauuuuucu

SEQ ID NO: 2254990 - RNA, 17 nt, Yersinia pestis
uuacucaguucagcccc

SEQ ID NO: 2254991 - RNA, 18 nt, Yersinia pestis
uuacucaggaacaagacu

SEQ ID NO: 2254992 - RNA, 18 nt, Yersinia pestis
uuacucauuauggauaau

SEQ ID NO: 2254993 - RNA, 14 nt, Yersinia pestis
uuacuaacuggcug

SEQ ID NO: 2254994 - RNA, 19 nt, Yersinia pestis
uuacguuucauaugucacc

SEQ ID NO: 2254995 - RNA, 19 nt, Yersinia pestis
uuacccucuaucgcucacu

SEQ ID NO: 2254996 - RNA, 22 nt, Yersinia pestis
uuacccugcgggugcuuuaaug

SEQ ID NO: 2254997 - RNA, 14 nt, Yersinia pestis
uuacccguacaaaa

SEQ ID NO: 2254998 - RNA, 17 nt, Yersinia pestis
uuacgugaucaucuuuu

SEQ ID NO: 2254999 - RNA, 19 nt, Yersinia pestis
uuacgugucagacugcuga

SEQ ID NO: 2255000 - RNA, 19 nt, Yersinia pestis
uuacguguucuuaauuuaa

SEQ ID NO: 2255001 - RNA, 18 nt, Yersinia pestis
uuacgugaugaugcuagu

SEQ ID NO: 2255002 - RNA, 13 nt, Yersinia pestis
uuacgugauauac

SEQ ID NO: 2255003 - RNA, 16 nt, Yersinia pestis
uuacgugaucaucuuu

SEQ ID NO: 2255004 - RNA, 13 nt, Yersinia pestis
uuacuuuuuauua

SEQ ID NO: 2255005 - RNA, 21 nt, Yersinia pestis
uuacuugugcgcgggcacggg

SEQ ID NO: 2255006 - RNA, 11 nt, Yersinia pestis
uuacuguaaga

SEQ ID NO: 2255007 - RNA, 15 nt, Yersinia pestis
uuacugaugucauca

SEQ ID NO: 2255008 - RNA, 14 nt, Yersinia pestis
uuacuccucugccu

SEQ ID NO: 2255009 - RNA, 17 nt, Yersinia pestis
uuacucccuuguugccu

SEQ ID NO: 2255010 - RNA, 22 nt, Yersinia pestis
uuacugaucaauaaaaaaguca

SEQ ID NO: 2255011 - RNA, 14 nt, Yersinia pestis
uuacugcauucuga

SEQ ID NO: 2255012 - RNA, 21 nt, Yersinia pestis
uuacugcggcuuucugccugu

SEQ ID NO: 2255013 - RNA, 17 nt, Yersinia pestis
uuagcacauaugcagcu

SEQ ID NO: 2255014 - RNA, 20 nt, Yersinia pestis
uuagcaguauuagcuuuacu

SEQ ID NO: 2255015 - RNA, 14 nt, Yersinia pestis
uuagaguaaguaaa

SEQ ID NO: 2255016 - RNA, 14 nt, Yersinia pestis
uuagagucuauaau

SEQ ID NO: 2255017 - RNA, 20 nt, Yersinia pestis
uuacuuuuuauuaaugcuua

SEQ ID NO: 2255018 - RNA, 18 nt, Yersinia pestis
uuagacgucagauuagcu

SEQ ID NO: 2255019 - RNA, 22 nt, Yersinia pestis
uuagacgucagauuagcuuuaa

SEQ ID NO: 2255020 - RNA, 23 nt, Yersinia pestis
uuagacgucagauuaguuuuaga

SEQ ID NO: 2255021 - RNA, 12 nt, Yersinia pestis
uuagcuguuuua

SEQ ID NO: 2255022 - RNA, 13 nt, Yersinia pestis
uuagcugcgcgca

SEQ ID NO: 2255023 - RNA, 19 nt, Yersinia pestis
uuagcuguacuaaaggugu

SEQ ID NO: 2255024 - RNA, 20 nt, Yersinia pestis
uuagcucccccguguucuga

SEQ ID NO: 2255025 - RNA, 16 nt, Yersinia pestis
uuagccauuucaaaac

SEQ ID NO: 2255026 - RNA, 13 nt, Yersinia pestis
uuagccccuucac

SEQ ID NO: 2255027 - RNA, 15 nt, Yersinia pestis
uuagccgaauauccc

SEQ ID NO: 2255028 - RNA, 20 nt, Yersinia pestis
uuagccgaguugacuuuuuu

SEQ ID NO: 2255029 - RNA, 15 nt, Yersinia pestis
uuagcaugcauccau

SEQ ID NO: 2255030 - RNA, 19 nt, Yersinia pestis
uucaagagggcgguuaaau

SEQ ID NO: 2255031 - RNA, 15 nt, Yersinia pestis
uucaagcaauucaga

SEQ ID NO: 2255032 - RNA, 17 nt, Yersinia pestis
uucaagcagcauguguu

SEQ ID NO: 2255033 - RNA, 20 nt, Yersinia pestis
uucaacgcaccauccagcaa

SEQ ID NO: 2255034 - RNA, 15 nt, Yersinia pestis
uucaacgcauccaaa

SEQ ID NO: 2255035 - RNA, 23 nt, Yersinia pestis
uucaagacgggucgcguuggcua

SEQ ID NO: 2255036 - RNA, 22 nt, Yersinia pestis
uucaauaacaccgucuuugacc

SEQ ID NO: 2255037 - RNA, 20 nt, Yersinia pestis
uucaauaauuauaccuaccc

SEQ ID NO: 2255038 - RNA, 22 nt, Yersinia pestis
uucaauacccuaacucuuugga

SEQ ID NO: 2255039 - RNA, 13 nt, Yersinia pestis
uucaauacauggu

SEQ ID NO: 2255040 - RNA, 15 nt, Yersinia pestis
uucaaaccgcuggug

SEQ ID NO: 2255041 - RNA, 14 nt, Yersinia pestis
uucaaacacuuaug

SEQ ID NO: 2255042 - RNA, 14 nt, Yersinia pestis
uucaaaacuaauau

SEQ ID NO: 2255043 - RNA, 15 nt, Yersinia pestis
uucaaaaucaaaaau

SEQ ID NO: 2255044 - RNA, 21 nt, Yersinia pestis
uucaaaauagaggaaauaaau

SEQ ID NO: 2255045 - RNA, 17 nt, Yersinia pestis
uucaaaaggugcaagca

SEQ ID NO: 2255046 - RNA, 20 nt, Yersinia pestis
uucaaaaggugcaagcagcu

SEQ ID NO: 2255047 - RNA, 20 nt, Yersinia pestis
uuauugucucuacucucugu

SEQ ID NO: 2255048 - RNA, 16 nt, Yersinia pestis
uuauugucuuuaauaa

SEQ ID NO: 2255049 - RNA, 18 nt, Yersinia pestis
uuauuguggcuaccaauu

SEQ ID NO: 2255050 - RNA, 17 nt, Yersinia pestis
uuauugaccaccuuauu

SEQ ID NO: 2255051 - RNA, 17 nt, Yersinia pestis
uuauugaguaacauuaa

SEQ ID NO: 2255052 - RNA, 18 nt, Yersinia pestis
uuauugaguaacauuaau

SEQ ID NO: 2255053 - RNA, 12 nt, Yersinia pestis
uuauugacugcc

SEQ ID NO: 2255054 - RNA, 18 nt, Yersinia pestis
uuauugacuguaaauauu

SEQ ID NO: 2255055 - RNA, 23 nt, Yersinia pestis
uuauugagaaucacuacgguuua

SEQ ID NO: 2255056 - RNA, 12 nt, Yersinia pestis
uuauuacugaua

SEQ ID NO: 2255057 - RNA, 16 nt, Yersinia pestis
uuauuacugucacugu

SEQ ID NO: 2255058 - RNA, 14 nt, Yersinia pestis
uuauuacugucauu

SEQ ID NO: 2255059 - RNA, 16 nt, Yersinia pestis
uuauuagacauagaga

SEQ ID NO: 2255060 - RNA, 22 nt, Yersinia pestis
uuauuagagagugauuccagcu

SEQ ID NO: 2255061 - RNA, 11 nt, Yersinia pestis
uuauucuaauu

SEQ ID NO: 2255062 - RNA, 23 nt, Yersinia pestis
uuauucucaauugacuguauaua

SEQ ID NO: 2255063 - RNA, 15 nt, Yersinia pestis
uuauucucacucuau

SEQ ID NO: 2255064 - RNA, 17 nt, Yersinia pestis
uuauuauaggcguugau

SEQ ID NO: 2255065 - RNA, 16 nt, Yersinia pestis
uuauuauaugaucagu

SEQ ID NO: 2255066 - RNA, 21 nt, Yersinia pestis
uuauucuuauuucgcgacuca

SEQ ID NO: 2255067 - RNA, 16 nt, Yersinia pestis
uuauucuuuauuuauu

SEQ ID NO: 2255068 - RNA, 16 nt, Yersinia pestis
uuauuugggguauaua

SEQ ID NO: 2255069 - RNA, 13 nt, Yersinia pestis
uuauuugcuauca

SEQ ID NO: 2255070 - RNA, 23 nt, Yersinia pestis
uuauuuggugaguaaaugcccca

SEQ ID NO: 2255071 - RNA, 13 nt, Yersinia pestis
uuauuuaauuaaa

SEQ ID NO: 2255072 - RNA, 17 nt, Yersinia pestis
uuauuuaauuaaaugua

SEQ ID NO: 2255073 - RNA, 18 nt, Yersinia pestis
uuauuugaaauacuuauu

SEQ ID NO: 2255074 - RNA, 18 nt, Yersinia pestis
uuauuucuguuccaggca

SEQ ID NO: 2255075 - RNA, 21 nt, Yersinia pestis
uuauuuaaacaaugaaauugc

SEQ ID NO: 2255076 - RNA, 20 nt, Yersinia pestis
uuauuuaagcaguucacucu

SEQ ID NO: 2255077 - RNA, 16 nt, Yersinia pestis
uucaaaaauuaaauua

SEQ ID NO: 2255078 - RNA, 21 nt, Yersinia pestis
uuauuuuuuguuuuuauauug

SEQ ID NO: 2255079 - RNA, 14 nt, Yersinia pestis
uucaaucaacugaa

SEQ ID NO: 2255080 - RNA, 23 nt, Yersinia pestis
uucaaucauugagaucaguucag

SEQ ID NO: 2255081 - RNA, 16 nt, Yersinia pestis
uucaauccuacaauau

SEQ ID NO: 2255082 - RNA, 23 nt, Yersinia pestis
uucaccgugacuguuaacaucca

SEQ ID NO: 2255083 - RNA, 23 nt, Yersinia pestis
uucaccguaucaucaccaaacag

SEQ ID NO: 2255084 - RNA, 14 nt, Yersinia pestis
uucacccuugauuu

SEQ ID NO: 2255085 - RNA, 17 nt, Yersinia pestis
uucaccgcuuuucuggu

SEQ ID NO: 2255086 - RNA, 18 nt, Yersinia pestis
uucacccauaccaaccau

SEQ ID NO: 2255087 - RNA, 14 nt, Yersinia pestis
uucaccccagauaa

SEQ ID NO: 2255088 - RNA, 14 nt, Yersinia pestis
uucacccauuaaua

SEQ ID NO: 2255089 - RNA, 16 nt, Yersinia pestis
uucacccauuaauaga

SEQ ID NO: 2255090 - RNA, 16 nt, Yersinia pestis
uucacgauggaaaaaa

SEQ ID NO: 2255091 - RNA, 23 nt, Yersinia pestis
uucaccuaucgguaucucccgca

SEQ ID NO: 2255092 - RNA, 15 nt, Yersinia pestis
uucagcacugcuuuu

SEQ ID NO: 2255093 - RNA, 16 nt, Yersinia pestis
uucagcaccauaaaaa

SEQ ID NO: 2255094 - RNA, 13 nt, Yersinia pestis
uucagagcagcau

SEQ ID NO: 2255095 - RNA, 14 nt, Yersinia pestis
uucagacugaaagu

SEQ ID NO: 2255096 - RNA, 17 nt, Yersinia pestis
uucagacugaaaugaca

SEQ ID NO: 2255097 - RNA, 15 nt, Yersinia pestis
uucagcaagccaaua

SEQ ID NO: 2255098 - RNA, 22 nt, Yersinia pestis
uucaggagauagccucaccgcc

SEQ ID NO: 2255099 - RNA, 13 nt, Yersinia pestis
uucaggccaauag

SEQ ID NO: 2255100 - RNA, 19 nt, Yersinia pestis
uucagcauaucccuguuuu

SEQ ID NO: 2255101 - RNA, 16 nt, Yersinia pestis
uucagcauaaauauuc

SEQ ID NO: 2255102 - RNA, 21 nt, Yersinia pestis
uucagcaggggcaaccucuuc

SEQ ID NO: 2255103 - RNA, 20 nt, Yersinia pestis
uucagccucuguaaaacgau

SEQ ID NO: 2255104 - RNA, 14 nt, Yersinia pestis
uucagcucugccag

SEQ ID NO: 2255105 - RNA, 16 nt, Yersinia pestis
uucagccuauccucac

SEQ ID NO: 2255106 - RNA, 23 nt, Yersinia pestis
uucagcccauggcugaaauaacu

SEQ ID NO: 2255107 - RNA, 22 nt, Yersinia pestis
uuauggauauggaccugaguca

SEQ ID NO: 2255108 - RNA, 18 nt, Yersinia pestis
uuaugccgugacugccgg

SEQ ID NO: 2255109 - RNA, 19 nt, Yersinia pestis
uuauggcguuuuugguuaa

SEQ ID NO: 2255110 - RNA, 16 nt, Yersinia pestis
uuaugggugguuagca

SEQ ID NO: 2255111 - RNA, 16 nt, Yersinia pestis
uuauggcauaaacuga

SEQ ID NO: 2255112 - RNA, 17 nt, Yersinia pestis
uuauggcauaaacugaa

SEQ ID NO: 2255113 - RNA, 19 nt, Yersinia pestis
uuauguaguuaaucuaccc

SEQ ID NO: 2255114 - RNA, 18 nt, Yersinia pestis
uuauguacguucagguau

SEQ ID NO: 2255115 - RNA, 22 nt, Yersinia pestis
uuaugguuuuuaacgauauagg

SEQ ID NO: 2255116 - RNA, 16 nt, Yersinia pestis
uuauuaaacagucuua

SEQ ID NO: 2255117 - RNA, 21 nt, Yersinia pestis
uuauuaaauaagaaguagaau

SEQ ID NO: 2255118 - RNA, 21 nt, Yersinia pestis
uuauguucauucucuacugaa

SEQ ID NO: 2255119 - RNA, 23 nt, Yersinia pestis
uuauuaacgauuauuaaacuauu

SEQ ID NO: 2255120 - RNA, 13 nt, Yersinia pestis
uuauuaaguuuuu

SEQ ID NO: 2255121 - RNA, 19 nt, Yersinia pestis
uuauuaaguuuuucauaau

SEQ ID NO: 2255122 - RNA, 12 nt, Yersinia pestis
uuauuaccuaau

SEQ ID NO: 2255123 - RNA, 15 nt, Yersinia pestis
uuauuacucauuaug

SEQ ID NO: 2255124 - RNA, 16 nt, Yersinia pestis
uuaugaucuugaauaa

SEQ ID NO: 2255125 - RNA, 13 nt, Yersinia pestis
uuaugaguucugc

SEQ ID NO: 2255126 - RNA, 13 nt, Yersinia pestis
uuaugaauaaacc

SEQ ID NO: 2255127 - RNA, 17 nt, Yersinia pestis
uuaugaccaauagucac

SEQ ID NO: 2255128 - RNA, 20 nt, Yersinia pestis
uuaucugagccuucaacaaa

SEQ ID NO: 2255129 - RNA, 15 nt, Yersinia pestis
uuaucugcauuaaaa

SEQ ID NO: 2255130 - RNA, 18 nt, Yersinia pestis
uuaucuguuucaaauaag

SEQ ID NO: 2255131 - RNA, 16 nt, Yersinia pestis
uuaucuguuucaaaua

SEQ ID NO: 2255132 - RNA, 14 nt, Yersinia pestis
uuaucuaaccguca

SEQ ID NO: 2255133 - RNA, 14 nt, Yersinia pestis
uuaucuacuucuau

SEQ ID NO: 2255134 - RNA, 22 nt, Yersinia pestis
uuaucugaauagcgcugcauca

SEQ ID NO: 2255135 - RNA, 13 nt, Yersinia pestis
uuaucuccuguaa

SEQ ID NO: 2255136 - RNA, 19 nt, Yersinia pestis
uuaucucacgcugaauaac

SEQ ID NO: 2255137 - RNA, 17 nt, Yersinia pestis
uuaucucccauuaauua

SEQ ID NO: 2255138 - RNA, 19 nt, Yersinia pestis
uuaucucccauuaauuaau

SEQ ID NO: 2255139 - RNA, 13 nt, Yersinia pestis
uuaucuaaaacug

SEQ ID NO: 2255140 - RNA, 15 nt, Yersinia pestis
uuaucgcaauuucag

SEQ ID NO: 2255141 - RNA, 15 nt, Yersinia pestis
uuaucggcaggcuua

SEQ ID NO: 2255142 - RNA, 22 nt, Yersinia pestis
uuauagcucaucgguaacuuac

SEQ ID NO: 2255143 - RNA, 21 nt, Yersinia pestis
uuauaggucaucccagcacag

SEQ ID NO: 2255144 - RNA, 19 nt, Yersinia pestis
uuauauagaccaagcauuu

SEQ ID NO: 2255145 - RNA, 23 nt, Yersinia pestis
uuauauaguaacuauuuacauaa

SEQ ID NO: 2255146 - RNA, 17 nt, Yersinia pestis
uuauauauccaaaauaa

SEQ ID NO: 2255147 - RNA, 13 nt, Yersinia pestis
uuauauauuuuga

SEQ ID NO: 2255148 - RNA, 14 nt, Yersinia pestis
uuaucaacgaagaa

SEQ ID NO: 2255149 - RNA, 19 nt, Yersinia pestis
uuaucaagaucaaaagcag

SEQ ID NO: 2255150 - RNA, 22 nt, Yersinia pestis
uuaucaagccaaugaaucaaca

SEQ ID NO: 2255151 - RNA, 15 nt, Yersinia pestis
uuaucaaguuaaaua

SEQ ID NO: 2255152 - RNA, 12 nt, Yersinia pestis
uuauauuccaca

SEQ ID NO: 2255153 - RNA, 16 nt, Yersinia pestis
uuauauugauaaaaau

SEQ ID NO: 2255154 - RNA, 18 nt, Yersinia pestis
uuauauugauaaaaauca

SEQ ID NO: 2255155 - RNA, 22 nt, Yersinia pestis
uuauauugaugugaaacauaau

SEQ ID NO: 2255156 - RNA, 16 nt, Yersinia pestis
uuauauugcucaguuc

SEQ ID NO: 2255157 - RNA, 19 nt, Yersinia pestis
uuauaugcgcuggcucuau

SEQ ID NO: 2255158 - RNA, 21 nt, Yersinia pestis
uuauaugcuugacugcguucu

SEQ ID NO: 2255159 - RNA, 14 nt, Yersinia pestis
uuauaucuccacca

SEQ ID NO: 2255160 - RNA, 22 nt, Yersinia pestis
uuauauccgccauccuucaaga

SEQ ID NO: 2255161 - RNA, 13 nt, Yersinia pestis
uuauccuuuuuau

SEQ ID NO: 2255162 - RNA, 15 nt, Yersinia pestis
uuauccuuuuuauuu

SEQ ID NO: 2255163 - RNA, 23 nt, Yersinia pestis
uuauccauccccgccucaaugca

SEQ ID NO: 2255164 - RNA, 18 nt, Yersinia pestis
uuaucccaguuuuuaauu

SEQ ID NO: 2255165 - RNA, 18 nt, Yersinia pestis
uuauccauuuucugccaa

SEQ ID NO: 2255166 - RNA, 17 nt, Yersinia pestis
uuaucccuccaucaagc

SEQ ID NO: 2255167 - RNA, 21 nt, Yersinia pestis
uuaucaucccuugacugacca

SEQ ID NO: 2255168 - RNA, 14 nt, Yersinia pestis
uuaucaggugaacg

SEQ ID NO: 2255169 - RNA, 14 nt, Yersinia pestis
uuaucauuuaaaua

SEQ ID NO: 2255170 - RNA, 21 nt, Yersinia pestis
uuaucauuuaaauacagauca

SEQ ID NO: 2255171 - RNA, 23 nt, Yersinia pestis
uuaucaccuuccgucccaagaaa

SEQ ID NO: 2255172 - RNA, 14 nt, Yersinia pestis
uuaucaccaaaagc

SEQ ID NO: 2255173 - RNA, 13 nt, Yersinia pestis
uuaucacaucauc

SEQ ID NO: 2255174 - RNA, 21 nt, Yersinia pestis
uuaucaccaacguuuauaucc

SEQ ID NO: 2255175 - RNA, 19 nt, Yersinia pestis
uuaucagcccaucuuugau

SEQ ID NO: 2255176 - RNA, 19 nt, Yersinia pestis
uuaucagcgaaaaauuuca

SEQ ID NO: 2255177 - RNA, 17 nt, Yersinia pestis
uuaucacgguugccgcg

SEQ ID NO: 2255178 - RNA, 19 nt, Yersinia pestis
uuaucacgucgccaauuuu

SEQ ID NO: 2255179 - RNA, 22 nt, Yersinia pestis
uuaucacuguccaagaagccaa

SEQ ID NO: 2255180 - RNA, 12 nt, Yersinia pestis
uucucaucauca

SEQ ID NO: 2255181 - RNA, 13 nt, Yersinia pestis
uucucagcaaggu

SEQ ID NO: 2255182 - RNA, 23 nt, Yersinia pestis
uucucuaugcguguugccaccug

SEQ ID NO: 2255183 - RNA, 19 nt, Yersinia pestis
uucucuauucugcuuuuug

SEQ ID NO: 2255184 - RNA, 13 nt, Yersinia pestis
uucucuuuaucaa

SEQ ID NO: 2255185 - RNA, 13 nt, Yersinia pestis
uucucuuggcuga

SEQ ID NO: 2255186 - RNA, 15 nt, Yersinia pestis
uucugaucauuauua

SEQ ID NO: 2255187 - RNA, 17 nt, Yersinia pestis
uucucuggcuaaugucu

SEQ ID NO: 2255188 - RNA, 22 nt, Yersinia pestis
uucucugcgcuguaagcaccag

SEQ ID NO: 2255189 - RNA, 14 nt, Yersinia pestis
uucucugcucgcau

SEQ ID NO: 2255190 - RNA, 11 nt, Yersinia pestis
uucuauaaaac

SEQ ID NO: 2255191 - RNA, 15 nt, Yersinia pestis
uucuauaccaauuga

SEQ ID NO: 2255192 - RNA, 18 nt, Yersinia pestis
uucuauuuccacaagcgu

SEQ ID NO: 2255193 - RNA, 19 nt, Yersinia pestis
uucuaaguaaaacaaagua

SEQ ID NO: 2255194 - RNA, 20 nt, Yersinia pestis
uucgucaauuuuugccuuuc

SEQ ID NO: 2255195 - RNA, 22 nt, Yersinia pestis
uucgucaccaucaauauaagag

SEQ ID NO: 2255196 - RNA, 19 nt, Yersinia pestis
uucguauguuuuuaacaaa

SEQ ID NO: 2255197 - RNA, 20 nt, Yersinia pestis
uucgugcucaucaaccucag

SEQ ID NO: 2255198 - RNA, 23 nt, Yersinia pestis
uucguggugggcgguaguauuug

SEQ ID NO: 2255199 - RNA, 22 nt, Yersinia pestis
uucguagaaacaucgccagcgg

SEQ ID NO: 2255200 - RNA, 24 nt, Yersinia pestis
uucguagaguugcaguucaucaau

SEQ ID NO: 2255201 - RNA, 13 nt, Yersinia pestis
uucgguggcccuu

SEQ ID NO: 2255202 - RNA, 14 nt, Yersinia pestis
uucgcuuucaucuu

SEQ ID NO: 2255203 - RNA, 15 nt, Yersinia pestis
uucgcaucuuccaaa

SEQ ID NO: 2255204 - RNA, 17 nt, Yersinia pestis
uucgcaucuuccaaagg

SEQ ID NO: 2255205 - RNA, 13 nt, Yersinia pestis
uucgcgaacacaa

SEQ ID NO: 2255206 - RNA, 19 nt, Yersinia pestis
uucgcuauuucucucuacu

SEQ ID NO: 2255207 - RNA, 21 nt, Yersinia pestis
uucgcuauuucaaugggaugc

SEQ ID NO: 2255208 - RNA, 17 nt, Yersinia pestis
uucgcuauuucucucua

SEQ ID NO: 2255209 - RNA, 22 nt, Yersinia pestis
uuccuuugcccuuacuauuuuu

SEQ ID NO: 2255210 - RNA, 21 nt, Yersinia pestis
uuccuuuauuuuucauucuau

SEQ ID NO: 2255211 - RNA, 15 nt, Yersinia pestis
uucgaaagaaauaaa

SEQ ID NO: 2255212 - RNA, 21 nt, Yersinia pestis
uucgaaagaaauaaaagaaaa

SEQ ID NO: 2255213 - RNA, 23 nt, Yersinia pestis
uucgaaagaaauaaaagaaaacc

SEQ ID NO: 2255214 - RNA, 15 nt, Yersinia pestis
uuccaucgucaauuc

SEQ ID NO: 2255215 - RNA, 23 nt, Yersinia pestis
uuccaugcccagcguuggcagaa

SEQ ID NO: 2255216 - RNA, 21 nt, Yersinia pestis
uuccauuggagauccguuuuu

SEQ ID NO: 2255217 - RNA, 15 nt, Yersinia pestis
uuccaguaaaaaaau

SEQ ID NO: 2255218 - RNA, 18 nt, Yersinia pestis
uuccaguucgauauuauu

SEQ ID NO: 2255219 - RNA, 17 nt, Yersinia pestis
uuccagauagcgaauca

SEQ ID NO: 2255220 - RNA, 11 nt, Yersinia pestis
uuccagaucuu

SEQ ID NO: 2255221 - RNA, 23 nt, Yersinia pestis
uuccagcgcccggcugaccuguu

SEQ ID NO: 2255222 - RNA, 18 nt, Yersinia pestis
uuccacucucugcuuacu

SEQ ID NO: 2255223 - RNA, 21 nt, Yersinia pestis
uuccacucuuucaaugauggc

SEQ ID NO: 2255224 - RNA, 22 nt, Yersinia pestis
uuccacauggcugcucagccac

SEQ ID NO: 2255225 - RNA, 15 nt, Yersinia pestis
uuccacccgcugcac

SEQ ID NO: 2255226 - RNA, 16 nt, Yersinia pestis
uuccacaauguugaua

SEQ ID NO: 2255227 - RNA, 15 nt, Yersinia pestis
uuccaauucauaaua

SEQ ID NO: 2255228 - RNA, 20 nt, Yersinia pestis
uuccaauuggugcuuuaugu

SEQ ID NO: 2255229 - RNA, 21 nt, Yersinia pestis
uucagguaccccauaaauccc

SEQ ID NO: 2255230 - RNA, 20 nt, Yersinia pestis
uucaggccacgcaauucauc

SEQ ID NO: 2255231 - RNA, 15 nt, Yersinia pestis
uucagguaauuuaua

SEQ ID NO: 2255232 - RNA, 19 nt, Yersinia pestis
uucagggcguauaaacaga

SEQ ID NO: 2255233 - RNA, 22 nt, Yersinia pestis
uuccccaccauugcaaacauca

SEQ ID NO: 2255234 - RNA, 18 nt, Yersinia pestis
uucccgacagaacugauu

SEQ ID NO: 2255235 - RNA, 20 nt, Yersinia pestis
uucccgaggagagaaaauuu

SEQ ID NO: 2255236 - RNA, 19 nt, Yersinia pestis
uucccgauggaacaggauu

SEQ ID NO: 2255237 - RNA, 20 nt, Yersinia pestis
uucccgauuauugugccgcc

SEQ ID NO: 2255238 - RNA, 23 nt, Yersinia pestis
uucccgccaaccaggucaguuuu

SEQ ID NO: 2255239 - RNA, 17 nt, Yersinia pestis
uuccgagcaaucaaaag

SEQ ID NO: 2255240 - RNA, 19 nt, Yersinia pestis
uucccaccauaaugugccu

SEQ ID NO: 2255241 - RNA, 20 nt, Yersinia pestis
uucccaguaagcucuacuaa

SEQ ID NO: 2255242 - RNA, 18 nt, Yersinia pestis
uuccgcgccguguaguuu

SEQ ID NO: 2255243 - RNA, 21 nt, Yersinia pestis
uuccgcuucacauuugaaaug

SEQ ID NO: 2255244 - RNA, 16 nt, Yersinia pestis
uuccucccagaauaau

SEQ ID NO: 2255245 - RNA, 12 nt, Yersinia pestis
uuccuguuuauu

SEQ ID NO: 2255246 - RNA, 15 nt, Yersinia pestis
uuccuggcggcaaca

SEQ ID NO: 2255247 - RNA, 20 nt, Yersinia pestis
uuccugauggccguaucaug

SEQ ID NO: 2255248 - RNA, 16 nt, Yersinia pestis
uuccugaucaacugcu

SEQ ID NO: 2255249 - RNA, 21 nt, Yersinia pestis
uugccucugcuagcaaauucc

SEQ ID NO: 2255250 - RNA, 20 nt, Yersinia pestis
uugcccgcgcuuccaggcug

SEQ ID NO: 2255251 - RNA, 21 nt, Yersinia pestis
uugcccgcgcuuccaggcuga

SEQ ID NO: 2255252 - RNA, 23 nt, Yersinia pestis
uugcacgguguaaauaacaccca

SEQ ID NO: 2255253 - RNA, 14 nt, Yersinia pestis
uugccaaaugcaaa

SEQ ID NO: 2255254 - RNA, 14 nt, Yersinia pestis
uugccaaaauuuua

SEQ ID NO: 2255255 - RNA, 15 nt, Yersinia pestis
uugccacauuucccu

SEQ ID NO: 2255256 - RNA, 23 nt, Yersinia pestis
uugcucacccauuuuauccucuu

SEQ ID NO: 2255257 - RNA, 15 nt, Yersinia pestis
uugcucauguucgca

SEQ ID NO: 2255258 - RNA, 16 nt, Yersinia pestis
uugcucccaucccuca

SEQ ID NO: 2255259 - RNA, 19 nt, Yersinia pestis
uugccuucugcugccagcu

SEQ ID NO: 2255260 - RNA, 21 nt, Yersinia pestis
uugcgcacaaucagggcacuc

SEQ ID NO: 2255261 - RNA, 12 nt, Yersinia pestis
uugccuggccca

SEQ ID NO: 2255262 - RNA, 14 nt, Yersinia pestis
uugcgucaccaggc

SEQ ID NO: 2255263 - RNA, 20 nt, Yersinia pestis
uugcgccgcauuguucucau

SEQ ID NO: 2255264 - RNA, 13 nt, Yersinia pestis
uugcgccgcuuug

SEQ ID NO: 2255265 - RNA, 14 nt, Yersinia pestis
uugcgccgcuuugc

SEQ ID NO: 2255266 - RNA, 19 nt, Yersinia pestis
uugcgccauacaguuaauu

SEQ ID NO: 2255267 - RNA, 20 nt, Yersinia pestis
uugcgugacauacuuugccu

SEQ ID NO: 2255268 - RNA, 20 nt, Yersinia pestis
uugcacaaagcuuacuguuc

SEQ ID NO: 2255269 - RNA, 21 nt, Yersinia pestis
uugcaaugcuuauuucacacu

SEQ ID NO: 2255270 - RNA, 21 nt, Yersinia pestis
uugcaauuaauuggcccauaa

SEQ ID NO: 2255271 - RNA, 18 nt, Yersinia pestis
uugcaauucauguugcca

SEQ ID NO: 2255272 - RNA, 18 nt, Yersinia pestis
uugcaacugagucgcuug

SEQ ID NO: 2255273 - RNA, 19 nt, Yersinia pestis
uugcaacaacgccagauaa

SEQ ID NO: 2255274 - RNA, 22 nt, Yersinia pestis
uugcaacgcaggcacugcagaa

SEQ ID NO: 2255275 - RNA, 13 nt, Yersinia pestis
uugauugauaacg

SEQ ID NO: 2255276 - RNA, 17 nt, Yersinia pestis
uugaugcaaaaccguac

SEQ ID NO: 2255277 - RNA, 14 nt, Yersinia pestis
uugaugccaaggcc

SEQ ID NO: 2255278 - RNA, 15 nt, Yersinia pestis
uugaugaugagcgca

SEQ ID NO: 2255279 - RNA, 14 nt, Yersinia pestis
uugaugaguaaaca

SEQ ID NO: 2255280 - RNA, 16 nt, Yersinia pestis
uugaugaguaaacaga

SEQ ID NO: 2255281 - RNA, 22 nt, Yersinia pestis
uugauucaaaaugccagucaau

SEQ ID NO: 2255282 - RNA, 12 nt, Yersinia pestis
uugauucaccag

SEQ ID NO: 2255283 - RNA, 15 nt, Yersinia pestis
uugauucucauuaau

SEQ ID NO: 2255284 - RNA, 18 nt, Yersinia pestis
uugacuuuuuuuaaccaa

SEQ ID NO: 2255285 - RNA, 15 nt, Yersinia pestis
uugacuuugucagca

SEQ ID NO: 2255286 - RNA, 13 nt, Yersinia pestis
uugacuuuaauua

SEQ ID NO: 2255287 - RNA, 14 nt, Yersinia pestis
uugacuuaacaguu

SEQ ID NO: 2255288 - RNA, 15 nt, Yersinia pestis
uugacuuaacaguua

SEQ ID NO: 2255289 - RNA, 13 nt, Yersinia pestis
uugagaaauauuu

SEQ ID NO: 2255290 - RNA, 13 nt, Yersinia pestis
uugagaaaugaau

SEQ ID NO: 2255291 - RNA, 18 nt, Yersinia pestis
uugauaaaaaucuuuuaa

SEQ ID NO: 2255292 - RNA, 21 nt, Yersinia pestis
uugagcaaaaauauacccgac

SEQ ID NO: 2255293 - RNA, 18 nt, Yersinia pestis
uugauaucuucggcggcu

SEQ ID NO: 2255294 - RNA, 13 nt, Yersinia pestis
uugauauauagaa

SEQ ID NO: 2255295 - RNA, 15 nt, Yersinia pestis
uugauauuauuuaua

SEQ ID NO: 2255296 - RNA, 16 nt, Yersinia pestis
uugauauuauuuauau

SEQ ID NO: 2255297 - RNA, 22 nt, Yersinia pestis
uugauccgauaaacuucacaau

SEQ ID NO: 2255298 - RNA, 13 nt, Yersinia pestis
uugauccauccau

SEQ ID NO: 2255299 - RNA, 22 nt, Yersinia pestis
uugaucaguaaacgguugcugu

SEQ ID NO: 2255300 - RNA, 17 nt, Yersinia pestis
uucuuuugcuguauuuu

SEQ ID NO: 2255301 - RNA, 21 nt, Yersinia pestis
uugaaagcgugacgcugaaca

SEQ ID NO: 2255302 - RNA, 16 nt, Yersinia pestis
uugaaaucauugcucu

SEQ ID NO: 2255303 - RNA, 12 nt, Yersinia pestis
uugaaacagcag

SEQ ID NO: 2255304 - RNA, 17 nt, Yersinia pestis
uugaaacucaacgaucu

SEQ ID NO: 2255305 - RNA, 22 nt, Yersinia pestis
uugaacaaaccccacuaacgcu

SEQ ID NO: 2255306 - RNA, 18 nt, Yersinia pestis
uugaacauucaucuuuug

SEQ ID NO: 2255307 - RNA, 13 nt, Yersinia pestis
uucuuucaacgca

SEQ ID NO: 2255308 - RNA, 13 nt, Yersinia pestis
uucuuucacuaau

SEQ ID NO: 2255309 - RNA, 22 nt, Yersinia pestis
uucuuuacgguuaaaacaguaa

SEQ ID NO: 2255310 - RNA, 14 nt, Yersinia pestis
uucuugauaccaua

SEQ ID NO: 2255311 - RNA, 17 nt, Yersinia pestis
uucugcauaagcaucag

SEQ ID NO: 2255312 - RNA, 17 nt, Yersinia pestis
uucugccuauccucacc

SEQ ID NO: 2255313 - RNA, 14 nt, Yersinia pestis
uucugcgagcguuu

SEQ ID NO: 2255314 - RNA, 13 nt, Yersinia pestis
uugaauuaaaaac

SEQ ID NO: 2255315 - RNA, 23 nt, Yersinia pestis
uugaauauuuuuaaucugcccag

SEQ ID NO: 2255316 - RNA, 12 nt, Yersinia pestis
uugaauaauccg

SEQ ID NO: 2255317 - RNA, 14 nt, Yersinia pestis
uugaauaacuucuc

SEQ ID NO: 2255318 - RNA, 16 nt, Yersinia pestis
uugaagcgcucaagua

SEQ ID NO: 2255319 - RNA, 16 nt, Yersinia pestis
uugaagauuuaaauaa

SEQ ID NO: 2255320 - RNA, 11 nt, Yersinia pestis
uugaagauacc

SEQ ID NO: 2255321 - RNA, 15 nt, Yersinia pestis
uugaacgugccccaa

SEQ ID NO: 2255322 - RNA, 18 nt, Yersinia pestis
uugacacaucccaacgca

SEQ ID NO: 2255323 - RNA, 17 nt, Yersinia pestis
uugaccaauaaaaugca

SEQ ID NO: 2255324 - RNA, 12 nt, Yersinia pestis
uugacagcaucu

SEQ ID NO: 2255325 - RNA, 20 nt, Yersinia pestis
uugacugaccauaaaaggau

SEQ ID NO: 2255326 - RNA, 18 nt, Yersinia pestis
uugacuaauuaauaacca

SEQ ID NO: 2255327 - RNA, 16 nt, Yersinia pestis
uugacuaaauuucucg

SEQ ID NO: 2255328 - RNA, 23 nt, Yersinia pestis
uugacgguucgaaaauaaugaau

SEQ ID NO: 2255329 - RNA, 20 nt, Yersinia pestis
uuuacaaaccauauuauuua

SEQ ID NO: 2255330 - RNA, 23 nt, Yersinia pestis
uuuacaccacuaguuaaaaccag

SEQ ID NO: 2255331 - RNA, 23 nt, Yersinia pestis
uuuaccacgucuaauugcugccc

SEQ ID NO: 2255332 - RNA, 14 nt, Yersinia pestis
uuuacccagccaag

SEQ ID NO: 2255333 - RNA, 17 nt, Yersinia pestis
uuuacccagccaagacu

SEQ ID NO: 2255334 - RNA, 17 nt, Yersinia pestis
uuuaauugcugauguca

SEQ ID NO: 2255335 - RNA, 16 nt, Yersinia pestis
uuuaauuuaugaacac

SEQ ID NO: 2255336 - RNA, 12 nt, Yersinia pestis
uuuaauuauaau

SEQ ID NO: 2255337 - RNA, 22 nt, Yersinia pestis
uuuaauuauaauccacugaaau

SEQ ID NO: 2255338 - RNA, 18 nt, Yersinia pestis
uuuaauuaguuuaucagu

SEQ ID NO: 2255339 - RNA, 14 nt, Yersinia pestis
uuuaauuaaaaaua

SEQ ID NO: 2255340 - RNA, 15 nt, Yersinia pestis
uuuaauuaaaaauag

SEQ ID NO: 2255341 - RNA, 18 nt, Yersinia pestis
uuuaacgccaccaaugca

SEQ ID NO: 2255342 - RNA, 18 nt, Yersinia pestis
uuuaacggcuguuguucu

SEQ ID NO: 2255343 - RNA, 19 nt, Yersinia pestis
uuuacgcaaguaaaaguca

SEQ ID NO: 2255344 - RNA, 23 nt, Yersinia pestis
uuuacucgcaauaccaaugucuu

SEQ ID NO: 2255345 - RNA, 21 nt, Yersinia pestis
uuuacuguuaauccaguugag

SEQ ID NO: 2255346 - RNA, 21 nt, Yersinia pestis
uuuacuggcgggcauuuucua

SEQ ID NO: 2255347 - RNA, 19 nt, Yersinia pestis
uuuacugggugauguccug

SEQ ID NO: 2255348 - RNA, 21 nt, Yersinia pestis
uuuacugcuuuucuaccugag

SEQ ID NO: 2255349 - RNA, 19 nt, Yersinia pestis
uuuaggcgggcaguauaau

SEQ ID NO: 2255350 - RNA, 23 nt, Yersinia pestis
uuuaggguauagcaugaaugaaa

SEQ ID NO: 2255351 - RNA, 20 nt, Yersinia pestis
uugcugcaacgccaaugacg

SEQ ID NO: 2255352 - RNA, 14 nt, Yersinia pestis
uugcugcaaccacu

SEQ ID NO: 2255353 - RNA, 20 nt, Yersinia pestis
uugcugaguaaauuaaauuu

SEQ ID NO: 2255354 - RNA, 21 nt, Yersinia pestis
uugcugaguggacgauaaauu

SEQ ID NO: 2255355 - RNA, 17 nt, Yersinia pestis
uuguuauuuuaauuuaa

SEQ ID NO: 2255356 - RNA, 13 nt, Yersinia pestis
uuguuauuacuaa

SEQ ID NO: 2255357 - RNA, 21 nt, Yersinia pestis
uuguugccuuucuguaacuca

SEQ ID NO: 2255358 - RNA, 17 nt, Yersinia pestis
uuuaaaaaaauuaucau

SEQ ID NO: 2255359 - RNA, 11 nt, Yersinia pestis
uuuaaaaaaau

SEQ ID NO: 2255360 - RNA, 15 nt, Yersinia pestis
uuguuuuuacgugau

SEQ ID NO: 2255361 - RNA, 18 nt, Yersinia pestis
uuuaaaaacccucuucaa

SEQ ID NO: 2255362 - RNA, 22 nt, Yersinia pestis
uuguuuaaucaccgcuguggaa

SEQ ID NO: 2255363 - RNA, 21 nt, Yersinia pestis
uuguuucaauaaaucccgcuu

SEQ ID NO: 2255364 - RNA, 17 nt, Yersinia pestis
uuuaaccgcucaguauu

SEQ ID NO: 2255365 - RNA, 12 nt, Yersinia pestis
uuuaacaaaaaa

SEQ ID NO: 2255366 - RNA, 15 nt, Yersinia pestis
uuuaacaaaaaauua

SEQ ID NO: 2255367 - RNA, 12 nt, Yersinia pestis
uuuaacaacaac

SEQ ID NO: 2255368 - RNA, 17 nt, Yersinia pestis
uuuaacaauuuaucaga

SEQ ID NO: 2255369 - RNA, 21 nt, Yersinia pestis
uuuaacacauuccaguaaaaa

SEQ ID NO: 2255370 - RNA, 20 nt, Yersinia pestis
uuuaaaucuuucuccaguaa

SEQ ID NO: 2255371 - RNA, 14 nt, Yersinia pestis
uuuaaauaugaucu

SEQ ID NO: 2255372 - RNA, 21 nt, Yersinia pestis
uuuaaauuacgguuuaccacc

SEQ ID NO: 2255373 - RNA, 19 nt, Yersinia pestis
uuuaaauuccgguguuuuu

SEQ ID NO: 2255374 - RNA, 12 nt, Yersinia pestis
uuuaaaguuuuu

SEQ ID NO: 2255375 - RNA, 17 nt, Yersinia pestis
uuucaauacuauuccgu

SEQ ID NO: 2255376 - RNA, 23 nt, Yersinia pestis
uuucaagugguagauguauuagu

SEQ ID NO: 2255377 - RNA, 23 nt, Yersinia pestis
uuucaaguggucuaucauuuacg

SEQ ID NO: 2255378 - RNA, 14 nt, Yersinia pestis
uuucaauaacaccg

SEQ ID NO: 2255379 - RNA, 12 nt, Yersinia pestis
uuucaauugccc

SEQ ID NO: 2255380 - RNA, 21 nt, Yersinia pestis
uuucaauugcccccuagugau

SEQ ID NO: 2255381 - RNA, 17 nt, Yersinia pestis
uuucaaucacuucugcu

SEQ ID NO: 2255382 - RNA, 20 nt, Yersinia pestis
uuucacccuugauuuuacca

SEQ ID NO: 2255383 - RNA, 23 nt, Yersinia pestis
uuucacccuugauuuuaccaaca

SEQ ID NO: 2255384 - RNA, 17 nt, Yersinia pestis
uuucacggauaucaaca

SEQ ID NO: 2255385 - RNA, 17 nt, Yersinia pestis
uuucaccaaccaauuug

SEQ ID NO: 2255386 - RNA, 15 nt, Yersinia pestis
uuucacccucugcgu

SEQ ID NO: 2255387 - RNA, 23 nt, Yersinia pestis
uuucaaauaguagaucuauuagg

SEQ ID NO: 2255388 - RNA, 21 nt, Yersinia pestis
uuucaaauuaucgaucacaug

SEQ ID NO: 2255389 - RNA, 18 nt, Yersinia pestis
uuucaacgcauccaaaua

SEQ ID NO: 2255390 - RNA, 23 nt, Yersinia pestis
uuucaaaguaaaauaaaaaagua

SEQ ID NO: 2255391 - RNA, 11 nt, Yersinia pestis
uuuauuauuca

SEQ ID NO: 2255392 - RNA, 23 nt, Yersinia pestis
uuuauucacagcagaacaaaaca

SEQ ID NO: 2255393 - RNA, 16 nt, Yersinia pestis
uuuauucaagugcuca

SEQ ID NO: 2255394 - RNA, 18 nt, Yersinia pestis
uuuauuaucaucuuucau

SEQ ID NO: 2255395 - RNA, 15 nt, Yersinia pestis
uuuauuauauauuuu

SEQ ID NO: 2255396 - RNA, 22 nt, Yersinia pestis
uuuauuuccgaauuaaaaauca

SEQ ID NO: 2255397 - RNA, 18 nt, Yersinia pestis
uuuauacggcuauuuuua

SEQ ID NO: 2255398 - RNA, 24 nt, Yersinia pestis
uuuauacuuugcgcgcuguggcua

SEQ ID NO: 2255399 - RNA, 17 nt, Yersinia pestis
uuucaugauucucuauu

SEQ ID NO: 2255400 - RNA, 14 nt, Yersinia pestis
uuucauuagucaau

SEQ ID NO: 2255401 - RNA, 16 nt, Yersinia pestis
uuucaucucaauaacu

SEQ ID NO: 2255402 - RNA, 15 nt, Yersinia pestis
uuucaucugugccug

SEQ ID NO: 2255403 - RNA, 18 nt, Yersinia pestis
uuucaucgcugaauuuag

SEQ ID NO: 2255404 - RNA, 12 nt, Yersinia pestis
uuucauauguca

SEQ ID NO: 2255405 - RNA, 21 nt, Yersinia pestis
uuucauuuguuggcaaauuaa

SEQ ID NO: 2255406 - RNA, 20 nt, Yersinia pestis
uuucauuuuaacaauuuuau

SEQ ID NO: 2255407 - RNA, 15 nt, Yersinia pestis
uuuccaaaugaaaaa

SEQ ID NO: 2255408 - RNA, 15 nt, Yersinia pestis
uuuccaauaccaauu

SEQ ID NO: 2255409 - RNA, 21 nt, Yersinia pestis
uuuccacgcccaacucuuuag

SEQ ID NO: 2255410 - RNA, 16 nt, Yersinia pestis
uuucaguggcuucucu

SEQ ID NO: 2255411 - RNA, 17 nt, Yersinia pestis
uuucaguaagauacuug

SEQ ID NO: 2255412 - RNA, 12 nt, Yersinia pestis
uuucagcugcuu

SEQ ID NO: 2255413 - RNA, 21 nt, Yersinia pestis
uuucagcucuucaauuuccau

SEQ ID NO: 2255414 - RNA, 19 nt, Yersinia pestis
uuucaggagugaauuucuu

SEQ ID NO: 2255415 - RNA, 19 nt, Yersinia pestis
uuucagggaguaacuugac

SEQ ID NO: 2255416 - RNA, 14 nt, Yersinia pestis
uuucaggugacuga

SEQ ID NO: 2255417 - RNA, 15 nt, Yersinia pestis
uuucauaauaaugau

SEQ ID NO: 2255418 - RNA, 23 nt, Yersinia pestis
uuucagcaccauaaaaacuucag

SEQ ID NO: 2255419 - RNA, 15 nt, Yersinia pestis
uuucagcaccauaaa

SEQ ID NO: 2255420 - RNA, 17 nt, Yersinia pestis
uuucagacccuaauauc

SEQ ID NO: 2255421 - RNA, 14 nt, Yersinia pestis
uuucagauaaaaau

SEQ ID NO: 2255422 - RNA, 11 nt, Yersinia pestis
uuucagacucc

SEQ ID NO: 2255423 - RNA, 23 nt, Yersinia pestis
uuucacuggccuauuaagauaau

SEQ ID NO: 2255424 - RNA, 20 nt, Yersinia pestis
uuucacuggccuauuaagau

SEQ ID NO: 2255425 - RNA, 13 nt, Yersinia pestis
uuucacuuccauu

SEQ ID NO: 2255426 - RNA, 19 nt, Yersinia pestis
uuugauaauuucaguucag

SEQ ID NO: 2255427 - RNA, 16 nt, Yersinia pestis
uuugaucauggcuugu

SEQ ID NO: 2255428 - RNA, 15 nt, Yersinia pestis
uuugauuaaaacccc

SEQ ID NO: 2255429 - RNA, 13 nt, Yersinia pestis
uuugcagaaagua

SEQ ID NO: 2255430 - RNA, 12 nt, Yersinia pestis
uuugcaauuaau

SEQ ID NO: 2255431 - RNA, 21 nt, Yersinia pestis
uuugauucgucugccauugcu

SEQ ID NO: 2255432 - RNA, 16 nt, Yersinia pestis
uuugauucaaaaugcc

SEQ ID NO: 2255433 - RNA, 19 nt, Yersinia pestis
uuugauucaaaaugccagu

SEQ ID NO: 2255434 - RNA, 14 nt, Yersinia pestis
uuugauuugaagau

SEQ ID NO: 2255435 - RNA, 13 nt, Yersinia pestis
uuugccucugcua

SEQ ID NO: 2255436 - RNA, 15 nt, Yersinia pestis
uuugcauauuucucu

SEQ ID NO: 2255437 - RNA, 14 nt, Yersinia pestis
uuugcuauugaaca

SEQ ID NO: 2255438 - RNA, 15 nt, Yersinia pestis
uuugcguuaucuuuu

SEQ ID NO: 2255439 - RNA, 20 nt, Yersinia pestis
uuugcguaauaggcugcgca

SEQ ID NO: 2255440 - RNA, 19 nt, Yersinia pestis
uuugcgauacaccauuucc

SEQ ID NO: 2255441 - RNA, 24 nt, Yersinia pestis
uuugcgauacaccauuuccaggcu

SEQ ID NO: 2255442 - RNA, 22 nt, Yersinia pestis
uuugcgggacauuuuaaagaau

SEQ ID NO: 2255443 - RNA, 14 nt, Yersinia pestis
uuucuuuaugucuu

SEQ ID NO: 2255444 - RNA, 14 nt, Yersinia pestis
uuucuuucaguaau

SEQ ID NO: 2255445 - RNA, 18 nt, Yersinia pestis
uuucuuuuaaaucagaag

SEQ ID NO: 2255446 - RNA, 20 nt, Yersinia pestis
uuucuuuucgcuauuucucu

SEQ ID NO: 2255447 - RNA, 23 nt, Yersinia pestis
uuucuguugaugaguaaacagag

SEQ ID NO: 2255448 - RNA, 23 nt, Yersinia pestis
uuucuuagaccaccgccauuucc

SEQ ID NO: 2255449 - RNA, 17 nt, Yersinia pestis
uuucuuacuaaaauauc

SEQ ID NO: 2255450 - RNA, 15 nt, Yersinia pestis
uuucuuacuaaaaua

SEQ ID NO: 2255451 - RNA, 22 nt, Yersinia pestis
uuugaagauuuaacgcauuagc

SEQ ID NO: 2255452 - RNA, 21 nt, Yersinia pestis
uuugaagacaacucuucuauc

SEQ ID NO: 2255453 - RNA, 21 nt, Yersinia pestis
uuugaaauaacgccacaauau

SEQ ID NO: 2255454 - RNA, 14 nt, Yersinia pestis
uuugacuggaauau

SEQ ID NO: 2255455 - RNA, 23 nt, Yersinia pestis
uuugacuuugucagcagucugag

SEQ ID NO: 2255456 - RNA, 23 nt, Yersinia pestis
uuugagauauaggcaucuuucag

SEQ ID NO: 2255457 - RNA, 17 nt, Yersinia pestis
uuugagcuugcugcuga

SEQ ID NO: 2255458 - RNA, 18 nt, Yersinia pestis
uuugacacgggaucaaca

SEQ ID NO: 2255459 - RNA, 22 nt, Yersinia pestis
uuugaauuuggugguggccugg

SEQ ID NO: 2255460 - RNA, 15 nt, Yersinia pestis
uuugaauggcugcca

SEQ ID NO: 2255461 - RNA, 18 nt, Yersinia pestis
uuugaauggcugccauca

SEQ ID NO: 2255462 - RNA, 14 nt, Yersinia pestis
uuucgaguugaacu

SEQ ID NO: 2255463 - RNA, 18 nt, Yersinia pestis
uuucgaguaguuuggcua

SEQ ID NO: 2255464 - RNA, 14 nt, Yersinia pestis
uuuccuaugugaua

SEQ ID NO: 2255465 - RNA, 18 nt, Yersinia pestis
uuuccuguauuuccugua

SEQ ID NO: 2255466 - RNA, 20 nt, Yersinia pestis
uuuccccuggcguuccugga

SEQ ID NO: 2255467 - RNA, 23 nt, Yersinia pestis
uuucccgaggagagaaaauuucu

SEQ ID NO: 2255468 - RNA, 20 nt, Yersinia pestis
uuuccauuggagauccguuu

SEQ ID NO: 2255469 - RNA, 14 nt, Yersinia pestis
uuuccaucugcaau

SEQ ID NO: 2255470 - RNA, 18 nt, Yersinia pestis
uuucccucagccaaagca

SEQ ID NO: 2255471 - RNA, 18 nt, Yersinia pestis
uuucccgcucuucaccaa

SEQ ID NO: 2255472 - RNA, 19 nt, Yersinia pestis
uuucccgcuagcuacccga

SEQ ID NO: 2255473 - RNA, 16 nt, Yersinia pestis
uuuccgccaugagaac

SEQ ID NO: 2255474 - RNA, 13 nt, Yersinia pestis
uuucuaucccuau

SEQ ID NO: 2255475 - RNA, 13 nt, Yersinia pestis
uuucuaguggcaa

SEQ ID NO: 2255476 - RNA, 17 nt, Yersinia pestis
uuucuaccgcuucagca

SEQ ID NO: 2255477 - RNA, 15 nt, Yersinia pestis
uuucgguaauacuga

SEQ ID NO: 2255478 - RNA, 14 nt, Yersinia pestis
uuucgggcaaaaaa

SEQ ID NO: 2255479 - RNA, 15 nt, Yersinia pestis
uuucgggcaaaaaaa

SEQ ID NO: 2255480 - RNA, 17 nt, Yersinia pestis
uuucguuguagacuucc

SEQ ID NO: 2255481 - RNA, 17 nt, Yersinia pestis
uuucguuuaaaaaauau

SEQ ID NO: 2255482 - RNA, 15 nt, Yersinia pestis
uuucucaucgcuuuu

SEQ ID NO: 2255483 - RNA, 15 nt, Yersinia pestis
uuucuccaacuaauc

SEQ ID NO: 2255484 - RNA, 14 nt, Yersinia pestis
uuucucccuuucac

SEQ ID NO: 2255485 - RNA, 20 nt, Yersinia pestis
uuucuccgauucaccuugau

SEQ ID NO: 2255486 - RNA, 13 nt, Yersinia pestis
uuucuauuuucag

SEQ ID NO: 2255487 - RNA, 12 nt, Yersinia pestis
uuucucugccgc

SEQ ID NO: 2255488 - RNA, 18 nt, Yersinia pestis
uuucucucuacuucgucu

SEQ ID NO: 2255489 - RNA, 19 nt, Yersinia pestis
uuucucgacauccaauuca

SEQ ID NO: 2255490 - RNA, 19 nt, Yersinia pestis
uuucucggccaacaucuuc

SEQ ID NO: 2255491 - RNA, 13 nt, Yersinia pestis
uuucugucgaucu

SEQ ID NO: 2255492 - RNA, 13 nt, Yersinia pestis
uuucugccugugg

SEQ ID NO: 2255493 - RNA, 13 nt, Yersinia pestis
uuucugccuaucu

SEQ ID NO: 2255494 - RNA, 13 nt, Yersinia pestis
uuucuggaaugag

SEQ ID NO: 2255495 - RNA, 13 nt, Yersinia pestis
uuuucaaccaaca

SEQ ID NO: 2255496 - RNA, 22 nt, Yersinia pestis
uuuucaaucacuucugcugcca

SEQ ID NO: 2255497 - RNA, 18 nt, Yersinia pestis
uuuucacacgcccaggcc

SEQ ID NO: 2255498 - RNA, 19 nt, Yersinia pestis
uuuucacuccggcaucauc

SEQ ID NO: 2255499 - RNA, 15 nt, Yersinia pestis
uuuucaguuuuaauu

SEQ ID NO: 2255500 - RNA, 21 nt, Yersinia pestis
uuuucaggcuaaugcgcucug

SEQ ID NO: 2255501 - RNA, 19 nt, Yersinia pestis
uuuucgucauuauuaaacu

SEQ ID NO: 2255502 - RNA, 23 nt, Yersinia pestis
uuuucgggccacuacggcgacuu

SEQ ID NO: 2255503 - RNA, 15 nt, Yersinia pestis
uuuucgaacuuaacu

SEQ ID NO: 2255504 - RNA, 21 nt, Yersinia pestis
uuuucgaacuuaacuacugca

SEQ ID NO: 2255505 - RNA, 15 nt, Yersinia pestis
uuuucgacaaaaaag

SEQ ID NO: 2255506 - RNA, 14 nt, Yersinia pestis
uuuucgaacuuaac

SEQ ID NO: 2255507 - RNA, 12 nt, Yersinia pestis
uuuuccugcugc

SEQ ID NO: 2255508 - RNA, 15 nt, Yersinia pestis
uuuuccuauaaacca

SEQ ID NO: 2255509 - RNA, 15 nt, Yersinia pestis
uuuuccguaaccucc

SEQ ID NO: 2255510 - RNA, 17 nt, Yersinia pestis
uuuuauaggucauccca

SEQ ID NO: 2255511 - RNA, 15 nt, Yersinia pestis
uuuuauaaucaucua

SEQ ID NO: 2255512 - RNA, 17 nt, Yersinia pestis
uuuuagcgcuuuuacau

SEQ ID NO: 2255513 - RNA, 19 nt, Yersinia pestis
uuuuagcgcuaaaucagcc

SEQ ID NO: 2255514 - RNA, 20 nt, Yersinia pestis
uuuuaguauuggaaaaauca

SEQ ID NO: 2255515 - RNA, 16 nt, Yersinia pestis
uuuuagauaucagaaa

SEQ ID NO: 2255516 - RNA, 22 nt, Yersinia pestis
uuuuagccgcuucgcugacauu

SEQ ID NO: 2255517 - RNA, 22 nt, Yersinia pestis
uuuuacugggugauguccuguu

SEQ ID NO: 2255518 - RNA, 20 nt, Yersinia pestis
uuuuacugguucauuuucca

SEQ ID NO: 2255519 - RNA, 22 nt, Yersinia pestis
uuuuacugucggucgauuuuua

SEQ ID NO: 2255520 - RNA, 16 nt, Yersinia pestis
uuuuacgcgugauauu

SEQ ID NO: 2255521 - RNA, 16 nt, Yersinia pestis
uuuuacgggccuuuua

SEQ ID NO: 2255522 - RNA, 14 nt, Yersinia pestis
uuuuacgcaaguaa

SEQ ID NO: 2255523 - RNA, 15 nt, Yersinia pestis
uuuuaucauuuaaau

SEQ ID NO: 2255524 - RNA, 22 nt, Yersinia pestis
uuuuauauccgccauccuucaa

SEQ ID NO: 2255525 - RNA, 12 nt, Yersinia pestis
uuuuaucaauag

SEQ ID NO: 2255526 - RNA, 16 nt, Yersinia pestis
uuuuauauauccaaaa

SEQ ID NO: 2255527 - RNA, 16 nt, Yersinia pestis
uuuuaucaacgaagaa

SEQ ID NO: 2255528 - RNA, 13 nt, Yersinia pestis
uuuuaugcccccu

SEQ ID NO: 2255529 - RNA, 20 nt, Yersinia pestis
uuuuaucgcaguaauagaaa

SEQ ID NO: 2255530 - RNA, 21 nt, Yersinia pestis
uuuuaucgugaauaaaaauaa

SEQ ID NO: 2255531 - RNA, 19 nt, Yersinia pestis
uuuuauugucuuuaauaaa

SEQ ID NO: 2255532 - RNA, 15 nt, Yersinia pestis
uuuuauuauuuuuug

SEQ ID NO: 2255533 - RNA, 17 nt, Yersinia pestis
uuuuauuaaguuuuuca

SEQ ID NO: 2255534 - RNA, 14 nt, Yersinia pestis
uuuuauuaaaucac

SEQ ID NO: 2255535 - RNA, 13 nt, Yersinia pestis
uuuuauguuaaau

SEQ ID NO: 2255536 - RNA, 14 nt, Yersinia pestis
uuugucauuuaauu

SEQ ID NO: 2255537 - RNA, 24 nt, Yersinia pestis
uuugucauacacggucuggcaacg

SEQ ID NO: 2255538 - RNA, 15 nt, Yersinia pestis
uuugucaucaaccuc

SEQ ID NO: 2255539 - RNA, 13 nt, Yersinia pestis
uuugucauguuga

SEQ ID NO: 2255540 - RNA, 22 nt, Yersinia pestis
uuugucagcagucugagccuca

SEQ ID NO: 2255541 - RNA, 15 nt, Yersinia pestis
uuugucaauaaccuc

SEQ ID NO: 2255542 - RNA, 13 nt, Yersinia pestis
uuuguauuuuguu

SEQ ID NO: 2255543 - RNA, 18 nt, Yersinia pestis
uuugguuuuuucaguaca

SEQ ID NO: 2255544 - RNA, 17 nt, Yersinia pestis
uuuguacaacuucuuca

SEQ ID NO: 2255545 - RNA, 23 nt, Yersinia pestis
uuuggaaccgccauaggcuguuu

SEQ ID NO: 2255546 - RNA, 19 nt, Yersinia pestis
uuugcugccugcaccagug

SEQ ID NO: 2255547 - RNA, 13 nt, Yersinia pestis
uuugcugcuuaua

SEQ ID NO: 2255548 - RNA, 21 nt, Yersinia pestis
uuugcuguucuaucucaucuu

SEQ ID NO: 2255549 - RNA, 19 nt, Yersinia pestis
uuugcuguggcgauuuaau

SEQ ID NO: 2255550 - RNA, 23 nt, Yersinia pestis
uuugcuugguuacgggcuugcug

SEQ ID NO: 2255551 - RNA, 19 nt, Yersinia pestis
uuugcuucgauuuuauauu

SEQ ID NO: 2255552 - RNA, 20 nt, Yersinia pestis
uuuggccgcucaacuuugcu

SEQ ID NO: 2255553 - RNA, 14 nt, Yersinia pestis
uuuggcauuuucag

SEQ ID NO: 2255554 - RNA, 17 nt, Yersinia pestis
uuugggaacaacagcau

SEQ ID NO: 2255555 - RNA, 18 nt, Yersinia pestis
uuugggaacaacagcauc

SEQ ID NO: 2255556 - RNA, 13 nt, Yersinia pestis
uuugggcuaaaac

SEQ ID NO: 2255557 - RNA, 22 nt, Yersinia pestis
uuuggucaaauccggauuucua

SEQ ID NO: 2255558 - RNA, 15 nt, Yersinia pestis
uuugggguauauauu

SEQ ID NO: 2255559 - RNA, 18 nt, Yersinia pestis
uuugguuggcuuuaaccc

SEQ ID NO: 2255560 - RNA, 23 nt, Yersinia pestis
uuugguugaacauuuccacucuu

SEQ ID NO: 2255561 - RNA, 14 nt, Yersinia pestis
uuuuacauuccaca

SEQ ID NO: 2255562 - RNA, 13 nt, Yersinia pestis
uuuuacaauuacg

SEQ ID NO: 2255563 - RNA, 16 nt, Yersinia pestis
uuuuaauuuaaacucu

SEQ ID NO: 2255564 - RNA, 17 nt, Yersinia pestis
uuuuaauuuaaccaucu

SEQ ID NO: 2255565 - RNA, 23 nt, Yersinia pestis
uuuuacaaauuugacauuuccuu

SEQ ID NO: 2255566 - RNA, 18 nt, Yersinia pestis
uuuuaaucucuccaugau

SEQ ID NO: 2255567 - RNA, 20 nt, Yersinia pestis
uuuuaaucucuccaugauau

SEQ ID NO: 2255568 - RNA, 16 nt, Yersinia pestis
uuuuaaucucuccaug

SEQ ID NO: 2255569 - RNA, 22 nt, Yersinia pestis
uuuuaacgucgcugaaaugcua

SEQ ID NO: 2255570 - RNA, 16 nt, Yersinia pestis
uuuuaacguuagagca

SEQ ID NO: 2255571 - RNA, 21 nt, Yersinia pestis
uuuuaacgucgcugaaaugcu

SEQ ID NO: 2255572 - RNA, 15 nt, Yersinia pestis
uuuuaacaaaaugga

SEQ ID NO: 2255573 - RNA, 23 nt, Yersinia pestis
uuuuaaggacucuuaguuucuac

SEQ ID NO: 2255574 - RNA, 13 nt, Yersinia pestis
uuuuaauaaaaaa

SEQ ID NO: 2255575 - RNA, 17 nt, Yersinia pestis
uuuuaaguuuauuuaac

SEQ ID NO: 2255576 - RNA, 20 nt, Yersinia pestis
uuuuaaaaaaauuaaaauaa

SEQ ID NO: 2255577 - RNA, 20 nt, Yersinia pestis
uuuguuuccccuaauucucc

SEQ ID NO: 2255578 - RNA, 14 nt, Yersinia pestis
uuuguuugugagag

SEQ ID NO: 2255579 - RNA, 13 nt, Yersinia pestis
uuuguuaauauuu

SEQ ID NO: 2255580 - RNA, 16 nt, Yersinia pestis
uuuguuaauauuuauc

SEQ ID NO: 2255581 - RNA, 22 nt, Yersinia pestis
uuuguugucagauaucugcuca

SEQ ID NO: 2255582 - RNA, 19 nt, Yersinia pestis
uuuuaaacgucagauuagu

SEQ ID NO: 2255583 - RNA, 16 nt, Yersinia pestis
uuuuaaagaaaaaacg

SEQ ID NO: 2255584 - RNA, 20 nt, Yersinia pestis
uuuuaaauauggguuaaaaa

SEQ ID NO: 2255585 - RNA, 18 nt, Yersinia pestis
uuuugaaacuuuccugac

SEQ ID NO: 2255586 - RNA, 15 nt, Yersinia pestis
uuuugaacaaaccac

SEQ ID NO: 2255587 - RNA, 14 nt, Yersinia pestis
uuuucuuucaggcu

SEQ ID NO: 2255588 - RNA, 15 nt, Yersinia pestis
uuuucuuucaacugc

SEQ ID NO: 2255589 - RNA, 19 nt, Yersinia pestis
uuuucuucugagauaugua

SEQ ID NO: 2255590 - RNA, 14 nt, Yersinia pestis
uuuucugccuaucu

SEQ ID NO: 2255591 - RNA, 16 nt, Yersinia pestis
uuuucugcggaaugcu

SEQ ID NO: 2255592 - RNA, 22 nt, Yersinia pestis
uuuucugcauaagcaucaguaa

SEQ ID NO: 2255593 - RNA, 22 nt, Yersinia pestis
uuuucucuuaaagaaaauuuac

SEQ ID NO: 2255594 - RNA, 15 nt, Yersinia pestis
uuuucuauaccaauu

SEQ ID NO: 2255595 - RNA, 15 nt, Yersinia pestis
uuuuggccuucaucc

SEQ ID NO: 2255596 - RNA, 12 nt, Yersinia pestis
uuuuggaaugcu

SEQ ID NO: 2255597 - RNA, 13 nt, Yersinia pestis
uuuuggcuugaaa

SEQ ID NO: 2255598 - RNA, 19 nt, Yersinia pestis
uuuugggaugaaaaauaca

SEQ ID NO: 2255599 - RNA, 17 nt, Yersinia pestis
uuuuggggucugaauau

SEQ ID NO: 2255600 - RNA, 11 nt, Yersinia pestis
uuuugcugcca

SEQ ID NO: 2255601 - RNA, 17 nt, Yersinia pestis
uuuugcaucaccaucau

SEQ ID NO: 2255602 - RNA, 23 nt, Yersinia pestis
uuuugcgccacaacccaauaaua

SEQ ID NO: 2255603 - RNA, 22 nt, Yersinia pestis
uuuugccggggagucgcuccuc

SEQ ID NO: 2255604 - RNA, 19 nt, Yersinia pestis
uuuugaugcuaauuucauc

SEQ ID NO: 2255605 - RNA, 20 nt, Yersinia pestis
uuuugaggauauuagggcug

SEQ ID NO: 2255606 - RNA, 19 nt, Yersinia pestis
uuuugaauagguaaaacau

SEQ ID NO: 2255607 - RNA, 15 nt, Yersinia pestis
uuuuuauauuccaca

SEQ ID NO: 2255608 - RNA, 20 nt, Yersinia pestis
uuuuuauuucuccuuacuau

SEQ ID NO: 2255609 - RNA, 16 nt, Yersinia pestis
uuuuuauaaucgauac

SEQ ID NO: 2255610 - RNA, 12 nt, Yersinia pestis
uuuuuagaaaac

SEQ ID NO: 2255611 - RNA, 19 nt, Yersinia pestis
uuuuuacgugauauaccac

SEQ ID NO: 2255612 - RNA, 16 nt, Yersinia pestis
uuuuucauaauaauga

SEQ ID NO: 2255613 - RNA, 13 nt, Yersinia pestis
uuuuucaaucacu

SEQ ID NO: 2255614 - RNA, 12 nt, Yersinia pestis
uuuuuauuucuu

SEQ ID NO: 2255615 - RNA, 20 nt, Yersinia pestis
uuuuucauuauuugauauag

SEQ ID NO: 2255616 - RNA, 21 nt, Yersinia pestis
uuuuucauaaucaccuucaau

SEQ ID NO: 2255617 - RNA, 16 nt, Yersinia pestis
uuuuucagcuucuucu

SEQ ID NO: 2255618 - RNA, 17 nt, Yersinia pestis
uuuuucauagcguugcu

SEQ ID NO: 2255619 - RNA, 14 nt, Yersinia pestis
uuuuguuuccccua

SEQ ID NO: 2255620 - RNA, 17 nt, Yersinia pestis
uuuuguuuucucuuaaa

SEQ ID NO: 2255621 - RNA, 15 nt, Yersinia pestis
uuuuuaaagaaaaaa

SEQ ID NO: 2255622 - RNA, 19 nt, Yersinia pestis
uuuuuaaacuuguaucaaa

SEQ ID NO: 2255623 - RNA, 12 nt, Yersinia pestis
uuuuuaacaaaa

SEQ ID NO: 2255624 - RNA, 14 nt, Yersinia pestis
uuuuuacauuccac

SEQ ID NO: 2255625 - RNA, 18 nt, Yersinia pestis
uuuuuacaagcacucaau

SEQ ID NO: 2255626 - RNA, 17 nt, Yersinia pestis
uuuuggugacaaacgcu

SEQ ID NO: 2255627 - RNA, 23 nt, Yersinia pestis
aaauuaauaacgccgaguaaguc

SEQ ID NO: 2255628 - RNA, 16 nt, Yersinia pestis
aaauuaaucuuguaaa

SEQ ID NO: 2255629 - RNA, 22 nt, Yersinia pestis
aaauuaauuacuuuauuuaaaa

SEQ ID NO: 2255630 - RNA, 15 nt, Yersinia pestis
aaauuaaaaauuaau

SEQ ID NO: 2255631 - RNA, 12 nt, Yersinia pestis
aaauuaaaauaa

SEQ ID NO: 2255632 - RNA, 14 nt, Yersinia pestis
aaauuaaauuuuaa

SEQ ID NO: 2255633 - RNA, 18 nt, Yersinia pestis
aaauuaaauuuuaauuau

SEQ ID NO: 2255634 - RNA, 17 nt, Yersinia pestis
uuuuuuauuuauagaau

SEQ ID NO: 2255635 - RNA, 20 nt, Yersinia pestis
uuuuugucgcccugcgaggc

SEQ ID NO: 2255636 - RNA, 21 nt, Yersinia pestis
uuuuugguuuucuauuuccac

SEQ ID NO: 2255637 - RNA, 21 nt, Yersinia pestis
uuuuuguaucuauaauucagc

SEQ ID NO: 2255638 - RNA, 16 nt, Yersinia pestis
uuuuuuaaaaccaaau

SEQ ID NO: 2255639 - RNA, 14 nt, Yersinia pestis
uuuuuuaaccaauu

SEQ ID NO: 2255640 - RNA, 23 nt, Yersinia pestis
uuuuugcgggacagaaagaaguc

SEQ ID NO: 2255641 - RNA, 14 nt, Yersinia pestis
uuuuugcaauuaau

SEQ ID NO: 2255642 - RNA, 11 nt, Yersinia pestis
uuuuucucaau

SEQ ID NO: 2255643 - RNA, 13 nt, Yersinia pestis
uuuuucucuacau

SEQ ID NO: 2255644 - RNA, 13 nt, Yersinia pestis
uuuuugaaauucu

SEQ ID NO: 2255645 - RNA, 19 nt, Yersinia pestis
uuuuugacuuuaauuaaaa

SEQ ID NO: 2255646 - RNA, 11 nt, Yersinia pestis
uuuuugaccau

SEQ ID NO: 2255647 - RNA, 16 nt, Yersinia pestis
aaauucccguuuuauu

SEQ ID NO: 2255648 - RNA, 21 nt, Yersinia pestis
aaauuccgcuucacauuugaa

SEQ ID NO: 2255649 - RNA, 23 nt, Yersinia pestis
aaauucgcuuuucgcaucauuaa

SEQ ID NO: 2255650 - RNA, 21 nt, Yersinia pestis
aaauucuguagaguaaaacug

SEQ ID NO: 2255651 - RNA, 12 nt, Yersinia pestis
aaauucaucuuu

SEQ ID NO: 2255652 - RNA, 18 nt, Yersinia pestis
aaauucaaauaucauuau

SEQ ID NO: 2255653 - RNA, 15 nt, Yersinia pestis
aaauucaaaauagag

SEQ ID NO: 2255654 - RNA, 17 nt, Yersinia pestis
aaauucaacuucuccug

SEQ ID NO: 2255655 - RNA, 17 nt, Yersinia pestis
aaauucacaacagugca

SEQ ID NO: 2255656 - RNA, 11 nt, Yersinia pestis
uuuuuugccag

SEQ ID NO: 2255657 - RNA, 14 nt, Yersinia pestis
aaauuagaaaacaa

SEQ ID NO: 2255658 - RNA, 15 nt, Yersinia pestis
aaauuagaaaacaag

SEQ ID NO: 2255659 - RNA, 12 nt, Yersinia pestis
aaauuacuuuaa

SEQ ID NO: 2255660 - RNA, 16 nt, Yersinia pestis
aaauuagaaaacaagu

SEQ ID NO: 2255661 - RNA, 20 nt, Yersinia pestis
aaauuacucguauaaaaaau

SEQ ID NO: 2255662 - RNA, 17 nt, Yersinia pestis
aaauuauugaguaacau

SEQ ID NO: 2255663 - RNA, 13 nt, Yersinia pestis
aaauuauuuagaa

SEQ ID NO: 2255664 - RNA, 15 nt, Yersinia pestis
aaauuauuaaauaag

SEQ ID NO: 2255665 - RNA, 23 nt, Yersinia pestis
aaauuagaugguuaacucauuua

SEQ ID NO: 2255666 - RNA, 23 nt, Yersinia pestis
aauaaagauacccgccauaaaua

SEQ ID NO: 2255667 - RNA, 16 nt, Yersinia pestis
aauaaagaguccccau

SEQ ID NO: 2255668 - RNA, 18 nt, Yersinia pestis
aauaaagccguuaucaau

SEQ ID NO: 2255669 - RNA, 19 nt, Yersinia pestis
aauaaagcgauaaauacuc

SEQ ID NO: 2255670 - RNA, 22 nt, Yersinia pestis
aauaaaguccaccucgaaauca

SEQ ID NO: 2255671 - RNA, 18 nt, Yersinia pestis
aauacaaauauaaugcug

SEQ ID NO: 2255672 - RNA, 18 nt, Yersinia pestis
aauacaacguuuaguaau

SEQ ID NO: 2255673 - RNA, 15 nt, Yersinia pestis
aauacaaccaacaaa

SEQ ID NO: 2255674 - RNA, 17 nt, Yersinia pestis
aauacaaccaacaaaca

SEQ ID NO: 2255675 - RNA, 23 nt, Yersinia pestis
aauacacgaaugcgacaccugcu

SEQ ID NO: 2255676 - RNA, 20 nt, Yersinia pestis
aauacaccuucuuuaucugu

SEQ ID NO: 2255677 - RNA, 22 nt, Yersinia pestis
aauacaggggcguuauugagaa

SEQ ID NO: 2255678 - RNA, 12 nt, Yersinia pestis
aauacagccagc

SEQ ID NO: 2255679 - RNA, 18 nt, Yersinia pestis
aauacacgcuuccaguaa

SEQ ID NO: 2255680 - RNA, 20 nt, Yersinia pestis
aauacacucguggugauuaa

SEQ ID NO: 2255681 - RNA, 14 nt, Yersinia pestis
aauacauaagcucc

SEQ ID NO: 2255682 - RNA, 22 nt, Yersinia pestis
aauacauaagcuccugagacuu

SEQ ID NO: 2255683 - RNA, 14 nt, Yersinia pestis
aauacauagaagcu

SEQ ID NO: 2255684 - RNA, 17 nt, Yersinia pestis
aauacauaucaacacug

SEQ ID NO: 2255685 - RNA, 20 nt, Yersinia pestis
aauacauaucaacacugccu

SEQ ID NO: 2255686 - RNA, 12 nt, Yersinia pestis
aauacauccaug

SEQ ID NO: 2255687 - RNA, 14 nt, Yersinia pestis
aauacaucaucaaa

SEQ ID NO: 2255688 - RNA, 17 nt, Yersinia pestis
aauacaugguaccugua

SEQ ID NO: 2255689 - RNA, 16 nt, Yersinia pestis
aauacaucaucaaaac

SEQ ID NO: 2255690 - RNA, 14 nt, Yersinia pestis
aauacauccaugua

SEQ ID NO: 2255691 - RNA, 23 nt, Yersinia pestis
aauacauccauguaggcucgagc

SEQ ID NO: 2255692 - RNA, 22 nt, Yersinia pestis
aauagaagagaggcaaugauuu

SEQ ID NO: 2255693 - RNA, 20 nt, Yersinia pestis
aauacuuauuugaaacagau

SEQ ID NO: 2255694 - RNA, 13 nt, Yersinia pestis
aauacuucaggcc

SEQ ID NO: 2255695 - RNA, 18 nt, Yersinia pestis
aauacuuaacaaucagug

SEQ ID NO: 2255696 - RNA, 19 nt, Yersinia pestis
aauacuaucaucaucgcca

SEQ ID NO: 2255697 - RNA, 14 nt, Yersinia pestis
aauacuauuuguag

SEQ ID NO: 2255698 - RNA, 20 nt, Yersinia pestis
aauacuauuuguaguuuuuc

SEQ ID NO: 2255699 - RNA, 17 nt, Yersinia pestis
aauaccauaacgcugcu

SEQ ID NO: 2255700 - RNA, 17 nt, Yersinia pestis
aauacccagcuucuuuu

SEQ ID NO: 2255701 - RNA, 22 nt, Yersinia pestis
aauacgaaauacuuaucuguuu

SEQ ID NO: 2255702 - RNA, 18 nt, Yersinia pestis
aauacguucaaaugauuc

SEQ ID NO: 2255703 - RNA, 18 nt, Yersinia pestis
aauacgaccgucaccaaa

SEQ ID NO: 2255704 - RNA, 15 nt, Yersinia pestis
aauacgauaaagaag

SEQ ID NO: 2255705 - RNA, 17 nt, Yersinia pestis
aauagcuuaaucaucau

SEQ ID NO: 2255706 - RNA, 20 nt, Yersinia pestis
aauagcuuaaucaucaucac

SEQ ID NO: 2255707 - RNA, 13 nt, Yersinia pestis
aauagcuuccauu

SEQ ID NO: 2255708 - RNA, 16 nt, Yersinia pestis
aauagguuggcauuag

SEQ ID NO: 2255709 - RNA, 13 nt, Yersinia pestis
aauagucaguaaa

SEQ ID NO: 2255710 - RNA, 18 nt, Yersinia pestis
aauagagaauagauagca

SEQ ID NO: 2255711 - RNA, 14 nt, Yersinia pestis
aauagcuaauaauu

SEQ ID NO: 2255712 - RNA, 21 nt, Yersinia pestis
aauagcggccauuaggcguga

SEQ ID NO: 2255713 - RNA, 13 nt, Yersinia pestis
aauagaggacuau

SEQ ID NO: 2255714 - RNA, 16 nt, Yersinia pestis
aauagaggaaauaaau

SEQ ID NO: 2255715 - RNA, 18 nt, Yersinia pestis
aauaucaccagugauaaa

SEQ ID NO: 2255716 - RNA, 22 nt, Yersinia pestis
aauaucagcaaaguaccgcuuu

SEQ ID NO: 2255717 - RNA, 15 nt, Yersinia pestis
aauaucaaugaaaaa

SEQ ID NO: 2255718 - RNA, 17 nt, Yersinia pestis
aauaucaagucuugaag

SEQ ID NO: 2255719 - RNA, 19 nt, Yersinia pestis
aauauccugcucagcuaaa

SEQ ID NO: 2255720 - RNA, 16 nt, Yersinia pestis
aauaucuuucauauca

SEQ ID NO: 2255721 - RNA, 13 nt, Yersinia pestis
aauauaaccaaag

SEQ ID NO: 2255722 - RNA, 19 nt, Yersinia pestis
aauauaacguuuaccuauu

SEQ ID NO: 2255723 - RNA, 14 nt, Yersinia pestis
aauauaaaagcaca

SEQ ID NO: 2255724 - RNA, 14 nt, Yersinia pestis
aauauaaaauaaua

SEQ ID NO: 2255725 - RNA, 17 nt, Yersinia pestis
aauauaaauuuaauaaa

SEQ ID NO: 2255726 - RNA, 22 nt, Yersinia pestis
aauauaaauuuaauaaaaacca

SEQ ID NO: 2255727 - RNA, 16 nt, Yersinia pestis
aauaucaaaacuccau

SEQ ID NO: 2255728 - RNA, 22 nt, Yersinia pestis
aauauuauuuaauuaaauguau

SEQ ID NO: 2255729 - RNA, 22 nt, Yersinia pestis
aauauuagcgguggcaugccaa

SEQ ID NO: 2255730 - RNA, 13 nt, Yersinia pestis
aauauuaauaaug

SEQ ID NO: 2255731 - RNA, 20 nt, Yersinia pestis
aauaugaucuugauaaacau

SEQ ID NO: 2255732 - RNA, 21 nt, Yersinia pestis
aauaugaagaugcuucagcca

SEQ ID NO: 2255733 - RNA, 15 nt, Yersinia pestis
aauaugcaaaaaaag

SEQ ID NO: 2255734 - RNA, 17 nt, Yersinia pestis
aauauuaacugcaguga

SEQ ID NO: 2255735 - RNA, 16 nt, Yersinia pestis
aauauuaacugcagug

SEQ ID NO: 2255736 - RNA, 17 nt, Yersinia pestis
aauauucaauaggguaa

SEQ ID NO: 2255737 - RNA, 17 nt, Yersinia pestis
aauauucaguaagguuu

SEQ ID NO: 2255738 - RNA, 16 nt, Yersinia pestis
aauauucgcagccaaa

SEQ ID NO: 2255739 - RNA, 19 nt, Yersinia pestis
aauauuccggccagcuuuu

SEQ ID NO: 2255740 - RNA, 22 nt, Yersinia pestis
aauauuccggccagcuuuuuau

SEQ ID NO: 2255741 - RNA, 14 nt, Yersinia pestis
aauauugaauuaaa

SEQ ID NO: 2255742 - RNA, 22 nt, Yersinia pestis
aauauuggcgcacaacugcgau

SEQ ID NO: 2255743 - RNA, 21 nt, Yersinia pestis
aauauuggauaauaaccugau

SEQ ID NO: 2255744 - RNA, 20 nt, Yersinia pestis
aauauuggauaauaaccuga

SEQ ID NO: 2255745 - RNA, 21 nt, Yersinia pestis
aauauugcguuaccuaaaacu

SEQ ID NO: 2255746 - RNA, 12 nt, Yersinia pestis
aauauugccgca

SEQ ID NO: 2255747 - RNA, 12 nt, Yersinia pestis
aauauugcacaa

SEQ ID NO: 2255748 - RNA, 15 nt, Yersinia pestis
aauauugugcacucg

SEQ ID NO: 2255749 - RNA, 23 nt, Yersinia pestis
aaucaacagaugaugauuuuuac

SEQ ID NO: 2255750 - RNA, 21 nt, Yersinia pestis
aaucaacagauaugcauuauu

SEQ ID NO: 2255751 - RNA, 15 nt, Yersinia pestis
aaucaaaaaauaaau

SEQ ID NO: 2255752 - RNA, 23 nt, Yersinia pestis
aaucaaaaguuaggguucaguaa

SEQ ID NO: 2255753 - RNA, 12 nt, Yersinia pestis
aaucaaaacagg

SEQ ID NO: 2255754 - RNA, 14 nt, Yersinia pestis
aaucaaacaaaucu

SEQ ID NO: 2255755 - RNA, 23 nt, Yersinia pestis
aaucaaaaaacagaauagugggu

SEQ ID NO: 2255756 - RNA, 16 nt, Yersinia pestis
aauauuuucaucccaa

SEQ ID NO: 2255757 - RNA, 20 nt, Yersinia pestis
aauauuuguuugaauuuuag

SEQ ID NO: 2255758 - RNA, 19 nt, Yersinia pestis
aauauuuaucugcauuaaa

SEQ ID NO: 2255759 - RNA, 22 nt, Yersinia pestis
aauauuuaucugcauuaaaaua

SEQ ID NO: 2255760 - RNA, 16 nt, Yersinia pestis
aauauuuauaaaaaau

SEQ ID NO: 2255761 - RNA, 14 nt, Yersinia pestis
aauauuucaagcug

SEQ ID NO: 2255762 - RNA, 12 nt, Yersinia pestis
aauauuucaggc

SEQ ID NO: 2255763 - RNA, 15 nt, Yersinia pestis
aaucacgacaaguca

SEQ ID NO: 2255764 - RNA, 16 nt, Yersinia pestis
aaucacgacaagucau

SEQ ID NO: 2255765 - RNA, 21 nt, Yersinia pestis
aaucaccuuggaaaacagcaa

SEQ ID NO: 2255766 - RNA, 12 nt, Yersinia pestis
aaucaccuucaa

SEQ ID NO: 2255767 - RNA, 14 nt, Yersinia pestis
aaucacguuuccaa

SEQ ID NO: 2255768 - RNA, 19 nt, Yersinia pestis
aaucacuggcaauaauuca

SEQ ID NO: 2255769 - RNA, 19 nt, Yersinia pestis
aaucacugauucagaaagg

SEQ ID NO: 2255770 - RNA, 17 nt, Yersinia pestis
aaucagauacggcucca

SEQ ID NO: 2255771 - RNA, 20 nt, Yersinia pestis
aaucagaucaacagauuuuc

SEQ ID NO: 2255772 - RNA, 18 nt, Yersinia pestis
aaucagauacggcuccag

SEQ ID NO: 2255773 - RNA, 20 nt, Yersinia pestis
aaucagauggucgccuuucc

SEQ ID NO: 2255774 - RNA, 17 nt, Yersinia pestis
aaucagcaagcugcuca

SEQ ID NO: 2255775 - RNA, 14 nt, Yersinia pestis
aaucauaaaagccc

SEQ ID NO: 2255776 - RNA, 14 nt, Yersinia pestis
aaucauauuuuccu

SEQ ID NO: 2255777 - RNA, 15 nt, Yersinia pestis
aaucaucagccucua

SEQ ID NO: 2255778 - RNA, 14 nt, Yersinia pestis
aaucaguuuacaug

SEQ ID NO: 2255779 - RNA, 17 nt, Yersinia pestis
aaucaguguaucaauag

SEQ ID NO: 2255780 - RNA, 22 nt, Yersinia pestis
aaucaguguauuacuccacacg

SEQ ID NO: 2255781 - RNA, 15 nt, Yersinia pestis
aaucagccccaagcu

SEQ ID NO: 2255782 - RNA, 18 nt, Yersinia pestis
aaucagcauuaacccaua

SEQ ID NO: 2255783 - RNA, 22 nt, Yersinia pestis
aaucagcgugguauaaauggca

SEQ ID NO: 2255784 - RNA, 13 nt, Yersinia pestis
aaucagcucauua

SEQ ID NO: 2255785 - RNA, 20 nt, Yersinia pestis
aaucagugaaggaugaauaa

SEQ ID NO: 2255786 - RNA, 11 nt, Yersinia pestis
aaucaccaaca

SEQ ID NO: 2255787 - RNA, 14 nt, Yersinia pestis
aaucacccgcaaga

SEQ ID NO: 2255788 - RNA, 17 nt, Yersinia pestis
aaucacccgcaagaaua

SEQ ID NO: 2255789 - RNA, 22 nt, Yersinia pestis
aaucacauuucaaauuaucgau

SEQ ID NO: 2255790 - RNA, 16 nt, Yersinia pestis
aaucaccauaacugcu

SEQ ID NO: 2255791 - RNA, 20 nt, Yersinia pestis
aaucacacgggaucuacaua

SEQ ID NO: 2255792 - RNA, 15 nt, Yersinia pestis
aaucacaucaccgac

SEQ ID NO: 2255793 - RNA, 20 nt, Yersinia pestis
aaucacaucaccgacagcau

SEQ ID NO: 2255794 - RNA, 23 nt, Yersinia pestis
aaucacaucauucagcgucacga

SEQ ID NO: 2255795 - RNA, 14 nt, Yersinia pestis
aaucaauaagcuac

SEQ ID NO: 2255796 - RNA, 21 nt, Yersinia pestis
aaucaauaaagccauuucagu

SEQ ID NO: 2255797 - RNA, 23 nt, Yersinia pestis
aaucaagugcgaaaauuuaacua

SEQ ID NO: 2255798 - RNA, 14 nt, Yersinia pestis
aaucaauuaaucaa

SEQ ID NO: 2255799 - RNA, 17 nt, Yersinia pestis
aaucaaugggauauuau

SEQ ID NO: 2255800 - RNA, 15 nt, Yersinia pestis
aaucaauguauugcu

SEQ ID NO: 2255801 - RNA, 17 nt, Yersinia pestis
aaucaauguauugcucc

SEQ ID NO: 2255802 - RNA, 14 nt, Yersinia pestis
aaucaaguaaccaa

SEQ ID NO: 2255803 - RNA, 15 nt, Yersinia pestis
aaucaaggcuuuaau

SEQ ID NO: 2255804 - RNA, 18 nt, Yersinia pestis
aaucaagcuacgcaaaaa

SEQ ID NO: 2255805 - RNA, 17 nt, Yersinia pestis
aaucaagcuacgccaag

SEQ ID NO: 2255806 - RNA, 17 nt, Yersinia pestis
aaucaacugaaccacag

SEQ ID NO: 2255807 - RNA, 14 nt, Yersinia pestis
aaucaacucauuua

SEQ ID NO: 2255808 - RNA, 16 nt, Yersinia pestis
aaucaacgcucaauca

SEQ ID NO: 2255809 - RNA, 14 nt, Yersinia pestis
aaucaacggcacca

SEQ ID NO: 2255810 - RNA, 17 nt, Yersinia pestis
aaucuuguuaauuuaaa

SEQ ID NO: 2255811 - RNA, 20 nt, Yersinia pestis
aaugaaccgccaaucgaacc

SEQ ID NO: 2255812 - RNA, 20 nt, Yersinia pestis
aaugaacuguguuuauacca

SEQ ID NO: 2255813 - RNA, 21 nt, Yersinia pestis
aaucuuggcacucgaucaauc

SEQ ID NO: 2255814 - RNA, 18 nt, Yersinia pestis
aaucuugcagcgaucaca

SEQ ID NO: 2255815 - RNA, 15 nt, Yersinia pestis
aaucugcgcccuuau

SEQ ID NO: 2255816 - RNA, 19 nt, Yersinia pestis
aaucugcccagccugguuu

SEQ ID NO: 2255817 - RNA, 21 nt, Yersinia pestis
aaugaccacccacguuccccc

SEQ ID NO: 2255818 - RNA, 16 nt, Yersinia pestis
aaugacauugcgaaua

SEQ ID NO: 2255819 - RNA, 17 nt, Yersinia pestis
aaugacuuaacugaaag

SEQ ID NO: 2255820 - RNA, 20 nt, Yersinia pestis
aaugacuaucccuucaauca

SEQ ID NO: 2255821 - RNA, 22 nt, Yersinia pestis
aaugauaacguuccauggcuga

SEQ ID NO: 2255822 - RNA, 20 nt, Yersinia pestis
aaugauaaaauccugaauaa

SEQ ID NO: 2255823 - RNA, 16 nt, Yersinia pestis
aaugaguuaaugagaa

SEQ ID NO: 2255824 - RNA, 17 nt, Yersinia pestis
aaugaggguaagugaau

SEQ ID NO: 2255825 - RNA, 15 nt, Yersinia pestis
aaugauauuccgagc

SEQ ID NO: 2255826 - RNA, 17 nt, Yersinia pestis
aaugaugguauuaauca

SEQ ID NO: 2255827 - RNA, 18 nt, Yersinia pestis
aaugaugguauuaaucaa

SEQ ID NO: 2255828 - RNA, 14 nt, Yersinia pestis
aaugauuauugacc

SEQ ID NO: 2255829 - RNA, 11 nt, Yersinia pestis
aaucaucaucc

SEQ ID NO: 2255830 - RNA, 18 nt, Yersinia pestis
aaucaucaucacaaauaa

SEQ ID NO: 2255831 - RNA, 15 nt, Yersinia pestis
aaucgaaugcaauaa

SEQ ID NO: 2255832 - RNA, 15 nt, Yersinia pestis
aaucgauuacuggcu

SEQ ID NO: 2255833 - RNA, 21 nt, Yersinia pestis
aaucgauacugccaucaucau

SEQ ID NO: 2255834 - RNA, 21 nt, Yersinia pestis
aaucgauggccgcccuccaau

SEQ ID NO: 2255835 - RNA, 12 nt, Yersinia pestis
aaucucaucaau

SEQ ID NO: 2255836 - RNA, 12 nt, Yersinia pestis
aaucucugccug

SEQ ID NO: 2255837 - RNA, 18 nt, Yersinia pestis
aaucucuccuagaggcuu

SEQ ID NO: 2255838 - RNA, 17 nt, Yersinia pestis
aaucucugggugcugcu

SEQ ID NO: 2255839 - RNA, 18 nt, Yersinia pestis
aaucucugccugugauuu

SEQ ID NO: 2255840 - RNA, 16 nt, Yersinia pestis
aaucucuccaugauau

SEQ ID NO: 2255841 - RNA, 17 nt, Yersinia pestis
aaucucuccaugauaua

SEQ ID NO: 2255842 - RNA, 19 nt, Yersinia pestis
aaucuccuggugguuuggu

SEQ ID NO: 2255843 - RNA, 12 nt, Yersinia pestis
aaucugauacug

SEQ ID NO: 2255844 - RNA, 17 nt, Yersinia pestis
aaucugagcgaacugaa

SEQ ID NO: 2255845 - RNA, 18 nt, Yersinia pestis
aauuaaacgcucaucaac

SEQ ID NO: 2255846 - RNA, 19 nt, Yersinia pestis
aauuaaacgcucaucaacc

SEQ ID NO: 2255847 - RNA, 17 nt, Yersinia pestis
aauuaaauguauaaaaa

SEQ ID NO: 2255848 - RNA, 13 nt, Yersinia pestis
aauuaaggaaaag

SEQ ID NO: 2255849 - RNA, 17 nt, Yersinia pestis
aauuaaggaaacucaug

SEQ ID NO: 2255850 - RNA, 17 nt, Yersinia pestis
aauuacuuuaaagccaa

SEQ ID NO: 2255851 - RNA, 21 nt, Yersinia pestis
aauuaccaccaccuccacagg

SEQ ID NO: 2255852 - RNA, 13 nt, Yersinia pestis
aauuaauauuuaa

SEQ ID NO: 2255853 - RNA, 17 nt, Yersinia pestis
aauuaaucaauuaaaua

SEQ ID NO: 2255854 - RNA, 22 nt, Yersinia pestis
aauuaaucuuguaaagacgcua

SEQ ID NO: 2255855 - RNA, 19 nt, Yersinia pestis
aauuaauaaccauaaaaua

SEQ ID NO: 2255856 - RNA, 23 nt, Yersinia pestis
aauuaauaugccgacaaccaaca

SEQ ID NO: 2255857 - RNA, 15 nt, Yersinia pestis
aauuaauauauaaaa

SEQ ID NO: 2255858 - RNA, 17 nt, Yersinia pestis
aauuaauauauaaaaua

SEQ ID NO: 2255859 - RNA, 18 nt, Yersinia pestis
aauguuuuacgaucaacc

SEQ ID NO: 2255860 - RNA, 20 nt, Yersinia pestis
aauguuuuuauccaaacaaa

SEQ ID NO: 2255861 - RNA, 23 nt, Yersinia pestis
aauuaaaaaagguggccauuacg

SEQ ID NO: 2255862 - RNA, 18 nt, Yersinia pestis
aauuaaaaauagauuaaa

SEQ ID NO: 2255863 - RNA, 21 nt, Yersinia pestis
aauuaaaaacccucucauccu

SEQ ID NO: 2255864 - RNA, 11 nt, Yersinia pestis
aauuaaaaauu

SEQ ID NO: 2255865 - RNA, 11 nt, Yersinia pestis
aauuaaaacau

SEQ ID NO: 2255866 - RNA, 19 nt, Yersinia pestis
aauuaaaacauauuaaguu

SEQ ID NO: 2255867 - RNA, 14 nt, Yersinia pestis
aauguugagaaaua

SEQ ID NO: 2255868 - RNA, 15 nt, Yersinia pestis
aauguugagaaauau

SEQ ID NO: 2255869 - RNA, 16 nt, Yersinia pestis
aauguugagaaauauu

SEQ ID NO: 2255870 - RNA, 18 nt, Yersinia pestis
aauguugagucccuuggc

SEQ ID NO: 2255871 - RNA, 22 nt, Yersinia pestis
aauguuucuauccgaaaaauau

SEQ ID NO: 2255872 - RNA, 18 nt, Yersinia pestis
aaugugccguaacucacc

SEQ ID NO: 2255873 - RNA, 17 nt, Yersinia pestis
aauguguugaauaucca

SEQ ID NO: 2255874 - RNA, 23 nt, Yersinia pestis
aauguuaaacuuugcuauuaaga

SEQ ID NO: 2255875 - RNA, 17 nt, Yersinia pestis
aauguguuuuugucauu

SEQ ID NO: 2255876 - RNA, 14 nt, Yersinia pestis
aauguuaucgccaa

SEQ ID NO: 2255877 - RNA, 20 nt, Yersinia pestis
aauggguuugguuauuauga

SEQ ID NO: 2255878 - RNA, 12 nt, Yersinia pestis
aauggucaggaa

SEQ ID NO: 2255879 - RNA, 17 nt, Yersinia pestis
aaugguaccggcaccaa

SEQ ID NO: 2255880 - RNA, 22 nt, Yersinia pestis
aaugggccacaggcugcauggg

SEQ ID NO: 2255881 - RNA, 23 nt, Yersinia pestis
aauguaugguuguauuuugaaug

SEQ ID NO: 2255882 - RNA, 12 nt, Yersinia pestis
aauggucuugau

SEQ ID NO: 2255883 - RNA, 14 nt, Yersinia pestis
aauggugcccauca

SEQ ID NO: 2255884 - RNA, 14 nt, Yersinia pestis
aauguauaaaaaag

SEQ ID NO: 2255885 - RNA, 22 nt, Yersinia pestis
aauguauaaaaaagauaauaaa

SEQ ID NO: 2255886 - RNA, 22 nt, Yersinia pestis
aauggugucaucgcuaaauacu

SEQ ID NO: 2255887 - RNA, 18 nt, Yersinia pestis
aauggugcccaucacauc

SEQ ID NO: 2255888 - RNA, 19 nt, Yersinia pestis
aauguccauuacuguccuu

SEQ ID NO: 2255889 - RNA, 23 nt, Yersinia pestis
aauguccccuugaguauccaaua

SEQ ID NO: 2255890 - RNA, 14 nt, Yersinia pestis
aaugucaggaaaug

SEQ ID NO: 2255891 - RNA, 20 nt, Yersinia pestis
aaugcucuucaccaaaggaa

SEQ ID NO: 2255892 - RNA, 23 nt, Yersinia pestis
aauggauugaaaccgcugauaac

SEQ ID NO: 2255893 - RNA, 18 nt, Yersinia pestis
aauggauugaucauucuc

SEQ ID NO: 2255894 - RNA, 18 nt, Yersinia pestis
aauggcacuggaaacaaa

SEQ ID NO: 2255895 - RNA, 16 nt, Yersinia pestis
aaugccauagcugcug

SEQ ID NO: 2255896 - RNA, 12 nt, Yersinia pestis
aaugccauucaa

SEQ ID NO: 2255897 - RNA, 16 nt, Yersinia pestis
aaugcaccgacaaaga

SEQ ID NO: 2255898 - RNA, 17 nt, Yersinia pestis
aaugcaccgacaaagau

SEQ ID NO: 2255899 - RNA, 21 nt, Yersinia pestis
aaugcacgauaccaccaccaa

SEQ ID NO: 2255900 - RNA, 22 nt, Yersinia pestis
aaugcacuucaucauucauuuu

SEQ ID NO: 2255901 - RNA, 18 nt, Yersinia pestis
aaugcagacucuuauaua

SEQ ID NO: 2255902 - RNA, 12 nt, Yersinia pestis
aaugcagaugcc

SEQ ID NO: 2255903 - RNA, 17 nt, Yersinia pestis
aaugccaguacagugaa

SEQ ID NO: 2255904 - RNA, 16 nt, Yersinia pestis
aaugccccauccugac

SEQ ID NO: 2255905 - RNA, 17 nt, Yersinia pestis
aaugcuaccuguaacau

SEQ ID NO: 2255906 - RNA, 12 nt, Yersinia pestis
aaauugaagagu

SEQ ID NO: 2255907 - RNA, 16 nt, Yersinia pestis
aaauugacuuuaaaaa

SEQ ID NO: 2255908 - RNA, 23 nt, Yersinia pestis
aagaauaaaugucacuugcccug

SEQ ID NO: 2255909 - RNA, 12 nt, Yersinia pestis
aagaauaaauaa

SEQ ID NO: 2255910 - RNA, 15 nt, Yersinia pestis
aagaauaaauaauau

SEQ ID NO: 2255911 - RNA, 22 nt, Yersinia pestis
aagaauaaggguagguucaaua

SEQ ID NO: 2255912 - RNA, 16 nt, Yersinia pestis
aagaauggcgcgacca

SEQ ID NO: 2255913 - RNA, 15 nt, Yersinia pestis
aagaauguauugaga

SEQ ID NO: 2255914 - RNA, 23 nt, Yersinia pestis
aagaauguauugagauuuuccca

SEQ ID NO: 2255915 - RNA, 22 nt, Yersinia pestis
aagaaugcgaagaaaaacacuu

SEQ ID NO: 2255916 - RNA, 19 nt, Yersinia pestis
aagaaucaccgaaagaaga

SEQ ID NO: 2255917 - RNA, 20 nt, Yersinia pestis
aagaauccucugaauaaaaa

SEQ ID NO: 2255918 - RNA, 14 nt, Yersinia pestis
aagaaucaguaggu

SEQ ID NO: 2255919 - RNA, 18 nt, Yersinia pestis
aagaccgguggcuuuuuc

SEQ ID NO: 2255920 - RNA, 19 nt, Yersinia pestis
aagaccacaucaaccugau

SEQ ID NO: 2255921 - RNA, 19 nt, Yersinia pestis
aagacauaucacaguuaaa

SEQ ID NO: 2255922 - RNA, 23 nt, Yersinia pestis
aagacagggguuuuuaucccccu

SEQ ID NO: 2255923 - RNA, 23 nt, Yersinia pestis
aagaauugcagauaccacaucaa

SEQ ID NO: 2255924 - RNA, 16 nt, Yersinia pestis
aagaauuccggcgcau

SEQ ID NO: 2255925 - RNA, 11 nt, Yersinia pestis
aagacacccgu

SEQ ID NO: 2255926 - RNA, 13 nt, Yersinia pestis
aagacaacaaaca

SEQ ID NO: 2255927 - RNA, 15 nt, Yersinia pestis
aagacaaggaaaagg

SEQ ID NO: 2255928 - RNA, 17 nt, Yersinia pestis
aagacaauaaaucgcca

SEQ ID NO: 2255929 - RNA, 18 nt, Yersinia pestis
aagagaggcaaugauuuu

SEQ ID NO: 2255930 - RNA, 15 nt, Yersinia pestis
aagagagaauccauu

SEQ ID NO: 2255931 - RNA, 21 nt, Yersinia pestis
aagagaugacccaaagucauu

SEQ ID NO: 2255932 - RNA, 15 nt, Yersinia pestis
aagagaugaaauuuu

SEQ ID NO: 2255933 - RNA, 21 nt, Yersinia pestis
aagagaaagccugcguuaaaa

SEQ ID NO: 2255934 - RNA, 21 nt, Yersinia pestis
aagagaaaguugauccugggu

SEQ ID NO: 2255935 - RNA, 13 nt, Yersinia pestis
aagagaaaagcag

SEQ ID NO: 2255936 - RNA, 19 nt, Yersinia pestis
aagacguaucgcaguuaaa

SEQ ID NO: 2255937 - RNA, 20 nt, Yersinia pestis
aagacguaucgcaguuaaag

SEQ ID NO: 2255938 - RNA, 24 nt, Yersinia pestis
aagacguaucgcaguuaaagacau

SEQ ID NO: 2255939 - RNA, 19 nt, Yersinia pestis
aagacgucauaaauauuuu

SEQ ID NO: 2255940 - RNA, 18 nt, Yersinia pestis
aagacgccggcuucccug

SEQ ID NO: 2255941 - RNA, 17 nt, Yersinia pestis
aagacgccguaaauaca

SEQ ID NO: 2255942 - RNA, 20 nt, Yersinia pestis
aagacuucaugacuaccuug

SEQ ID NO: 2255943 - RNA, 18 nt, Yersinia pestis
aagagcugcuaaucccuu

SEQ ID NO: 2255944 - RNA, 18 nt, Yersinia pestis
aagaggguuuuuaaauuu

SEQ ID NO: 2255945 - RNA, 19 nt, Yersinia pestis
aagagggcgguuaaauaca

SEQ ID NO: 2255946 - RNA, 22 nt, Yersinia pestis
aagagcggucgacaaaauguga

SEQ ID NO: 2255947 - RNA, 12 nt, Yersinia pestis
aagagucacagc

SEQ ID NO: 2255948 - RNA, 17 nt, Yersinia pestis
aagaguccagcacuggu

SEQ ID NO: 2255949 - RNA, 18 nt, Yersinia pestis
aagagucuggauuugaga

SEQ ID NO: 2255950 - RNA, 20 nt, Yersinia pestis
aagagucacagcauucagau

SEQ ID NO: 2255951 - RNA, 21 nt, Yersinia pestis
aagagucgcaaaacuucacuu

SEQ ID NO: 2255952 - RNA, 19 nt, Yersinia pestis
aagagugaccaaagcagua

SEQ ID NO: 2255953 - RNA, 21 nt, Yersinia pestis
aagagugaccaaagcaguaaa

SEQ ID NO: 2255954 - RNA, 23 nt, Yersinia pestis
aagagugaccaaagcaguaaaca

SEQ ID NO: 2255955 - RNA, 13 nt, Yersinia pestis
aagagugaaauau

SEQ ID NO: 2255956 - RNA, 21 nt, Yersinia pestis
aagaguguucauaaauuaaaa

SEQ ID NO: 2255957 - RNA, 21 nt, Yersinia pestis
aagauaacuuuuuauuucuuu

SEQ ID NO: 2255958 - RNA, 14 nt, Yersinia pestis
aagcaaugaaauau

SEQ ID NO: 2255959 - RNA, 20 nt, Yersinia pestis
aagcaauguucaaaucugcu

SEQ ID NO: 2255960 - RNA, 20 nt, Yersinia pestis
aagcaauggcacgugcaggu

SEQ ID NO: 2255961 - RNA, 14 nt, Yersinia pestis
aagcaauaaacuca

SEQ ID NO: 2255962 - RNA, 22 nt, Yersinia pestis
aagcacuguacugggaugaaga

SEQ ID NO: 2255963 - RNA, 15 nt, Yersinia pestis
aagcacagacaaaca

SEQ ID NO: 2255964 - RNA, 21 nt, Yersinia pestis
aagcacccacaccgcagcagu

SEQ ID NO: 2255965 - RNA, 12 nt, Yersinia pestis
aagcaccagcac

SEQ ID NO: 2255966 - RNA, 17 nt, Yersinia pestis
aagcauacguugccagc

SEQ ID NO: 2255967 - RNA, 13 nt, Yersinia pestis
aagcauauggaug

SEQ ID NO: 2255968 - RNA, 15 nt, Yersinia pestis
aagcaucggaaucca

SEQ ID NO: 2255969 - RNA, 15 nt, Yersinia pestis
aagcaugaaacacag

SEQ ID NO: 2255970 - RNA, 17 nt, Yersinia pestis
aagccaaacaaaugaac

SEQ ID NO: 2255971 - RNA, 22 nt, Yersinia pestis
aagcauggcagguaucaauaca

SEQ ID NO: 2255972 - RNA, 19 nt, Yersinia pestis
aagcauucgcgguuacacc

SEQ ID NO: 2255973 - RNA, 16 nt, Yersinia pestis
aagcaguucacugagu

SEQ ID NO: 2255974 - RNA, 14 nt, Yersinia pestis
aagcagucagcaug

SEQ ID NO: 2255975 - RNA, 22 nt, Yersinia pestis
aagcagucgacaguguaaaaag

SEQ ID NO: 2255976 - RNA, 19 nt, Yersinia pestis
aagcaguaagcaugaaaca

SEQ ID NO: 2255977 - RNA, 15 nt, Yersinia pestis
aagcaguaaacauuu

SEQ ID NO: 2255978 - RNA, 17 nt, Yersinia pestis
aagcagguaguuacagc

SEQ ID NO: 2255979 - RNA, 18 nt, Yersinia pestis
aagcaggggaucgggcug

SEQ ID NO: 2255980 - RNA, 13 nt, Yersinia pestis
aagcagauaaaga

SEQ ID NO: 2255981 - RNA, 16 nt, Yersinia pestis
aagcagcguucaaauc

SEQ ID NO: 2255982 - RNA, 14 nt, Yersinia pestis
aagcagccgccgcu

SEQ ID NO: 2255983 - RNA, 17 nt, Yersinia pestis
aagauaggcagaaaagc

SEQ ID NO: 2255984 - RNA, 21 nt, Yersinia pestis
aagauaggcagaaaagcaaag

SEQ ID NO: 2255985 - RNA, 16 nt, Yersinia pestis
aagauaucuuugaguu

SEQ ID NO: 2255986 - RNA, 17 nt, Yersinia pestis
aagauaccaacccacuc

SEQ ID NO: 2255987 - RNA, 20 nt, Yersinia pestis
aagauacccuucucuuuauc

SEQ ID NO: 2255988 - RNA, 20 nt, Yersinia pestis
aagauacccuugagguuauu

SEQ ID NO: 2255989 - RNA, 16 nt, Yersinia pestis
aagauagcaaaagaau

SEQ ID NO: 2255990 - RNA, 14 nt, Yersinia pestis
aagauagccacuaa

SEQ ID NO: 2255991 - RNA, 20 nt, Yersinia pestis
aagauacccgccauaaauaa

SEQ ID NO: 2255992 - RNA, 13 nt, Yersinia pestis
aagauaaucugca

SEQ ID NO: 2255993 - RNA, 14 nt, Yersinia pestis
aagauccaguucag

SEQ ID NO: 2255994 - RNA, 16 nt, Yersinia pestis
aagauccaccacauca

SEQ ID NO: 2255995 - RNA, 19 nt, Yersinia pestis
aagaucacgcuaccggaac

SEQ ID NO: 2255996 - RNA, 14 nt, Yersinia pestis
aagaucaauauguu

SEQ ID NO: 2255997 - RNA, 17 nt, Yersinia pestis
aagaucugcauugauua

SEQ ID NO: 2255998 - RNA, 23 nt, Yersinia pestis
aagauuucaucggcaaaaacagu

SEQ ID NO: 2255999 - RNA, 16 nt, Yersinia pestis
aagauuggcagcguaa

SEQ ID NO: 2256000 - RNA, 22 nt, Yersinia pestis
aagauuuuuagcgugccgcagu

SEQ ID NO: 2256001 - RNA, 23 nt, Yersinia pestis
aagauuuaacggcuguuguucug

SEQ ID NO: 2256002 - RNA, 16 nt, Yersinia pestis
aagauucauaaaaaaa

SEQ ID NO: 2256003 - RNA, 17 nt, Yersinia pestis
aagauugccaccuucac

SEQ ID NO: 2256004 - RNA, 18 nt, Yersinia pestis
aagauuacguagacauaa

SEQ ID NO: 2256005 - RNA, 20 nt, Yersinia pestis
aagaugccaaucaaaaaacc

SEQ ID NO: 2256006 - RNA, 18 nt, Yersinia pestis
aagaugcauauuugcaga

SEQ ID NO: 2256007 - RNA, 21 nt, Yersinia pestis
aagaugccaaucaaaaaaccg

SEQ ID NO: 2256008 - RNA, 20 nt, Yersinia pestis
aagaugaccaccaauuucau

SEQ ID NO: 2256009 - RNA, 23 nt, Yersinia pestis
aagaugauaaauacaaaauuaac

SEQ ID NO: 2256010 - RNA, 12 nt, Yersinia pestis
aauaaaaucaaa

SEQ ID NO: 2256011 - RNA, 13 nt, Yersinia pestis
aauaaacaaaaua

SEQ ID NO: 2256012 - RNA, 14 nt, Yersinia pestis
aauaaacaaaauag

SEQ ID NO: 2256013 - RNA, 23 nt, Yersinia pestis
aauaaacuaccgaucaucaggca

SEQ ID NO: 2256014 - RNA, 16 nt, Yersinia pestis
aauaaaccagcaagcc

SEQ ID NO: 2256015 - RNA, 15 nt, Yersinia pestis
aauaaacacuuggca

SEQ ID NO: 2256016 - RNA, 19 nt, Yersinia pestis
aauaaaaaauccagugcgc

SEQ ID NO: 2256017 - RNA, 12 nt, Yersinia pestis
aauaaaaacaca

SEQ ID NO: 2256018 - RNA, 12 nt, Yersinia pestis
aauaaaaaagua

SEQ ID NO: 2256019 - RNA, 23 nt, Yersinia pestis
aauaaaaagucagcuggaacaag

SEQ ID NO: 2256020 - RNA, 20 nt, Yersinia pestis
aauaaaaaugauaauaaaaa

SEQ ID NO: 2256021 - RNA, 14 nt, Yersinia pestis
aauaaaacucacuu

SEQ ID NO: 2256022 - RNA, 13 nt, Yersinia pestis
aauaaaauaaauu

SEQ ID NO: 2256023 - RNA, 15 nt, Yersinia pestis
aauaaaauaaauugg

SEQ ID NO: 2256024 - RNA, 22 nt, Yersinia pestis
aaguugaaccaaugaaucgggc

SEQ ID NO: 2256025 - RNA, 11 nt, Yersinia pestis
aaguuuaacca

SEQ ID NO: 2256026 - RNA, 18 nt, Yersinia pestis
aaguuagcgauaucugcg

SEQ ID NO: 2256027 - RNA, 21 nt, Yersinia pestis
aaguuuacuuuguauuuugca

SEQ ID NO: 2256028 - RNA, 19 nt, Yersinia pestis
aaguuucagcguggaauua

SEQ ID NO: 2256029 - RNA, 18 nt, Yersinia pestis
aaguuugauguagcagau

SEQ ID NO: 2256030 - RNA, 21 nt, Yersinia pestis
aaguuuucuggcaauuucugu

SEQ ID NO: 2256031 - RNA, 22 nt, Yersinia pestis
aaguuuucuggcaauuucuguu

SEQ ID NO: 2256032 - RNA, 15 nt, Yersinia pestis
aaguccgucuuguau

SEQ ID NO: 2256033 - RNA, 23 nt, Yersinia pestis
aaguccaagaagauaacuuuuua

SEQ ID NO: 2256034 - RNA, 20 nt, Yersinia pestis
aaguccaagaagauaacuuu

SEQ ID NO: 2256035 - RNA, 11 nt, Yersinia pestis
aagucacaccg

SEQ ID NO: 2256036 - RNA, 23 nt, Yersinia pestis
aaguaugcguggguucuucaaag

SEQ ID NO: 2256037 - RNA, 14 nt, Yersinia pestis
aaguaaguuuaaac

SEQ ID NO: 2256038 - RNA, 22 nt, Yersinia pestis
aaguaacuugccguaaaauuua

SEQ ID NO: 2256039 - RNA, 15 nt, Yersinia pestis
aaguuacgucagaaa

SEQ ID NO: 2256040 - RNA, 12 nt, Yersinia pestis
aaguuaauguuu

SEQ ID NO: 2256041 - RNA, 17 nt, Yersinia pestis
aaguuaaugacaaagug

SEQ ID NO: 2256042 - RNA, 15 nt, Yersinia pestis
aaguuaaacaauguu

SEQ ID NO: 2256043 - RNA, 17 nt, Yersinia pestis
aaguuaaaaagccugaa

SEQ ID NO: 2256044 - RNA, 21 nt, Yersinia pestis
aaguuaaaaagccugaauucu

SEQ ID NO: 2256045 - RNA, 16 nt, Yersinia pestis
aaguguuucaaauaag

SEQ ID NO: 2256046 - RNA, 21 nt, Yersinia pestis
aaguguucacucaguugauca

SEQ ID NO: 2256047 - RNA, 21 nt, Yersinia pestis
aaguguuaguuuuaauaacuu

SEQ ID NO: 2256048 - RNA, 16 nt, Yersinia pestis
aaguggcugaauauca

SEQ ID NO: 2256049 - RNA, 22 nt, Yersinia pestis
aaguggcuaucugaaacugaga

SEQ ID NO: 2256050 - RNA, 15 nt, Yersinia pestis
aaguggcccuuguaa

SEQ ID NO: 2256051 - RNA, 18 nt, Yersinia pestis
aagugcauuuuugaaacu

SEQ ID NO: 2256052 - RNA, 21 nt, Yersinia pestis
aagugcccccuguaacgcuaa

SEQ ID NO: 2256053 - RNA, 17 nt, Yersinia pestis
aagugcaaacuuaaaaa

SEQ ID NO: 2256054 - RNA, 18 nt, Yersinia pestis
aagugcaaacuuaaaaau

SEQ ID NO: 2256055 - RNA, 21 nt, Yersinia pestis
aagugcaaacuuaaaaaucaa

SEQ ID NO: 2256056 - RNA, 19 nt, Yersinia pestis
aagugaacgaacacaucuu

SEQ ID NO: 2256057 - RNA, 16 nt, Yersinia pestis
aagugaauaaaucaaa

SEQ ID NO: 2256058 - RNA, 13 nt, Yersinia pestis
aagugaauaacgc

SEQ ID NO: 2256059 - RNA, 15 nt, Yersinia pestis
aagugaauaacgcug

SEQ ID NO: 2256060 - RNA, 20 nt, Yersinia pestis
aagugaaacccgcgcagccu

SEQ ID NO: 2256061 - RNA, 14 nt, Yersinia pestis
aagucuuuccuaca

SEQ ID NO: 2256062 - RNA, 22 nt, Yersinia pestis
aagcucuacacugauugaaguc

SEQ ID NO: 2256063 - RNA, 18 nt, Yersinia pestis
aagcucuacuaauauucc

SEQ ID NO: 2256064 - RNA, 14 nt, Yersinia pestis
aagcucuuccaaua

SEQ ID NO: 2256065 - RNA, 17 nt, Yersinia pestis
aagcucuuccaauagca

SEQ ID NO: 2256066 - RNA, 21 nt, Yersinia pestis
aagcuacuaauggagagaugu

SEQ ID NO: 2256067 - RNA, 21 nt, Yersinia pestis
aagcuacggccuguaccacca

SEQ ID NO: 2256068 - RNA, 22 nt, Yersinia pestis
aagcguuaauuauagugaaaac

SEQ ID NO: 2256069 - RNA, 20 nt, Yersinia pestis
aagcguggcgcaggaagcgu

SEQ ID NO: 2256070 - RNA, 22 nt, Yersinia pestis
aagcuacaggcaacgaccuuua

SEQ ID NO: 2256071 - RNA, 17 nt, Yersinia pestis
aagcuacagcgucagau

SEQ ID NO: 2256072 - RNA, 17 nt, Yersinia pestis
aagcuacagcucagacu

SEQ ID NO: 2256073 - RNA, 18 nt, Yersinia pestis
aagccacgccauucauuu

SEQ ID NO: 2256074 - RNA, 19 nt, Yersinia pestis
aagccaccggcaucgagaa

SEQ ID NO: 2256075 - RNA, 17 nt, Yersinia pestis
aagccaaaacagccuaa

SEQ ID NO: 2256076 - RNA, 20 nt, Yersinia pestis
aagcggaucucuucagcaau

SEQ ID NO: 2256077 - RNA, 13 nt, Yersinia pestis
aagcgucucaagg

SEQ ID NO: 2256078 - RNA, 15 nt, Yersinia pestis
aagcuuacuguucac

SEQ ID NO: 2256079 - RNA, 18 nt, Yersinia pestis
aagcuguuggcuuuaucu

SEQ ID NO: 2256080 - RNA, 17 nt, Yersinia pestis
aaggauaaacgaaagag

SEQ ID NO: 2256081 - RNA, 13 nt, Yersinia pestis
aaggauaagcagu

SEQ ID NO: 2256082 - RNA, 20 nt, Yersinia pestis
aaggaauauacuuuacauau

SEQ ID NO: 2256083 - RNA, 19 nt, Yersinia pestis
aaggaagggguucuuccaa

SEQ ID NO: 2256084 - RNA, 22 nt, Yersinia pestis
aagcuuuugccacauuucccuu

SEQ ID NO: 2256085 - RNA, 20 nt, Yersinia pestis
aagcuuuugccacauuuccc

SEQ ID NO: 2256086 - RNA, 14 nt, Yersinia pestis
aaggcugauuaaua

SEQ ID NO: 2256087 - RNA, 22 nt, Yersinia pestis
aaggcuggagcaagugcuucaa

SEQ ID NO: 2256088 - RNA, 15 nt, Yersinia pestis
aaggcggaugugggu

SEQ ID NO: 2256089 - RNA, 18 nt, Yersinia pestis
aaggcugacggugccaga

SEQ ID NO: 2256090 - RNA, 19 nt, Yersinia pestis
aagguaugugccaaaaaaa

SEQ ID NO: 2256091 - RNA, 21 nt, Yersinia pestis
aagguauaaccauuaacaaua

SEQ ID NO: 2256092 - RNA, 18 nt, Yersinia pestis
aagguauagcgauagagu

SEQ ID NO: 2256093 - RNA, 16 nt, Yersinia pestis
aagguuaaauuuaaua

SEQ ID NO: 2256094 - RNA, 15 nt, Yersinia pestis
aagguuagcuaugca

SEQ ID NO: 2256095 - RNA, 19 nt, Yersinia pestis
aaggugugcucacaaucuu

SEQ ID NO: 2256096 - RNA, 15 nt, Yersinia pestis
aagguguacucuccc

SEQ ID NO: 2256097 - RNA, 18 nt, Yersinia pestis
aaggugugauugaagcgu

SEQ ID NO: 2256098 - RNA, 12 nt, Yersinia pestis
aagguugaccug

SEQ ID NO: 2256099 - RNA, 13 nt, Yersinia pestis
aaggcaauaccgg

SEQ ID NO: 2256100 - RNA, 22 nt, Yersinia pestis
aaggcacaucuccagaauauaa

SEQ ID NO: 2256101 - RNA, 13 nt, Yersinia pestis
aaggcaccagcgc

SEQ ID NO: 2256102 - RNA, 20 nt, Yersinia pestis
aaggcaacgaaggcaacaac

SEQ ID NO: 2256103 - RNA, 16 nt, Yersinia pestis
aaggcauccacaucuu

SEQ ID NO: 2256104 - RNA, 13 nt, Yersinia pestis
aaggcauccacau

SEQ ID NO: 2256105 - RNA, 14 nt, Yersinia pestis
aaggcauccacauc

SEQ ID NO: 2256106 - RNA, 13 nt, Yersinia pestis
aaggcagugacag

SEQ ID NO: 2256107 - RNA, 13 nt, Yersinia pestis
aaggcagcaagca

SEQ ID NO: 2256108 - RNA, 13 nt, Yersinia pestis
aaggccccucggg

SEQ ID NO: 2256109 - RNA, 16 nt, Yersinia pestis
aaggcccuaaccaauu

SEQ ID NO: 2256110 - RNA, 19 nt, Yersinia pestis
aaggcccgcuaucacuagc

SEQ ID NO: 2256111 - RNA, 22 nt, Yersinia pestis
aaggccaguaguaaaaaaucua

SEQ ID NO: 2256112 - RNA, 19 nt, Yersinia pestis
acaaauugcggcaaccaaa

SEQ ID NO: 2256113 - RNA, 18 nt, Yersinia pestis
acaaauucaccagcaaua

SEQ ID NO: 2256114 - RNA, 23 nt, Yersinia pestis
acaaauggucaggaacccauuug

SEQ ID NO: 2256115 - RNA, 17 nt, Yersinia pestis
acaaauuugacauuucc

SEQ ID NO: 2256116 - RNA, 18 nt, Yersinia pestis
acaaauuugacauuuccu

SEQ ID NO: 2256117 - RNA, 12 nt, Yersinia pestis
acaacaaaggcg

SEQ ID NO: 2256118 - RNA, 20 nt, Yersinia pestis
acaacaagaucccaagcagg

SEQ ID NO: 2256119 - RNA, 23 nt, Yersinia pestis
acaaauaacccgccuagcaucau

SEQ ID NO: 2256120 - RNA, 14 nt, Yersinia pestis
acaaauaaaaccaa

SEQ ID NO: 2256121 - RNA, 16 nt, Yersinia pestis
acaaauaaaaccaaga

SEQ ID NO: 2256122 - RNA, 14 nt, Yersinia pestis
acaaauaaaacaga

SEQ ID NO: 2256123 - RNA, 16 nt, Yersinia pestis
acaaauagauuuaacu

SEQ ID NO: 2256124 - RNA, 18 nt, Yersinia pestis
acaaauaguaauaauuaa

SEQ ID NO: 2256125 - RNA, 19 nt, Yersinia pestis
acaaauauuggcccacugg

SEQ ID NO: 2256126 - RNA, 13 nt, Yersinia pestis
acaaauaugaaga

SEQ ID NO: 2256127 - RNA, 23 nt, Yersinia pestis
acaaauaugacgcagcgaaaugu

SEQ ID NO: 2256128 - RNA, 18 nt, Yersinia pestis
acaaauaaggcguuuaau

SEQ ID NO: 2256129 - RNA, 13 nt, Yersinia pestis
acaaauccuguag

SEQ ID NO: 2256130 - RNA, 14 nt, Yersinia pestis
acaaauccuuuuaa

SEQ ID NO: 2256131 - RNA, 16 nt, Yersinia pestis
acaaauccuuuuaaaa

SEQ ID NO: 2256132 - RNA, 21 nt, Yersinia pestis
acaaaucuuaaauugaagagu

SEQ ID NO: 2256133 - RNA, 24 nt, Yersinia pestis
acaaagauacagcccaagagaaau

SEQ ID NO: 2256134 - RNA, 15 nt, Yersinia pestis
acaaagauagcguca

SEQ ID NO: 2256135 - RNA, 13 nt, Yersinia pestis
acaaagcauuuca

SEQ ID NO: 2256136 - RNA, 23 nt, Yersinia pestis
acaaagugcccgcgacgagagaa

SEQ ID NO: 2256137 - RNA, 20 nt, Yersinia pestis
acaaaguuaugccacaucag

SEQ ID NO: 2256138 - RNA, 18 nt, Yersinia pestis
acaaaguccacgugcuua

SEQ ID NO: 2256139 - RNA, 21 nt, Yersinia pestis
acaaaggucagcauggucccu

SEQ ID NO: 2256140 - RNA, 13 nt, Yersinia pestis
acaaacagauaca

SEQ ID NO: 2256141 - RNA, 20 nt, Yersinia pestis
acaaaccacauuuuuuaaaa

SEQ ID NO: 2256142 - RNA, 18 nt, Yersinia pestis
acaaacauggcggcagca

SEQ ID NO: 2256143 - RNA, 15 nt, Yersinia pestis
acaaaccguugcuca

SEQ ID NO: 2256144 - RNA, 15 nt, Yersinia pestis
acaaaccuaaaccuu

SEQ ID NO: 2256145 - RNA, 23 nt, Yersinia pestis
acaaacuguuuuuuaaagaaaaa

SEQ ID NO: 2256146 - RNA, 12 nt, Yersinia pestis
acaagccaaaca

SEQ ID NO: 2256147 - RNA, 19 nt, Yersinia pestis
acaagccagugacugagca

SEQ ID NO: 2256148 - RNA, 14 nt, Yersinia pestis
acaagcgaccauca

SEQ ID NO: 2256149 - RNA, 17 nt, Yersinia pestis
acaagcgaccaucauga

SEQ ID NO: 2256150 - RNA, 20 nt, Yersinia pestis
acaagccgugaccaaagugc

SEQ ID NO: 2256151 - RNA, 19 nt, Yersinia pestis
acaagcgaccaucaugaau

SEQ ID NO: 2256152 - RNA, 22 nt, Yersinia pestis
acaagcuacagcgucagauauu

SEQ ID NO: 2256153 - RNA, 13 nt, Yersinia pestis
acaacguuucugg

SEQ ID NO: 2256154 - RNA, 21 nt, Yersinia pestis
acaacggguuuucuguuuuug

SEQ ID NO: 2256155 - RNA, 18 nt, Yersinia pestis
acaacguguccgcaccau

SEQ ID NO: 2256156 - RNA, 16 nt, Yersinia pestis
acaacguccagaacaa

SEQ ID NO: 2256157 - RNA, 15 nt, Yersinia pestis
acaacgcuccagguu

SEQ ID NO: 2256158 - RNA, 20 nt, Yersinia pestis
acaacgccggaucaucaacc

SEQ ID NO: 2256159 - RNA, 18 nt, Yersinia pestis
acaacgcugaaaaaucuu

SEQ ID NO: 2256160 - RNA, 17 nt, Yersinia pestis
acaaccuguagcucaua

SEQ ID NO: 2256161 - RNA, 15 nt, Yersinia pestis
acaacgagggcucaa

SEQ ID NO: 2256162 - RNA, 19 nt, Yersinia pestis
acaacgagggcucaaucuc

SEQ ID NO: 2256163 - RNA, 14 nt, Yersinia pestis
acaaccuaccaccu

SEQ ID NO: 2256164 - RNA, 14 nt, Yersinia pestis
acaaccgugcacca

SEQ ID NO: 2256165 - RNA, 12 nt, Yersinia pestis
acaacaucaucg

SEQ ID NO: 2256166 - RNA, 15 nt, Yersinia pestis
acaacaucaucguca

SEQ ID NO: 2256167 - RNA, 19 nt, Yersinia pestis
acaacauagguuuuuucac

SEQ ID NO: 2256168 - RNA, 22 nt, Yersinia pestis
acaacagucacaccaacacuga

SEQ ID NO: 2256169 - RNA, 22 nt, Yersinia pestis
acaaccauuguggcuaaaccca

SEQ ID NO: 2256170 - RNA, 18 nt, Yersinia pestis
acaacccgaauuaauaaa

SEQ ID NO: 2256171 - RNA, 23 nt, Yersinia pestis
acaaccauuguggcuaaacccaa

SEQ ID NO: 2256172 - RNA, 13 nt, Yersinia pestis
acaacccauuucc

SEQ ID NO: 2256173 - RNA, 20 nt, Yersinia pestis
acaacauuagggccaccaga

SEQ ID NO: 2256174 - RNA, 17 nt, Yersinia pestis
acaaccaauacacagca

SEQ ID NO: 2256175 - RNA, 14 nt, Yersinia pestis
acaaccaacaaaca

SEQ ID NO: 2256176 - RNA, 16 nt, Yersinia pestis
acaaccaacaaacaau

SEQ ID NO: 2256177 - RNA, 14 nt, Yersinia pestis
acaaccaacaguuu

SEQ ID NO: 2256178 - RNA, 20 nt, Yersinia pestis
aauuuuuaccuucuacaaau

SEQ ID NO: 2256179 - RNA, 16 nt, Yersinia pestis
aauuuuuagaaaacau

SEQ ID NO: 2256180 - RNA, 16 nt, Yersinia pestis
aauuuuugauacuguu

SEQ ID NO: 2256181 - RNA, 22 nt, Yersinia pestis
aauuuuauucgcguuucauuuu

SEQ ID NO: 2256182 - RNA, 20 nt, Yersinia pestis
aauuuuauuguuuucguuua

SEQ ID NO: 2256183 - RNA, 19 nt, Yersinia pestis
acaaaaaguuaaauaugcu

SEQ ID NO: 2256184 - RNA, 22 nt, Yersinia pestis
acaaaagagauccguuuaauca

SEQ ID NO: 2256185 - RNA, 13 nt, Yersinia pestis
acaaaaccaaccc

SEQ ID NO: 2256186 - RNA, 15 nt, Yersinia pestis
acaaaaacgcucacg

SEQ ID NO: 2256187 - RNA, 11 nt, Yersinia pestis
acaaaaacagu

SEQ ID NO: 2256188 - RNA, 20 nt, Yersinia pestis
acaaaaugccguacaacaau

SEQ ID NO: 2256189 - RNA, 21 nt, Yersinia pestis
acaaaaugccguacaacaaua

SEQ ID NO: 2256190 - RNA, 17 nt, Yersinia pestis
acaaaaugugaaaagca

SEQ ID NO: 2256191 - RNA, 22 nt, Yersinia pestis
acaaaaugugaaaagcagucga

SEQ ID NO: 2256192 - RNA, 20 nt, Yersinia pestis
acaaaauaauaauucugcua

SEQ ID NO: 2256193 - RNA, 13 nt, Yersinia pestis
aauuuggccaaua

SEQ ID NO: 2256194 - RNA, 16 nt, Yersinia pestis
aauuugguaauuucca

SEQ ID NO: 2256195 - RNA, 15 nt, Yersinia pestis
aauuugguagaacug

SEQ ID NO: 2256196 - RNA, 14 nt, Yersinia pestis
aauuugccauacca

SEQ ID NO: 2256197 - RNA, 14 nt, Yersinia pestis
aauuugaucaccaa

SEQ ID NO: 2256198 - RNA, 15 nt, Yersinia pestis
aauuugacauuuccu

SEQ ID NO: 2256199 - RNA, 14 nt, Yersinia pestis
aauuuuaauuauaa

SEQ ID NO: 2256200 - RNA, 13 nt, Yersinia pestis
aauuuuacguuca

SEQ ID NO: 2256201 - RNA, 14 nt, Yersinia pestis
aauuuuagucaaaa

SEQ ID NO: 2256202 - RNA, 19 nt, Yersinia pestis
aauuuuagucaaaacaaua

SEQ ID NO: 2256203 - RNA, 15 nt, Yersinia pestis
aauuauaauccacug

SEQ ID NO: 2256204 - RNA, 23 nt, Yersinia pestis
aauuucaugcgaauacuuugcua

SEQ ID NO: 2256205 - RNA, 20 nt, Yersinia pestis
aauuucauuguggaggaagg

SEQ ID NO: 2256206 - RNA, 23 nt, Yersinia pestis
aauuucucggccaacaucuucca

SEQ ID NO: 2256207 - RNA, 13 nt, Yersinia pestis
aauuucucaaaua

SEQ ID NO: 2256208 - RNA, 22 nt, Yersinia pestis
aauuucuugucaccugaguaau

SEQ ID NO: 2256209 - RNA, 18 nt, Yersinia pestis
aauuucuucuagcucuuc

SEQ ID NO: 2256210 - RNA, 23 nt, Yersinia pestis
aauuucuucuagcucuuccagca

SEQ ID NO: 2256211 - RNA, 14 nt, Yersinia pestis
acacaaaagacgcc

SEQ ID NO: 2256212 - RNA, 18 nt, Yersinia pestis
acaauuucgaaaacucaa

SEQ ID NO: 2256213 - RNA, 10 nt, Yersinia pestis
acaauuuuau

SEQ ID NO: 2256214 - RNA, 15 nt, Yersinia pestis
acaauugcuccaguu

SEQ ID NO: 2256215 - RNA, 17 nt, Yersinia pestis
acaauugcuccaguuga

SEQ ID NO: 2256216 - RNA, 22 nt, Yersinia pestis
acaaugguugaaugaccaaggu

SEQ ID NO: 2256217 - RNA, 15 nt, Yersinia pestis
acaauguuauauuuc

SEQ ID NO: 2256218 - RNA, 13 nt, Yersinia pestis
acaauuacacacc

SEQ ID NO: 2256219 - RNA, 22 nt, Yersinia pestis
acaaugcggccuuugcucaggu

SEQ ID NO: 2256220 - RNA, 18 nt, Yersinia pestis
acacauaaccaucaaaca

SEQ ID NO: 2256221 - RNA, 14 nt, Yersinia pestis
acacauaccacaca

SEQ ID NO: 2256222 - RNA, 15 nt, Yersinia pestis
acacauaccacacac

SEQ ID NO: 2256223 - RNA, 16 nt, Yersinia pestis
acacauaccacacaca

SEQ ID NO: 2256224 - RNA, 19 nt, Yersinia pestis
acacauaccacacacaaag

SEQ ID NO: 2256225 - RNA, 13 nt, Yersinia pestis
acacauaaccauc

SEQ ID NO: 2256226 - RNA, 17 nt, Yersinia pestis
acacaguuauucccauc

SEQ ID NO: 2256227 - RNA, 14 nt, Yersinia pestis
acacaguggaaccu

SEQ ID NO: 2256228 - RNA, 21 nt, Yersinia pestis
acacauacuucgaugauuauu

SEQ ID NO: 2256229 - RNA, 13 nt, Yersinia pestis
acacauauuucau

SEQ ID NO: 2256230 - RNA, 17 nt, Yersinia pestis
acacaucgaagcugucu

SEQ ID NO: 2256231 - RNA, 17 nt, Yersinia pestis
acacaucacgcuuaaga

SEQ ID NO: 2256232 - RNA, 14 nt, Yersinia pestis
acacagccagccuu

SEQ ID NO: 2256233 - RNA, 23 nt, Yersinia pestis
acacagcccugccuggcaggaag

SEQ ID NO: 2256234 - RNA, 15 nt, Yersinia pestis
acacagcacggcaac

SEQ ID NO: 2256235 - RNA, 15 nt, Yersinia pestis
acacagcuccccccu

SEQ ID NO: 2256236 - RNA, 15 nt, Yersinia pestis
acacagguucuccag

SEQ ID NO: 2256237 - RNA, 16 nt, Yersinia pestis
acacagaaucaccaac

SEQ ID NO: 2256238 - RNA, 19 nt, Yersinia pestis
acacagacuggugaacgaa

SEQ ID NO: 2256239 - RNA, 13 nt, Yersinia pestis
acacaccugcaac

SEQ ID NO: 2256240 - RNA, 19 nt, Yersinia pestis
acacacagccuacgggguc

SEQ ID NO: 2256241 - RNA, 22 nt, Yersinia pestis
acacaauucccguuagguucaa

SEQ ID NO: 2256242 - RNA, 12 nt, Yersinia pestis
acacaauuuuua

SEQ ID NO: 2256243 - RNA, 15 nt, Yersinia pestis
acacaauaggcuauu

SEQ ID NO: 2256244 - RNA, 15 nt, Yersinia pestis
acaagugccaaaugg

SEQ ID NO: 2256245 - RNA, 18 nt, Yersinia pestis
acaaguuacauuuuuaac

SEQ ID NO: 2256246 - RNA, 16 nt, Yersinia pestis
acaauaccgccacaca

SEQ ID NO: 2256247 - RNA, 17 nt, Yersinia pestis
acaauaccauuuugccg

SEQ ID NO: 2256248 - RNA, 15 nt, Yersinia pestis
acaauaaauauccuc

SEQ ID NO: 2256249 - RNA, 23 nt, Yersinia pestis
acaauaacgcugaauacacucgu

SEQ ID NO: 2256250 - RNA, 15 nt, Yersinia pestis
acaauaaaaucuuaa

SEQ ID NO: 2256251 - RNA, 20 nt, Yersinia pestis
acaaguuggugcaguugguc

SEQ ID NO: 2256252 - RNA, 21 nt, Yersinia pestis
acaaguugucuguaauaauaa

SEQ ID NO: 2256253 - RNA, 16 nt, Yersinia pestis
acaaugacuuaacuga

SEQ ID NO: 2256254 - RNA, 23 nt, Yersinia pestis
acaaugacuuaacugaaagccaa

SEQ ID NO: 2256255 - RNA, 14 nt, Yersinia pestis
acaaugacuuaacu

SEQ ID NO: 2256256 - RNA, 13 nt, Yersinia pestis
acaaugacuuaac

SEQ ID NO: 2256257 - RNA, 16 nt, Yersinia pestis
acaaugcacagugccg

SEQ ID NO: 2256258 - RNA, 13 nt, Yersinia pestis
acaaugauuucag

SEQ ID NO: 2256259 - RNA, 13 nt, Yersinia pestis
acaaucuggcagc

SEQ ID NO: 2256260 - RNA, 14 nt, Yersinia pestis
acaaucuucuucag

SEQ ID NO: 2256261 - RNA, 12 nt, Yersinia pestis
acaaucgauucc

SEQ ID NO: 2256262 - RNA, 16 nt, Yersinia pestis
acaaucgucuucgguc

SEQ ID NO: 2256263 - RNA, 22 nt, Yersinia pestis
acaaucagugcaauaaauucaa

SEQ ID NO: 2256264 - RNA, 17 nt, Yersinia pestis
acaaucaucguggcuuu

SEQ ID NO: 2256265 - RNA, 14 nt, Yersinia pestis
acaauccgaacaaa

SEQ ID NO: 2256266 - RNA, 15 nt, Yersinia pestis
acaauaucuucccug

SEQ ID NO: 2256267 - RNA, 17 nt, Yersinia pestis
acaauaggcuauuuuac

SEQ ID NO: 2256268 - RNA, 18 nt, Yersinia pestis
acaccauugauaauaaua

SEQ ID NO: 2256269 - RNA, 13 nt, Yersinia pestis
acaccauuuucaa

SEQ ID NO: 2256270 - RNA, 22 nt, Yersinia pestis
acacccgaccagacaacaguca

SEQ ID NO: 2256271 - RNA, 16 nt, Yersinia pestis
acacccgccaaaccau

SEQ ID NO: 2256272 - RNA, 15 nt, Yersinia pestis
acaccauauugcugu

SEQ ID NO: 2256273 - RNA, 17 nt, Yersinia pestis
acaccauauugcuguuu

SEQ ID NO: 2256274 - RNA, 12 nt, Yersinia pestis
acaccaucagua

SEQ ID NO: 2256275 - RNA, 19 nt, Yersinia pestis
acaccagagaugauagcaa

SEQ ID NO: 2256276 - RNA, 19 nt, Yersinia pestis
acacauuggccacuggccu

SEQ ID NO: 2256277 - RNA, 15 nt, Yersinia pestis
acaccaaaacucccu

SEQ ID NO: 2256278 - RNA, 18 nt, Yersinia pestis
acaccaacaccacacuga

SEQ ID NO: 2256279 - RNA, 18 nt, Yersinia pestis
acacauuccaguaaaaaa

SEQ ID NO: 2256280 - RNA, 22 nt, Yersinia pestis
acacauuccaguaaaaaaauag

SEQ ID NO: 2256281 - RNA, 16 nt, Yersinia pestis
acacaugaaaaucaag

SEQ ID NO: 2256282 - RNA, 19 nt, Yersinia pestis
acacaucuuccaguacaga

SEQ ID NO: 2256283 - RNA, 13 nt, Yersinia pestis
acacaugaaaauc

SEQ ID NO: 2256284 - RNA, 13 nt, Yersinia pestis
acaccaacuggcg

SEQ ID NO: 2256285 - RNA, 19 nt, Yersinia pestis
acaccaacacugaauaacu

SEQ ID NO: 2256286 - RNA, 21 nt, Yersinia pestis
acaccaagcccgauugccugu

SEQ ID NO: 2256287 - RNA, 21 nt, Yersinia pestis
acaccaagaacccuuuaucuu

SEQ ID NO: 2256288 - RNA, 21 nt, Yersinia pestis
acaccacgcuauauagacgaa

SEQ ID NO: 2256289 - RNA, 14 nt, Yersinia pestis
acaccaccaucacu

SEQ ID NO: 2256290 - RNA, 15 nt, Yersinia pestis
acaccguuguuggcg

SEQ ID NO: 2256291 - RNA, 20 nt, Yersinia pestis
acacccucaacucaaaacaa

SEQ ID NO: 2256292 - RNA, 21 nt, Yersinia pestis
acacccucaacucaaaacaau

SEQ ID NO: 2256293 - RNA, 15 nt, Yersinia pestis
acaccgaaauuagaa

SEQ ID NO: 2256294 - RNA, 17 nt, Yersinia pestis
acaccgagauauuauug

SEQ ID NO: 2256295 - RNA, 17 nt, Yersinia pestis
acacgacagcgcggcua

SEQ ID NO: 2256296 - RNA, 15 nt, Yersinia pestis
acacgaaaagcagca

SEQ ID NO: 2256297 - RNA, 13 nt, Yersinia pestis
acacgauuuuuac

SEQ ID NO: 2256298 - RNA, 24 nt, Yersinia pestis
acaccugcaacguuaaagaugaag

SEQ ID NO: 2256299 - RNA, 14 nt, Yersinia pestis
acaccuuaaaacag

SEQ ID NO: 2256300 - RNA, 19 nt, Yersinia pestis
acaccuuuauggcuggagg

SEQ ID NO: 2256301 - RNA, 13 nt, Yersinia pestis
acagacuggugaa

SEQ ID NO: 2256302 - RNA, 15 nt, Yersinia pestis
acagauaaauaaaau

SEQ ID NO: 2256303 - RNA, 12 nt, Yersinia pestis
acagauaaagcu

SEQ ID NO: 2256304 - RNA, 23 nt, Yersinia pestis
acagauauuuucggguaucugug

SEQ ID NO: 2256305 - RNA, 23 nt, Yersinia pestis
acagauauauccaggcacugcca

SEQ ID NO: 2256306 - RNA, 22 nt, Yersinia pestis
acagauauuacgcagccauacc

SEQ ID NO: 2256307 - RNA, 16 nt, Yersinia pestis
acagauauuacgcagc

SEQ ID NO: 2256308 - RNA, 15 nt, Yersinia pestis
acagaucauuaggcc

SEQ ID NO: 2256309 - RNA, 23 nt, Yersinia pestis
acagacgccccgaaccauuuacc

SEQ ID NO: 2256310 - RNA, 23 nt, Yersinia pestis
acagacguuuaaauaagcuauca

SEQ ID NO: 2256311 - RNA, 19 nt, Yersinia pestis
acagacuaaaaaccgccac

SEQ ID NO: 2256312 - RNA, 15 nt, Yersinia pestis
acagaaucaccaaca

SEQ ID NO: 2256313 - RNA, 24 nt, Yersinia pestis
acagaaucaccaacaccaccauca

SEQ ID NO: 2256314 - RNA, 19 nt, Yersinia pestis
acagaagcguaaagcaccc

SEQ ID NO: 2256315 - RNA, 21 nt, Yersinia pestis
acagauccugccgccucugcu

SEQ ID NO: 2256316 - RNA, 22 nt, Yersinia pestis
acagcaggugguuaaacugaca

SEQ ID NO: 2256317 - RNA, 23 nt, Yersinia pestis
acagcaucugcaauggcuggcaa

SEQ ID NO: 2256318 - RNA, 16 nt, Yersinia pestis
acagcaucacugucua

SEQ ID NO: 2256319 - RNA, 15 nt, Yersinia pestis
acagcaucacugucu

SEQ ID NO: 2256320 - RNA, 13 nt, Yersinia pestis
acagcaucaauau

SEQ ID NO: 2256321 - RNA, 14 nt, Yersinia pestis
acacggugaauaaa

SEQ ID NO: 2256322 - RNA, 20 nt, Yersinia pestis
acacggucuggcaacgcugu

SEQ ID NO: 2256323 - RNA, 14 nt, Yersinia pestis
acacguugaccgac

SEQ ID NO: 2256324 - RNA, 17 nt, Yersinia pestis
acacggcggugcuuuuu

SEQ ID NO: 2256325 - RNA, 15 nt, Yersinia pestis
acagaaacgauuacc

SEQ ID NO: 2256326 - RNA, 16 nt, Yersinia pestis
acagaagcguaaagca

SEQ ID NO: 2256327 - RNA, 17 nt, Yersinia pestis
acagaaaaauaacaucc

SEQ ID NO: 2256328 - RNA, 13 nt, Yersinia pestis
acagaaaaauaac

SEQ ID NO: 2256329 - RNA, 13 nt, Yersinia pestis
acacuccauuaau

SEQ ID NO: 2256330 - RNA, 17 nt, Yersinia pestis
acacucaccguucauga

SEQ ID NO: 2256331 - RNA, 19 nt, Yersinia pestis
acacucagaugaaaaacug

SEQ ID NO: 2256332 - RNA, 23 nt, Yersinia pestis
acauuacaagugccaaauggaau

SEQ ID NO: 2256333 - RNA, 24 nt, Yersinia pestis
acauuacaagugccaaauggaaua

SEQ ID NO: 2256334 - RNA, 17 nt, Yersinia pestis
acauuacggcccugaau

SEQ ID NO: 2256335 - RNA, 21 nt, Yersinia pestis
acauuacggcccugaauuaaa

SEQ ID NO: 2256336 - RNA, 22 nt, Yersinia pestis
acauuacgggccucgcggaaau

SEQ ID NO: 2256337 - RNA, 13 nt, Yersinia pestis
acauuauuauuua

SEQ ID NO: 2256338 - RNA, 15 nt, Yersinia pestis
acauuauuauuuaca

SEQ ID NO: 2256339 - RNA, 13 nt, Yersinia pestis
acauuccacaaau

SEQ ID NO: 2256340 - RNA, 16 nt, Yersinia pestis
acauuccacaaauuuu

SEQ ID NO: 2256341 - RNA, 19 nt, Yersinia pestis
acauuccacaaauuuuuac

SEQ ID NO: 2256342 - RNA, 23 nt, Yersinia pestis
acauucucuacucgcucaccacu

SEQ ID NO: 2256343 - RNA, 19 nt, Yersinia pestis
acauucugauagugauuuu

SEQ ID NO: 2256344 - RNA, 20 nt, Yersinia pestis
acauugccaaauuauucauc

SEQ ID NO: 2256345 - RNA, 22 nt, Yersinia pestis
acaugcgaugcgagcaaggcau

SEQ ID NO: 2256346 - RNA, 21 nt, Yersinia pestis
acaugccgucaccucaucagu

SEQ ID NO: 2256347 - RNA, 15 nt, Yersinia pestis
acauguugaaaucua

SEQ ID NO: 2256348 - RNA, 22 nt, Yersinia pestis
acauguugaaaucuauuguaua

SEQ ID NO: 2256349 - RNA, 15 nt, Yersinia pestis
acauguuccagugcu

SEQ ID NO: 2256350 - RNA, 13 nt, Yersinia pestis
acauuaaaugaau

SEQ ID NO: 2256351 - RNA, 16 nt, Yersinia pestis
acauuaaacccacccc

SEQ ID NO: 2256352 - RNA, 19 nt, Yersinia pestis
acauuaaaaauacaaccaa

SEQ ID NO: 2256353 - RNA, 20 nt, Yersinia pestis
acauuaaaaauacaaccaac

SEQ ID NO: 2256354 - RNA, 14 nt, Yersinia pestis
acauuaaaugaaua

SEQ ID NO: 2256355 - RNA, 19 nt, Yersinia pestis
acaucgugaccccguggcg

SEQ ID NO: 2256356 - RNA, 21 nt, Yersinia pestis
acaucgaagcugucuuuuaaa

SEQ ID NO: 2256357 - RNA, 12 nt, Yersinia pestis
acaucaauggca

SEQ ID NO: 2256358 - RNA, 22 nt, Yersinia pestis
acaucaggcuguugacauaaac

SEQ ID NO: 2256359 - RNA, 18 nt, Yersinia pestis
acaucaggccuucuuuuc

SEQ ID NO: 2256360 - RNA, 17 nt, Yersinia pestis
acauauaaccaucaaau

SEQ ID NO: 2256361 - RNA, 19 nt, Yersinia pestis
acauaucaacacugccuga

SEQ ID NO: 2256362 - RNA, 15 nt, Yersinia pestis
acauaucaacacugc

SEQ ID NO: 2256363 - RNA, 19 nt, Yersinia pestis
acauaucuuuauuaucaau

SEQ ID NO: 2256364 - RNA, 22 nt, Yersinia pestis
acauaucucaucgcuugccacu

SEQ ID NO: 2256365 - RNA, 17 nt, Yersinia pestis
acauccuaaauaauucc

SEQ ID NO: 2256366 - RNA, 13 nt, Yersinia pestis
acauccucagagc

SEQ ID NO: 2256367 - RNA, 16 nt, Yersinia pestis
acauccgaauuuuuac

SEQ ID NO: 2256368 - RNA, 12 nt, Yersinia pestis
acaucaucaccu

SEQ ID NO: 2256369 - RNA, 19 nt, Yersinia pestis
acaucauccacuagcauca

SEQ ID NO: 2256370 - RNA, 13 nt, Yersinia pestis
acaucaugaguaa

SEQ ID NO: 2256371 - RNA, 21 nt, Yersinia pestis
acauccagcgguguuaccaga

SEQ ID NO: 2256372 - RNA, 21 nt, Yersinia pestis
acauacgucuccauuucaacg

SEQ ID NO: 2256373 - RNA, 20 nt, Yersinia pestis
acauagaagcucauaugcag

SEQ ID NO: 2256374 - RNA, 19 nt, Yersinia pestis
acauagagagaacagcgaa

SEQ ID NO: 2256375 - RNA, 21 nt, Yersinia pestis
acauauaaaccagccagugau

SEQ ID NO: 2256376 - RNA, 22 nt, Yersinia pestis
acauauaauccaaaauaauaua

SEQ ID NO: 2256377 - RNA, 15 nt, Yersinia pestis
acauauaaaccagcc

SEQ ID NO: 2256378 - RNA, 23 nt, Yersinia pestis
acauaguuaugaugaguaacaua

SEQ ID NO: 2256379 - RNA, 17 nt, Yersinia pestis
acauaguugaauaacuu

SEQ ID NO: 2256380 - RNA, 22 nt, Yersinia pestis
acauagcugcgauaauccgcca

SEQ ID NO: 2256381 - RNA, 23 nt, Yersinia pestis
acauagcacccaauguauauguu

SEQ ID NO: 2256382 - RNA, 22 nt, Yersinia pestis
acauagcccggcucauccgcca

SEQ ID NO: 2256383 - RNA, 21 nt, Yersinia pestis
acagcauuuugcggaucacau

SEQ ID NO: 2256384 - RNA, 15 nt, Yersinia pestis
acagccaaaucagua

SEQ ID NO: 2256385 - RNA, 18 nt, Yersinia pestis
acagcauuaccaaggaaa

SEQ ID NO: 2256386 - RNA, 23 nt, Yersinia pestis
acagcauuaccaaggaaaccacc

SEQ ID NO: 2256387 - RNA, 15 nt, Yersinia pestis
acauaaaaagaaaaa

SEQ ID NO: 2256388 - RNA, 21 nt, Yersinia pestis
acauaaaaagaaaaaaacaga

SEQ ID NO: 2256389 - RNA, 24 nt, Yersinia pestis
acauaaaaagaaaaaaacagacua

SEQ ID NO: 2256390 - RNA, 15 nt, Yersinia pestis
acauaaaaaagagua

SEQ ID NO: 2256391 - RNA, 16 nt, Yersinia pestis
acauaauaaauuaaua

SEQ ID NO: 2256392 - RNA, 18 nt, Yersinia pestis
acauaauaaccauuuaua

SEQ ID NO: 2256393 - RNA, 17 nt, Yersinia pestis
acauaaguaagugauuc

SEQ ID NO: 2256394 - RNA, 13 nt, Yersinia pestis
acauaaggcuaga

SEQ ID NO: 2256395 - RNA, 18 nt, Yersinia pestis
acauaacguuauaacuca

SEQ ID NO: 2256396 - RNA, 16 nt, Yersinia pestis
acauaaaaaugcacug

SEQ ID NO: 2256397 - RNA, 19 nt, Yersinia pestis
accacagcgaucucauuua

SEQ ID NO: 2256398 - RNA, 21 nt, Yersinia pestis
accacauaacgcacuggucag

SEQ ID NO: 2256399 - RNA, 21 nt, Yersinia pestis
accaaugggguaaucacuaca

SEQ ID NO: 2256400 - RNA, 19 nt, Yersinia pestis
accacaaugauuucaguuu

SEQ ID NO: 2256401 - RNA, 13 nt, Yersinia pestis
accaaugauuuug

SEQ ID NO: 2256402 - RNA, 19 nt, Yersinia pestis
accaauggacggaacacgu

SEQ ID NO: 2256403 - RNA, 10 nt, Yersinia pestis
accaauggug

SEQ ID NO: 2256404 - RNA, 18 nt, Yersinia pestis
accaagaggaaaugccgc

SEQ ID NO: 2256405 - RNA, 21 nt, Yersinia pestis
accaagccaaauuaaguaagc

SEQ ID NO: 2256406 - RNA, 20 nt, Yersinia pestis
accaagcccuuuggcaauca

SEQ ID NO: 2256407 - RNA, 20 nt, Yersinia pestis
accaagcccaguaaagcaaa

SEQ ID NO: 2256408 - RNA, 19 nt, Yersinia pestis
accaagacuucaugacuac

SEQ ID NO: 2256409 - RNA, 15 nt, Yersinia pestis
accaagagagaaucc

SEQ ID NO: 2256410 - RNA, 20 nt, Yersinia pestis
accaacacuccucuuucuua

SEQ ID NO: 2256411 - RNA, 19 nt, Yersinia pestis
accaagaacccuuuaucuu

SEQ ID NO: 2256412 - RNA, 22 nt, Yersinia pestis
acauuuccuuguggauccagca

SEQ ID NO: 2256413 - RNA, 23 nt, Yersinia pestis
acauugucaccuaaccaaacauu

SEQ ID NO: 2256414 - RNA, 21 nt, Yersinia pestis
acauuguuaccuaaccaaaca

SEQ ID NO: 2256415 - RNA, 22 nt, Yersinia pestis
acauuguuaccuaaccaaacau

SEQ ID NO: 2256416 - RNA, 18 nt, Yersinia pestis
acauugucuaacaacugg

SEQ ID NO: 2256417 - RNA, 15 nt, Yersinia pestis
acauuucuuauauua

SEQ ID NO: 2256418 - RNA, 15 nt, Yersinia pestis
acauuuguugcaaua

SEQ ID NO: 2256419 - RNA, 14 nt, Yersinia pestis
acauuuuaaagaau

SEQ ID NO: 2256420 - RNA, 17 nt, Yersinia pestis
acauuuuaaagaaugca

SEQ ID NO: 2256421 - RNA, 19 nt, Yersinia pestis
acauuuguauuuuuucuuu

SEQ ID NO: 2256422 - RNA, 20 nt, Yersinia pestis
accaaaucugacgguuauuu

SEQ ID NO: 2256423 - RNA, 21 nt, Yersinia pestis
accaacaacuccacuuccuca

SEQ ID NO: 2256424 - RNA, 12 nt, Yersinia pestis
accaacaaacaa

SEQ ID NO: 2256425 - RNA, 17 nt, Yersinia pestis
accaaacauugucaccu

SEQ ID NO: 2256426 - RNA, 19 nt, Yersinia pestis
accaaacauuuucaucuga

SEQ ID NO: 2256427 - RNA, 12 nt, Yersinia pestis
accaaacauugu

SEQ ID NO: 2256428 - RNA, 19 nt, Yersinia pestis
accaaaauucacaacuugu

SEQ ID NO: 2256429 - RNA, 12 nt, Yersinia pestis
accaaaauuuaa

SEQ ID NO: 2256430 - RNA, 12 nt, Yersinia pestis
accaaaauagcg

SEQ ID NO: 2256431 - RNA, 21 nt, Yersinia pestis
acauuuugguuucuccaagca

SEQ ID NO: 2256432 - RNA, 23 nt, Yersinia pestis
acauuuugguuucuccaagcaca

SEQ ID NO: 2256433 - RNA, 14 nt, Yersinia pestis
acauuuucuaucuc

SEQ ID NO: 2256434 - RNA, 17 nt, Yersinia pestis
acauuuuucuauuucug

SEQ ID NO: 2256435 - RNA, 11 nt, Yersinia pestis
acauuuugugc

SEQ ID NO: 2256436 - RNA, 16 nt, Yersinia pestis
accacuuaguggcauu

SEQ ID NO: 2256437 - RNA, 22 nt, Yersinia pestis
accacuagcagagcacgcagag

SEQ ID NO: 2256438 - RNA, 17 nt, Yersinia pestis
accacuaguuaaaacca

SEQ ID NO: 2256439 - RNA, 16 nt, Yersinia pestis
accacgauuagccaua

SEQ ID NO: 2256440 - RNA, 19 nt, Yersinia pestis
accacgcauuccaucagcc

SEQ ID NO: 2256441 - RNA, 14 nt, Yersinia pestis
accaccuccacagg

SEQ ID NO: 2256442 - RNA, 15 nt, Yersinia pestis
accaccuaauacagc

SEQ ID NO: 2256443 - RNA, 20 nt, Yersinia pestis
accaccuaauacagcaccac

SEQ ID NO: 2256444 - RNA, 22 nt, Yersinia pestis
accaccuaauacagcaccaccg

SEQ ID NO: 2256445 - RNA, 15 nt, Yersinia pestis
accaccuacaaccua

SEQ ID NO: 2256446 - RNA, 23 nt, Yersinia pestis
accaccuacaaccuaccaccuac

SEQ ID NO: 2256447 - RNA, 14 nt, Yersinia pestis
accaccuaccaccu

SEQ ID NO: 2256448 - RNA, 16 nt, Yersinia pestis
accaccuaccaccuac

SEQ ID NO: 2256449 - RNA, 21 nt, Yersinia pestis
accaccuaccaccuaccaccu

SEQ ID NO: 2256450 - RNA, 16 nt, Yersinia pestis
accaccgucaagacaa

SEQ ID NO: 2256451 - RNA, 11 nt, Yersinia pestis
accacccacgu

SEQ ID NO: 2256452 - RNA, 18 nt, Yersinia pestis
accacaucaaccugauca

SEQ ID NO: 2256453 - RNA, 21 nt, Yersinia pestis
accagcgucaaaccauuuuac

SEQ ID NO: 2256454 - RNA, 20 nt, Yersinia pestis
accagccgauaauccaccug

SEQ ID NO: 2256455 - RNA, 17 nt, Yersinia pestis
accagcaaagccucuac

SEQ ID NO: 2256456 - RNA, 11 nt, Yersinia pestis
accagcaagcc

SEQ ID NO: 2256457 - RNA, 16 nt, Yersinia pestis
accagcacauaaagcg

SEQ ID NO: 2256458 - RNA, 20 nt, Yersinia pestis
acccguuauaccucaagcug

SEQ ID NO: 2256459 - RNA, 14 nt, Yersinia pestis
acccguuauauuuc

SEQ ID NO: 2256460 - RNA, 13 nt, Yersinia pestis
acccuaauaccaa

SEQ ID NO: 2256461 - RNA, 17 nt, Yersinia pestis
acccguugcauuuuucu

SEQ ID NO: 2256462 - RNA, 20 nt, Yersinia pestis
acccuaauaccaacagcagg

SEQ ID NO: 2256463 - RNA, 23 nt, Yersinia pestis
acccuaucugcucuugcucagua

SEQ ID NO: 2256464 - RNA, 19 nt, Yersinia pestis
acccucaacucaaaacaau

SEQ ID NO: 2256465 - RNA, 17 nt, Yersinia pestis
acccucauguaagccaa

SEQ ID NO: 2256466 - RNA, 16 nt, Yersinia pestis
acccuccgacuuugau

SEQ ID NO: 2256467 - RNA, 22 nt, Yersinia pestis
acccuuguuuaucuucuacuua

SEQ ID NO: 2256468 - RNA, 23 nt, Yersinia pestis
acccuugagguuauugacaaagu

SEQ ID NO: 2256469 - RNA, 15 nt, Yersinia pestis
acccuucucuuuauc

SEQ ID NO: 2256470 - RNA, 16 nt, Yersinia pestis
acccuucaucuuucaa

SEQ ID NO: 2256471 - RNA, 21 nt, Yersinia pestis
acccucugucggcaagcgaua

SEQ ID NO: 2256472 - RNA, 21 nt, Yersinia pestis
acccucucuuuccagcaaaag

SEQ ID NO: 2256473 - RNA, 16 nt, Yersinia pestis
acccugcuacaggcga

SEQ ID NO: 2256474 - RNA, 21 nt, Yersinia pestis
acccuuuuugaguaaauucgg

SEQ ID NO: 2256475 - RNA, 20 nt, Yersinia pestis
acccuuuugaauucaccaaa

SEQ ID NO: 2256476 - RNA, 14 nt, Yersinia pestis
accgaaauuagaag

SEQ ID NO: 2256477 - RNA, 23 nt, Yersinia pestis
accgaaauauucgucucaucaau

SEQ ID NO: 2256478 - RNA, 18 nt, Yersinia pestis
accgacgauaaucaggcu

SEQ ID NO: 2256479 - RNA, 20 nt, Yersinia pestis
accgagcgucaagccaaccc

SEQ ID NO: 2256480 - RNA, 17 nt, Yersinia pestis
accgagcgugaagagcg

SEQ ID NO: 2256481 - RNA, 21 nt, Yersinia pestis
accgacgguucccaugacgau

SEQ ID NO: 2256482 - RNA, 14 nt, Yersinia pestis
accgcuaaggccaa

SEQ ID NO: 2256483 - RNA, 14 nt, Yersinia pestis
accgcucaguauuc

SEQ ID NO: 2256484 - RNA, 21 nt, Yersinia pestis
accgcuaugcuaaaaaacagc

SEQ ID NO: 2256485 - RNA, 20 nt, Yersinia pestis
accgcguaaaauuagagcaa

SEQ ID NO: 2256486 - RNA, 14 nt, Yersinia pestis
accggacaaaccag

SEQ ID NO: 2256487 - RNA, 21 nt, Yersinia pestis
accgcuuugaugccuaauaau

SEQ ID NO: 2256488 - RNA, 14 nt, Yersinia pestis
accgcgaucacaau

SEQ ID NO: 2256489 - RNA, 15 nt, Yersinia pestis
accgccggcaacagc

SEQ ID NO: 2256490 - RNA, 19 nt, Yersinia pestis
accgccggcaacagcgccu

SEQ ID NO: 2256491 - RNA, 22 nt, Yersinia pestis
accgaggcucgacgggaacgac

SEQ ID NO: 2256492 - RNA, 19 nt, Yersinia pestis
accgauauugauagccaca

SEQ ID NO: 2256493 - RNA, 21 nt, Yersinia pestis
accgcaauaucaaugaaaaaa

SEQ ID NO: 2256494 - RNA, 17 nt, Yersinia pestis
accgcagauaaaagaaa

SEQ ID NO: 2256495 - RNA, 18 nt, Yersinia pestis
accgcaaccuguugugga

SEQ ID NO: 2256496 - RNA, 20 nt, Yersinia pestis
accgcagucgauaaacauca

SEQ ID NO: 2256497 - RNA, 22 nt, Yersinia pestis
accgcccgacuugcugaaucaa

SEQ ID NO: 2256498 - RNA, 17 nt, Yersinia pestis
acccgauacaggcucug

SEQ ID NO: 2256499 - RNA, 18 nt, Yersinia pestis
acccgaugagcguauucg

SEQ ID NO: 2256500 - RNA, 15 nt, Yersinia pestis
acccgaccagacaac

SEQ ID NO: 2256501 - RNA, 22 nt, Yersinia pestis
acccgaaucacugacugaugua

SEQ ID NO: 2256502 - RNA, 13 nt, Yersinia pestis
acccgaaucacuu

SEQ ID NO: 2256503 - RNA, 14 nt, Yersinia pestis
acccgcacgcccau

SEQ ID NO: 2256504 - RNA, 13 nt, Yersinia pestis
acccgauuucacg

SEQ ID NO: 2256505 - RNA, 17 nt, Yersinia pestis
acccgauuuccacgaaa

SEQ ID NO: 2256506 - RNA, 13 nt, Yersinia pestis
acccauuugcaca

SEQ ID NO: 2256507 - RNA, 20 nt, Yersinia pestis
acccauuuccccuuucuggu

SEQ ID NO: 2256508 - RNA, 18 nt, Yersinia pestis
acccgcucugucagcccu

SEQ ID NO: 2256509 - RNA, 15 nt, Yersinia pestis
acccggcaucaacca

SEQ ID NO: 2256510 - RNA, 18 nt, Yersinia pestis
acccggugacccgugcgg

SEQ ID NO: 2256511 - RNA, 17 nt, Yersinia pestis
acccguacgaauuuuuc

SEQ ID NO: 2256512 - RNA, 12 nt, Yersinia pestis
accaucaauaua

SEQ ID NO: 2256513 - RNA, 18 nt, Yersinia pestis
accaucaauauaagagaa

SEQ ID NO: 2256514 - RNA, 21 nt, Yersinia pestis
accagcuugggugaagacacu

SEQ ID NO: 2256515 - RNA, 14 nt, Yersinia pestis
accagcuuggguga

SEQ ID NO: 2256516 - RNA, 14 nt, Yersinia pestis
accaugagaaugcg

SEQ ID NO: 2256517 - RNA, 21 nt, Yersinia pestis
accaugagugaaaauauguag

SEQ ID NO: 2256518 - RNA, 13 nt, Yersinia pestis
accaugaugacaa

SEQ ID NO: 2256519 - RNA, 15 nt, Yersinia pestis
accaugaugacaaug

SEQ ID NO: 2256520 - RNA, 16 nt, Yersinia pestis
accaucugaugcaggu

SEQ ID NO: 2256521 - RNA, 15 nt, Yersinia pestis
accaucugcuuaguu

SEQ ID NO: 2256522 - RNA, 23 nt, Yersinia pestis
accauccggguuuaucccauuaa

SEQ ID NO: 2256523 - RNA, 14 nt, Yersinia pestis
accaucgacgccag

SEQ ID NO: 2256524 - RNA, 14 nt, Yersinia pestis
acccaccugaaucu

SEQ ID NO: 2256525 - RNA, 22 nt, Yersinia pestis
acccagcuucuuuuaaagaaga

SEQ ID NO: 2256526 - RNA, 18 nt, Yersinia pestis
acccauacgaucagcaag

SEQ ID NO: 2256527 - RNA, 15 nt, Yersinia pestis
acccauaccaaccau

SEQ ID NO: 2256528 - RNA, 20 nt, Yersinia pestis
acccauauuacucacacagc

SEQ ID NO: 2256529 - RNA, 18 nt, Yersinia pestis
acccauauuacucacaca

SEQ ID NO: 2256530 - RNA, 23 nt, Yersinia pestis
acccauaaguccuuaaaaaucca

SEQ ID NO: 2256531 - RNA, 17 nt, Yersinia pestis
acccaaaccaacaauau

SEQ ID NO: 2256532 - RNA, 16 nt, Yersinia pestis
accauuugcccuggag

SEQ ID NO: 2256533 - RNA, 23 nt, Yersinia pestis
acccaaaguggugagcugaucug

SEQ ID NO: 2256534 - RNA, 17 nt, Yersinia pestis
accauuuauauaacagc

SEQ ID NO: 2256535 - RNA, 16 nt, Yersinia pestis
accauuuauugccacg

SEQ ID NO: 2256536 - RNA, 15 nt, Yersinia pestis
accauuuccaggcua

SEQ ID NO: 2256537 - RNA, 19 nt, Yersinia pestis
accauuuuauugccagagg

SEQ ID NO: 2256538 - RNA, 18 nt, Yersinia pestis
accauuuuagcuggcagu

SEQ ID NO: 2256539 - RNA, 14 nt, Yersinia pestis
accauuugcccugg

SEQ ID NO: 2256540 - RNA, 13 nt, Yersinia pestis
accauuaacaaua

SEQ ID NO: 2256541 - RNA, 17 nt, Yersinia pestis
accauuaacaauauuau

SEQ ID NO: 2256542 - RNA, 18 nt, Yersinia pestis
accauuaacaauauuaua

SEQ ID NO: 2256543 - RNA, 22 nt, Yersinia pestis
accauuaacaauguuauauuuc

SEQ ID NO: 2256544 - RNA, 23 nt, Yersinia pestis
accauuaagccggauuuaguugg

SEQ ID NO: 2256545 - RNA, 17 nt, Yersinia pestis
accaugccaucagaaua

SEQ ID NO: 2256546 - RNA, 20 nt, Yersinia pestis
accaugccaucaauguucgg

SEQ ID NO: 2256547 - RNA, 22 nt, Yersinia pestis
acgucauugguguuacagcaag

SEQ ID NO: 2256548 - RNA, 15 nt, Yersinia pestis
acgucaccuuucuug

SEQ ID NO: 2256549 - RNA, 14 nt, Yersinia pestis
acgucaucgaagag

SEQ ID NO: 2256550 - RNA, 20 nt, Yersinia pestis
acgucaucgccacacgcauu

SEQ ID NO: 2256551 - RNA, 21 nt, Yersinia pestis
acguauugguaacgcagaaau

SEQ ID NO: 2256552 - RNA, 13 nt, Yersinia pestis
acguauggcauga

SEQ ID NO: 2256553 - RNA, 14 nt, Yersinia pestis
acguauauuggccu

SEQ ID NO: 2256554 - RNA, 20 nt, Yersinia pestis
acgucacccaaccgaccaaa

SEQ ID NO: 2256555 - RNA, 17 nt, Yersinia pestis
acgucaccgccaaaaua

SEQ ID NO: 2256556 - RNA, 21 nt, Yersinia pestis
acgggaucgagaguugcucac

SEQ ID NO: 2256557 - RNA, 14 nt, Yersinia pestis
acgggcaaccugua

SEQ ID NO: 2256558 - RNA, 13 nt, Yersinia pestis
acgggaugcaauc

SEQ ID NO: 2256559 - RNA, 17 nt, Yersinia pestis
acguagccucaauuuug

SEQ ID NO: 2256560 - RNA, 15 nt, Yersinia pestis
acguagcgauaacag

SEQ ID NO: 2256561 - RNA, 13 nt, Yersinia pestis
acgugaucaucuu

SEQ ID NO: 2256562 - RNA, 14 nt, Yersinia pestis
acgugaucaucuuu

SEQ ID NO: 2256563 - RNA, 23 nt, Yersinia pestis
acgugaucgccgcuaauuuuccc

SEQ ID NO: 2256564 - RNA, 23 nt, Yersinia pestis
acgugaugaugcuagugauaaac

SEQ ID NO: 2256565 - RNA, 19 nt, Yersinia pestis
acguggagccugugcagcc

SEQ ID NO: 2256566 - RNA, 20 nt, Yersinia pestis
acgugaaagcacgauaaaug

SEQ ID NO: 2256567 - RNA, 17 nt, Yersinia pestis
acguucagcacugcuuu

SEQ ID NO: 2256568 - RNA, 12 nt, Yersinia pestis
acguucagcagc

SEQ ID NO: 2256569 - RNA, 16 nt, Yersinia pestis
acguucaggcuuucga

SEQ ID NO: 2256570 - RNA, 12 nt, Yersinia pestis
acguuaacugca

SEQ ID NO: 2256571 - RNA, 19 nt, Yersinia pestis
acguguuggcuaagcaugc

SEQ ID NO: 2256572 - RNA, 19 nt, Yersinia pestis
acuacgguguuuggugaag

SEQ ID NO: 2256573 - RNA, 13 nt, Yersinia pestis
acuagcaucaccc

SEQ ID NO: 2256574 - RNA, 20 nt, Yersinia pestis
acuagagcguuacacaucag

SEQ ID NO: 2256575 - RNA, 13 nt, Yersinia pestis
acuauaggcuauu

SEQ ID NO: 2256576 - RNA, 18 nt, Yersinia pestis
acuaacgaaucccacacu

SEQ ID NO: 2256577 - RNA, 22 nt, Yersinia pestis
acuaacaucagcgauucauuga

SEQ ID NO: 2256578 - RNA, 23 nt, Yersinia pestis
acuaacgauugacggaaaauuaa

SEQ ID NO: 2256579 - RNA, 15 nt, Yersinia pestis
acuaacgucccauuc

SEQ ID NO: 2256580 - RNA, 22 nt, Yersinia pestis
acuaacguuuuguaaucaacac

SEQ ID NO: 2256581 - RNA, 21 nt, Yersinia pestis
acuaauaauaauuaaucuuaa

SEQ ID NO: 2256582 - RNA, 12 nt, Yersinia pestis
acguugaguaau

SEQ ID NO: 2256583 - RNA, 15 nt, Yersinia pestis
acguugcacccugcu

SEQ ID NO: 2256584 - RNA, 17 nt, Yersinia pestis
acuaaauuagaaaacaa

SEQ ID NO: 2256585 - RNA, 18 nt, Yersinia pestis
acuaaauuagaaaacaag

SEQ ID NO: 2256586 - RNA, 15 nt, Yersinia pestis
acuaaauuagaaaac

SEQ ID NO: 2256587 - RNA, 21 nt, Yersinia pestis
acuaaauccuuguaaggugcu

SEQ ID NO: 2256588 - RNA, 16 nt, Yersinia pestis
acuaaccucugcaaug

SEQ ID NO: 2256589 - RNA, 16 nt, Yersinia pestis
acuaacagaauauuga

SEQ ID NO: 2256590 - RNA, 13 nt, Yersinia pestis
acucccuguuacg

SEQ ID NO: 2256591 - RNA, 17 nt, Yersinia pestis
acucccguccugagcug

SEQ ID NO: 2256592 - RNA, 18 nt, Yersinia pestis
acucccauucgcgcccca

SEQ ID NO: 2256593 - RNA, 18 nt, Yersinia pestis
acuccccgucagcaucau

SEQ ID NO: 2256594 - RNA, 14 nt, Yersinia pestis
acuccccuggcagg

SEQ ID NO: 2256595 - RNA, 13 nt, Yersinia pestis
acuccccuggcgg

SEQ ID NO: 2256596 - RNA, 22 nt, Yersinia pestis
acucgcaauaccaaugucuuau

SEQ ID NO: 2256597 - RNA, 13 nt, Yersinia pestis
acucucaagccca

SEQ ID NO: 2256598 - RNA, 20 nt, Yersinia pestis
acucguucucaaccaaauag

SEQ ID NO: 2256599 - RNA, 16 nt, Yersinia pestis
acucguuuuacauuga

SEQ ID NO: 2256600 - RNA, 19 nt, Yersinia pestis
acucggucgccaaggaugc

SEQ ID NO: 2256601 - RNA, 15 nt, Yersinia pestis
acucguauaaaaaau

SEQ ID NO: 2256602 - RNA, 19 nt, Yersinia pestis
acucggcucaccugcggga

SEQ ID NO: 2256603 - RNA, 15 nt, Yersinia pestis
acucgggucagugaa

SEQ ID NO: 2256604 - RNA, 18 nt, Yersinia pestis
acucgguacaaucucugg

SEQ ID NO: 2256605 - RNA, 15 nt, Yersinia pestis
acugaagcaucaaua

SEQ ID NO: 2256606 - RNA, 12 nt, Yersinia pestis
acugaaguuauu

SEQ ID NO: 2256607 - RNA, 17 nt, Yersinia pestis
acugaaucccagaaccu

SEQ ID NO: 2256608 - RNA, 22 nt, Yersinia pestis
acugaauggaucacaucacagu

SEQ ID NO: 2256609 - RNA, 18 nt, Yersinia pestis
acugaacgauaaauugcu

SEQ ID NO: 2256610 - RNA, 23 nt, Yersinia pestis
acugaagaauucaguaucaccag

SEQ ID NO: 2256611 - RNA, 14 nt, Yersinia pestis
acugaacaaugcca

SEQ ID NO: 2256612 - RNA, 14 nt, Yersinia pestis
acugacaacaucaa

SEQ ID NO: 2256613 - RNA, 16 nt, Yersinia pestis
acugacaacaucaaau

SEQ ID NO: 2256614 - RNA, 19 nt, Yersinia pestis
acugacaacaucaaaugaa

SEQ ID NO: 2256615 - RNA, 22 nt, Yersinia pestis
acugaaugcacgauaccaccac

SEQ ID NO: 2256616 - RNA, 13 nt, Yersinia pestis
acugaaugugaag

SEQ ID NO: 2256617 - RNA, 17 nt, Yersinia pestis
acugaaugugaagagcg

SEQ ID NO: 2256618 - RNA, 14 nt, Yersinia pestis
acugacaucaucac

SEQ ID NO: 2256619 - RNA, 17 nt, Yersinia pestis
acugaccauaaaaggau

SEQ ID NO: 2256620 - RNA, 20 nt, Yersinia pestis
acucuuucaucccauaugcu

SEQ ID NO: 2256621 - RNA, 16 nt, Yersinia pestis
acucuucggccuauca

SEQ ID NO: 2256622 - RNA, 19 nt, Yersinia pestis
acucuucggccuaucauca

SEQ ID NO: 2256623 - RNA, 19 nt, Yersinia pestis
acucuucugccuacacuca

SEQ ID NO: 2256624 - RNA, 19 nt, Yersinia pestis
acucuucuuuacugcccuc

SEQ ID NO: 2256625 - RNA, 13 nt, Yersinia pestis
acucuucagccua

SEQ ID NO: 2256626 - RNA, 22 nt, Yersinia pestis
acucucccuuuuccaucacccc

SEQ ID NO: 2256627 - RNA, 21 nt, Yersinia pestis
acucuucagccuauccucacc

SEQ ID NO: 2256628 - RNA, 21 nt, Yersinia pestis
acuccacauuuuggccuucau

SEQ ID NO: 2256629 - RNA, 15 nt, Yersinia pestis
acucauauuguccaa

SEQ ID NO: 2256630 - RNA, 19 nt, Yersinia pestis
acucauauuguccaaagga

SEQ ID NO: 2256631 - RNA, 19 nt, Yersinia pestis
acucaugccggucugcugg

SEQ ID NO: 2256632 - RNA, 21 nt, Yersinia pestis
acucaugcucuucauaagcca

SEQ ID NO: 2256633 - RNA, 22 nt, Yersinia pestis
acucauguccagggcaaucagg

SEQ ID NO: 2256634 - RNA, 15 nt, Yersinia pestis
acucauuauggauaa

SEQ ID NO: 2256635 - RNA, 14 nt, Yersinia pestis
acucacaacccgcu

SEQ ID NO: 2256636 - RNA, 12 nt, Yersinia pestis
acucacacagcc

SEQ ID NO: 2256637 - RNA, 18 nt, Yersinia pestis
acucaccccacuuuccac

SEQ ID NO: 2256638 - RNA, 18 nt, Yersinia pestis
acucaccuaaaucauaca

SEQ ID NO: 2256639 - RNA, 16 nt, Yersinia pestis
acucaguucagccccc

SEQ ID NO: 2256640 - RNA, 14 nt, Yersinia pestis
acucagccaaucca

SEQ ID NO: 2256641 - RNA, 17 nt, Yersinia pestis
acucagccaauccagca

SEQ ID NO: 2256642 - RNA, 16 nt, Yersinia pestis
acucagcuugguaaug

SEQ ID NO: 2256643 - RNA, 23 nt, Yersinia pestis
acucagcuugguaaugcgcacca

SEQ ID NO: 2256644 - RNA, 12 nt, Yersinia pestis
acucacugaaua

SEQ ID NO: 2256645 - RNA, 16 nt, Yersinia pestis
acucagaugaaaaacu

SEQ ID NO: 2256646 - RNA, 21 nt, Yersinia pestis
acucagcauccuccugaucuu

SEQ ID NO: 2256647 - RNA, 12 nt, Yersinia pestis
acucagaucacc

SEQ ID NO: 2256648 - RNA, 14 nt, Yersinia pestis
acucagaaaacagc

SEQ ID NO: 2256649 - RNA, 22 nt, Yersinia pestis
acucagaaaacagccaccagcc

SEQ ID NO: 2256650 - RNA, 20 nt, Yersinia pestis
acucacgguuucuaaaaaau

SEQ ID NO: 2256651 - RNA, 22 nt, Yersinia pestis
acucacguaccaaaucagcaag

SEQ ID NO: 2256652 - RNA, 16 nt, Yersinia pestis
acucacuacauucuga

SEQ ID NO: 2256653 - RNA, 23 nt, Yersinia pestis
acgcauucauaucguccaaaggg

SEQ ID NO: 2256654 - RNA, 17 nt, Yersinia pestis
acgcauucaucagggca

SEQ ID NO: 2256655 - RNA, 17 nt, Yersinia pestis
acgcauuccaucagcca

SEQ ID NO: 2256656 - RNA, 18 nt, Yersinia pestis
acgcaucgaccacccgua

SEQ ID NO: 2256657 - RNA, 15 nt, Yersinia pestis
acgcaucaauaauaa

SEQ ID NO: 2256658 - RNA, 16 nt, Yersinia pestis
acgcaucacgcccggc

SEQ ID NO: 2256659 - RNA, 16 nt, Yersinia pestis
acgcaucacaucuugc

SEQ ID NO: 2256660 - RNA, 14 nt, Yersinia pestis
acgccaauucacgc

SEQ ID NO: 2256661 - RNA, 21 nt, Yersinia pestis
acgccauuuaccgcaauauca

SEQ ID NO: 2256662 - RNA, 17 nt, Yersinia pestis
acgccauucauuuauca

SEQ ID NO: 2256663 - RNA, 15 nt, Yersinia pestis
acgcagauaaaucag

SEQ ID NO: 2256664 - RNA, 21 nt, Yersinia pestis
acgcagcaggcguagcgugug

SEQ ID NO: 2256665 - RNA, 14 nt, Yersinia pestis
acgcagcgaaaugu

SEQ ID NO: 2256666 - RNA, 16 nt, Yersinia pestis
acgcacucgaaucacu

SEQ ID NO: 2256667 - RNA, 21 nt, Yersinia pestis
acgcagaacuagcgccgcauc

SEQ ID NO: 2256668 - RNA, 17 nt, Yersinia pestis
acgcacucgaaucacuu

SEQ ID NO: 2256669 - RNA, 23 nt, Yersinia pestis
acgcacugagagcauaaccccaa

SEQ ID NO: 2256670 - RNA, 15 nt, Yersinia pestis
acgcaccauccagca

SEQ ID NO: 2256671 - RNA, 21 nt, Yersinia pestis
accggauaacguuucagggug

SEQ ID NO: 2256672 - RNA, 15 nt, Yersinia pestis
accggauaaaacaau

SEQ ID NO: 2256673 - RNA, 16 nt, Yersinia pestis
accggagcaagggcgc

SEQ ID NO: 2256674 - RNA, 17 nt, Yersinia pestis
accggagcaagggcgca

SEQ ID NO: 2256675 - RNA, 18 nt, Yersinia pestis
acgccuuggcguuucuga

SEQ ID NO: 2256676 - RNA, 14 nt, Yersinia pestis
acgccuucauguug

SEQ ID NO: 2256677 - RNA, 22 nt, Yersinia pestis
acgccucguuuaacucaaauaa

SEQ ID NO: 2256678 - RNA, 16 nt, Yersinia pestis
acgccggcuucccugu

SEQ ID NO: 2256679 - RNA, 17 nt, Yersinia pestis
acgccguggugaaaaau

SEQ ID NO: 2256680 - RNA, 13 nt, Yersinia pestis
acgccuauccuca

SEQ ID NO: 2256681 - RNA, 17 nt, Yersinia pestis
acgccucaucuucacga

SEQ ID NO: 2256682 - RNA, 16 nt, Yersinia pestis
acgccguaaauacauc

SEQ ID NO: 2256683 - RNA, 22 nt, Yersinia pestis
acgcccgcagcggcuagcagca

SEQ ID NO: 2256684 - RNA, 21 nt, Yersinia pestis
acgcccagcuuuagcauugca

SEQ ID NO: 2256685 - RNA, 13 nt, Yersinia pestis
acgccccgccccu

SEQ ID NO: 2256686 - RNA, 22 nt, Yersinia pestis
acgccgaggugaagacacccgu

SEQ ID NO: 2256687 - RNA, 15 nt, Yersinia pestis
acgccgaucauaaau

SEQ ID NO: 2256688 - RNA, 14 nt, Yersinia pestis
acgccgacaauacu

SEQ ID NO: 2256689 - RNA, 16 nt, Yersinia pestis
acgccgacaauacugc

SEQ ID NO: 2256690 - RNA, 22 nt, Yersinia pestis
acgcgccuccaguuuuccagag

SEQ ID NO: 2256691 - RNA, 14 nt, Yersinia pestis
acgcgcuagcuuca

SEQ ID NO: 2256692 - RNA, 14 nt, Yersinia pestis
acgcgggauauaag

SEQ ID NO: 2256693 - RNA, 18 nt, Yersinia pestis
acgcggcuuuuaucuucc

SEQ ID NO: 2256694 - RNA, 15 nt, Yersinia pestis
acgcuccacacccgc

SEQ ID NO: 2256695 - RNA, 21 nt, Yersinia pestis
acgcucccuccgccagcaagu

SEQ ID NO: 2256696 - RNA, 21 nt, Yersinia pestis
acgcuccuggcgauccaguga

SEQ ID NO: 2256697 - RNA, 12 nt, Yersinia pestis
acgcuaauuaaa

SEQ ID NO: 2256698 - RNA, 21 nt, Yersinia pestis
acgcuaauuauuuuauuuaaa

SEQ ID NO: 2256699 - RNA, 20 nt, Yersinia pestis
acgcuaccaugagugaaaau

SEQ ID NO: 2256700 - RNA, 16 nt, Yersinia pestis
acgcuauauagacgaa

SEQ ID NO: 2256701 - RNA, 15 nt, Yersinia pestis
acgcuaucaacuuug

SEQ ID NO: 2256702 - RNA, 15 nt, Yersinia pestis
acgcucaaacaaugu

SEQ ID NO: 2256703 - RNA, 13 nt, Yersinia pestis
acgcguuugcuug

SEQ ID NO: 2256704 - RNA, 18 nt, Yersinia pestis
acgcguugcccuucuuca

SEQ ID NO: 2256705 - RNA, 13 nt, Yersinia pestis
acgcguagagccu

SEQ ID NO: 2256706 - RNA, 15 nt, Yersinia pestis
acgcgucacuggcca

SEQ ID NO: 2256707 - RNA, 18 nt, Yersinia pestis
acggcuucucgaccaccg

SEQ ID NO: 2256708 - RNA, 19 nt, Yersinia pestis
acggcuuuucgcucagacu

SEQ ID NO: 2256709 - RNA, 15 nt, Yersinia pestis
acggcuuaucaaucu

SEQ ID NO: 2256710 - RNA, 23 nt, Yersinia pestis
acggcgucuuuacgaucugccug

SEQ ID NO: 2256711 - RNA, 14 nt, Yersinia pestis
acggcgucuuuacg

SEQ ID NO: 2256712 - RNA, 17 nt, Yersinia pestis
acggcucuauuucauga

SEQ ID NO: 2256713 - RNA, 17 nt, Yersinia pestis
acggcucaucacaccgc

SEQ ID NO: 2256714 - RNA, 13 nt, Yersinia pestis
acggcucacacac

SEQ ID NO: 2256715 - RNA, 16 nt, Yersinia pestis
acggcagugaucgcac

SEQ ID NO: 2256716 - RNA, 21 nt, Yersinia pestis
acggcagugaucgcacuucaa

SEQ ID NO: 2256717 - RNA, 19 nt, Yersinia pestis
acggcagcgagcacugccc

SEQ ID NO: 2256718 - RNA, 16 nt, Yersinia pestis
acggcagcgagcacug

SEQ ID NO: 2256719 - RNA, 15 nt, Yersinia pestis
acggacgugaauaug

SEQ ID NO: 2256720 - RNA, 13 nt, Yersinia pestis
acggagaagagga

SEQ ID NO: 2256721 - RNA, 23 nt, Yersinia pestis
acgcuuucagggaguaacuugac

SEQ ID NO: 2256722 - RNA, 17 nt, Yersinia pestis
acggauagcgcuucagu

SEQ ID NO: 2256723 - RNA, 18 nt, Yersinia pestis
acggauacccgagaauac

SEQ ID NO: 2256724 - RNA, 16 nt, Yersinia pestis
acggcaccuuuuuugu

SEQ ID NO: 2256725 - RNA, 17 nt, Yersinia pestis
acggcacguuuccccuu

SEQ ID NO: 2256726 - RNA, 14 nt, Yersinia pestis
acggcagcaacgaa

SEQ ID NO: 2256727 - RNA, 16 nt, Yersinia pestis
acgcugauacauuucc

SEQ ID NO: 2256728 - RNA, 13 nt, Yersinia pestis
acgcugauuaaac

SEQ ID NO: 2256729 - RNA, 16 nt, Yersinia pestis
acgcuuuacuccucug

SEQ ID NO: 2256730 - RNA, 15 nt, Yersinia pestis
agaauaaacgagaau

SEQ ID NO: 2256731 - RNA, 17 nt, Yersinia pestis
agaaguugaauuugacg

SEQ ID NO: 2256732 - RNA, 18 nt, Yersinia pestis
agaaguucuaaauaaaau

SEQ ID NO: 2256733 - RNA, 13 nt, Yersinia pestis
agaauaaaaauga

SEQ ID NO: 2256734 - RNA, 18 nt, Yersinia pestis
agaauaaugcuaaaugag

SEQ ID NO: 2256735 - RNA, 23 nt, Yersinia pestis
agaauaauccccacggccagagc

SEQ ID NO: 2256736 - RNA, 14 nt, Yersinia pestis
agaauaaucacagg

SEQ ID NO: 2256737 - RNA, 23 nt, Yersinia pestis
agaauauaaaagcacagacaaac

SEQ ID NO: 2256738 - RNA, 20 nt, Yersinia pestis
agaaugcaaccaguuaaaga

SEQ ID NO: 2256739 - RNA, 16 nt, Yersinia pestis
agaauguguaguugaa

SEQ ID NO: 2256740 - RNA, 15 nt, Yersinia pestis
agaauguuaaacccc

SEQ ID NO: 2256741 - RNA, 16 nt, Yersinia pestis
agaaugcgaagaaaaa

SEQ ID NO: 2256742 - RNA, 18 nt, Yersinia pestis
agaauccacauaaaaaga

SEQ ID NO: 2256743 - RNA, 22 nt, Yersinia pestis
agaauccaacccguacucugac

SEQ ID NO: 2256744 - RNA, 14 nt, Yersinia pestis
agaaucaguagguu

SEQ ID NO: 2256745 - RNA, 19 nt, Yersinia pestis
agaaucacugucaaaaagc

SEQ ID NO: 2256746 - RNA, 22 nt, Yersinia pestis
agaaauucaacuugccugaaau

SEQ ID NO: 2256747 - RNA, 23 nt, Yersinia pestis
agaaauucauaccuuaauuaacu

SEQ ID NO: 2256748 - RNA, 18 nt, Yersinia pestis
agaaaugcucaucaagua

SEQ ID NO: 2256749 - RNA, 14 nt, Yersinia pestis
agaaaugaauauua

SEQ ID NO: 2256750 - RNA, 21 nt, Yersinia pestis
agaaggauugaccaauaaaau

SEQ ID NO: 2256751 - RNA, 15 nt, Yersinia pestis
agaaggauugaccaa

SEQ ID NO: 2256752 - RNA, 16 nt, Yersinia pestis
agaagcgcacaucggu

SEQ ID NO: 2256753 - RNA, 22 nt, Yersinia pestis
agaagccucaugaaugaggcug

SEQ ID NO: 2256754 - RNA, 15 nt, Yersinia pestis
agaagccucaugaau

SEQ ID NO: 2256755 - RNA, 20 nt, Yersinia pestis
agaagcccugaguuaaguaa

SEQ ID NO: 2256756 - RNA, 22 nt, Yersinia pestis
agaagccauuagccccaaaugc

SEQ ID NO: 2256757 - RNA, 17 nt, Yersinia pestis
agaaggccaguaguaaa

SEQ ID NO: 2256758 - RNA, 18 nt, Yersinia pestis
agaagugagaagugaaaa

SEQ ID NO: 2256759 - RNA, 20 nt, Yersinia pestis
agaagugagaagugaaaaac

SEQ ID NO: 2256760 - RNA, 11 nt, Yersinia pestis
agaagugaaaa

SEQ ID NO: 2256761 - RNA, 18 nt, Yersinia pestis
agaagggcggccagcaag

SEQ ID NO: 2256762 - RNA, 23 nt, Yersinia pestis
agaagggcggccagcaagagcag

SEQ ID NO: 2256763 - RNA, 16 nt, Yersinia pestis
agaaguucagaccagc

SEQ ID NO: 2256764 - RNA, 22 nt, Yersinia pestis
agaccgcguuaauaccuuguuc

SEQ ID NO: 2256765 - RNA, 19 nt, Yersinia pestis
agacauguuguucuuguuu

SEQ ID NO: 2256766 - RNA, 22 nt, Yersinia pestis
agacaugggcagugcacaguca

SEQ ID NO: 2256767 - RNA, 15 nt, Yersinia pestis
agaccaagcauuuua

SEQ ID NO: 2256768 - RNA, 15 nt, Yersinia pestis
agaccacagauaaau

SEQ ID NO: 2256769 - RNA, 16 nt, Yersinia pestis
agaccccugcgauaau

SEQ ID NO: 2256770 - RNA, 23 nt, Yersinia pestis
agaccccugcgauaaucuccauc

SEQ ID NO: 2256771 - RNA, 13 nt, Yersinia pestis
agacccgauuuca

SEQ ID NO: 2256772 - RNA, 15 nt, Yersinia pestis
agacccuaauaucau

SEQ ID NO: 2256773 - RNA, 21 nt, Yersinia pestis
agacccuaauaucauguucuu

SEQ ID NO: 2256774 - RNA, 17 nt, Yersinia pestis
agacaguaaauccugau

SEQ ID NO: 2256775 - RNA, 22 nt, Yersinia pestis
agacagcaguuaaugcuuaaga

SEQ ID NO: 2256776 - RNA, 19 nt, Yersinia pestis
agacaguaaauccugauga

SEQ ID NO: 2256777 - RNA, 16 nt, Yersinia pestis
agacaguaacuaaagc

SEQ ID NO: 2256778 - RNA, 14 nt, Yersinia pestis
agacaucuuuacca

SEQ ID NO: 2256779 - RNA, 16 nt, Yersinia pestis
agacaucgccagauuc

SEQ ID NO: 2256780 - RNA, 21 nt, Yersinia pestis
agacaaugcggccuuugcuca

SEQ ID NO: 2256781 - RNA, 23 nt, Yersinia pestis
agaauuuuuuuagauaucagaaa

SEQ ID NO: 2256782 - RNA, 21 nt, Yersinia pestis
agacuuacgcgaugccaacaa

SEQ ID NO: 2256783 - RNA, 21 nt, Yersinia pestis
agacuggcgauauggcacagg

SEQ ID NO: 2256784 - RNA, 16 nt, Yersinia pestis
agacugcucuuucccu

SEQ ID NO: 2256785 - RNA, 15 nt, Yersinia pestis
agacucugcuaccag

SEQ ID NO: 2256786 - RNA, 16 nt, Yersinia pestis
agacugacgcagagcu

SEQ ID NO: 2256787 - RNA, 22 nt, Yersinia pestis
agacugaaguuuaccgcaugaa

SEQ ID NO: 2256788 - RNA, 15 nt, Yersinia pestis
agacuccaaauuagc

SEQ ID NO: 2256789 - RNA, 19 nt, Yersinia pestis
agacucgcuaacucaauaa

SEQ ID NO: 2256790 - RNA, 15 nt, Yersinia pestis
agacucaguaaauau

SEQ ID NO: 2256791 - RNA, 16 nt, Yersinia pestis
agacgccguaaauaca

SEQ ID NO: 2256792 - RNA, 16 nt, Yersinia pestis
agacgcgcuagcuuca

SEQ ID NO: 2256793 - RNA, 14 nt, Yersinia pestis
agagaaauaaccca

SEQ ID NO: 2256794 - RNA, 16 nt, Yersinia pestis
agagaaaugcucauca

SEQ ID NO: 2256795 - RNA, 22 nt, Yersinia pestis
agagaaaagcagacuugaacuu

SEQ ID NO: 2256796 - RNA, 19 nt, Yersinia pestis
agacuuggguaaccaauca

SEQ ID NO: 2256797 - RNA, 19 nt, Yersinia pestis
agacuucgguauggcgcuu

SEQ ID NO: 2256798 - RNA, 23 nt, Yersinia pestis
agacuucuaaaucacgcagcagg

SEQ ID NO: 2256799 - RNA, 14 nt, Yersinia pestis
agacuucgccguuc

SEQ ID NO: 2256800 - RNA, 12 nt, Yersinia pestis
agacuuuuccaa

SEQ ID NO: 2256801 - RNA, 20 nt, Yersinia pestis
agagacaaaaauagaaggcc

SEQ ID NO: 2256802 - RNA, 15 nt, Yersinia pestis
agagaacaggcagau

SEQ ID NO: 2256803 - RNA, 18 nt, Yersinia pestis
agagaaccauuauuaccu

SEQ ID NO: 2256804 - RNA, 23 nt, Yersinia pestis
agagaacccuuguuuaucuucua

SEQ ID NO: 2256805 - RNA, 17 nt, Yersinia pestis
agagccgcuauaaccuu

SEQ ID NO: 2256806 - RNA, 16 nt, Yersinia pestis
agagcagugcagcaaa

SEQ ID NO: 2256807 - RNA, 16 nt, Yersinia pestis
agagcagaaagcagca

SEQ ID NO: 2256808 - RNA, 21 nt, Yersinia pestis
agagacuauucucgaaaaaga

SEQ ID NO: 2256809 - RNA, 22 nt, Yersinia pestis
agagacuauucucgaaaaagag

SEQ ID NO: 2256810 - RNA, 21 nt, Yersinia pestis
agaggccagcuucccugcaua

SEQ ID NO: 2256811 - RNA, 23 nt, Yersinia pestis
agagcggaugauucgccauucug

SEQ ID NO: 2256812 - RNA, 22 nt, Yersinia pestis
agagcgucccugauggggcaau

SEQ ID NO: 2256813 - RNA, 20 nt, Yersinia pestis
agagcgguuuauauuuuugg

SEQ ID NO: 2256814 - RNA, 13 nt, Yersinia pestis
agaggaaagagag

SEQ ID NO: 2256815 - RNA, 15 nt, Yersinia pestis
agaguacguaacgaa

SEQ ID NO: 2256816 - RNA, 17 nt, Yersinia pestis
agaguggcggccaguga

SEQ ID NO: 2256817 - RNA, 15 nt, Yersinia pestis
agagguuauugacaa

SEQ ID NO: 2256818 - RNA, 19 nt, Yersinia pestis
agagguuauugacaaagag

SEQ ID NO: 2256819 - RNA, 14 nt, Yersinia pestis
agagguuaaauugu

SEQ ID NO: 2256820 - RNA, 22 nt, Yersinia pestis
agagggccccgauuaaggagcc

SEQ ID NO: 2256821 - RNA, 15 nt, Yersinia pestis
agagguuguugacaa

SEQ ID NO: 2256822 - RNA, 17 nt, Yersinia pestis
agaguaaggccaauugg

SEQ ID NO: 2256823 - RNA, 17 nt, Yersinia pestis
agauaacgcaaaacgcc

SEQ ID NO: 2256824 - RNA, 23 nt, Yersinia pestis
agauaacgcaaaacgcccuugcc

SEQ ID NO: 2256825 - RNA, 15 nt, Yersinia pestis
agauaacaacaaaga

SEQ ID NO: 2256826 - RNA, 12 nt, Yersinia pestis
agauaacaacaa

SEQ ID NO: 2256827 - RNA, 22 nt, Yersinia pestis
agauaaacaaggcagaaguaug

SEQ ID NO: 2256828 - RNA, 20 nt, Yersinia pestis
agauaaagcuugaucacaau

SEQ ID NO: 2256829 - RNA, 17 nt, Yersinia pestis
agauaaauaaaauaaua

SEQ ID NO: 2256830 - RNA, 15 nt, Yersinia pestis
agaaagaaaaauaga

SEQ ID NO: 2256831 - RNA, 20 nt, Yersinia pestis
agaaacaucuucauuuggcu

SEQ ID NO: 2256832 - RNA, 18 nt, Yersinia pestis
agaaacauccuaaaaagc

SEQ ID NO: 2256833 - RNA, 21 nt, Yersinia pestis
agaaaccagcggcagcgccug

SEQ ID NO: 2256834 - RNA, 15 nt, Yersinia pestis
agaaacuucauuuca

SEQ ID NO: 2256835 - RNA, 20 nt, Yersinia pestis
agaaaguugauccuggguuu

SEQ ID NO: 2256836 - RNA, 17 nt, Yersinia pestis
agaaauaaguugaacca

SEQ ID NO: 2256837 - RNA, 22 nt, Yersinia pestis
agaaauaccugaguuaccuugu

SEQ ID NO: 2256838 - RNA, 16 nt, Yersinia pestis
agaaauaauaucaagu

SEQ ID NO: 2256839 - RNA, 15 nt, Yersinia pestis
agaaauaaucauauc

SEQ ID NO: 2256840 - RNA, 14 nt, Yersinia pestis
agaaauaauaucaa

SEQ ID NO: 2256841 - RNA, 19 nt, Yersinia pestis
agaaauaaguugaaccaua

SEQ ID NO: 2256842 - RNA, 13 nt, Yersinia pestis
agaaauagcacca

SEQ ID NO: 2256843 - RNA, 21 nt, Yersinia pestis
agaaaucgccccuuuuuuguu

SEQ ID NO: 2256844 - RNA, 14 nt, Yersinia pestis
agaaaucaucagca

SEQ ID NO: 2256845 - RNA, 19 nt, Yersinia pestis
agaaaaccuugacucuuca

SEQ ID NO: 2256846 - RNA, 20 nt, Yersinia pestis
agaaaaccuucagcaaagag

SEQ ID NO: 2256847 - RNA, 18 nt, Yersinia pestis
agaaaaaauaaauauccu

SEQ ID NO: 2256848 - RNA, 21 nt, Yersinia pestis
acuuuucaucgcauaggccaa

SEQ ID NO: 2256849 - RNA, 14 nt, Yersinia pestis
acuuuuauuauaua

SEQ ID NO: 2256850 - RNA, 15 nt, Yersinia pestis
agaaaaacacuggca

SEQ ID NO: 2256851 - RNA, 17 nt, Yersinia pestis
agaaaaacacuggcagc

SEQ ID NO: 2256852 - RNA, 22 nt, Yersinia pestis
agaaaacaguuacuccuacacc

SEQ ID NO: 2256853 - RNA, 18 nt, Yersinia pestis
agaaaaccuucagcaaag

SEQ ID NO: 2256854 - RNA, 19 nt, Yersinia pestis
agaaaaccuucagcaaaga

SEQ ID NO: 2256855 - RNA, 22 nt, Yersinia pestis
acuuucgauagucagcuucacu

SEQ ID NO: 2256856 - RNA, 13 nt, Yersinia pestis
acuuuccuuccuc

SEQ ID NO: 2256857 - RNA, 16 nt, Yersinia pestis
acuuuccccagaugaa

SEQ ID NO: 2256858 - RNA, 19 nt, Yersinia pestis
acuuugucaauaaccucag

SEQ ID NO: 2256859 - RNA, 22 nt, Yersinia pestis
acuuugucacccgucaggaugc

SEQ ID NO: 2256860 - RNA, 22 nt, Yersinia pestis
acuuugucaauaaccucagccu

SEQ ID NO: 2256861 - RNA, 16 nt, Yersinia pestis
acuuuuauauccgcca

SEQ ID NO: 2256862 - RNA, 19 nt, Yersinia pestis
acuuuuacugguucauuuu

SEQ ID NO: 2256863 - RNA, 20 nt, Yersinia pestis
acuuuggcaaagucaucaaa

SEQ ID NO: 2256864 - RNA, 17 nt, Yersinia pestis
acuuugcgcuuuuuaau

SEQ ID NO: 2256865 - RNA, 18 nt, Yersinia pestis
acuuugaugccaaggccg

SEQ ID NO: 2256866 - RNA, 22 nt, Yersinia pestis
acuuugauucaaaaugccaguc

SEQ ID NO: 2256867 - RNA, 13 nt, Yersinia pestis
acuuuccacaaca

SEQ ID NO: 2256868 - RNA, 17 nt, Yersinia pestis
acuuucaugccuugaaa

SEQ ID NO: 2256869 - RNA, 17 nt, Yersinia pestis
acuuuauuuaaaauuaa

SEQ ID NO: 2256870 - RNA, 15 nt, Yersinia pestis
acuuuaucugccaaa

SEQ ID NO: 2256871 - RNA, 22 nt, Yersinia pestis
acuuuaucugccaaauauugca

SEQ ID NO: 2256872 - RNA, 22 nt, Yersinia pestis
acuuuauucacagcagaacaaa

SEQ ID NO: 2256873 - RNA, 19 nt, Yersinia pestis
acuuuauugacuguaaaua

SEQ ID NO: 2256874 - RNA, 16 nt, Yersinia pestis
acuuuauugagaauca

SEQ ID NO: 2256875 - RNA, 13 nt, Yersinia pestis
acuuuacucuuca

SEQ ID NO: 2256876 - RNA, 13 nt, Yersinia pestis
acuuuacuuuaau

SEQ ID NO: 2256877 - RNA, 14 nt, Yersinia pestis
acuuguucauccug

SEQ ID NO: 2256878 - RNA, 18 nt, Yersinia pestis
acuuguucauccuguacc

SEQ ID NO: 2256879 - RNA, 21 nt, Yersinia pestis
acuuguuguugaccucaaaau

SEQ ID NO: 2256880 - RNA, 22 nt, Yersinia pestis
acuuguuguugaccucaaaaua

SEQ ID NO: 2256881 - RNA, 16 nt, Yersinia pestis
acuuuacauauaggaa

SEQ ID NO: 2256882 - RNA, 14 nt, Yersinia pestis
acuuuaauuaaaaa

SEQ ID NO: 2256883 - RNA, 16 nt, Yersinia pestis
acuuuaccgauuucag

SEQ ID NO: 2256884 - RNA, 15 nt, Yersinia pestis
acuuauuauaaagcu

SEQ ID NO: 2256885 - RNA, 20 nt, Yersinia pestis
acuuauucccacuuauuaua

SEQ ID NO: 2256886 - RNA, 20 nt, Yersinia pestis
acuuauuacaccuuaaaaca

SEQ ID NO: 2256887 - RNA, 15 nt, Yersinia pestis
acuuauggguuuuua

SEQ ID NO: 2256888 - RNA, 14 nt, Yersinia pestis
acuuauggguuuuu

SEQ ID NO: 2256889 - RNA, 19 nt, Yersinia pestis
acuuacaggcugccugccu

SEQ ID NO: 2256890 - RNA, 20 nt, Yersinia pestis
acuuacaggcugccugccug

SEQ ID NO: 2256891 - RNA, 18 nt, Yersinia pestis
acuuaccuugauccgcca

SEQ ID NO: 2256892 - RNA, 16 nt, Yersinia pestis
acuuacgagcuaaugc

SEQ ID NO: 2256893 - RNA, 15 nt, Yersinia pestis
acuuacgguaagcac

SEQ ID NO: 2256894 - RNA, 13 nt, Yersinia pestis
acuucauuuucuc

SEQ ID NO: 2256895 - RNA, 14 nt, Yersinia pestis
acuucauuuucucg

SEQ ID NO: 2256896 - RNA, 14 nt, Yersinia pestis
acuucauuuuucuc

SEQ ID NO: 2256897 - RNA, 17 nt, Yersinia pestis
acuucaucuuuuuuaau

SEQ ID NO: 2256898 - RNA, 21 nt, Yersinia pestis
acuucauaauucagcaaacuc

SEQ ID NO: 2256899 - RNA, 12 nt, Yersinia pestis
acuuauuugaaa

SEQ ID NO: 2256900 - RNA, 16 nt, Yersinia pestis
acuuauuugaaacacu

SEQ ID NO: 2256901 - RNA, 14 nt, Yersinia pestis
acuuauuugaaaua

SEQ ID NO: 2256902 - RNA, 16 nt, Yersinia pestis
acuuauuggaaguacu

SEQ ID NO: 2256903 - RNA, 16 nt, Yersinia pestis
acuuauugauuauaug

SEQ ID NO: 2256904 - RNA, 15 nt, Yersinia pestis
acuucaaaucgccaa

SEQ ID NO: 2256905 - RNA, 16 nt, Yersinia pestis
acuucaagcagcaugu

SEQ ID NO: 2256906 - RNA, 15 nt, Yersinia pestis
acuuaauuucaguca

SEQ ID NO: 2256907 - RNA, 16 nt, Yersinia pestis
acuuaauuccaugcaa

SEQ ID NO: 2256908 - RNA, 17 nt, Yersinia pestis
acuuaauggucuucuuu

SEQ ID NO: 2256909 - RNA, 17 nt, Yersinia pestis
acuguugcaaccagcaa

SEQ ID NO: 2256910 - RNA, 19 nt, Yersinia pestis
acugugggacugaucaagu

SEQ ID NO: 2256911 - RNA, 15 nt, Yersinia pestis
acugugcuuuucuua

SEQ ID NO: 2256912 - RNA, 14 nt, Yersinia pestis
acugugcugaauug

SEQ ID NO: 2256913 - RNA, 15 nt, Yersinia pestis
acuguaguaaagcag

SEQ ID NO: 2256914 - RNA, 20 nt, Yersinia pestis
acugacgauuguccaggcua

SEQ ID NO: 2256915 - RNA, 23 nt, Yersinia pestis
acugucaccuagauaaucaagua

SEQ ID NO: 2256916 - RNA, 14 nt, Yersinia pestis
acugucaaaauccg

SEQ ID NO: 2256917 - RNA, 13 nt, Yersinia pestis
acugucauugcug

SEQ ID NO: 2256918 - RNA, 14 nt, Yersinia pestis
acugucauugcugu

SEQ ID NO: 2256919 - RNA, 18 nt, Yersinia pestis
acugucauugcuguuguu

SEQ ID NO: 2256920 - RNA, 13 nt, Yersinia pestis
acugucauuuccu

SEQ ID NO: 2256921 - RNA, 14 nt, Yersinia pestis
acugucaaaaagca

SEQ ID NO: 2256922 - RNA, 12 nt, Yersinia pestis
acuguaucaaua

SEQ ID NO: 2256923 - RNA, 16 nt, Yersinia pestis
acuguaucaauaccuu

SEQ ID NO: 2256924 - RNA, 15 nt, Yersinia pestis
acuucuuucacuaau

SEQ ID NO: 2256925 - RNA, 14 nt, Yersinia pestis
acuucuuauuaauc

SEQ ID NO: 2256926 - RNA, 18 nt, Yersinia pestis
acuucugcgaccugaucc

SEQ ID NO: 2256927 - RNA, 18 nt, Yersinia pestis
acuucguagggcacuuuc

SEQ ID NO: 2256928 - RNA, 19 nt, Yersinia pestis
acuuccagcguauguuccu

SEQ ID NO: 2256929 - RNA, 16 nt, Yersinia pestis
acuuccauaaacggaa

SEQ ID NO: 2256930 - RNA, 12 nt, Yersinia pestis
acuuccagcacc

SEQ ID NO: 2256931 - RNA, 21 nt, Yersinia pestis
acuuccaauaagucacuuucc

SEQ ID NO: 2256932 - RNA, 15 nt, Yersinia pestis
acuuccaauuucuca

SEQ ID NO: 2256933 - RNA, 14 nt, Yersinia pestis
acuuccacggccag

SEQ ID NO: 2256934 - RNA, 18 nt, Yersinia pestis
acuuccacggccagccug

SEQ ID NO: 2256935 - RNA, 19 nt, Yersinia pestis
acuugccacaacugaaugu

SEQ ID NO: 2256936 - RNA, 15 nt, Yersinia pestis
acuugcccugagugu

SEQ ID NO: 2256937 - RNA, 18 nt, Yersinia pestis
acuugccguaaaauuuaa

SEQ ID NO: 2256938 - RNA, 13 nt, Yersinia pestis
acuugccguggcu

SEQ ID NO: 2256939 - RNA, 22 nt, Yersinia pestis
acuugcaauucauguugccaau

SEQ ID NO: 2256940 - RNA, 15 nt, Yersinia pestis
acuugagagaaacuu

SEQ ID NO: 2256941 - RNA, 14 nt, Yersinia pestis
acuugagucagcac

SEQ ID NO: 2256942 - RNA, 19 nt, Yersinia pestis
acuuguagguuaaauucac

SEQ ID NO: 2256943 - RNA, 18 nt, Yersinia pestis
acuuguaccugugccagu

SEQ ID NO: 2256944 - RNA, 16 nt, Yersinia pestis
acuuggcuuuuucuuc

SEQ ID NO: 2256945 - RNA, 22 nt, Yersinia pestis
acuuggauacguucaacgaccu

SEQ ID NO: 2256946 - RNA, 20 nt, Yersinia pestis
acuugcuggaggcuggcagg

SEQ ID NO: 2256947 - RNA, 16 nt, Yersinia pestis
acuugcucuugagugu

SEQ ID NO: 2256948 - RNA, 12 nt, Yersinia pestis
agccagauaaaa

SEQ ID NO: 2256949 - RNA, 17 nt, Yersinia pestis
agccagccuuaacugca

SEQ ID NO: 2256950 - RNA, 13 nt, Yersinia pestis
agccagccuuaac

SEQ ID NO: 2256951 - RNA, 20 nt, Yersinia pestis
agccagccacugggcuaccc

SEQ ID NO: 2256952 - RNA, 15 nt, Yersinia pestis
agccaccgcauucca

SEQ ID NO: 2256953 - RNA, 13 nt, Yersinia pestis
agccagaagccag

SEQ ID NO: 2256954 - RNA, 22 nt, Yersinia pestis
agccacguaauaccacuagcag

SEQ ID NO: 2256955 - RNA, 13 nt, Yersinia pestis
agccacucacaua

SEQ ID NO: 2256956 - RNA, 17 nt, Yersinia pestis
agccacucacauaagaa

SEQ ID NO: 2256957 - RNA, 14 nt, Yersinia pestis
agccauucagcagc

SEQ ID NO: 2256958 - RNA, 15 nt, Yersinia pestis
agccauucagcagca

SEQ ID NO: 2256959 - RNA, 16 nt, Yersinia pestis
agccauguguuuguuu

SEQ ID NO: 2256960 - RNA, 15 nt, Yersinia pestis
agccaugggcugaag

SEQ ID NO: 2256961 - RNA, 23 nt, Yersinia pestis
agccauggcuuuagguugagaau

SEQ ID NO: 2256962 - RNA, 15 nt, Yersinia pestis
agccaugagguuuau

SEQ ID NO: 2256963 - RNA, 15 nt, Yersinia pestis
agccauccaggcaag

SEQ ID NO: 2256964 - RNA, 18 nt, Yersinia pestis
agccauccuucagacugc

SEQ ID NO: 2256965 - RNA, 22 nt, Yersinia pestis
agccaucgacuaauuaaacaag

SEQ ID NO: 2256966 - RNA, 23 nt, Yersinia pestis
agccaucuugggccgacucugca

SEQ ID NO: 2256967 - RNA, 17 nt, Yersinia pestis
agccauacccaaaccaa

SEQ ID NO: 2256968 - RNA, 17 nt, Yersinia pestis
agccauauguugccacc

SEQ ID NO: 2256969 - RNA, 16 nt, Yersinia pestis
agccauauccaaagau

SEQ ID NO: 2256970 - RNA, 16 nt, Yersinia pestis
agccaguuuacgggug

SEQ ID NO: 2256971 - RNA, 18 nt, Yersinia pestis
agccauaaagugcguagg

SEQ ID NO: 2256972 - RNA, 22 nt, Yersinia pestis
agccagugaugcugcacaucaa

SEQ ID NO: 2256973 - RNA, 16 nt, Yersinia pestis
agccaauggccacugc

SEQ ID NO: 2256974 - RNA, 16 nt, Yersinia pestis
agccaaucggccuuaa

SEQ ID NO: 2256975 - RNA, 15 nt, Yersinia pestis
agccaagcuucaauu

SEQ ID NO: 2256976 - RNA, 15 nt, Yersinia pestis
agccaacuuucgguu

SEQ ID NO: 2256977 - RNA, 16 nt, Yersinia pestis
agccaagaucccaagc

SEQ ID NO: 2256978 - RNA, 21 nt, Yersinia pestis
agccacaaguucugccccuga

SEQ ID NO: 2256979 - RNA, 20 nt, Yersinia pestis
agccacacauucagucacuu

SEQ ID NO: 2256980 - RNA, 22 nt, Yersinia pestis
agccaccaccacggccagaauc

SEQ ID NO: 2256981 - RNA, 11 nt, Yersinia pestis
agccaccagau

SEQ ID NO: 2256982 - RNA, 17 nt, Yersinia pestis
agccaccaguuuauuuu

SEQ ID NO: 2256983 - RNA, 20 nt, Yersinia pestis
agccaccccguggcaggccu

SEQ ID NO: 2256984 - RNA, 21 nt, Yersinia pestis
agccaccauggguacgauggg

SEQ ID NO: 2256985 - RNA, 14 nt, Yersinia pestis
agccaccagccaac

SEQ ID NO: 2256986 - RNA, 14 nt, Yersinia pestis
agccaaaauaauca

SEQ ID NO: 2256987 - RNA, 18 nt, Yersinia pestis
agccaaaauaaucaccag

SEQ ID NO: 2256988 - RNA, 21 nt, Yersinia pestis
agccaaacaaaugaacccuuu

SEQ ID NO: 2256989 - RNA, 21 nt, Yersinia pestis
agccaaaaccauuggaaaggg

SEQ ID NO: 2256990 - RNA, 19 nt, Yersinia pestis
agcauuuuucggugaacca

SEQ ID NO: 2256991 - RNA, 22 nt, Yersinia pestis
agccaaauacccuaauucagau

SEQ ID NO: 2256992 - RNA, 15 nt, Yersinia pestis
agccaaauugugagu

SEQ ID NO: 2256993 - RNA, 16 nt, Yersinia pestis
agccaacagcugacua

SEQ ID NO: 2256994 - RNA, 15 nt, Yersinia pestis
agccaacgauaauga

SEQ ID NO: 2256995 - RNA, 19 nt, Yersinia pestis
agcaugcccagccucugga

SEQ ID NO: 2256996 - RNA, 17 nt, Yersinia pestis
agcaugccauccugcca

SEQ ID NO: 2256997 - RNA, 14 nt, Yersinia pestis
agcaugcccagccu

SEQ ID NO: 2256998 - RNA, 15 nt, Yersinia pestis
agcaugcccagccuc

SEQ ID NO: 2256999 - RNA, 15 nt, Yersinia pestis
agcaugaaugaaaua

SEQ ID NO: 2257000 - RNA, 18 nt, Yersinia pestis
agcaugcguaucauuauu

SEQ ID NO: 2257001 - RNA, 22 nt, Yersinia pestis
agcauguuccuguugcuggcca

SEQ ID NO: 2257002 - RNA, 12 nt, Yersinia pestis
agcauucauucg

SEQ ID NO: 2257003 - RNA, 13 nt, Yersinia pestis
agcauuucaggau

SEQ ID NO: 2257004 - RNA, 18 nt, Yersinia pestis
agcaucaguaauuuuuug

SEQ ID NO: 2257005 - RNA, 14 nt, Yersinia pestis
agcaucccagccac

SEQ ID NO: 2257006 - RNA, 15 nt, Yersinia pestis
agcaucccagccacc

SEQ ID NO: 2257007 - RNA, 18 nt, Yersinia pestis
agcauauuacccaguacu

SEQ ID NO: 2257008 - RNA, 17 nt, Yersinia pestis
agcauaucccuguuuuc

SEQ ID NO: 2257009 - RNA, 15 nt, Yersinia pestis
agcaucaaauuauuu

SEQ ID NO: 2257010 - RNA, 19 nt, Yersinia pestis
agcaucaaauuauuuuucc

SEQ ID NO: 2257011 - RNA, 12 nt, Yersinia pestis
agcaucaccaaa

SEQ ID NO: 2257012 - RNA, 14 nt, Yersinia pestis
agcaucacccgccc

SEQ ID NO: 2257013 - RNA, 20 nt, Yersinia pestis
agcaucacgauagccaguga

SEQ ID NO: 2257014 - RNA, 13 nt, Yersinia pestis
agcaucaauaacg

SEQ ID NO: 2257015 - RNA, 14 nt, Yersinia pestis
agcaucuuuucaug

SEQ ID NO: 2257016 - RNA, 23 nt, Yersinia pestis
agcaucgaggauuuuccgcagcu

SEQ ID NO: 2257017 - RNA, 17 nt, Yersinia pestis
agcauccugaacuuccu

SEQ ID NO: 2257018 - RNA, 19 nt, Yersinia pestis
agcaucgccgggucuugca

SEQ ID NO: 2257019 - RNA, 22 nt, Yersinia pestis
agcauagaagaagaauugcaga

SEQ ID NO: 2257020 - RNA, 19 nt, Yersinia pestis
agcauacuguuggcaauuu

SEQ ID NO: 2257021 - RNA, 19 nt, Yersinia pestis
agcauacguugccagccau

SEQ ID NO: 2257022 - RNA, 18 nt, Yersinia pestis
agcauauacagcccggua

SEQ ID NO: 2257023 - RNA, 19 nt, Yersinia pestis
agcauaaauaucagugaca

SEQ ID NO: 2257024 - RNA, 12 nt, Yersinia pestis
agcauaaauauc

SEQ ID NO: 2257025 - RNA, 20 nt, Yersinia pestis
agcaguucuggcucugcgac

SEQ ID NO: 2257026 - RNA, 15 nt, Yersinia pestis
agcagugcagccaag

SEQ ID NO: 2257027 - RNA, 18 nt, Yersinia pestis
agcagugauuucaguguc

SEQ ID NO: 2257028 - RNA, 15 nt, Yersinia pestis
agcagucaaaaugaa

SEQ ID NO: 2257029 - RNA, 16 nt, Yersinia pestis
agcagucaaaaugaaa

SEQ ID NO: 2257030 - RNA, 19 nt, Yersinia pestis
agcaguaacguccaacuga

SEQ ID NO: 2257031 - RNA, 20 nt, Yersinia pestis
agcaguaacguccaacugac

SEQ ID NO: 2257032 - RNA, 18 nt, Yersinia pestis
agcagucugaggcccgcu

SEQ ID NO: 2257033 - RNA, 17 nt, Yersinia pestis
agcagucugagccucau

SEQ ID NO: 2257034 - RNA, 19 nt, Yersinia pestis
agcagucugauuaccuucu

SEQ ID NO: 2257035 - RNA, 17 nt, Yersinia pestis
agcagucugagggccac

SEQ ID NO: 2257036 - RNA, 19 nt, Yersinia pestis
agcagucugagggccacuu

SEQ ID NO: 2257037 - RNA, 17 nt, Yersinia pestis
agcagucugagguggcc

SEQ ID NO: 2257038 - RNA, 15 nt, Yersinia pestis
agcagcauccugaac

SEQ ID NO: 2257039 - RNA, 17 nt, Yersinia pestis
agcagccaacacaccug

SEQ ID NO: 2257040 - RNA, 22 nt, Yersinia pestis
agcagccucuaacauacucaga

SEQ ID NO: 2257041 - RNA, 15 nt, Yersinia pestis
agcagcguggugcgg

SEQ ID NO: 2257042 - RNA, 15 nt, Yersinia pestis
agcagcgcccaacag

SEQ ID NO: 2257043 - RNA, 17 nt, Yersinia pestis
agcaggaaacaugcuga

SEQ ID NO: 2257044 - RNA, 20 nt, Yersinia pestis
agcaguaaacauuuugacuu

SEQ ID NO: 2257045 - RNA, 21 nt, Yersinia pestis
agcagguucggcgcaaucaua

SEQ ID NO: 2257046 - RNA, 14 nt, Yersinia pestis
agcagggucaccac

SEQ ID NO: 2257047 - RNA, 16 nt, Yersinia pestis
agcagggccgcccaga

SEQ ID NO: 2257048 - RNA, 23 nt, Yersinia pestis
agcacaaacauggcggcagcaca

SEQ ID NO: 2257049 - RNA, 12 nt, Yersinia pestis
agcacaaaaaga

SEQ ID NO: 2257050 - RNA, 11 nt, Yersinia pestis
agcacacacag

SEQ ID NO: 2257051 - RNA, 15 nt, Yersinia pestis
agcacacacagccua

SEQ ID NO: 2257052 - RNA, 21 nt, Yersinia pestis
agcacaagcgccugcgacagc

SEQ ID NO: 2257053 - RNA, 21 nt, Yersinia pestis
agcacacucagaugaaaaacu

SEQ ID NO: 2257054 - RNA, 20 nt, Yersinia pestis
agcacagccugccgggauga

SEQ ID NO: 2257055 - RNA, 15 nt, Yersinia pestis
agcacagacaaacaa

SEQ ID NO: 2257056 - RNA, 17 nt, Yersinia pestis
agcaccggauggucacc

SEQ ID NO: 2257057 - RNA, 13 nt, Yersinia pestis
agcaccuaucgcc

SEQ ID NO: 2257058 - RNA, 22 nt, Yersinia pestis
agcaccauuaucuuccauagau

SEQ ID NO: 2257059 - RNA, 22 nt, Yersinia pestis
agcacgaauuuuauucagcaag

SEQ ID NO: 2257060 - RNA, 18 nt, Yersinia pestis
agcacugcgcgaucccag

SEQ ID NO: 2257061 - RNA, 22 nt, Yersinia pestis
agcacugcgcgaucccagaaug

SEQ ID NO: 2257062 - RNA, 17 nt, Yersinia pestis
agcacuaucacaucaaa

SEQ ID NO: 2257063 - RNA, 14 nt, Yersinia pestis
agcacuaagauuca

SEQ ID NO: 2257064 - RNA, 14 nt, Yersinia pestis
agcacguaccgcug

SEQ ID NO: 2257065 - RNA, 19 nt, Yersinia pestis
agcacggcugaacgguagc

SEQ ID NO: 2257066 - RNA, 17 nt, Yersinia pestis
agcagcaagaaacuccc

SEQ ID NO: 2257067 - RNA, 20 nt, Yersinia pestis
agcagcaccaauaucaauau

SEQ ID NO: 2257068 - RNA, 21 nt, Yersinia pestis
agcagcaccaauaucaauauu

SEQ ID NO: 2257069 - RNA, 14 nt, Yersinia pestis
agcagcaacuguuu

SEQ ID NO: 2257070 - RNA, 22 nt, Yersinia pestis
agcagauggucaacuaaacaga

SEQ ID NO: 2257071 - RNA, 14 nt, Yersinia pestis
agcagauaauaaau

SEQ ID NO: 2257072 - RNA, 13 nt, Yersinia pestis
agcagacuugaac

SEQ ID NO: 2257073 - RNA, 14 nt, Yersinia pestis
agcagaaagggcgc

SEQ ID NO: 2257074 - RNA, 12 nt, Yersinia pestis
agcagaacaaaa

SEQ ID NO: 2257075 - RNA, 16 nt, Yersinia pestis
agcagaacaaaacaag

SEQ ID NO: 2257076 - RNA, 19 nt, Yersinia pestis
agcacuuuacgauuucgcu

SEQ ID NO: 2257077 - RNA, 21 nt, Yersinia pestis
agcaaaauccgguaauggcca

SEQ ID NO: 2257078 - RNA, 12 nt, Yersinia pestis
agcaaaagccuc

SEQ ID NO: 2257079 - RNA, 17 nt, Yersinia pestis
agcaaaaaaaaagccug

SEQ ID NO: 2257080 - RNA, 15 nt, Yersinia pestis
agcaaaucaaacaaa

SEQ ID NO: 2257081 - RNA, 15 nt, Yersinia pestis
agcaaaucauuuaau

SEQ ID NO: 2257082 - RNA, 23 nt, Yersinia pestis
agcaaagucccggcuaggaggcc

SEQ ID NO: 2257083 - RNA, 23 nt, Yersinia pestis
agcaaagcgauaucguuaucaac

SEQ ID NO: 2257084 - RNA, 17 nt, Yersinia pestis
agcaaagccaaaaccau

SEQ ID NO: 2257085 - RNA, 12 nt, Yersinia pestis
agcaaaggccac

SEQ ID NO: 2257086 - RNA, 14 nt, Yersinia pestis
agcaaaggcccgcu

SEQ ID NO: 2257087 - RNA, 16 nt, Yersinia pestis
agcaaacgaacgaaua

SEQ ID NO: 2257088 - RNA, 14 nt, Yersinia pestis
agcaaacgaacgaa

SEQ ID NO: 2257089 - RNA, 15 nt, Yersinia pestis
agcaaacgaacgaau

SEQ ID NO: 2257090 - RNA, 20 nt, Yersinia pestis
agcaaacccacaauauauac

SEQ ID NO: 2257091 - RNA, 15 nt, Yersinia pestis
agauuuuaugaauua

SEQ ID NO: 2257092 - RNA, 20 nt, Yersinia pestis
agauuucgguuaauauugaa

SEQ ID NO: 2257093 - RNA, 14 nt, Yersinia pestis
agauuuacccaaag

SEQ ID NO: 2257094 - RNA, 12 nt, Yersinia pestis
agauuuaccaug

SEQ ID NO: 2257095 - RNA, 17 nt, Yersinia pestis
agauuuaaccccaauuc

SEQ ID NO: 2257096 - RNA, 15 nt, Yersinia pestis
agauuuaauugugcu

SEQ ID NO: 2257097 - RNA, 14 nt, Yersinia pestis
agauuucagacugc

SEQ ID NO: 2257098 - RNA, 19 nt, Yersinia pestis
agauuucagacugcugaca

SEQ ID NO: 2257099 - RNA, 13 nt, Yersinia pestis
agauuucacuuuc

SEQ ID NO: 2257100 - RNA, 12 nt, Yersinia pestis
agauaaggccug

SEQ ID NO: 2257101 - RNA, 19 nt, Yersinia pestis
agauaaggggauugcugcc

SEQ ID NO: 2257102 - RNA, 17 nt, Yersinia pestis
agauuguuuauaaauua

SEQ ID NO: 2257103 - RNA, 13 nt, Yersinia pestis
agauuuaaauaac

SEQ ID NO: 2257104 - RNA, 20 nt, Yersinia pestis
agauuguuuuccacauggcu

SEQ ID NO: 2257105 - RNA, 15 nt, Yersinia pestis
agauaauuauccauu

SEQ ID NO: 2257106 - RNA, 20 nt, Yersinia pestis
agauaauuauccauuuucug

SEQ ID NO: 2257107 - RNA, 17 nt, Yersinia pestis
agauaauuuagcaaagc

SEQ ID NO: 2257108 - RNA, 21 nt, Yersinia pestis
agcaaccggauacaaagugaa

SEQ ID NO: 2257109 - RNA, 22 nt, Yersinia pestis
agcaacaugguuaagagauccc

SEQ ID NO: 2257110 - RNA, 19 nt, Yersinia pestis
agcaacacaucuuccagua

SEQ ID NO: 2257111 - RNA, 14 nt, Yersinia pestis
agcaacaauaacuu

SEQ ID NO: 2257112 - RNA, 16 nt, Yersinia pestis
agcaacaaccccauga

SEQ ID NO: 2257113 - RNA, 14 nt, Yersinia pestis
agcaaauugcugaa

SEQ ID NO: 2257114 - RNA, 17 nt, Yersinia pestis
agcaaauucccaccaua

SEQ ID NO: 2257115 - RNA, 21 nt, Yersinia pestis
agcaaauuuaucaguagcuag

SEQ ID NO: 2257116 - RNA, 13 nt, Yersinia pestis
agcaaauuuugca

SEQ ID NO: 2257117 - RNA, 15 nt, Yersinia pestis
agcaacaaacagccg

SEQ ID NO: 2257118 - RNA, 20 nt, Yersinia pestis
agcaacugaaaccgaucacu

SEQ ID NO: 2257119 - RNA, 12 nt, Yersinia pestis
agcaagaaacug

SEQ ID NO: 2257120 - RNA, 22 nt, Yersinia pestis
agcaacgguuuguaucgaugau

SEQ ID NO: 2257121 - RNA, 14 nt, Yersinia pestis
agcaaucuggcggc

SEQ ID NO: 2257122 - RNA, 22 nt, Yersinia pestis
agcaaucgggggaggaagcuga

SEQ ID NO: 2257123 - RNA, 19 nt, Yersinia pestis
agcaauauaauaaucuaua

SEQ ID NO: 2257124 - RNA, 19 nt, Yersinia pestis
agcaauguucaaaucugcu

SEQ ID NO: 2257125 - RNA, 19 nt, Yersinia pestis
agcaaugcaccgacaaaga

SEQ ID NO: 2257126 - RNA, 20 nt, Yersinia pestis
agcaaugcaccgacaaagau

SEQ ID NO: 2257127 - RNA, 12 nt, Yersinia pestis
agcaaguuaacg

SEQ ID NO: 2257128 - RNA, 16 nt, Yersinia pestis
agcaaguuagcgauau

SEQ ID NO: 2257129 - RNA, 14 nt, Yersinia pestis
agcaauaaacucau

SEQ ID NO: 2257130 - RNA, 11 nt, Yersinia pestis
agcaagugaac

SEQ ID NO: 2257131 - RNA, 23 nt, Yersinia pestis
agcaaggauuccccccagucacu

SEQ ID NO: 2257132 - RNA, 20 nt, Yersinia pestis
agcaaggcggcaagcaagca

SEQ ID NO: 2257133 - RNA, 21 nt, Yersinia pestis
agcaagcggcagcgcuggugc

SEQ ID NO: 2257134 - RNA, 19 nt, Yersinia pestis
agcaagccgauaaucaauu

SEQ ID NO: 2257135 - RNA, 23 nt, Yersinia pestis
agcaagauuuuguagcccacuga

SEQ ID NO: 2257136 - RNA, 20 nt, Yersinia pestis
agcaagauuuuguagcccac

SEQ ID NO: 2257137 - RNA, 15 nt, Yersinia pestis
agcuccgcagcuaau

SEQ ID NO: 2257138 - RNA, 19 nt, Yersinia pestis
agcucccccacucgcccca

SEQ ID NO: 2257139 - RNA, 19 nt, Yersinia pestis
agcucauuaauccccgguc

SEQ ID NO: 2257140 - RNA, 15 nt, Yersinia pestis
agcucuggccagauu

SEQ ID NO: 2257141 - RNA, 13 nt, Yersinia pestis
agcugacgcagca

SEQ ID NO: 2257142 - RNA, 20 nt, Yersinia pestis
agcugcugcaagaguccagc

SEQ ID NO: 2257143 - RNA, 16 nt, Yersinia pestis
agcugcugcuuucagu

SEQ ID NO: 2257144 - RNA, 14 nt, Yersinia pestis
agcugauaugaaaa

SEQ ID NO: 2257145 - RNA, 16 nt, Yersinia pestis
agcugauaugaaaaau

SEQ ID NO: 2257146 - RNA, 23 nt, Yersinia pestis
agcuacagcaccauuaucuucca

SEQ ID NO: 2257147 - RNA, 13 nt, Yersinia pestis
agcuacagcucag

SEQ ID NO: 2257148 - RNA, 17 nt, Yersinia pestis
agcuacggccuguacca

SEQ ID NO: 2257149 - RNA, 21 nt, Yersinia pestis
agcuacggccuguaccaccac

SEQ ID NO: 2257150 - RNA, 17 nt, Yersinia pestis
agcuacgccaagagggc

SEQ ID NO: 2257151 - RNA, 13 nt, Yersinia pestis
agcuagccugccc

SEQ ID NO: 2257152 - RNA, 19 nt, Yersinia pestis
agcuagauggaaaucacac

SEQ ID NO: 2257153 - RNA, 22 nt, Yersinia pestis
agcuagaauaaguugaugcagu

SEQ ID NO: 2257154 - RNA, 20 nt, Yersinia pestis
agcuacuaauggagagaugu

SEQ ID NO: 2257155 - RNA, 21 nt, Yersinia pestis
agcguucuucugauucaauuu

SEQ ID NO: 2257156 - RNA, 14 nt, Yersinia pestis
agcguuuacucgcu

SEQ ID NO: 2257157 - RNA, 16 nt, Yersinia pestis
agcguuuaaauacccg

SEQ ID NO: 2257158 - RNA, 14 nt, Yersinia pestis
agcguuggccacgu

SEQ ID NO: 2257159 - RNA, 19 nt, Yersinia pestis
agcgugagaauaauaauca

SEQ ID NO: 2257160 - RNA, 19 nt, Yersinia pestis
agcgugauuuuuauauuuu

SEQ ID NO: 2257161 - RNA, 17 nt, Yersinia pestis
agcgugauuuuuauauu

SEQ ID NO: 2257162 - RNA, 14 nt, Yersinia pestis
agcggcaggggcgc

SEQ ID NO: 2257163 - RNA, 15 nt, Yersinia pestis
agcggcagcgaagaa

SEQ ID NO: 2257164 - RNA, 18 nt, Yersinia pestis
agcggguaauaccgggga

SEQ ID NO: 2257165 - RNA, 15 nt, Yersinia pestis
agcguaauaccacua

SEQ ID NO: 2257166 - RNA, 18 nt, Yersinia pestis
agcgguuucauggcuggg

SEQ ID NO: 2257167 - RNA, 22 nt, Yersinia pestis
agcgguuuuuucuuucuucagc

SEQ ID NO: 2257168 - RNA, 12 nt, Yersinia pestis
agcgucaaccca

SEQ ID NO: 2257169 - RNA, 16 nt, Yersinia pestis
agcgucaacccagaca

SEQ ID NO: 2257170 - RNA, 13 nt, Yersinia pestis
agcgccagcaauu

SEQ ID NO: 2257171 - RNA, 15 nt, Yersinia pestis
agcgcaggauaaagc

SEQ ID NO: 2257172 - RNA, 12 nt, Yersinia pestis
agcgcagguaac

SEQ ID NO: 2257173 - RNA, 22 nt, Yersinia pestis
agcgcagguuaugcagcucaau

SEQ ID NO: 2257174 - RNA, 14 nt, Yersinia pestis
agcgcagugcucau

SEQ ID NO: 2257175 - RNA, 20 nt, Yersinia pestis
agcgcauuugggcaauguug

SEQ ID NO: 2257176 - RNA, 12 nt, Yersinia pestis
agcgauauccuu

SEQ ID NO: 2257177 - RNA, 20 nt, Yersinia pestis
agcgauagaguugauaaaca

SEQ ID NO: 2257178 - RNA, 21 nt, Yersinia pestis
agcgauagaguugauaaacaa

SEQ ID NO: 2257179 - RNA, 18 nt, Yersinia pestis
agcgaucaauacaccaga

SEQ ID NO: 2257180 - RNA, 17 nt, Yersinia pestis
agcgauaucguuaucaa

SEQ ID NO: 2257181 - RNA, 18 nt, Yersinia pestis
agcgauuaaaauaaagcg

SEQ ID NO: 2257182 - RNA, 18 nt, Yersinia pestis
agcgauguucgcuccccc

SEQ ID NO: 2257183 - RNA, 19 nt, Yersinia pestis
agcgcaaugcuccagcaac

SEQ ID NO: 2257184 - RNA, 22 nt, Yersinia pestis
agcgcaaugcuccagcaacuga

SEQ ID NO: 2257185 - RNA, 14 nt, Yersinia pestis
agcggaugauaaau

SEQ ID NO: 2257186 - RNA, 15 nt, Yersinia pestis
agcgcuugcugguau

SEQ ID NO: 2257187 - RNA, 15 nt, Yersinia pestis
agcgcuuggcucugg

SEQ ID NO: 2257188 - RNA, 13 nt, Yersinia pestis
agcgcuaauauua

SEQ ID NO: 2257189 - RNA, 21 nt, Yersinia pestis
agcgcuauguuggcaaauaau

SEQ ID NO: 2257190 - RNA, 15 nt, Yersinia pestis
agcgccuuccuuuua

SEQ ID NO: 2257191 - RNA, 23 nt, Yersinia pestis
agcgccuguuccaacgagugcag

SEQ ID NO: 2257192 - RNA, 18 nt, Yersinia pestis
agcgccuguuguuuuuca

SEQ ID NO: 2257193 - RNA, 21 nt, Yersinia pestis
agcgcguaucguccagcagca

SEQ ID NO: 2257194 - RNA, 13 nt, Yersinia pestis
agcgccugcccuc

SEQ ID NO: 2257195 - RNA, 17 nt, Yersinia pestis
agcgcccgcaguuuauc

SEQ ID NO: 2257196 - RNA, 23 nt, Yersinia pestis
agcgccgauauacaccccaucag

SEQ ID NO: 2257197 - RNA, 23 nt, Yersinia pestis
agcgcccuugccagugcaauccg

SEQ ID NO: 2257198 - RNA, 18 nt, Yersinia pestis
agcgccgacacccagcca

SEQ ID NO: 2257199 - RNA, 16 nt, Yersinia pestis
agcccuucgcaccgcc

SEQ ID NO: 2257200 - RNA, 23 nt, Yersinia pestis
agcccuuuggcaaucacaacccc

SEQ ID NO: 2257201 - RNA, 18 nt, Yersinia pestis
agcccuuugcuuucagga

SEQ ID NO: 2257202 - RNA, 20 nt, Yersinia pestis
agcccuuugaccauuuguuu

SEQ ID NO: 2257203 - RNA, 15 nt, Yersinia pestis
agccgaagcgccccu

SEQ ID NO: 2257204 - RNA, 19 nt, Yersinia pestis
agccgaccauuaagccgga

SEQ ID NO: 2257205 - RNA, 18 nt, Yersinia pestis
agccgauaauccaccuga

SEQ ID NO: 2257206 - RNA, 18 nt, Yersinia pestis
agccgcuuuaaucgccug

SEQ ID NO: 2257207 - RNA, 19 nt, Yersinia pestis
agccgcuuuaaucgccuga

SEQ ID NO: 2257208 - RNA, 17 nt, Yersinia pestis
agccggacucaaaauac

SEQ ID NO: 2257209 - RNA, 21 nt, Yersinia pestis
agccgccagucauucaccugc

SEQ ID NO: 2257210 - RNA, 18 nt, Yersinia pestis
agccgcgccauccuuggc

SEQ ID NO: 2257211 - RNA, 19 nt, Yersinia pestis
agccgcgccauccuuggcg

SEQ ID NO: 2257212 - RNA, 13 nt, Yersinia pestis
agcccauugcugu

SEQ ID NO: 2257213 - RNA, 17 nt, Yersinia pestis
agcccauagccauggcu

SEQ ID NO: 2257214 - RNA, 21 nt, Yersinia pestis
agcccaggcgacgcaguaaga

SEQ ID NO: 2257215 - RNA, 15 nt, Yersinia pestis
agcccaguaaagcaa

SEQ ID NO: 2257216 - RNA, 20 nt, Yersinia pestis
agcccagguuacugcccugg

SEQ ID NO: 2257217 - RNA, 19 nt, Yersinia pestis
agccccacaguacaaaaaa

SEQ ID NO: 2257218 - RNA, 15 nt, Yersinia pestis
agcccccucaauacc

SEQ ID NO: 2257219 - RNA, 19 nt, Yersinia pestis
agcccagauggcaaucugc

SEQ ID NO: 2257220 - RNA, 13 nt, Yersinia pestis
agcccagcguucu

SEQ ID NO: 2257221 - RNA, 16 nt, Yersinia pestis
agccauuucaccaaua

SEQ ID NO: 2257222 - RNA, 13 nt, Yersinia pestis
agcccaacacuuu

SEQ ID NO: 2257223 - RNA, 16 nt, Yersinia pestis
agcccguucggucaca

SEQ ID NO: 2257224 - RNA, 21 nt, Yersinia pestis
agcccgugauaaaucuuauuu

SEQ ID NO: 2257225 - RNA, 21 nt, Yersinia pestis
agcccgguguuaaccgcccca

SEQ ID NO: 2257226 - RNA, 15 nt, Yersinia pestis
agccccuuugaacug

SEQ ID NO: 2257227 - RNA, 16 nt, Yersinia pestis
agccccuaacagcagu

SEQ ID NO: 2257228 - RNA, 20 nt, Yersinia pestis
agccccuaaauccugcaaug

SEQ ID NO: 2257229 - RNA, 18 nt, Yersinia pestis
agcccgauggcaaaggau

SEQ ID NO: 2257230 - RNA, 17 nt, Yersinia pestis
agcgaaagucggugacu

SEQ ID NO: 2257231 - RNA, 21 nt, Yersinia pestis
agccuuuuuugcuuaaaacag

SEQ ID NO: 2257232 - RNA, 22 nt, Yersinia pestis
agccuuuuuugcuuaaaacagg

SEQ ID NO: 2257233 - RNA, 15 nt, Yersinia pestis
agccuucuaauauua

SEQ ID NO: 2257234 - RNA, 14 nt, Yersinia pestis
agccuuaauguuuu

SEQ ID NO: 2257235 - RNA, 21 nt, Yersinia pestis
agccuguuauuuuucuucuuu

SEQ ID NO: 2257236 - RNA, 16 nt, Yersinia pestis
agccuguacauaaauu

SEQ ID NO: 2257237 - RNA, 21 nt, Yersinia pestis
agccugguuuuuuaaaaaagu

SEQ ID NO: 2257238 - RNA, 17 nt, Yersinia pestis
agccugguguaaaaacu

SEQ ID NO: 2257239 - RNA, 15 nt, Yersinia pestis
agccugucuuaggug

SEQ ID NO: 2257240 - RNA, 23 nt, Yersinia pestis
agccuggagcgguuaaucaaacg

SEQ ID NO: 2257241 - RNA, 17 nt, Yersinia pestis
agccuggaagcaaaagc

SEQ ID NO: 2257242 - RNA, 13 nt, Yersinia pestis
agcgaacguaaaa

SEQ ID NO: 2257243 - RNA, 15 nt, Yersinia pestis
agcgaauaaauaauu

SEQ ID NO: 2257244 - RNA, 12 nt, Yersinia pestis
agcgaaggggcg

SEQ ID NO: 2257245 - RNA, 14 nt, Yersinia pestis
agcgacaaccugua

SEQ ID NO: 2257246 - RNA, 23 nt, Yersinia pestis
agcgaauugacuuaacaguuaaa

SEQ ID NO: 2257247 - RNA, 15 nt, Yersinia pestis
agcgaaucacaucau

SEQ ID NO: 2257248 - RNA, 22 nt, Yersinia pestis
agcgacgucccuaaagccaucg

SEQ ID NO: 2257249 - RNA, 18 nt, Yersinia pestis
agcgaccaaauggacgaa

SEQ ID NO: 2257250 - RNA, 12 nt, Yersinia pestis
agcgacgcuaaa

SEQ ID NO: 2257251 - RNA, 16 nt, Yersinia pestis
agcgagcacugccccg

SEQ ID NO: 2257252 - RNA, 20 nt, Yersinia pestis
agccuccaagaugauaaaua

SEQ ID NO: 2257253 - RNA, 15 nt, Yersinia pestis
agccucaugaaugag

SEQ ID NO: 2257254 - RNA, 17 nt, Yersinia pestis
agccucaugaaugaggc

SEQ ID NO: 2257255 - RNA, 15 nt, Yersinia pestis
agccucauucaugag

SEQ ID NO: 2257256 - RNA, 20 nt, Yersinia pestis
agccucauucaugaggcuca

SEQ ID NO: 2257257 - RNA, 19 nt, Yersinia pestis
agccuaacuggcgguuauu

SEQ ID NO: 2257258 - RNA, 17 nt, Yersinia pestis
agccuaacaaacugaau

SEQ ID NO: 2257259 - RNA, 14 nt, Yersinia pestis
agccuacgagagau

SEQ ID NO: 2257260 - RNA, 15 nt, Yersinia pestis
agccuacgagagauc

SEQ ID NO: 2257261 - RNA, 20 nt, Yersinia pestis
agccuacauggauguauuua

SEQ ID NO: 2257262 - RNA, 18 nt, Yersinia pestis
agccuacuacauggaugu

SEQ ID NO: 2257263 - RNA, 19 nt, Yersinia pestis
agccucuuguguaauuaua

SEQ ID NO: 2257264 - RNA, 12 nt, Yersinia pestis
agccugaauucu

SEQ ID NO: 2257265 - RNA, 21 nt, Yersinia pestis
agccucuagcuaacagugacc

SEQ ID NO: 2257266 - RNA, 15 nt, Yersinia pestis
agccucugaucauuc

SEQ ID NO: 2257267 - RNA, 12 nt, Yersinia pestis
agccugauacac

SEQ ID NO: 2257268 - RNA, 17 nt, Yersinia pestis
agccugcacggcucagg

SEQ ID NO: 2257269 - RNA, 18 nt, Yersinia pestis
agccugccauacccgcug

SEQ ID NO: 2257270 - RNA, 13 nt, Yersinia pestis
agccugccgggau

SEQ ID NO: 2257271 - RNA, 23 nt, Yersinia pestis
agccguguaaauguacagucauu

SEQ ID NO: 2257272 - RNA, 18 nt, Yersinia pestis
agccguaauucagauaag

SEQ ID NO: 2257273 - RNA, 18 nt, Yersinia pestis
aguagaauaccucacugg

SEQ ID NO: 2257274 - RNA, 19 nt, Yersinia pestis
aguagaacuggccuuaugc

SEQ ID NO: 2257275 - RNA, 20 nt, Yersinia pestis
aguacucaccgccguauuca

SEQ ID NO: 2257276 - RNA, 23 nt, Yersinia pestis
aguacuggaucacaaugcaaaua

SEQ ID NO: 2257277 - RNA, 16 nt, Yersinia pestis
aguacuuaccuuccca

SEQ ID NO: 2257278 - RNA, 16 nt, Yersinia pestis
aguacuuagcaauaau

SEQ ID NO: 2257279 - RNA, 13 nt, Yersinia pestis
aguacuuccaaua

SEQ ID NO: 2257280 - RNA, 17 nt, Yersinia pestis
agcuggcggauaaaaau

SEQ ID NO: 2257281 - RNA, 21 nt, Yersinia pestis
aguacggugccagcagcaagu

SEQ ID NO: 2257282 - RNA, 22 nt, Yersinia pestis
aguacguaacgaauucagcagc

SEQ ID NO: 2257283 - RNA, 23 nt, Yersinia pestis
aguagcagggccgcccagauaaa

SEQ ID NO: 2257284 - RNA, 11 nt, Yersinia pestis
aguagcccagc

SEQ ID NO: 2257285 - RNA, 15 nt, Yersinia pestis
aguagcuaauaaaau

SEQ ID NO: 2257286 - RNA, 18 nt, Yersinia pestis
aguagcuaauaaaauggc

SEQ ID NO: 2257287 - RNA, 22 nt, Yersinia pestis
aguaggggccaccaaauaaaac

SEQ ID NO: 2257288 - RNA, 14 nt, Yersinia pestis
aguauaaauaccug

SEQ ID NO: 2257289 - RNA, 14 nt, Yersinia pestis
aguauacuaaaaca

SEQ ID NO: 2257290 - RNA, 17 nt, Yersinia pestis
aguauacggucaaaagc

SEQ ID NO: 2257291 - RNA, 19 nt, Yersinia pestis
aguauacggucaaaagcug

SEQ ID NO: 2257292 - RNA, 19 nt, Yersinia pestis
agucacaucgcgcuuuuua

SEQ ID NO: 2257293 - RNA, 14 nt, Yersinia pestis
agucacauuuuuaa

SEQ ID NO: 2257294 - RNA, 20 nt, Yersinia pestis
agucaaucauuuuuuuauua

SEQ ID NO: 2257295 - RNA, 22 nt, Yersinia pestis
agucaaucggaacucagacuuc

SEQ ID NO: 2257296 - RNA, 15 nt, Yersinia pestis
agucaaaaugaaauu

SEQ ID NO: 2257297 - RNA, 14 nt, Yersinia pestis
agucaaaaugaaau

SEQ ID NO: 2257298 - RNA, 19 nt, Yersinia pestis
agucagcaaaucaaacaaa

SEQ ID NO: 2257299 - RNA, 14 nt, Yersinia pestis
agucagcaaaucaa

SEQ ID NO: 2257300 - RNA, 15 nt, Yersinia pestis
agucagcaaaucaaa

SEQ ID NO: 2257301 - RNA, 16 nt, Yersinia pestis
agucagcaaaucaaac

SEQ ID NO: 2257302 - RNA, 16 nt, Yersinia pestis
agucagauugucagac

SEQ ID NO: 2257303 - RNA, 17 nt, Yersinia pestis
agucacuuaaacccuuu

SEQ ID NO: 2257304 - RNA, 13 nt, Yersinia pestis
agucacuggccgc

SEQ ID NO: 2257305 - RNA, 16 nt, Yersinia pestis
agucacgucuucacca

SEQ ID NO: 2257306 - RNA, 16 nt, Yersinia pestis
agucacuuugggcuga

SEQ ID NO: 2257307 - RNA, 12 nt, Yersinia pestis
agucagugcuau

SEQ ID NO: 2257308 - RNA, 13 nt, Yersinia pestis
agucagucagggu

SEQ ID NO: 2257309 - RNA, 18 nt, Yersinia pestis
agucagugauucggguga

SEQ ID NO: 2257310 - RNA, 15 nt, Yersinia pestis
agucagggugaaagc

SEQ ID NO: 2257311 - RNA, 15 nt, Yersinia pestis
agucauacaaaauga

SEQ ID NO: 2257312 - RNA, 16 nt, Yersinia pestis
agucagggaucaccuc

SEQ ID NO: 2257313 - RNA, 19 nt, Yersinia pestis
aguaucugggugagagguu

SEQ ID NO: 2257314 - RNA, 18 nt, Yersinia pestis
aguaucugggugagaggu

SEQ ID NO: 2257315 - RNA, 16 nt, Yersinia pestis
aguaugcgaaacaccu

SEQ ID NO: 2257316 - RNA, 19 nt, Yersinia pestis
aguaugcguggguucuuca

SEQ ID NO: 2257317 - RNA, 17 nt, Yersinia pestis
aguaucagaaacagcag

SEQ ID NO: 2257318 - RNA, 18 nt, Yersinia pestis
aguauccauaaaaucacg

SEQ ID NO: 2257319 - RNA, 13 nt, Yersinia pestis
aguauuuguagug

SEQ ID NO: 2257320 - RNA, 18 nt, Yersinia pestis
aguauucgccagauacaa

SEQ ID NO: 2257321 - RNA, 19 nt, Yersinia pestis
aguauucgccagauacaag

SEQ ID NO: 2257322 - RNA, 18 nt, Yersinia pestis
aguauugcagagcaaaac

SEQ ID NO: 2257323 - RNA, 19 nt, Yersinia pestis
aguauuagccagcagaaac

SEQ ID NO: 2257324 - RNA, 14 nt, Yersinia pestis
aguauuccaauaau

SEQ ID NO: 2257325 - RNA, 17 nt, Yersinia pestis
aguauuccccacuguaa

SEQ ID NO: 2257326 - RNA, 16 nt, Yersinia pestis
aguauguuugauuaag

SEQ ID NO: 2257327 - RNA, 15 nt, Yersinia pestis
aguauguauccaucu

SEQ ID NO: 2257328 - RNA, 20 nt, Yersinia pestis
agucccauugacgaauuaaa

SEQ ID NO: 2257329 - RNA, 23 nt, Yersinia pestis
aguccaagacagaacuuaagaua

SEQ ID NO: 2257330 - RNA, 21 nt, Yersinia pestis
aguccacccagcguuucagua

SEQ ID NO: 2257331 - RNA, 22 nt, Yersinia pestis
aguccacccagcguuucaguaa

SEQ ID NO: 2257332 - RNA, 16 nt, Yersinia pestis
aguccagcacugguag

SEQ ID NO: 2257333 - RNA, 17 nt, Yersinia pestis
aguccaaaaaacugcgg

SEQ ID NO: 2257334 - RNA, 15 nt, Yersinia pestis
agucauucaccugcc

SEQ ID NO: 2257335 - RNA, 18 nt, Yersinia pestis
agucaucgcggguuuuua

SEQ ID NO: 2257336 - RNA, 23 nt, Yersinia pestis
agucaucgccuucuggcaaaccg

SEQ ID NO: 2257337 - RNA, 24 nt, Yersinia pestis
agucauauauuuuucuuucucgau

SEQ ID NO: 2257338 - RNA, 21 nt, Yersinia pestis
agucauauauuuuucuuucuc

SEQ ID NO: 2257339 - RNA, 13 nt, Yersinia pestis
agucauauauuuu

SEQ ID NO: 2257340 - RNA, 18 nt, Yersinia pestis
agucauauauuuuucuuu

SEQ ID NO: 2257341 - RNA, 19 nt, Yersinia pestis
agucauauauuuuucuuuc

SEQ ID NO: 2257342 - RNA, 23 nt, Yersinia pestis
aguccugauucgcgaccagcaga

SEQ ID NO: 2257343 - RNA, 19 nt, Yersinia pestis
agucccugugcgcccacgc

SEQ ID NO: 2257344 - RNA, 18 nt, Yersinia pestis
agucgcacugauagcaau

SEQ ID NO: 2257345 - RNA, 17 nt, Yersinia pestis
agucgauaugagucagu

SEQ ID NO: 2257346 - RNA, 20 nt, Yersinia pestis
agucgaucacggaaaucugc

SEQ ID NO: 2257347 - RNA, 13 nt, Yersinia pestis
agucgcugcuguu

SEQ ID NO: 2257348 - RNA, 16 nt, Yersinia pestis
agucuccaaauucauu

SEQ ID NO: 2257349 - RNA, 15 nt, Yersinia pestis
agucucaucaaggaa

SEQ ID NO: 2257350 - RNA, 14 nt, Yersinia pestis
agucucacaaaaua

SEQ ID NO: 2257351 - RNA, 16 nt, Yersinia pestis
agucuauugaaaaaau

SEQ ID NO: 2257352 - RNA, 14 nt, Yersinia pestis
agugaaaucaucac

SEQ ID NO: 2257353 - RNA, 18 nt, Yersinia pestis
agugaaaucaucacaccu

SEQ ID NO: 2257354 - RNA, 20 nt, Yersinia pestis
agugaaaacguuaacugcag

SEQ ID NO: 2257355 - RNA, 21 nt, Yersinia pestis
agugaaaacguuaacugcagu

SEQ ID NO: 2257356 - RNA, 14 nt, Yersinia pestis
agugaaaaugguuu

SEQ ID NO: 2257357 - RNA, 21 nt, Yersinia pestis
agugaaacccgcgcagccuaa

SEQ ID NO: 2257358 - RNA, 16 nt, Yersinia pestis
agugaaaacguuaacu

SEQ ID NO: 2257359 - RNA, 18 nt, Yersinia pestis
agucucgcagccgccagu

SEQ ID NO: 2257360 - RNA, 19 nt, Yersinia pestis
agugagugaauagauaaca

SEQ ID NO: 2257361 - RNA, 19 nt, Yersinia pestis
agugauaaacuuaucgguu

SEQ ID NO: 2257362 - RNA, 14 nt, Yersinia pestis
agugauaaucacgu

SEQ ID NO: 2257363 - RNA, 16 nt, Yersinia pestis
agugaugcaguaaaua

SEQ ID NO: 2257364 - RNA, 15 nt, Yersinia pestis
agugaugggggcaau

SEQ ID NO: 2257365 - RNA, 20 nt, Yersinia pestis
agugaugggggcaauugauu

SEQ ID NO: 2257366 - RNA, 20 nt, Yersinia pestis
agugaugaaaccaaaaccuu

SEQ ID NO: 2257367 - RNA, 18 nt, Yersinia pestis
agugaucaaugacuucuu

SEQ ID NO: 2257368 - RNA, 17 nt, Yersinia pestis
agugaaguaauaaaaau

SEQ ID NO: 2257369 - RNA, 15 nt, Yersinia pestis
agugaaguaucacca

SEQ ID NO: 2257370 - RNA, 17 nt, Yersinia pestis
agugaacguagccucaa

SEQ ID NO: 2257371 - RNA, 18 nt, Yersinia pestis
agugaaccgcgcucugcu

SEQ ID NO: 2257372 - RNA, 16 nt, Yersinia pestis
agugaacccacgacua

SEQ ID NO: 2257373 - RNA, 18 nt, Yersinia pestis
agugaaugacaguauuug

SEQ ID NO: 2257374 - RNA, 15 nt, Yersinia pestis
agugaauaaaucaaa

SEQ ID NO: 2257375 - RNA, 15 nt, Yersinia pestis
agugaauaacgcuga

SEQ ID NO: 2257376 - RNA, 13 nt, Yersinia pestis
agugaaucagcca

SEQ ID NO: 2257377 - RNA, 16 nt, Yersinia pestis
agugaaucaucaauac

SEQ ID NO: 2257378 - RNA, 23 nt, Yersinia pestis
agugcggccaccuaucuauuuuu

SEQ ID NO: 2257379 - RNA, 18 nt, Yersinia pestis
agugcggcauguacaccg

SEQ ID NO: 2257380 - RNA, 12 nt, Yersinia pestis
agugcggccacc

SEQ ID NO: 2257381 - RNA, 19 nt, Yersinia pestis
agugcggccaucuaacugc

SEQ ID NO: 2257382 - RNA, 13 nt, Yersinia pestis
agugcugccagac

SEQ ID NO: 2257383 - RNA, 22 nt, Yersinia pestis
agugauuucagugucaguucga

SEQ ID NO: 2257384 - RNA, 13 nt, Yersinia pestis
agugauuucagug

SEQ ID NO: 2257385 - RNA, 17 nt, Yersinia pestis
agugcaaacuuaaaaau

SEQ ID NO: 2257386 - RNA, 21 nt, Yersinia pestis
agugcaacauuaaaaauacaa

SEQ ID NO: 2257387 - RNA, 17 nt, Yersinia pestis
agugcaacauuaaaaau

SEQ ID NO: 2257388 - RNA, 16 nt, Yersinia pestis
agugcacggcagugau

SEQ ID NO: 2257389 - RNA, 15 nt, Yersinia pestis
agugccaauccccac

SEQ ID NO: 2257390 - RNA, 17 nt, Yersinia pestis
agugcacagucacucaa

SEQ ID NO: 2257391 - RNA, 17 nt, Yersinia pestis
agugcaauaaauucaaa

SEQ ID NO: 2257392 - RNA, 21 nt, Yersinia pestis
agugcccgcgacggagagaac

SEQ ID NO: 2257393 - RNA, 20 nt, Yersinia pestis
auaacaaguuacauuuuuaa

SEQ ID NO: 2257394 - RNA, 22 nt, Yersinia pestis
auaacaauggccggacucauua

SEQ ID NO: 2257395 - RNA, 17 nt, Yersinia pestis
auaacagccauuuauau

SEQ ID NO: 2257396 - RNA, 23 nt, Yersinia pestis
auaacagcuaaucauugcaaugc

SEQ ID NO: 2257397 - RNA, 12 nt, Yersinia pestis
auaaauuggccg

SEQ ID NO: 2257398 - RNA, 21 nt, Yersinia pestis
auaaauuggccgauagauuuu

SEQ ID NO: 2257399 - RNA, 13 nt, Yersinia pestis
auaaauuuaauaa

SEQ ID NO: 2257400 - RNA, 16 nt, Yersinia pestis
auaaauuuaucgauaa

SEQ ID NO: 2257401 - RNA, 18 nt, Yersinia pestis
auaaccaaucaucacgau

SEQ ID NO: 2257402 - RNA, 17 nt, Yersinia pestis
auaaccaauccaugcca

SEQ ID NO: 2257403 - RNA, 18 nt, Yersinia pestis
auaaccaauccaugccag

SEQ ID NO: 2257404 - RNA, 21 nt, Yersinia pestis
auaaccauaaaauaaauaauu

SEQ ID NO: 2257405 - RNA, 15 nt, Yersinia pestis
auaaccagagucagu

SEQ ID NO: 2257406 - RNA, 14 nt, Yersinia pestis
auaacgccacaaua

SEQ ID NO: 2257407 - RNA, 19 nt, Yersinia pestis
auaacgcaucaugguccag

SEQ ID NO: 2257408 - RNA, 13 nt, Yersinia pestis
auaaccagccaac

SEQ ID NO: 2257409 - RNA, 16 nt, Yersinia pestis
auaaccaucaaauaca

SEQ ID NO: 2257410 - RNA, 14 nt, Yersinia pestis
auaaccuucuucau

SEQ ID NO: 2257411 - RNA, 16 nt, Yersinia pestis
auaaccauuaacaaua

SEQ ID NO: 2257412 - RNA, 18 nt, Yersinia pestis
auaaccugagcaccagaa

SEQ ID NO: 2257413 - RNA, 21 nt, Yersinia pestis
auaaauucgauaaaaggcuau

SEQ ID NO: 2257414 - RNA, 19 nt, Yersinia pestis
auaaauucgggaucaugau

SEQ ID NO: 2257415 - RNA, 23 nt, Yersinia pestis
auaaauuaucugaauagcgcugc

SEQ ID NO: 2257416 - RNA, 14 nt, Yersinia pestis
auaaauucaaaaua

SEQ ID NO: 2257417 - RNA, 22 nt, Yersinia pestis
auaaauucaaaauagaggaaau

SEQ ID NO: 2257418 - RNA, 17 nt, Yersinia pestis
auaaauucaaauaucau

SEQ ID NO: 2257419 - RNA, 17 nt, Yersinia pestis
auaaauggcaacuuaaa

SEQ ID NO: 2257420 - RNA, 15 nt, Yersinia pestis
auaaaucaugucccu

SEQ ID NO: 2257421 - RNA, 18 nt, Yersinia pestis
auaaagacgucauaaaua

SEQ ID NO: 2257422 - RNA, 22 nt, Yersinia pestis
auaaagacgucauaaauauuuu

SEQ ID NO: 2257423 - RNA, 12 nt, Yersinia pestis
auaaauaaaaua

SEQ ID NO: 2257424 - RNA, 14 nt, Yersinia pestis
auaaauaccgccaa

SEQ ID NO: 2257425 - RNA, 21 nt, Yersinia pestis
auaaauacucuugagaaauga

SEQ ID NO: 2257426 - RNA, 23 nt, Yersinia pestis
auaaauagagugaaguaucacca

SEQ ID NO: 2257427 - RNA, 12 nt, Yersinia pestis
auaaaauuaacg

SEQ ID NO: 2257428 - RNA, 20 nt, Yersinia pestis
auaaaauuaacggaaaagag

SEQ ID NO: 2257429 - RNA, 22 nt, Yersinia pestis
auaaaauucguuucucuaaaau

SEQ ID NO: 2257430 - RNA, 19 nt, Yersinia pestis
auaaaaugggccugagugg

SEQ ID NO: 2257431 - RNA, 12 nt, Yersinia pestis
auaaaaucuuaa

SEQ ID NO: 2257432 - RNA, 16 nt, Yersinia pestis
auaaaauccugaauaa

SEQ ID NO: 2257433 - RNA, 20 nt, Yersinia pestis
auaaaauccugaauaauacu

SEQ ID NO: 2257434 - RNA, 16 nt, Yersinia pestis
auaaaaucgaacccuu

SEQ ID NO: 2257435 - RNA, 21 nt, Yersinia pestis
auaaaaucgaacccuucagca

SEQ ID NO: 2257436 - RNA, 22 nt, Yersinia pestis
auaaacgucuuaugccauaaca

SEQ ID NO: 2257437 - RNA, 19 nt, Yersinia pestis
auaaacgcuuuugcugcaa

SEQ ID NO: 2257438 - RNA, 20 nt, Yersinia pestis
auaaacggaacucaucuuuc

SEQ ID NO: 2257439 - RNA, 20 nt, Yersinia pestis
auaaacaccgugcuggguaa

SEQ ID NO: 2257440 - RNA, 20 nt, Yersinia pestis
auaaaauucguuugggcuaa

SEQ ID NO: 2257441 - RNA, 21 nt, Yersinia pestis
auaaaaggauggcccaagcca

SEQ ID NO: 2257442 - RNA, 15 nt, Yersinia pestis
auaaaagaaagggca

SEQ ID NO: 2257443 - RNA, 13 nt, Yersinia pestis
auaaaaguaauuu

SEQ ID NO: 2257444 - RNA, 21 nt, Yersinia pestis
auaaaaguaauuuaucaguag

SEQ ID NO: 2257445 - RNA, 16 nt, Yersinia pestis
auaaaauaauaauggu

SEQ ID NO: 2257446 - RNA, 22 nt, Yersinia pestis
auaaaaauauccagcaacgaau

SEQ ID NO: 2257447 - RNA, 22 nt, Yersinia pestis
auaaaaaugcacugaacaaugc

SEQ ID NO: 2257448 - RNA, 12 nt, Yersinia pestis
auaaaacaauag

SEQ ID NO: 2257449 - RNA, 18 nt, Yersinia pestis
auaaaacagaacccccgc

SEQ ID NO: 2257450 - RNA, 15 nt, Yersinia pestis
auaaaaccacugacc

SEQ ID NO: 2257451 - RNA, 19 nt, Yersinia pestis
auaaaaccacugaccuauu

SEQ ID NO: 2257452 - RNA, 21 nt, Yersinia pestis
auaaaacagcuugauagggcu

SEQ ID NO: 2257453 - RNA, 12 nt, Yersinia pestis
auaaaaccaucu

SEQ ID NO: 2257454 - RNA, 18 nt, Yersinia pestis
auaaaaccgcuuaucccu

SEQ ID NO: 2257455 - RNA, 18 nt, Yersinia pestis
auaaaaccuuuacaauua

SEQ ID NO: 2257456 - RNA, 23 nt, Yersinia pestis
auaaaaccuuuacaauuacacac

SEQ ID NO: 2257457 - RNA, 21 nt, Yersinia pestis
auaaaacuauucugcuuggac

SEQ ID NO: 2257458 - RNA, 19 nt, Yersinia pestis
aguucagcccccucaauac

SEQ ID NO: 2257459 - RNA, 23 nt, Yersinia pestis
aguucacgauggaaaaaauacag

SEQ ID NO: 2257460 - RNA, 22 nt, Yersinia pestis
aguucacucuguuuuaaaaaaa

SEQ ID NO: 2257461 - RNA, 18 nt, Yersinia pestis
aguucacccaacaaugaa

SEQ ID NO: 2257462 - RNA, 14 nt, Yersinia pestis
aguuauccaaacuu

SEQ ID NO: 2257463 - RNA, 16 nt, Yersinia pestis
aguuacacagaauuau

SEQ ID NO: 2257464 - RNA, 23 nt, Yersinia pestis
aguuaauguguuuuugucauuua

SEQ ID NO: 2257465 - RNA, 12 nt, Yersinia pestis
aguuaauguuua

SEQ ID NO: 2257466 - RNA, 23 nt, Yersinia pestis
aguuaauaccagaugcauauacu

SEQ ID NO: 2257467 - RNA, 19 nt, Yersinia pestis
aguuaaugacauaucucau

SEQ ID NO: 2257468 - RNA, 15 nt, Yersinia pestis
aguuaaucgcagcag

SEQ ID NO: 2257469 - RNA, 18 nt, Yersinia pestis
aguuaagguuagcuaugc

SEQ ID NO: 2257470 - RNA, 16 nt, Yersinia pestis
aguuaaguaauaacuc

SEQ ID NO: 2257471 - RNA, 15 nt, Yersinia pestis
aguuaaguagucagc

SEQ ID NO: 2257472 - RNA, 12 nt, Yersinia pestis
aguuaacaccau

SEQ ID NO: 2257473 - RNA, 20 nt, Yersinia pestis
aguuaacccuaccuaggcca

SEQ ID NO: 2257474 - RNA, 20 nt, Yersinia pestis
aguuaacacgaaaagcagca

SEQ ID NO: 2257475 - RNA, 19 nt, Yersinia pestis
aguuaaaucccugugcuga

SEQ ID NO: 2257476 - RNA, 20 nt, Yersinia pestis
aguuaacacgggcaugaacg

SEQ ID NO: 2257477 - RNA, 13 nt, Yersinia pestis
aguuaaaugaagg

SEQ ID NO: 2257478 - RNA, 16 nt, Yersinia pestis
aguggcggccagugau

SEQ ID NO: 2257479 - RNA, 16 nt, Yersinia pestis
aguucauggccaugaa

SEQ ID NO: 2257480 - RNA, 18 nt, Yersinia pestis
aguucauuccccaucgcc

SEQ ID NO: 2257481 - RNA, 11 nt, Yersinia pestis
aguucaucaaa

SEQ ID NO: 2257482 - RNA, 20 nt, Yersinia pestis
aguucuucugauaaaacagu

SEQ ID NO: 2257483 - RNA, 22 nt, Yersinia pestis
aguugggaaucgguuucagcuu

SEQ ID NO: 2257484 - RNA, 14 nt, Yersinia pestis
aguugggcauugga

SEQ ID NO: 2257485 - RNA, 17 nt, Yersinia pestis
aguugagagacaaaaau

SEQ ID NO: 2257486 - RNA, 13 nt, Yersinia pestis
aguugacuuuuuu

SEQ ID NO: 2257487 - RNA, 19 nt, Yersinia pestis
aguugacuuuuuuuaacca

SEQ ID NO: 2257488 - RNA, 16 nt, Yersinia pestis
aguugaguauuucuuu

SEQ ID NO: 2257489 - RNA, 16 nt, Yersinia pestis
aguugaugcaauggca

SEQ ID NO: 2257490 - RNA, 14 nt, Yersinia pestis
aguugauaaagcug

SEQ ID NO: 2257491 - RNA, 17 nt, Yersinia pestis
aguugauaaacaauaaa

SEQ ID NO: 2257492 - RNA, 14 nt, Yersinia pestis
aguuucaaauagua

SEQ ID NO: 2257493 - RNA, 15 nt, Yersinia pestis
aguuuauuuucccuu

SEQ ID NO: 2257494 - RNA, 19 nt, Yersinia pestis
aguugucuguaauaauaau

SEQ ID NO: 2257495 - RNA, 18 nt, Yersinia pestis
aguugucuauuuucauua

SEQ ID NO: 2257496 - RNA, 20 nt, Yersinia pestis
aguugucuauuuucauuauu

SEQ ID NO: 2257497 - RNA, 18 nt, Yersinia pestis
aguuuagcgagaaaguca

SEQ ID NO: 2257498 - RNA, 15 nt, Yersinia pestis
aguuuacgcagugcu

SEQ ID NO: 2257499 - RNA, 16 nt, Yersinia pestis
aguugguggcacaagg

SEQ ID NO: 2257500 - RNA, 21 nt, Yersinia pestis
aguuguaaugaauucagaauc

SEQ ID NO: 2257501 - RNA, 17 nt, Yersinia pestis
aguugucuauuuucauu

SEQ ID NO: 2257502 - RNA, 20 nt, Yersinia pestis
aguuguauuaccgauaaagg

SEQ ID NO: 2257503 - RNA, 22 nt, Yersinia pestis
auaaaaaccccugucuuauuuu

SEQ ID NO: 2257504 - RNA, 12 nt, Yersinia pestis
auaaaaacauug

SEQ ID NO: 2257505 - RNA, 15 nt, Yersinia pestis
auaaaaaagucacuu

SEQ ID NO: 2257506 - RNA, 19 nt, Yersinia pestis
aguuuuauuguauaaaaca

SEQ ID NO: 2257507 - RNA, 22 nt, Yersinia pestis
aguuuucccugcgccagcagca

SEQ ID NO: 2257508 - RNA, 19 nt, Yersinia pestis
aguuuuuccguaaccucca

SEQ ID NO: 2257509 - RNA, 20 nt, Yersinia pestis
aguuuuuccguaaccuccac

SEQ ID NO: 2257510 - RNA, 16 nt, Yersinia pestis
aguuuggcugccaugg

SEQ ID NO: 2257511 - RNA, 20 nt, Yersinia pestis
aguuuggugaucaguucauu

SEQ ID NO: 2257512 - RNA, 19 nt, Yersinia pestis
aguuugccuugugugaaua

SEQ ID NO: 2257513 - RNA, 18 nt, Yersinia pestis
aguuucaauaugcucugc

SEQ ID NO: 2257514 - RNA, 15 nt, Yersinia pestis
aguuucagguuguua

SEQ ID NO: 2257515 - RNA, 20 nt, Yersinia pestis
auagaagguaaucagacugc

SEQ ID NO: 2257516 - RNA, 21 nt, Yersinia pestis
auagaagguaaucagacugcu

SEQ ID NO: 2257517 - RNA, 18 nt, Yersinia pestis
auagaaggcggagaaugu

SEQ ID NO: 2257518 - RNA, 15 nt, Yersinia pestis
auagaagcucauaug

SEQ ID NO: 2257519 - RNA, 15 nt, Yersinia pestis
auagaaucugcugca

SEQ ID NO: 2257520 - RNA, 16 nt, Yersinia pestis
auagaacggcagugau

SEQ ID NO: 2257521 - RNA, 15 nt, Yersinia pestis
auacuacuuucucuu

SEQ ID NO: 2257522 - RNA, 12 nt, Yersinia pestis
auacuguuuggu

SEQ ID NO: 2257523 - RNA, 18 nt, Yersinia pestis
auacuuaagucaaauuua

SEQ ID NO: 2257524 - RNA, 16 nt, Yersinia pestis
auacuucaaacugcgu

SEQ ID NO: 2257525 - RNA, 16 nt, Yersinia pestis
auagauagcaaucaau

SEQ ID NO: 2257526 - RNA, 15 nt, Yersinia pestis
auagauacacuccau

SEQ ID NO: 2257527 - RNA, 16 nt, Yersinia pestis
auagauaacaaacuac

SEQ ID NO: 2257528 - RNA, 17 nt, Yersinia pestis
auagauuggcaucagug

SEQ ID NO: 2257529 - RNA, 23 nt, Yersinia pestis
auagacaauacuacuuucucuug

SEQ ID NO: 2257530 - RNA, 16 nt, Yersinia pestis
auagacgaauggccgc

SEQ ID NO: 2257531 - RNA, 20 nt, Yersinia pestis
auagacucaucgggauuaau

SEQ ID NO: 2257532 - RNA, 15 nt, Yersinia pestis
auagccaaaauaauu

SEQ ID NO: 2257533 - RNA, 18 nt, Yersinia pestis
auagccggagguuuuuca

SEQ ID NO: 2257534 - RNA, 14 nt, Yersinia pestis
auagcaacugccaa

SEQ ID NO: 2257535 - RNA, 17 nt, Yersinia pestis
auagauuuauucaacau

SEQ ID NO: 2257536 - RNA, 16 nt, Yersinia pestis
auagaucccauaccca

SEQ ID NO: 2257537 - RNA, 18 nt, Yersinia pestis
auagauuuuaugaauuaa

SEQ ID NO: 2257538 - RNA, 18 nt, Yersinia pestis
auagcaaaagaaucagua

SEQ ID NO: 2257539 - RNA, 14 nt, Yersinia pestis
auaccguuuuguac

SEQ ID NO: 2257540 - RNA, 19 nt, Yersinia pestis
auaccucaguuaucagggc

SEQ ID NO: 2257541 - RNA, 15 nt, Yersinia pestis
auacuaaagaaauaa

SEQ ID NO: 2257542 - RNA, 21 nt, Yersinia pestis
auacuaauagaagagaggcaa

SEQ ID NO: 2257543 - RNA, 14 nt, Yersinia pestis
auacgaauuuuucc

SEQ ID NO: 2257544 - RNA, 19 nt, Yersinia pestis
auacgaccgucaccaaaua

SEQ ID NO: 2257545 - RNA, 20 nt, Yersinia pestis
auacgaccgucaccaaauag

SEQ ID NO: 2257546 - RNA, 23 nt, Yersinia pestis
auacgcgcaccggcuaaccacag

SEQ ID NO: 2257547 - RNA, 19 nt, Yersinia pestis
auaccauuuuagcuggcag

SEQ ID NO: 2257548 - RNA, 22 nt, Yersinia pestis
auaccauucucugucuuccauu

SEQ ID NO: 2257549 - RNA, 21 nt, Yersinia pestis
auaccauguugaaucaauugc

SEQ ID NO: 2257550 - RNA, 16 nt, Yersinia pestis
auacccaacagguugg

SEQ ID NO: 2257551 - RNA, 15 nt, Yersinia pestis
auacccaaagccagu

SEQ ID NO: 2257552 - RNA, 20 nt, Yersinia pestis
auaccaugccaucaauguuc

SEQ ID NO: 2257553 - RNA, 18 nt, Yersinia pestis
auacccgccgcaucuaaa

SEQ ID NO: 2257554 - RNA, 22 nt, Yersinia pestis
auacccgccgcaucuaaaccga

SEQ ID NO: 2257555 - RNA, 19 nt, Yersinia pestis
auacccuuuggucaauaaa

SEQ ID NO: 2257556 - RNA, 17 nt, Yersinia pestis
auacccuucaggauuau

SEQ ID NO: 2257557 - RNA, 17 nt, Yersinia pestis
auaccaagccaaauuaa

SEQ ID NO: 2257558 - RNA, 12 nt, Yersinia pestis
auaccaaauuua

SEQ ID NO: 2257559 - RNA, 17 nt, Yersinia pestis
auaccaaauuuaccgac

SEQ ID NO: 2257560 - RNA, 16 nt, Yersinia pestis
auaccacaauccggug

SEQ ID NO: 2257561 - RNA, 21 nt, Yersinia pestis
auaccacccguugcauuuuuc

SEQ ID NO: 2257562 - RNA, 16 nt, Yersinia pestis
auaccaccaccaaccc

SEQ ID NO: 2257563 - RNA, 13 nt, Yersinia pestis
auaccacaucaaa

SEQ ID NO: 2257564 - RNA, 16 nt, Yersinia pestis
auaccacaucaaaccg

SEQ ID NO: 2257565 - RNA, 16 nt, Yersinia pestis
auaccagaugcauaua

SEQ ID NO: 2257566 - RNA, 12 nt, Yersinia pestis
auaccagagacg

SEQ ID NO: 2257567 - RNA, 14 nt, Yersinia pestis
auaauuuauacaua

SEQ ID NO: 2257568 - RNA, 19 nt, Yersinia pestis
auaauuucaaaguaaaaua

SEQ ID NO: 2257569 - RNA, 16 nt, Yersinia pestis
auaauuucagcagcac

SEQ ID NO: 2257570 - RNA, 11 nt, Yersinia pestis
auaauugaaga

SEQ ID NO: 2257571 - RNA, 17 nt, Yersinia pestis
auaauugaagauuuaaa

SEQ ID NO: 2257572 - RNA, 15 nt, Yersinia pestis
auaauugaagauuua

SEQ ID NO: 2257573 - RNA, 17 nt, Yersinia pestis
auaauuggcaauaaugu

SEQ ID NO: 2257574 - RNA, 22 nt, Yersinia pestis
auaaugucaccacggcuuucaa

SEQ ID NO: 2257575 - RNA, 16 nt, Yersinia pestis
auaauuaugaaaguaa

SEQ ID NO: 2257576 - RNA, 21 nt, Yersinia pestis
auaaugguuagguugaaauac

SEQ ID NO: 2257577 - RNA, 18 nt, Yersinia pestis
auaaugguauuugaaaua

SEQ ID NO: 2257578 - RNA, 20 nt, Yersinia pestis
auaaugguauuugaaauauu

SEQ ID NO: 2257579 - RNA, 17 nt, Yersinia pestis
auaaugguauuugaaau

SEQ ID NO: 2257580 - RNA, 21 nt, Yersinia pestis
auaauucugcuauuaauuauu

SEQ ID NO: 2257581 - RNA, 15 nt, Yersinia pestis
auaauuauuucucug

SEQ ID NO: 2257582 - RNA, 12 nt, Yersinia pestis
auaauucagcau

SEQ ID NO: 2257583 - RNA, 21 nt, Yersinia pestis
auaauucagcaucaaauuauu

SEQ ID NO: 2257584 - RNA, 21 nt, Yersinia pestis
auaauucauuuuuugggauga

SEQ ID NO: 2257585 - RNA, 14 nt, Yersinia pestis
auaauuccacauaa

SEQ ID NO: 2257586 - RNA, 22 nt, Yersinia pestis
auaauucccccgguuaaugcca

SEQ ID NO: 2257587 - RNA, 16 nt, Yersinia pestis
auaaugagguuaucca

SEQ ID NO: 2257588 - RNA, 23 nt, Yersinia pestis
auaaugagguuauccaauaacau

SEQ ID NO: 2257589 - RNA, 16 nt, Yersinia pestis
auaaugcaccaaucaa

SEQ ID NO: 2257590 - RNA, 14 nt, Yersinia pestis
auaaucccuuuccu

SEQ ID NO: 2257591 - RNA, 12 nt, Yersinia pestis
auaauccaaaau

SEQ ID NO: 2257592 - RNA, 16 nt, Yersinia pestis
auaauccacugaaaua

SEQ ID NO: 2257593 - RNA, 13 nt, Yersinia pestis
auaaucaucuaca

SEQ ID NO: 2257594 - RNA, 19 nt, Yersinia pestis
auaaucaucuacaacauca

SEQ ID NO: 2257595 - RNA, 17 nt, Yersinia pestis
auaacgguaucagucau

SEQ ID NO: 2257596 - RNA, 20 nt, Yersinia pestis
auaacgccccuguaaauaaa

SEQ ID NO: 2257597 - RNA, 16 nt, Yersinia pestis
auacauacgucuccau

SEQ ID NO: 2257598 - RNA, 14 nt, Yersinia pestis
auacaguuuugccg

SEQ ID NO: 2257599 - RNA, 23 nt, Yersinia pestis
auacaguggcgagcgcaggguca

SEQ ID NO: 2257600 - RNA, 17 nt, Yersinia pestis
auacagucaauugagaa

SEQ ID NO: 2257601 - RNA, 19 nt, Yersinia pestis
auacaggugucaucaaggc

SEQ ID NO: 2257602 - RNA, 21 nt, Yersinia pestis
auacaggcguugggguggcag

SEQ ID NO: 2257603 - RNA, 17 nt, Yersinia pestis
auacaggguaaauuauu

SEQ ID NO: 2257604 - RNA, 16 nt, Yersinia pestis
auacauccuaaauaau

SEQ ID NO: 2257605 - RNA, 17 nt, Yersinia pestis
auacauccuaaauaauu

SEQ ID NO: 2257606 - RNA, 21 nt, Yersinia pestis
auacaucgccaguguugccau

SEQ ID NO: 2257607 - RNA, 18 nt, Yersinia pestis
auacauauaaccaucaaa

SEQ ID NO: 2257608 - RNA, 15 nt, Yersinia pestis
auacauaucaacacu

SEQ ID NO: 2257609 - RNA, 20 nt, Yersinia pestis
auacaucaaaucagaggcuu

SEQ ID NO: 2257610 - RNA, 18 nt, Yersinia pestis
auacauuggcuccccuuu

SEQ ID NO: 2257611 - RNA, 19 nt, Yersinia pestis
auacauuauuauuuacaaa

SEQ ID NO: 2257612 - RNA, 21 nt, Yersinia pestis
auacaacguuuaguaaucaau

SEQ ID NO: 2257613 - RNA, 21 nt, Yersinia pestis
auacaaauaguaauaauuaau

SEQ ID NO: 2257614 - RNA, 21 nt, Yersinia pestis
auacaaauauuacgaaugagu

SEQ ID NO: 2257615 - RNA, 20 nt, Yersinia pestis
auacaaccacugaacaccau

SEQ ID NO: 2257616 - RNA, 13 nt, Yersinia pestis
auaauuuuucuuc

SEQ ID NO: 2257617 - RNA, 20 nt, Yersinia pestis
auaauuuuucuuccaccauc

SEQ ID NO: 2257618 - RNA, 23 nt, Yersinia pestis
auacacagcacggcaacaggcuu

SEQ ID NO: 2257619 - RNA, 12 nt, Yersinia pestis
auacaccgccag

SEQ ID NO: 2257620 - RNA, 17 nt, Yersinia pestis
auacaccauuuccaggc

SEQ ID NO: 2257621 - RNA, 12 nt, Yersinia pestis
auacaauuuuug

SEQ ID NO: 2257622 - RNA, 23 nt, Yersinia pestis
auacaauuuuuggucguauucau

SEQ ID NO: 2257623 - RNA, 12 nt, Yersinia pestis
auacacuugcuc

SEQ ID NO: 2257624 - RNA, 21 nt, Yersinia pestis
auacaccuucuuuaucugucc

SEQ ID NO: 2257625 - RNA, 19 nt, Yersinia pestis
auacaccucaacgugauau

SEQ ID NO: 2257626 - RNA, 17 nt, Yersinia pestis
aucaaaggcgaccaaug

SEQ ID NO: 2257627 - RNA, 16 nt, Yersinia pestis
aucaaaucauacgcag

SEQ ID NO: 2257628 - RNA, 19 nt, Yersinia pestis
auauuugagauauaggcau

SEQ ID NO: 2257629 - RNA, 19 nt, Yersinia pestis
aucaaaacugauuaauagu

SEQ ID NO: 2257630 - RNA, 16 nt, Yersinia pestis
aucaaaagcaagaccg

SEQ ID NO: 2257631 - RNA, 14 nt, Yersinia pestis
aucaaaauaucggu

SEQ ID NO: 2257632 - RNA, 21 nt, Yersinia pestis
aucaaaagggaucaccaggcu

SEQ ID NO: 2257633 - RNA, 22 nt, Yersinia pestis
auauuucacguucaucaauacc

SEQ ID NO: 2257634 - RNA, 13 nt, Yersinia pestis
auauuuauuuaau

SEQ ID NO: 2257635 - RNA, 13 nt, Yersinia pestis
auauuuauuuuua

SEQ ID NO: 2257636 - RNA, 14 nt, Yersinia pestis
auauuuauuuuuau

SEQ ID NO: 2257637 - RNA, 11 nt, Yersinia pestis
auauuucucuu

SEQ ID NO: 2257638 - RNA, 19 nt, Yersinia pestis
aucaagacucaguaaauau

SEQ ID NO: 2257639 - RNA, 16 nt, Yersinia pestis
aucaacuuucaccccu

SEQ ID NO: 2257640 - RNA, 18 nt, Yersinia pestis
aucaacuuucaccccuuu

SEQ ID NO: 2257641 - RNA, 23 nt, Yersinia pestis
aucaacuuucaccccuuucuugc

SEQ ID NO: 2257642 - RNA, 16 nt, Yersinia pestis
aucaauaaagcuggcu

SEQ ID NO: 2257643 - RNA, 17 nt, Yersinia pestis
aucaauaccaauaaaac

SEQ ID NO: 2257644 - RNA, 16 nt, Yersinia pestis
aucaauacccugccac

SEQ ID NO: 2257645 - RNA, 12 nt, Yersinia pestis
aucaauaccgaa

SEQ ID NO: 2257646 - RNA, 13 nt, Yersinia pestis
aucaauaccuuac

SEQ ID NO: 2257647 - RNA, 18 nt, Yersinia pestis
aucaauaccuuacugcau

SEQ ID NO: 2257648 - RNA, 20 nt, Yersinia pestis
aucaauaccuuacugcauca

SEQ ID NO: 2257649 - RNA, 22 nt, Yersinia pestis
aucaaucagcugauaugaaaaa

SEQ ID NO: 2257650 - RNA, 23 nt, Yersinia pestis
aucaacaggccaccuaacacuuu

SEQ ID NO: 2257651 - RNA, 14 nt, Yersinia pestis
aucaacauacugau

SEQ ID NO: 2257652 - RNA, 17 nt, Yersinia pestis
aucaacuucugcaaaau

SEQ ID NO: 2257653 - RNA, 17 nt, Yersinia pestis
aucaacucgccacccgc

SEQ ID NO: 2257654 - RNA, 15 nt, Yersinia pestis
auauugagaaucagu

SEQ ID NO: 2257655 - RNA, 20 nt, Yersinia pestis
auauucauuaaaaaauaauu

SEQ ID NO: 2257656 - RNA, 16 nt, Yersinia pestis
auauuccacauacaaa

SEQ ID NO: 2257657 - RNA, 19 nt, Yersinia pestis
auauucauuaaaaaauaau

SEQ ID NO: 2257658 - RNA, 14 nt, Yersinia pestis
auauucauauuucu

SEQ ID NO: 2257659 - RNA, 17 nt, Yersinia pestis
auauuggucauuuuucc

SEQ ID NO: 2257660 - RNA, 21 nt, Yersinia pestis
auauuggucauuuuucccuuc

SEQ ID NO: 2257661 - RNA, 19 nt, Yersinia pestis
auauuggggggcaguuuuu

SEQ ID NO: 2257662 - RNA, 19 nt, Yersinia pestis
auauuggcaauauucagua

SEQ ID NO: 2257663 - RNA, 15 nt, Yersinia pestis
auauuggcaacaaca

SEQ ID NO: 2257664 - RNA, 12 nt, Yersinia pestis
auauugcucagu

SEQ ID NO: 2257665 - RNA, 16 nt, Yersinia pestis
auauugcucugccgca

SEQ ID NO: 2257666 - RNA, 18 nt, Yersinia pestis
auauugauaaaaaucaau

SEQ ID NO: 2257667 - RNA, 17 nt, Yersinia pestis
auauugauaaaaguaau

SEQ ID NO: 2257668 - RNA, 22 nt, Yersinia pestis
auauuuacggugagaauaaaua

SEQ ID NO: 2257669 - RNA, 15 nt, Yersinia pestis
auauuuauugccaac

SEQ ID NO: 2257670 - RNA, 19 nt, Yersinia pestis
auauuuaucugcauuaaaa

SEQ ID NO: 2257671 - RNA, 22 nt, Yersinia pestis
auauuuaucugcauuaaaauaa

SEQ ID NO: 2257672 - RNA, 15 nt, Yersinia pestis
auauuuauuaauucu

SEQ ID NO: 2257673 - RNA, 15 nt, Yersinia pestis
auauuuaauuuaaau

SEQ ID NO: 2257674 - RNA, 17 nt, Yersinia pestis
auauuuaauuuaaauaa

SEQ ID NO: 2257675 - RNA, 20 nt, Yersinia pestis
auauguucgaucaaaacaau

SEQ ID NO: 2257676 - RNA, 15 nt, Yersinia pestis
auauggguuaaugcu

SEQ ID NO: 2257677 - RNA, 11 nt, Yersinia pestis
auauuaacccg

SEQ ID NO: 2257678 - RNA, 12 nt, Yersinia pestis
auauuaaaugca

SEQ ID NO: 2257679 - RNA, 22 nt, Yersinia pestis
auauuaaagccauucagcagca

SEQ ID NO: 2257680 - RNA, 19 nt, Yersinia pestis
auauuaacugcagugaaaa

SEQ ID NO: 2257681 - RNA, 15 nt, Yersinia pestis
auauuagguauuaag

SEQ ID NO: 2257682 - RNA, 18 nt, Yersinia pestis
auauuaccgcugaaaaau

SEQ ID NO: 2257683 - RNA, 14 nt, Yersinia pestis
auauuacucacaca

SEQ ID NO: 2257684 - RNA, 13 nt, Yersinia pestis
auauaaauaaaau

SEQ ID NO: 2257685 - RNA, 20 nt, Yersinia pestis
auauaauagcuggcggauaa

SEQ ID NO: 2257686 - RNA, 14 nt, Yersinia pestis
auauaaucauacug

SEQ ID NO: 2257687 - RNA, 14 nt, Yersinia pestis
auauaauaaugcug

SEQ ID NO: 2257688 - RNA, 17 nt, Yersinia pestis
auauaaugcugaaugaa

SEQ ID NO: 2257689 - RNA, 14 nt, Yersinia pestis
auauagagaaaucu

SEQ ID NO: 2257690 - RNA, 23 nt, Yersinia pestis
auauagagcucagcuucaggcca

SEQ ID NO: 2257691 - RNA, 14 nt, Yersinia pestis
auauacccaccaga

SEQ ID NO: 2257692 - RNA, 17 nt, Yersinia pestis
auauacccgacuaaucu

SEQ ID NO: 2257693 - RNA, 22 nt, Yersinia pestis
auauacccgucauaaauaaaga

SEQ ID NO: 2257694 - RNA, 15 nt, Yersinia pestis
auauaccacaugaga

SEQ ID NO: 2257695 - RNA, 22 nt, Yersinia pestis
auauaccggggaagagauaaau

SEQ ID NO: 2257696 - RNA, 17 nt, Yersinia pestis
auauacccgucauacuu

SEQ ID NO: 2257697 - RNA, 20 nt, Yersinia pestis
auauaggguauaugccuaua

SEQ ID NO: 2257698 - RNA, 16 nt, Yersinia pestis
auauaguaacuauuua

SEQ ID NO: 2257699 - RNA, 13 nt, Yersinia pestis
auauaggcgucau

SEQ ID NO: 2257700 - RNA, 22 nt, Yersinia pestis
auauaggaaaugucguacaucu

SEQ ID NO: 2257701 - RNA, 22 nt, Yersinia pestis
auauauacaauccaaccuauau

SEQ ID NO: 2257702 - RNA, 13 nt, Yersinia pestis
auauauagaaaua

SEQ ID NO: 2257703 - RNA, 15 nt, Yersinia pestis
auauauagagaaauc

SEQ ID NO: 2257704 - RNA, 14 nt, Yersinia pestis
auagccuucccugg

SEQ ID NO: 2257705 - RNA, 23 nt, Yersinia pestis
auagccuguaauccggcaaaaac

SEQ ID NO: 2257706 - RNA, 19 nt, Yersinia pestis
auagucauauauuuuucuu

SEQ ID NO: 2257707 - RNA, 15 nt, Yersinia pestis
auagucaucuuucca

SEQ ID NO: 2257708 - RNA, 14 nt, Yersinia pestis
auagcgccugcccu

SEQ ID NO: 2257709 - RNA, 14 nt, Yersinia pestis
auauaaaccagcca

SEQ ID NO: 2257710 - RNA, 14 nt, Yersinia pestis
auauaaacauaaaa

SEQ ID NO: 2257711 - RNA, 15 nt, Yersinia pestis
auauaaaccagccag

SEQ ID NO: 2257712 - RNA, 17 nt, Yersinia pestis
auauaaacuaauaucuu

SEQ ID NO: 2257713 - RNA, 21 nt, Yersinia pestis
auagucuuuuuaauaugugac

SEQ ID NO: 2257714 - RNA, 17 nt, Yersinia pestis
auaguuacccacauuca

SEQ ID NO: 2257715 - RNA, 21 nt, Yersinia pestis
auaguuaugaugaguaacaua

SEQ ID NO: 2257716 - RNA, 13 nt, Yersinia pestis
auagucuguuuca

SEQ ID NO: 2257717 - RNA, 19 nt, Yersinia pestis
auaucugccaauucaaggc

SEQ ID NO: 2257718 - RNA, 21 nt, Yersinia pestis
auaucucggugugacuuucaa

SEQ ID NO: 2257719 - RNA, 16 nt, Yersinia pestis
auaucucaguugaaac

SEQ ID NO: 2257720 - RNA, 16 nt, Yersinia pestis
auaugaaauuucacug

SEQ ID NO: 2257721 - RNA, 16 nt, Yersinia pestis
auaugaagcacaaaaa

SEQ ID NO: 2257722 - RNA, 15 nt, Yersinia pestis
auauggaugaugcac

SEQ ID NO: 2257723 - RNA, 22 nt, Yersinia pestis
auauggaugaugcacagcugga

SEQ ID NO: 2257724 - RNA, 16 nt, Yersinia pestis
auaugcugauaaaauu

SEQ ID NO: 2257725 - RNA, 18 nt, Yersinia pestis
auaugcugauaaaauucg

SEQ ID NO: 2257726 - RNA, 23 nt, Yersinia pestis
auaugcucugcugggauacuggu

SEQ ID NO: 2257727 - RNA, 12 nt, Yersinia pestis
auaugcugaaua

SEQ ID NO: 2257728 - RNA, 15 nt, Yersinia pestis
auaugcuucaucacu

SEQ ID NO: 2257729 - RNA, 16 nt, Yersinia pestis
auaugcuucaucacuu

SEQ ID NO: 2257730 - RNA, 19 nt, Yersinia pestis
auaugcuucaucacuugcu

SEQ ID NO: 2257731 - RNA, 22 nt, Yersinia pestis
auaugcgcuggcucuauuuucc

SEQ ID NO: 2257732 - RNA, 20 nt, Yersinia pestis
auaugcgccuauaaggcucu

SEQ ID NO: 2257733 - RNA, 18 nt, Yersinia pestis
auaugcgcgucaauccac

SEQ ID NO: 2257734 - RNA, 18 nt, Yersinia pestis
auaucccgagaaacaaaa

SEQ ID NO: 2257735 - RNA, 20 nt, Yersinia pestis
auaucccgagaaacaaaacc

SEQ ID NO: 2257736 - RNA, 17 nt, Yersinia pestis
auaucccuguuuucuag

SEQ ID NO: 2257737 - RNA, 19 nt, Yersinia pestis
auauccucaagaccgauuu

SEQ ID NO: 2257738 - RNA, 17 nt, Yersinia pestis
auauccuguggccuuaa

SEQ ID NO: 2257739 - RNA, 20 nt, Yersinia pestis
auauccugcgucucuaaccc

SEQ ID NO: 2257740 - RNA, 16 nt, Yersinia pestis
auaucgcuaaaacaca

SEQ ID NO: 2257741 - RNA, 15 nt, Yersinia pestis
auaucgguaaaaaau

SEQ ID NO: 2257742 - RNA, 18 nt, Yersinia pestis
auaucccccccaagagaa

SEQ ID NO: 2257743 - RNA, 17 nt, Yersinia pestis
auauaucacuauuucag

SEQ ID NO: 2257744 - RNA, 16 nt, Yersinia pestis
aucuuauccacagcau

SEQ ID NO: 2257745 - RNA, 19 nt, Yersinia pestis
aucuucauccgcuccagcc

SEQ ID NO: 2257746 - RNA, 14 nt, Yersinia pestis
aucuguuucaaaua

SEQ ID NO: 2257747 - RNA, 17 nt, Yersinia pestis
aucuguuuuugccaccu

SEQ ID NO: 2257748 - RNA, 14 nt, Yersinia pestis
aucuuaaucacgau

SEQ ID NO: 2257749 - RNA, 22 nt, Yersinia pestis
aucuaaucggcuggcaagauaa

SEQ ID NO: 2257750 - RNA, 14 nt, Yersinia pestis
aucuaaguccaaga

SEQ ID NO: 2257751 - RNA, 18 nt, Yersinia pestis
aucuaacucauucauaau

SEQ ID NO: 2257752 - RNA, 23 nt, Yersinia pestis
aucugcucccggcacuaaguguc

SEQ ID NO: 2257753 - RNA, 15 nt, Yersinia pestis
aucuggauauauuua

SEQ ID NO: 2257754 - RNA, 15 nt, Yersinia pestis
aucuggaugugcuuc

SEQ ID NO: 2257755 - RNA, 19 nt, Yersinia pestis
aucugcuuuacugcuuuuc

SEQ ID NO: 2257756 - RNA, 17 nt, Yersinia pestis
aucugcuguaagggaaa

SEQ ID NO: 2257757 - RNA, 23 nt, Yersinia pestis
aucugucuaagugccaguuaaua

SEQ ID NO: 2257758 - RNA, 21 nt, Yersinia pestis
aucugugucaguaccugaugu

SEQ ID NO: 2257759 - RNA, 14 nt, Yersinia pestis
aucuguggugacau

SEQ ID NO: 2257760 - RNA, 23 nt, Yersinia pestis
aucugguuuuuuuauaaauuacu

SEQ ID NO: 2257761 - RNA, 15 nt, Yersinia pestis
aucuguaaucaccag

SEQ ID NO: 2257762 - RNA, 23 nt, Yersinia pestis
aucuuuuuuuuuauuaucaucuu

SEQ ID NO: 2257763 - RNA, 23 nt, Yersinia pestis
augaaaaacugugcaaauggcuu

SEQ ID NO: 2257764 - RNA, 12 nt, Yersinia pestis
augaaaaacaga

SEQ ID NO: 2257765 - RNA, 19 nt, Yersinia pestis
augaaaaaguccgcaacau

SEQ ID NO: 2257766 - RNA, 16 nt, Yersinia pestis
aucuuguucuaauaau

SEQ ID NO: 2257767 - RNA, 13 nt, Yersinia pestis
aucuuuacugcau

SEQ ID NO: 2257768 - RNA, 17 nt, Yersinia pestis
aucuuuauugcuccuua

SEQ ID NO: 2257769 - RNA, 22 nt, Yersinia pestis
aucuugugaugcauauuauuaa

SEQ ID NO: 2257770 - RNA, 16 nt, Yersinia pestis
aucuugucguuauuuu

SEQ ID NO: 2257771 - RNA, 14 nt, Yersinia pestis
aucuuguaguaacc

SEQ ID NO: 2257772 - RNA, 23 nt, Yersinia pestis
aucuuguaaauagucauauauuu

SEQ ID NO: 2257773 - RNA, 18 nt, Yersinia pestis
aucuugcaacaacgccuc

SEQ ID NO: 2257774 - RNA, 19 nt, Yersinia pestis
aucuugcgccgaaauaaaa

SEQ ID NO: 2257775 - RNA, 15 nt, Yersinia pestis
aucuuccucacucca

SEQ ID NO: 2257776 - RNA, 19 nt, Yersinia pestis
aucuucgcuuucaucuucu

SEQ ID NO: 2257777 - RNA, 15 nt, Yersinia pestis
augacacaauucccg

SEQ ID NO: 2257778 - RNA, 15 nt, Yersinia pestis
augacaagucaugau

SEQ ID NO: 2257779 - RNA, 12 nt, Yersinia pestis
augacaaauaag

SEQ ID NO: 2257780 - RNA, 17 nt, Yersinia pestis
augaaccgucauagcau

SEQ ID NO: 2257781 - RNA, 23 nt, Yersinia pestis
augaaccgccaaucgaacccaac

SEQ ID NO: 2257782 - RNA, 18 nt, Yersinia pestis
augaacccuuucagcgcu

SEQ ID NO: 2257783 - RNA, 14 nt, Yersinia pestis
augaaccaaaauuc

SEQ ID NO: 2257784 - RNA, 12 nt, Yersinia pestis
augaacgugccg

SEQ ID NO: 2257785 - RNA, 18 nt, Yersinia pestis
augaacggauacccagca

SEQ ID NO: 2257786 - RNA, 16 nt, Yersinia pestis
augacggugauguccg

SEQ ID NO: 2257787 - RNA, 18 nt, Yersinia pestis
augacgguugcugggauc

SEQ ID NO: 2257788 - RNA, 16 nt, Yersinia pestis
augacagcaucaauau

SEQ ID NO: 2257789 - RNA, 19 nt, Yersinia pestis
augacagcauuauauuauu

SEQ ID NO: 2257790 - RNA, 21 nt, Yersinia pestis
augacaggggauagcaacugc

SEQ ID NO: 2257791 - RNA, 23 nt, Yersinia pestis
augacaguauuugcagcggauga

SEQ ID NO: 2257792 - RNA, 20 nt, Yersinia pestis
augacauauucaaccgccag

SEQ ID NO: 2257793 - RNA, 23 nt, Yersinia pestis
augauaagugaauaaaucaaagc

SEQ ID NO: 2257794 - RNA, 13 nt, Yersinia pestis
augaggcugaggu

SEQ ID NO: 2257795 - RNA, 21 nt, Yersinia pestis
augauaggcacggcacuaaua

SEQ ID NO: 2257796 - RNA, 14 nt, Yersinia pestis
augauacgugcuau

SEQ ID NO: 2257797 - RNA, 17 nt, Yersinia pestis
augauagcgcgagagcg

SEQ ID NO: 2257798 - RNA, 13 nt, Yersinia pestis
augauagacagca

SEQ ID NO: 2257799 - RNA, 21 nt, Yersinia pestis
augacuaauugugcagcauca

SEQ ID NO: 2257800 - RNA, 13 nt, Yersinia pestis
augacuagcgagc

SEQ ID NO: 2257801 - RNA, 17 nt, Yersinia pestis
augacuccugaaauaaa

SEQ ID NO: 2257802 - RNA, 18 nt, Yersinia pestis
augagcacggacagcagc

SEQ ID NO: 2257803 - RNA, 14 nt, Yersinia pestis
augagccuuacccc

SEQ ID NO: 2257804 - RNA, 14 nt, Yersinia pestis
augagcuguagaac

SEQ ID NO: 2257805 - RNA, 16 nt, Yersinia pestis
augagcuuaugcgucu

SEQ ID NO: 2257806 - RNA, 23 nt, Yersinia pestis
augcaaaauaugguagaauuuac

SEQ ID NO: 2257807 - RNA, 12 nt, Yersinia pestis
augauuuuuaac

SEQ ID NO: 2257808 - RNA, 17 nt, Yersinia pestis
augcaccaaauucagaa

SEQ ID NO: 2257809 - RNA, 19 nt, Yersinia pestis
augcaccaaucaacauaaa

SEQ ID NO: 2257810 - RNA, 20 nt, Yersinia pestis
augauugagaucauauuguu

SEQ ID NO: 2257811 - RNA, 13 nt, Yersinia pestis
augauugauuauc

SEQ ID NO: 2257812 - RNA, 15 nt, Yersinia pestis
augauugauuaucaa

SEQ ID NO: 2257813 - RNA, 13 nt, Yersinia pestis
augauucucuauu

SEQ ID NO: 2257814 - RNA, 15 nt, Yersinia pestis
augauucucuauucu

SEQ ID NO: 2257815 - RNA, 14 nt, Yersinia pestis
augauugaaaaaca

SEQ ID NO: 2257816 - RNA, 16 nt, Yersinia pestis
augauugaaaaacaga

SEQ ID NO: 2257817 - RNA, 14 nt, Yersinia pestis
augauuauuuugug

SEQ ID NO: 2257818 - RNA, 21 nt, Yersinia pestis
augcauauuugcagaaaguaa

SEQ ID NO: 2257819 - RNA, 12 nt, Yersinia pestis
augcauccaagc

SEQ ID NO: 2257820 - RNA, 20 nt, Yersinia pestis
augcauacccgucguacuuu

SEQ ID NO: 2257821 - RNA, 14 nt, Yersinia pestis
augcagauaucagc

SEQ ID NO: 2257822 - RNA, 16 nt, Yersinia pestis
augcagaugccaauga

SEQ ID NO: 2257823 - RNA, 14 nt, Yersinia pestis
augcacuucaccug

SEQ ID NO: 2257824 - RNA, 14 nt, Yersinia pestis
augcacuccacuau

SEQ ID NO: 2257825 - RNA, 18 nt, Yersinia pestis
augaugcggaagaaggcu

SEQ ID NO: 2257826 - RNA, 15 nt, Yersinia pestis
augaugccgaucauc

SEQ ID NO: 2257827 - RNA, 18 nt, Yersinia pestis
augaucugaugaucaucu

SEQ ID NO: 2257828 - RNA, 17 nt, Yersinia pestis
augaucuugauaaacau

SEQ ID NO: 2257829 - RNA, 13 nt, Yersinia pestis
augaugauuuuua

SEQ ID NO: 2257830 - RNA, 14 nt, Yersinia pestis
augaugauuauuuu

SEQ ID NO: 2257831 - RNA, 20 nt, Yersinia pestis
augaugcuggguauauauac

SEQ ID NO: 2257832 - RNA, 18 nt, Yersinia pestis
augauuaacggauacccu

SEQ ID NO: 2257833 - RNA, 16 nt, Yersinia pestis
augauuaaacgccugg

SEQ ID NO: 2257834 - RNA, 23 nt, Yersinia pestis
augaucaaauuauauaagagaug

SEQ ID NO: 2257835 - RNA, 11 nt, Yersinia pestis
augaucggcau

SEQ ID NO: 2257836 - RNA, 20 nt, Yersinia pestis
augaucccugguuugccaua

SEQ ID NO: 2257837 - RNA, 18 nt, Yersinia pestis
augguugaaugaccaagg

SEQ ID NO: 2257838 - RNA, 17 nt, Yersinia pestis
augguugaaugaccaag

SEQ ID NO: 2257839 - RNA, 18 nt, Yersinia pestis
augguucaucauuuuuua

SEQ ID NO: 2257840 - RNA, 18 nt, Yersinia pestis
auggugggccgugcggga

SEQ ID NO: 2257841 - RNA, 19 nt, Yersinia pestis
auggugggccgugcgggau

SEQ ID NO: 2257842 - RNA, 20 nt, Yersinia pestis
augggguucgcuauccccac

SEQ ID NO: 2257843 - RNA, 14 nt, Yersinia pestis
auggcuuuuuuaau

SEQ ID NO: 2257844 - RNA, 20 nt, Yersinia pestis
auggcuuuuuuacgcgccug

SEQ ID NO: 2257845 - RNA, 23 nt, Yersinia pestis
auggggcauugcagacugcugac

SEQ ID NO: 2257846 - RNA, 20 nt, Yersinia pestis
auggggccaccuaauccaag

SEQ ID NO: 2257847 - RNA, 16 nt, Yersinia pestis
auggcuugugcagcaa

SEQ ID NO: 2257848 - RNA, 18 nt, Yersinia pestis
auggcuugugcagcaaua

SEQ ID NO: 2257849 - RNA, 20 nt, Yersinia pestis
auggcuuuacggcucaccug

SEQ ID NO: 2257850 - RNA, 18 nt, Yersinia pestis
auggucaggaacccauuu

SEQ ID NO: 2257851 - RNA, 19 nt, Yersinia pestis
auggucaggaacccauuug

SEQ ID NO: 2257852 - RNA, 16 nt, Yersinia pestis
auggucacccuuuuga

SEQ ID NO: 2257853 - RNA, 22 nt, Yersinia pestis
auggucaggaacccauuugcac

SEQ ID NO: 2257854 - RNA, 19 nt, Yersinia pestis
auggcguauugagugucau

SEQ ID NO: 2257855 - RNA, 21 nt, Yersinia pestis
auggcgcagacccgugaacau

SEQ ID NO: 2257856 - RNA, 20 nt, Yersinia pestis
auggcgcaguguaaaaccug

SEQ ID NO: 2257857 - RNA, 15 nt, Yersinia pestis
auggcacaauccaau

SEQ ID NO: 2257858 - RNA, 15 nt, Yersinia pestis
auggccgccagcacg

SEQ ID NO: 2257859 - RNA, 17 nt, Yersinia pestis
auggccuugaaucaaaa

SEQ ID NO: 2257860 - RNA, 18 nt, Yersinia pestis
auggcgaaaauccuucau

SEQ ID NO: 2257861 - RNA, 15 nt, Yersinia pestis
auggauuugcacaua

SEQ ID NO: 2257862 - RNA, 20 nt, Yersinia pestis
auggauugaaaccgcugaua

SEQ ID NO: 2257863 - RNA, 14 nt, Yersinia pestis
auggauucucuaua

SEQ ID NO: 2257864 - RNA, 15 nt, Yersinia pestis
auggcaaccccugcc

SEQ ID NO: 2257865 - RNA, 18 nt, Yersinia pestis
auggcaaaggauaaugau

SEQ ID NO: 2257866 - RNA, 15 nt, Yersinia pestis
augucaauuaaaaac

SEQ ID NO: 2257867 - RNA, 13 nt, Yersinia pestis
augucaccuccac

SEQ ID NO: 2257868 - RNA, 18 nt, Yersinia pestis
augucaccuccacuucaa

SEQ ID NO: 2257869 - RNA, 15 nt, Yersinia pestis
augucacguuaaguu

SEQ ID NO: 2257870 - RNA, 17 nt, Yersinia pestis
augucagccguuuacga

SEQ ID NO: 2257871 - RNA, 23 nt, Yersinia pestis
augucgcuguagcgccagguaag

SEQ ID NO: 2257872 - RNA, 21 nt, Yersinia pestis
auguacgcaaguaucuuaccg

SEQ ID NO: 2257873 - RNA, 15 nt, Yersinia pestis
auguacuuaauacug

SEQ ID NO: 2257874 - RNA, 20 nt, Yersinia pestis
auguagcacacuaccgucuu

SEQ ID NO: 2257875 - RNA, 20 nt, Yersinia pestis
auguauucccucaauagcua

SEQ ID NO: 2257876 - RNA, 15 nt, Yersinia pestis
auguaacacacagca

SEQ ID NO: 2257877 - RNA, 14 nt, Yersinia pestis
auguacauuauuca

SEQ ID NO: 2257878 - RNA, 15 nt, Yersinia pestis
auguuagagauaaca

SEQ ID NO: 2257879 - RNA, 22 nt, Yersinia pestis
auguucgcucccccggaucacu

SEQ ID NO: 2257880 - RNA, 20 nt, Yersinia pestis
auguucgcacugcucugccc

SEQ ID NO: 2257881 - RNA, 19 nt, Yersinia pestis
augucucuauucacuauuu

SEQ ID NO: 2257882 - RNA, 20 nt, Yersinia pestis
augucucuggcgcgaaaugc

SEQ ID NO: 2257883 - RNA, 19 nt, Yersinia pestis
augugcugguuauuggccc

SEQ ID NO: 2257884 - RNA, 18 nt, Yersinia pestis
augugcggaaauaaacau

SEQ ID NO: 2257885 - RNA, 22 nt, Yersinia pestis
augugcggaaauaaacaucaaa

SEQ ID NO: 2257886 - RNA, 14 nt, Yersinia pestis
auggagagauguug

SEQ ID NO: 2257887 - RNA, 22 nt, Yersinia pestis
auggacgccgcuacaagcaugu

SEQ ID NO: 2257888 - RNA, 14 nt, Yersinia pestis
auggacggcauaua

SEQ ID NO: 2257889 - RNA, 13 nt, Yersinia pestis
auggacgaacagc

SEQ ID NO: 2257890 - RNA, 13 nt, Yersinia pestis
auggaagauagau

SEQ ID NO: 2257891 - RNA, 17 nt, Yersinia pestis
auggaaauccguuuuuu

SEQ ID NO: 2257892 - RNA, 12 nt, Yersinia pestis
auggaauaacug

SEQ ID NO: 2257893 - RNA, 23 nt, Yersinia pestis
augcuuuuugcaucgcuucugaa

SEQ ID NO: 2257894 - RNA, 15 nt, Yersinia pestis
augcuuuucuuuccc

SEQ ID NO: 2257895 - RNA, 22 nt, Yersinia pestis
augcuuuucuuucccgccggca

SEQ ID NO: 2257896 - RNA, 20 nt, Yersinia pestis
auggaaaaauuagccaagca

SEQ ID NO: 2257897 - RNA, 21 nt, Yersinia pestis
auggaaaauauucuaaguaaa

SEQ ID NO: 2257898 - RNA, 12 nt, Yersinia pestis
augcugugccau

SEQ ID NO: 2257899 - RNA, 20 nt, Yersinia pestis
augcugucacugucaaaacc

SEQ ID NO: 2257900 - RNA, 16 nt, Yersinia pestis
augcuggugcucggca

SEQ ID NO: 2257901 - RNA, 17 nt, Yersinia pestis
augcuggugcucggcau

SEQ ID NO: 2257902 - RNA, 17 nt, Yersinia pestis
augcuuaagaggaucuu

SEQ ID NO: 2257903 - RNA, 21 nt, Yersinia pestis
augcuguuguagcgccaggua

SEQ ID NO: 2257904 - RNA, 17 nt, Yersinia pestis
augcugaccacugcuuc

SEQ ID NO: 2257905 - RNA, 18 nt, Yersinia pestis
augcugaccccaaauuug

SEQ ID NO: 2257906 - RNA, 19 nt, Yersinia pestis
augcuggguauauauacag

SEQ ID NO: 2257907 - RNA, 17 nt, Yersinia pestis
augcucaucaaguauuu

SEQ ID NO: 2257908 - RNA, 18 nt, Yersinia pestis
augcucaucaaguauuuu

SEQ ID NO: 2257909 - RNA, 14 nt, Yersinia pestis
augcucauuuaaaa

SEQ ID NO: 2257910 - RNA, 13 nt, Yersinia pestis
augcucacaauca

SEQ ID NO: 2257911 - RNA, 11 nt, Yersinia pestis
augcuaauuuc

SEQ ID NO: 2257912 - RNA, 13 nt, Yersinia pestis
augcuaauuucau

SEQ ID NO: 2257913 - RNA, 22 nt, Yersinia pestis
augcuacaccauccauaggcua

SEQ ID NO: 2257914 - RNA, 17 nt, Yersinia pestis
augcuaacucgcgauaa

SEQ ID NO: 2257915 - RNA, 18 nt, Yersinia pestis
augcuaaccgaauaaaac

SEQ ID NO: 2257916 - RNA, 16 nt, Yersinia pestis
augcucauuuaaaaua

SEQ ID NO: 2257917 - RNA, 17 nt, Yersinia pestis
augcucgcucaucauaa

SEQ ID NO: 2257918 - RNA, 19 nt, Yersinia pestis
augcucucgagaaauaaau

SEQ ID NO: 2257919 - RNA, 16 nt, Yersinia pestis
augcucugcugggaua

SEQ ID NO: 2257920 - RNA, 17 nt, Yersinia pestis
augcucuucauaagcca

SEQ ID NO: 2257921 - RNA, 21 nt, Yersinia pestis
augcucggugcgguaucaaca

SEQ ID NO: 2257922 - RNA, 16 nt, Yersinia pestis
augcgucuuuagauuu

SEQ ID NO: 2257923 - RNA, 15 nt, Yersinia pestis
augcuaaaaaacagc

SEQ ID NO: 2257924 - RNA, 16 nt, Yersinia pestis
augcguuggcucagau

SEQ ID NO: 2257925 - RNA, 19 nt, Yersinia pestis
augcauguuauuggcuaaa

SEQ ID NO: 2257926 - RNA, 13 nt, Yersinia pestis
augcauuauaagg

SEQ ID NO: 2257927 - RNA, 14 nt, Yersinia pestis
augcgaauacuuug

SEQ ID NO: 2257928 - RNA, 22 nt, Yersinia pestis
augcgauacgcccgccccagca

SEQ ID NO: 2257929 - RNA, 19 nt, Yersinia pestis
augcgcucgcuugcugccu

SEQ ID NO: 2257930 - RNA, 23 nt, Yersinia pestis
augcgccauauacccaaagccag

SEQ ID NO: 2257931 - RNA, 15 nt, Yersinia pestis
augcgcgacauuuug

SEQ ID NO: 2257932 - RNA, 17 nt, Yersinia pestis
augcgccuguuagggcg

SEQ ID NO: 2257933 - RNA, 17 nt, Yersinia pestis
augcgcgcgucacuaaa

SEQ ID NO: 2257934 - RNA, 17 nt, Yersinia pestis
aucaggcuuauauuuau

SEQ ID NO: 2257935 - RNA, 15 nt, Yersinia pestis
aucaggcuguugaca

SEQ ID NO: 2257936 - RNA, 18 nt, Yersinia pestis
aucaggccuucuuuucuc

SEQ ID NO: 2257937 - RNA, 19 nt, Yersinia pestis
aucaggccuucuuuucucc

SEQ ID NO: 2257938 - RNA, 24 nt, Yersinia pestis
aucaggucaguaaugaauucauug

SEQ ID NO: 2257939 - RNA, 22 nt, Yersinia pestis
aucaggugaacguuggcuucac

SEQ ID NO: 2257940 - RNA, 16 nt, Yersinia pestis
aucaguauuauaaaau

SEQ ID NO: 2257941 - RNA, 18 nt, Yersinia pestis
aucaguaccaccaccaca

SEQ ID NO: 2257942 - RNA, 16 nt, Yersinia pestis
aucagguuguauuuug

SEQ ID NO: 2257943 - RNA, 20 nt, Yersinia pestis
aucagguuguccgaagagaa

SEQ ID NO: 2257944 - RNA, 22 nt, Yersinia pestis
aucagguuguccgaagagaaag

SEQ ID NO: 2257945 - RNA, 14 nt, Yersinia pestis
aucaggcagacaau

SEQ ID NO: 2257946 - RNA, 14 nt, Yersinia pestis
aucaggaucaccag

SEQ ID NO: 2257947 - RNA, 16 nt, Yersinia pestis
aucaaucucaucaauc

SEQ ID NO: 2257948 - RNA, 14 nt, Yersinia pestis
aucagugaagagau

SEQ ID NO: 2257949 - RNA, 16 nt, Yersinia pestis
aucagugaagagauaa

SEQ ID NO: 2257950 - RNA, 21 nt, Yersinia pestis
aucaguguugcaacggucauu

SEQ ID NO: 2257951 - RNA, 23 nt, Yersinia pestis
aucagugcaauaaauucaaaaua

SEQ ID NO: 2257952 - RNA, 19 nt, Yersinia pestis
aucaguucguucccuguau

SEQ ID NO: 2257953 - RNA, 21 nt, Yersinia pestis
aucaguugugggucgccuugc

SEQ ID NO: 2257954 - RNA, 19 nt, Yersinia pestis
aucauaucaaaauaaaaau

SEQ ID NO: 2257955 - RNA, 14 nt, Yersinia pestis
aucauaucaaaaua

SEQ ID NO: 2257956 - RNA, 14 nt, Yersinia pestis
aucauagccaucag

SEQ ID NO: 2257957 - RNA, 11 nt, Yersinia pestis
aucauauauua

SEQ ID NO: 2257958 - RNA, 16 nt, Yersinia pestis
aucauaagacuaacag

SEQ ID NO: 2257959 - RNA, 13 nt, Yersinia pestis
aucauagaaggcg

SEQ ID NO: 2257960 - RNA, 14 nt, Yersinia pestis
aucaucuucuucau

SEQ ID NO: 2257961 - RNA, 14 nt, Yersinia pestis
aucaucguggcuuu

SEQ ID NO: 2257962 - RNA, 18 nt, Yersinia pestis
aucauccgcucagcaaaa

SEQ ID NO: 2257963 - RNA, 23 nt, Yersinia pestis
aucaucgacuugaugaaguuauu

SEQ ID NO: 2257964 - RNA, 18 nt, Yersinia pestis
aucaucgcucaucgccaa

SEQ ID NO: 2257965 - RNA, 22 nt, Yersinia pestis
aucaucgcccuugucugggcug

SEQ ID NO: 2257966 - RNA, 15 nt, Yersinia pestis
aucaucaagccaaug

SEQ ID NO: 2257967 - RNA, 16 nt, Yersinia pestis
aucaucaaauucaggu

SEQ ID NO: 2257968 - RNA, 15 nt, Yersinia pestis
aucaucaccauucaa

SEQ ID NO: 2257969 - RNA, 16 nt, Yersinia pestis
aucaucagacagccau

SEQ ID NO: 2257970 - RNA, 22 nt, Yersinia pestis
aucaucaauggauucuugcugc

SEQ ID NO: 2257971 - RNA, 14 nt, Yersinia pestis
aucaucacaaauaa

SEQ ID NO: 2257972 - RNA, 20 nt, Yersinia pestis
aucaucaucgguaccgccag

SEQ ID NO: 2257973 - RNA, 22 nt, Yersinia pestis
aucaucaucgguaccgccagaa

SEQ ID NO: 2257974 - RNA, 19 nt, Yersinia pestis
aucaucaucuuuaauaaua

SEQ ID NO: 2257975 - RNA, 13 nt, Yersinia pestis
aucaucaucacaa

SEQ ID NO: 2257976 - RNA, 14 nt, Yersinia pestis
aucaucaucccagu

SEQ ID NO: 2257977 - RNA, 16 nt, Yersinia pestis
aucauccauaaagacg

SEQ ID NO: 2257978 - RNA, 18 nt, Yersinia pestis
aucauggaagaccagaua

SEQ ID NO: 2257979 - RNA, 17 nt, Yersinia pestis
aucaugcugucauuggu

SEQ ID NO: 2257980 - RNA, 17 nt, Yersinia pestis
aucaugcgggauuacuc

SEQ ID NO: 2257981 - RNA, 21 nt, Yersinia pestis
aucaugaacggauacccagca

SEQ ID NO: 2257982 - RNA, 15 nt, Yersinia pestis
aucaugccagcaaua

SEQ ID NO: 2257983 - RNA, 17 nt, Yersinia pestis
aucaugccagcaauaua

SEQ ID NO: 2257984 - RNA, 18 nt, Yersinia pestis
aucauguaacacacagca

SEQ ID NO: 2257985 - RNA, 20 nt, Yersinia pestis
aucauguaaggcaauaccaa

SEQ ID NO: 2257986 - RNA, 15 nt, Yersinia pestis
aucauuaagaugcau

SEQ ID NO: 2257987 - RNA, 13 nt, Yersinia pestis
aucauuauuaugu

SEQ ID NO: 2257988 - RNA, 21 nt, Yersinia pestis
aucauuauuauguauuuuuau

SEQ ID NO: 2257989 - RNA, 18 nt, Yersinia pestis
aucauucagcgucacgau

SEQ ID NO: 2257990 - RNA, 23 nt, Yersinia pestis
aucauuauuauguauuuuuaugc

SEQ ID NO: 2257991 - RNA, 13 nt, Yersinia pestis
aucauuuuuuuau

SEQ ID NO: 2257992 - RNA, 14 nt, Yersinia pestis
auccaaaauaauuc

SEQ ID NO: 2257993 - RNA, 22 nt, Yersinia pestis
auccaagccaccaccacggcca

SEQ ID NO: 2257994 - RNA, 18 nt, Yersinia pestis
aucauucgguuauuuaga

SEQ ID NO: 2257995 - RNA, 15 nt, Yersinia pestis
aucauucauuuuaaa

SEQ ID NO: 2257996 - RNA, 23 nt, Yersinia pestis
aucauugccacgacgcagcucca

SEQ ID NO: 2257997 - RNA, 13 nt, Yersinia pestis
aucauuggcuuca

SEQ ID NO: 2257998 - RNA, 17 nt, Yersinia pestis
auccacuuuucagauag

SEQ ID NO: 2257999 - RNA, 13 nt, Yersinia pestis
auccagaagccau

SEQ ID NO: 2258000 - RNA, 20 nt, Yersinia pestis
auccagaauuucauugugga

SEQ ID NO: 2258001 - RNA, 18 nt, Yersinia pestis
auccagauccucaucacu

SEQ ID NO: 2258002 - RNA, 13 nt, Yersinia pestis
auccagauucaga

SEQ ID NO: 2258003 - RNA, 17 nt, Yersinia pestis
auccaccuggguuccau

SEQ ID NO: 2258004 - RNA, 17 nt, Yersinia pestis
auccacuuauaucucca

SEQ ID NO: 2258005 - RNA, 16 nt, Yersinia pestis
auccacuuggcuaauu

SEQ ID NO: 2258006 - RNA, 14 nt, Yersinia pestis
auccacuagcauca

SEQ ID NO: 2258007 - RNA, 17 nt, Yersinia pestis
auccaauaacaucaccu

SEQ ID NO: 2258008 - RNA, 22 nt, Yersinia pestis
auccaaggcggaauagaggaag

SEQ ID NO: 2258009 - RNA, 17 nt, Yersinia pestis
auccacaaugaucaaac

SEQ ID NO: 2258010 - RNA, 19 nt, Yersinia pestis
auccacacagcauucugcu

SEQ ID NO: 2258011 - RNA, 23 nt, Yersinia pestis
auccacacccucuaucucacccu

SEQ ID NO: 2258012 - RNA, 16 nt, Yersinia pestis
auccacaaacucaugc

SEQ ID NO: 2258013 - RNA, 13 nt, Yersinia pestis
auccaauucagua

SEQ ID NO: 2258014 - RNA, 15 nt, Yersinia pestis
auccacauaaaaaga

SEQ ID NO: 2258015 - RNA, 17 nt, Yersinia pestis
auccacauuggaauuuu

SEQ ID NO: 2258016 - RNA, 14 nt, Yersinia pestis
auccacauucugug

SEQ ID NO: 2258017 - RNA, 23 nt, Yersinia pestis
aucccagagauggcgaucaagcc

SEQ ID NO: 2258018 - RNA, 13 nt, Yersinia pestis
aucccagccacca

SEQ ID NO: 2258019 - RNA, 19 nt, Yersinia pestis
aucccagccaccaugggua

SEQ ID NO: 2258020 - RNA, 15 nt, Yersinia pestis
aucccagcagcaaac

SEQ ID NO: 2258021 - RNA, 16 nt, Yersinia pestis
aucccagcagcaaaca

SEQ ID NO: 2258022 - RNA, 16 nt, Yersinia pestis
aucccagaaccucaac

SEQ ID NO: 2258023 - RNA, 19 nt, Yersinia pestis
aucccacucuguaccgccc

SEQ ID NO: 2258024 - RNA, 16 nt, Yersinia pestis
auccauuuucugccaa

SEQ ID NO: 2258025 - RNA, 15 nt, Yersinia pestis
auccauuuucugcca

SEQ ID NO: 2258026 - RNA, 14 nt, Yersinia pestis
aucccaaaagaaga

SEQ ID NO: 2258027 - RNA, 16 nt, Yersinia pestis
aucccaaaagaagaca

SEQ ID NO: 2258028 - RNA, 17 nt, Yersinia pestis
aucccaaaagaagacaa

SEQ ID NO: 2258029 - RNA, 19 nt, Yersinia pestis
aucccaccaaaccauuggu

SEQ ID NO: 2258030 - RNA, 13 nt, Yersinia pestis
aucccaagagaac

SEQ ID NO: 2258031 - RNA, 14 nt, Yersinia pestis
aucccaaucaucau

SEQ ID NO: 2258032 - RNA, 15 nt, Yersinia pestis
aucccaaucaucauc

SEQ ID NO: 2258033 - RNA, 15 nt, Yersinia pestis
aucccaaugaauauu

SEQ ID NO: 2258034 - RNA, 18 nt, Yersinia pestis
auccauuucaaucacugc

SEQ ID NO: 2258035 - RNA, 15 nt, Yersinia pestis
auccaugggccucgc

SEQ ID NO: 2258036 - RNA, 17 nt, Yersinia pestis
auccaugagaugauuag

SEQ ID NO: 2258037 - RNA, 12 nt, Yersinia pestis
auccauauuaaa

SEQ ID NO: 2258038 - RNA, 20 nt, Yersinia pestis
auccaucccaacaauuugcg

SEQ ID NO: 2258039 - RNA, 23 nt, Yersinia pestis
auccaucauugcuaaauuuugua

SEQ ID NO: 2258040 - RNA, 11 nt, Yersinia pestis
auccagcagcg

SEQ ID NO: 2258041 - RNA, 15 nt, Yersinia pestis
auccagcagcgcugg

SEQ ID NO: 2258042 - RNA, 20 nt, Yersinia pestis
auccagcaccacaauggcag

SEQ ID NO: 2258043 - RNA, 13 nt, Yersinia pestis
auccagcaaacgc

SEQ ID NO: 2258044 - RNA, 20 nt, Yersinia pestis
auccagugucaugcgcagaa

SEQ ID NO: 2258045 - RNA, 21 nt, Yersinia pestis
auccaguguuucgcaguugcc

SEQ ID NO: 2258046 - RNA, 18 nt, Yersinia pestis
auccauaaaaucacgcau

SEQ ID NO: 2258047 - RNA, 20 nt, Yersinia pestis
auccaguucgaccaauucac

SEQ ID NO: 2258048 - RNA, 15 nt, Yersinia pestis
aucccguuccgcuuc

SEQ ID NO: 2258049 - RNA, 21 nt, Yersinia pestis
aucccgggaauaaucaauuaa

SEQ ID NO: 2258050 - RNA, 14 nt, Yersinia pestis
aucccggugaucau

SEQ ID NO: 2258051 - RNA, 18 nt, Yersinia pestis
aucccgugugauuuccau

SEQ ID NO: 2258052 - RNA, 14 nt, Yersinia pestis
aucccgugccagau

SEQ ID NO: 2258053 - RNA, 20 nt, Yersinia pestis
auccccuuugacagcaucug

SEQ ID NO: 2258054 - RNA, 12 nt, Yersinia pestis
aucccgagaaac

SEQ ID NO: 2258055 - RNA, 16 nt, Yersinia pestis
aucccccugcugccag

SEQ ID NO: 2258056 - RNA, 20 nt, Yersinia pestis
auccccaucgccaauacaau

SEQ ID NO: 2258057 - RNA, 23 nt, Yersinia pestis
auccccacuuguaccugugccag

SEQ ID NO: 2258058 - RNA, 18 nt, Yersinia pestis
aucccugcgguauccuua

SEQ ID NO: 2258059 - RNA, 22 nt, Yersinia pestis
aucccugccagaaucagcccca

SEQ ID NO: 2258060 - RNA, 14 nt, Yersinia pestis
auccgaauauguca

SEQ ID NO: 2258061 - RNA, 17 nt, Yersinia pestis
auccgaauuaucauauu

SEQ ID NO: 2258062 - RNA, 22 nt, Yersinia pestis
aucccuuugggugguggacuga

SEQ ID NO: 2258063 - RNA, 16 nt, Yersinia pestis
aucccuuuccucucuc

SEQ ID NO: 2258064 - RNA, 15 nt, Yersinia pestis
auccgauaauaauuc

SEQ ID NO: 2258065 - RNA, 17 nt, Yersinia pestis
auccgaguuauugauau

SEQ ID NO: 2258066 - RNA, 19 nt, Yersinia pestis
auccgacugcagaaaauca

SEQ ID NO: 2258067 - RNA, 16 nt, Yersinia pestis
auccgcaaaaugggua

SEQ ID NO: 2258068 - RNA, 16 nt, Yersinia pestis
auccgcagcuuagguu

SEQ ID NO: 2258069 - RNA, 17 nt, Yersinia pestis
auccgcccuuguaagcg

SEQ ID NO: 2258070 - RNA, 23 nt, Yersinia pestis
auccgcgauaacguuguuucuga

SEQ ID NO: 2258071 - RNA, 13 nt, Yersinia pestis
auccuauauacaa

SEQ ID NO: 2258072 - RNA, 19 nt, Yersinia pestis
auccucaccguucaagauc

SEQ ID NO: 2258073 - RNA, 14 nt, Yersinia pestis
auccuacaauaucu

SEQ ID NO: 2258074 - RNA, 17 nt, Yersinia pestis
auccguuuuaacgcugc

SEQ ID NO: 2258075 - RNA, 22 nt, Yersinia pestis
auccguuuuaacgcugcccaau

SEQ ID NO: 2258076 - RNA, 16 nt, Yersinia pestis
auccguucagcggcag

SEQ ID NO: 2258077 - RNA, 18 nt, Yersinia pestis
auccguuaacccaaagcc

SEQ ID NO: 2258078 - RNA, 19 nt, Yersinia pestis
auccgugcugguccuuuug

SEQ ID NO: 2258079 - RNA, 16 nt, Yersinia pestis
auccgggaaaaaauac

SEQ ID NO: 2258080 - RNA, 12 nt, Yersinia pestis
auccucuucuuc

SEQ ID NO: 2258081 - RNA, 12 nt, Yersinia pestis
auccucuuccaa

SEQ ID NO: 2258082 - RNA, 15 nt, Yersinia pestis
auccucaucacugcc

SEQ ID NO: 2258083 - RNA, 22 nt, Yersinia pestis
auccugaaauacggaacgcaga

SEQ ID NO: 2258084 - RNA, 23 nt, Yersinia pestis
auccugaacgaggacuuccugcc

SEQ ID NO: 2258085 - RNA, 22 nt, Yersinia pestis
auccuggccguguuuuucccua

SEQ ID NO: 2258086 - RNA, 16 nt, Yersinia pestis
auccuguagcucagcc

SEQ ID NO: 2258087 - RNA, 22 nt, Yersinia pestis
auccugccgugucguggcauau

SEQ ID NO: 2258088 - RNA, 17 nt, Yersinia pestis
auccugccgccucugcu

SEQ ID NO: 2258089 - RNA, 18 nt, Yersinia pestis
auccugcucagcuaaaga

SEQ ID NO: 2258090 - RNA, 18 nt, Yersinia pestis
auccugcuauuuaacaaa

SEQ ID NO: 2258091 - RNA, 20 nt, Yersinia pestis
auccugcuauuuaacaaaaa

SEQ ID NO: 2258092 - RNA, 12 nt, Yersinia pestis
aucguagucuau

SEQ ID NO: 2258093 - RNA, 22 nt, Yersinia pestis
aucgucagccccugccagaauc

SEQ ID NO: 2258094 - RNA, 17 nt, Yersinia pestis
aucgucacuggcaccau

SEQ ID NO: 2258095 - RNA, 16 nt, Yersinia pestis
aucgucagaaccugca

SEQ ID NO: 2258096 - RNA, 15 nt, Yersinia pestis
aucuaacuaauaaua

SEQ ID NO: 2258097 - RNA, 15 nt, Yersinia pestis
aucgugaccaauaau

SEQ ID NO: 2258098 - RNA, 17 nt, Yersinia pestis
aucguugcuaccagcaa

SEQ ID NO: 2258099 - RNA, 21 nt, Yersinia pestis
aucgugaguguuucucagcgu

SEQ ID NO: 2258100 - RNA, 24 nt, Yersinia pestis
aucgucuauagugccuaauaaaua

SEQ ID NO: 2258101 - RNA, 19 nt, Yersinia pestis
aucgcuuuggcuucuggau

SEQ ID NO: 2258102 - RNA, 21 nt, Yersinia pestis
aucgcuuuggcuucuggaugg

SEQ ID NO: 2258103 - RNA, 13 nt, Yersinia pestis
aucgcuuuuuaca

SEQ ID NO: 2258104 - RNA, 18 nt, Yersinia pestis
aucgcuuuuagauaaagg

SEQ ID NO: 2258105 - RNA, 13 nt, Yersinia pestis
aucggcagugcca

SEQ ID NO: 2258106 - RNA, 21 nt, Yersinia pestis
aucgcuacguacuaucuauua

SEQ ID NO: 2258107 - RNA, 15 nt, Yersinia pestis
aucgcgaaagcacuc

SEQ ID NO: 2258108 - RNA, 17 nt, Yersinia pestis
aucgccuguaaaucuug

SEQ ID NO: 2258109 - RNA, 21 nt, Yersinia pestis
aucgcugccaccgucgcagaa

SEQ ID NO: 2258110 - RNA, 15 nt, Yersinia pestis
aucgcugccgcaaga

SEQ ID NO: 2258111 - RNA, 20 nt, Yersinia pestis
aucgcucugcguuuuucccu

SEQ ID NO: 2258112 - RNA, 14 nt, Yersinia pestis
aucgauugauauau

SEQ ID NO: 2258113 - RNA, 23 nt, Yersinia pestis
aucgauugauauauagaaauaag

SEQ ID NO: 2258114 - RNA, 21 nt, Yersinia pestis
aucgaucucuuuauauucaau

SEQ ID NO: 2258115 - RNA, 17 nt, Yersinia pestis
aucgacuaauuaaacaa

SEQ ID NO: 2258116 - RNA, 22 nt, Yersinia pestis
aucgacuaaaaccugcuugaaa

SEQ ID NO: 2258117 - RNA, 19 nt, Yersinia pestis
aucgcccuugucugggcug

SEQ ID NO: 2258118 - RNA, 19 nt, Yersinia pestis
aucgccauagccgaucacc

SEQ ID NO: 2258119 - RNA, 22 nt, Yersinia pestis
aucgccauagccgaucaccgca

SEQ ID NO: 2258120 - RNA, 20 nt, Yersinia pestis
aucgccagugaguccuuuac

SEQ ID NO: 2258121 - RNA, 22 nt, Yersinia pestis
aucgccagcggguacacugucg

SEQ ID NO: 2258122 - RNA, 18 nt, Yersinia pestis
aucgccagcaaaucacau

SEQ ID NO: 2258123 - RNA, 19 nt, Yersinia pestis
aucgccugaugcuuuucuu

SEQ ID NO: 2258124 - RNA, 17 nt, Yersinia pestis
aucgccugaugcuuuuc

SEQ ID NO: 2258125 - RNA, 13 nt, Yersinia pestis
aucgccgaaaucu

SEQ ID NO: 2258126 - RNA, 19 nt, Yersinia pestis
auccuugggucaguuuuau

SEQ ID NO: 2258127 - RNA, 19 nt, Yersinia pestis
auccuugcuaguuauauaa

SEQ ID NO: 2258128 - RNA, 16 nt, Yersinia pestis
auccuugaucgccaaa

SEQ ID NO: 2258129 - RNA, 19 nt, Yersinia pestis
auccuucaagaugcagggc

SEQ ID NO: 2258130 - RNA, 20 nt, Yersinia pestis
auccuguggccuuaauucgg

SEQ ID NO: 2258131 - RNA, 17 nt, Yersinia pestis
auccuucauuucaggac

SEQ ID NO: 2258132 - RNA, 19 nt, Yersinia pestis
aucgaaugaucagaggcug

SEQ ID NO: 2258133 - RNA, 18 nt, Yersinia pestis
aucgaauugaucugauau

SEQ ID NO: 2258134 - RNA, 21 nt, Yersinia pestis
aucgaacccgcuaacaugcca

SEQ ID NO: 2258135 - RNA, 23 nt, Yersinia pestis
aucgaccgaguguaaaaagcagu

SEQ ID NO: 2258136 - RNA, 19 nt, Yersinia pestis
aucgaccgaguguaaaaag

SEQ ID NO: 2258137 - RNA, 16 nt, Yersinia pestis
aucgacgcgaaauuca

SEQ ID NO: 2258138 - RNA, 17 nt, Yersinia pestis
aucgacaccauguccau

SEQ ID NO: 2258139 - RNA, 16 nt, Yersinia pestis
caauuggucaugauga

SEQ ID NO: 2258140 - RNA, 17 nt, Yersinia pestis
caauuggucaugaugaa

SEQ ID NO: 2258141 - RNA, 19 nt, Yersinia pestis
caauugaugucaugauaaa

SEQ ID NO: 2258142 - RNA, 20 nt, Yersinia pestis
caauugaguaguaaaaccua

SEQ ID NO: 2258143 - RNA, 17 nt, Yersinia pestis
caauucaucagcgcugg

SEQ ID NO: 2258144 - RNA, 19 nt, Yersinia pestis
caauucaucagcgcuggcu

SEQ ID NO: 2258145 - RNA, 12 nt, Yersinia pestis
caauucaugcau

SEQ ID NO: 2258146 - RNA, 18 nt, Yersinia pestis
caauucauguugccaaug

SEQ ID NO: 2258147 - RNA, 13 nt, Yersinia pestis
caauucggcuggc

SEQ ID NO: 2258148 - RNA, 15 nt, Yersinia pestis
caauucgcaagaagc

SEQ ID NO: 2258149 - RNA, 20 nt, Yersinia pestis
caauucgaccguuuuuacaa

SEQ ID NO: 2258150 - RNA, 22 nt, Yersinia pestis
caauucuuaggguaaccaaugu

SEQ ID NO: 2258151 - RNA, 17 nt, Yersinia pestis
caauucagaagacaaua

SEQ ID NO: 2258152 - RNA, 18 nt, Yersinia pestis
caauucacgcaaggccag

SEQ ID NO: 2258153 - RNA, 20 nt, Yersinia pestis
caauuaugacguucaguagu

SEQ ID NO: 2258154 - RNA, 14 nt, Yersinia pestis
caauuaucuuaucc

SEQ ID NO: 2258155 - RNA, 13 nt, Yersinia pestis
caauuagucacua

SEQ ID NO: 2258156 - RNA, 22 nt, Yersinia pestis
caauuaauacccuaucgacuuc

SEQ ID NO: 2258157 - RNA, 12 nt, Yersinia pestis
caauuaacacuu

SEQ ID NO: 2258158 - RNA, 15 nt, Yersinia pestis
caaucaggaaauuac

SEQ ID NO: 2258159 - RNA, 17 nt, Yersinia pestis
caaucacuuuauacgcu

SEQ ID NO: 2258160 - RNA, 15 nt, Yersinia pestis
caauuuucccaagcc

SEQ ID NO: 2258161 - RNA, 14 nt, Yersinia pestis
caauuuuauggaua

SEQ ID NO: 2258162 - RNA, 20 nt, Yersinia pestis
caauuugucauguugaccaa

SEQ ID NO: 2258163 - RNA, 16 nt, Yersinia pestis
caauuuuugcagugca

SEQ ID NO: 2258164 - RNA, 22 nt, Yersinia pestis
cacaaaaaagaaauuuuuagaa

SEQ ID NO: 2258165 - RNA, 23 nt, Yersinia pestis
cacaaaaaccggcguaaauaaaa

SEQ ID NO: 2258166 - RNA, 14 nt, Yersinia pestis
caauuugcccaucu

SEQ ID NO: 2258167 - RNA, 15 nt, Yersinia pestis
caauuugguagaacu

SEQ ID NO: 2258168 - RNA, 21 nt, Yersinia pestis
caauuugccgccuuccucaau

SEQ ID NO: 2258169 - RNA, 22 nt, Yersinia pestis
caauuucgaaaacucaaagauu

SEQ ID NO: 2258170 - RNA, 15 nt, Yersinia pestis
caauuucucaaauac

SEQ ID NO: 2258171 - RNA, 16 nt, Yersinia pestis
caauuucucaaauacu

SEQ ID NO: 2258172 - RNA, 22 nt, Yersinia pestis
caauuucucaaauacuucaaau

SEQ ID NO: 2258173 - RNA, 18 nt, Yersinia pestis
caauuuacgguccauaaa

SEQ ID NO: 2258174 - RNA, 17 nt, Yersinia pestis
caauuuacgguccauaa

SEQ ID NO: 2258175 - RNA, 20 nt, Yersinia pestis
caauuucaccccgacauuca

SEQ ID NO: 2258176 - RNA, 23 nt, Yersinia pestis
caauuucacgcucgcccaugacc

SEQ ID NO: 2258177 - RNA, 21 nt, Yersinia pestis
caauuucaugcgaauacuuug

SEQ ID NO: 2258178 - RNA, 16 nt, Yersinia pestis
cacaacccgcugaugc

SEQ ID NO: 2258179 - RNA, 14 nt, Yersinia pestis
cacaacaagcggcc

SEQ ID NO: 2258180 - RNA, 19 nt, Yersinia pestis
cacaacggaaggcccagcc

SEQ ID NO: 2258181 - RNA, 19 nt, Yersinia pestis
cacaacgcaucaguaaugu

SEQ ID NO: 2258182 - RNA, 16 nt, Yersinia pestis
cacaacgcauuacccc

SEQ ID NO: 2258183 - RNA, 12 nt, Yersinia pestis
cacaacugcgau

SEQ ID NO: 2258184 - RNA, 23 nt, Yersinia pestis
cacaaacucaugcucuucauaag

SEQ ID NO: 2258185 - RNA, 12 nt, Yersinia pestis
cacaaacauggc

SEQ ID NO: 2258186 - RNA, 17 nt, Yersinia pestis
cacaaacauggcggcag

SEQ ID NO: 2258187 - RNA, 20 nt, Yersinia pestis
cacaaaguagguuaagaccc

SEQ ID NO: 2258188 - RNA, 16 nt, Yersinia pestis
cacaaauuuuuaccuu

SEQ ID NO: 2258189 - RNA, 18 nt, Yersinia pestis
cacaaacuugagucagca

SEQ ID NO: 2258190 - RNA, 12 nt, Yersinia pestis
cacauaaauaag

SEQ ID NO: 2258191 - RNA, 15 nt, Yersinia pestis
cacauaaccaucaaa

SEQ ID NO: 2258192 - RNA, 17 nt, Yersinia pestis
cacauagcgucagguag

SEQ ID NO: 2258193 - RNA, 19 nt, Yersinia pestis
cacauaaaaagaaaaaaac

SEQ ID NO: 2258194 - RNA, 20 nt, Yersinia pestis
cacaguuuucuuaaaauacu

SEQ ID NO: 2258195 - RNA, 22 nt, Yersinia pestis
cacaguggaaccuccaaaugaa

SEQ ID NO: 2258196 - RNA, 18 nt, Yersinia pestis
cacagugaugaccauuca

SEQ ID NO: 2258197 - RNA, 23 nt, Yersinia pestis
cacagucaguucauuacaggccc

SEQ ID NO: 2258198 - RNA, 18 nt, Yersinia pestis
cacaggggcgaugucacc

SEQ ID NO: 2258199 - RNA, 19 nt, Yersinia pestis
cacaggcuucgacaggcaa

SEQ ID NO: 2258200 - RNA, 20 nt, Yersinia pestis
cacaggcuucgacaggcaau

SEQ ID NO: 2258201 - RNA, 17 nt, Yersinia pestis
cacaggggcaauuugcc

SEQ ID NO: 2258202 - RNA, 17 nt, Yersinia pestis
cacagcacgguaaccuu

SEQ ID NO: 2258203 - RNA, 15 nt, Yersinia pestis
cacagauaaauaaaa

SEQ ID NO: 2258204 - RNA, 14 nt, Yersinia pestis
cacagaugcuggcu

SEQ ID NO: 2258205 - RNA, 13 nt, Yersinia pestis
cacagaaucacca

SEQ ID NO: 2258206 - RNA, 13 nt, Yersinia pestis
cacagacaaacaa

SEQ ID NO: 2258207 - RNA, 16 nt, Yersinia pestis
cacagaaucaccaaca

SEQ ID NO: 2258208 - RNA, 13 nt, Yersinia pestis
cacagauaaacaa

SEQ ID NO: 2258209 - RNA, 19 nt, Yersinia pestis
cacagccacguaauaccac

SEQ ID NO: 2258210 - RNA, 23 nt, Yersinia pestis
cacagccugccgggaugacuuuu

SEQ ID NO: 2258211 - RNA, 23 nt, Yersinia pestis
cacaauuugguagaacugcggca

SEQ ID NO: 2258212 - RNA, 23 nt, Yersinia pestis
cacaauuagcugaucgggcuuua

SEQ ID NO: 2258213 - RNA, 16 nt, Yersinia pestis
cacaauuucaccccga

SEQ ID NO: 2258214 - RNA, 21 nt, Yersinia pestis
cacaauuucaccccgacauuc

SEQ ID NO: 2258215 - RNA, 18 nt, Yersinia pestis
cacacacaaagcccaaaa

SEQ ID NO: 2258216 - RNA, 12 nt, Yersinia pestis
cacacacuaaua

SEQ ID NO: 2258217 - RNA, 14 nt, Yersinia pestis
cacacagaaucacc

SEQ ID NO: 2258218 - RNA, 17 nt, Yersinia pestis
cacacagaaucaccaac

SEQ ID NO: 2258219 - RNA, 15 nt, Yersinia pestis
cacacaguauucugc

SEQ ID NO: 2258220 - RNA, 12 nt, Yersinia pestis
cacacauaccac

SEQ ID NO: 2258221 - RNA, 15 nt, Yersinia pestis
cacacauaccacaca

SEQ ID NO: 2258222 - RNA, 14 nt, Yersinia pestis
cacaccaacacuga

SEQ ID NO: 2258223 - RNA, 21 nt, Yersinia pestis
cacaaucucguuaucagccac

SEQ ID NO: 2258224 - RNA, 18 nt, Yersinia pestis
cacaauccaggcgaccca

SEQ ID NO: 2258225 - RNA, 21 nt, Yersinia pestis
cacaaucagggcacucugcuu

SEQ ID NO: 2258226 - RNA, 17 nt, Yersinia pestis
cacaauaggcuauuuua

SEQ ID NO: 2258227 - RNA, 15 nt, Yersinia pestis
cacaaucaguaaaua

SEQ ID NO: 2258228 - RNA, 14 nt, Yersinia pestis
cacaauauauacau

SEQ ID NO: 2258229 - RNA, 21 nt, Yersinia pestis
cacaaguucugccccugacuc

SEQ ID NO: 2258230 - RNA, 13 nt, Yersinia pestis
cacaagauaaaua

SEQ ID NO: 2258231 - RNA, 19 nt, Yersinia pestis
cacagaaacgauuacccac

SEQ ID NO: 2258232 - RNA, 17 nt, Yersinia pestis
cacacuggguaaggcaa

SEQ ID NO: 2258233 - RNA, 18 nt, Yersinia pestis
cacacuggguaaggcaaa

SEQ ID NO: 2258234 - RNA, 13 nt, Yersinia pestis
cacacucaguaca

SEQ ID NO: 2258235 - RNA, 17 nt, Yersinia pestis
cacacugagcaccgcag

SEQ ID NO: 2258236 - RNA, 14 nt, Yersinia pestis
cacacugagcaccg

SEQ ID NO: 2258237 - RNA, 15 nt, Yersinia pestis
cacacugagcaccgc

SEQ ID NO: 2258238 - RNA, 23 nt, Yersinia pestis
cacacgacugaguuccaaaaugc

SEQ ID NO: 2258239 - RNA, 20 nt, Yersinia pestis
cacaccaucaguacgguuca

SEQ ID NO: 2258240 - RNA, 20 nt, Yersinia pestis
cacacccucucuuuccagca

SEQ ID NO: 2258241 - RNA, 16 nt, Yersinia pestis
cacacccgccaaacca

SEQ ID NO: 2258242 - RNA, 17 nt, Yersinia pestis
cacauuugaaaugcauu

SEQ ID NO: 2258243 - RNA, 17 nt, Yersinia pestis
cacauuucccuuacugu

SEQ ID NO: 2258244 - RNA, 16 nt, Yersinia pestis
cacauucuguguaccc

SEQ ID NO: 2258245 - RNA, 19 nt, Yersinia pestis
cacauuccaguaaaaaaau

SEQ ID NO: 2258246 - RNA, 13 nt, Yersinia pestis
cacauucagucaa

SEQ ID NO: 2258247 - RNA, 21 nt, Yersinia pestis
caccaauacaaacagggcagc

SEQ ID NO: 2258248 - RNA, 16 nt, Yersinia pestis
caccaaugaaugcagg

SEQ ID NO: 2258249 - RNA, 21 nt, Yersinia pestis
caccaaucauuacaucaucuu

SEQ ID NO: 2258250 - RNA, 21 nt, Yersinia pestis
caccaauagcgaucagcaacg

SEQ ID NO: 2258251 - RNA, 14 nt, Yersinia pestis
caccaacuccugcc

SEQ ID NO: 2258252 - RNA, 23 nt, Yersinia pestis
caccaacggcccggcuaaaccaa

SEQ ID NO: 2258253 - RNA, 13 nt, Yersinia pestis
caccaacccgccc

SEQ ID NO: 2258254 - RNA, 14 nt, Yersinia pestis
caccaaccaaccau

SEQ ID NO: 2258255 - RNA, 15 nt, Yersinia pestis
cacaugcagcauuuc

SEQ ID NO: 2258256 - RNA, 14 nt, Yersinia pestis
cacaugugcaauua

SEQ ID NO: 2258257 - RNA, 19 nt, Yersinia pestis
cacauuaacuucagguuca

SEQ ID NO: 2258258 - RNA, 21 nt, Yersinia pestis
cacaucggucaauaccauauc

SEQ ID NO: 2258259 - RNA, 18 nt, Yersinia pestis
cacaucgcccugcucuuc

SEQ ID NO: 2258260 - RNA, 13 nt, Yersinia pestis
cacauaugcagcu

SEQ ID NO: 2258261 - RNA, 17 nt, Yersinia pestis
cacaucaaauuuuugau

SEQ ID NO: 2258262 - RNA, 14 nt, Yersinia pestis
cacaucaauauaaa

SEQ ID NO: 2258263 - RNA, 17 nt, Yersinia pestis
cacaucaccgacagcau

SEQ ID NO: 2258264 - RNA, 11 nt, Yersinia pestis
cacaucacagu

SEQ ID NO: 2258265 - RNA, 15 nt, Yersinia pestis
cacaucauuacccau

SEQ ID NO: 2258266 - RNA, 22 nt, Yersinia pestis
cacaucagugggauagagauca

SEQ ID NO: 2258267 - RNA, 14 nt, Yersinia pestis
caccaccacaaaca

SEQ ID NO: 2258268 - RNA, 13 nt, Yersinia pestis
caccaccacaccg

SEQ ID NO: 2258269 - RNA, 14 nt, Yersinia pestis
caccaccaacagca

SEQ ID NO: 2258270 - RNA, 13 nt, Yersinia pestis
caccacacauacc

SEQ ID NO: 2258271 - RNA, 14 nt, Yersinia pestis
caccaccaggcggc

SEQ ID NO: 2258272 - RNA, 13 nt, Yersinia pestis
caccaccuccaca

SEQ ID NO: 2258273 - RNA, 17 nt, Yersinia pestis
caccagagaugauagca

SEQ ID NO: 2258274 - RNA, 20 nt, Yersinia pestis
caccagauggcgaucaaggu

SEQ ID NO: 2258275 - RNA, 20 nt, Yersinia pestis
caccagauuuaauugugcuu

SEQ ID NO: 2258276 - RNA, 21 nt, Yersinia pestis
caccagacucugcuaccagga

SEQ ID NO: 2258277 - RNA, 13 nt, Yersinia pestis
caccagacaacca

SEQ ID NO: 2258278 - RNA, 16 nt, Yersinia pestis
caccagaaucaucaga

SEQ ID NO: 2258279 - RNA, 18 nt, Yersinia pestis
caccacugauaggucaua

SEQ ID NO: 2258280 - RNA, 20 nt, Yersinia pestis
caccagcaggugauacauca

SEQ ID NO: 2258281 - RNA, 15 nt, Yersinia pestis
caccagcgcacugaa

SEQ ID NO: 2258282 - RNA, 19 nt, Yersinia pestis
caccauaaccaauccaugc

SEQ ID NO: 2258283 - RNA, 16 nt, Yersinia pestis
caccauaaugugccuc

SEQ ID NO: 2258284 - RNA, 22 nt, Yersinia pestis
caccauaaaaacuucagagcca

SEQ ID NO: 2258285 - RNA, 18 nt, Yersinia pestis
caccaguuuauuuucccu

SEQ ID NO: 2258286 - RNA, 15 nt, Yersinia pestis
caccaucaacauggg

SEQ ID NO: 2258287 - RNA, 14 nt, Yersinia pestis
caccaucaauauaa

SEQ ID NO: 2258288 - RNA, 15 nt, Yersinia pestis
caccaucacuuccag

SEQ ID NO: 2258289 - RNA, 15 nt, Yersinia pestis
caccaguagcccagc

SEQ ID NO: 2258290 - RNA, 16 nt, Yersinia pestis
caccaguagcccagcc

SEQ ID NO: 2258291 - RNA, 14 nt, Yersinia pestis
caccagugggaucc

SEQ ID NO: 2258292 - RNA, 21 nt, Yersinia pestis
caccaggcucucauauccccc

SEQ ID NO: 2258293 - RNA, 14 nt, Yersinia pestis
caccauuugcccug

SEQ ID NO: 2258294 - RNA, 15 nt, Yersinia pestis
cacccaauaauaaaa

SEQ ID NO: 2258295 - RNA, 12 nt, Yersinia pestis
caccauccauag

SEQ ID NO: 2258296 - RNA, 17 nt, Yersinia pestis
caccaucgcgcugucuu

SEQ ID NO: 2258297 - RNA, 20 nt, Yersinia pestis
cacccauggagauugccuca

SEQ ID NO: 2258298 - RNA, 12 nt, Yersinia pestis
cacccauguauc

SEQ ID NO: 2258299 - RNA, 21 nt, Yersinia pestis
cacccauuuuauccucuucca

SEQ ID NO: 2258300 - RNA, 15 nt, Yersinia pestis
cacccauaccaacca

SEQ ID NO: 2258301 - RNA, 14 nt, Yersinia pestis
cacccaguaacuga

SEQ ID NO: 2258302 - RNA, 23 nt, Yersinia pestis
caccccuauuagggaacgccagc

SEQ ID NO: 2258303 - RNA, 14 nt, Yersinia pestis
cacccgcacgccca

SEQ ID NO: 2258304 - RNA, 13 nt, Yersinia pestis
caccuuccaaacu

SEQ ID NO: 2258305 - RNA, 19 nt, Yersinia pestis
caccuuccgucccaagaaa

SEQ ID NO: 2258306 - RNA, 19 nt, Yersinia pestis
caccuucuugguuaguucu

SEQ ID NO: 2258307 - RNA, 18 nt, Yersinia pestis
caccuuggaaaacagcaa

SEQ ID NO: 2258308 - RNA, 16 nt, Yersinia pestis
caccugucaccuguca

SEQ ID NO: 2258309 - RNA, 21 nt, Yersinia pestis
caccugcgagggucgcgcccu

SEQ ID NO: 2258310 - RNA, 20 nt, Yersinia pestis
caccugcuuaguuacaauaa

SEQ ID NO: 2258311 - RNA, 18 nt, Yersinia pestis
cacgaauacgauccgcua

SEQ ID NO: 2258312 - RNA, 17 nt, Yersinia pestis
cacgaauuuugaggaua

SEQ ID NO: 2258313 - RNA, 16 nt, Yersinia pestis
cacgacaugagcaugc

SEQ ID NO: 2258314 - RNA, 18 nt, Yersinia pestis
cacgaacaaucgcccccu

SEQ ID NO: 2258315 - RNA, 18 nt, Yersinia pestis
cacgacgcagcuccagcg

SEQ ID NO: 2258316 - RNA, 14 nt, Yersinia pestis
cacgaguaaugaua

SEQ ID NO: 2258317 - RNA, 18 nt, Yersinia pestis
cacgaguugguaaaauau

SEQ ID NO: 2258318 - RNA, 16 nt, Yersinia pestis
cacgacuuuuggcccc

SEQ ID NO: 2258319 - RNA, 13 nt, Yersinia pestis
caccuacaaccua

SEQ ID NO: 2258320 - RNA, 19 nt, Yersinia pestis
caccuaccaccuacaaccu

SEQ ID NO: 2258321 - RNA, 19 nt, Yersinia pestis
caccuaccaccuaccaccu

SEQ ID NO: 2258322 - RNA, 16 nt, Yersinia pestis
caccuaauccaaggcg

SEQ ID NO: 2258323 - RNA, 13 nt, Yersinia pestis
caccucaaacuga

SEQ ID NO: 2258324 - RNA, 15 nt, Yersinia pestis
caccuaacaugcuga

SEQ ID NO: 2258325 - RNA, 15 nt, Yersinia pestis
caccuaaccaaacau

SEQ ID NO: 2258326 - RNA, 19 nt, Yersinia pestis
caccuaaccaaacauuguu

SEQ ID NO: 2258327 - RNA, 16 nt, Yersinia pestis
caccuaaaaugacgau

SEQ ID NO: 2258328 - RNA, 15 nt, Yersinia pestis
caccguggcgcgcca

SEQ ID NO: 2258329 - RNA, 18 nt, Yersinia pestis
caccguggcgcgccacuu

SEQ ID NO: 2258330 - RNA, 16 nt, Yersinia pestis
caccguguuucagcau

SEQ ID NO: 2258331 - RNA, 16 nt, Yersinia pestis
caccggggauccauag

SEQ ID NO: 2258332 - RNA, 15 nt, Yersinia pestis
caccucagucaucgc

SEQ ID NO: 2258333 - RNA, 16 nt, Yersinia pestis
caccugaguaauauua

SEQ ID NO: 2258334 - RNA, 13 nt, Yersinia pestis
caccugaaccuga

SEQ ID NO: 2258335 - RNA, 16 nt, Yersinia pestis
caccugaucaugccac

SEQ ID NO: 2258336 - RNA, 21 nt, Yersinia pestis
caccugauaagccgucagcuu

SEQ ID NO: 2258337 - RNA, 15 nt, Yersinia pestis
caccgcgacuucagc

SEQ ID NO: 2258338 - RNA, 14 nt, Yersinia pestis
caccgcccccucca

SEQ ID NO: 2258339 - RNA, 20 nt, Yersinia pestis
caccgccgucaaaccaagcc

SEQ ID NO: 2258340 - RNA, 20 nt, Yersinia pestis
caccggauuuauugcucucg

SEQ ID NO: 2258341 - RNA, 14 nt, Yersinia pestis
caccggcuaaccac

SEQ ID NO: 2258342 - RNA, 23 nt, Yersinia pestis
caccggcgagaaggauugaccaa

SEQ ID NO: 2258343 - RNA, 20 nt, Yersinia pestis
caccgagcaugcuaacuugu

SEQ ID NO: 2258344 - RNA, 12 nt, Yersinia pestis
caccgagccacu

SEQ ID NO: 2258345 - RNA, 17 nt, Yersinia pestis
caccgagccacuuuaau

SEQ ID NO: 2258346 - RNA, 20 nt, Yersinia pestis
caccgaggcgggucagaaac

SEQ ID NO: 2258347 - RNA, 17 nt, Yersinia pestis
caccgagguuaucagcc

SEQ ID NO: 2258348 - RNA, 16 nt, Yersinia pestis
caccgcacacugacag

SEQ ID NO: 2258349 - RNA, 21 nt, Yersinia pestis
cacccuggcucuggccagcgu

SEQ ID NO: 2258350 - RNA, 17 nt, Yersinia pestis
caccgacaccacgauca

SEQ ID NO: 2258351 - RNA, 19 nt, Yersinia pestis
cacccucugcagcuugcaa

SEQ ID NO: 2258352 - RNA, 21 nt, Yersinia pestis
cacccucucuuuccagcaaaa

SEQ ID NO: 2258353 - RNA, 20 nt, Yersinia pestis
cacccuaaugaacgaguaaa

SEQ ID NO: 2258354 - RNA, 23 nt, Yersinia pestis
cacccguugcauuuuucuguuca

SEQ ID NO: 2258355 - RNA, 19 nt, Yersinia pestis
cacccgcuaauucaccaau

SEQ ID NO: 2258356 - RNA, 13 nt, Yersinia pestis
cacccggccaucu

SEQ ID NO: 2258357 - RNA, 22 nt, Yersinia pestis
cacuauuucguguauaucacua

SEQ ID NO: 2258358 - RNA, 12 nt, Yersinia pestis
cacuauuucaga

SEQ ID NO: 2258359 - RNA, 22 nt, Yersinia pestis
cacucaagccaguaacuacuau

SEQ ID NO: 2258360 - RNA, 19 nt, Yersinia pestis
cacucaauaaguagccacu

SEQ ID NO: 2258361 - RNA, 16 nt, Yersinia pestis
cacucacaacccgcug

SEQ ID NO: 2258362 - RNA, 17 nt, Yersinia pestis
cacucacauaagaaagu

SEQ ID NO: 2258363 - RNA, 15 nt, Yersinia pestis
cacucaauuggacua

SEQ ID NO: 2258364 - RNA, 19 nt, Yersinia pestis
cacucagauuuacccaaag

SEQ ID NO: 2258365 - RNA, 22 nt, Yersinia pestis
cacucauaauuuugaugcuaau

SEQ ID NO: 2258366 - RNA, 15 nt, Yersinia pestis
cacucaugacaaaau

SEQ ID NO: 2258367 - RNA, 15 nt, Yersinia pestis
cacucauccucuggc

SEQ ID NO: 2258368 - RNA, 15 nt, Yersinia pestis
cacuauaauuauuuc

SEQ ID NO: 2258369 - RNA, 19 nt, Yersinia pestis
cacuauaauuauuucucug

SEQ ID NO: 2258370 - RNA, 13 nt, Yersinia pestis
cacuauaggcuau

SEQ ID NO: 2258371 - RNA, 20 nt, Yersinia pestis
cacuauaggcuauuuuacuu

SEQ ID NO: 2258372 - RNA, 14 nt, Yersinia pestis
cacuacucaguugc

SEQ ID NO: 2258373 - RNA, 18 nt, Yersinia pestis
cacuacgaccccaacggc

SEQ ID NO: 2258374 - RNA, 22 nt, Yersinia pestis
cacuagggggcaauugaaaaug

SEQ ID NO: 2258375 - RNA, 18 nt, Yersinia pestis
cacuagagcguuacacau

SEQ ID NO: 2258376 - RNA, 20 nt, Yersinia pestis
cacuagagcguuacacauca

SEQ ID NO: 2258377 - RNA, 13 nt, Yersinia pestis
cacuagcgggccu

SEQ ID NO: 2258378 - RNA, 14 nt, Yersinia pestis
cacucguuguauuu

SEQ ID NO: 2258379 - RNA, 16 nt, Yersinia pestis
cacuccccgucagcau

SEQ ID NO: 2258380 - RNA, 18 nt, Yersinia pestis
cacucuguuuuaaaaaaa

SEQ ID NO: 2258381 - RNA, 17 nt, Yersinia pestis
cacucuuuuuaauuuau

SEQ ID NO: 2258382 - RNA, 21 nt, Yersinia pestis
cacugaaauaaacaagccauu

SEQ ID NO: 2258383 - RNA, 20 nt, Yersinia pestis
cacucucuucaucagucacu

SEQ ID NO: 2258384 - RNA, 12 nt, Yersinia pestis
cacucucugcuu

SEQ ID NO: 2258385 - RNA, 22 nt, Yersinia pestis
cacucuggggcaaucaauguau

SEQ ID NO: 2258386 - RNA, 14 nt, Yersinia pestis
cacucugguuuugu

SEQ ID NO: 2258387 - RNA, 17 nt, Yersinia pestis
cacucuguacguaaaua

SEQ ID NO: 2258388 - RNA, 14 nt, Yersinia pestis
cacucuguuuuaaa

SEQ ID NO: 2258389 - RNA, 15 nt, Yersinia pestis
cacucuguuuuaaaa

SEQ ID NO: 2258390 - RNA, 14 nt, Yersinia pestis
cacugaaucccaga

SEQ ID NO: 2258391 - RNA, 15 nt, Yersinia pestis
cacugacaaaaacag

SEQ ID NO: 2258392 - RNA, 14 nt, Yersinia pestis
cacugacaucauca

SEQ ID NO: 2258393 - RNA, 16 nt, Yersinia pestis
cacugaccuauugaua

SEQ ID NO: 2258394 - RNA, 19 nt, Yersinia pestis
cacugaccuauugauaaaa

SEQ ID NO: 2258395 - RNA, 19 nt, Yersinia pestis
cacugacugauguaagcuc

SEQ ID NO: 2258396 - RNA, 15 nt, Yersinia pestis
cacugagaaccgaua

SEQ ID NO: 2258397 - RNA, 12 nt, Yersinia pestis
cacugagagaac

SEQ ID NO: 2258398 - RNA, 23 nt, Yersinia pestis
cacugagagaaccauuauuaccu

SEQ ID NO: 2258399 - RNA, 20 nt, Yersinia pestis
cacugacggcagacaaccau

SEQ ID NO: 2258400 - RNA, 14 nt, Yersinia pestis
cacguucccccgcc

SEQ ID NO: 2258401 - RNA, 22 nt, Yersinia pestis
cacguucggcgucgccacccca

SEQ ID NO: 2258402 - RNA, 18 nt, Yersinia pestis
cacguugucaaaaaccca

SEQ ID NO: 2258403 - RNA, 20 nt, Yersinia pestis
cacguuuuucagcuucuucu

SEQ ID NO: 2258404 - RNA, 21 nt, Yersinia pestis
cacguugagugaucaccugag

SEQ ID NO: 2258405 - RNA, 17 nt, Yersinia pestis
cacguggguauccagug

SEQ ID NO: 2258406 - RNA, 17 nt, Yersinia pestis
cacuaauuagugacagu

SEQ ID NO: 2258407 - RNA, 15 nt, Yersinia pestis
cacuaauaauaauua

SEQ ID NO: 2258408 - RNA, 20 nt, Yersinia pestis
cacuaauaccugauguuuug

SEQ ID NO: 2258409 - RNA, 20 nt, Yersinia pestis
cacuaauacucuguuaccaa

SEQ ID NO: 2258410 - RNA, 12 nt, Yersinia pestis
cacuaauaauaa

SEQ ID NO: 2258411 - RNA, 14 nt, Yersinia pestis
cacuacauucugau

SEQ ID NO: 2258412 - RNA, 18 nt, Yersinia pestis
cacuacccgaaucacuga

SEQ ID NO: 2258413 - RNA, 20 nt, Yersinia pestis
cacuaagauucaaacaguaa

SEQ ID NO: 2258414 - RNA, 17 nt, Yersinia pestis
cacuaacgcugaggcga

SEQ ID NO: 2258415 - RNA, 22 nt, Yersinia pestis
cacggguuuuaucaacgaagaa

SEQ ID NO: 2258416 - RNA, 19 nt, Yersinia pestis
cacgguagugacucaucaa

SEQ ID NO: 2258417 - RNA, 17 nt, Yersinia pestis
cacgguauugcucucga

SEQ ID NO: 2258418 - RNA, 14 nt, Yersinia pestis
cacgguaucugcuu

SEQ ID NO: 2258419 - RNA, 15 nt, Yersinia pestis
cacgggaucaacaug

SEQ ID NO: 2258420 - RNA, 18 nt, Yersinia pestis
cacgggcgcaauggaaga

SEQ ID NO: 2258421 - RNA, 19 nt, Yersinia pestis
cacggucaugcggccuucc

SEQ ID NO: 2258422 - RNA, 14 nt, Yersinia pestis
cacgguugaaaagu

SEQ ID NO: 2258423 - RNA, 13 nt, Yersinia pestis
cacgguucacccc

SEQ ID NO: 2258424 - RNA, 16 nt, Yersinia pestis
cacgguucauuuuuag

SEQ ID NO: 2258425 - RNA, 16 nt, Yersinia pestis
cacgucaucgaagagu

SEQ ID NO: 2258426 - RNA, 16 nt, Yersinia pestis
cacgucgauaguccuu

SEQ ID NO: 2258427 - RNA, 20 nt, Yersinia pestis
cacguaccaaaucagcaagc

SEQ ID NO: 2258428 - RNA, 20 nt, Yersinia pestis
cacgguuugaucaacauggg

SEQ ID NO: 2258429 - RNA, 13 nt, Yersinia pestis
cacgcuaauuauu

SEQ ID NO: 2258430 - RNA, 13 nt, Yersinia pestis
cacgcuauauaga

SEQ ID NO: 2258431 - RNA, 21 nt, Yersinia pestis
cacgcucgcccaugaccacuu

SEQ ID NO: 2258432 - RNA, 23 nt, Yersinia pestis
cacgcugggcgaucauuuucugu

SEQ ID NO: 2258433 - RNA, 13 nt, Yersinia pestis
cacgcgaagcccu

SEQ ID NO: 2258434 - RNA, 20 nt, Yersinia pestis
cacggauuaacuuuucuuca

SEQ ID NO: 2258435 - RNA, 19 nt, Yersinia pestis
cacgcuuuaagcuaauucu

SEQ ID NO: 2258436 - RNA, 16 nt, Yersinia pestis
cacgcuguucaccgau

SEQ ID NO: 2258437 - RNA, 17 nt, Yersinia pestis
cacggccauuucuuaga

SEQ ID NO: 2258438 - RNA, 17 nt, Yersinia pestis
cacggccuauugaauaa

SEQ ID NO: 2258439 - RNA, 19 nt, Yersinia pestis
cacggccuauugaauaaca

SEQ ID NO: 2258440 - RNA, 18 nt, Yersinia pestis
cacggccgggugcagcgc

SEQ ID NO: 2258441 - RNA, 17 nt, Yersinia pestis
cacggcuaccagcagca

SEQ ID NO: 2258442 - RNA, 15 nt, Yersinia pestis
cacgaucuggcaaaa

SEQ ID NO: 2258443 - RNA, 15 nt, Yersinia pestis
cacgaucuccuccag

SEQ ID NO: 2258444 - RNA, 13 nt, Yersinia pestis
cacgauccgcuuu

SEQ ID NO: 2258445 - RNA, 16 nt, Yersinia pestis
cacgaucgaugugaua

SEQ ID NO: 2258446 - RNA, 16 nt, Yersinia pestis
cacgauaccaccacca

SEQ ID NO: 2258447 - RNA, 22 nt, Yersinia pestis
cacgauaaauucgauaaaaggc

SEQ ID NO: 2258448 - RNA, 21 nt, Yersinia pestis
cacgauagcaaugaccuuaca

SEQ ID NO: 2258449 - RNA, 16 nt, Yersinia pestis
cacgauuuaaugguuu

SEQ ID NO: 2258450 - RNA, 21 nt, Yersinia pestis
cacgcaaauaaagggccugca

SEQ ID NO: 2258451 - RNA, 12 nt, Yersinia pestis
cacgcaaauaaa

SEQ ID NO: 2258452 - RNA, 12 nt, Yersinia pestis
cacgcccaacuc

SEQ ID NO: 2258453 - RNA, 13 nt, Yersinia pestis
cacgcccaauucc

SEQ ID NO: 2258454 - RNA, 22 nt, Yersinia pestis
cacgccggcuuuuuucucuaca

SEQ ID NO: 2258455 - RNA, 21 nt, Yersinia pestis
cacgccgucuggcuaauacug

SEQ ID NO: 2258456 - RNA, 15 nt, Yersinia pestis
cacgccgaacucguc

SEQ ID NO: 2258457 - RNA, 23 nt, Yersinia pestis
auugauuaauuuuucauaauaau

SEQ ID NO: 2258458 - RNA, 22 nt, Yersinia pestis
auugaugugaaacauaauuaaa

SEQ ID NO: 2258459 - RNA, 15 nt, Yersinia pestis
auugaugcacaguag

SEQ ID NO: 2258460 - RNA, 17 nt, Yersinia pestis
auugaugagucagucug

SEQ ID NO: 2258461 - RNA, 19 nt, Yersinia pestis
auugauggccuugaaucaa

SEQ ID NO: 2258462 - RNA, 18 nt, Yersinia pestis
auugcaggaaguuaugga

SEQ ID NO: 2258463 - RNA, 15 nt, Yersinia pestis
auugauugcuuacca

SEQ ID NO: 2258464 - RNA, 17 nt, Yersinia pestis
auugcagagcaaaacug

SEQ ID NO: 2258465 - RNA, 19 nt, Yersinia pestis
auugcagagcaaaacuggg

SEQ ID NO: 2258466 - RNA, 11 nt, Yersinia pestis
auugcagauac

SEQ ID NO: 2258467 - RNA, 19 nt, Yersinia pestis
auugacaaagugccugcaa

SEQ ID NO: 2258468 - RNA, 14 nt, Yersinia pestis
auugacaaagugcc

SEQ ID NO: 2258469 - RNA, 14 nt, Yersinia pestis
auugaagauacccu

SEQ ID NO: 2258470 - RNA, 21 nt, Yersinia pestis
auugaagauacccuucucuuu

SEQ ID NO: 2258471 - RNA, 22 nt, Yersinia pestis
auugauaaaaccacugaccuau

SEQ ID NO: 2258472 - RNA, 13 nt, Yersinia pestis
auugauaaaacca

SEQ ID NO: 2258473 - RNA, 17 nt, Yersinia pestis
auugaccagauagcugu

SEQ ID NO: 2258474 - RNA, 15 nt, Yersinia pestis
auugaccaauaaaau

SEQ ID NO: 2258475 - RNA, 12 nt, Yersinia pestis
auugaccacuug

SEQ ID NO: 2258476 - RNA, 17 nt, Yersinia pestis
auugaccaauaaaaugc

SEQ ID NO: 2258477 - RNA, 15 nt, Yersinia pestis
auugaucauucucug

SEQ ID NO: 2258478 - RNA, 13 nt, Yersinia pestis
auugauacaguaa

SEQ ID NO: 2258479 - RNA, 13 nt, Yersinia pestis
auugauaccacaa

SEQ ID NO: 2258480 - RNA, 13 nt, Yersinia pestis
auugcaucuuuaa

SEQ ID NO: 2258481 - RNA, 13 nt, Yersinia pestis
auugcauauugcu

SEQ ID NO: 2258482 - RNA, 13 nt, Yersinia pestis
auugccaaaugca

SEQ ID NO: 2258483 - RNA, 18 nt, Yersinia pestis
auugccaaaugcaaacca

SEQ ID NO: 2258484 - RNA, 22 nt, Yersinia pestis
auugccaucuuguucuaauaau

SEQ ID NO: 2258485 - RNA, 14 nt, Yersinia pestis
auugcggaguaaca

SEQ ID NO: 2258486 - RNA, 19 nt, Yersinia pestis
auugcggccaguauccaga

SEQ ID NO: 2258487 - RNA, 18 nt, Yersinia pestis
auugcuggcuaucauccc

SEQ ID NO: 2258488 - RNA, 18 nt, Yersinia pestis
auugcugcuguuauuacu

SEQ ID NO: 2258489 - RNA, 23 nt, Yersinia pestis
auugcugcuguuauuacugucau

SEQ ID NO: 2258490 - RNA, 16 nt, Yersinia pestis
auugcugaugucauuc

SEQ ID NO: 2258491 - RNA, 13 nt, Yersinia pestis
auugcugaguaaa

SEQ ID NO: 2258492 - RNA, 19 nt, Yersinia pestis
auuggcgaugcgcuccgcc

SEQ ID NO: 2258493 - RNA, 24 nt, Yersinia pestis
auuggcggaagacuuccagcacca

SEQ ID NO: 2258494 - RNA, 23 nt, Yersinia pestis
auuggaaguacuuauuugaaaca

SEQ ID NO: 2258495 - RNA, 21 nt, Yersinia pestis
auucuuugguccucuuauggu

SEQ ID NO: 2258496 - RNA, 16 nt, Yersinia pestis
auucuucuaugcucac

SEQ ID NO: 2258497 - RNA, 14 nt, Yersinia pestis
auucugauagugau

SEQ ID NO: 2258498 - RNA, 19 nt, Yersinia pestis
auucugauagugauuuuuu

SEQ ID NO: 2258499 - RNA, 14 nt, Yersinia pestis
auucugaucgaguu

SEQ ID NO: 2258500 - RNA, 15 nt, Yersinia pestis
auucugccuauccuc

SEQ ID NO: 2258501 - RNA, 16 nt, Yersinia pestis
auucugccuauccuca

SEQ ID NO: 2258502 - RNA, 18 nt, Yersinia pestis
auucugccuauccucacc

SEQ ID NO: 2258503 - RNA, 17 nt, Yersinia pestis
auucggugacuaaaauc

SEQ ID NO: 2258504 - RNA, 18 nt, Yersinia pestis
auucguuagcucuucacg

SEQ ID NO: 2258505 - RNA, 18 nt, Yersinia pestis
auucgugcucaucaaccu

SEQ ID NO: 2258506 - RNA, 20 nt, Yersinia pestis
auucgugcucaucaaccuca

SEQ ID NO: 2258507 - RNA, 21 nt, Yersinia pestis
auucgugcucaucaaccucag

SEQ ID NO: 2258508 - RNA, 23 nt, Yersinia pestis
auucgugccauaaaguuuuuccu

SEQ ID NO: 2258509 - RNA, 21 nt, Yersinia pestis
auucuaccuggcucaaauuug

SEQ ID NO: 2258510 - RNA, 12 nt, Yersinia pestis
auucucaauauu

SEQ ID NO: 2258511 - RNA, 13 nt, Yersinia pestis
auucucacucuau

SEQ ID NO: 2258512 - RNA, 19 nt, Yersinia pestis
auucucaauauuaauaaug

SEQ ID NO: 2258513 - RNA, 18 nt, Yersinia pestis
auucucaauggcuuuuuu

SEQ ID NO: 2258514 - RNA, 13 nt, Yersinia pestis
auucucaucauca

SEQ ID NO: 2258515 - RNA, 20 nt, Yersinia pestis
auucccaaagcgcagugcuc

SEQ ID NO: 2258516 - RNA, 19 nt, Yersinia pestis
auuccacauaaaauagccc

SEQ ID NO: 2258517 - RNA, 23 nt, Yersinia pestis
auuccagcggcgcugacuggcag

SEQ ID NO: 2258518 - RNA, 21 nt, Yersinia pestis
auucauuuugcuggaaaagua

SEQ ID NO: 2258519 - RNA, 19 nt, Yersinia pestis
auuccaaccuuguaacuuu

SEQ ID NO: 2258520 - RNA, 20 nt, Yersinia pestis
auuccacagaguauacauaa

SEQ ID NO: 2258521 - RNA, 16 nt, Yersinia pestis
auuccacaaauuuuua

SEQ ID NO: 2258522 - RNA, 18 nt, Yersinia pestis
auuccacaaauuuuuacc

SEQ ID NO: 2258523 - RNA, 13 nt, Yersinia pestis
auucauuuuaaaa

SEQ ID NO: 2258524 - RNA, 17 nt, Yersinia pestis
auucauuuuaaaaaaau

SEQ ID NO: 2258525 - RNA, 13 nt, Yersinia pestis
auucauugagcaa

SEQ ID NO: 2258526 - RNA, 17 nt, Yersinia pestis
auucauuauuacucagc

SEQ ID NO: 2258527 - RNA, 19 nt, Yersinia pestis
auucaucuuuaacaacaac

SEQ ID NO: 2258528 - RNA, 14 nt, Yersinia pestis
auucaucuagcuua

SEQ ID NO: 2258529 - RNA, 18 nt, Yersinia pestis
auucaugcuaauaccaca

SEQ ID NO: 2258530 - RNA, 19 nt, Yersinia pestis
auucaugcuaauaccacaa

SEQ ID NO: 2258531 - RNA, 22 nt, Yersinia pestis
auucaugcuaauaccacaacau

SEQ ID NO: 2258532 - RNA, 12 nt, Yersinia pestis
auucauaucuuu

SEQ ID NO: 2258533 - RNA, 20 nt, Yersinia pestis
auucaucagcaauuugcuug

SEQ ID NO: 2258534 - RNA, 15 nt, Yersinia pestis
auucaucccuaaaau

SEQ ID NO: 2258535 - RNA, 18 nt, Yersinia pestis
auucaucggcgucaaggu

SEQ ID NO: 2258536 - RNA, 12 nt, Yersinia pestis
auucaucaccag

SEQ ID NO: 2258537 - RNA, 14 nt, Yersinia pestis
auucauaguuaaga

SEQ ID NO: 2258538 - RNA, 16 nt, Yersinia pestis
auucauaguuaagaca

SEQ ID NO: 2258539 - RNA, 17 nt, Yersinia pestis
auucauaccuguacuuu

SEQ ID NO: 2258540 - RNA, 19 nt, Yersinia pestis
auucauaccgcagauaaaa

SEQ ID NO: 2258541 - RNA, 16 nt, Yersinia pestis
auguucuuccugugcg

SEQ ID NO: 2258542 - RNA, 12 nt, Yersinia pestis
auguucugccaa

SEQ ID NO: 2258543 - RNA, 16 nt, Yersinia pestis
auguugaccaaacaga

SEQ ID NO: 2258544 - RNA, 18 nt, Yersinia pestis
auguugccaaugggccaa

SEQ ID NO: 2258545 - RNA, 15 nt, Yersinia pestis
auuccguuuaaacuc

SEQ ID NO: 2258546 - RNA, 16 nt, Yersinia pestis
auuccuauaaauuuua

SEQ ID NO: 2258547 - RNA, 22 nt, Yersinia pestis
auuccgucgauaucuaagucca

SEQ ID NO: 2258548 - RNA, 23 nt, Yersinia pestis
auuccgcgagcaauaccaaaaau

SEQ ID NO: 2258549 - RNA, 16 nt, Yersinia pestis
auuccccaccauugca

SEQ ID NO: 2258550 - RNA, 21 nt, Yersinia pestis
auuccccaccauugcaaacau

SEQ ID NO: 2258551 - RNA, 16 nt, Yersinia pestis
auucccccaaaaccuc

SEQ ID NO: 2258552 - RNA, 16 nt, Yersinia pestis
auucccccaguagcac

SEQ ID NO: 2258553 - RNA, 15 nt, Yersinia pestis
auucccgccagguuu

SEQ ID NO: 2258554 - RNA, 14 nt, Yersinia pestis
auucgacuguuuuu

SEQ ID NO: 2258555 - RNA, 14 nt, Yersinia pestis
auucgaugauuuau

SEQ ID NO: 2258556 - RNA, 22 nt, Yersinia pestis
auucgcacaguuuucuuaaaau

SEQ ID NO: 2258557 - RNA, 19 nt, Yersinia pestis
auucgcggaacaacgccuc

SEQ ID NO: 2258558 - RNA, 18 nt, Yersinia pestis
auucgccugauaaaauua

SEQ ID NO: 2258559 - RNA, 15 nt, Yersinia pestis
auucgcgaccagcag

SEQ ID NO: 2258560 - RNA, 18 nt, Yersinia pestis
auucgggaucaugaugau

SEQ ID NO: 2258561 - RNA, 12 nt, Yersinia pestis
auuucacuuucc

SEQ ID NO: 2258562 - RNA, 13 nt, Yersinia pestis
auuucacuuuccc

SEQ ID NO: 2258563 - RNA, 15 nt, Yersinia pestis
auuucacuuucccgg

SEQ ID NO: 2258564 - RNA, 11 nt, Yersinia pestis
auuucagggcg

SEQ ID NO: 2258565 - RNA, 22 nt, Yersinia pestis
auuucagggcguauaaacagag

SEQ ID NO: 2258566 - RNA, 15 nt, Yersinia pestis
auuucagucaauaaa

SEQ ID NO: 2258567 - RNA, 19 nt, Yersinia pestis
auuucagucaauaaacauu

SEQ ID NO: 2258568 - RNA, 19 nt, Yersinia pestis
auuucacguucaucaauac

SEQ ID NO: 2258569 - RNA, 21 nt, Yersinia pestis
auuucacgcugguuaagcauu

SEQ ID NO: 2258570 - RNA, 13 nt, Yersinia pestis
auuucacguucau

SEQ ID NO: 2258571 - RNA, 17 nt, Yersinia pestis
auuucacuggcaccgcu

SEQ ID NO: 2258572 - RNA, 16 nt, Yersinia pestis
auuucacuuccauucc

SEQ ID NO: 2258573 - RNA, 19 nt, Yersinia pestis
auuucacugugcuuuucuu

SEQ ID NO: 2258574 - RNA, 17 nt, Yersinia pestis
auuucacgcuaauuauu

SEQ ID NO: 2258575 - RNA, 17 nt, Yersinia pestis
auuucaccuauaauuaa

SEQ ID NO: 2258576 - RNA, 19 nt, Yersinia pestis
auuucaccgagaucaccua

SEQ ID NO: 2258577 - RNA, 14 nt, Yersinia pestis
auuucacacuguuu

SEQ ID NO: 2258578 - RNA, 20 nt, Yersinia pestis
auuucacacuguuuaguuca

SEQ ID NO: 2258579 - RNA, 23 nt, Yersinia pestis
auuuaugcaccaaauucagaaug

SEQ ID NO: 2258580 - RNA, 13 nt, Yersinia pestis
auuuaugaacacu

SEQ ID NO: 2258581 - RNA, 21 nt, Yersinia pestis
auuuccuccgcuuuagcugua

SEQ ID NO: 2258582 - RNA, 14 nt, Yersinia pestis
auuuccuguauuuc

SEQ ID NO: 2258583 - RNA, 16 nt, Yersinia pestis
auuuccuguauuuccu

SEQ ID NO: 2258584 - RNA, 17 nt, Yersinia pestis
auuuccuguauuuccug

SEQ ID NO: 2258585 - RNA, 21 nt, Yersinia pestis
auuuccuuucgcacuuuaaau

SEQ ID NO: 2258586 - RNA, 23 nt, Yersinia pestis
auuuccuuucgcacuuuaaauac

SEQ ID NO: 2258587 - RNA, 21 nt, Yersinia pestis
auuuccuuguggauccagcac

SEQ ID NO: 2258588 - RNA, 22 nt, Yersinia pestis
auuuccuuguggauccagcacc

SEQ ID NO: 2258589 - RNA, 21 nt, Yersinia pestis
auuucgacggcgggguuuuca

SEQ ID NO: 2258590 - RNA, 14 nt, Yersinia pestis
auuucgaagcaguc

SEQ ID NO: 2258591 - RNA, 14 nt, Yersinia pestis
auuucgaaaacuca

SEQ ID NO: 2258592 - RNA, 19 nt, Yersinia pestis
auuucgcccugcauaucau

SEQ ID NO: 2258593 - RNA, 23 nt, Yersinia pestis
auuuccaucugcaauaacgugau

SEQ ID NO: 2258594 - RNA, 11 nt, Yersinia pestis
auuuccgaaag

SEQ ID NO: 2258595 - RNA, 22 nt, Yersinia pestis
auuuccgccccuugcuucaguu

SEQ ID NO: 2258596 - RNA, 23 nt, Yersinia pestis
auuuccgguaacugacgcagcgu

SEQ ID NO: 2258597 - RNA, 16 nt, Yersinia pestis
auuuccguuaacccaa

SEQ ID NO: 2258598 - RNA, 17 nt, Yersinia pestis
auuuccguuaacccaaa

SEQ ID NO: 2258599 - RNA, 12 nt, Yersinia pestis
auugguuaaguu

SEQ ID NO: 2258600 - RNA, 14 nt, Yersinia pestis
auugguuaacuuau

SEQ ID NO: 2258601 - RNA, 20 nt, Yersinia pestis
auugguguuacagcaaggca

SEQ ID NO: 2258602 - RNA, 15 nt, Yersinia pestis
auuggucaauaaaau

SEQ ID NO: 2258603 - RNA, 21 nt, Yersinia pestis
auuggucaugaugaauacgau

SEQ ID NO: 2258604 - RNA, 12 nt, Yersinia pestis
auuuaaaauacu

SEQ ID NO: 2258605 - RNA, 20 nt, Yersinia pestis
auuguuuucguuuaaaaaau

SEQ ID NO: 2258606 - RNA, 20 nt, Yersinia pestis
auuuaagcugaaauuuuuua

SEQ ID NO: 2258607 - RNA, 18 nt, Yersinia pestis
auuuaagcugaaauuuuu

SEQ ID NO: 2258608 - RNA, 19 nt, Yersinia pestis
auuuaagcugaaauuuuuu

SEQ ID NO: 2258609 - RNA, 19 nt, Yersinia pestis
auuuaacuuuaaauccauc

SEQ ID NO: 2258610 - RNA, 12 nt, Yersinia pestis
auuuaagaaauc

SEQ ID NO: 2258611 - RNA, 20 nt, Yersinia pestis
auuuaaacagccguauaucu

SEQ ID NO: 2258612 - RNA, 18 nt, Yersinia pestis
auuuaauuuauccaacug

SEQ ID NO: 2258613 - RNA, 20 nt, Yersinia pestis
auuuaauuuaaauaaaauaa

SEQ ID NO: 2258614 - RNA, 21 nt, Yersinia pestis
auuuacaaaccacauuuuuua

SEQ ID NO: 2258615 - RNA, 14 nt, Yersinia pestis
auuuacaaaccaua

SEQ ID NO: 2258616 - RNA, 19 nt, Yersinia pestis
auuuaauuuaugauuaaau

SEQ ID NO: 2258617 - RNA, 15 nt, Yersinia pestis
auuuaaugguuucca

SEQ ID NO: 2258618 - RNA, 13 nt, Yersinia pestis
auuuaauuaaaug

SEQ ID NO: 2258619 - RNA, 16 nt, Yersinia pestis
auuuaauuaaaugacu

SEQ ID NO: 2258620 - RNA, 16 nt, Yersinia pestis
auuuacauaauaacca

SEQ ID NO: 2258621 - RNA, 21 nt, Yersinia pestis
auuuacaccgugcaauagcua

SEQ ID NO: 2258622 - RNA, 22 nt, Yersinia pestis
auuuaccgacagcaucuagcag

SEQ ID NO: 2258623 - RNA, 12 nt, Yersinia pestis
auuuaccacuau

SEQ ID NO: 2258624 - RNA, 19 nt, Yersinia pestis
auuuaccugcucaacugcu

SEQ ID NO: 2258625 - RNA, 17 nt, Yersinia pestis
auuuaccgucuuuuugg

SEQ ID NO: 2258626 - RNA, 20 nt, Yersinia pestis
auuuacugcauucugagcac

SEQ ID NO: 2258627 - RNA, 19 nt, Yersinia pestis
auuuauaucaguugugggu

SEQ ID NO: 2258628 - RNA, 16 nt, Yersinia pestis
auuuauauaguaacua

SEQ ID NO: 2258629 - RNA, 21 nt, Yersinia pestis
auuuaucauauuaacauauca

SEQ ID NO: 2258630 - RNA, 14 nt, Yersinia pestis
auuuaucaguagcu

SEQ ID NO: 2258631 - RNA, 22 nt, Yersinia pestis
auuuacugguaccaaacaacaa

SEQ ID NO: 2258632 - RNA, 17 nt, Yersinia pestis
auuuagcuggcugaacg

SEQ ID NO: 2258633 - RNA, 16 nt, Yersinia pestis
auuuagccauucaaaa

SEQ ID NO: 2258634 - RNA, 20 nt, Yersinia pestis
auuuagcgugacacugucac

SEQ ID NO: 2258635 - RNA, 22 nt, Yersinia pestis
auuuggagguguauuuuuaugg

SEQ ID NO: 2258636 - RNA, 21 nt, Yersinia pestis
auuuggugguugaaauaacug

SEQ ID NO: 2258637 - RNA, 16 nt, Yersinia pestis
auuuuaauuauaaucc

SEQ ID NO: 2258638 - RNA, 14 nt, Yersinia pestis
auuugcagaaagua

SEQ ID NO: 2258639 - RNA, 11 nt, Yersinia pestis
auuugcagcgg

SEQ ID NO: 2258640 - RNA, 15 nt, Yersinia pestis
auuugcuucguuucc

SEQ ID NO: 2258641 - RNA, 19 nt, Yersinia pestis
auuugacauggauugugaa

SEQ ID NO: 2258642 - RNA, 23 nt, Yersinia pestis
auuugacgcuguauacccgccgc

SEQ ID NO: 2258643 - RNA, 23 nt, Yersinia pestis
auuugagauauaggcaucuuuca

SEQ ID NO: 2258644 - RNA, 15 nt, Yersinia pestis
auuugcacauagccc

SEQ ID NO: 2258645 - RNA, 17 nt, Yersinia pestis
auuucgugauuuucuuu

SEQ ID NO: 2258646 - RNA, 21 nt, Yersinia pestis
auuucuaccaguuuuuuccug

SEQ ID NO: 2258647 - RNA, 18 nt, Yersinia pestis
auuucgguuugucauauc

SEQ ID NO: 2258648 - RNA, 15 nt, Yersinia pestis
auuucggcuauuuca

SEQ ID NO: 2258649 - RNA, 21 nt, Yersinia pestis
auuucucugaugaacggagau

SEQ ID NO: 2258650 - RNA, 16 nt, Yersinia pestis
auuucucuguauuuuc

SEQ ID NO: 2258651 - RNA, 19 nt, Yersinia pestis
auuucuaguggcaacggaa

SEQ ID NO: 2258652 - RNA, 22 nt, Yersinia pestis
auuucuuuugcuguauuuuucg

SEQ ID NO: 2258653 - RNA, 20 nt, Yersinia pestis
auuucuuuaaggaucuuuca

SEQ ID NO: 2258654 - RNA, 20 nt, Yersinia pestis
auuucugguuugaauccagu

SEQ ID NO: 2258655 - RNA, 16 nt, Yersinia pestis
auuucuguuccaggca

SEQ ID NO: 2258656 - RNA, 16 nt, Yersinia pestis
auuuuuagaaaacauu

SEQ ID NO: 2258657 - RNA, 19 nt, Yersinia pestis
auuuuuacgauaucaccag

SEQ ID NO: 2258658 - RNA, 21 nt, Yersinia pestis
auuuuuacgauaucaccaggu

SEQ ID NO: 2258659 - RNA, 22 nt, Yersinia pestis
auuuuuaguauuggaaaaauca

SEQ ID NO: 2258660 - RNA, 14 nt, Yersinia pestis
auuuuuaauaaugu

SEQ ID NO: 2258661 - RNA, 11 nt, Yersinia pestis
auuuuuacauu

SEQ ID NO: 2258662 - RNA, 13 nt, Yersinia pestis
auuuuuacauucc

SEQ ID NO: 2258663 - RNA, 17 nt, Yersinia pestis
auuuuggguuugagcag

SEQ ID NO: 2258664 - RNA, 17 nt, Yersinia pestis
auuuugggcuugagcag

SEQ ID NO: 2258665 - RNA, 16 nt, Yersinia pestis
auuuugggcuaaaacu

SEQ ID NO: 2258666 - RNA, 13 nt, Yersinia pestis
auuuucuauacca

SEQ ID NO: 2258667 - RNA, 14 nt, Yersinia pestis
auuuucuauaccaa

SEQ ID NO: 2258668 - RNA, 19 nt, Yersinia pestis
auuuucuauaccaauugau

SEQ ID NO: 2258669 - RNA, 23 nt, Yersinia pestis
auuuucuaucucauccagcaacu

SEQ ID NO: 2258670 - RNA, 15 nt, Yersinia pestis
auuuugcggaucaca

SEQ ID NO: 2258671 - RNA, 16 nt, Yersinia pestis
auuuucauuuuaacaa

SEQ ID NO: 2258672 - RNA, 15 nt, Yersinia pestis
auuuucauuuuaaca

SEQ ID NO: 2258673 - RNA, 14 nt, Yersinia pestis
auuuucccuuucuc

SEQ ID NO: 2258674 - RNA, 19 nt, Yersinia pestis
auuuucggucauacacaug

SEQ ID NO: 2258675 - RNA, 20 nt, Yersinia pestis
auuuuccgcagcucaccuag

SEQ ID NO: 2258676 - RNA, 21 nt, Yersinia pestis
auuuucccugugcaaucaagg

SEQ ID NO: 2258677 - RNA, 16 nt, Yersinia pestis
auuuuccaguuucauc

SEQ ID NO: 2258678 - RNA, 19 nt, Yersinia pestis
auuuuauaaugagaaugua

SEQ ID NO: 2258679 - RNA, 21 nt, Yersinia pestis
auuuuauaaugagaauguaaa

SEQ ID NO: 2258680 - RNA, 16 nt, Yersinia pestis
auuuuaguuuuauacc

SEQ ID NO: 2258681 - RNA, 19 nt, Yersinia pestis
auuuuauauugauaaaaau

SEQ ID NO: 2258682 - RNA, 17 nt, Yersinia pestis
auuuuauauugaugacu

SEQ ID NO: 2258683 - RNA, 20 nt, Yersinia pestis
auuuuauauugaugacugaa

SEQ ID NO: 2258684 - RNA, 21 nt, Yersinia pestis
auuuuauccucuuccaauugg

SEQ ID NO: 2258685 - RNA, 20 nt, Yersinia pestis
auuuuaucgugaauaaaaau

SEQ ID NO: 2258686 - RNA, 19 nt, Yersinia pestis
caacaucaauggcaccuca

SEQ ID NO: 2258687 - RNA, 19 nt, Yersinia pestis
caacaucacauccgaucag

SEQ ID NO: 2258688 - RNA, 18 nt, Yersinia pestis
caacauaguugaauaacu

SEQ ID NO: 2258689 - RNA, 14 nt, Yersinia pestis
caacaucaaaugaa

SEQ ID NO: 2258690 - RNA, 23 nt, Yersinia pestis
caaccuguuguggaauuaccaca

SEQ ID NO: 2258691 - RNA, 22 nt, Yersinia pestis
caaccuugggggaccagcacau

SEQ ID NO: 2258692 - RNA, 18 nt, Yersinia pestis
caaccuugaucaaaaacg

SEQ ID NO: 2258693 - RNA, 16 nt, Yersinia pestis
caaccugcgccaccca

SEQ ID NO: 2258694 - RNA, 18 nt, Yersinia pestis
caaccuguagcucauacu

SEQ ID NO: 2258695 - RNA, 19 nt, Yersinia pestis
caaccuguagcucauacuc

SEQ ID NO: 2258696 - RNA, 14 nt, Yersinia pestis
caacgacagccaaa

SEQ ID NO: 2258697 - RNA, 17 nt, Yersinia pestis
caacgaccucaucaccc

SEQ ID NO: 2258698 - RNA, 17 nt, Yersinia pestis
caacgacagcaacaaca

SEQ ID NO: 2258699 - RNA, 17 nt, Yersinia pestis
caacgaaggcaacaaca

SEQ ID NO: 2258700 - RNA, 20 nt, Yersinia pestis
caaccuuuuccgccaugaga

SEQ ID NO: 2258701 - RNA, 22 nt, Yersinia pestis
caaccuuuuccgccaugagaac

SEQ ID NO: 2258702 - RNA, 21 nt, Yersinia pestis
caacgaaaugucgaaagauag

SEQ ID NO: 2258703 - RNA, 16 nt, Yersinia pestis
caacgcagacaugauu

SEQ ID NO: 2258704 - RNA, 21 nt, Yersinia pestis
caacgcaggcacugcagaaaa

SEQ ID NO: 2258705 - RNA, 13 nt, Yersinia pestis
caacgcacacccc

SEQ ID NO: 2258706 - RNA, 14 nt, Yersinia pestis
caacgcacaccccc

SEQ ID NO: 2258707 - RNA, 15 nt, Yersinia pestis
caacgugguuuauuu

SEQ ID NO: 2258708 - RNA, 15 nt, Yersinia pestis
caacguuaaaccccc

SEQ ID NO: 2258709 - RNA, 15 nt, Yersinia pestis
caacguuaguuugag

SEQ ID NO: 2258710 - RNA, 18 nt, Yersinia pestis
caacuauugcaucuuuaa

SEQ ID NO: 2258711 - RNA, 14 nt, Yersinia pestis
caacucaaaacaau

SEQ ID NO: 2258712 - RNA, 22 nt, Yersinia pestis
caacuauugcaucuuuaauuaa

SEQ ID NO: 2258713 - RNA, 22 nt, Yersinia pestis
caacuaaacagggcagaaaaua

SEQ ID NO: 2258714 - RNA, 18 nt, Yersinia pestis
caacucgagcauuugacc

SEQ ID NO: 2258715 - RNA, 16 nt, Yersinia pestis
caacucgaauuauuuu

SEQ ID NO: 2258716 - RNA, 20 nt, Yersinia pestis
caacuccugccuacgcuggc

SEQ ID NO: 2258717 - RNA, 22 nt, Yersinia pestis
caacuccuuaccacugcucacu

SEQ ID NO: 2258718 - RNA, 17 nt, Yersinia pestis
caacuccuuaccacugc

SEQ ID NO: 2258719 - RNA, 23 nt, Yersinia pestis
caacgcauuaccccguugcucua

SEQ ID NO: 2258720 - RNA, 14 nt, Yersinia pestis
caacgguaaaaggu

SEQ ID NO: 2258721 - RNA, 16 nt, Yersinia pestis
caacgguaaaagguua

SEQ ID NO: 2258722 - RNA, 19 nt, Yersinia pestis
caacgggguauuuaacccg

SEQ ID NO: 2258723 - RNA, 22 nt, Yersinia pestis
caacguaacaugcagcccgacc

SEQ ID NO: 2258724 - RNA, 15 nt, Yersinia pestis
caagaagauaacuuu

SEQ ID NO: 2258725 - RNA, 16 nt, Yersinia pestis
caagaagauaacuuuu

SEQ ID NO: 2258726 - RNA, 18 nt, Yersinia pestis
caagaaccgaaauaucau

SEQ ID NO: 2258727 - RNA, 23 nt, Yersinia pestis
caagaaccugucgcagaaaacag

SEQ ID NO: 2258728 - RNA, 18 nt, Yersinia pestis
caagaaauuuaaaaaccc

SEQ ID NO: 2258729 - RNA, 19 nt, Yersinia pestis
caagaaagaaaaauagacu

SEQ ID NO: 2258730 - RNA, 22 nt, Yersinia pestis
caagaaacuucauuucagguaa

SEQ ID NO: 2258731 - RNA, 13 nt, Yersinia pestis
caacuugcuggca

SEQ ID NO: 2258732 - RNA, 12 nt, Yersinia pestis
caacuucuucau

SEQ ID NO: 2258733 - RNA, 11 nt, Yersinia pestis
caacuucuuca

SEQ ID NO: 2258734 - RNA, 14 nt, Yersinia pestis
caagaaaagcaccg

SEQ ID NO: 2258735 - RNA, 19 nt, Yersinia pestis
caacuuucucuuuccucuu

SEQ ID NO: 2258736 - RNA, 22 nt, Yersinia pestis
caacuuucucuuuccucuucuc

SEQ ID NO: 2258737 - RNA, 21 nt, Yersinia pestis
caacuuuggcaaagucaucaa

SEQ ID NO: 2258738 - RNA, 16 nt, Yersinia pestis
caacuuuggccaccgc

SEQ ID NO: 2258739 - RNA, 22 nt, Yersinia pestis
caagagcgauaaccgcacugag

SEQ ID NO: 2258740 - RNA, 15 nt, Yersinia pestis
caagagugagucauc

SEQ ID NO: 2258741 - RNA, 20 nt, Yersinia pestis
caagauagaaccaugagaau

SEQ ID NO: 2258742 - RNA, 17 nt, Yersinia pestis
caagaucacaugacuga

SEQ ID NO: 2258743 - RNA, 13 nt, Yersinia pestis
caagaugcauauu

SEQ ID NO: 2258744 - RNA, 15 nt, Yersinia pestis
caagaugcgugaaau

SEQ ID NO: 2258745 - RNA, 17 nt, Yersinia pestis
caagacucaguaaauau

SEQ ID NO: 2258746 - RNA, 19 nt, Yersinia pestis
caagacucaguaaauauaa

SEQ ID NO: 2258747 - RNA, 17 nt, Yersinia pestis
caagacuuuccacaaca

SEQ ID NO: 2258748 - RNA, 20 nt, Yersinia pestis
caagagaaacccauagcaaa

SEQ ID NO: 2258749 - RNA, 16 nt, Yersinia pestis
caagagaaaugcacuu

SEQ ID NO: 2258750 - RNA, 23 nt, Yersinia pestis
caagaaugucaugguuaaacuga

SEQ ID NO: 2258751 - RNA, 14 nt, Yersinia pestis
caagacagaacuua

SEQ ID NO: 2258752 - RNA, 16 nt, Yersinia pestis
caaucaauacacuggc

SEQ ID NO: 2258753 - RNA, 17 nt, Yersinia pestis
caaucaagcaauaauug

SEQ ID NO: 2258754 - RNA, 15 nt, Yersinia pestis
caauauguuuguuga

SEQ ID NO: 2258755 - RNA, 15 nt, Yersinia pestis
caaucacauccccug

SEQ ID NO: 2258756 - RNA, 19 nt, Yersinia pestis
caaucaauguauugcucca

SEQ ID NO: 2258757 - RNA, 17 nt, Yersinia pestis
caaucaauugcccccau

SEQ ID NO: 2258758 - RNA, 19 nt, Yersinia pestis
caauagcauaaauaucagu

SEQ ID NO: 2258759 - RNA, 15 nt, Yersinia pestis
caauaccuuacugca

SEQ ID NO: 2258760 - RNA, 19 nt, Yersinia pestis
caauaccuuacuguaucaa

SEQ ID NO: 2258761 - RNA, 22 nt, Yersinia pestis
caauaccuuacuguaucaauac

SEQ ID NO: 2258762 - RNA, 16 nt, Yersinia pestis
caauagaaaaacacug

SEQ ID NO: 2258763 - RNA, 13 nt, Yersinia pestis
caauauaagagaa

SEQ ID NO: 2258764 - RNA, 18 nt, Yersinia pestis
caauauaaggcuuuauau

SEQ ID NO: 2258765 - RNA, 16 nt, Yersinia pestis
caauauaauaaucuau

SEQ ID NO: 2258766 - RNA, 21 nt, Yersinia pestis
caauauaggcgucaucagcau

SEQ ID NO: 2258767 - RNA, 15 nt, Yersinia pestis
caauaucuuugucug

SEQ ID NO: 2258768 - RNA, 15 nt, Yersinia pestis
caauaugaaauuuca

SEQ ID NO: 2258769 - RNA, 17 nt, Yersinia pestis
caauaugaaauuucacu

SEQ ID NO: 2258770 - RNA, 13 nt, Yersinia pestis
caauaucaacgcc

SEQ ID NO: 2258771 - RNA, 15 nt, Yersinia pestis
caauaaucucagcau

SEQ ID NO: 2258772 - RNA, 18 nt, Yersinia pestis
caauaauuaauuucacug

SEQ ID NO: 2258773 - RNA, 14 nt, Yersinia pestis
caauacauagaagc

SEQ ID NO: 2258774 - RNA, 15 nt, Yersinia pestis
caauaccaacgguag

SEQ ID NO: 2258775 - RNA, 16 nt, Yersinia pestis
caauaccgccaauauc

SEQ ID NO: 2258776 - RNA, 16 nt, Yersinia pestis
caauaccgccacacaa

SEQ ID NO: 2258777 - RNA, 20 nt, Yersinia pestis
caaguucagcaucccagcca

SEQ ID NO: 2258778 - RNA, 18 nt, Yersinia pestis
caaguuguggauccagca

SEQ ID NO: 2258779 - RNA, 17 nt, Yersinia pestis
caaguugcugagauauc

SEQ ID NO: 2258780 - RNA, 15 nt, Yersinia pestis
caauaaccucagggc

SEQ ID NO: 2258781 - RNA, 23 nt, Yersinia pestis
caauaaccucacacgauuuuuac

SEQ ID NO: 2258782 - RNA, 15 nt, Yersinia pestis
caauaaccucagccu

SEQ ID NO: 2258783 - RNA, 16 nt, Yersinia pestis
caauaacuauuuuuga

SEQ ID NO: 2258784 - RNA, 16 nt, Yersinia pestis
caauaacguguuuauc

SEQ ID NO: 2258785 - RNA, 17 nt, Yersinia pestis
caauaacguuuaccgcu

SEQ ID NO: 2258786 - RNA, 17 nt, Yersinia pestis
caagucuugaagaguga

SEQ ID NO: 2258787 - RNA, 14 nt, Yersinia pestis
caaguccugcuuca

SEQ ID NO: 2258788 - RNA, 12 nt, Yersinia pestis
caagugcuucaa

SEQ ID NO: 2258789 - RNA, 23 nt, Yersinia pestis
caagugcuucaaauccucggguu

SEQ ID NO: 2258790 - RNA, 18 nt, Yersinia pestis
caaguuacuucaagaugu

SEQ ID NO: 2258791 - RNA, 13 nt, Yersinia pestis
caaggcuuucugg

SEQ ID NO: 2258792 - RNA, 19 nt, Yersinia pestis
caaggcucuggcaauggcu

SEQ ID NO: 2258793 - RNA, 16 nt, Yersinia pestis
caagucccgccccggg

SEQ ID NO: 2258794 - RNA, 17 nt, Yersinia pestis
caaguaaaagucagcaa

SEQ ID NO: 2258795 - RNA, 19 nt, Yersinia pestis
caaguaauaaaaacacaau

SEQ ID NO: 2258796 - RNA, 14 nt, Yersinia pestis
caagcugcauguac

SEQ ID NO: 2258797 - RNA, 14 nt, Yersinia pestis
caagcugugccuga

SEQ ID NO: 2258798 - RNA, 15 nt, Yersinia pestis
caagcugugccugag

SEQ ID NO: 2258799 - RNA, 17 nt, Yersinia pestis
caaggauggggcugcca

SEQ ID NO: 2258800 - RNA, 22 nt, Yersinia pestis
caagcuuuugccacauuucccu

SEQ ID NO: 2258801 - RNA, 21 nt, Yersinia pestis
caagcuucaauuugacgcugu

SEQ ID NO: 2258802 - RNA, 15 nt, Yersinia pestis
caagcuacggccugu

SEQ ID NO: 2258803 - RNA, 23 nt, Yersinia pestis
caagcuacggccuguaccaccac

SEQ ID NO: 2258804 - RNA, 19 nt, Yersinia pestis
caagcaagcggcagcgcug

SEQ ID NO: 2258805 - RNA, 20 nt, Yersinia pestis
caagcaaccuuguuuuaucg

SEQ ID NO: 2258806 - RNA, 15 nt, Yersinia pestis
caagauggucauaaa

SEQ ID NO: 2258807 - RNA, 19 nt, Yersinia pestis
caagauugggaucaacgcc

SEQ ID NO: 2258808 - RNA, 15 nt, Yersinia pestis
caacauaaguaauaa

SEQ ID NO: 2258809 - RNA, 17 nt, Yersinia pestis
caacauaaguaauaagu

SEQ ID NO: 2258810 - RNA, 14 nt, Yersinia pestis
caacauaaguaaua

SEQ ID NO: 2258811 - RNA, 21 nt, Yersinia pestis
caacagugcaacauuaaaaau

SEQ ID NO: 2258812 - RNA, 20 nt, Yersinia pestis
caacagugcucgcaaacgau

SEQ ID NO: 2258813 - RNA, 21 nt, Yersinia pestis
caacagugcucgcaaacgauc

SEQ ID NO: 2258814 - RNA, 19 nt, Yersinia pestis
caacagucacaccaacacu

SEQ ID NO: 2258815 - RNA, 12 nt, Yersinia pestis
caacaagccucg

SEQ ID NO: 2258816 - RNA, 18 nt, Yersinia pestis
caacaacucgaauuauuu

SEQ ID NO: 2258817 - RNA, 17 nt, Yersinia pestis
caacaacggugaacaga

SEQ ID NO: 2258818 - RNA, 18 nt, Yersinia pestis
caacaacgccucaucuuc

SEQ ID NO: 2258819 - RNA, 15 nt, Yersinia pestis
caacacccaacucaa

SEQ ID NO: 2258820 - RNA, 18 nt, Yersinia pestis
caacacccgaccagacaa

SEQ ID NO: 2258821 - RNA, 20 nt, Yersinia pestis
caaauccuguagcucagccu

SEQ ID NO: 2258822 - RNA, 20 nt, Yersinia pestis
caaaucugcccccagcgugc

SEQ ID NO: 2258823 - RNA, 22 nt, Yersinia pestis
caaaucugacgguuauuuucug

SEQ ID NO: 2258824 - RNA, 13 nt, Yersinia pestis
caaaucugcuccc

SEQ ID NO: 2258825 - RNA, 20 nt, Yersinia pestis
caaaucuugugaugcauauu

SEQ ID NO: 2258826 - RNA, 11 nt, Yersinia pestis
caaaugaaaaa

SEQ ID NO: 2258827 - RNA, 12 nt, Yersinia pestis
caaaugaacuau

SEQ ID NO: 2258828 - RNA, 17 nt, Yersinia pestis
caaaugaacuaucgccu

SEQ ID NO: 2258829 - RNA, 22 nt, Yersinia pestis
caaauggaauaaaaagucagcu

SEQ ID NO: 2258830 - RNA, 22 nt, Yersinia pestis
caaaugggccacaggcugcaug

SEQ ID NO: 2258831 - RNA, 13 nt, Yersinia pestis
caaaugucagauc

SEQ ID NO: 2258832 - RNA, 20 nt, Yersinia pestis
caaaugucagaucgcgaugc

SEQ ID NO: 2258833 - RNA, 14 nt, Yersinia pestis
caaauuuuuuauau

SEQ ID NO: 2258834 - RNA, 15 nt, Yersinia pestis
caaauuuuuccuuua

SEQ ID NO: 2258835 - RNA, 20 nt, Yersinia pestis
caacaaacaguucauaucga

SEQ ID NO: 2258836 - RNA, 16 nt, Yersinia pestis
caaauacggcgaaaua

SEQ ID NO: 2258837 - RNA, 20 nt, Yersinia pestis
caaauacggcgaaauauaaa

SEQ ID NO: 2258838 - RNA, 23 nt, Yersinia pestis
caaauacgaccgucaccaaauag

SEQ ID NO: 2258839 - RNA, 19 nt, Yersinia pestis
caaauaccgggacuaccaa

SEQ ID NO: 2258840 - RNA, 18 nt, Yersinia pestis
caaauagauagcaaucaa

SEQ ID NO: 2258841 - RNA, 14 nt, Yersinia pestis
caaaucauuuaauu

SEQ ID NO: 2258842 - RNA, 17 nt, Yersinia pestis
caaaucauuuaauuuau

SEQ ID NO: 2258843 - RNA, 16 nt, Yersinia pestis
caaaggaagggguucu

SEQ ID NO: 2258844 - RNA, 19 nt, Yersinia pestis
caaauaaggcguuuaauuc

SEQ ID NO: 2258845 - RNA, 23 nt, Yersinia pestis
caaauaaguacuuccaauaagug

SEQ ID NO: 2258846 - RNA, 23 nt, Yersinia pestis
caaauaaguauuucaaauaagug

SEQ ID NO: 2258847 - RNA, 21 nt, Yersinia pestis
caaagagaacgggcaaccugu

SEQ ID NO: 2258848 - RNA, 22 nt, Yersinia pestis
caaagagaacgggcaaccugua

SEQ ID NO: 2258849 - RNA, 17 nt, Yersinia pestis
caaagagucgcaaaacu

SEQ ID NO: 2258850 - RNA, 16 nt, Yersinia pestis
caaacuugagucagca

SEQ ID NO: 2258851 - RNA, 22 nt, Yersinia pestis
caaacuguuuuuuaaagaaaaa

SEQ ID NO: 2258852 - RNA, 13 nt, Yersinia pestis
caaacuuaaaaau

SEQ ID NO: 2258853 - RNA, 13 nt, Yersinia pestis
caaagcuauuuuu

SEQ ID NO: 2258854 - RNA, 11 nt, Yersinia pestis
caaagcuucca

SEQ ID NO: 2258855 - RNA, 12 nt, Yersinia pestis
caaagcuauuuu

SEQ ID NO: 2258856 - RNA, 21 nt, Yersinia pestis
caaagcgcguaucguccagca

SEQ ID NO: 2258857 - RNA, 22 nt, Yersinia pestis
caaagcgcguaucguccagcag

SEQ ID NO: 2258858 - RNA, 11 nt, Yersinia pestis
caaaccauggg

SEQ ID NO: 2258859 - RNA, 17 nt, Yersinia pestis
caaaccccacuaacgcu

SEQ ID NO: 2258860 - RNA, 13 nt, Yersinia pestis
caaaccagcccug

SEQ ID NO: 2258861 - RNA, 15 nt, Yersinia pestis
caaaccagcccuguu

SEQ ID NO: 2258862 - RNA, 16 nt, Yersinia pestis
caaacccuaauaccaa

SEQ ID NO: 2258863 - RNA, 20 nt, Yersinia pestis
caaaccccgccucuucuaau

SEQ ID NO: 2258864 - RNA, 22 nt, Yersinia pestis
caaacaugagcgcaugcccggu

SEQ ID NO: 2258865 - RNA, 17 nt, Yersinia pestis
caaacauuuucaucuga

SEQ ID NO: 2258866 - RNA, 14 nt, Yersinia pestis
caaacagauacauc

SEQ ID NO: 2258867 - RNA, 23 nt, Yersinia pestis
caaacacuuaugaucuugaauaa

SEQ ID NO: 2258868 - RNA, 19 nt, Yersinia pestis
caaacaguucauaucgaua

SEQ ID NO: 2258869 - RNA, 23 nt, Yersinia pestis
caaacagccgaucaacccgcaga

SEQ ID NO: 2258870 - RNA, 18 nt, Yersinia pestis
caaacagcuucgccacca

SEQ ID NO: 2258871 - RNA, 13 nt, Yersinia pestis
caaacgcugcaca

SEQ ID NO: 2258872 - RNA, 14 nt, Yersinia pestis
caaacgcacaacaa

SEQ ID NO: 2258873 - RNA, 22 nt, Yersinia pestis
caaacgccucguuuaacucaaa

SEQ ID NO: 2258874 - RNA, 24 nt, Yersinia pestis
caaacgugaugugcccuuguuuau

SEQ ID NO: 2258875 - RNA, 17 nt, Yersinia pestis
caaacgugcuacuuaau

SEQ ID NO: 2258876 - RNA, 16 nt, Yersinia pestis
caaacggugugcaaug

SEQ ID NO: 2258877 - RNA, 15 nt, Yersinia pestis
caaacguauugguaa

SEQ ID NO: 2258878 - RNA, 18 nt, Yersinia pestis
caaacugaauggauugaa

SEQ ID NO: 2258879 - RNA, 13 nt, Yersinia pestis
caaacucagccaa

SEQ ID NO: 2258880 - RNA, 21 nt, Yersinia pestis
caaacucagccaauccagcaa

SEQ ID NO: 2258881 - RNA, 20 nt, Yersinia pestis
caaacucagccaucaguuca

SEQ ID NO: 2258882 - RNA, 23 nt, Yersinia pestis
caaacucagcgaauaaauaauug

SEQ ID NO: 2258883 - RNA, 13 nt, Yersinia pestis
caaaauaaaaauu

SEQ ID NO: 2258884 - RNA, 13 nt, Yersinia pestis
auuuuuauaauca

SEQ ID NO: 2258885 - RNA, 18 nt, Yersinia pestis
auuuuuaucugauuuuau

SEQ ID NO: 2258886 - RNA, 18 nt, Yersinia pestis
auuuuuaucaauggggau

SEQ ID NO: 2258887 - RNA, 16 nt, Yersinia pestis
auuuuuaugguuuuua

SEQ ID NO: 2258888 - RNA, 19 nt, Yersinia pestis
auuuuuauguuuaucaccc

SEQ ID NO: 2258889 - RNA, 13 nt, Yersinia pestis
caaaaucaccggu

SEQ ID NO: 2258890 - RNA, 22 nt, Yersinia pestis
caaaauauucgcauugugcuuu

SEQ ID NO: 2258891 - RNA, 21 nt, Yersinia pestis
caaaauaucgcgcuucagguc

SEQ ID NO: 2258892 - RNA, 15 nt, Yersinia pestis
caaaauagggcgccc

SEQ ID NO: 2258893 - RNA, 23 nt, Yersinia pestis
caaaauagggccguuuaccuugu

SEQ ID NO: 2258894 - RNA, 18 nt, Yersinia pestis
caaaauagccagccccag

SEQ ID NO: 2258895 - RNA, 21 nt, Yersinia pestis
caaaauacuuaacaaucagug

SEQ ID NO: 2258896 - RNA, 23 nt, Yersinia pestis
caaaauuaugccagucuuccaug

SEQ ID NO: 2258897 - RNA, 22 nt, Yersinia pestis
caaaauugagauaacgcugaug

SEQ ID NO: 2258898 - RNA, 14 nt, Yersinia pestis
caaacaacaacaca

SEQ ID NO: 2258899 - RNA, 14 nt, Yersinia pestis
caaacaaacgcuug

SEQ ID NO: 2258900 - RNA, 19 nt, Yersinia pestis
caaacaaccuaaaaaaaac

SEQ ID NO: 2258901 - RNA, 15 nt, Yersinia pestis
caaacaaccuaaaaa

SEQ ID NO: 2258902 - RNA, 15 nt, Yersinia pestis
caaaaugugaaaagc

SEQ ID NO: 2258903 - RNA, 12 nt, Yersinia pestis
caaaaugacaau

SEQ ID NO: 2258904 - RNA, 20 nt, Yersinia pestis
caaaaugccguacaacaaua

SEQ ID NO: 2258905 - RNA, 18 nt, Yersinia pestis
caucuaacugcacaauuu

SEQ ID NO: 2258906 - RNA, 18 nt, Yersinia pestis
caucucggcguaaacaau

SEQ ID NO: 2258907 - RNA, 12 nt, Yersinia pestis
caucucaauaac

SEQ ID NO: 2258908 - RNA, 21 nt, Yersinia pestis
caucucaauaacuauuuuuga

SEQ ID NO: 2258909 - RNA, 17 nt, Yersinia pestis
caucucaugacaaagaa

SEQ ID NO: 2258910 - RNA, 23 nt, Yersinia pestis
caucucaugacaaagaauguuau

SEQ ID NO: 2258911 - RNA, 16 nt, Yersinia pestis
caucuccagaauauaa

SEQ ID NO: 2258912 - RNA, 18 nt, Yersinia pestis
caucuccagaauauaaaa

SEQ ID NO: 2258913 - RNA, 19 nt, Yersinia pestis
caucuccagaauauaaaag

SEQ ID NO: 2258914 - RNA, 22 nt, Yersinia pestis
caucgugcuccgcuuccaucac

SEQ ID NO: 2258915 - RNA, 19 nt, Yersinia pestis
caucgucacgaucaaccau

SEQ ID NO: 2258916 - RNA, 17 nt, Yersinia pestis
caucgucagaaccugca

SEQ ID NO: 2258917 - RNA, 21 nt, Yersinia pestis
caucgucgcuguuacccaugg

SEQ ID NO: 2258918 - RNA, 17 nt, Yersinia pestis
caucggccugcgcugcu

SEQ ID NO: 2258919 - RNA, 17 nt, Yersinia pestis
caucgcucuccugcccu

SEQ ID NO: 2258920 - RNA, 21 nt, Yersinia pestis
caucggcaauaauaucuggcg

SEQ ID NO: 2258921 - RNA, 16 nt, Yersinia pestis
caucggauugcaacaa

SEQ ID NO: 2258922 - RNA, 22 nt, Yersinia pestis
caucggauugcaacaacgccag

SEQ ID NO: 2258923 - RNA, 18 nt, Yersinia pestis
caucgccguuuugccauu

SEQ ID NO: 2258924 - RNA, 16 nt, Yersinia pestis
caucgcucaucgccaa

SEQ ID NO: 2258925 - RNA, 19 nt, Yersinia pestis
cauccugcuauuuaacaaa

SEQ ID NO: 2258926 - RNA, 21 nt, Yersinia pestis
caucagcguagccguuaaaua

SEQ ID NO: 2258927 - RNA, 17 nt, Yersinia pestis
cauccaagccaucauua

SEQ ID NO: 2258928 - RNA, 20 nt, Yersinia pestis
cauccaauaccaccaaugcg

SEQ ID NO: 2258929 - RNA, 23 nt, Yersinia pestis
cauccaacguaaacauuggcuuu

SEQ ID NO: 2258930 - RNA, 16 nt, Yersinia pestis
cauccaagccaucauu

SEQ ID NO: 2258931 - RNA, 20 nt, Yersinia pestis
cauccaauuuuuucaucaua

SEQ ID NO: 2258932 - RNA, 22 nt, Yersinia pestis
caucauucauuuuaaaaaaauu

SEQ ID NO: 2258933 - RNA, 22 nt, Yersinia pestis
caucauucaauuguuccauaug

SEQ ID NO: 2258934 - RNA, 16 nt, Yersinia pestis
cauccagauucagacg

SEQ ID NO: 2258935 - RNA, 15 nt, Yersinia pestis
cauccagcucauaua

SEQ ID NO: 2258936 - RNA, 23 nt, Yersinia pestis
cauccagcguaaacaguagcagg

SEQ ID NO: 2258937 - RNA, 23 nt, Yersinia pestis
cauccauaaugagugacaacauu

SEQ ID NO: 2258938 - RNA, 17 nt, Yersinia pestis
cauccauaaguauuuau

SEQ ID NO: 2258939 - RNA, 14 nt, Yersinia pestis
cauccaguaagcug

SEQ ID NO: 2258940 - RNA, 20 nt, Yersinia pestis
cauccgcaggaagcaaugaa

SEQ ID NO: 2258941 - RNA, 17 nt, Yersinia pestis
cauccgaucagccagcg

SEQ ID NO: 2258942 - RNA, 19 nt, Yersinia pestis
cauccccacuuguaccugu

SEQ ID NO: 2258943 - RNA, 11 nt, Yersinia pestis
caucccagcac

SEQ ID NO: 2258944 - RNA, 14 nt, Yersinia pestis
caucccauaugcua

SEQ ID NO: 2258945 - RNA, 20 nt, Yersinia pestis
caucccagucgucuucagcu

SEQ ID NO: 2258946 - RNA, 13 nt, Yersinia pestis
caucccagccacc

SEQ ID NO: 2258947 - RNA, 13 nt, Yersinia pestis
caucccaacaauu

SEQ ID NO: 2258948 - RNA, 16 nt, Yersinia pestis
caucccaacgcaggca

SEQ ID NO: 2258949 - RNA, 14 nt, Yersinia pestis
caucccaauaauua

SEQ ID NO: 2258950 - RNA, 18 nt, Yersinia pestis
caucccaauaauuaccac

SEQ ID NO: 2258951 - RNA, 20 nt, Yersinia pestis
cauccauuguauugcucagg

SEQ ID NO: 2258952 - RNA, 13 nt, Yersinia pestis
cauccauuguauu

SEQ ID NO: 2258953 - RNA, 18 nt, Yersinia pestis
cauccaugggccucgcuu

SEQ ID NO: 2258954 - RNA, 20 nt, Yersinia pestis
caucccggcgacggcuggaa

SEQ ID NO: 2258955 - RNA, 22 nt, Yersinia pestis
caucccgguugcgauacagcgc

SEQ ID NO: 2258956 - RNA, 13 nt, Yersinia pestis
caucaccacccug

SEQ ID NO: 2258957 - RNA, 23 nt, Yersinia pestis
caucaauguuggcccaagauacu

SEQ ID NO: 2258958 - RNA, 19 nt, Yersinia pestis
caucaauguuggcccaaga

SEQ ID NO: 2258959 - RNA, 23 nt, Yersinia pestis
caucacaaauauuggcccacugg

SEQ ID NO: 2258960 - RNA, 14 nt, Yersinia pestis
caucacaccgcgau

SEQ ID NO: 2258961 - RNA, 14 nt, Yersinia pestis
caucagacugcucu

SEQ ID NO: 2258962 - RNA, 21 nt, Yersinia pestis
caucagacugcucuuucccuu

SEQ ID NO: 2258963 - RNA, 22 nt, Yersinia pestis
caucagacacguaaaacaggga

SEQ ID NO: 2258964 - RNA, 14 nt, Yersinia pestis
caucagacagccau

SEQ ID NO: 2258965 - RNA, 22 nt, Yersinia pestis
caucacuuagugguucuggccc

SEQ ID NO: 2258966 - RNA, 18 nt, Yersinia pestis
caucacuuccagcgcccg

SEQ ID NO: 2258967 - RNA, 19 nt, Yersinia pestis
caucacugucuauuuuuau

SEQ ID NO: 2258968 - RNA, 18 nt, Yersinia pestis
caucagcgccgccucuuc

SEQ ID NO: 2258969 - RNA, 23 nt, Yersinia pestis
caucagcauauuacccaguacug

SEQ ID NO: 2258970 - RNA, 21 nt, Yersinia pestis
caucagcagugacgucaucgu

SEQ ID NO: 2258971 - RNA, 13 nt, Yersinia pestis
caucagaugauga

SEQ ID NO: 2258972 - RNA, 18 nt, Yersinia pestis
caucaauacuguuaucac

SEQ ID NO: 2258973 - RNA, 22 nt, Yersinia pestis
caucaacagaggcauuuuuguu

SEQ ID NO: 2258974 - RNA, 20 nt, Yersinia pestis
caucaauagguaaauccaga

SEQ ID NO: 2258975 - RNA, 22 nt, Yersinia pestis
caucaauggcaccucaucccaa

SEQ ID NO: 2258976 - RNA, 21 nt, Yersinia pestis
caucaaaugaauaaccuugcu

SEQ ID NO: 2258977 - RNA, 11 nt, Yersinia pestis
caucaaaggag

SEQ ID NO: 2258978 - RNA, 19 nt, Yersinia pestis
cauauuucucuuuccgcuc

SEQ ID NO: 2258979 - RNA, 19 nt, Yersinia pestis
cauauuguccaaaggaagg

SEQ ID NO: 2258980 - RNA, 15 nt, Yersinia pestis
cauauuguccaaagg

SEQ ID NO: 2258981 - RNA, 17 nt, Yersinia pestis
cauauuguccaaaggaa

SEQ ID NO: 2258982 - RNA, 22 nt, Yersinia pestis
cauauuggccaguugccacuca

SEQ ID NO: 2258983 - RNA, 16 nt, Yersinia pestis
cauauuggcaauauuc

SEQ ID NO: 2258984 - RNA, 16 nt, Yersinia pestis
cauauccgguuguuca

SEQ ID NO: 2258985 - RNA, 14 nt, Yersinia pestis
cauaucgaccauga

SEQ ID NO: 2258986 - RNA, 20 nt, Yersinia pestis
cauagguuggggaugccauu

SEQ ID NO: 2258987 - RNA, 22 nt, Yersinia pestis
cauagggcugaauaucauuaug

SEQ ID NO: 2258988 - RNA, 19 nt, Yersinia pestis
cauagcuggcuucaaaauc

SEQ ID NO: 2258989 - RNA, 14 nt, Yersinia pestis
cauagcuaaccuua

SEQ ID NO: 2258990 - RNA, 15 nt, Yersinia pestis
cauauaaaaaacuaa

SEQ ID NO: 2258991 - RNA, 19 nt, Yersinia pestis
cauagugauuauuuaaaca

SEQ ID NO: 2258992 - RNA, 22 nt, Yersinia pestis
cauaguccaacgcacugguugc

SEQ ID NO: 2258993 - RNA, 13 nt, Yersinia pestis
cauaguccaacgc

SEQ ID NO: 2258994 - RNA, 15 nt, Yersinia pestis
cauaguccaacgcac

SEQ ID NO: 2258995 - RNA, 21 nt, Yersinia pestis
cauaucagaaccaagcaauag

SEQ ID NO: 2258996 - RNA, 18 nt, Yersinia pestis
cauaucagcaaugacggu

SEQ ID NO: 2258997 - RNA, 15 nt, Yersinia pestis
cauauacuggagcua

SEQ ID NO: 2258998 - RNA, 17 nt, Yersinia pestis
cauauaaaacacgcaua

SEQ ID NO: 2258999 - RNA, 15 nt, Yersinia pestis
cauacaaccauuuca

SEQ ID NO: 2259000 - RNA, 20 nt, Yersinia pestis
cauaauuuugaugcuaauuu

SEQ ID NO: 2259001 - RNA, 14 nt, Yersinia pestis
cauaauucugccga

SEQ ID NO: 2259002 - RNA, 16 nt, Yersinia pestis
cauaauuccacauaaa

SEQ ID NO: 2259003 - RNA, 13 nt, Yersinia pestis
cauaauuaaauau

SEQ ID NO: 2259004 - RNA, 16 nt, Yersinia pestis
cauaauuaaauauuaa

SEQ ID NO: 2259005 - RNA, 21 nt, Yersinia pestis
cauagaagcucauaugcagca

SEQ ID NO: 2259006 - RNA, 22 nt, Yersinia pestis
cauagaagaagaauugcagaua

SEQ ID NO: 2259007 - RNA, 15 nt, Yersinia pestis
cauagacaugagaca

SEQ ID NO: 2259008 - RNA, 20 nt, Yersinia pestis
cauagacaugagacagcgcg

SEQ ID NO: 2259009 - RNA, 15 nt, Yersinia pestis
cauagccauggcuuc

SEQ ID NO: 2259010 - RNA, 12 nt, Yersinia pestis
cauagagagaaa

SEQ ID NO: 2259011 - RNA, 20 nt, Yersinia pestis
cauagcacccaauguauaug

SEQ ID NO: 2259012 - RNA, 18 nt, Yersinia pestis
cauagauuauuuuuauac

SEQ ID NO: 2259013 - RNA, 21 nt, Yersinia pestis
cauuauuauguauuuuuaugc

SEQ ID NO: 2259014 - RNA, 15 nt, Yersinia pestis
cauuauuaccuaauu

SEQ ID NO: 2259015 - RNA, 17 nt, Yersinia pestis
cauuauuauguauuuuu

SEQ ID NO: 2259016 - RNA, 14 nt, Yersinia pestis
cauucaauguaaaa

SEQ ID NO: 2259017 - RNA, 13 nt, Yersinia pestis
cauuauuauuuac

SEQ ID NO: 2259018 - RNA, 13 nt, Yersinia pestis
cauucaaacacuu

SEQ ID NO: 2259019 - RNA, 17 nt, Yersinia pestis
cauuauuugauauagac

SEQ ID NO: 2259020 - RNA, 22 nt, Yersinia pestis
cauuacguaauaguaaaacagg

SEQ ID NO: 2259021 - RNA, 13 nt, Yersinia pestis
cauuacgccaccu

SEQ ID NO: 2259022 - RNA, 23 nt, Yersinia pestis
cauguguauuagguuuggccuaa

SEQ ID NO: 2259023 - RNA, 14 nt, Yersinia pestis
cauguguguucuug

SEQ ID NO: 2259024 - RNA, 21 nt, Yersinia pestis
cauguuauuagcguuacagcu

SEQ ID NO: 2259025 - RNA, 18 nt, Yersinia pestis
cauguuaggauaggguuu

SEQ ID NO: 2259026 - RNA, 19 nt, Yersinia pestis
cauguucacccaguaacug

SEQ ID NO: 2259027 - RNA, 14 nt, Yersinia pestis
cauguucagccgcu

SEQ ID NO: 2259028 - RNA, 16 nt, Yersinia pestis
cauuagucugaggcca

SEQ ID NO: 2259029 - RNA, 14 nt, Yersinia pestis
cauuauauagauuu

SEQ ID NO: 2259030 - RNA, 20 nt, Yersinia pestis
cauuacugcggaucaaccgc

SEQ ID NO: 2259031 - RNA, 19 nt, Yersinia pestis
cauuagggccaccagacug

SEQ ID NO: 2259032 - RNA, 16 nt, Yersinia pestis
cauuccaguaaaaaaa

SEQ ID NO: 2259033 - RNA, 20 nt, Yersinia pestis
cauuccaauuagauuugagc

SEQ ID NO: 2259034 - RNA, 16 nt, Yersinia pestis
cauucauuuuaaaaaa

SEQ ID NO: 2259035 - RNA, 14 nt, Yersinia pestis
cauucauuuuaaaa

SEQ ID NO: 2259036 - RNA, 19 nt, Yersinia pestis
cauucaugaggcucagacu

SEQ ID NO: 2259037 - RNA, 18 nt, Yersinia pestis
cauucauaauugaagagu

SEQ ID NO: 2259038 - RNA, 15 nt, Yersinia pestis
cauucauaucuuuac

SEQ ID NO: 2259039 - RNA, 15 nt, Yersinia pestis
cauucaguacauaaa

SEQ ID NO: 2259040 - RNA, 18 nt, Yersinia pestis
cauucacgccgcuccuga

SEQ ID NO: 2259041 - RNA, 10 nt, Yersinia pestis
cauucagcag

SEQ ID NO: 2259042 - RNA, 12 nt, Yersinia pestis
cauucagcagca

SEQ ID NO: 2259043 - RNA, 20 nt, Yersinia pestis
cauucagcgucacgauagca

SEQ ID NO: 2259044 - RNA, 22 nt, Yersinia pestis
cauucccugcgguuauuugcua

SEQ ID NO: 2259045 - RNA, 16 nt, Yersinia pestis
cauuccccaucgccaa

SEQ ID NO: 2259046 - RNA, 20 nt, Yersinia pestis
cauuccccaucgccaauugg

SEQ ID NO: 2259047 - RNA, 17 nt, Yersinia pestis
cauucgaaugauugacu

SEQ ID NO: 2259048 - RNA, 17 nt, Yersinia pestis
cauucgacggguuuuac

SEQ ID NO: 2259049 - RNA, 23 nt, Yersinia pestis
cauucgcacaguuuucuuaaaau

SEQ ID NO: 2259050 - RNA, 23 nt, Yersinia pestis
cauucgagcuaccggcauuggcu

SEQ ID NO: 2259051 - RNA, 19 nt, Yersinia pestis
cauucgcacgggcuuuaau

SEQ ID NO: 2259052 - RNA, 17 nt, Yersinia pestis
cauucgccugauaaaau

SEQ ID NO: 2259053 - RNA, 22 nt, Yersinia pestis
cauucgcgguuacaccaauaau

SEQ ID NO: 2259054 - RNA, 15 nt, Yersinia pestis
cauucuuuaucacac

SEQ ID NO: 2259055 - RNA, 17 nt, Yersinia pestis
cauucuuugguccucuu

SEQ ID NO: 2259056 - RNA, 13 nt, Yersinia pestis
cauuguaaaauaa

SEQ ID NO: 2259057 - RNA, 18 nt, Yersinia pestis
cauuggcuugguuguuuc

SEQ ID NO: 2259058 - RNA, 13 nt, Yersinia pestis
cauuggcuuuuug

SEQ ID NO: 2259059 - RNA, 21 nt, Yersinia pestis
cauuggcuuuuugcuggaacu

SEQ ID NO: 2259060 - RNA, 20 nt, Yersinia pestis
cauugcguucaauacauggu

SEQ ID NO: 2259061 - RNA, 17 nt, Yersinia pestis
cauugcguaauuaccca

SEQ ID NO: 2259062 - RNA, 19 nt, Yersinia pestis
cauugcgugcaauaaagcg

SEQ ID NO: 2259063 - RNA, 19 nt, Yersinia pestis
cauugcucaaacucagcau

SEQ ID NO: 2259064 - RNA, 16 nt, Yersinia pestis
cauuguagauggccau

SEQ ID NO: 2259065 - RNA, 14 nt, Yersinia pestis
cauuuaccaucagg

SEQ ID NO: 2259066 - RNA, 20 nt, Yersinia pestis
cauuuacccgucauccuuca

SEQ ID NO: 2259067 - RNA, 23 nt, Yersinia pestis
cauugucagguuaauaccugcac

SEQ ID NO: 2259068 - RNA, 23 nt, Yersinia pestis
cauuuauauaacgacuauuuauc

SEQ ID NO: 2259069 - RNA, 22 nt, Yersinia pestis
cauuuauauaguaacuauuuac

SEQ ID NO: 2259070 - RNA, 15 nt, Yersinia pestis
cauuuagcauuauuc

SEQ ID NO: 2259071 - RNA, 18 nt, Yersinia pestis
cauuuaucuaaaacugcc

SEQ ID NO: 2259072 - RNA, 18 nt, Yersinia pestis
cauuuauuacauuuacau

SEQ ID NO: 2259073 - RNA, 12 nt, Yersinia pestis
cauuuauuucca

SEQ ID NO: 2259074 - RNA, 13 nt, Yersinia pestis
cauuuauuuccac

SEQ ID NO: 2259075 - RNA, 22 nt, Yersinia pestis
cauuuauugcggcuuagccacu

SEQ ID NO: 2259076 - RNA, 23 nt, Yersinia pestis
cauuucacccucugcagcuugca

SEQ ID NO: 2259077 - RNA, 23 nt, Yersinia pestis
cauuuccuguguuuugagcauca

SEQ ID NO: 2259078 - RNA, 19 nt, Yersinia pestis
cauuucgcuccaccagccc

SEQ ID NO: 2259079 - RNA, 14 nt, Yersinia pestis
cauuucguagccuu

SEQ ID NO: 2259080 - RNA, 16 nt, Yersinia pestis
cauuucccgugcacug

SEQ ID NO: 2259081 - RNA, 19 nt, Yersinia pestis
cauuucccgugcacugcga

SEQ ID NO: 2259082 - RNA, 15 nt, Yersinia pestis
cauuucccccaccug

SEQ ID NO: 2259083 - RNA, 15 nt, Yersinia pestis
cauuucacggugcuc

SEQ ID NO: 2259084 - RNA, 21 nt, Yersinia pestis
cauuucaggacugucuucaac

SEQ ID NO: 2259085 - RNA, 13 nt, Yersinia pestis
caugacaaaauac

SEQ ID NO: 2259086 - RNA, 17 nt, Yersinia pestis
caugacaaagaauguua

SEQ ID NO: 2259087 - RNA, 23 nt, Yersinia pestis
caugacaaagaauguuauugcuc

SEQ ID NO: 2259088 - RNA, 14 nt, Yersinia pestis
caugacaucccagc

SEQ ID NO: 2259089 - RNA, 20 nt, Yersinia pestis
caugacuagugccacaacaa

SEQ ID NO: 2259090 - RNA, 14 nt, Yersinia pestis
caugaaugaggcug

SEQ ID NO: 2259091 - RNA, 17 nt, Yersinia pestis
caugaacggauacccag

SEQ ID NO: 2259092 - RNA, 14 nt, Yersinia pestis
caugaguaaaagau

SEQ ID NO: 2259093 - RNA, 20 nt, Yersinia pestis
caugagaauacuucaggcca

SEQ ID NO: 2259094 - RNA, 13 nt, Yersinia pestis
caugagaaccagu

SEQ ID NO: 2259095 - RNA, 20 nt, Yersinia pestis
caugagaaccaguucuggua

SEQ ID NO: 2259096 - RNA, 19 nt, Yersinia pestis
caugauaaaacuauucugc

SEQ ID NO: 2259097 - RNA, 22 nt, Yersinia pestis
caugauaaugccaugcucucug

SEQ ID NO: 2259098 - RNA, 18 nt, Yersinia pestis
caugaugacaaugcguua

SEQ ID NO: 2259099 - RNA, 21 nt, Yersinia pestis
caugauggcaccgugggcaaa

SEQ ID NO: 2259100 - RNA, 12 nt, Yersinia pestis
caugauucucua

SEQ ID NO: 2259101 - RNA, 18 nt, Yersinia pestis
caugauucguagaaacau

SEQ ID NO: 2259102 - RNA, 16 nt, Yersinia pestis
caugauuucucgcuuu

SEQ ID NO: 2259103 - RNA, 17 nt, Yersinia pestis
caugcauuggaaaaaau

SEQ ID NO: 2259104 - RNA, 15 nt, Yersinia pestis
caugcauuaaggcgc

SEQ ID NO: 2259105 - RNA, 23 nt, Yersinia pestis
caugcauuaaggcgcgacugauu

SEQ ID NO: 2259106 - RNA, 15 nt, Yersinia pestis
cauguacuagaucac

SEQ ID NO: 2259107 - RNA, 14 nt, Yersinia pestis
cauguagcacacua

SEQ ID NO: 2259108 - RNA, 17 nt, Yersinia pestis
caugguugcuagcccaa

SEQ ID NO: 2259109 - RNA, 18 nt, Yersinia pestis
caugguuggcccaaucga

SEQ ID NO: 2259110 - RNA, 18 nt, Yersinia pestis
cauggcggcagcacagag

SEQ ID NO: 2259111 - RNA, 19 nt, Yersinia pestis
cauguaucccgcuugggua

SEQ ID NO: 2259112 - RNA, 18 nt, Yersinia pestis
caugcucuucauaagcca

SEQ ID NO: 2259113 - RNA, 15 nt, Yersinia pestis
caugcugucauuggu

SEQ ID NO: 2259114 - RNA, 14 nt, Yersinia pestis
caugcuggcggaua

SEQ ID NO: 2259115 - RNA, 21 nt, Yersinia pestis
cauggcgaaaauccuucauuu

SEQ ID NO: 2259116 - RNA, 19 nt, Yersinia pestis
cauggccaugaaucaaauu

SEQ ID NO: 2259117 - RNA, 14 nt, Yersinia pestis
caugccaauuauuc

SEQ ID NO: 2259118 - RNA, 16 nt, Yersinia pestis
caugccaauuauucuc

SEQ ID NO: 2259119 - RNA, 23 nt, Yersinia pestis
caugccagaaacggcaucugcca

SEQ ID NO: 2259120 - RNA, 15 nt, Yersinia pestis
caugcccagcguugg

SEQ ID NO: 2259121 - RNA, 17 nt, Yersinia pestis
caugccggaugguauuc

SEQ ID NO: 2259122 - RNA, 19 nt, Yersinia pestis
caugcuaauaccacaacau

SEQ ID NO: 2259123 - RNA, 14 nt, Yersinia pestis
caggauagccaacc

SEQ ID NO: 2259124 - RNA, 18 nt, Yersinia pestis
caggaucaccagcaaagg

SEQ ID NO: 2259125 - RNA, 22 nt, Yersinia pestis
caggaucaccagcaaaggccac

SEQ ID NO: 2259126 - RNA, 22 nt, Yersinia pestis
caggaugaugaauaccaccauc

SEQ ID NO: 2259127 - RNA, 20 nt, Yersinia pestis
caggcaacgacagcaacaac

SEQ ID NO: 2259128 - RNA, 20 nt, Yersinia pestis
caggcaaagacuacacacag

SEQ ID NO: 2259129 - RNA, 15 nt, Yersinia pestis
caggcacaccagaac

SEQ ID NO: 2259130 - RNA, 14 nt, Yersinia pestis
caggcauaucacua

SEQ ID NO: 2259131 - RNA, 18 nt, Yersinia pestis
caggccaagccugugcua

SEQ ID NO: 2259132 - RNA, 17 nt, Yersinia pestis
caggcccgcuaucacua

SEQ ID NO: 2259133 - RNA, 19 nt, Yersinia pestis
caggcccgcuaucacuagc

SEQ ID NO: 2259134 - RNA, 16 nt, Yersinia pestis
caggccccaucauaaa

SEQ ID NO: 2259135 - RNA, 15 nt, Yersinia pestis
caggccccuuaaaua

SEQ ID NO: 2259136 - RNA, 23 nt, Yersinia pestis
caggccauacuggguuuaaaggu

SEQ ID NO: 2259137 - RNA, 12 nt, Yersinia pestis
caggccauuuuc

SEQ ID NO: 2259138 - RNA, 13 nt, Yersinia pestis
caggcuuauauuu

SEQ ID NO: 2259139 - RNA, 13 nt, Yersinia pestis
caggcugcauggg

SEQ ID NO: 2259140 - RNA, 23 nt, Yersinia pestis
caggcugcauggguaaagcccau

SEQ ID NO: 2259141 - RNA, 16 nt, Yersinia pestis
caggcugccugccuga

SEQ ID NO: 2259142 - RNA, 18 nt, Yersinia pestis
caggcucuuuauacuuug

SEQ ID NO: 2259143 - RNA, 19 nt, Yersinia pestis
caggccuuuuucucaaucu

SEQ ID NO: 2259144 - RNA, 22 nt, Yersinia pestis
caggccuagcccaguaccgcug

SEQ ID NO: 2259145 - RNA, 18 nt, Yersinia pestis
caggccuagcccaguacc

SEQ ID NO: 2259146 - RNA, 17 nt, Yersinia pestis
caggcggcccuuggcuu

SEQ ID NO: 2259147 - RNA, 17 nt, Yersinia pestis
cagcguuuuauucguuc

SEQ ID NO: 2259148 - RNA, 16 nt, Yersinia pestis
cagcguuggucagcaa

SEQ ID NO: 2259149 - RNA, 19 nt, Yersinia pestis
cagcguuucaguaagauac

SEQ ID NO: 2259150 - RNA, 22 nt, Yersinia pestis
cagcgucgccguaaauugcuca

SEQ ID NO: 2259151 - RNA, 23 nt, Yersinia pestis
cagcgucuuucgggcugaugaau

SEQ ID NO: 2259152 - RNA, 15 nt, Yersinia pestis
cagcgucuucagugg

SEQ ID NO: 2259153 - RNA, 16 nt, Yersinia pestis
cagcgucuucaguggc

SEQ ID NO: 2259154 - RNA, 14 nt, Yersinia pestis
cacugagggugaua

SEQ ID NO: 2259155 - RNA, 23 nt, Yersinia pestis
cacugaugagcuggcaaaacuca

SEQ ID NO: 2259156 - RNA, 21 nt, Yersinia pestis
cacugauauagccuucuucac

SEQ ID NO: 2259157 - RNA, 13 nt, Yersinia pestis
cacugaguucugc

SEQ ID NO: 2259158 - RNA, 16 nt, Yersinia pestis
cacugaguucugcugc

SEQ ID NO: 2259159 - RNA, 18 nt, Yersinia pestis
cagcgguagagaucucug

SEQ ID NO: 2259160 - RNA, 19 nt, Yersinia pestis
cagcggugaucgcugccac

SEQ ID NO: 2259161 - RNA, 23 nt, Yersinia pestis
cagcgguaugaggaucccuucug

SEQ ID NO: 2259162 - RNA, 15 nt, Yersinia pestis
cagcggggcauucau

SEQ ID NO: 2259163 - RNA, 18 nt, Yersinia pestis
cagcgucacccaacgcaa

SEQ ID NO: 2259164 - RNA, 23 nt, Yersinia pestis
cagcgguuuuuucuuucuucagc

SEQ ID NO: 2259165 - RNA, 18 nt, Yersinia pestis
cagcguauagcgccgcca

SEQ ID NO: 2259166 - RNA, 18 nt, Yersinia pestis
cagcguagauuuucucag

SEQ ID NO: 2259167 - RNA, 16 nt, Yersinia pestis
cagcuuguugauauca

SEQ ID NO: 2259168 - RNA, 13 nt, Yersinia pestis
cagcuuguugaua

SEQ ID NO: 2259169 - RNA, 14 nt, Yersinia pestis
caggaaacuccagu

SEQ ID NO: 2259170 - RNA, 18 nt, Yersinia pestis
cagcucacucgguaauga

SEQ ID NO: 2259171 - RNA, 17 nt, Yersinia pestis
cagcucuacagugacuu

SEQ ID NO: 2259172 - RNA, 15 nt, Yersinia pestis
cagcucuagaccuga

SEQ ID NO: 2259173 - RNA, 17 nt, Yersinia pestis
cagcucuucaauuucca

SEQ ID NO: 2259174 - RNA, 13 nt, Yersinia pestis
cagcucucugagc

SEQ ID NO: 2259175 - RNA, 13 nt, Yersinia pestis
caguccguaaauc

SEQ ID NO: 2259176 - RNA, 18 nt, Yersinia pestis
cagucccugugcgcccac

SEQ ID NO: 2259177 - RNA, 21 nt, Yersinia pestis
cagugauucgggugagugagc

SEQ ID NO: 2259178 - RNA, 13 nt, Yersinia pestis
cagugaucagucc

SEQ ID NO: 2259179 - RNA, 15 nt, Yersinia pestis
cagugcaaaaugcuc

SEQ ID NO: 2259180 - RNA, 16 nt, Yersinia pestis
cagugauuuuaaccac

SEQ ID NO: 2259181 - RNA, 20 nt, Yersinia pestis
cagugcaacauuaaaaauac

SEQ ID NO: 2259182 - RNA, 20 nt, Yersinia pestis
cagugcaaccaacaccaaug

SEQ ID NO: 2259183 - RNA, 18 nt, Yersinia pestis
cagugccugguuuuacgc

SEQ ID NO: 2259184 - RNA, 23 nt, Yersinia pestis
cagugcggccaccuaucuauuuu

SEQ ID NO: 2259185 - RNA, 20 nt, Yersinia pestis
cagugcgccguaaaucguca

SEQ ID NO: 2259186 - RNA, 16 nt, Yersinia pestis
cagugcgcgauaaacg

SEQ ID NO: 2259187 - RNA, 16 nt, Yersinia pestis
cagugccguaugcgca

SEQ ID NO: 2259188 - RNA, 15 nt, Yersinia pestis
cagugcgcggcgccg

SEQ ID NO: 2259189 - RNA, 16 nt, Yersinia pestis
cagugcgcggcgccgu

SEQ ID NO: 2259190 - RNA, 23 nt, Yersinia pestis
cagugcucccugaacgccuugcc

SEQ ID NO: 2259191 - RNA, 22 nt, Yersinia pestis
caguggcggcaaaagaacgugc

SEQ ID NO: 2259192 - RNA, 18 nt, Yersinia pestis
cagugggauagagaucag

SEQ ID NO: 2259193 - RNA, 14 nt, Yersinia pestis
caguggcuggaaag

SEQ ID NO: 2259194 - RNA, 15 nt, Yersinia pestis
caguucauggccaug

SEQ ID NO: 2259195 - RNA, 22 nt, Yersinia pestis
caguuccugauucgguuucguu

SEQ ID NO: 2259196 - RNA, 16 nt, Yersinia pestis
caguucgacaccuuca

SEQ ID NO: 2259197 - RNA, 21 nt, Yersinia pestis
caguucgauauuauucucuac

SEQ ID NO: 2259198 - RNA, 18 nt, Yersinia pestis
caguucgcguuccggcgu

SEQ ID NO: 2259199 - RNA, 14 nt, Yersinia pestis
caguucaucaauaa

SEQ ID NO: 2259200 - RNA, 12 nt, Yersinia pestis
caguucauuaau

SEQ ID NO: 2259201 - RNA, 17 nt, Yersinia pestis
caguucauuacaggccc

SEQ ID NO: 2259202 - RNA, 23 nt, Yersinia pestis
caguucaagauaaaguucuucga

SEQ ID NO: 2259203 - RNA, 20 nt, Yersinia pestis
caguucaacaguaucaauac

SEQ ID NO: 2259204 - RNA, 21 nt, Yersinia pestis
caguucacucuguuuuaaaaa

SEQ ID NO: 2259205 - RNA, 13 nt, Yersinia pestis
caguuaauuucaa

SEQ ID NO: 2259206 - RNA, 20 nt, Yersinia pestis
caguuacacagaauuaugga

SEQ ID NO: 2259207 - RNA, 22 nt, Yersinia pestis
caguuaagguguuguuuaaaaa

SEQ ID NO: 2259208 - RNA, 23 nt, Yersinia pestis
caguuauuauuuuuaaugauuga

SEQ ID NO: 2259209 - RNA, 14 nt, Yersinia pestis
caguuauuauuuuu

SEQ ID NO: 2259210 - RNA, 19 nt, Yersinia pestis
caguuauuauuuuuaauga

SEQ ID NO: 2259211 - RNA, 19 nt, Yersinia pestis
caguuacgucaggaauaaa

SEQ ID NO: 2259212 - RNA, 13 nt, Yersinia pestis
cauaaaaggaugg

SEQ ID NO: 2259213 - RNA, 20 nt, Yersinia pestis
cauaaaaggauggcccaagc

SEQ ID NO: 2259214 - RNA, 16 nt, Yersinia pestis
cauaaaaggauggccc

SEQ ID NO: 2259215 - RNA, 19 nt, Yersinia pestis
cauaaaauaaauaauuugu

SEQ ID NO: 2259216 - RNA, 13 nt, Yersinia pestis
cauaaagcuauuc

SEQ ID NO: 2259217 - RNA, 18 nt, Yersinia pestis
cauaaagcaucagacugc

SEQ ID NO: 2259218 - RNA, 16 nt, Yersinia pestis
cauaaaaaaagaaggg

SEQ ID NO: 2259219 - RNA, 17 nt, Yersinia pestis
caguuuuuuauggcaua

SEQ ID NO: 2259220 - RNA, 19 nt, Yersinia pestis
caguuuuucccguaacuua

SEQ ID NO: 2259221 - RNA, 22 nt, Yersinia pestis
caguuuuuaauuuaaacucuuu

SEQ ID NO: 2259222 - RNA, 12 nt, Yersinia pestis
caguuucaggcg

SEQ ID NO: 2259223 - RNA, 16 nt, Yersinia pestis
caguuuauccaaggca

SEQ ID NO: 2259224 - RNA, 16 nt, Yersinia pestis
caguuuauuuucccuu

SEQ ID NO: 2259225 - RNA, 14 nt, Yersinia pestis
caguucggcuuucg

SEQ ID NO: 2259226 - RNA, 13 nt, Yersinia pestis
caguucuaacccg

SEQ ID NO: 2259227 - RNA, 17 nt, Yersinia pestis
caguuucgucaugauaa

SEQ ID NO: 2259228 - RNA, 17 nt, Yersinia pestis
caguuuggcugccaugg

SEQ ID NO: 2259229 - RNA, 16 nt, Yersinia pestis
caguuugcgaccaaua

SEQ ID NO: 2259230 - RNA, 16 nt, Yersinia pestis
cauaaugccggcggcc

SEQ ID NO: 2259231 - RNA, 14 nt, Yersinia pestis
cauaaucagccugc

SEQ ID NO: 2259232 - RNA, 16 nt, Yersinia pestis
cauaauauagcugaau

SEQ ID NO: 2259233 - RNA, 23 nt, Yersinia pestis
cauaauaaugauuauugaccaga

SEQ ID NO: 2259234 - RNA, 14 nt, Yersinia pestis
cauaaguauuuauu

SEQ ID NO: 2259235 - RNA, 13 nt, Yersinia pestis
cauaaguaaagcg

SEQ ID NO: 2259236 - RNA, 15 nt, Yersinia pestis
cauaaauaauaaaua

SEQ ID NO: 2259237 - RNA, 16 nt, Yersinia pestis
cauaacugcugugcau

SEQ ID NO: 2259238 - RNA, 20 nt, Yersinia pestis
cauaagcacgaauuuuauuc

SEQ ID NO: 2259239 - RNA, 14 nt, Yersinia pestis
cagguucaauuccc

SEQ ID NO: 2259240 - RNA, 13 nt, Yersinia pestis
cagguugaaauaa

SEQ ID NO: 2259241 - RNA, 17 nt, Yersinia pestis
cagguugaaauaaauaa

SEQ ID NO: 2259242 - RNA, 13 nt, Yersinia pestis
cagguugaagauc

SEQ ID NO: 2259243 - RNA, 18 nt, Yersinia pestis
cagguucauuacacagca

SEQ ID NO: 2259244 - RNA, 17 nt, Yersinia pestis
cagguuguccgaagaga

SEQ ID NO: 2259245 - RNA, 21 nt, Yersinia pestis
cagguuguuauuacuaaugag

SEQ ID NO: 2259246 - RNA, 23 nt, Yersinia pestis
caguaaagcaaauucccaccaua

SEQ ID NO: 2259247 - RNA, 17 nt, Yersinia pestis
caguaaauuauuuucca

SEQ ID NO: 2259248 - RNA, 14 nt, Yersinia pestis
caguaaauucauca

SEQ ID NO: 2259249 - RNA, 13 nt, Yersinia pestis
caguaacaacauc

SEQ ID NO: 2259250 - RNA, 18 nt, Yersinia pestis
caguaaccccuucgagca

SEQ ID NO: 2259251 - RNA, 16 nt, Yersinia pestis
caguaaugaauucauu

SEQ ID NO: 2259252 - RNA, 16 nt, Yersinia pestis
caguaugcgaaacacc

SEQ ID NO: 2259253 - RNA, 15 nt, Yersinia pestis
cagucauuuuauuag

SEQ ID NO: 2259254 - RNA, 13 nt, Yersinia pestis
cagucauuuacug

SEQ ID NO: 2259255 - RNA, 22 nt, Yersinia pestis
caguauuuagcgugacacuguc

SEQ ID NO: 2259256 - RNA, 17 nt, Yersinia pestis
caguauucgccagauac

SEQ ID NO: 2259257 - RNA, 14 nt, Yersinia pestis
cagucauuaacaca

SEQ ID NO: 2259258 - RNA, 19 nt, Yersinia pestis
cagucccccucacaagcca

SEQ ID NO: 2259259 - RNA, 15 nt, Yersinia pestis
caguaccugcuaacc

SEQ ID NO: 2259260 - RNA, 14 nt, Yersinia pestis
caguagcccagccg

SEQ ID NO: 2259261 - RNA, 19 nt, Yersinia pestis
caguagcccagccggaaca

SEQ ID NO: 2259262 - RNA, 14 nt, Yersinia pestis
caguaggcugaagg

SEQ ID NO: 2259263 - RNA, 19 nt, Yersinia pestis
caguaggcugaaggccugc

SEQ ID NO: 2259264 - RNA, 15 nt, Yersinia pestis
caguaggggccacca

SEQ ID NO: 2259265 - RNA, 15 nt, Yersinia pestis
caggucugcauggua

SEQ ID NO: 2259266 - RNA, 13 nt, Yersinia pestis
caggugacugaag

SEQ ID NO: 2259267 - RNA, 17 nt, Yersinia pestis
caggugaguaaacaccu

SEQ ID NO: 2259268 - RNA, 15 nt, Yersinia pestis
caggucaggaagaga

SEQ ID NO: 2259269 - RNA, 17 nt, Yersinia pestis
caggucaggaagagaaa

SEQ ID NO: 2259270 - RNA, 13 nt, Yersinia pestis
cagguaguucauu

SEQ ID NO: 2259271 - RNA, 13 nt, Yersinia pestis
cagguaagaaaga

SEQ ID NO: 2259272 - RNA, 19 nt, Yersinia pestis
cagggaugggcgccgcuuu

SEQ ID NO: 2259273 - RNA, 20 nt, Yersinia pestis
cagguaaugucacugccauc

SEQ ID NO: 2259274 - RNA, 14 nt, Yersinia pestis
cagguaccccauaa

SEQ ID NO: 2259275 - RNA, 22 nt, Yersinia pestis
cagguaccgggccauagcccau

SEQ ID NO: 2259276 - RNA, 23 nt, Yersinia pestis
ccagcauguuccuguugcuggcc

SEQ ID NO: 2259277 - RNA, 14 nt, Yersinia pestis
ccagcagcauccug

SEQ ID NO: 2259278 - RNA, 19 nt, Yersinia pestis
ccagcaacucaagccacuc

SEQ ID NO: 2259279 - RNA, 20 nt, Yersinia pestis
ccagcaacguaacaugcagc

SEQ ID NO: 2259280 - RNA, 20 nt, Yersinia pestis
ccagcaacgaauaaaaaagc

SEQ ID NO: 2259281 - RNA, 22 nt, Yersinia pestis
ccagcacguuuuaaugccaauu

SEQ ID NO: 2259282 - RNA, 21 nt, Yersinia pestis
ccagcagcauaaccagugccg

SEQ ID NO: 2259283 - RNA, 23 nt, Yersinia pestis
ccagcagcauaauacgaucagcg

SEQ ID NO: 2259284 - RNA, 23 nt, Yersinia pestis
ccagcagaaguuguugcccuuca

SEQ ID NO: 2259285 - RNA, 16 nt, Yersinia pestis
ccagacauguuguucu

SEQ ID NO: 2259286 - RNA, 23 nt, Yersinia pestis
ccagaccgcguaagccgugccug

SEQ ID NO: 2259287 - RNA, 18 nt, Yersinia pestis
ccagaccgcguaagccgu

SEQ ID NO: 2259288 - RNA, 18 nt, Yersinia pestis
ccagacgaguauucccca

SEQ ID NO: 2259289 - RNA, 15 nt, Yersinia pestis
ccagaggauaaucac

SEQ ID NO: 2259290 - RNA, 15 nt, Yersinia pestis
ccagagacagcaaca

SEQ ID NO: 2259291 - RNA, 17 nt, Yersinia pestis
ccagacugacaaccacu

SEQ ID NO: 2259292 - RNA, 20 nt, Yersinia pestis
ccagacugacaaccacuaaa

SEQ ID NO: 2259293 - RNA, 12 nt, Yersinia pestis
ccagaagccagg

SEQ ID NO: 2259294 - RNA, 16 nt, Yersinia pestis
ccagacaaccaauaca

SEQ ID NO: 2259295 - RNA, 20 nt, Yersinia pestis
ccagacaaccaauacacagc

SEQ ID NO: 2259296 - RNA, 14 nt, Yersinia pestis
ccagacaaccaaua

SEQ ID NO: 2259297 - RNA, 16 nt, Yersinia pestis
ccacuuuaacugcacc

SEQ ID NO: 2259298 - RNA, 18 nt, Yersinia pestis
ccacgucuaauugcugcc

SEQ ID NO: 2259299 - RNA, 16 nt, Yersinia pestis
ccaccuaucuauuuuu

SEQ ID NO: 2259300 - RNA, 20 nt, Yersinia pestis
ccacgaucaucaacucgcca

SEQ ID NO: 2259301 - RNA, 13 nt, Yersinia pestis
ccacgaaaaaaug

SEQ ID NO: 2259302 - RNA, 19 nt, Yersinia pestis
ccaccuacaaccuaccacc

SEQ ID NO: 2259303 - RNA, 19 nt, Yersinia pestis
ccaccuaccaccuacaacc

SEQ ID NO: 2259304 - RNA, 18 nt, Yersinia pestis
ccaccuaccaccuaccac

SEQ ID NO: 2259305 - RNA, 20 nt, Yersinia pestis
ccaccgucaagacaacaaac

SEQ ID NO: 2259306 - RNA, 21 nt, Yersinia pestis
ccaccgucaagacaacaaaca

SEQ ID NO: 2259307 - RNA, 14 nt, Yersinia pestis
ccaccgucaccaaa

SEQ ID NO: 2259308 - RNA, 16 nt, Yersinia pestis
ccaccgucaccaaaua

SEQ ID NO: 2259309 - RNA, 14 nt, Yersinia pestis
ccaccccguggcag

SEQ ID NO: 2259310 - RNA, 14 nt, Yersinia pestis
ccaccccccccuua

SEQ ID NO: 2259311 - RNA, 20 nt, Yersinia pestis
ccacccguugcauuuuucug

SEQ ID NO: 2259312 - RNA, 13 nt, Yersinia pestis
ccacggauuaacu

SEQ ID NO: 2259313 - RNA, 17 nt, Yersinia pestis
ccacgcugauacauuuc

SEQ ID NO: 2259314 - RNA, 19 nt, Yersinia pestis
ccacgccaguaaacagcca

SEQ ID NO: 2259315 - RNA, 16 nt, Yersinia pestis
ccacggccaaguagau

SEQ ID NO: 2259316 - RNA, 13 nt, Yersinia pestis
ccacggcgcugca

SEQ ID NO: 2259317 - RNA, 18 nt, Yersinia pestis
ccacggcgcugcagcgau

SEQ ID NO: 2259318 - RNA, 15 nt, Yersinia pestis
ccacgguaucaauca

SEQ ID NO: 2259319 - RNA, 21 nt, Yersinia pestis
ccacggugccuagccuauuug

SEQ ID NO: 2259320 - RNA, 14 nt, Yersinia pestis
ccacaucaaccuga

SEQ ID NO: 2259321 - RNA, 13 nt, Yersinia pestis
ccacaucaggccg

SEQ ID NO: 2259322 - RNA, 19 nt, Yersinia pestis
ccacauaacgcacugguca

SEQ ID NO: 2259323 - RNA, 19 nt, Yersinia pestis
ccacauaaaauagcccagu

SEQ ID NO: 2259324 - RNA, 21 nt, Yersinia pestis
ccacaucggccccuuaccuac

SEQ ID NO: 2259325 - RNA, 19 nt, Yersinia pestis
ccacaugagauucaggaga

SEQ ID NO: 2259326 - RNA, 20 nt, Yersinia pestis
ccacaugagauucaggagau

SEQ ID NO: 2259327 - RNA, 18 nt, Yersinia pestis
ccacauggcugcucagcc

SEQ ID NO: 2259328 - RNA, 20 nt, Yersinia pestis
ccaccaagggucaucaacaa

SEQ ID NO: 2259329 - RNA, 14 nt, Yersinia pestis
ccaccaaauaaaac

SEQ ID NO: 2259330 - RNA, 14 nt, Yersinia pestis
ccaccaacccgccc

SEQ ID NO: 2259331 - RNA, 18 nt, Yersinia pestis
ccacauuuuggccuucau

SEQ ID NO: 2259332 - RNA, 23 nt, Yersinia pestis
ccacauuuccuaugugauauuuu

SEQ ID NO: 2259333 - RNA, 20 nt, Yersinia pestis
ccacauucaguacauaaacc

SEQ ID NO: 2259334 - RNA, 14 nt, Yersinia pestis
ccaccacaucaucc

SEQ ID NO: 2259335 - RNA, 17 nt, Yersinia pestis
ccaccagcguggcauug

SEQ ID NO: 2259336 - RNA, 20 nt, Yersinia pestis
ccaccagacugacaaccacu

SEQ ID NO: 2259337 - RNA, 16 nt, Yersinia pestis
ccaccaucacuuccag

SEQ ID NO: 2259338 - RNA, 18 nt, Yersinia pestis
ccaccaugaugaaucugu

SEQ ID NO: 2259339 - RNA, 15 nt, Yersinia pestis
ccaccccagcauuca

SEQ ID NO: 2259340 - RNA, 15 nt, Yersinia pestis
ccacccccagugcug

SEQ ID NO: 2259341 - RNA, 13 nt, Yersinia pestis
ccaaccgguauug

SEQ ID NO: 2259342 - RNA, 17 nt, Yersinia pestis
ccaaccuuguaacuuua

SEQ ID NO: 2259343 - RNA, 21 nt, Yersinia pestis
ccaacgcaagcgggccaaggg

SEQ ID NO: 2259344 - RNA, 23 nt, Yersinia pestis
ccaacgguagggcguucugucac

SEQ ID NO: 2259345 - RNA, 21 nt, Yersinia pestis
ccaacgguagguucaacccaa

SEQ ID NO: 2259346 - RNA, 15 nt, Yersinia pestis
ccaacggacacauaa

SEQ ID NO: 2259347 - RNA, 21 nt, Yersinia pestis
ccaacggcuaacgguaaauaa

SEQ ID NO: 2259348 - RNA, 18 nt, Yersinia pestis
ccaacuccugccuacgcu

SEQ ID NO: 2259349 - RNA, 15 nt, Yersinia pestis
ccaacugaaacugga

SEQ ID NO: 2259350 - RNA, 15 nt, Yersinia pestis
ccaacugauuuuuau

SEQ ID NO: 2259351 - RNA, 15 nt, Yersinia pestis
ccaacugacugaagu

SEQ ID NO: 2259352 - RNA, 14 nt, Yersinia pestis
ccaacuugccgcgg

SEQ ID NO: 2259353 - RNA, 22 nt, Yersinia pestis
ccaacuuuuuuaccacauuucc

SEQ ID NO: 2259354 - RNA, 22 nt, Yersinia pestis
ccaagaaacgccccgauaaacc

SEQ ID NO: 2259355 - RNA, 14 nt, Yersinia pestis
ccaacuguaaaauc

SEQ ID NO: 2259356 - RNA, 14 nt, Yersinia pestis
ccaacuuaccuuga

SEQ ID NO: 2259357 - RNA, 19 nt, Yersinia pestis
ccaacuuaccuugauccgc

SEQ ID NO: 2259358 - RNA, 15 nt, Yersinia pestis
ccaaauugugaguua

SEQ ID NO: 2259359 - RNA, 21 nt, Yersinia pestis
ccaaauguuggauaacccccu

SEQ ID NO: 2259360 - RNA, 19 nt, Yersinia pestis
ccaaaugcucagccaucuc

SEQ ID NO: 2259361 - RNA, 18 nt, Yersinia pestis
ccaaauggacgaacagcc

SEQ ID NO: 2259362 - RNA, 16 nt, Yersinia pestis
ccaaaugagaugggcc

SEQ ID NO: 2259363 - RNA, 14 nt, Yersinia pestis
ccaacaccaccauc

SEQ ID NO: 2259364 - RNA, 17 nt, Yersinia pestis
ccaacaauugcuccagu

SEQ ID NO: 2259365 - RNA, 16 nt, Yersinia pestis
ccaacaauuugcgccc

SEQ ID NO: 2259366 - RNA, 14 nt, Yersinia pestis
ccaacaacugcccc

SEQ ID NO: 2259367 - RNA, 20 nt, Yersinia pestis
ccaacaacuggguggccagu

SEQ ID NO: 2259368 - RNA, 23 nt, Yersinia pestis
ccaacacguggguauccaguguc

SEQ ID NO: 2259369 - RNA, 16 nt, Yersinia pestis
ccaacacuggggcgca

SEQ ID NO: 2259370 - RNA, 17 nt, Yersinia pestis
ccaacaguuauuuuaau

SEQ ID NO: 2259371 - RNA, 16 nt, Yersinia pestis
ccaacagcauuaccaa

SEQ ID NO: 2259372 - RNA, 16 nt, Yersinia pestis
ccaacaucuuccaaug

SEQ ID NO: 2259373 - RNA, 22 nt, Yersinia pestis
ccaacaucgcuugugcuacauc

SEQ ID NO: 2259374 - RNA, 14 nt, Yersinia pestis
ccaaccaggccgcc

SEQ ID NO: 2259375 - RNA, 20 nt, Yersinia pestis
ccaacccccauuagcaguaa

SEQ ID NO: 2259376 - RNA, 14 nt, Yersinia pestis
ccaaccaucaucaa

SEQ ID NO: 2259377 - RNA, 14 nt, Yersinia pestis
ccaacccuuuuuga

SEQ ID NO: 2259378 - RNA, 19 nt, Yersinia pestis
ccaaaacagccuaaggcca

SEQ ID NO: 2259379 - RNA, 10 nt, Yersinia pestis
ccaaaaccuu

SEQ ID NO: 2259380 - RNA, 16 nt, Yersinia pestis
ccaaaacgacgggcca

SEQ ID NO: 2259381 - RNA, 22 nt, Yersinia pestis
ccaaaaccgugacuaaaacaag

SEQ ID NO: 2259382 - RNA, 22 nt, Yersinia pestis
ccaaaccauugguuaaguuuca

SEQ ID NO: 2259383 - RNA, 15 nt, Yersinia pestis
ccaaacaccacgcca

SEQ ID NO: 2259384 - RNA, 12 nt, Yersinia pestis
ccaaacauuuuc

SEQ ID NO: 2259385 - RNA, 14 nt, Yersinia pestis
ccaaaccaaaaacu

SEQ ID NO: 2259386 - RNA, 19 nt, Yersinia pestis
ccaaacauugucaccugaa

SEQ ID NO: 2259387 - RNA, 22 nt, Yersinia pestis
ccaaaauaugauaguguaaaaa

SEQ ID NO: 2259388 - RNA, 15 nt, Yersinia pestis
ccaaaaucaaauacu

SEQ ID NO: 2259389 - RNA, 20 nt, Yersinia pestis
ccaaacaaaugaacccuuuc

SEQ ID NO: 2259390 - RNA, 19 nt, Yersinia pestis
ccaaaauuuagaagcccug

SEQ ID NO: 2259391 - RNA, 12 nt, Yersinia pestis
ccaaaauuugcu

SEQ ID NO: 2259392 - RNA, 14 nt, Yersinia pestis
ccaaacucuggaug

SEQ ID NO: 2259393 - RNA, 16 nt, Yersinia pestis
ccaaagauaucuuuga

SEQ ID NO: 2259394 - RNA, 18 nt, Yersinia pestis
ccaaagauauguucuucc

SEQ ID NO: 2259395 - RNA, 13 nt, Yersinia pestis
ccaaagcugcgcc

SEQ ID NO: 2259396 - RNA, 19 nt, Yersinia pestis
ccaaagccgucaguuccug

SEQ ID NO: 2259397 - RNA, 22 nt, Yersinia pestis
ccaaauacauauaaccaucaaa

SEQ ID NO: 2259398 - RNA, 18 nt, Yersinia pestis
ccaaauaaauauccuccg

SEQ ID NO: 2259399 - RNA, 12 nt, Yersinia pestis
ccaaauaaaaca

SEQ ID NO: 2259400 - RNA, 16 nt, Yersinia pestis
ccaaaguagaacuggc

SEQ ID NO: 2259401 - RNA, 14 nt, Yersinia pestis
ccaaaucagcaagc

SEQ ID NO: 2259402 - RNA, 17 nt, Yersinia pestis
ccaaaucagcaagcugc

SEQ ID NO: 2259403 - RNA, 22 nt, Yersinia pestis
ccaaaucaguaccaccaccaca

SEQ ID NO: 2259404 - RNA, 16 nt, Yersinia pestis
ccaaaugcaaaccagg

SEQ ID NO: 2259405 - RNA, 15 nt, Yersinia pestis
ccaagguuauacacu

SEQ ID NO: 2259406 - RNA, 17 nt, Yersinia pestis
ccaaggggagccacaca

SEQ ID NO: 2259407 - RNA, 17 nt, Yersinia pestis
ccaaggagaucgcucuc

SEQ ID NO: 2259408 - RNA, 23 nt, Yersinia pestis
ccaaggauggcgcggcucgagcc

SEQ ID NO: 2259409 - RNA, 21 nt, Yersinia pestis
ccaagcuuuugccacauuucc

SEQ ID NO: 2259410 - RNA, 14 nt, Yersinia pestis
ccaagcggcagggg

SEQ ID NO: 2259411 - RNA, 13 nt, Yersinia pestis
ccaagaggcugcg

SEQ ID NO: 2259412 - RNA, 17 nt, Yersinia pestis
ccaagauaccgaguucu

SEQ ID NO: 2259413 - RNA, 19 nt, Yersinia pestis
ccaagaauaauaacgccua

SEQ ID NO: 2259414 - RNA, 17 nt, Yersinia pestis
ccaagaacccuuuaucu

SEQ ID NO: 2259415 - RNA, 14 nt, Yersinia pestis
ccaagacuuuccac

SEQ ID NO: 2259416 - RNA, 17 nt, Yersinia pestis
ccaaugacguugaguaa

SEQ ID NO: 2259417 - RNA, 21 nt, Yersinia pestis
ccaaugaugacuugauuaaca

SEQ ID NO: 2259418 - RNA, 12 nt, Yersinia pestis
ccaaugauuaac

SEQ ID NO: 2259419 - RNA, 18 nt, Yersinia pestis
ccaaucggccuuaaccaa

SEQ ID NO: 2259420 - RNA, 22 nt, Yersinia pestis
ccaaucgcucugcguuuuuccc

SEQ ID NO: 2259421 - RNA, 18 nt, Yersinia pestis
ccaaucauuacaucaucu

SEQ ID NO: 2259422 - RNA, 14 nt, Yersinia pestis
ccaauccccaccaa

SEQ ID NO: 2259423 - RNA, 19 nt, Yersinia pestis
ccaauagaaaaacacuggc

SEQ ID NO: 2259424 - RNA, 13 nt, Yersinia pestis
ccaauauccauau

SEQ ID NO: 2259425 - RNA, 14 nt, Yersinia pestis
ccaauauugaguaa

SEQ ID NO: 2259426 - RNA, 21 nt, Yersinia pestis
ccaauaucuguggugacauga

SEQ ID NO: 2259427 - RNA, 23 nt, Yersinia pestis
ccaauacaaacagggcagccaau

SEQ ID NO: 2259428 - RNA, 23 nt, Yersinia pestis
ccaauaauaaaaaaaaauaaaau

SEQ ID NO: 2259429 - RNA, 16 nt, Yersinia pestis
ccaauaaugccgaaug

SEQ ID NO: 2259430 - RNA, 15 nt, Yersinia pestis
ccaauaccaauucuu

SEQ ID NO: 2259431 - RNA, 17 nt, Yersinia pestis
ccaauaccauuuuagcu

SEQ ID NO: 2259432 - RNA, 14 nt, Yersinia pestis
ccaauaacguccug

SEQ ID NO: 2259433 - RNA, 17 nt, Yersinia pestis
ccaauaauaauccauaa

SEQ ID NO: 2259434 - RNA, 18 nt, Yersinia pestis
ccaauaauaaaaaaaaau

SEQ ID NO: 2259435 - RNA, 19 nt, Yersinia pestis
ccacaaaggucagcauggu

SEQ ID NO: 2259436 - RNA, 16 nt, Yersinia pestis
ccaauuguuucuuccc

SEQ ID NO: 2259437 - RNA, 16 nt, Yersinia pestis
ccaauuuuucuguauc

SEQ ID NO: 2259438 - RNA, 15 nt, Yersinia pestis
ccacaaccugcgcca

SEQ ID NO: 2259439 - RNA, 22 nt, Yersinia pestis
ccacaauccgguguuccacaau

SEQ ID NO: 2259440 - RNA, 18 nt, Yersinia pestis
ccaauucguauuccucaa

SEQ ID NO: 2259441 - RNA, 13 nt, Yersinia pestis
ccaauucaucagc

SEQ ID NO: 2259442 - RNA, 18 nt, Yersinia pestis
ccaauucacgcaaggcca

SEQ ID NO: 2259443 - RNA, 22 nt, Yersinia pestis
ccaauucacgcagguaguuagu

SEQ ID NO: 2259444 - RNA, 11 nt, Yersinia pestis
ccaaugcuuuu

SEQ ID NO: 2259445 - RNA, 19 nt, Yersinia pestis
ccaaugcauccaagccauc

SEQ ID NO: 2259446 - RNA, 15 nt, Yersinia pestis
ccacaccggcugcaa

SEQ ID NO: 2259447 - RNA, 21 nt, Yersinia pestis
ccacacccucuaucucacccu

SEQ ID NO: 2259448 - RNA, 21 nt, Yersinia pestis
ccacacagcauucugcuucca

SEQ ID NO: 2259449 - RNA, 15 nt, Yersinia pestis
ccacacaauacauag

SEQ ID NO: 2259450 - RNA, 21 nt, Yersinia pestis
ccacacaguauucugcuucca

SEQ ID NO: 2259451 - RNA, 20 nt, Yersinia pestis
ccacacauaccacacacaaa

SEQ ID NO: 2259452 - RNA, 14 nt, Yersinia pestis
ccacacuuuugcug

SEQ ID NO: 2259453 - RNA, 12 nt, Yersinia pestis
ccacacugucau

SEQ ID NO: 2259454 - RNA, 15 nt, Yersinia pestis
ccacagcgagcggcg

SEQ ID NO: 2259455 - RNA, 22 nt, Yersinia pestis
ccacagcgagcggcgauaucac

SEQ ID NO: 2259456 - RNA, 20 nt, Yersinia pestis
ccacagguggggcaguuaac

SEQ ID NO: 2259457 - RNA, 20 nt, Yersinia pestis
ccagcuuacgguuagcgauu

SEQ ID NO: 2259458 - RNA, 11 nt, Yersinia pestis
ccagcuucccu

SEQ ID NO: 2259459 - RNA, 16 nt, Yersinia pestis
ccagcuucuuuuaaag

SEQ ID NO: 2259460 - RNA, 16 nt, Yersinia pestis
ccaggcaagaaacuuc

SEQ ID NO: 2259461 - RNA, 15 nt, Yersinia pestis
ccaggcaacgacagc

SEQ ID NO: 2259462 - RNA, 19 nt, Yersinia pestis
ccagcuuuagcauugcaga

SEQ ID NO: 2259463 - RNA, 17 nt, Yersinia pestis
ccagccccuaacagcag

SEQ ID NO: 2259464 - RNA, 18 nt, Yersinia pestis
ccagcgguguuaccagac

SEQ ID NO: 2259465 - RNA, 19 nt, Yersinia pestis
ccagcguaaacaguagcag

SEQ ID NO: 2259466 - RNA, 18 nt, Yersinia pestis
ccagcguggcccaggcaa

SEQ ID NO: 2259467 - RNA, 14 nt, Yersinia pestis
ccagcucauauaau

SEQ ID NO: 2259468 - RNA, 12 nt, Yersinia pestis
ccagcucaccgu

SEQ ID NO: 2259469 - RNA, 15 nt, Yersinia pestis
ccagguucaauuuca

SEQ ID NO: 2259470 - RNA, 19 nt, Yersinia pestis
ccagguucauuauuuauuc

SEQ ID NO: 2259471 - RNA, 12 nt, Yersinia pestis
ccaguaacuggc

SEQ ID NO: 2259472 - RNA, 23 nt, Yersinia pestis
ccaguaagcuguugaccugaaga

SEQ ID NO: 2259473 - RNA, 17 nt, Yersinia pestis
ccaguaaaagaauaaau

SEQ ID NO: 2259474 - RNA, 13 nt, Yersinia pestis
ccaguaaaaaaau

SEQ ID NO: 2259475 - RNA, 14 nt, Yersinia pestis
ccaguaaaaaaaua

SEQ ID NO: 2259476 - RNA, 16 nt, Yersinia pestis
ccaguaaaaaaauagc

SEQ ID NO: 2259477 - RNA, 20 nt, Yersinia pestis
ccagggcuaaaauggcacaa

SEQ ID NO: 2259478 - RNA, 21 nt, Yersinia pestis
ccagguaagaaagagaugacc

SEQ ID NO: 2259479 - RNA, 13 nt, Yersinia pestis
ccagggcaccaag

SEQ ID NO: 2259480 - RNA, 20 nt, Yersinia pestis
ccaggcgaucucuucggccc

SEQ ID NO: 2259481 - RNA, 18 nt, Yersinia pestis
ccaggccuagcccaguac

SEQ ID NO: 2259482 - RNA, 19 nt, Yersinia pestis
ccaggccuccgcaaacuua

SEQ ID NO: 2259483 - RNA, 13 nt, Yersinia pestis
ccaggcacugucc

SEQ ID NO: 2259484 - RNA, 21 nt, Yersinia pestis
ccauagaugcaaaugucagau

SEQ ID NO: 2259485 - RNA, 20 nt, Yersinia pestis
ccauacucccguaauuuauu

SEQ ID NO: 2259486 - RNA, 18 nt, Yersinia pestis
ccauagccgaucaccgca

SEQ ID NO: 2259487 - RNA, 19 nt, Yersinia pestis
ccauacgaauuuuucccug

SEQ ID NO: 2259488 - RNA, 22 nt, Yersinia pestis
ccauaaucuggaagcgcagguu

SEQ ID NO: 2259489 - RNA, 23 nt, Yersinia pestis
ccauaaucgcaccggagcaaggg

SEQ ID NO: 2259490 - RNA, 21 nt, Yersinia pestis
ccauacccuuuggucaauaaa

SEQ ID NO: 2259491 - RNA, 14 nt, Yersinia pestis
ccauaaugugccuc

SEQ ID NO: 2259492 - RNA, 21 nt, Yersinia pestis
ccauaaugccguuauagaucu

SEQ ID NO: 2259493 - RNA, 23 nt, Yersinia pestis
ccauauagcggcguucagcaaua

SEQ ID NO: 2259494 - RNA, 12 nt, Yersinia pestis
ccauaguugaac

SEQ ID NO: 2259495 - RNA, 23 nt, Yersinia pestis
ccauagugauuauuuaaacaaug

SEQ ID NO: 2259496 - RNA, 16 nt, Yersinia pestis
ccauagguugcaacug

SEQ ID NO: 2259497 - RNA, 17 nt, Yersinia pestis
ccaucaacauacugaua

SEQ ID NO: 2259498 - RNA, 21 nt, Yersinia pestis
ccaucaaauacacauaaccau

SEQ ID NO: 2259499 - RNA, 22 nt, Yersinia pestis
ccaucaccaucggcaauaauau

SEQ ID NO: 2259500 - RNA, 19 nt, Yersinia pestis
ccaucaacgacaacaucaa

SEQ ID NO: 2259501 - RNA, 18 nt, Yersinia pestis
ccaguggucaucaccguu

SEQ ID NO: 2259502 - RNA, 19 nt, Yersinia pestis
ccaguggcucgacggccaa

SEQ ID NO: 2259503 - RNA, 13 nt, Yersinia pestis
ccaguuauuauuu

SEQ ID NO: 2259504 - RNA, 23 nt, Yersinia pestis
ccaguucaagauaaaguucuucg

SEQ ID NO: 2259505 - RNA, 15 nt, Yersinia pestis
ccaguguucauauuc

SEQ ID NO: 2259506 - RNA, 20 nt, Yersinia pestis
ccaguguuuucuccacacca

SEQ ID NO: 2259507 - RNA, 16 nt, Yersinia pestis
ccaguucaguccagcc

SEQ ID NO: 2259508 - RNA, 17 nt, Yersinia pestis
ccaguucaguccagcca

SEQ ID NO: 2259509 - RNA, 16 nt, Yersinia pestis
ccauaauccagaagcc

SEQ ID NO: 2259510 - RNA, 21 nt, Yersinia pestis
ccauaaaauaaauaauuugua

SEQ ID NO: 2259511 - RNA, 19 nt, Yersinia pestis
ccauaaaaggauggcccaa

SEQ ID NO: 2259512 - RNA, 22 nt, Yersinia pestis
ccauaagugaacaugaugaaug

SEQ ID NO: 2259513 - RNA, 20 nt, Yersinia pestis
ccaguuuuccagagcccggg

SEQ ID NO: 2259514 - RNA, 18 nt, Yersinia pestis
ccaguuuuuuccugcugc

SEQ ID NO: 2259515 - RNA, 14 nt, Yersinia pestis
ccaugccgguugau

SEQ ID NO: 2259516 - RNA, 15 nt, Yersinia pestis
ccaugcacuccacua

SEQ ID NO: 2259517 - RNA, 18 nt, Yersinia pestis
ccaugcacuccacuaugc

SEQ ID NO: 2259518 - RNA, 13 nt, Yersinia pestis
ccaugaccgccag

SEQ ID NO: 2259519 - RNA, 12 nt, Yersinia pestis
ccaugagaacca

SEQ ID NO: 2259520 - RNA, 16 nt, Yersinia pestis
ccaugagugaaaauau

SEQ ID NO: 2259521 - RNA, 17 nt, Yersinia pestis
ccaugagguuuauuccu

SEQ ID NO: 2259522 - RNA, 22 nt, Yersinia pestis
ccaugacaaaauacgguucacu

SEQ ID NO: 2259523 - RNA, 23 nt, Yersinia pestis
ccaucugaugaguguuuauucuc

SEQ ID NO: 2259524 - RNA, 13 nt, Yersinia pestis
ccaucucaauagc

SEQ ID NO: 2259525 - RNA, 21 nt, Yersinia pestis
ccaucuaauagaauagauccc

SEQ ID NO: 2259526 - RNA, 18 nt, Yersinia pestis
ccaucucauguuaaauga

SEQ ID NO: 2259527 - RNA, 18 nt, Yersinia pestis
ccaucuaacugcacaauu

SEQ ID NO: 2259528 - RNA, 20 nt, Yersinia pestis
ccaucgcuuuggcuucugga

SEQ ID NO: 2259529 - RNA, 22 nt, Yersinia pestis
ccaucgcuuuggcuucuggaug

SEQ ID NO: 2259530 - RNA, 21 nt, Yersinia pestis
ccauccccaacucuuucaacu

SEQ ID NO: 2259531 - RNA, 17 nt, Yersinia pestis
ccauccggguuuauccc

SEQ ID NO: 2259532 - RNA, 19 nt, Yersinia pestis
ccauccuagcguuucuaca

SEQ ID NO: 2259533 - RNA, 17 nt, Yersinia pestis
ccauccuagcguuucua

SEQ ID NO: 2259534 - RNA, 20 nt, Yersinia pestis
ccaucgaacgcgucacuggc

SEQ ID NO: 2259535 - RNA, 13 nt, Yersinia pestis
ccauccacuaggu

SEQ ID NO: 2259536 - RNA, 16 nt, Yersinia pestis
ccauuaucguuagcau

SEQ ID NO: 2259537 - RNA, 16 nt, Yersinia pestis
ccauuacuguccuuua

SEQ ID NO: 2259538 - RNA, 14 nt, Yersinia pestis
ccauuacgccaccu

SEQ ID NO: 2259539 - RNA, 20 nt, Yersinia pestis
ccauucacgccgcuccugau

SEQ ID NO: 2259540 - RNA, 20 nt, Yersinia pestis
ccauucaccguguuucagca

SEQ ID NO: 2259541 - RNA, 20 nt, Yersinia pestis
ccauucaaaaauuaaauuaa

SEQ ID NO: 2259542 - RNA, 22 nt, Yersinia pestis
ccauucaaaaauuaaauuaaua

SEQ ID NO: 2259543 - RNA, 19 nt, Yersinia pestis
ccauuaaccuaaaaacguc

SEQ ID NO: 2259544 - RNA, 19 nt, Yersinia pestis
ccauuacagcaccuggaac

SEQ ID NO: 2259545 - RNA, 16 nt, Yersinia pestis
ccauguugugugugaa

SEQ ID NO: 2259546 - RNA, 22 nt, Yersinia pestis
ccauuaacaauguuauauuucu

SEQ ID NO: 2259547 - RNA, 17 nt, Yersinia pestis
ccauuccguuauuaaac

SEQ ID NO: 2259548 - RNA, 23 nt, Yersinia pestis
ccauucgucacugucagacaguu

SEQ ID NO: 2259549 - RNA, 16 nt, Yersinia pestis
ccauuggcaaaggcca

SEQ ID NO: 2259550 - RNA, 23 nt, Yersinia pestis
ccauugcgguuacguucaccuaa

SEQ ID NO: 2259551 - RNA, 16 nt, Yersinia pestis
ccaugcgcucuugcau

SEQ ID NO: 2259552 - RNA, 20 nt, Yersinia pestis
ccaugcuuucuaacaaaccu

SEQ ID NO: 2259553 - RNA, 21 nt, Yersinia pestis
ccaugcugcuugauuugcugg

SEQ ID NO: 2259554 - RNA, 21 nt, Yersinia pestis
ccaugucaggccaccaaucac

SEQ ID NO: 2259555 - RNA, 21 nt, Yersinia pestis
ccauguuaauggggcauugca

SEQ ID NO: 2259556 - RNA, 20 nt, Yersinia pestis
ccauguuagagauaacaacu

SEQ ID NO: 2259557 - RNA, 17 nt, Yersinia pestis
ccauggcguaaccgccg

SEQ ID NO: 2259558 - RNA, 19 nt, Yersinia pestis
ccaugggccucaucugcgg

SEQ ID NO: 2259559 - RNA, 15 nt, Yersinia pestis
ccaugggaaaucaaa

SEQ ID NO: 2259560 - RNA, 20 nt, Yersinia pestis
ccauguaggcucgagccgcg

SEQ ID NO: 2259561 - RNA, 17 nt, Yersinia pestis
ccauguacuuaauacug

SEQ ID NO: 2259562 - RNA, 20 nt, Yersinia pestis
cccaauaauaaaaaaaaaua

SEQ ID NO: 2259563 - RNA, 21 nt, Yersinia pestis
cccaauaagugaaacaaauac

SEQ ID NO: 2259564 - RNA, 17 nt, Yersinia pestis
cccaagggcuauugcug

SEQ ID NO: 2259565 - RNA, 18 nt, Yersinia pestis
cccaaggcgacuuugaug

SEQ ID NO: 2259566 - RNA, 17 nt, Yersinia pestis
ccauuguauugcucagg

SEQ ID NO: 2259567 - RNA, 17 nt, Yersinia pestis
cccaacuggcgcgggaa

SEQ ID NO: 2259568 - RNA, 15 nt, Yersinia pestis
cccaagaauaauaac

SEQ ID NO: 2259569 - RNA, 13 nt, Yersinia pestis
cccaacugacuga

SEQ ID NO: 2259570 - RNA, 12 nt, Yersinia pestis
cccaagcaggaa

SEQ ID NO: 2259571 - RNA, 12 nt, Yersinia pestis
cccacauucagg

SEQ ID NO: 2259572 - RNA, 15 nt, Yersinia pestis
cccacauucaggccg

SEQ ID NO: 2259573 - RNA, 21 nt, Yersinia pestis
cccaccauaaugugccucgaa

SEQ ID NO: 2259574 - RNA, 14 nt, Yersinia pestis
cccaaugucaggaa

SEQ ID NO: 2259575 - RNA, 13 nt, Yersinia pestis
cccagaggguuaa

SEQ ID NO: 2259576 - RNA, 22 nt, Yersinia pestis
cccagagcgcggcuucagcacc

SEQ ID NO: 2259577 - RNA, 21 nt, Yersinia pestis
cccagagcgcaaaagaccaag

SEQ ID NO: 2259578 - RNA, 16 nt, Yersinia pestis
cccagaaaggcaaaaa

SEQ ID NO: 2259579 - RNA, 16 nt, Yersinia pestis
cccacuuuuugaauaa

SEQ ID NO: 2259580 - RNA, 21 nt, Yersinia pestis
cccacuuguaccugugccagu

SEQ ID NO: 2259581 - RNA, 16 nt, Yersinia pestis
cccacucgccccacaa

SEQ ID NO: 2259582 - RNA, 17 nt, Yersinia pestis
ccccuagccagccaccg

SEQ ID NO: 2259583 - RNA, 13 nt, Yersinia pestis
ccccuagccagcc

SEQ ID NO: 2259584 - RNA, 15 nt, Yersinia pestis
ccccuccggaaucag

SEQ ID NO: 2259585 - RNA, 17 nt, Yersinia pestis
ccccuaagguucacccu

SEQ ID NO: 2259586 - RNA, 15 nt, Yersinia pestis
ccccuaauucuccuu

SEQ ID NO: 2259587 - RNA, 14 nt, Yersinia pestis
ccccgguaaucuga

SEQ ID NO: 2259588 - RNA, 15 nt, Yersinia pestis
ccccgugguuguauc

SEQ ID NO: 2259589 - RNA, 15 nt, Yersinia pestis
cccccuuuggccgcu

SEQ ID NO: 2259590 - RNA, 17 nt, Yersinia pestis
cccccuuuuucaaucac

SEQ ID NO: 2259591 - RNA, 17 nt, Yersinia pestis
cccccuuucaccaacca

SEQ ID NO: 2259592 - RNA, 15 nt, Yersinia pestis
cccccuguaaaacaa

SEQ ID NO: 2259593 - RNA, 21 nt, Yersinia pestis
cccauuugcccgaaucacugg

SEQ ID NO: 2259594 - RNA, 15 nt, Yersinia pestis
cccauuuaucgccaa

SEQ ID NO: 2259595 - RNA, 18 nt, Yersinia pestis
cccauucgcgccccaaau

SEQ ID NO: 2259596 - RNA, 14 nt, Yersinia pestis
cccauugcaccaau

SEQ ID NO: 2259597 - RNA, 15 nt, Yersinia pestis
cccauucgcgcccca

SEQ ID NO: 2259598 - RNA, 17 nt, Yersinia pestis
cccauucgcgccccaaa

SEQ ID NO: 2259599 - RNA, 12 nt, Yersinia pestis
ccccaucucuuc

SEQ ID NO: 2259600 - RNA, 13 nt, Yersinia pestis
ccccaugaccgcc

SEQ ID NO: 2259601 - RNA, 13 nt, Yersinia pestis
ccccaucgccaau

SEQ ID NO: 2259602 - RNA, 23 nt, Yersinia pestis
ccccaucgccaauacaaucguca

SEQ ID NO: 2259603 - RNA, 14 nt, Yersinia pestis
ccccaucauaaagg

SEQ ID NO: 2259604 - RNA, 12 nt, Yersinia pestis
ccccauccccaa

SEQ ID NO: 2259605 - RNA, 19 nt, Yersinia pestis
cccagcauucagguguuca

SEQ ID NO: 2259606 - RNA, 12 nt, Yersinia pestis
cccaguaaugcc

SEQ ID NO: 2259607 - RNA, 22 nt, Yersinia pestis
cccaguaaagcaaauucccacc

SEQ ID NO: 2259608 - RNA, 15 nt, Yersinia pestis
cccagguuacugccc

SEQ ID NO: 2259609 - RNA, 23 nt, Yersinia pestis
cccaggugcuuauuuauuuuuaa

SEQ ID NO: 2259610 - RNA, 14 nt, Yersinia pestis
cccaggcguucugu

SEQ ID NO: 2259611 - RNA, 17 nt, Yersinia pestis
cccaguagagcacuuca

SEQ ID NO: 2259612 - RNA, 16 nt, Yersinia pestis
cccaguaccgcuggug

SEQ ID NO: 2259613 - RNA, 18 nt, Yersinia pestis
cccaguacagaauuucau

SEQ ID NO: 2259614 - RNA, 14 nt, Yersinia pestis
cccaguaccgcugg

SEQ ID NO: 2259615 - RNA, 16 nt, Yersinia pestis
cccauagcuggcuuca

SEQ ID NO: 2259616 - RNA, 15 nt, Yersinia pestis
cccaucaaccaccgc

SEQ ID NO: 2259617 - RNA, 22 nt, Yersinia pestis
cccaucaacgacaacaucaaug

SEQ ID NO: 2259618 - RNA, 20 nt, Yersinia pestis
cccauauaaaaaacuaaugu

SEQ ID NO: 2259619 - RNA, 21 nt, Yersinia pestis
cccauacaaauaguaauaauu

SEQ ID NO: 2259620 - RNA, 22 nt, Yersinia pestis
cccauacaaauaguaauaauua

SEQ ID NO: 2259621 - RNA, 16 nt, Yersinia pestis
cccaguuacuaccuuu

SEQ ID NO: 2259622 - RNA, 17 nt, Yersinia pestis
cccaucaauuuccccaa

SEQ ID NO: 2259623 - RNA, 17 nt, Yersinia pestis
cccaucaugccagcaau

SEQ ID NO: 2259624 - RNA, 11 nt, Yersinia pestis
cccaucacuag

SEQ ID NO: 2259625 - RNA, 13 nt, Yersinia pestis
cccaucagcacuc

SEQ ID NO: 2259626 - RNA, 21 nt, Yersinia pestis
cccaucgccaauacaaucguc

SEQ ID NO: 2259627 - RNA, 15 nt, Yersinia pestis
cccaugaccacuugg

SEQ ID NO: 2259628 - RNA, 15 nt, Yersinia pestis
cgaaguuagacccaa

SEQ ID NO: 2259629 - RNA, 17 nt, Yersinia pestis
cgaauaaacaccgugcu

SEQ ID NO: 2259630 - RNA, 22 nt, Yersinia pestis
cgaaggggcguuuaaugccccu

SEQ ID NO: 2259631 - RNA, 18 nt, Yersinia pestis
cgaaggcgcguuacaccg

SEQ ID NO: 2259632 - RNA, 14 nt, Yersinia pestis
cgaacuaucuuuuc

SEQ ID NO: 2259633 - RNA, 18 nt, Yersinia pestis
cgaacuacgccucgcaga

SEQ ID NO: 2259634 - RNA, 19 nt, Yersinia pestis
cgaacuucaucggauugaa

SEQ ID NO: 2259635 - RNA, 21 nt, Yersinia pestis
cgaagauaaccggcuggaaau

SEQ ID NO: 2259636 - RNA, 17 nt, Yersinia pestis
cgaagaaacggcucgau

SEQ ID NO: 2259637 - RNA, 15 nt, Yersinia pestis
cgaauauaguugauc

SEQ ID NO: 2259638 - RNA, 13 nt, Yersinia pestis
cgaaucacugacu

SEQ ID NO: 2259639 - RNA, 15 nt, Yersinia pestis
cgaauagucuguuuc

SEQ ID NO: 2259640 - RNA, 17 nt, Yersinia pestis
cgaaugaucagaggcug

SEQ ID NO: 2259641 - RNA, 17 nt, Yersinia pestis
cgaaugaguuuuguccu

SEQ ID NO: 2259642 - RNA, 21 nt, Yersinia pestis
cgaaugagcaguaauagcaaa

SEQ ID NO: 2259643 - RNA, 20 nt, Yersinia pestis
cgaauuauuuagagucuaua

SEQ ID NO: 2259644 - RNA, 13 nt, Yersinia pestis
cgaauuuuauuca

SEQ ID NO: 2259645 - RNA, 16 nt, Yersinia pestis
cgacaaaaaagcggcu

SEQ ID NO: 2259646 - RNA, 23 nt, Yersinia pestis
cgacaauaccgccacacaauaca

SEQ ID NO: 2259647 - RNA, 16 nt, Yersinia pestis
cgacaauauaauaaug

SEQ ID NO: 2259648 - RNA, 17 nt, Yersinia pestis
cgacaauauaauaaugc

SEQ ID NO: 2259649 - RNA, 18 nt, Yersinia pestis
cgacaacuucaauaccaa

SEQ ID NO: 2259650 - RNA, 16 nt, Yersinia pestis
cgacagcaacaacaaa

SEQ ID NO: 2259651 - RNA, 13 nt, Yersinia pestis
cgacacaaaugcu

SEQ ID NO: 2259652 - RNA, 13 nt, Yersinia pestis
cgacaccaaucuu

SEQ ID NO: 2259653 - RNA, 13 nt, Yersinia pestis
cgacacccagcca

SEQ ID NO: 2259654 - RNA, 17 nt, Yersinia pestis
cgaccugaugccccaug

SEQ ID NO: 2259655 - RNA, 14 nt, Yersinia pestis
cgaccgucaccaaa

SEQ ID NO: 2259656 - RNA, 20 nt, Yersinia pestis
cgacccguuuaugccccugc

SEQ ID NO: 2259657 - RNA, 14 nt, Yersinia pestis
cgaccgcucuucac

SEQ ID NO: 2259658 - RNA, 18 nt, Yersinia pestis
cgacauccaauucaguac

SEQ ID NO: 2259659 - RNA, 20 nt, Yersinia pestis
cgacaucagcgccacagucg

SEQ ID NO: 2259660 - RNA, 15 nt, Yersinia pestis
cgaccaacuggcaau

SEQ ID NO: 2259661 - RNA, 18 nt, Yersinia pestis
cgacauuaagcauaucca

SEQ ID NO: 2259662 - RNA, 15 nt, Yersinia pestis
cgacaggcuaacaac

SEQ ID NO: 2259663 - RNA, 11 nt, Yersinia pestis
cgaccagcaga

SEQ ID NO: 2259664 - RNA, 23 nt, Yersinia pestis
ccuugacgccgaugaauauaaac

SEQ ID NO: 2259665 - RNA, 15 nt, Yersinia pestis
ccuucuuccauugau

SEQ ID NO: 2259666 - RNA, 14 nt, Yersinia pestis
ccuucuuuaucugu

SEQ ID NO: 2259667 - RNA, 18 nt, Yersinia pestis
ccuucucgaugccuucuu

SEQ ID NO: 2259668 - RNA, 15 nt, Yersinia pestis
ccuucuggugguguc

SEQ ID NO: 2259669 - RNA, 20 nt, Yersinia pestis
ccuucuggcaaaccggacau

SEQ ID NO: 2259670 - RNA, 17 nt, Yersinia pestis
ccuucuuauuuaucaca

SEQ ID NO: 2259671 - RNA, 11 nt, Yersinia pestis
ccuucuucacc

SEQ ID NO: 2259672 - RNA, 22 nt, Yersinia pestis
ccuucugaaaccccaaagcgca

SEQ ID NO: 2259673 - RNA, 19 nt, Yersinia pestis
ccuucucuuuaucaauuua

SEQ ID NO: 2259674 - RNA, 13 nt, Yersinia pestis
ccuucccauccua

SEQ ID NO: 2259675 - RNA, 11 nt, Yersinia pestis
ccuucccuggg

SEQ ID NO: 2259676 - RNA, 23 nt, Yersinia pestis
ccuucccguccacuuucaccaaa

SEQ ID NO: 2259677 - RNA, 14 nt, Yersinia pestis
ccuuccggcaucuu

SEQ ID NO: 2259678 - RNA, 20 nt, Yersinia pestis
ccuguuagggcgcggcuggu

SEQ ID NO: 2259679 - RNA, 15 nt, Yersinia pestis
ccuucgaaacugauc

SEQ ID NO: 2259680 - RNA, 15 nt, Yersinia pestis
ccuugcacaccgugc

SEQ ID NO: 2259681 - RNA, 14 nt, Yersinia pestis
ccuugccagugcaa

SEQ ID NO: 2259682 - RNA, 21 nt, Yersinia pestis
ccuugcauccggucaagcgca

SEQ ID NO: 2259683 - RNA, 17 nt, Yersinia pestis
ccuugaugugcucugcu

SEQ ID NO: 2259684 - RNA, 18 nt, Yersinia pestis
ccuugaugugcucugcuc

SEQ ID NO: 2259685 - RNA, 22 nt, Yersinia pestis
ccuugaugugcucugcuccgcc

SEQ ID NO: 2259686 - RNA, 17 nt, Yersinia pestis
ccuugagggucgcccgg

SEQ ID NO: 2259687 - RNA, 13 nt, Yersinia pestis
ccuugcugcaacg

SEQ ID NO: 2259688 - RNA, 22 nt, Yersinia pestis
ccuugcggaagguauccaauac

SEQ ID NO: 2259689 - RNA, 23 nt, Yersinia pestis
ccuugcggaagguauccaauacc

SEQ ID NO: 2259690 - RNA, 22 nt, Yersinia pestis
ccuuggcauugucugcuggccu

SEQ ID NO: 2259691 - RNA, 24 nt, Yersinia pestis
ccuuggcgcggacgcuuuacuccu

SEQ ID NO: 2259692 - RNA, 15 nt, Yersinia pestis
ccuuggcguuucuga

SEQ ID NO: 2259693 - RNA, 17 nt, Yersinia pestis
ccuuuaaaucuagcccu

SEQ ID NO: 2259694 - RNA, 13 nt, Yersinia pestis
ccuuguggaucca

SEQ ID NO: 2259695 - RNA, 17 nt, Yersinia pestis
ccuugugugaauaucag

SEQ ID NO: 2259696 - RNA, 17 nt, Yersinia pestis
ccuuguucaaucagcau

SEQ ID NO: 2259697 - RNA, 15 nt, Yersinia pestis
ccuuguugccuuucu

SEQ ID NO: 2259698 - RNA, 19 nt, Yersinia pestis
cgaacacaguccuguuuau

SEQ ID NO: 2259699 - RNA, 14 nt, Yersinia pestis
cgaaaugaucuuca

SEQ ID NO: 2259700 - RNA, 14 nt, Yersinia pestis
cgaaauauaaaaca

SEQ ID NO: 2259701 - RNA, 22 nt, Yersinia pestis
cgaaagauaauuuagcaaagcg

SEQ ID NO: 2259702 - RNA, 18 nt, Yersinia pestis
cgaaagauagcaaaagaa

SEQ ID NO: 2259703 - RNA, 15 nt, Yersinia pestis
cgaaagcgccugugg

SEQ ID NO: 2259704 - RNA, 14 nt, Yersinia pestis
cgaacaugccgaca

SEQ ID NO: 2259705 - RNA, 16 nt, Yersinia pestis
cgaacauaaaaaugca

SEQ ID NO: 2259706 - RNA, 14 nt, Yersinia pestis
cgaaccaaggcccu

SEQ ID NO: 2259707 - RNA, 21 nt, Yersinia pestis
cgaacagugccaacagcgaga

SEQ ID NO: 2259708 - RNA, 15 nt, Yersinia pestis
cgaacgcgucacugg

SEQ ID NO: 2259709 - RNA, 21 nt, Yersinia pestis
cgaacgcgucacuggccaccc

SEQ ID NO: 2259710 - RNA, 16 nt, Yersinia pestis
ccuuuauccaaccacc

SEQ ID NO: 2259711 - RNA, 21 nt, Yersinia pestis
ccuuuaucgcggacaccaacu

SEQ ID NO: 2259712 - RNA, 16 nt, Yersinia pestis
ccuuuauucauucaga

SEQ ID NO: 2259713 - RNA, 22 nt, Yersinia pestis
ccuuucaacaaauucaccagca

SEQ ID NO: 2259714 - RNA, 12 nt, Yersinia pestis
ccuuucaaaauu

SEQ ID NO: 2259715 - RNA, 19 nt, Yersinia pestis
ccuuuccccuggcguuccu

SEQ ID NO: 2259716 - RNA, 19 nt, Yersinia pestis
ccuuugacagcaucugcaa

SEQ ID NO: 2259717 - RNA, 18 nt, Yersinia pestis
ccuuugacagcaucugca

SEQ ID NO: 2259718 - RNA, 15 nt, Yersinia pestis
ccuuuguauccacgg

SEQ ID NO: 2259719 - RNA, 22 nt, Yersinia pestis
ccuuuuagccuucguuugucaa

SEQ ID NO: 2259720 - RNA, 13 nt, Yersinia pestis
ccuuuuauuuaga

SEQ ID NO: 2259721 - RNA, 12 nt, Yersinia pestis
cgaaaaaccaug

SEQ ID NO: 2259722 - RNA, 18 nt, Yersinia pestis
cgaaaaaacagcgaucua

SEQ ID NO: 2259723 - RNA, 18 nt, Yersinia pestis
cgaaaaccuaauacuuuc

SEQ ID NO: 2259724 - RNA, 12 nt, Yersinia pestis
cgaaaauaauga

SEQ ID NO: 2259725 - RNA, 22 nt, Yersinia pestis
cgaaacaccacgcccaauucca

SEQ ID NO: 2259726 - RNA, 10 nt, Yersinia pestis
cgaaacacca

SEQ ID NO: 2259727 - RNA, 12 nt, Yersinia pestis
cgaaaauuuuac

SEQ ID NO: 2259728 - RNA, 17 nt, Yersinia pestis
cgaaacacacuucgccg

SEQ ID NO: 2259729 - RNA, 15 nt, Yersinia pestis
ccuuuuugccucccc

SEQ ID NO: 2259730 - RNA, 20 nt, Yersinia pestis
ccuuuuugguuuucuauuuc

SEQ ID NO: 2259731 - RNA, 20 nt, Yersinia pestis
ccuuuuucaaucacuucugc

SEQ ID NO: 2259732 - RNA, 18 nt, Yersinia pestis
ccuuuugaauucaccaaa

SEQ ID NO: 2259733 - RNA, 20 nt, Yersinia pestis
cgcagacggcguaagccuuc

SEQ ID NO: 2259734 - RNA, 20 nt, Yersinia pestis
cgcagacugcugacaaaccc

SEQ ID NO: 2259735 - RNA, 22 nt, Yersinia pestis
cgcacuacccgaaucacugacu

SEQ ID NO: 2259736 - RNA, 19 nt, Yersinia pestis
cgcacgacgagcuucaccu

SEQ ID NO: 2259737 - RNA, 18 nt, Yersinia pestis
cgcaccgaaauagucgcg

SEQ ID NO: 2259738 - RNA, 23 nt, Yersinia pestis
cgcaccggcuaaccacagcaaug

SEQ ID NO: 2259739 - RNA, 18 nt, Yersinia pestis
cgcaagaaagaaaaauag

SEQ ID NO: 2259740 - RNA, 16 nt, Yersinia pestis
cgcaaggccagguuag

SEQ ID NO: 2259741 - RNA, 19 nt, Yersinia pestis
cgcaaggauaccaaucccu

SEQ ID NO: 2259742 - RNA, 22 nt, Yersinia pestis
cgcaaaaugccaacaacugggu

SEQ ID NO: 2259743 - RNA, 15 nt, Yersinia pestis
cgcacaacugcgaua

SEQ ID NO: 2259744 - RNA, 12 nt, Yersinia pestis
cgcaccaaugcc

SEQ ID NO: 2259745 - RNA, 20 nt, Yersinia pestis
cgcacaguuuucuuaaaaua

SEQ ID NO: 2259746 - RNA, 16 nt, Yersinia pestis
cgcacauuacaagugc

SEQ ID NO: 2259747 - RNA, 19 nt, Yersinia pestis
cgcaaucucuugacgccga

SEQ ID NO: 2259748 - RNA, 20 nt, Yersinia pestis
cgcaauggaagaaucaccga

SEQ ID NO: 2259749 - RNA, 17 nt, Yersinia pestis
cgauuccuguugaccaa

SEQ ID NO: 2259750 - RNA, 20 nt, Yersinia pestis
cgauuccgcgagcaauacca

SEQ ID NO: 2259751 - RNA, 18 nt, Yersinia pestis
cgauugcacuggcuaaua

SEQ ID NO: 2259752 - RNA, 11 nt, Yersinia pestis
cgauuuuagcu

SEQ ID NO: 2259753 - RNA, 13 nt, Yersinia pestis
cgcaaaaagggca

SEQ ID NO: 2259754 - RNA, 14 nt, Yersinia pestis
cgauuucagcugcu

SEQ ID NO: 2259755 - RNA, 12 nt, Yersinia pestis
cgauuucuacgg

SEQ ID NO: 2259756 - RNA, 16 nt, Yersinia pestis
cgauuugcucuuuuuu

SEQ ID NO: 2259757 - RNA, 22 nt, Yersinia pestis
cgauggauaaauucagccgcuc

SEQ ID NO: 2259758 - RNA, 16 nt, Yersinia pestis
cgauggaccaugccau

SEQ ID NO: 2259759 - RNA, 13 nt, Yersinia pestis
cgauggaaaaaau

SEQ ID NO: 2259760 - RNA, 23 nt, Yersinia pestis
cgauggaacaggauuuucaaacu

SEQ ID NO: 2259761 - RNA, 16 nt, Yersinia pestis
cgauggcuuuacgcaa

SEQ ID NO: 2259762 - RNA, 23 nt, Yersinia pestis
cgauggggaguauucgugguggg

SEQ ID NO: 2259763 - RNA, 16 nt, Yersinia pestis
cgaucaacccgcagac

SEQ ID NO: 2259764 - RNA, 21 nt, Yersinia pestis
cgaucaacccgcagacugaaa

SEQ ID NO: 2259765 - RNA, 14 nt, Yersinia pestis
cgaugccuuuuugu

SEQ ID NO: 2259766 - RNA, 16 nt, Yersinia pestis
cgccaacacuauugug

SEQ ID NO: 2259767 - RNA, 16 nt, Yersinia pestis
cgccaaaccauggcuc

SEQ ID NO: 2259768 - RNA, 14 nt, Yersinia pestis
cgccaacugcggca

SEQ ID NO: 2259769 - RNA, 18 nt, Yersinia pestis
cgccaaccggcgcgcuuu

SEQ ID NO: 2259770 - RNA, 17 nt, Yersinia pestis
cgccaaaacgcgcgcca

SEQ ID NO: 2259771 - RNA, 20 nt, Yersinia pestis
cgcauuuauuuguagugacg

SEQ ID NO: 2259772 - RNA, 20 nt, Yersinia pestis
cgcauugucacccacuaaug

SEQ ID NO: 2259773 - RNA, 17 nt, Yersinia pestis
cgcauucgugccauaaa

SEQ ID NO: 2259774 - RNA, 22 nt, Yersinia pestis
cgcauucuuuuuguuaaaauag

SEQ ID NO: 2259775 - RNA, 16 nt, Yersinia pestis
cgcauucaccaccaua

SEQ ID NO: 2259776 - RNA, 20 nt, Yersinia pestis
cgccacgcugauacauuucc

SEQ ID NO: 2259777 - RNA, 17 nt, Yersinia pestis
cgcagcaaauaaacaaa

SEQ ID NO: 2259778 - RNA, 19 nt, Yersinia pestis
cgcagcaaauaaacaaaau

SEQ ID NO: 2259779 - RNA, 16 nt, Yersinia pestis
cgcagugacgcaguga

SEQ ID NO: 2259780 - RNA, 12 nt, Yersinia pestis
cgcagugcauug

SEQ ID NO: 2259781 - RNA, 15 nt, Yersinia pestis
cgcaguguaaaaccu

SEQ ID NO: 2259782 - RNA, 17 nt, Yersinia pestis
cgcagguaacgccgcug

SEQ ID NO: 2259783 - RNA, 20 nt, Yersinia pestis
cgcagggugagucucagggg

SEQ ID NO: 2259784 - RNA, 22 nt, Yersinia pestis
cgcauaugaaaaaccuccggcu

SEQ ID NO: 2259785 - RNA, 21 nt, Yersinia pestis
cgcaucaaacggcaacuucua

SEQ ID NO: 2259786 - RNA, 12 nt, Yersinia pestis
cgcauaggccaa

SEQ ID NO: 2259787 - RNA, 16 nt, Yersinia pestis
cgcauccccacuugua

SEQ ID NO: 2259788 - RNA, 13 nt, Yersinia pestis
cgcaugacuagug

SEQ ID NO: 2259789 - RNA, 15 nt, Yersinia pestis
cgcaucgucgcuguu

SEQ ID NO: 2259790 - RNA, 20 nt, Yersinia pestis
cgcaucgccuguaaaucuug

SEQ ID NO: 2259791 - RNA, 17 nt, Yersinia pestis
cgagaggcuauuuaucg

SEQ ID NO: 2259792 - RNA, 18 nt, Yersinia pestis
cgagaauucagaggcugc

SEQ ID NO: 2259793 - RNA, 15 nt, Yersinia pestis
cgagaauaccuggcg

SEQ ID NO: 2259794 - RNA, 18 nt, Yersinia pestis
cgagacuaccggaaccgc

SEQ ID NO: 2259795 - RNA, 19 nt, Yersinia pestis
cgagaagcuucaacuuaau

SEQ ID NO: 2259796 - RNA, 22 nt, Yersinia pestis
cgagaaagucuuaaucuuuaau

SEQ ID NO: 2259797 - RNA, 12 nt, Yersinia pestis
cgagcacugccc

SEQ ID NO: 2259798 - RNA, 14 nt, Yersinia pestis
cgagcacugccccg

SEQ ID NO: 2259799 - RNA, 17 nt, Yersinia pestis
cgagcccccagggaagg

SEQ ID NO: 2259800 - RNA, 24 nt, Yersinia pestis
cgacuguucguaaugacugucugc

SEQ ID NO: 2259801 - RNA, 18 nt, Yersinia pestis
cgacuaaggcaaccugag

SEQ ID NO: 2259802 - RNA, 14 nt, Yersinia pestis
cgacuaauggccag

SEQ ID NO: 2259803 - RNA, 15 nt, Yersinia pestis
cgacuaaaaccugcu

SEQ ID NO: 2259804 - RNA, 20 nt, Yersinia pestis
cgacucuuuuugugcuucau

SEQ ID NO: 2259805 - RNA, 12 nt, Yersinia pestis
cgacucaauaaa

SEQ ID NO: 2259806 - RNA, 21 nt, Yersinia pestis
cgacggaugaaaagugaucca

SEQ ID NO: 2259807 - RNA, 20 nt, Yersinia pestis
cgacgucccuaaagccaucg

SEQ ID NO: 2259808 - RNA, 14 nt, Yersinia pestis
cgacguccaaccca

SEQ ID NO: 2259809 - RNA, 22 nt, Yersinia pestis
cgauaauuauaaauuccuggcg

SEQ ID NO: 2259810 - RNA, 22 nt, Yersinia pestis
cgauaauggaugaauauccacc

SEQ ID NO: 2259811 - RNA, 13 nt, Yersinia pestis
cgaguucagugau

SEQ ID NO: 2259812 - RNA, 23 nt, Yersinia pestis
cgaguuaggaaaaauuguuugac

SEQ ID NO: 2259813 - RNA, 17 nt, Yersinia pestis
cgaguuaaacugggucg

SEQ ID NO: 2259814 - RNA, 13 nt, Yersinia pestis
cgaguuucccuuu

SEQ ID NO: 2259815 - RNA, 16 nt, Yersinia pestis
cgaguuuccaguucaa

SEQ ID NO: 2259816 - RNA, 15 nt, Yersinia pestis
cgauacaccauuucc

SEQ ID NO: 2259817 - RNA, 19 nt, Yersinia pestis
cgauacaccauuuccaggc

SEQ ID NO: 2259818 - RNA, 20 nt, Yersinia pestis
cgauagcccaaagcaauaaa

SEQ ID NO: 2259819 - RNA, 23 nt, Yersinia pestis
cgauagcccaaagcaauaaacuc

SEQ ID NO: 2259820 - RNA, 19 nt, Yersinia pestis
cgauacccauuuuaaucuc

SEQ ID NO: 2259821 - RNA, 22 nt, Yersinia pestis
cgauagugcuuccaacucaccu

SEQ ID NO: 2259822 - RNA, 17 nt, Yersinia pestis
cgauagcugcuuuugcu

SEQ ID NO: 2259823 - RNA, 14 nt, Yersinia pestis
cgauagcggccgca

SEQ ID NO: 2259824 - RNA, 15 nt, Yersinia pestis
cgauaugcuccagau

SEQ ID NO: 2259825 - RNA, 19 nt, Yersinia pestis
cgauauggcacaggcaaaa

SEQ ID NO: 2259826 - RNA, 16 nt, Yersinia pestis
cgauaugaucagauuu

SEQ ID NO: 2259827 - RNA, 23 nt, Yersinia pestis
cgagucuauugaaaaaauaaugu

SEQ ID NO: 2259828 - RNA, 14 nt, Yersinia pestis
cgaguguaaaaagc

SEQ ID NO: 2259829 - RNA, 15 nt, Yersinia pestis
cgagugccaacucag

SEQ ID NO: 2259830 - RNA, 18 nt, Yersinia pestis
cgaguccguuaaaaaauu

SEQ ID NO: 2259831 - RNA, 21 nt, Yersinia pestis
cgagcuaaugcuauccacaaa

SEQ ID NO: 2259832 - RNA, 16 nt, Yersinia pestis
cgagcguuuaaauacc

SEQ ID NO: 2259833 - RNA, 17 nt, Yersinia pestis
cgagcgugcgguagacc

SEQ ID NO: 2259834 - RNA, 17 nt, Yersinia pestis
cgagccuacuacaugga

SEQ ID NO: 2259835 - RNA, 15 nt, Yersinia pestis
cgaggaauagccagc

SEQ ID NO: 2259836 - RNA, 12 nt, Yersinia pestis
cgaggaugacga

SEQ ID NO: 2259837 - RNA, 23 nt, Yersinia pestis
ccguuuuaacgcugcccaauaaa

SEQ ID NO: 2259838 - RNA, 21 nt, Yersinia pestis
ccguuuuaacgcugcccaaua

SEQ ID NO: 2259839 - RNA, 10 nt, Yersinia pestis
ccguuucucu

SEQ ID NO: 2259840 - RNA, 15 nt, Yersinia pestis
ccguugcauuuuucu

SEQ ID NO: 2259841 - RNA, 18 nt, Yersinia pestis
ccguugcauuuuucuguu

SEQ ID NO: 2259842 - RNA, 15 nt, Yersinia pestis
ccguugcucagcgca

SEQ ID NO: 2259843 - RNA, 12 nt, Yersinia pestis
ccguugccugug

SEQ ID NO: 2259844 - RNA, 13 nt, Yersinia pestis
ccuaaugcccccg

SEQ ID NO: 2259845 - RNA, 14 nt, Yersinia pestis
ccuaaugccgcgcc

SEQ ID NO: 2259846 - RNA, 18 nt, Yersinia pestis
ccuaaugaacacuuaauu

SEQ ID NO: 2259847 - RNA, 13 nt, Yersinia pestis
ccuacauggaugu

SEQ ID NO: 2259848 - RNA, 16 nt, Yersinia pestis
ccuaccaccuacaacc

SEQ ID NO: 2259849 - RNA, 13 nt, Yersinia pestis
ccuaccaccuacc

SEQ ID NO: 2259850 - RNA, 15 nt, Yersinia pestis
ccuaacacguuaaau

SEQ ID NO: 2259851 - RNA, 13 nt, Yersinia pestis
ccuaacagaccaa

SEQ ID NO: 2259852 - RNA, 21 nt, Yersinia pestis
ccuaaccaaacauugucaccu

SEQ ID NO: 2259853 - RNA, 18 nt, Yersinia pestis
ccuaacgccaaaauguag

SEQ ID NO: 2259854 - RNA, 14 nt, Yersinia pestis
ccuaacuuccuaac

SEQ ID NO: 2259855 - RNA, 17 nt, Yersinia pestis
ccuaauacagcaccacc

SEQ ID NO: 2259856 - RNA, 11 nt, Yersinia pestis
ccgugacuaaa

SEQ ID NO: 2259857 - RNA, 13 nt, Yersinia pestis
ccgugacauuuuc

SEQ ID NO: 2259858 - RNA, 17 nt, Yersinia pestis
ccgucuuggauauuuga

SEQ ID NO: 2259859 - RNA, 18 nt, Yersinia pestis
ccgugaacaucuggcgau

SEQ ID NO: 2259860 - RNA, 19 nt, Yersinia pestis
ccgugcgccugaacagccu

SEQ ID NO: 2259861 - RNA, 17 nt, Yersinia pestis
ccguggauauccacauc

SEQ ID NO: 2259862 - RNA, 18 nt, Yersinia pestis
ccgugcggcuucuuauuu

SEQ ID NO: 2259863 - RNA, 13 nt, Yersinia pestis
ccgugucgggcca

SEQ ID NO: 2259864 - RNA, 18 nt, Yersinia pestis
ccgugucgggccaauaaa

SEQ ID NO: 2259865 - RNA, 20 nt, Yersinia pestis
ccguguccggguuuacccag

SEQ ID NO: 2259866 - RNA, 19 nt, Yersinia pestis
ccguucacccuuuggugag

SEQ ID NO: 2259867 - RNA, 13 nt, Yersinia pestis
ccguaacuucuuc

SEQ ID NO: 2259868 - RNA, 14 nt, Yersinia pestis
ccguaacuucuucg

SEQ ID NO: 2259869 - RNA, 17 nt, Yersinia pestis
ccguagcacacacagcc

SEQ ID NO: 2259870 - RNA, 20 nt, Yersinia pestis
ccgucacuuaaaaaucaaua

SEQ ID NO: 2259871 - RNA, 20 nt, Yersinia pestis
ccguaaacguucugccaauu

SEQ ID NO: 2259872 - RNA, 17 nt, Yersinia pestis
ccguaacgcccuccugc

SEQ ID NO: 2259873 - RNA, 15 nt, Yersinia pestis
ccgguuuuggucagu

SEQ ID NO: 2259874 - RNA, 14 nt, Yersinia pestis
ccgucagcaucaua

SEQ ID NO: 2259875 - RNA, 14 nt, Yersinia pestis
ccgggaaaaaauac

SEQ ID NO: 2259876 - RNA, 14 nt, Yersinia pestis
ccgggaacaacgaa

SEQ ID NO: 2259877 - RNA, 22 nt, Yersinia pestis
ccggggagcggauaaagcgcug

SEQ ID NO: 2259878 - RNA, 19 nt, Yersinia pestis
ccggucgaacccauucauc

SEQ ID NO: 2259879 - RNA, 23 nt, Yersinia pestis
ccgguaaaaucacguuuccaaaa

SEQ ID NO: 2259880 - RNA, 17 nt, Yersinia pestis
ccggcuaaugccgagaa

SEQ ID NO: 2259881 - RNA, 19 nt, Yersinia pestis
ccggcuaugccggaggaua

SEQ ID NO: 2259882 - RNA, 12 nt, Yersinia pestis
ccggcucgccca

SEQ ID NO: 2259883 - RNA, 21 nt, Yersinia pestis
ccuacgcuggcgcauccccac

SEQ ID NO: 2259884 - RNA, 18 nt, Yersinia pestis
ccuacgccuaaaaaugau

SEQ ID NO: 2259885 - RNA, 15 nt, Yersinia pestis
ccuaccggccauuga

SEQ ID NO: 2259886 - RNA, 19 nt, Yersinia pestis
ccuacccuuugagaaagga

SEQ ID NO: 2259887 - RNA, 14 nt, Yersinia pestis
ccuaccgcaccaau

SEQ ID NO: 2259888 - RNA, 21 nt, Yersinia pestis
ccucaugaaugaggcugaggu

SEQ ID NO: 2259889 - RNA, 16 nt, Yersinia pestis
ccucauccguaaaaaa

SEQ ID NO: 2259890 - RNA, 23 nt, Yersinia pestis
ccuccacugcguacucaccccac

SEQ ID NO: 2259891 - RNA, 20 nt, Yersinia pestis
ccucauucaugaggcucaga

SEQ ID NO: 2259892 - RNA, 17 nt, Yersinia pestis
ccucauucaugaggcuc

SEQ ID NO: 2259893 - RNA, 15 nt, Yersinia pestis
ccuccaacugaguga

SEQ ID NO: 2259894 - RNA, 18 nt, Yersinia pestis
ccuccagucccccucaca

SEQ ID NO: 2259895 - RNA, 14 nt, Yersinia pestis
ccuccggcuaugcc

SEQ ID NO: 2259896 - RNA, 14 nt, Yersinia pestis
ccuccugcccaaga

SEQ ID NO: 2259897 - RNA, 21 nt, Yersinia pestis
ccuccgcuuuagcuguacuaa

SEQ ID NO: 2259898 - RNA, 17 nt, Yersinia pestis
ccucuuuagguacuuug

SEQ ID NO: 2259899 - RNA, 18 nt, Yersinia pestis
ccucuuguguaauuauau

SEQ ID NO: 2259900 - RNA, 20 nt, Yersinia pestis
ccugaaaugauuaaacgccu

SEQ ID NO: 2259901 - RNA, 13 nt, Yersinia pestis
ccugaaagucagg

SEQ ID NO: 2259902 - RNA, 17 nt, Yersinia pestis
ccugaaggcugauuaau

SEQ ID NO: 2259903 - RNA, 15 nt, Yersinia pestis
ccugaacucaucagc

SEQ ID NO: 2259904 - RNA, 20 nt, Yersinia pestis
ccucucgccgguuaucaccu

SEQ ID NO: 2259905 - RNA, 15 nt, Yersinia pestis
ccucuccccuaccuc

SEQ ID NO: 2259906 - RNA, 17 nt, Yersinia pestis
ccucucaguugauggcu

SEQ ID NO: 2259907 - RNA, 12 nt, Yersinia pestis
ccucucaccaag

SEQ ID NO: 2259908 - RNA, 15 nt, Yersinia pestis
ccucgugagugaagg

SEQ ID NO: 2259909 - RNA, 18 nt, Yersinia pestis
ccucuuggcguagcuuga

SEQ ID NO: 2259910 - RNA, 14 nt, Yersinia pestis
ccucuuguaaacca

SEQ ID NO: 2259911 - RNA, 16 nt, Yersinia pestis
ccucucucauuucguc

SEQ ID NO: 2259912 - RNA, 16 nt, Yersinia pestis
ccucucuuuccagcaa

SEQ ID NO: 2259913 - RNA, 23 nt, Yersinia pestis
ccucucuggucuugcaccugauc

SEQ ID NO: 2259914 - RNA, 18 nt, Yersinia pestis
ccucugauuguaacaauc

SEQ ID NO: 2259915 - RNA, 17 nt, Yersinia pestis
ccucugcaaugcccaga

SEQ ID NO: 2259916 - RNA, 19 nt, Yersinia pestis
ccucggucggcaagaccuu

SEQ ID NO: 2259917 - RNA, 19 nt, Yersinia pestis
ccucgguggcucaauccaa

SEQ ID NO: 2259918 - RNA, 18 nt, Yersinia pestis
ccucggugauaaguuuua

SEQ ID NO: 2259919 - RNA, 20 nt, Yersinia pestis
ccucgacaccaaaacucccu

SEQ ID NO: 2259920 - RNA, 12 nt, Yersinia pestis
ccucgaaaauaa

SEQ ID NO: 2259921 - RNA, 14 nt, Yersinia pestis
ccucgaaaauaacc

SEQ ID NO: 2259922 - RNA, 16 nt, Yersinia pestis
ccuggcaccggacaaa

SEQ ID NO: 2259923 - RNA, 13 nt, Yersinia pestis
ccuggccaaagcc

SEQ ID NO: 2259924 - RNA, 22 nt, Yersinia pestis
ccuggcggaugucagauggugc

SEQ ID NO: 2259925 - RNA, 18 nt, Yersinia pestis
ccuggcaggccagcgaca

SEQ ID NO: 2259926 - RNA, 14 nt, Yersinia pestis
ccuguggaaauuua

SEQ ID NO: 2259927 - RNA, 23 nt, Yersinia pestis
ccugugcgcccacgccaacccuc

SEQ ID NO: 2259928 - RNA, 13 nt, Yersinia pestis
ccugucaccuacc

SEQ ID NO: 2259929 - RNA, 16 nt, Yersinia pestis
ccugucaccugucacc

SEQ ID NO: 2259930 - RNA, 21 nt, Yersinia pestis
ccuguaccaccaccaacagca

SEQ ID NO: 2259931 - RNA, 15 nt, Yersinia pestis
ccuguacauaaauuu

SEQ ID NO: 2259932 - RNA, 14 nt, Yersinia pestis
ccuguacuuuaacu

SEQ ID NO: 2259933 - RNA, 15 nt, Yersinia pestis
ccuguaaauaaauac

SEQ ID NO: 2259934 - RNA, 13 nt, Yersinia pestis
ccuguaaaucuug

SEQ ID NO: 2259935 - RNA, 19 nt, Yersinia pestis
ccuguaacgcuaaacuaaa

SEQ ID NO: 2259936 - RNA, 16 nt, Yersinia pestis
ccuguaacuuuauuga

SEQ ID NO: 2259937 - RNA, 19 nt, Yersinia pestis
ccugcaucaucacauucaa

SEQ ID NO: 2259938 - RNA, 14 nt, Yersinia pestis
ccugcauaaaaaua

SEQ ID NO: 2259939 - RNA, 17 nt, Yersinia pestis
ccugccgccucugcucc

SEQ ID NO: 2259940 - RNA, 19 nt, Yersinia pestis
ccugcccuaauaccaauac

SEQ ID NO: 2259941 - RNA, 19 nt, Yersinia pestis
ccugaaucucgcgcccugc

SEQ ID NO: 2259942 - RNA, 23 nt, Yersinia pestis
ccugcaauaccgccggcaacagc

SEQ ID NO: 2259943 - RNA, 12 nt, Yersinia pestis
ccugcaccauau

SEQ ID NO: 2259944 - RNA, 15 nt, Yersinia pestis
ccugcaccagugcca

SEQ ID NO: 2259945 - RNA, 13 nt, Yersinia pestis
ccugccugcugcu

SEQ ID NO: 2259946 - RNA, 18 nt, Yersinia pestis
ccugcgaauuaucaucca

SEQ ID NO: 2259947 - RNA, 21 nt, Yersinia pestis
ccugccgggucagguuuauca

SEQ ID NO: 2259948 - RNA, 14 nt, Yersinia pestis
ccugccuauccuca

SEQ ID NO: 2259949 - RNA, 19 nt, Yersinia pestis
ccugcgaggcacuucauug

SEQ ID NO: 2259950 - RNA, 18 nt, Yersinia pestis
ccugcgauagccccauau

SEQ ID NO: 2259951 - RNA, 19 nt, Yersinia pestis
ccugcgaucugccuuaucu

SEQ ID NO: 2259952 - RNA, 14 nt, Yersinia pestis
ccugcgccagcagc

SEQ ID NO: 2259953 - RNA, 18 nt, Yersinia pestis
ccugcggcuucaaguacg

SEQ ID NO: 2259954 - RNA, 15 nt, Yersinia pestis
ccugcgcugcuuuuu

SEQ ID NO: 2259955 - RNA, 13 nt, Yersinia pestis
cccugcucuucug

SEQ ID NO: 2259956 - RNA, 15 nt, Yersinia pestis
cccuggcaggccagc

SEQ ID NO: 2259957 - RNA, 16 nt, Yersinia pestis
cccugcgaucugccuu

SEQ ID NO: 2259958 - RNA, 19 nt, Yersinia pestis
cccugccagaaucagcccc

SEQ ID NO: 2259959 - RNA, 13 nt, Yersinia pestis
cccugccaccuug

SEQ ID NO: 2259960 - RNA, 23 nt, Yersinia pestis
cccugagugugccuuggucucag

SEQ ID NO: 2259961 - RNA, 20 nt, Yersinia pestis
cccugacucccugacucccu

SEQ ID NO: 2259962 - RNA, 13 nt, Yersinia pestis
cccugacucccug

SEQ ID NO: 2259963 - RNA, 22 nt, Yersinia pestis
cccugaauuucaauaacaccgu

SEQ ID NO: 2259964 - RNA, 16 nt, Yersinia pestis
cccugcaauugcagac

SEQ ID NO: 2259965 - RNA, 14 nt, Yersinia pestis
cccugcaagugggg

SEQ ID NO: 2259966 - RNA, 21 nt, Yersinia pestis
cccugagguuccacucucugc

SEQ ID NO: 2259967 - RNA, 19 nt, Yersinia pestis
ccccuucgauauuacaguu

SEQ ID NO: 2259968 - RNA, 15 nt, Yersinia pestis
cccucuggcauagag

SEQ ID NO: 2259969 - RNA, 20 nt, Yersinia pestis
cccucuguauugauccccaa

SEQ ID NO: 2259970 - RNA, 22 nt, Yersinia pestis
cccucuugcuuaucaccccuuc

SEQ ID NO: 2259971 - RNA, 15 nt, Yersinia pestis
ccccuguaaaacaag

SEQ ID NO: 2259972 - RNA, 11 nt, Yersinia pestis
ccccugucucc

SEQ ID NO: 2259973 - RNA, 21 nt, Yersinia pestis
ccccugggauauagaagguuu

SEQ ID NO: 2259974 - RNA, 16 nt, Yersinia pestis
ccccuucgagcaccgc

SEQ ID NO: 2259975 - RNA, 24 nt, Yersinia pestis
ccgaaaaaacagcgaucuauucuc

SEQ ID NO: 2259976 - RNA, 15 nt, Yersinia pestis
cccuucguccuugau

SEQ ID NO: 2259977 - RNA, 16 nt, Yersinia pestis
cccuugauuuuaccaa

SEQ ID NO: 2259978 - RNA, 18 nt, Yersinia pestis
ccgaaucacugacugaug

SEQ ID NO: 2259979 - RNA, 15 nt, Yersinia pestis
ccgaauaauauuaaa

SEQ ID NO: 2259980 - RNA, 17 nt, Yersinia pestis
cccuucaacucuacauu

SEQ ID NO: 2259981 - RNA, 20 nt, Yersinia pestis
cccuucaaagccgcuuuaau

SEQ ID NO: 2259982 - RNA, 22 nt, Yersinia pestis
cccuucagaugaauccagccau

SEQ ID NO: 2259983 - RNA, 13 nt, Yersinia pestis
cccuucagucagu

SEQ ID NO: 2259984 - RNA, 14 nt, Yersinia pestis
cccuucgagcaccg

SEQ ID NO: 2259985 - RNA, 16 nt, Yersinia pestis
cccuucgagcaccgcg

SEQ ID NO: 2259986 - RNA, 18 nt, Yersinia pestis
cccuggcucaucaaagga

SEQ ID NO: 2259987 - RNA, 23 nt, Yersinia pestis
cccuguugcccagcaaggcgggc

SEQ ID NO: 2259988 - RNA, 15 nt, Yersinia pestis
cccuguugaucugag

SEQ ID NO: 2259989 - RNA, 13 nt, Yersinia pestis
cccugugcgccca

SEQ ID NO: 2259990 - RNA, 18 nt, Yersinia pestis
cccugugaaauaccgauu

SEQ ID NO: 2259991 - RNA, 21 nt, Yersinia pestis
cccuguaguucaucauuauua

SEQ ID NO: 2259992 - RNA, 15 nt, Yersinia pestis
cccuguauaaaaaua

SEQ ID NO: 2259993 - RNA, 20 nt, Yersinia pestis
cccugguugcagcacgccag

SEQ ID NO: 2259994 - RNA, 11 nt, Yersinia pestis
cccuguaaccg

SEQ ID NO: 2259995 - RNA, 22 nt, Yersinia pestis
ccgaguugacuuuuuuuaacca

SEQ ID NO: 2259996 - RNA, 16 nt, Yersinia pestis
ccgauaaaccaacuga

SEQ ID NO: 2259997 - RNA, 18 nt, Yersinia pestis
ccgaucaacaggccaccu

SEQ ID NO: 2259998 - RNA, 20 nt, Yersinia pestis
ccgauauugauagccacauc

SEQ ID NO: 2259999 - RNA, 19 nt, Yersinia pestis
ccgaggaauaugcccuuuu

SEQ ID NO: 2260000 - RNA, 15 nt, Yersinia pestis
ccgagcgccccgccu

SEQ ID NO: 2260001 - RNA, 13 nt, Yersinia pestis
ccgagccuguuga

SEQ ID NO: 2260002 - RNA, 12 nt, Yersinia pestis
ccgagaggcuga

SEQ ID NO: 2260003 - RNA, 15 nt, Yersinia pestis
ccgacuugcccaaug

SEQ ID NO: 2260004 - RNA, 19 nt, Yersinia pestis
ccgacuugcccaauggcaa

SEQ ID NO: 2260005 - RNA, 14 nt, Yersinia pestis
ccgagaaacaaaac

SEQ ID NO: 2260006 - RNA, 14 nt, Yersinia pestis
ccgaugagugaaau

SEQ ID NO: 2260007 - RNA, 19 nt, Yersinia pestis
ccgaugaaccaaccgccaa

SEQ ID NO: 2260008 - RNA, 20 nt, Yersinia pestis
ccgaugacgcgaucuugaac

SEQ ID NO: 2260009 - RNA, 16 nt, Yersinia pestis
ccgcaaccugacugcu

SEQ ID NO: 2260010 - RNA, 11 nt, Yersinia pestis
ccgcaaaacug

SEQ ID NO: 2260011 - RNA, 18 nt, Yersinia pestis
ccgcagcaggcagagcaa

SEQ ID NO: 2260012 - RNA, 20 nt, Yersinia pestis
ccgcacugggucaucaccca

SEQ ID NO: 2260013 - RNA, 23 nt, Yersinia pestis
ccgcaaggcuucgacucugggcc

SEQ ID NO: 2260014 - RNA, 24 nt, Yersinia pestis
ccgcaggccaugucgaucauggca

SEQ ID NO: 2260015 - RNA, 15 nt, Yersinia pestis
ccgcagcucaccuag

SEQ ID NO: 2260016 - RNA, 15 nt, Yersinia pestis
ccgccauugccagaa

SEQ ID NO: 2260017 - RNA, 17 nt, Yersinia pestis
ccgccaugagaaccagu

SEQ ID NO: 2260018 - RNA, 17 nt, Yersinia pestis
ccgcccgguaccgccga

SEQ ID NO: 2260019 - RNA, 12 nt, Yersinia pestis
ccgccccgggca

SEQ ID NO: 2260020 - RNA, 14 nt, Yersinia pestis
ccgcccucuugaac

SEQ ID NO: 2260021 - RNA, 15 nt, Yersinia pestis
ccgccgccagccccg

SEQ ID NO: 2260022 - RNA, 19 nt, Yersinia pestis
ccgccggauuucaauccga

SEQ ID NO: 2260023 - RNA, 21 nt, Yersinia pestis
ccgccggguuuugcaucaagc

SEQ ID NO: 2260024 - RNA, 15 nt, Yersinia pestis
ccgccgucaaaccaa

SEQ ID NO: 2260025 - RNA, 16 nt, Yersinia pestis
ccgccgguuuuugccc

SEQ ID NO: 2260026 - RNA, 19 nt, Yersinia pestis
ccgccgugcggacugccgc

SEQ ID NO: 2260027 - RNA, 23 nt, Yersinia pestis
ccgcgauaaaaaauaaaguccag

SEQ ID NO: 2260028 - RNA, 14 nt, Yersinia pestis
ccgcgcccucccug

SEQ ID NO: 2260029 - RNA, 14 nt, Yersinia pestis
ccgcuuuagcugua

SEQ ID NO: 2260030 - RNA, 17 nt, Yersinia pestis
ccggaaugaguugcccu

SEQ ID NO: 2260031 - RNA, 14 nt, Yersinia pestis
ccggacucaaaaua

SEQ ID NO: 2260032 - RNA, 17 nt, Yersinia pestis
ccggagaacuugaacua

SEQ ID NO: 2260033 - RNA, 20 nt, Yersinia pestis
ccggcaaucgcuuccaggac

SEQ ID NO: 2260034 - RNA, 18 nt, Yersinia pestis
ccgcuaauucaggcaaau

SEQ ID NO: 2260035 - RNA, 20 nt, Yersinia pestis
ccgcuaacaaccgugcacca

SEQ ID NO: 2260036 - RNA, 23 nt, Yersinia pestis
ccgcuaacguuuauuuauaagaa

SEQ ID NO: 2260037 - RNA, 13 nt, Yersinia pestis
ccgcuaaccuuaa

SEQ ID NO: 2260038 - RNA, 16 nt, Yersinia pestis
ccgcuaaaucaucaaa

SEQ ID NO: 2260039 - RNA, 17 nt, Yersinia pestis
ccgcuuccaucacaaau

SEQ ID NO: 2260040 - RNA, 12 nt, Yersinia pestis
ccgcuuggguaa

SEQ ID NO: 2260041 - RNA, 19 nt, Yersinia pestis
ccgcucagcaucuucaauc

SEQ ID NO: 2260042 - RNA, 14 nt, Yersinia pestis
ccgcucaacuuugc

SEQ ID NO: 2260043 - RNA, 13 nt, Yersinia pestis
ccgcugcccggcu

SEQ ID NO: 2260044 - RNA, 16 nt, Yersinia pestis
ccgcucuucaccaauc

SEQ ID NO: 2260045 - RNA, 13 nt, Yersinia pestis
cgguacugaggca

SEQ ID NO: 2260046 - RNA, 16 nt, Yersinia pestis
cgguauuugaacuuca

SEQ ID NO: 2260047 - RNA, 17 nt, Yersinia pestis
cgguauuugaacuucaa

SEQ ID NO: 2260048 - RNA, 22 nt, Yersinia pestis
cgguauuuggcauucauaucuu

SEQ ID NO: 2260049 - RNA, 15 nt, Yersinia pestis
cgguaucgauaugaa

SEQ ID NO: 2260050 - RNA, 21 nt, Yersinia pestis
cgguaaauggcgugcacugac

SEQ ID NO: 2260051 - RNA, 14 nt, Yersinia pestis
cgguaaccagcauc

SEQ ID NO: 2260052 - RNA, 18 nt, Yersinia pestis
cgguaacgcagauaaauc

SEQ ID NO: 2260053 - RNA, 22 nt, Yersinia pestis
cgguaacgcccguugcccaccg

SEQ ID NO: 2260054 - RNA, 22 nt, Yersinia pestis
cgguaacuuuuuguugcaccaa

SEQ ID NO: 2260055 - RNA, 17 nt, Yersinia pestis
cgguaauggccaauuuu

SEQ ID NO: 2260056 - RNA, 22 nt, Yersinia pestis
cgguaaugagccgcauugaucc

SEQ ID NO: 2260057 - RNA, 19 nt, Yersinia pestis
cgguaaucugagacgucca

SEQ ID NO: 2260058 - RNA, 23 nt, Yersinia pestis
cgguaaucccgauauaaauaaaa

SEQ ID NO: 2260059 - RNA, 16 nt, Yersinia pestis
cggguuuacccagcca

SEQ ID NO: 2260060 - RNA, 15 nt, Yersinia pestis
cggguuuugcaucaa

SEQ ID NO: 2260061 - RNA, 16 nt, Yersinia pestis
cggguuuugucggcgg

SEQ ID NO: 2260062 - RNA, 17 nt, Yersinia pestis
cggguuaacuuuuucua

SEQ ID NO: 2260063 - RNA, 16 nt, Yersinia pestis
cggguuaacuuuuucu

SEQ ID NO: 2260064 - RNA, 23 nt, Yersinia pestis
cgggccaaggggagccacacacu

SEQ ID NO: 2260065 - RNA, 22 nt, Yersinia pestis
cggggcacuccgguggcuuacg

SEQ ID NO: 2260066 - RNA, 14 nt, Yersinia pestis
cgggguugcaguua

SEQ ID NO: 2260067 - RNA, 15 nt, Yersinia pestis
cgggucagcucacca

SEQ ID NO: 2260068 - RNA, 14 nt, Yersinia pestis
cgggucagcugacg

SEQ ID NO: 2260069 - RNA, 14 nt, Yersinia pestis
cgggucagugaaaa

SEQ ID NO: 2260070 - RNA, 16 nt, Yersinia pestis
cgggugcuuuaaugag

SEQ ID NO: 2260071 - RNA, 12 nt, Yersinia pestis
cgggugaaacca

SEQ ID NO: 2260072 - RNA, 17 nt, Yersinia pestis
cguaaucucucacagcg

SEQ ID NO: 2260073 - RNA, 14 nt, Yersinia pestis
cguaaucagccgcg

SEQ ID NO: 2260074 - RNA, 14 nt, Yersinia pestis
cguaauucagauaa

SEQ ID NO: 2260075 - RNA, 21 nt, Yersinia pestis
cguacaaaaauaaacgggcuu

SEQ ID NO: 2260076 - RNA, 13 nt, Yersinia pestis
cguaccacaagcc

SEQ ID NO: 2260077 - RNA, 16 nt, Yersinia pestis
cguaccaaaucagcaa

SEQ ID NO: 2260078 - RNA, 16 nt, Yersinia pestis
cguacauauaucacua

SEQ ID NO: 2260079 - RNA, 11 nt, Yersinia pestis
cguacauuaaa

SEQ ID NO: 2260080 - RNA, 14 nt, Yersinia pestis
cguacaucagggug

SEQ ID NO: 2260081 - RNA, 15 nt, Yersinia pestis
cguacaucucuuggg

SEQ ID NO: 2260082 - RNA, 17 nt, Yersinia pestis
cguacauuaaaugaaua

SEQ ID NO: 2260083 - RNA, 13 nt, Yersinia pestis
cguaauaccacua

SEQ ID NO: 2260084 - RNA, 11 nt, Yersinia pestis
cguaacuucuu

SEQ ID NO: 2260085 - RNA, 11 nt, Yersinia pestis
cguaaauacau

SEQ ID NO: 2260086 - RNA, 15 nt, Yersinia pestis
cguaaauacauccau

SEQ ID NO: 2260087 - RNA, 16 nt, Yersinia pestis
cguaaauacauccaug

SEQ ID NO: 2260088 - RNA, 17 nt, Yersinia pestis
cguaaaucauagccagc

SEQ ID NO: 2260089 - RNA, 12 nt, Yersinia pestis
cguaaaaagcag

SEQ ID NO: 2260090 - RNA, 20 nt, Yersinia pestis
cgguuuuuucuuucuucagc

SEQ ID NO: 2260091 - RNA, 14 nt, Yersinia pestis
cguaaaaaacccuc

SEQ ID NO: 2260092 - RNA, 14 nt, Yersinia pestis
cgguuccaaagcac

SEQ ID NO: 2260093 - RNA, 19 nt, Yersinia pestis
cgguucuaguauucaggaa

SEQ ID NO: 2260094 - RNA, 18 nt, Yersinia pestis
cgguugacguuugccaaa

SEQ ID NO: 2260095 - RNA, 14 nt, Yersinia pestis
cggucucuggaugc

SEQ ID NO: 2260096 - RNA, 16 nt, Yersinia pestis
cggugaauacguucaa

SEQ ID NO: 2260097 - RNA, 11 nt, Yersinia pestis
cggugaggaua

SEQ ID NO: 2260098 - RNA, 14 nt, Yersinia pestis
cgguguggcaccau

SEQ ID NO: 2260099 - RNA, 19 nt, Yersinia pestis
cgguguaauccaacccgca

SEQ ID NO: 2260100 - RNA, 17 nt, Yersinia pestis
cggcucucuuucuccaa

SEQ ID NO: 2260101 - RNA, 20 nt, Yersinia pestis
cggcucuauuucaugauucu

SEQ ID NO: 2260102 - RNA, 22 nt, Yersinia pestis
cggcugaccacaaaaacagugu

SEQ ID NO: 2260103 - RNA, 15 nt, Yersinia pestis
cggcuccaggcauua

SEQ ID NO: 2260104 - RNA, 17 nt, Yersinia pestis
cggcuccaggcauuaaa

SEQ ID NO: 2260105 - RNA, 19 nt, Yersinia pestis
cggcgugaguuccagcccc

SEQ ID NO: 2260106 - RNA, 18 nt, Yersinia pestis
cggcgucgccaccccauu

SEQ ID NO: 2260107 - RNA, 15 nt, Yersinia pestis
cggcgucaaggacgc

SEQ ID NO: 2260108 - RNA, 12 nt, Yersinia pestis
cgggauaauaga

SEQ ID NO: 2260109 - RNA, 23 nt, Yersinia pestis
cgggaugcgcucgcuugcugccu

SEQ ID NO: 2260110 - RNA, 22 nt, Yersinia pestis
cgggcaaacgccagugcaaaau

SEQ ID NO: 2260111 - RNA, 11 nt, Yersinia pestis
cgggcaaccug

SEQ ID NO: 2260112 - RNA, 19 nt, Yersinia pestis
cgggcacuuugucaauaac

SEQ ID NO: 2260113 - RNA, 17 nt, Yersinia pestis
cgggcacuaucaccgcg

SEQ ID NO: 2260114 - RNA, 14 nt, Yersinia pestis
cgggaacgccaagu

SEQ ID NO: 2260115 - RNA, 23 nt, Yersinia pestis
cgggaacaggaucugcuccucuu

SEQ ID NO: 2260116 - RNA, 14 nt, Yersinia pestis
cgggagccgcacaa

SEQ ID NO: 2260117 - RNA, 22 nt, Yersinia pestis
cggcuggaaauauuggcaacaa

SEQ ID NO: 2260118 - RNA, 23 nt, Yersinia pestis
cggcuugggagucagaugccgcu

SEQ ID NO: 2260119 - RNA, 23 nt, Yersinia pestis
cggcgaaagcauggcagguauca

SEQ ID NO: 2260120 - RNA, 17 nt, Yersinia pestis
cggcgagcacugccccg

SEQ ID NO: 2260121 - RNA, 18 nt, Yersinia pestis
cggcgauaucacugauac

SEQ ID NO: 2260122 - RNA, 17 nt, Yersinia pestis
cggcgaugaaaaacaga

SEQ ID NO: 2260123 - RNA, 13 nt, Yersinia pestis
cggcgcaucgcca

SEQ ID NO: 2260124 - RNA, 14 nt, Yersinia pestis
cgcuugucacccca

SEQ ID NO: 2260125 - RNA, 15 nt, Yersinia pestis
cgcuuggcaucacag

SEQ ID NO: 2260126 - RNA, 16 nt, Yersinia pestis
cgcuuuggucaacagc

SEQ ID NO: 2260127 - RNA, 17 nt, Yersinia pestis
cgcuuucuguucaucaa

SEQ ID NO: 2260128 - RNA, 19 nt, Yersinia pestis
cggaagacuuccagcacca

SEQ ID NO: 2260129 - RNA, 14 nt, Yersinia pestis
cggaauaaaugaga

SEQ ID NO: 2260130 - RNA, 17 nt, Yersinia pestis
cggaagugaguaucuuc

SEQ ID NO: 2260131 - RNA, 18 nt, Yersinia pestis
cggaagguauccaauacc

SEQ ID NO: 2260132 - RNA, 14 nt, Yersinia pestis
cggaaggccagagu

SEQ ID NO: 2260133 - RNA, 15 nt, Yersinia pestis
cggaagcaaucagga

SEQ ID NO: 2260134 - RNA, 19 nt, Yersinia pestis
cggaggauauuuauuuugg

SEQ ID NO: 2260135 - RNA, 17 nt, Yersinia pestis
cggacucauuccgccug

SEQ ID NO: 2260136 - RNA, 17 nt, Yersinia pestis
cggacuguugcaaccag

SEQ ID NO: 2260137 - RNA, 19 nt, Yersinia pestis
cggacgcuuuacuccucug

SEQ ID NO: 2260138 - RNA, 22 nt, Yersinia pestis
cggacgcuuuacuccucugccu

SEQ ID NO: 2260139 - RNA, 22 nt, Yersinia pestis
cggacgcuuuacuccccugccu

SEQ ID NO: 2260140 - RNA, 16 nt, Yersinia pestis
cggacgcuuuacuccu

SEQ ID NO: 2260141 - RNA, 16 nt, Yersinia pestis
cggacaccaacuggcg

SEQ ID NO: 2260142 - RNA, 14 nt, Yersinia pestis
cggacagcagcacg

SEQ ID NO: 2260143 - RNA, 14 nt, Yersinia pestis
cggacagcgcgcag

SEQ ID NO: 2260144 - RNA, 21 nt, Yersinia pestis
cggcaugauagacgcaucgac

SEQ ID NO: 2260145 - RNA, 15 nt, Yersinia pestis
cggcaugcaacuugg

SEQ ID NO: 2260146 - RNA, 17 nt, Yersinia pestis
cggccaggcucccaagg

SEQ ID NO: 2260147 - RNA, 15 nt, Yersinia pestis
cggccagaaaaacaa

SEQ ID NO: 2260148 - RNA, 15 nt, Yersinia pestis
cggccacccgccauc

SEQ ID NO: 2260149 - RNA, 23 nt, Yersinia pestis
cggcaacugccgcuucaguaaga

SEQ ID NO: 2260150 - RNA, 14 nt, Yersinia pestis
cggaucaaccgccc

SEQ ID NO: 2260151 - RNA, 20 nt, Yersinia pestis
cggauagcgcuucagugauu

SEQ ID NO: 2260152 - RNA, 15 nt, Yersinia pestis
cggauacuguuuggu

SEQ ID NO: 2260153 - RNA, 17 nt, Yersinia pestis
cggcaaucccggccauu

SEQ ID NO: 2260154 - RNA, 15 nt, Yersinia pestis
cggcaaucccggcca

SEQ ID NO: 2260155 - RNA, 14 nt, Yersinia pestis
cggcaaucacuggc

SEQ ID NO: 2260156 - RNA, 15 nt, Yersinia pestis
cggcaauagcgauca

SEQ ID NO: 2260157 - RNA, 23 nt, Yersinia pestis
cggcaaguuguucauagcggcca

SEQ ID NO: 2260158 - RNA, 17 nt, Yersinia pestis
cggcaaguugaucaccc

SEQ ID NO: 2260159 - RNA, 16 nt, Yersinia pestis
cggcacaggcgcuggc

SEQ ID NO: 2260160 - RNA, 17 nt, Yersinia pestis
cggcagagaucauguag

SEQ ID NO: 2260161 - RNA, 23 nt, Yersinia pestis
cgcugcaaacaggcccacugcaa

SEQ ID NO: 2260162 - RNA, 16 nt, Yersinia pestis
cgcugagcaacgguuu

SEQ ID NO: 2260163 - RNA, 15 nt, Yersinia pestis
cgcugcaucagcagu

SEQ ID NO: 2260164 - RNA, 19 nt, Yersinia pestis
cgcugcaacuccuuaccac

SEQ ID NO: 2260165 - RNA, 16 nt, Yersinia pestis
cgcugcaauuauaagc

SEQ ID NO: 2260166 - RNA, 13 nt, Yersinia pestis
cgcugcaauaaag

SEQ ID NO: 2260167 - RNA, 17 nt, Yersinia pestis
cgcugcagcaucaagga

SEQ ID NO: 2260168 - RNA, 17 nt, Yersinia pestis
cgcuccaccagcccauc

SEQ ID NO: 2260169 - RNA, 14 nt, Yersinia pestis
cgcuccacacccgc

SEQ ID NO: 2260170 - RNA, 14 nt, Yersinia pestis
cgcuccacacaaaa

SEQ ID NO: 2260171 - RNA, 13 nt, Yersinia pestis
cgcucaucgccaa

SEQ ID NO: 2260172 - RNA, 17 nt, Yersinia pestis
cgcucaucgccaaagcc

SEQ ID NO: 2260173 - RNA, 22 nt, Yersinia pestis
cgcuccaggcuggccacuucca

SEQ ID NO: 2260174 - RNA, 21 nt, Yersinia pestis
cgcuccguugccugugcgcug

SEQ ID NO: 2260175 - RNA, 14 nt, Yersinia pestis
cgcuccgagcgugc

SEQ ID NO: 2260176 - RNA, 22 nt, Yersinia pestis
cgcuauauugcgccgcauuguu

SEQ ID NO: 2260177 - RNA, 19 nt, Yersinia pestis
cgcuaucacuagcgggccu

SEQ ID NO: 2260178 - RNA, 14 nt, Yersinia pestis
cgcucaauuaaccu

SEQ ID NO: 2260179 - RNA, 21 nt, Yersinia pestis
cgcucauccaacguaaacauu

SEQ ID NO: 2260180 - RNA, 18 nt, Yersinia pestis
cgcucaguauucgccaga

SEQ ID NO: 2260181 - RNA, 20 nt, Yersinia pestis
cgcuaagucacgcacccacc

SEQ ID NO: 2260182 - RNA, 18 nt, Yersinia pestis
cgcguuaaugcuaaugcc

SEQ ID NO: 2260183 - RNA, 18 nt, Yersinia pestis
cgcguaucguccagcagc

SEQ ID NO: 2260184 - RNA, 14 nt, Yersinia pestis
cgcgucacuggcca

SEQ ID NO: 2260185 - RNA, 20 nt, Yersinia pestis
cgcggacaccaacuggcggc

SEQ ID NO: 2260186 - RNA, 15 nt, Yersinia pestis
cgcgcuucgagcccc

SEQ ID NO: 2260187 - RNA, 17 nt, Yersinia pestis
cgcgcuuuugauuuucu

SEQ ID NO: 2260188 - RNA, 18 nt, Yersinia pestis
cgcggacguuuuacucuu

SEQ ID NO: 2260189 - RNA, 21 nt, Yersinia pestis
cgcggacgcuuuacuccucug

SEQ ID NO: 2260190 - RNA, 19 nt, Yersinia pestis
cgcggacgcuuuacuccuc

SEQ ID NO: 2260191 - RNA, 21 nt, Yersinia pestis
cgcgggaaaaaccacgcuguu

SEQ ID NO: 2260192 - RNA, 18 nt, Yersinia pestis
cgcgggcgcgcugcugcu

SEQ ID NO: 2260193 - RNA, 22 nt, Yersinia pestis
cgcggcgguaaccccggcggcu

SEQ ID NO: 2260194 - RNA, 13 nt, Yersinia pestis
cgcgccugcucac

SEQ ID NO: 2260195 - RNA, 15 nt, Yersinia pestis
cgcgccuaccugccu

SEQ ID NO: 2260196 - RNA, 16 nt, Yersinia pestis
cgcgccuaccugccug

SEQ ID NO: 2260197 - RNA, 23 nt, Yersinia pestis
cgccagauucgcaaagcgggcca

SEQ ID NO: 2260198 - RNA, 21 nt, Yersinia pestis
cgccagcaaaucacauuucaa

SEQ ID NO: 2260199 - RNA, 22 nt, Yersinia pestis
cgugaaacgauaugcuccagau

SEQ ID NO: 2260200 - RNA, 13 nt, Yersinia pestis
cgugaacaucugg

SEQ ID NO: 2260201 - RNA, 15 nt, Yersinia pestis
cgugaacaucuggcg

SEQ ID NO: 2260202 - RNA, 14 nt, Yersinia pestis
cgucuucagcuucc

SEQ ID NO: 2260203 - RNA, 17 nt, Yersinia pestis
cgucuucgcauucuuua

SEQ ID NO: 2260204 - RNA, 19 nt, Yersinia pestis
cgucuucgcauucuuuauc

SEQ ID NO: 2260205 - RNA, 21 nt, Yersinia pestis
cgucugacggguauaucacuu

SEQ ID NO: 2260206 - RNA, 16 nt, Yersinia pestis
cgucugcaauagcuca

SEQ ID NO: 2260207 - RNA, 13 nt, Yersinia pestis
cgucucuuuuuca

SEQ ID NO: 2260208 - RNA, 16 nt, Yersinia pestis
cgucucuacgacgccc

SEQ ID NO: 2260209 - RNA, 15 nt, Yersinia pestis
cgucgugauaaacaa

SEQ ID NO: 2260210 - RNA, 16 nt, Yersinia pestis
cgugaauaaaaauaag

SEQ ID NO: 2260211 - RNA, 16 nt, Yersinia pestis
cgugagaauaauaauc

SEQ ID NO: 2260212 - RNA, 23 nt, Yersinia pestis
cgugacggcggcgagcacugccc

SEQ ID NO: 2260213 - RNA, 21 nt, Yersinia pestis
cgugacggcggcgagcacugc

SEQ ID NO: 2260214 - RNA, 16 nt, Yersinia pestis
cgugacggcagcgagc

SEQ ID NO: 2260215 - RNA, 16 nt, Yersinia pestis
cgugauuuuuauauuu

SEQ ID NO: 2260216 - RNA, 17 nt, Yersinia pestis
cgugauaugccugaagu

SEQ ID NO: 2260217 - RNA, 13 nt, Yersinia pestis
cgugauaucccca

SEQ ID NO: 2260218 - RNA, 21 nt, Yersinia pestis
cgugauaugaauauccgccgc

SEQ ID NO: 2260219 - RNA, 20 nt, Yersinia pestis
cgugagucagguggcuauuc

SEQ ID NO: 2260220 - RNA, 16 nt, Yersinia pestis
cgugagugaaggggug

SEQ ID NO: 2260221 - RNA, 17 nt, Yersinia pestis
cgugccaggugugccca

SEQ ID NO: 2260222 - RNA, 19 nt, Yersinia pestis
cgugccaggugugcccaac

SEQ ID NO: 2260223 - RNA, 14 nt, Yersinia pestis
cgugccccaaugau

SEQ ID NO: 2260224 - RNA, 18 nt, Yersinia pestis
cgugccugcuggcaaacu

SEQ ID NO: 2260225 - RNA, 14 nt, Yersinia pestis
cgugcaauaaagcg

SEQ ID NO: 2260226 - RNA, 14 nt, Yersinia pestis
cgugcagcgcgcag

SEQ ID NO: 2260227 - RNA, 15 nt, Yersinia pestis
cgugcagcgcgcagc

SEQ ID NO: 2260228 - RNA, 16 nt, Yersinia pestis
cgugcagcgcgcagcc

SEQ ID NO: 2260229 - RNA, 19 nt, Yersinia pestis
cgugcagcgcgcagccaac

SEQ ID NO: 2260230 - RNA, 23 nt, Yersinia pestis
cguccuugaugguucagccacca

SEQ ID NO: 2260231 - RNA, 17 nt, Yersinia pestis
cguccgcgccagggagg

SEQ ID NO: 2260232 - RNA, 12 nt, Yersinia pestis
cguccggcggcu

SEQ ID NO: 2260233 - RNA, 21 nt, Yersinia pestis
cguccagaacaauaccgccaa

SEQ ID NO: 2260234 - RNA, 22 nt, Yersinia pestis
cguccagaacaauaccgccaau

SEQ ID NO: 2260235 - RNA, 19 nt, Yersinia pestis
cguccagggcgcccuaaua

SEQ ID NO: 2260236 - RNA, 22 nt, Yersinia pestis
cgucccaagaaaagcaccgcag

SEQ ID NO: 2260237 - RNA, 14 nt, Yersinia pestis
cgucccaagaaaag

SEQ ID NO: 2260238 - RNA, 14 nt, Yersinia pestis
cgucccuaaagcca

SEQ ID NO: 2260239 - RNA, 16 nt, Yersinia pestis
cgucgaggaucaccac

SEQ ID NO: 2260240 - RNA, 22 nt, Yersinia pestis
cuaaacgaccaauuucaauaau

SEQ ID NO: 2260241 - RNA, 17 nt, Yersinia pestis
cuaaauguugauacacc

SEQ ID NO: 2260242 - RNA, 23 nt, Yersinia pestis
cuaaauguugauacaccgucuca

SEQ ID NO: 2260243 - RNA, 16 nt, Yersinia pestis
cuaaauuaacccgucu

SEQ ID NO: 2260244 - RNA, 22 nt, Yersinia pestis
cuaaauuaauaucuuuaaauua

SEQ ID NO: 2260245 - RNA, 16 nt, Yersinia pestis
cuaacaugccacauag

SEQ ID NO: 2260246 - RNA, 14 nt, Yersinia pestis
cuaaccaaacauug

SEQ ID NO: 2260247 - RNA, 22 nt, Yersinia pestis
cuaacagaagaguacgaacaga

SEQ ID NO: 2260248 - RNA, 18 nt, Yersinia pestis
cuaacagggaugaauaua

SEQ ID NO: 2260249 - RNA, 13 nt, Yersinia pestis
cuaacagcagugc

SEQ ID NO: 2260250 - RNA, 16 nt, Yersinia pestis
cuaacaacaauuuacg

SEQ ID NO: 2260251 - RNA, 21 nt, Yersinia pestis
cuaaauuuuguacaacuucuu

SEQ ID NO: 2260252 - RNA, 13 nt, Yersinia pestis
cuaacaaacugaa

SEQ ID NO: 2260253 - RNA, 18 nt, Yersinia pestis
cuaacaauauuaccaaua

SEQ ID NO: 2260254 - RNA, 16 nt, Yersinia pestis
cuaacaacagucaaua

SEQ ID NO: 2260255 - RNA, 18 nt, Yersinia pestis
cuaacaacagucaauaua

SEQ ID NO: 2260256 - RNA, 14 nt, Yersinia pestis
cuaacaacuuccac

SEQ ID NO: 2260257 - RNA, 14 nt, Yersinia pestis
cuaaauuguacauu

SEQ ID NO: 2260258 - RNA, 19 nt, Yersinia pestis
cuaagcucuuccaauagca

SEQ ID NO: 2260259 - RNA, 16 nt, Yersinia pestis
cuaaguacuaucuauu

SEQ ID NO: 2260260 - RNA, 17 nt, Yersinia pestis
cuaaguuaacaccauca

SEQ ID NO: 2260261 - RNA, 19 nt, Yersinia pestis
cuaacuggaauauggguaa

SEQ ID NO: 2260262 - RNA, 15 nt, Yersinia pestis
cuaagccggucuuuu

SEQ ID NO: 2260263 - RNA, 20 nt, Yersinia pestis
cuaagcggaguuggcuagca

SEQ ID NO: 2260264 - RNA, 19 nt, Yersinia pestis
cuaagcgucucaaggccuu

SEQ ID NO: 2260265 - RNA, 20 nt, Yersinia pestis
cuaacugugccaaugccucu

SEQ ID NO: 2260266 - RNA, 21 nt, Yersinia pestis
cuaacgcuuuuucgacaaaaa

SEQ ID NO: 2260267 - RNA, 22 nt, Yersinia pestis
cuaacgccgcguuagcuauauu

SEQ ID NO: 2260268 - RNA, 17 nt, Yersinia pestis
cuaacgcaauaggcuau

SEQ ID NO: 2260269 - RNA, 13 nt, Yersinia pestis
cuaacgcuuuuuc

SEQ ID NO: 2260270 - RNA, 17 nt, Yersinia pestis
cuaaccaaacauuguca

SEQ ID NO: 2260271 - RNA, 15 nt, Yersinia pestis
cuaacccauugguuu

SEQ ID NO: 2260272 - RNA, 17 nt, Yersinia pestis
cuaaccccugcaucuug

SEQ ID NO: 2260273 - RNA, 17 nt, Yersinia pestis
cuaaccuuaacugcaua

SEQ ID NO: 2260274 - RNA, 21 nt, Yersinia pestis
cuaaccuuaacugcauagcua

SEQ ID NO: 2260275 - RNA, 15 nt, Yersinia pestis
cuaaccuuaacugca

SEQ ID NO: 2260276 - RNA, 14 nt, Yersinia pestis
cuaacgagaaaguc

SEQ ID NO: 2260277 - RNA, 21 nt, Yersinia pestis
cuaacgaaucccacacucugg

SEQ ID NO: 2260278 - RNA, 17 nt, Yersinia pestis
cguuuaguaaucaauaa

SEQ ID NO: 2260279 - RNA, 18 nt, Yersinia pestis
cguuuagccaguuuacgg

SEQ ID NO: 2260280 - RNA, 18 nt, Yersinia pestis
cguuuacugcuuaaacca

SEQ ID NO: 2260281 - RNA, 24 nt, Yersinia pestis
cguuucauuuuaacaauuuuauug

SEQ ID NO: 2260282 - RNA, 19 nt, Yersinia pestis
cguuuauacggcuauuuuu

SEQ ID NO: 2260283 - RNA, 21 nt, Yersinia pestis
cguuuccaaaacucaugucca

SEQ ID NO: 2260284 - RNA, 14 nt, Yersinia pestis
cguuuccaaaacuc

SEQ ID NO: 2260285 - RNA, 14 nt, Yersinia pestis
cguugggcggucau

SEQ ID NO: 2260286 - RNA, 13 nt, Yersinia pestis
cguuggucagcaa

SEQ ID NO: 2260287 - RNA, 19 nt, Yersinia pestis
cguuguauuagccgccagu

SEQ ID NO: 2260288 - RNA, 20 nt, Yersinia pestis
cguuguaccaccaaaccccu

SEQ ID NO: 2260289 - RNA, 17 nt, Yersinia pestis
cguuguuguaugacaag

SEQ ID NO: 2260290 - RNA, 19 nt, Yersinia pestis
cguuggccggccaacaucg

SEQ ID NO: 2260291 - RNA, 20 nt, Yersinia pestis
cguuggaucaucgggaacag

SEQ ID NO: 2260292 - RNA, 11 nt, Yersinia pestis
cguucucuggc

SEQ ID NO: 2260293 - RNA, 9 nt, Yersinia pestis
cuaaaccac

SEQ ID NO: 2260294 - RNA, 19 nt, Yersinia pestis
cuaaaaaccauccccagaa

SEQ ID NO: 2260295 - RNA, 15 nt, Yersinia pestis
cuaaaaaaauucuga

SEQ ID NO: 2260296 - RNA, 16 nt, Yersinia pestis
cguuuuuuugccagug

SEQ ID NO: 2260297 - RNA, 18 nt, Yersinia pestis
cguuuuaaugccaauuga

SEQ ID NO: 2260298 - RNA, 22 nt, Yersinia pestis
cguuugccaaaauccaccagcg

SEQ ID NO: 2260299 - RNA, 15 nt, Yersinia pestis
cguuagcucuucacg

SEQ ID NO: 2260300 - RNA, 14 nt, Yersinia pestis
cguuagcgauuucu

SEQ ID NO: 2260301 - RNA, 23 nt, Yersinia pestis
cguuagcgauuucuaguggcaac

SEQ ID NO: 2260302 - RNA, 16 nt, Yersinia pestis
cguuauucucaauuga

SEQ ID NO: 2260303 - RNA, 17 nt, Yersinia pestis
cguuauugcgacauaaa

SEQ ID NO: 2260304 - RNA, 14 nt, Yersinia pestis
cguucaaaaucaaa

SEQ ID NO: 2260305 - RNA, 13 nt, Yersinia pestis
cguucaaccaacu

SEQ ID NO: 2260306 - RNA, 23 nt, Yersinia pestis
cguucccgcaggcggccaaugac

SEQ ID NO: 2260307 - RNA, 23 nt, Yersinia pestis
cguucaaucgugcacccccuucg

SEQ ID NO: 2260308 - RNA, 22 nt, Yersinia pestis
cguucaaucgugcacccccuuc

SEQ ID NO: 2260309 - RNA, 20 nt, Yersinia pestis
cguuaaauuucuucaauaau

SEQ ID NO: 2260310 - RNA, 16 nt, Yersinia pestis
cguuaauuauagugaa

SEQ ID NO: 2260311 - RNA, 22 nt, Yersinia pestis
cguuacaacgagggcucaaucu

SEQ ID NO: 2260312 - RNA, 18 nt, Yersinia pestis
cguuacacaaucaguaaa

SEQ ID NO: 2260313 - RNA, 17 nt, Yersinia pestis
cguuacagcuaaagggu

SEQ ID NO: 2260314 - RNA, 17 nt, Yersinia pestis
cguuacagggggcacuu

SEQ ID NO: 2260315 - RNA, 17 nt, Yersinia pestis
cguguuuaacgccgcug

SEQ ID NO: 2260316 - RNA, 16 nt, Yersinia pestis
cguuaaauuucuucaa

SEQ ID NO: 2260317 - RNA, 21 nt, Yersinia pestis
cguguugcaucauuggcuuca

SEQ ID NO: 2260318 - RNA, 23 nt, Yersinia pestis
cguguuggaguaucagaaacagc

SEQ ID NO: 2260319 - RNA, 18 nt, Yersinia pestis
cgugugcuguaagaaaaa

SEQ ID NO: 2260320 - RNA, 22 nt, Yersinia pestis
cguguccggguuuacccagcca

SEQ ID NO: 2260321 - RNA, 16 nt, Yersinia pestis
cguguaagaacuggcu

SEQ ID NO: 2260322 - RNA, 17 nt, Yersinia pestis
cgugucaaaccaauuuc

SEQ ID NO: 2260323 - RNA, 22 nt, Yersinia pestis
cgugguuguaucacaaaaguca

SEQ ID NO: 2260324 - RNA, 21 nt, Yersinia pestis
cgugguuuccuggaacgaagc

SEQ ID NO: 2260325 - RNA, 18 nt, Yersinia pestis
cguggaguagagcuucca

SEQ ID NO: 2260326 - RNA, 18 nt, Yersinia pestis
cgugcuuugccuucuagc

SEQ ID NO: 2260327 - RNA, 21 nt, Yersinia pestis
cgugcuauagaaaacaaaaag

SEQ ID NO: 2260328 - RNA, 21 nt, Yersinia pestis
cgugcucaucaaccucagccu

SEQ ID NO: 2260329 - RNA, 22 nt, Yersinia pestis
cgugcgcuccauuucugguugu

SEQ ID NO: 2260330 - RNA, 14 nt, Yersinia pestis
cguggugaugauga

SEQ ID NO: 2260331 - RNA, 13 nt, Yersinia pestis
cguggugauuaau

SEQ ID NO: 2260332 - RNA, 18 nt, Yersinia pestis
cguggugauuaauacacg

SEQ ID NO: 2260333 - RNA, 15 nt, Yersinia pestis
cgugggcgcagguaa

SEQ ID NO: 2260334 - RNA, 13 nt, Yersinia pestis
cguggguucuuca

SEQ ID NO: 2260335 - RNA, 19 nt, Yersinia pestis
cguggguauccagugucau

SEQ ID NO: 2260336 - RNA, 22 nt, Yersinia pestis
cuccgguaauccuuguaagacc

SEQ ID NO: 2260337 - RNA, 16 nt, Yersinia pestis
cuccuacaccauuaaa

SEQ ID NO: 2260338 - RNA, 16 nt, Yersinia pestis
cuccggcaucauccuc

SEQ ID NO: 2260339 - RNA, 20 nt, Yersinia pestis
cuccggcgugaguuccagcc

SEQ ID NO: 2260340 - RNA, 17 nt, Yersinia pestis
cuccggcuaugccggag

SEQ ID NO: 2260341 - RNA, 14 nt, Yersinia pestis
cuccggccugccgg

SEQ ID NO: 2260342 - RNA, 21 nt, Yersinia pestis
cuccggcgcccuucccauuua

SEQ ID NO: 2260343 - RNA, 16 nt, Yersinia pestis
cucccuuuuccaucac

SEQ ID NO: 2260344 - RNA, 14 nt, Yersinia pestis
cucccgcuaacgca

SEQ ID NO: 2260345 - RNA, 23 nt, Yersinia pestis
cucccgauacucauugcaccuca

SEQ ID NO: 2260346 - RNA, 20 nt, Yersinia pestis
cucccagaauaauaagccgu

SEQ ID NO: 2260347 - RNA, 23 nt, Yersinia pestis
cuccccaaagccuacgagagauc

SEQ ID NO: 2260348 - RNA, 20 nt, Yersinia pestis
cucccauucgcgccccaaau

SEQ ID NO: 2260349 - RNA, 12 nt, Yersinia pestis
cuccaucaauaa

SEQ ID NO: 2260350 - RNA, 18 nt, Yersinia pestis
cuccauccccaacucuuu

SEQ ID NO: 2260351 - RNA, 18 nt, Yersinia pestis
cuccaguuggcgcacguu

SEQ ID NO: 2260352 - RNA, 17 nt, Yersinia pestis
cuccaguugauacagga

SEQ ID NO: 2260353 - RNA, 16 nt, Yersinia pestis
cuccagugccugacgc

SEQ ID NO: 2260354 - RNA, 14 nt, Yersinia pestis
cuccagucccccuc

SEQ ID NO: 2260355 - RNA, 24 nt, Yersinia pestis
cuccaggguaauaagugaucagcu

SEQ ID NO: 2260356 - RNA, 13 nt, Yersinia pestis
cuccaggcauuaa

SEQ ID NO: 2260357 - RNA, 20 nt, Yersinia pestis
cuccaggcauuaaaaucacc

SEQ ID NO: 2260358 - RNA, 17 nt, Yersinia pestis
cuccagccuggaagcaa

SEQ ID NO: 2260359 - RNA, 16 nt, Yersinia pestis
cuccagaggguaugac

SEQ ID NO: 2260360 - RNA, 19 nt, Yersinia pestis
cuccagaauaucuucaacu

SEQ ID NO: 2260361 - RNA, 16 nt, Yersinia pestis
cuccacuaugcccagu

SEQ ID NO: 2260362 - RNA, 19 nt, Yersinia pestis
cuccacguagaucaacauu

SEQ ID NO: 2260363 - RNA, 17 nt, Yersinia pestis
cucgguuguucagcacc

SEQ ID NO: 2260364 - RNA, 23 nt, Yersinia pestis
cucuacgacgcccgcagacugcu

SEQ ID NO: 2260365 - RNA, 23 nt, Yersinia pestis
cucuacguauuucgugauuuucu

SEQ ID NO: 2260366 - RNA, 20 nt, Yersinia pestis
cucgcuuaacugugcagccc

SEQ ID NO: 2260367 - RNA, 19 nt, Yersinia pestis
cucgcuguggcuaccauag

SEQ ID NO: 2260368 - RNA, 14 nt, Yersinia pestis
cucggccgggcuga

SEQ ID NO: 2260369 - RNA, 21 nt, Yersinia pestis
cucggcuuucaggugacugaa

SEQ ID NO: 2260370 - RNA, 22 nt, Yersinia pestis
cucgggauaugacuaaacugau

SEQ ID NO: 2260371 - RNA, 23 nt, Yersinia pestis
cucggcugacgauaguauaaaua

SEQ ID NO: 2260372 - RNA, 20 nt, Yersinia pestis
cucgacaccaaaacucccug

SEQ ID NO: 2260373 - RNA, 18 nt, Yersinia pestis
cuccugagggugaugaca

SEQ ID NO: 2260374 - RNA, 18 nt, Yersinia pestis
cuccugaucuucauugcc

SEQ ID NO: 2260375 - RNA, 13 nt, Yersinia pestis
cuccugauuuaac

SEQ ID NO: 2260376 - RNA, 21 nt, Yersinia pestis
cuccugcaacgccuucacauu

SEQ ID NO: 2260377 - RNA, 18 nt, Yersinia pestis
cucgauugaauaacuucg

SEQ ID NO: 2260378 - RNA, 21 nt, Yersinia pestis
cucgaucaccacgucaccuuu

SEQ ID NO: 2260379 - RNA, 20 nt, Yersinia pestis
cucgcgguucgcagcuucca

SEQ ID NO: 2260380 - RNA, 17 nt, Yersinia pestis
cucgcuaaucaagccuu

SEQ ID NO: 2260381 - RNA, 17 nt, Yersinia pestis
cucgcgugucaaaccaa

SEQ ID NO: 2260382 - RNA, 14 nt, Yersinia pestis
cuauuuuaaaacuc

SEQ ID NO: 2260383 - RNA, 19 nt, Yersinia pestis
cuauuuuuauuucuccuua

SEQ ID NO: 2260384 - RNA, 15 nt, Yersinia pestis
cuauuuuuauacagg

SEQ ID NO: 2260385 - RNA, 12 nt, Yersinia pestis
cuauuuuuuccg

SEQ ID NO: 2260386 - RNA, 17 nt, Yersinia pestis
cucaaacugauaaagca

SEQ ID NO: 2260387 - RNA, 23 nt, Yersinia pestis
cucaaagaccacaucaaccugau

SEQ ID NO: 2260388 - RNA, 19 nt, Yersinia pestis
cuauuuacugcauucugag

SEQ ID NO: 2260389 - RNA, 19 nt, Yersinia pestis
cuauuuauuuauaaaacca

SEQ ID NO: 2260390 - RNA, 23 nt, Yersinia pestis
cuauuucagggcguauaaacaga

SEQ ID NO: 2260391 - RNA, 15 nt, Yersinia pestis
cuauuugaugcuaac

SEQ ID NO: 2260392 - RNA, 15 nt, Yersinia pestis
cuauuucucucuacu

SEQ ID NO: 2260393 - RNA, 14 nt, Yersinia pestis
cuauuuccccgccg

SEQ ID NO: 2260394 - RNA, 20 nt, Yersinia pestis
cuauuucggcuuggcucaau

SEQ ID NO: 2260395 - RNA, 13 nt, Yersinia pestis
cuauuaauuauua

SEQ ID NO: 2260396 - RNA, 19 nt, Yersinia pestis
cuauuaacucuuuuuaaac

SEQ ID NO: 2260397 - RNA, 22 nt, Yersinia pestis
cuauuagccagaaauagcacca

SEQ ID NO: 2260398 - RNA, 23 nt, Yersinia pestis
cuauuagccagaaauagcaccau

SEQ ID NO: 2260399 - RNA, 13 nt, Yersinia pestis
cuauuuaacaaaa

SEQ ID NO: 2260400 - RNA, 19 nt, Yersinia pestis
cucaagcuggccagugaga

SEQ ID NO: 2260401 - RNA, 14 nt, Yersinia pestis
cucaacauucuuua

SEQ ID NO: 2260402 - RNA, 22 nt, Yersinia pestis
cucaaauagauagcaaucaaua

SEQ ID NO: 2260403 - RNA, 19 nt, Yersinia pestis
cucaaauagcaagugugca

SEQ ID NO: 2260404 - RNA, 16 nt, Yersinia pestis
cucaaucgaaugcaau

SEQ ID NO: 2260405 - RNA, 16 nt, Yersinia pestis
cucaagggcacaguuu

SEQ ID NO: 2260406 - RNA, 20 nt, Yersinia pestis
cucaaggucuuucgcccaca

SEQ ID NO: 2260407 - RNA, 12 nt, Yersinia pestis
cucaccgccuag

SEQ ID NO: 2260408 - RNA, 14 nt, Yersinia pestis
cucacaaaauaacu

SEQ ID NO: 2260409 - RNA, 19 nt, Yersinia pestis
cucaaugcgaaaaaauaua

SEQ ID NO: 2260410 - RNA, 24 nt, Yersinia pestis
cucaaugcgaaaaaauauauuccu

SEQ ID NO: 2260411 - RNA, 18 nt, Yersinia pestis
cucaaugucaugcaauua

SEQ ID NO: 2260412 - RNA, 15 nt, Yersinia pestis
cucagagacaucuuu

SEQ ID NO: 2260413 - RNA, 21 nt, Yersinia pestis
cucagagacaucuuuaccagc

SEQ ID NO: 2260414 - RNA, 16 nt, Yersinia pestis
cucagaggccuguugg

SEQ ID NO: 2260415 - RNA, 19 nt, Yersinia pestis
cucagaugaaaaacugugc

SEQ ID NO: 2260416 - RNA, 14 nt, Yersinia pestis
cucagcaaccaacc

SEQ ID NO: 2260417 - RNA, 17 nt, Yersinia pestis
cucacuuuuauccagcc

SEQ ID NO: 2260418 - RNA, 21 nt, Yersinia pestis
cucaccucugcgaagccgcug

SEQ ID NO: 2260419 - RNA, 20 nt, Yersinia pestis
cucacuuguguaaacuccuu

SEQ ID NO: 2260420 - RNA, 23 nt, Yersinia pestis
cucacuuguguaaacuccuugga

SEQ ID NO: 2260421 - RNA, 19 nt, Yersinia pestis
cucacuuuuauauccgcca

SEQ ID NO: 2260422 - RNA, 15 nt, Yersinia pestis
cucaccgucaaccca

SEQ ID NO: 2260423 - RNA, 22 nt, Yersinia pestis
cucagcacggauaucuggguuu

SEQ ID NO: 2260424 - RNA, 22 nt, Yersinia pestis
cucagcagagucgcaaaaaaua

SEQ ID NO: 2260425 - RNA, 22 nt, Yersinia pestis
cucagcauauuguaaacuucca

SEQ ID NO: 2260426 - RNA, 13 nt, Yersinia pestis
cucagcaucaccg

SEQ ID NO: 2260427 - RNA, 17 nt, Yersinia pestis
cucagcacaaacauggc

SEQ ID NO: 2260428 - RNA, 15 nt, Yersinia pestis
cucagcaucuucaau

SEQ ID NO: 2260429 - RNA, 16 nt, Yersinia pestis
cucagccucauucaug

SEQ ID NO: 2260430 - RNA, 20 nt, Yersinia pestis
cucaggaucgcgcuauauug

SEQ ID NO: 2260431 - RNA, 21 nt, Yersinia pestis
cucaggauuagcuucugcuau

SEQ ID NO: 2260432 - RNA, 16 nt, Yersinia pestis
cucagcuucaggccaa

SEQ ID NO: 2260433 - RNA, 23 nt, Yersinia pestis
cucagcuugguaaugcgcaccag

SEQ ID NO: 2260434 - RNA, 20 nt, Yersinia pestis
cucagcugguuagagcacag

SEQ ID NO: 2260435 - RNA, 20 nt, Yersinia pestis
cucauuaauagaaucugcug

SEQ ID NO: 2260436 - RNA, 19 nt, Yersinia pestis
cucaucugcgggcuaacau

SEQ ID NO: 2260437 - RNA, 15 nt, Yersinia pestis
cucaucaccuuccaa

SEQ ID NO: 2260438 - RNA, 22 nt, Yersinia pestis
cucaucgggacgcguuugcuug

SEQ ID NO: 2260439 - RNA, 17 nt, Yersinia pestis
cucaucggguaaaauca

SEQ ID NO: 2260440 - RNA, 22 nt, Yersinia pestis
cucaucgguaacuuacaggcug

SEQ ID NO: 2260441 - RNA, 18 nt, Yersinia pestis
cucaucggguaaaaucau

SEQ ID NO: 2260442 - RNA, 16 nt, Yersinia pestis
cucaguagcaggcgca

SEQ ID NO: 2260443 - RNA, 23 nt, Yersinia pestis
cucaguaaauauaauuucaaagu

SEQ ID NO: 2260444 - RNA, 20 nt, Yersinia pestis
cucaguacagucccugugcg

SEQ ID NO: 2260445 - RNA, 22 nt, Yersinia pestis
cucaguaaaagcggguuaccag

SEQ ID NO: 2260446 - RNA, 14 nt, Yersinia pestis
cucagucaucgccu

SEQ ID NO: 2260447 - RNA, 22 nt, Yersinia pestis
cucauauuguccaaaggaaggg

SEQ ID NO: 2260448 - RNA, 17 nt, Yersinia pestis
cucaucaaaggagugcc

SEQ ID NO: 2260449 - RNA, 14 nt, Yersinia pestis
cucaucaaaacaau

SEQ ID NO: 2260450 - RNA, 16 nt, Yersinia pestis
cucaucaacuucugca

SEQ ID NO: 2260451 - RNA, 14 nt, Yersinia pestis
cucaucaaccucag

SEQ ID NO: 2260452 - RNA, 19 nt, Yersinia pestis
cucaucaaccucagccuca

SEQ ID NO: 2260453 - RNA, 23 nt, Yersinia pestis
cucaucgaaauucccguuuuauu

SEQ ID NO: 2260454 - RNA, 23 nt, Yersinia pestis
cucauccugcuauuuaacaaaaa

SEQ ID NO: 2260455 - RNA, 15 nt, Yersinia pestis
cucauccguaaaaaa

SEQ ID NO: 2260456 - RNA, 21 nt, Yersinia pestis
cuaccugaaugcgccgcggcc

SEQ ID NO: 2260457 - RNA, 12 nt, Yersinia pestis
cuaccugaaugc

SEQ ID NO: 2260458 - RNA, 19 nt, Yersinia pestis
cuaccugccugcugcugug

SEQ ID NO: 2260459 - RNA, 14 nt, Yersinia pestis
cuaccguaucagcc

SEQ ID NO: 2260460 - RNA, 23 nt, Yersinia pestis
cuaccggauaacguuucagggug

SEQ ID NO: 2260461 - RNA, 22 nt, Yersinia pestis
cuaccggccauugauaccuuca

SEQ ID NO: 2260462 - RNA, 15 nt, Yersinia pestis
cuaccggaaccaacg

SEQ ID NO: 2260463 - RNA, 19 nt, Yersinia pestis
cuaccggaaccgccgccuu

SEQ ID NO: 2260464 - RNA, 17 nt, Yersinia pestis
cuaauacagcaccaccg

SEQ ID NO: 2260465 - RNA, 22 nt, Yersinia pestis
cuaauacugccaaucgcugcca

SEQ ID NO: 2260466 - RNA, 20 nt, Yersinia pestis
cuacguacuaucuauuauug

SEQ ID NO: 2260467 - RNA, 18 nt, Yersinia pestis
cuacggcugaucugcccc

SEQ ID NO: 2260468 - RNA, 22 nt, Yersinia pestis
cuacgcuuucaggagugaauuu

SEQ ID NO: 2260469 - RNA, 18 nt, Yersinia pestis
cuacggccuguaccacca

SEQ ID NO: 2260470 - RNA, 20 nt, Yersinia pestis
cuaccuuuugcauauuucuc

SEQ ID NO: 2260471 - RNA, 19 nt, Yersinia pestis
cuaccuugcuccgcaauuu

SEQ ID NO: 2260472 - RNA, 21 nt, Yersinia pestis
cuaccuucccguccacuuuca

SEQ ID NO: 2260473 - RNA, 17 nt, Yersinia pestis
cuacgccgucaucaucu

SEQ ID NO: 2260474 - RNA, 23 nt, Yersinia pestis
cuagauaccgccccucacuucga

SEQ ID NO: 2260475 - RNA, 16 nt, Yersinia pestis
cuagauagccauaaua

SEQ ID NO: 2260476 - RNA, 14 nt, Yersinia pestis
cuagccagccaccg

SEQ ID NO: 2260477 - RNA, 17 nt, Yersinia pestis
cuagcaucacccgcccu

SEQ ID NO: 2260478 - RNA, 23 nt, Yersinia pestis
cuagccaagcuucaauuugacgc

SEQ ID NO: 2260479 - RNA, 15 nt, Yersinia pestis
cuagcgagcucugag

SEQ ID NO: 2260480 - RNA, 17 nt, Yersinia pestis
cuagcgccgcaucaaag

SEQ ID NO: 2260481 - RNA, 17 nt, Yersinia pestis
cuagcgaaguauuaaua

SEQ ID NO: 2260482 - RNA, 22 nt, Yersinia pestis
cuagccuugagcgcuauucuga

SEQ ID NO: 2260483 - RNA, 23 nt, Yersinia pestis
cuacguuguuaucaucaccaccc

SEQ ID NO: 2260484 - RNA, 13 nt, Yersinia pestis
cuacguucgcuuu

SEQ ID NO: 2260485 - RNA, 21 nt, Yersinia pestis
cuacuauaagcgcucaaauac

SEQ ID NO: 2260486 - RNA, 16 nt, Yersinia pestis
cuagagcauaacuggu

SEQ ID NO: 2260487 - RNA, 18 nt, Yersinia pestis
cuaucuuuucgauagcca

SEQ ID NO: 2260488 - RNA, 16 nt, Yersinia pestis
cuaucuuaaaaauaac

SEQ ID NO: 2260489 - RNA, 13 nt, Yersinia pestis
cuaugagccggcu

SEQ ID NO: 2260490 - RNA, 15 nt, Yersinia pestis
cuaucuuuauugcuc

SEQ ID NO: 2260491 - RNA, 18 nt, Yersinia pestis
cuauggcgguuccaaagc

SEQ ID NO: 2260492 - RNA, 22 nt, Yersinia pestis
cuaugcucagcaaccaaccuug

SEQ ID NO: 2260493 - RNA, 19 nt, Yersinia pestis
cuauggauuacuuacggcc

SEQ ID NO: 2260494 - RNA, 15 nt, Yersinia pestis
cuaucugaaugaauu

SEQ ID NO: 2260495 - RNA, 15 nt, Yersinia pestis
cuaucugcugcggua

SEQ ID NO: 2260496 - RNA, 21 nt, Yersinia pestis
cuaucucgacaaauccuuuua

SEQ ID NO: 2260497 - RNA, 18 nt, Yersinia pestis
cuaucucgcaauauaugg

SEQ ID NO: 2260498 - RNA, 14 nt, Yersinia pestis
cuaucgaaacaccc

SEQ ID NO: 2260499 - RNA, 20 nt, Yersinia pestis
cuaucgaugguuggcuauca

SEQ ID NO: 2260500 - RNA, 22 nt, Yersinia pestis
cuauauacccgucauaaauaaa

SEQ ID NO: 2260501 - RNA, 18 nt, Yersinia pestis
cuauauaacugcccaauu

SEQ ID NO: 2260502 - RNA, 13 nt, Yersinia pestis
cuauaugguaacg

SEQ ID NO: 2260503 - RNA, 14 nt, Yersinia pestis
cuauagaaaacaaa

SEQ ID NO: 2260504 - RNA, 14 nt, Yersinia pestis
cuauagacaauacu

SEQ ID NO: 2260505 - RNA, 15 nt, Yersinia pestis
cuauaauuauuucuc

SEQ ID NO: 2260506 - RNA, 13 nt, Yersinia pestis
cuauaaauuuuaa

SEQ ID NO: 2260507 - RNA, 11 nt, Yersinia pestis
cuauaaaaccg

SEQ ID NO: 2260508 - RNA, 20 nt, Yersinia pestis
cugccauaauccagaagcca

SEQ ID NO: 2260509 - RNA, 17 nt, Yersinia pestis
cugccaugggaaaucaa

SEQ ID NO: 2260510 - RNA, 18 nt, Yersinia pestis
cugccaugggaaaucaaa

SEQ ID NO: 2260511 - RNA, 22 nt, Yersinia pestis
cugcccagucacuaccgcucag

SEQ ID NO: 2260512 - RNA, 14 nt, Yersinia pestis
cugccauaaccgcu

SEQ ID NO: 2260513 - RNA, 22 nt, Yersinia pestis
cugccauaaccgcuaaggccaa

SEQ ID NO: 2260514 - RNA, 21 nt, Yersinia pestis
cugcauaaaaauagcccuccc

SEQ ID NO: 2260515 - RNA, 15 nt, Yersinia pestis
cugccagauagucau

SEQ ID NO: 2260516 - RNA, 19 nt, Yersinia pestis
cugccagauagucaucuuu

SEQ ID NO: 2260517 - RNA, 22 nt, Yersinia pestis
cugccagaaucagccccaagcu

SEQ ID NO: 2260518 - RNA, 17 nt, Yersinia pestis
cugccuauccucaccgu

SEQ ID NO: 2260519 - RNA, 22 nt, Yersinia pestis
cugccuaugcguuggcugccuu

SEQ ID NO: 2260520 - RNA, 12 nt, Yersinia pestis
cugccuauccuc

SEQ ID NO: 2260521 - RNA, 13 nt, Yersinia pestis
cugccuauccuca

SEQ ID NO: 2260522 - RNA, 14 nt, Yersinia pestis
cugccguaaacaau

SEQ ID NO: 2260523 - RNA, 22 nt, Yersinia pestis
cugccggcguuaaugccacccc

SEQ ID NO: 2260524 - RNA, 19 nt, Yersinia pestis
cugccgaaccuuuugccag

SEQ ID NO: 2260525 - RNA, 18 nt, Yersinia pestis
cugcccgucacucagaaa

SEQ ID NO: 2260526 - RNA, 15 nt, Yersinia pestis
cugccuguucucucc

SEQ ID NO: 2260527 - RNA, 13 nt, Yersinia pestis
cugccugaguaau

SEQ ID NO: 2260528 - RNA, 16 nt, Yersinia pestis
cugcgcauugauaauc

SEQ ID NO: 2260529 - RNA, 23 nt, Yersinia pestis
cugcgcccaaaucugcccccagc

SEQ ID NO: 2260530 - RNA, 23 nt, Yersinia pestis
cugcgcgacaaaaccgauggcuu

SEQ ID NO: 2260531 - RNA, 13 nt, Yersinia pestis
cugcgccugcgcu

SEQ ID NO: 2260532 - RNA, 19 nt, Yersinia pestis
cugcgcggaaaaaaggauu

SEQ ID NO: 2260533 - RNA, 14 nt, Yersinia pestis
cugcguucuucuug

SEQ ID NO: 2260534 - RNA, 22 nt, Yersinia pestis
cugcguuuuucccuguagaaca

SEQ ID NO: 2260535 - RNA, 17 nt, Yersinia pestis
cugcuaacaacagucaa

SEQ ID NO: 2260536 - RNA, 16 nt, Yersinia pestis
cugcggcuuucugccu

SEQ ID NO: 2260537 - RNA, 11 nt, Yersinia pestis
cugauaaaauu

SEQ ID NO: 2260538 - RNA, 13 nt, Yersinia pestis
cugauaaaacagu

SEQ ID NO: 2260539 - RNA, 15 nt, Yersinia pestis
cugauaaaacaguuc

SEQ ID NO: 2260540 - RNA, 18 nt, Yersinia pestis
cugauagugauuuuuuuc

SEQ ID NO: 2260541 - RNA, 21 nt, Yersinia pestis
cugauccacuacuuauuuccg

SEQ ID NO: 2260542 - RNA, 20 nt, Yersinia pestis
cugaucaugccacgaccauu

SEQ ID NO: 2260543 - RNA, 20 nt, Yersinia pestis
cugauagugauuuuuuucac

SEQ ID NO: 2260544 - RNA, 15 nt, Yersinia pestis
cugauauaaagcauu

SEQ ID NO: 2260545 - RNA, 13 nt, Yersinia pestis
cugauaucuaaaa

SEQ ID NO: 2260546 - RNA, 18 nt, Yersinia pestis
cugauaucuucacucagc

SEQ ID NO: 2260547 - RNA, 22 nt, Yersinia pestis
cugaucaauaucccgagaaaca

SEQ ID NO: 2260548 - RNA, 16 nt, Yersinia pestis
cugaguucugcugcca

SEQ ID NO: 2260549 - RNA, 11 nt, Yersinia pestis
cugaguucugc

SEQ ID NO: 2260550 - RNA, 15 nt, Yersinia pestis
cugagucgucugucg

SEQ ID NO: 2260551 - RNA, 20 nt, Yersinia pestis
cugagugggggcgauuaauu

SEQ ID NO: 2260552 - RNA, 13 nt, Yersinia pestis
cugagucagucag

SEQ ID NO: 2260553 - RNA, 17 nt, Yersinia pestis
cugagucaguaauucac

SEQ ID NO: 2260554 - RNA, 14 nt, Yersinia pestis
cugaguaauauuau

SEQ ID NO: 2260555 - RNA, 18 nt, Yersinia pestis
cugaggucgaaagcucaa

SEQ ID NO: 2260556 - RNA, 15 nt, Yersinia pestis
cugagguugaugagc

SEQ ID NO: 2260557 - RNA, 16 nt, Yersinia pestis
cugagguugcucagcg

SEQ ID NO: 2260558 - RNA, 17 nt, Yersinia pestis
cugagguugcucagcgg

SEQ ID NO: 2260559 - RNA, 22 nt, Yersinia pestis
cugaggggcguuuaaugccccu

SEQ ID NO: 2260560 - RNA, 13 nt, Yersinia pestis
cugagggccacuu

SEQ ID NO: 2260561 - RNA, 12 nt, Yersinia pestis
cugagggugaug

SEQ ID NO: 2260562 - RNA, 19 nt, Yersinia pestis
cucuauucugcuuuuugcu

SEQ ID NO: 2260563 - RNA, 17 nt, Yersinia pestis
cucuauucugcuuuuug

SEQ ID NO: 2260564 - RNA, 13 nt, Yersinia pestis
cucuaucucuucc

SEQ ID NO: 2260565 - RNA, 24 nt, Yersinia pestis
cucuaucagcgcccuacugcauca

SEQ ID NO: 2260566 - RNA, 22 nt, Yersinia pestis
cugaggacggaugguaaagcag

SEQ ID NO: 2260567 - RNA, 23 nt, Yersinia pestis
cugaggagccauugauuggcucc

SEQ ID NO: 2260568 - RNA, 23 nt, Yersinia pestis
cugaggccaacacucaugacaaa

SEQ ID NO: 2260569 - RNA, 22 nt, Yersinia pestis
cugagcuuauagaacggcagug

SEQ ID NO: 2260570 - RNA, 22 nt, Yersinia pestis
cugcacggaucacgcuguucac

SEQ ID NO: 2260571 - RNA, 20 nt, Yersinia pestis
cugcaauggcuggcaaggca

SEQ ID NO: 2260572 - RNA, 16 nt, Yersinia pestis
cugcaauuauaagcac

SEQ ID NO: 2260573 - RNA, 13 nt, Yersinia pestis
cugcacugcucua

SEQ ID NO: 2260574 - RNA, 14 nt, Yersinia pestis
cugcacugcucuau

SEQ ID NO: 2260575 - RNA, 19 nt, Yersinia pestis
cugcacugcucuaucuccc

SEQ ID NO: 2260576 - RNA, 18 nt, Yersinia pestis
cugcagaaucacuggcag

SEQ ID NO: 2260577 - RNA, 13 nt, Yersinia pestis
cugcagaaaauca

SEQ ID NO: 2260578 - RNA, 16 nt, Yersinia pestis
cugcacguuuaauuuc

SEQ ID NO: 2260579 - RNA, 21 nt, Yersinia pestis
cugcaguuuccaacacgauau

SEQ ID NO: 2260580 - RNA, 23 nt, Yersinia pestis
cugcagugaaaagguuaacugca

SEQ ID NO: 2260581 - RNA, 12 nt, Yersinia pestis
cugcagugaaaa

SEQ ID NO: 2260582 - RNA, 14 nt, Yersinia pestis
cugcagggccuuua

SEQ ID NO: 2260583 - RNA, 17 nt, Yersinia pestis
cugcaaacuggcaggga

SEQ ID NO: 2260584 - RNA, 21 nt, Yersinia pestis
cugcaaacggcucaucacacc

SEQ ID NO: 2260585 - RNA, 18 nt, Yersinia pestis
cugauuugggaacaacag

SEQ ID NO: 2260586 - RNA, 21 nt, Yersinia pestis
cugcaagaguccagcacuggu

SEQ ID NO: 2260587 - RNA, 21 nt, Yersinia pestis
cugcaacguuaaagaugaagg

SEQ ID NO: 2260588 - RNA, 22 nt, Yersinia pestis
cugauuaauauccaauuguuuu

SEQ ID NO: 2260589 - RNA, 13 nt, Yersinia pestis
cugauguuuugcu

SEQ ID NO: 2260590 - RNA, 18 nt, Yersinia pestis
cugauguuuugcugccau

SEQ ID NO: 2260591 - RNA, 17 nt, Yersinia pestis
cugauguucugccaacc

SEQ ID NO: 2260592 - RNA, 15 nt, Yersinia pestis
cugauguucugccaa

SEQ ID NO: 2260593 - RNA, 19 nt, Yersinia pestis
cugaugugcauguggaagc

SEQ ID NO: 2260594 - RNA, 17 nt, Yersinia pestis
cugaugugcauguggaa

SEQ ID NO: 2260595 - RNA, 18 nt, Yersinia pestis
cugaucuucauugccuuc

SEQ ID NO: 2260596 - RNA, 21 nt, Yersinia pestis
cugaucugccccuggcucagu

SEQ ID NO: 2260597 - RNA, 14 nt, Yersinia pestis
cuguauguguuugu

SEQ ID NO: 2260598 - RNA, 20 nt, Yersinia pestis
cuguauuuccuguauuuccu

SEQ ID NO: 2260599 - RNA, 15 nt, Yersinia pestis
cuguauuuguucuga

SEQ ID NO: 2260600 - RNA, 15 nt, Yersinia pestis
cugucaaaaagcacc

SEQ ID NO: 2260601 - RNA, 16 nt, Yersinia pestis
cugucagcgaaaaaaa

SEQ ID NO: 2260602 - RNA, 18 nt, Yersinia pestis
cugucagacaguucugua

SEQ ID NO: 2260603 - RNA, 12 nt, Yersinia pestis
cugucagccacc

SEQ ID NO: 2260604 - RNA, 17 nt, Yersinia pestis
cugucagcccuaauauc

SEQ ID NO: 2260605 - RNA, 13 nt, Yersinia pestis
cugucacugucaa

SEQ ID NO: 2260606 - RNA, 13 nt, Yersinia pestis
cugucaccuacca

SEQ ID NO: 2260607 - RNA, 15 nt, Yersinia pestis
cugucaccugucacc

SEQ ID NO: 2260608 - RNA, 16 nt, Yersinia pestis
cugucaccugucaccu

SEQ ID NO: 2260609 - RNA, 19 nt, Yersinia pestis
cugucaccugucaccuacc

SEQ ID NO: 2260610 - RNA, 16 nt, Yersinia pestis
cugucgcauaagacaa

SEQ ID NO: 2260611 - RNA, 21 nt, Yersinia pestis
cugucgcagaaaacaggccgc

SEQ ID NO: 2260612 - RNA, 12 nt, Yersinia pestis
cugucggguaac

SEQ ID NO: 2260613 - RNA, 18 nt, Yersinia pestis
cugucggcgaugaaaaac

SEQ ID NO: 2260614 - RNA, 15 nt, Yersinia pestis
cugucggcgcagcaa

SEQ ID NO: 2260615 - RNA, 23 nt, Yersinia pestis
cuguaguucaauggucaugcaca

SEQ ID NO: 2260616 - RNA, 17 nt, Yersinia pestis
cuguacaacaagauccc

SEQ ID NO: 2260617 - RNA, 15 nt, Yersinia pestis
cuguacacacaguga

SEQ ID NO: 2260618 - RNA, 15 nt, Yersinia pestis
cuguacauauauaau

SEQ ID NO: 2260619 - RNA, 17 nt, Yersinia pestis
cuguacauaaauuugug

SEQ ID NO: 2260620 - RNA, 20 nt, Yersinia pestis
cuguaccaccaccaacagca

SEQ ID NO: 2260621 - RNA, 12 nt, Yersinia pestis
cuguaccaccac

SEQ ID NO: 2260622 - RNA, 14 nt, Yersinia pestis
cuguaccaccacca

SEQ ID NO: 2260623 - RNA, 17 nt, Yersinia pestis
cuguaaaggcaaagaag

SEQ ID NO: 2260624 - RNA, 13 nt, Yersinia pestis
cuguaaaggcaaa

SEQ ID NO: 2260625 - RNA, 19 nt, Yersinia pestis
cugguagucauauucaggc

SEQ ID NO: 2260626 - RNA, 13 nt, Yersinia pestis
cuggugaacgaaa

SEQ ID NO: 2260627 - RNA, 20 nt, Yersinia pestis
cuggugaugcucgagcacca

SEQ ID NO: 2260628 - RNA, 14 nt, Yersinia pestis
cuggucgauaagca

SEQ ID NO: 2260629 - RNA, 21 nt, Yersinia pestis
cugggugacgcgaaacgccca

SEQ ID NO: 2260630 - RNA, 14 nt, Yersinia pestis
cugggucaucaccc

SEQ ID NO: 2260631 - RNA, 22 nt, Yersinia pestis
cuggggcuaucgcgaaaaugaa

SEQ ID NO: 2260632 - RNA, 14 nt, Yersinia pestis
cugguaccaaucuc

SEQ ID NO: 2260633 - RNA, 22 nt, Yersinia pestis
cugguaagcuggcgcacucauc

SEQ ID NO: 2260634 - RNA, 15 nt, Yersinia pestis
cugggugcugcuccc

SEQ ID NO: 2260635 - RNA, 15 nt, Yersinia pestis
cugggugugcguaca

SEQ ID NO: 2260636 - RNA, 17 nt, Yersinia pestis
cugggccuacuggugcc

SEQ ID NO: 2260637 - RNA, 13 nt, Yersinia pestis
cuggcguaauauu

SEQ ID NO: 2260638 - RNA, 15 nt, Yersinia pestis
cuggcgguaauaaau

SEQ ID NO: 2260639 - RNA, 18 nt, Yersinia pestis
cuggcgggaauugaaccu

SEQ ID NO: 2260640 - RNA, 19 nt, Yersinia pestis
cuggcguagguaguggcug

SEQ ID NO: 2260641 - RNA, 22 nt, Yersinia pestis
cuggcguagguaguggcugaua

SEQ ID NO: 2260642 - RNA, 16 nt, Yersinia pestis
cuggaaaggaauaucu

SEQ ID NO: 2260643 - RNA, 20 nt, Yersinia pestis
cuggaaauauuggcaacaac

SEQ ID NO: 2260644 - RNA, 17 nt, Yersinia pestis
cuggaacaagagaucuc

SEQ ID NO: 2260645 - RNA, 20 nt, Yersinia pestis
cuggaacguugcacccugcu

SEQ ID NO: 2260646 - RNA, 19 nt, Yersinia pestis
cuggaauccaaguucaacu

SEQ ID NO: 2260647 - RNA, 16 nt, Yersinia pestis
cuggacgcaucagauc

SEQ ID NO: 2260648 - RNA, 23 nt, Yersinia pestis
cuggacgcuggcagccuuuaucc

SEQ ID NO: 2260649 - RNA, 20 nt, Yersinia pestis
cuggagcaagauuuuguagc

SEQ ID NO: 2260650 - RNA, 20 nt, Yersinia pestis
cuggagcauugcgcucugac

SEQ ID NO: 2260651 - RNA, 22 nt, Yersinia pestis
cugcuauuuaacaaaaaauuaa

SEQ ID NO: 2260652 - RNA, 12 nt, Yersinia pestis
cugcucaacugc

SEQ ID NO: 2260653 - RNA, 14 nt, Yersinia pestis
cugcucaacugcuc

SEQ ID NO: 2260654 - RNA, 16 nt, Yersinia pestis
cugcucaacugcucaa

SEQ ID NO: 2260655 - RNA, 16 nt, Yersinia pestis
cugcuaucaugauaaa

SEQ ID NO: 2260656 - RNA, 22 nt, Yersinia pestis
cugcuaucaugauaaauaauaa

SEQ ID NO: 2260657 - RNA, 21 nt, Yersinia pestis
cugcuagcaaauuccgcuucu

SEQ ID NO: 2260658 - RNA, 12 nt, Yersinia pestis
cugcuugaaagc

SEQ ID NO: 2260659 - RNA, 20 nt, Yersinia pestis
cugcuugaaagcaccgcccc

SEQ ID NO: 2260660 - RNA, 13 nt, Yersinia pestis
cugcucacgcaaa

SEQ ID NO: 2260661 - RNA, 17 nt, Yersinia pestis
cugcucacgcaaauaaa

SEQ ID NO: 2260662 - RNA, 16 nt, Yersinia pestis
cugcucacgcaaauaa

SEQ ID NO: 2260663 - RNA, 23 nt, Yersinia pestis
cugcucacgguagguuucugggc

SEQ ID NO: 2260664 - RNA, 14 nt, Yersinia pestis
cugcucauaaagca

SEQ ID NO: 2260665 - RNA, 16 nt, Yersinia pestis
cugcucauaagauacc

SEQ ID NO: 2260666 - RNA, 16 nt, Yersinia pestis
cugcuuuuugcuuuuu

SEQ ID NO: 2260667 - RNA, 15 nt, Yersinia pestis
cugcuuuuaccgcag

SEQ ID NO: 2260668 - RNA, 12 nt, Yersinia pestis
cuggaaaaccaa

SEQ ID NO: 2260669 - RNA, 12 nt, Yersinia pestis
cuggaaacaaaa

SEQ ID NO: 2260670 - RNA, 14 nt, Yersinia pestis
cuggaaacgaccug

SEQ ID NO: 2260671 - RNA, 17 nt, Yersinia pestis
cuggaaacaaaaccuaa

SEQ ID NO: 2260672 - RNA, 13 nt, Yersinia pestis
cugcuugcgcguu

SEQ ID NO: 2260673 - RNA, 18 nt, Yersinia pestis
cugcuugauuugcuggcg

SEQ ID NO: 2260674 - RNA, 12 nt, Yersinia pestis
cuggcauugcau

SEQ ID NO: 2260675 - RNA, 18 nt, Yersinia pestis
cuggcaugcauuggaaaa

SEQ ID NO: 2260676 - RNA, 19 nt, Yersinia pestis
cuggcaugcauuggaaaaa

SEQ ID NO: 2260677 - RNA, 16 nt, Yersinia pestis
cuggcauacaguuuug

SEQ ID NO: 2260678 - RNA, 12 nt, Yersinia pestis
cuggcaggaaau

SEQ ID NO: 2260679 - RNA, 23 nt, Yersinia pestis
cuggccacccaacgcaauugcac

SEQ ID NO: 2260680 - RNA, 23 nt, Yersinia pestis
cuggccaaagccgguaucaacuc

SEQ ID NO: 2260681 - RNA, 17 nt, Yersinia pestis
cuggcccccaaugacac

SEQ ID NO: 2260682 - RNA, 15 nt, Yersinia pestis
cuggcaccggacaaa

SEQ ID NO: 2260683 - RNA, 22 nt, Yersinia pestis
cuggcaggcucgagcgcuaaua

SEQ ID NO: 2260684 - RNA, 22 nt, Yersinia pestis
cuggcaauuucuguuaccagaa

SEQ ID NO: 2260685 - RNA, 17 nt, Yersinia pestis
cuggcaauccagcgccu

SEQ ID NO: 2260686 - RNA, 17 nt, Yersinia pestis
cuggcaaggcacgagcg

SEQ ID NO: 2260687 - RNA, 16 nt, Yersinia pestis
cuggaggcuggcaggu

SEQ ID NO: 2260688 - RNA, 21 nt, Yersinia pestis
cuggauaagugaauaacgcug

SEQ ID NO: 2260689 - RNA, 18 nt, Yersinia pestis
cuggcggaacaguugcuu

SEQ ID NO: 2260690 - RNA, 15 nt, Yersinia pestis
cuggcggauaaaaau

SEQ ID NO: 2260691 - RNA, 19 nt, Yersinia pestis
cuggcggauaacggcggca

SEQ ID NO: 2260692 - RNA, 20 nt, Yersinia pestis
cuggcggauaacggcggcaa

SEQ ID NO: 2260693 - RNA, 17 nt, Yersinia pestis
cuggccuguugcaauug

SEQ ID NO: 2260694 - RNA, 17 nt, Yersinia pestis
cuggccugagaacccau

SEQ ID NO: 2260695 - RNA, 19 nt, Yersinia pestis
cuggccuauuaagauaauu

SEQ ID NO: 2260696 - RNA, 21 nt, Yersinia pestis
cuggccguguuuuucccuacc

SEQ ID NO: 2260697 - RNA, 12 nt, Yersinia pestis
cuucuuauuuau

SEQ ID NO: 2260698 - RNA, 14 nt, Yersinia pestis
cuucuuauuuauca

SEQ ID NO: 2260699 - RNA, 13 nt, Yersinia pestis
cuucuucaaaagc

SEQ ID NO: 2260700 - RNA, 19 nt, Yersinia pestis
cuucugguggugucacauu

SEQ ID NO: 2260701 - RNA, 22 nt, Yersinia pestis
cuucuggugguuuuguuaauau

SEQ ID NO: 2260702 - RNA, 23 nt, Yersinia pestis
cuucugggaucaucgcuugauca

SEQ ID NO: 2260703 - RNA, 18 nt, Yersinia pestis
cuucuuggguggcaauuu

SEQ ID NO: 2260704 - RNA, 21 nt, Yersinia pestis
cuucuugguguugcagucucc

SEQ ID NO: 2260705 - RNA, 22 nt, Yersinia pestis
cuucuuguggcaguucacccaa

SEQ ID NO: 2260706 - RNA, 12 nt, Yersinia pestis
cuucuuccaucu

SEQ ID NO: 2260707 - RNA, 21 nt, Yersinia pestis
cuucuuccaucuuacccaaca

SEQ ID NO: 2260708 - RNA, 14 nt, Yersinia pestis
cuucuuccauugau

SEQ ID NO: 2260709 - RNA, 20 nt, Yersinia pestis
cuucuucgauuuuagcuuug

SEQ ID NO: 2260710 - RNA, 18 nt, Yersinia pestis
cuucugauuuuuuguucu

SEQ ID NO: 2260711 - RNA, 16 nt, Yersinia pestis
cuucugauucaauuuc

SEQ ID NO: 2260712 - RNA, 15 nt, Yersinia pestis
cuucugaacguauau

SEQ ID NO: 2260713 - RNA, 19 nt, Yersinia pestis
cuucugccuauccucaccg

SEQ ID NO: 2260714 - RNA, 15 nt, Yersinia pestis
cuucuccuguauuug

SEQ ID NO: 2260715 - RNA, 21 nt, Yersinia pestis
cuucuccuauccacugugauu

SEQ ID NO: 2260716 - RNA, 16 nt, Yersinia pestis
cuugaaacagcagggg

SEQ ID NO: 2260717 - RNA, 16 nt, Yersinia pestis
cuucuuuauuguuuug

SEQ ID NO: 2260718 - RNA, 20 nt, Yersinia pestis
cuucuuuacugcccucgcaa

SEQ ID NO: 2260719 - RNA, 20 nt, Yersinia pestis
cuugaaaugauaacaauaaa

SEQ ID NO: 2260720 - RNA, 14 nt, Yersinia pestis
cuugaaccaauuuu

SEQ ID NO: 2260721 - RNA, 16 nt, Yersinia pestis
cuugaaccaauuuuuc

SEQ ID NO: 2260722 - RNA, 20 nt, Yersinia pestis
cuugaaccaauuuuucugua

SEQ ID NO: 2260723 - RNA, 18 nt, Yersinia pestis
cuugagcagugcgcggcg

SEQ ID NO: 2260724 - RNA, 15 nt, Yersinia pestis
cuugagcggcauccu

SEQ ID NO: 2260725 - RNA, 19 nt, Yersinia pestis
cuugaggugcuugaacaac

SEQ ID NO: 2260726 - RNA, 20 nt, Yersinia pestis
cuugauagcgggcagacguu

SEQ ID NO: 2260727 - RNA, 18 nt, Yersinia pestis
cuugaugugcucugcucc

SEQ ID NO: 2260728 - RNA, 19 nt, Yersinia pestis
cuugaugugcucugcuccg

SEQ ID NO: 2260729 - RNA, 13 nt, Yersinia pestis
cuugauucaccag

SEQ ID NO: 2260730 - RNA, 22 nt, Yersinia pestis
cuugaugaaguuauuuuuauua

SEQ ID NO: 2260731 - RNA, 19 nt, Yersinia pestis
cuugauugccuacaacuug

SEQ ID NO: 2260732 - RNA, 14 nt, Yersinia pestis
cuugcugaugccca

SEQ ID NO: 2260733 - RNA, 21 nt, Yersinia pestis
cuugcuaccaagacuucauga

SEQ ID NO: 2260734 - RNA, 16 nt, Yersinia pestis
cuugcggaauuucuuc

SEQ ID NO: 2260735 - RNA, 22 nt, Yersinia pestis
cuugcgcgcugggacgcuuaau

SEQ ID NO: 2260736 - RNA, 23 nt, Yersinia pestis
cuugcagcgaucacagauaaaca

SEQ ID NO: 2260737 - RNA, 16 nt, Yersinia pestis
cuugcgcgaaauaccc

SEQ ID NO: 2260738 - RNA, 20 nt, Yersinia pestis
cuugcgcgcugggacgcuua

SEQ ID NO: 2260739 - RNA, 17 nt, Yersinia pestis
cuuuaaucgccugaugc

SEQ ID NO: 2260740 - RNA, 21 nt, Yersinia pestis
cuuuaccagcgucaaaccauu

SEQ ID NO: 2260741 - RNA, 14 nt, Yersinia pestis
cuuuaccagccccg

SEQ ID NO: 2260742 - RNA, 18 nt, Yersinia pestis
cuuuacgaucugccuguu

SEQ ID NO: 2260743 - RNA, 21 nt, Yersinia pestis
cuuuacgcaacucagcaauau

SEQ ID NO: 2260744 - RNA, 17 nt, Yersinia pestis
cuuuaucaauuuauacc

SEQ ID NO: 2260745 - RNA, 16 nt, Yersinia pestis
cuuucaguucaacagu

SEQ ID NO: 2260746 - RNA, 12 nt, Yersinia pestis
cuuucaguaauc

SEQ ID NO: 2260747 - RNA, 23 nt, Yersinia pestis
cuuucagggaguaacuugacgac

SEQ ID NO: 2260748 - RNA, 18 nt, Yersinia pestis
cuuucacgcuccacaccc

SEQ ID NO: 2260749 - RNA, 12 nt, Yersinia pestis
cuuucaccaacc

SEQ ID NO: 2260750 - RNA, 16 nt, Yersinia pestis
cuuucaccaaaccauc

SEQ ID NO: 2260751 - RNA, 15 nt, Yersinia pestis
cuuucaccagugguc

SEQ ID NO: 2260752 - RNA, 21 nt, Yersinia pestis
cuuuauccaaccaccuuaagu

SEQ ID NO: 2260753 - RNA, 19 nt, Yersinia pestis
cuuuauguaacacauauuu

SEQ ID NO: 2260754 - RNA, 17 nt, Yersinia pestis
cuuuauguauucuugua

SEQ ID NO: 2260755 - RNA, 14 nt, Yersinia pestis
cuuuaugucuuuuu

SEQ ID NO: 2260756 - RNA, 21 nt, Yersinia pestis
cuuuauguauucuuguauccu

SEQ ID NO: 2260757 - RNA, 24 nt, Yersinia pestis
cuuuccgcucagcaucuucaauca

SEQ ID NO: 2260758 - RNA, 19 nt, Yersinia pestis
cuuucccgcgucgugauga

SEQ ID NO: 2260759 - RNA, 24 nt, Yersinia pestis
cuuucccccauaauucugccgacu

SEQ ID NO: 2260760 - RNA, 17 nt, Yersinia pestis
cuuucaguuuuauugua

SEQ ID NO: 2260761 - RNA, 13 nt, Yersinia pestis
cuuucaucgaaaa

SEQ ID NO: 2260762 - RNA, 19 nt, Yersinia pestis
cuuucaucgaaaaaaauac

SEQ ID NO: 2260763 - RNA, 17 nt, Yersinia pestis
cuuucaucgauugcugg

SEQ ID NO: 2260764 - RNA, 22 nt, Yersinia pestis
cuuuccccauuuuuuuauaauc

SEQ ID NO: 2260765 - RNA, 15 nt, Yersinia pestis
cuuucuauaucacuu

SEQ ID NO: 2260766 - RNA, 16 nt, Yersinia pestis
cuuucucgauacaauu

SEQ ID NO: 2260767 - RNA, 16 nt, Yersinia pestis
cuuucucauuagcguc

SEQ ID NO: 2260768 - RNA, 18 nt, Yersinia pestis
cuuucucuccuuauacua

SEQ ID NO: 2260769 - RNA, 13 nt, Yersinia pestis
cuuuccugacccg

SEQ ID NO: 2260770 - RNA, 14 nt, Yersinia pestis
cuuucgacacauuu

SEQ ID NO: 2260771 - RNA, 20 nt, Yersinia pestis
cuuucgaguuuauauugcca

SEQ ID NO: 2260772 - RNA, 17 nt, Yersinia pestis
cuuucgauaagcugaca

SEQ ID NO: 2260773 - RNA, 14 nt, Yersinia pestis
cuuucgcccacaac

SEQ ID NO: 2260774 - RNA, 14 nt, Yersinia pestis
cuuuaauaaaauca

SEQ ID NO: 2260775 - RNA, 20 nt, Yersinia pestis
cuuuaauagccaaaauaauu

SEQ ID NO: 2260776 - RNA, 18 nt, Yersinia pestis
cuuuaaaaaaauuaucau

SEQ ID NO: 2260777 - RNA, 22 nt, Yersinia pestis
cuuuaaauacccagcuucuuuu

SEQ ID NO: 2260778 - RNA, 16 nt, Yersinia pestis
cuuuaaagccaaauug

SEQ ID NO: 2260779 - RNA, 23 nt, Yersinia pestis
cuuguuugcgccguaaacugccg

SEQ ID NO: 2260780 - RNA, 22 nt, Yersinia pestis
cuuguugugauguuuuugacca

SEQ ID NO: 2260781 - RNA, 16 nt, Yersinia pestis
cuuguuggucaccacu

SEQ ID NO: 2260782 - RNA, 19 nt, Yersinia pestis
cuuguuucuggcacaagaa

SEQ ID NO: 2260783 - RNA, 19 nt, Yersinia pestis
cuuguuuaucggucacuuu

SEQ ID NO: 2260784 - RNA, 16 nt, Yersinia pestis
cuuguuaauuuaaaca

SEQ ID NO: 2260785 - RNA, 16 nt, Yersinia pestis
cuuguucacggcuuug

SEQ ID NO: 2260786 - RNA, 13 nt, Yersinia pestis
cuuguucaccaau

SEQ ID NO: 2260787 - RNA, 19 nt, Yersinia pestis
cuuguguugggcaguaacg

SEQ ID NO: 2260788 - RNA, 18 nt, Yersinia pestis
cuuguguaauuauauuua

SEQ ID NO: 2260789 - RNA, 20 nt, Yersinia pestis
cuugugagcgauauuuauca

SEQ ID NO: 2260790 - RNA, 17 nt, Yersinia pestis
cuugugcucacgucacc

SEQ ID NO: 2260791 - RNA, 15 nt, Yersinia pestis
cuuggaaaacagcaa

SEQ ID NO: 2260792 - RNA, 18 nt, Yersinia pestis
cuuggaacuuacucccuu

SEQ ID NO: 2260793 - RNA, 20 nt, Yersinia pestis
cuuggacagaaaacaaucug

SEQ ID NO: 2260794 - RNA, 17 nt, Yersinia pestis
cuuggacaucugcuuua

SEQ ID NO: 2260795 - RNA, 22 nt, Yersinia pestis
cuuaucuaucucaggcucagcg

SEQ ID NO: 2260796 - RNA, 13 nt, Yersinia pestis
cuuaucuaaaaaa

SEQ ID NO: 2260797 - RNA, 18 nt, Yersinia pestis
cuuauuaauuaaugaaau

SEQ ID NO: 2260798 - RNA, 15 nt, Yersinia pestis
cuucacauuuucucc

SEQ ID NO: 2260799 - RNA, 12 nt, Yersinia pestis
cuucaccaauac

SEQ ID NO: 2260800 - RNA, 23 nt, Yersinia pestis
cuucagcgauacguguaaaaccu

SEQ ID NO: 2260801 - RNA, 20 nt, Yersinia pestis
cuucagcccauggcugaaau

SEQ ID NO: 2260802 - RNA, 19 nt, Yersinia pestis
cuucagcccauggcugaaa

SEQ ID NO: 2260803 - RNA, 14 nt, Yersinia pestis
cuucagccaccaga

SEQ ID NO: 2260804 - RNA, 17 nt, Yersinia pestis
cuucacgcucuugcucu

SEQ ID NO: 2260805 - RNA, 16 nt, Yersinia pestis
cuucagagccauagau

SEQ ID NO: 2260806 - RNA, 14 nt, Yersinia pestis
cuucauccgcucca

SEQ ID NO: 2260807 - RNA, 18 nt, Yersinia pestis
cuucauggcuaaauccac

SEQ ID NO: 2260808 - RNA, 17 nt, Yersinia pestis
cuucaucagggaauuca

SEQ ID NO: 2260809 - RNA, 22 nt, Yersinia pestis
cuucaucagucacuaaaccauu

SEQ ID NO: 2260810 - RNA, 22 nt, Yersinia pestis
cuucauaagccagugcuauuca

SEQ ID NO: 2260811 - RNA, 17 nt, Yersinia pestis
cuucaguuuugcgggug

SEQ ID NO: 2260812 - RNA, 18 nt, Yersinia pestis
cuucaguggcuggaaagg

SEQ ID NO: 2260813 - RNA, 19 nt, Yersinia pestis
cuucaguuuauuuaagcug

SEQ ID NO: 2260814 - RNA, 18 nt, Yersinia pestis
cuucagucaguguuucua

SEQ ID NO: 2260815 - RNA, 14 nt, Yersinia pestis
cuucaggccaagcc

SEQ ID NO: 2260816 - RNA, 11 nt, Yersinia pestis
cuucaggccaa

SEQ ID NO: 2260817 - RNA, 19 nt, Yersinia pestis
cuucagcgguagagaucuc

SEQ ID NO: 2260818 - RNA, 20 nt, Yersinia pestis
cuucaggaauaaacagcagu

SEQ ID NO: 2260819 - RNA, 15 nt, Yersinia pestis
cuucaggaauaaaca

SEQ ID NO: 2260820 - RNA, 13 nt, Yersinia pestis
cuucgcaccacaa

SEQ ID NO: 2260821 - RNA, 19 nt, Yersinia pestis
cuucgauuuuauauugaua

SEQ ID NO: 2260822 - RNA, 16 nt, Yersinia pestis
cuuccggcguaccaca

SEQ ID NO: 2260823 - RNA, 18 nt, Yersinia pestis
cuucgccacuagucgccu

SEQ ID NO: 2260824 - RNA, 14 nt, Yersinia pestis
cuucgcaccgccgc

SEQ ID NO: 2260825 - RNA, 22 nt, Yersinia pestis
cuucgcaccgccgccauagaaa

SEQ ID NO: 2260826 - RNA, 16 nt, Yersinia pestis
cuucgccauuuccauc

SEQ ID NO: 2260827 - RNA, 22 nt, Yersinia pestis
cuucgccaggucaggaagagaa

SEQ ID NO: 2260828 - RNA, 19 nt, Yersinia pestis
cuucgccgucaaacucuuc

SEQ ID NO: 2260829 - RNA, 20 nt, Yersinia pestis
cuucgcgagucacauuuuua

SEQ ID NO: 2260830 - RNA, 22 nt, Yersinia pestis
cuucgccuuucaguucaacagu

SEQ ID NO: 2260831 - RNA, 15 nt, Yersinia pestis
cuucgcgaacacaau

SEQ ID NO: 2260832 - RNA, 16 nt, Yersinia pestis
cuuccaugacacauau

SEQ ID NO: 2260833 - RNA, 19 nt, Yersinia pestis
cuuccaugacacauauuuc

SEQ ID NO: 2260834 - RNA, 19 nt, Yersinia pestis
cuuccauuccguuauuaaa

SEQ ID NO: 2260835 - RNA, 23 nt, Yersinia pestis
cuuccgccgugcggacugccgcg

SEQ ID NO: 2260836 - RNA, 23 nt, Yersinia pestis
cuuccgccucuuuuuccacaccc

SEQ ID NO: 2260837 - RNA, 22 nt, Yersinia pestis
cuuccgccucuuuuuccacacc

SEQ ID NO: 2260838 - RNA, 14 nt, Yersinia pestis
cuuccgccagcaga

SEQ ID NO: 2260839 - RNA, 17 nt, Yersinia pestis
cuucauugccuucuauc

SEQ ID NO: 2260840 - RNA, 23 nt, Yersinia pestis
cuucauuggcuugguuguuucuu

SEQ ID NO: 2260841 - RNA, 14 nt, Yersinia pestis
cuucauuucaggua

SEQ ID NO: 2260842 - RNA, 14 nt, Yersinia pestis
cuucauguuuauca

SEQ ID NO: 2260843 - RNA, 20 nt, Yersinia pestis
cuucauuaaggagugccauc

SEQ ID NO: 2260844 - RNA, 13 nt, Yersinia pestis
cuucauuuuucuc

SEQ ID NO: 2260845 - RNA, 12 nt, Yersinia pestis
cuuccaguggcu

SEQ ID NO: 2260846 - RNA, 10 nt, Yersinia pestis
cuuccaucag

SEQ ID NO: 2260847 - RNA, 19 nt, Yersinia pestis
cuuccagugguuucccuuc

SEQ ID NO: 2260848 - RNA, 15 nt, Yersinia pestis
cuuauccacagcaug

SEQ ID NO: 2260849 - RNA, 19 nt, Yersinia pestis
cuuauccagcgccaucagc

SEQ ID NO: 2260850 - RNA, 18 nt, Yersinia pestis
cuuaucauaauccaacuc

SEQ ID NO: 2260851 - RNA, 19 nt, Yersinia pestis
cuuaucccuccaucaagcc

SEQ ID NO: 2260852 - RNA, 21 nt, Yersinia pestis
cuuauccccugagaaacaucc

SEQ ID NO: 2260853 - RNA, 18 nt, Yersinia pestis
cuuauccccugagaaaca

SEQ ID NO: 2260854 - RNA, 15 nt, Yersinia pestis
cuuauccguuaaccc

SEQ ID NO: 2260855 - RNA, 19 nt, Yersinia pestis
cuuaucgacaccaaucuuu

SEQ ID NO: 2260856 - RNA, 16 nt, Yersinia pestis
cuuauccugcaaccca

SEQ ID NO: 2260857 - RNA, 19 nt, Yersinia pestis
cuuagcacguuuuucagcu

SEQ ID NO: 2260858 - RNA, 18 nt, Yersinia pestis
cuuauaggcgcauaugaa

SEQ ID NO: 2260859 - RNA, 19 nt, Yersinia pestis
cuuauaggcgcauaugaaa

SEQ ID NO: 2260860 - RNA, 22 nt, Yersinia pestis
cuuauaggcgcauaugaaaaac

SEQ ID NO: 2260861 - RNA, 18 nt, Yersinia pestis
cuuacucccuuguugccu

SEQ ID NO: 2260862 - RNA, 14 nt, Yersinia pestis
cuuacuauuuuucu

SEQ ID NO: 2260863 - RNA, 18 nt, Yersinia pestis
cuuacuauuuuucucaau

SEQ ID NO: 2260864 - RNA, 16 nt, Yersinia pestis
cuuacugcaucaauaa

SEQ ID NO: 2260865 - RNA, 22 nt, Yersinia pestis
cuuagagucacgguaugugugu

SEQ ID NO: 2260866 - RNA, 16 nt, Yersinia pestis
cuuagcaauaccagcc

SEQ ID NO: 2260867 - RNA, 19 nt, Yersinia pestis
cuuaccuucaguuuauuua

SEQ ID NO: 2260868 - RNA, 18 nt, Yersinia pestis
cuuacaagaaugcagaua

SEQ ID NO: 2260869 - RNA, 16 nt, Yersinia pestis
cuuacaaagcauuuca

SEQ ID NO: 2260870 - RNA, 16 nt, Yersinia pestis
cuuaauuuaaauaaga

SEQ ID NO: 2260871 - RNA, 14 nt, Yersinia pestis
cuuaauuaacucuu

SEQ ID NO: 2260872 - RNA, 15 nt, Yersinia pestis
cuuaauuaacucuuc

SEQ ID NO: 2260873 - RNA, 19 nt, Yersinia pestis
cuuaaucauauuuuccugc

SEQ ID NO: 2260874 - RNA, 11 nt, Yersinia pestis
cuuaaauaaaa

SEQ ID NO: 2260875 - RNA, 22 nt, Yersinia pestis
cuuaaaguuauguuuuuccuuc

SEQ ID NO: 2260876 - RNA, 17 nt, Yersinia pestis
cugucugcuguugccac

SEQ ID NO: 2260877 - RNA, 16 nt, Yersinia pestis
cugucugacggggauu

SEQ ID NO: 2260878 - RNA, 22 nt, Yersinia pestis
cuguucugggggugauauuugu

SEQ ID NO: 2260879 - RNA, 16 nt, Yersinia pestis
cuguucucuguuucca

SEQ ID NO: 2260880 - RNA, 19 nt, Yersinia pestis
cuguucgggcugauuaaua

SEQ ID NO: 2260881 - RNA, 21 nt, Yersinia pestis
cuguucgggcugauuaauauc

SEQ ID NO: 2260882 - RNA, 21 nt, Yersinia pestis
cuguuguaguuagaugacauc

SEQ ID NO: 2260883 - RNA, 14 nt, Yersinia pestis
cuguuguucugggg

SEQ ID NO: 2260884 - RNA, 14 nt, Yersinia pestis
cuguuguugugaca

SEQ ID NO: 2260885 - RNA, 15 nt, Yersinia pestis
cuguuggcaauuuca

SEQ ID NO: 2260886 - RNA, 15 nt, Yersinia pestis
cuguuggcuccugag

SEQ ID NO: 2260887 - RNA, 19 nt, Yersinia pestis
cuguuguaacacuugacca

SEQ ID NO: 2260888 - RNA, 20 nt, Yersinia pestis
cuguuggugauauaaaucca

SEQ ID NO: 2260889 - RNA, 16 nt, Yersinia pestis
cuguugaugaguaaac

SEQ ID NO: 2260890 - RNA, 18 nt, Yersinia pestis
cuguugccggauuuuuua

SEQ ID NO: 2260891 - RNA, 18 nt, Yersinia pestis
cuguugcaugaaaucagu

SEQ ID NO: 2260892 - RNA, 23 nt, Yersinia pestis
cuguugagguacggcucuauuuc

SEQ ID NO: 2260893 - RNA, 11 nt, Yersinia pestis
cuguugccccc

SEQ ID NO: 2260894 - RNA, 20 nt, Yersinia pestis
cuguugcccccugcuccaaa

SEQ ID NO: 2260895 - RNA, 22 nt, Yersinia pestis
cuguuucaaauaaguauuucaa

SEQ ID NO: 2260896 - RNA, 14 nt, Yersinia pestis
cuguuuaguucacg

SEQ ID NO: 2260897 - RNA, 21 nt, Yersinia pestis
cuguuuaguucacgauggaaa

SEQ ID NO: 2260898 - RNA, 16 nt, Yersinia pestis
cuguuuucauuauuuu

SEQ ID NO: 2260899 - RNA, 18 nt, Yersinia pestis
cuguuuucauuauuuuca

SEQ ID NO: 2260900 - RNA, 17 nt, Yersinia pestis
cuguuuugguuuccgcu

SEQ ID NO: 2260901 - RNA, 22 nt, Yersinia pestis
cuguuuuaaaaaaaaagaaaau

SEQ ID NO: 2260902 - RNA, 18 nt, Yersinia pestis
cuguuuuuuaaagaaaaa

SEQ ID NO: 2260903 - RNA, 14 nt, Yersinia pestis
cuguuuuuuuuaaa

SEQ ID NO: 2260904 - RNA, 15 nt, Yersinia pestis
cuguuuuuuuuaaau

SEQ ID NO: 2260905 - RNA, 18 nt, Yersinia pestis
cuguuuuuuuuaaaugaa

SEQ ID NO: 2260906 - RNA, 16 nt, Yersinia pestis
cuuaaaccgugcggcu

SEQ ID NO: 2260907 - RNA, 19 nt, Yersinia pestis
gaauaucaucuuuuucugc

SEQ ID NO: 2260908 - RNA, 17 nt, Yersinia pestis
gaauaucaccauauuca

SEQ ID NO: 2260909 - RNA, 17 nt, Yersinia pestis
gaauaugucauuaccgc

SEQ ID NO: 2260910 - RNA, 15 nt, Yersinia pestis
gaauaugcuucauca

SEQ ID NO: 2260911 - RNA, 12 nt, Yersinia pestis
gaauauuauuca

SEQ ID NO: 2260912 - RNA, 19 nt, Yersinia pestis
gaauauuuacggugagaau

SEQ ID NO: 2260913 - RNA, 14 nt, Yersinia pestis
gaauauuuaaauua

SEQ ID NO: 2260914 - RNA, 20 nt, Yersinia pestis
gaauauuuaaauuacagaca

SEQ ID NO: 2260915 - RNA, 20 nt, Yersinia pestis
gaauagucacgcggcggcgu

SEQ ID NO: 2260916 - RNA, 23 nt, Yersinia pestis
gaauaguguguguauuuaaaaga

SEQ ID NO: 2260917 - RNA, 19 nt, Yersinia pestis
gaauauaaauuuaauaaaa

SEQ ID NO: 2260918 - RNA, 18 nt, Yersinia pestis
gaauagaaccggcugaca

SEQ ID NO: 2260919 - RNA, 14 nt, Yersinia pestis
gaauagagccucua

SEQ ID NO: 2260920 - RNA, 13 nt, Yersinia pestis
gaauagauaacac

SEQ ID NO: 2260921 - RNA, 15 nt, Yersinia pestis
gaauagauaacacga

SEQ ID NO: 2260922 - RNA, 24 nt, Yersinia pestis
gaauaacugagccgcauacauagc

SEQ ID NO: 2260923 - RNA, 16 nt, Yersinia pestis
gaauaaccuacuccaa

SEQ ID NO: 2260924 - RNA, 12 nt, Yersinia pestis
gaauaaaucaaa

SEQ ID NO: 2260925 - RNA, 17 nt, Yersinia pestis
gaauaacaaaagcccgu

SEQ ID NO: 2260926 - RNA, 13 nt, Yersinia pestis
gaauaaggcuuac

SEQ ID NO: 2260927 - RNA, 12 nt, Yersinia pestis
gaauaagauccc

SEQ ID NO: 2260928 - RNA, 23 nt, Yersinia pestis
gaauaauccccacggccagagcc

SEQ ID NO: 2260929 - RNA, 21 nt, Yersinia pestis
gaauaccggccugauuuacug

SEQ ID NO: 2260930 - RNA, 17 nt, Yersinia pestis
gaauaauuacagcuggg

SEQ ID NO: 2260931 - RNA, 14 nt, Yersinia pestis
gaauaccaagccaa

SEQ ID NO: 2260932 - RNA, 15 nt, Yersinia pestis
gaagugaacgaacac

SEQ ID NO: 2260933 - RNA, 19 nt, Yersinia pestis
gaagucgauaugagucagu

SEQ ID NO: 2260934 - RNA, 12 nt, Yersinia pestis
gaauaaaaauaa

SEQ ID NO: 2260935 - RNA, 13 nt, Yersinia pestis
gaauaaaaauaag

SEQ ID NO: 2260936 - RNA, 14 nt, Yersinia pestis
gaauaaaaaugaua

SEQ ID NO: 2260937 - RNA, 13 nt, Yersinia pestis
gaauaaaauccac

SEQ ID NO: 2260938 - RNA, 13 nt, Yersinia pestis
gaauaaacagcag

SEQ ID NO: 2260939 - RNA, 23 nt, Yersinia pestis
gaauaaaaccuugcgccaagucc

SEQ ID NO: 2260940 - RNA, 22 nt, Yersinia pestis
gaaguuauugacaggugguucu

SEQ ID NO: 2260941 - RNA, 17 nt, Yersinia pestis
gaaggcgguuaucugga

SEQ ID NO: 2260942 - RNA, 14 nt, Yersinia pestis
gaaggccugcugug

SEQ ID NO: 2260943 - RNA, 14 nt, Yersinia pestis
gaagggggcuuauu

SEQ ID NO: 2260944 - RNA, 19 nt, Yersinia pestis
gaaggguauugaagauacc

SEQ ID NO: 2260945 - RNA, 21 nt, Yersinia pestis
gaagggaguuacucagcaucc

SEQ ID NO: 2260946 - RNA, 12 nt, Yersinia pestis
gaagguaaugcg

SEQ ID NO: 2260947 - RNA, 20 nt, Yersinia pestis
gaaguauuaauauaauacuu

SEQ ID NO: 2260948 - RNA, 18 nt, Yersinia pestis
gaaguacaguaccugcua

SEQ ID NO: 2260949 - RNA, 21 nt, Yersinia pestis
gaaguaaagaaccccccacca

SEQ ID NO: 2260950 - RNA, 22 nt, Yersinia pestis
gaaucgccguagauuuaacccc

SEQ ID NO: 2260951 - RNA, 20 nt, Yersinia pestis
gaaugacgcggguuuugccg

SEQ ID NO: 2260952 - RNA, 16 nt, Yersinia pestis
gaaugaggcugagguu

SEQ ID NO: 2260953 - RNA, 15 nt, Yersinia pestis
gaaugauucauugag

SEQ ID NO: 2260954 - RNA, 22 nt, Yersinia pestis
gaaugaugguauuaaucaacag

SEQ ID NO: 2260955 - RNA, 12 nt, Yersinia pestis
gaaugaaauauc

SEQ ID NO: 2260956 - RNA, 21 nt, Yersinia pestis
gaaugaaguucaccagcuugg

SEQ ID NO: 2260957 - RNA, 20 nt, Yersinia pestis
gaaucauaaugguaccggca

SEQ ID NO: 2260958 - RNA, 19 nt, Yersinia pestis
gaaucagccccaagcuuag

SEQ ID NO: 2260959 - RNA, 12 nt, Yersinia pestis
gaaucaacucau

SEQ ID NO: 2260960 - RNA, 18 nt, Yersinia pestis
gaaucaccaacaccacca

SEQ ID NO: 2260961 - RNA, 20 nt, Yersinia pestis
gaaucagauacggcuccaga

SEQ ID NO: 2260962 - RNA, 21 nt, Yersinia pestis
gaaucacugucaaaaagcacc

SEQ ID NO: 2260963 - RNA, 17 nt, Yersinia pestis
gaaucccuaacgagaaa

SEQ ID NO: 2260964 - RNA, 15 nt, Yersinia pestis
gaauccggauccagc

SEQ ID NO: 2260965 - RNA, 12 nt, Yersinia pestis
gaauucaccaaa

SEQ ID NO: 2260966 - RNA, 20 nt, Yersinia pestis
gaauuauuugggguauauau

SEQ ID NO: 2260967 - RNA, 13 nt, Yersinia pestis
gaauuaucauauu

SEQ ID NO: 2260968 - RNA, 18 nt, Yersinia pestis
gaauuaucauauucauca

SEQ ID NO: 2260969 - RNA, 22 nt, Yersinia pestis
gaauugaugucaauuaaaaacg

SEQ ID NO: 2260970 - RNA, 19 nt, Yersinia pestis
gaauugucaucccaugcaa

SEQ ID NO: 2260971 - RNA, 19 nt, Yersinia pestis
gaauuuaugcaccaaauuc

SEQ ID NO: 2260972 - RNA, 23 nt, Yersinia pestis
gaauuuauccuguacauauauaa

SEQ ID NO: 2260973 - RNA, 14 nt, Yersinia pestis
gaauggauugaaac

SEQ ID NO: 2260974 - RNA, 13 nt, Yersinia pestis
gaauggaagauag

SEQ ID NO: 2260975 - RNA, 17 nt, Yersinia pestis
gaauggcaaagcacagu

SEQ ID NO: 2260976 - RNA, 17 nt, Yersinia pestis
gaauggcaacguauaau

SEQ ID NO: 2260977 - RNA, 21 nt, Yersinia pestis
gaaugcucuuuuuaugcaggg

SEQ ID NO: 2260978 - RNA, 22 nt, Yersinia pestis
gaaugcgccgcggcccugaggu

SEQ ID NO: 2260979 - RNA, 22 nt, Yersinia pestis
gaaugcguugccgaaagccaag

SEQ ID NO: 2260980 - RNA, 16 nt, Yersinia pestis
gaaugcaucgcaucag

SEQ ID NO: 2260981 - RNA, 13 nt, Yersinia pestis
gaaugauugacuu

SEQ ID NO: 2260982 - RNA, 14 nt, Yersinia pestis
gaauuaaaaacccu

SEQ ID NO: 2260983 - RNA, 21 nt, Yersinia pestis
gaauuaagaagccucaugaau

SEQ ID NO: 2260984 - RNA, 19 nt, Yersinia pestis
gaauggggggcaaccuggu

SEQ ID NO: 2260985 - RNA, 15 nt, Yersinia pestis
gaacucgccuucagg

SEQ ID NO: 2260986 - RNA, 14 nt, Yersinia pestis
gaacugauacccac

SEQ ID NO: 2260987 - RNA, 14 nt, Yersinia pestis
gaacuuacucccuu

SEQ ID NO: 2260988 - RNA, 21 nt, Yersinia pestis
gaacuagcgccgcaucaaagc

SEQ ID NO: 2260989 - RNA, 16 nt, Yersinia pestis
gaacgcgucacuggcc

SEQ ID NO: 2260990 - RNA, 23 nt, Yersinia pestis
gaacggauacccagcacaaugac

SEQ ID NO: 2260991 - RNA, 13 nt, Yersinia pestis
gaacggagaugau

SEQ ID NO: 2260992 - RNA, 21 nt, Yersinia pestis
gaacggacauuuuacucccug

SEQ ID NO: 2260993 - RNA, 22 nt, Yersinia pestis
gaacggacauuuuacucccuga

SEQ ID NO: 2260994 - RNA, 20 nt, Yersinia pestis
gaacgcuuguggaaauagaa

SEQ ID NO: 2260995 - RNA, 22 nt, Yersinia pestis
gaacgaagucgauaugagucag

SEQ ID NO: 2260996 - RNA, 23 nt, Yersinia pestis
gaaccuuggcauugucugcuggc

SEQ ID NO: 2260997 - RNA, 20 nt, Yersinia pestis
gaaccuguuacaucagagcu

SEQ ID NO: 2260998 - RNA, 22 nt, Yersinia pestis
gaaccuguuacaucagagcuca

SEQ ID NO: 2260999 - RNA, 23 nt, Yersinia pestis
gaaccugcauccccggcauccca

SEQ ID NO: 2261000 - RNA, 15 nt, Yersinia pestis
gaaccuccaaaugaa

SEQ ID NO: 2261001 - RNA, 20 nt, Yersinia pestis
gaacgcgccuacagaggccg

SEQ ID NO: 2261002 - RNA, 17 nt, Yersinia pestis
gaacgccucaaaaaccu

SEQ ID NO: 2261003 - RNA, 18 nt, Yersinia pestis
gaacgaggacuuccugcc

SEQ ID NO: 2261004 - RNA, 21 nt, Yersinia pestis
gaacgaguaaaaagauggccu

SEQ ID NO: 2261005 - RNA, 15 nt, Yersinia pestis
gaacgcacaaguaca

SEQ ID NO: 2261006 - RNA, 13 nt, Yersinia pestis
gaacgcacaaugg

SEQ ID NO: 2261007 - RNA, 19 nt, Yersinia pestis
gaacgccaaguaugcaggc

SEQ ID NO: 2261008 - RNA, 17 nt, Yersinia pestis
gaaccgaauaauauuaa

SEQ ID NO: 2261009 - RNA, 17 nt, Yersinia pestis
gaaccgcgcucugcugg

SEQ ID NO: 2261010 - RNA, 15 nt, Yersinia pestis
gaacccauucaucaa

SEQ ID NO: 2261011 - RNA, 19 nt, Yersinia pestis
gaaccaugagaaugcgaca

SEQ ID NO: 2261012 - RNA, 18 nt, Yersinia pestis
gaaccaauuuuucuguau

SEQ ID NO: 2261013 - RNA, 23 nt, Yersinia pestis
gaaccaccaagaacgccaaauga

SEQ ID NO: 2261014 - RNA, 24 nt, Yersinia pestis
gaaccauaaacaaguugaaccaua

SEQ ID NO: 2261015 - RNA, 19 nt, Yersinia pestis
gaagccgcagagaugaagg

SEQ ID NO: 2261016 - RNA, 14 nt, Yersinia pestis
gaagccagggucau

SEQ ID NO: 2261017 - RNA, 21 nt, Yersinia pestis
gaagccuacgagagaucguag

SEQ ID NO: 2261018 - RNA, 15 nt, Yersinia pestis
gaagcggccagguuc

SEQ ID NO: 2261019 - RNA, 14 nt, Yersinia pestis
gaagcgcgcccucc

SEQ ID NO: 2261020 - RNA, 18 nt, Yersinia pestis
gaagcgccgacacccagc

SEQ ID NO: 2261021 - RNA, 18 nt, Yersinia pestis
gaaggacuuggcguaacu

SEQ ID NO: 2261022 - RNA, 14 nt, Yersinia pestis
gaaggauugaccaa

SEQ ID NO: 2261023 - RNA, 20 nt, Yersinia pestis
gaagcugauaacgcacggcc

SEQ ID NO: 2261024 - RNA, 18 nt, Yersinia pestis
gaagcguauaagcagggg

SEQ ID NO: 2261025 - RNA, 23 nt, Yersinia pestis
gaagagcgccucacugaaacgcu

SEQ ID NO: 2261026 - RNA, 17 nt, Yersinia pestis
gaagaguaaagcguccg

SEQ ID NO: 2261027 - RNA, 22 nt, Yersinia pestis
gaagaguugauccgauaaacuu

SEQ ID NO: 2261028 - RNA, 20 nt, Yersinia pestis
gaagauagauuucacugccg

SEQ ID NO: 2261029 - RNA, 22 nt, Yersinia pestis
gaagauuuaaauaacagcuaaa

SEQ ID NO: 2261030 - RNA, 15 nt, Yersinia pestis
gaagcacaaaaagag

SEQ ID NO: 2261031 - RNA, 19 nt, Yersinia pestis
gaagcaauuugaucaccaa

SEQ ID NO: 2261032 - RNA, 13 nt, Yersinia pestis
gaagcagcggggg

SEQ ID NO: 2261033 - RNA, 13 nt, Yersinia pestis
gaagaaacccagu

SEQ ID NO: 2261034 - RNA, 12 nt, Yersinia pestis
gaagaauugcag

SEQ ID NO: 2261035 - RNA, 15 nt, Yersinia pestis
gaagacaucgccaga

SEQ ID NO: 2261036 - RNA, 13 nt, Yersinia pestis
gaagacuuccagc

SEQ ID NO: 2261037 - RNA, 21 nt, Yersinia pestis
gaagacuuccagcaccacuaa

SEQ ID NO: 2261038 - RNA, 15 nt, Yersinia pestis
gaagagaaaagcaga

SEQ ID NO: 2261039 - RNA, 19 nt, Yersinia pestis
gaagacgaguaaugaaauc

SEQ ID NO: 2261040 - RNA, 15 nt, Yersinia pestis
gaaaucgaaauuaag

SEQ ID NO: 2261041 - RNA, 21 nt, Yersinia pestis
gaaaucuccuguggcacauca

SEQ ID NO: 2261042 - RNA, 13 nt, Yersinia pestis
gaaaucuauugua

SEQ ID NO: 2261043 - RNA, 12 nt, Yersinia pestis
gaaaucucacca

SEQ ID NO: 2261044 - RNA, 16 nt, Yersinia pestis
gaaaucuaaguucagc

SEQ ID NO: 2261045 - RNA, 12 nt, Yersinia pestis
gaaaucaucaca

SEQ ID NO: 2261046 - RNA, 20 nt, Yersinia pestis
gaaaucagccauaucaaaau

SEQ ID NO: 2261047 - RNA, 16 nt, Yersinia pestis
gaaaucagcuucauua

SEQ ID NO: 2261048 - RNA, 15 nt, Yersinia pestis
gaaaucagaucaaca

SEQ ID NO: 2261049 - RNA, 13 nt, Yersinia pestis
gaaaugaauauua

SEQ ID NO: 2261050 - RNA, 17 nt, Yersinia pestis
gaaaugaauauuaggua

SEQ ID NO: 2261051 - RNA, 17 nt, Yersinia pestis
gaaaugccgauaaaaac

SEQ ID NO: 2261052 - RNA, 19 nt, Yersinia pestis
gaaaugccgauaaaaacua

SEQ ID NO: 2261053 - RNA, 19 nt, Yersinia pestis
gaaauucuguagaguaaaa

SEQ ID NO: 2261054 - RNA, 17 nt, Yersinia pestis
gaaauucauaccuuaau

SEQ ID NO: 2261055 - RNA, 15 nt, Yersinia pestis
gaacaacagcauccg

SEQ ID NO: 2261056 - RNA, 19 nt, Yersinia pestis
gaaauugauaugauuucau

SEQ ID NO: 2261057 - RNA, 20 nt, Yersinia pestis
gaaauuuaagaaaucuauua

SEQ ID NO: 2261058 - RNA, 17 nt, Yersinia pestis
gaaauuuauuugcugca

SEQ ID NO: 2261059 - RNA, 21 nt, Yersinia pestis
gaaauuuauuugcugcacgca

SEQ ID NO: 2261060 - RNA, 16 nt, Yersinia pestis
gaacagcgccuccagu

SEQ ID NO: 2261061 - RNA, 22 nt, Yersinia pestis
gaacaggcagcaaauaaagccg

SEQ ID NO: 2261062 - RNA, 15 nt, Yersinia pestis
gaacauaaaaaugca

SEQ ID NO: 2261063 - RNA, 17 nt, Yersinia pestis
gaacagugccaacagcg

SEQ ID NO: 2261064 - RNA, 23 nt, Yersinia pestis
gaaccaacggcaaugaccaucaa

SEQ ID NO: 2261065 - RNA, 21 nt, Yersinia pestis
gaaccaaaauucacaacuugu

SEQ ID NO: 2261066 - RNA, 18 nt, Yersinia pestis
gaacauugcaguauuuug

SEQ ID NO: 2261067 - RNA, 17 nt, Yersinia pestis
gaacaucaaacccccac

SEQ ID NO: 2261068 - RNA, 19 nt, Yersinia pestis
gaacaucuggcgauuuugc

SEQ ID NO: 2261069 - RNA, 16 nt, Yersinia pestis
gaacaccaacaccaca

SEQ ID NO: 2261070 - RNA, 15 nt, Yersinia pestis
gaacaacgaaacaca

SEQ ID NO: 2261071 - RNA, 19 nt, Yersinia pestis
gaacaauaccgccaauauc

SEQ ID NO: 2261072 - RNA, 21 nt, Yersinia pestis
gaacacuuaauuccaugcaaa

SEQ ID NO: 2261073 - RNA, 23 nt, Yersinia pestis
gaacagagaacccuuguuuaucu

SEQ ID NO: 2261074 - RNA, 18 nt, Yersinia pestis
gaacacgcucgcguguca

SEQ ID NO: 2261075 - RNA, 21 nt, Yersinia pestis
gaacacgauaagcgggguuaa

SEQ ID NO: 2261076 - RNA, 14 nt, Yersinia pestis
gaacagauugcagg

SEQ ID NO: 2261077 - RNA, 15 nt, Yersinia pestis
gaacagcagaauaau

SEQ ID NO: 2261078 - RNA, 16 nt, Yersinia pestis
gaacagcagaauaauu

SEQ ID NO: 2261079 - RNA, 13 nt, Yersinia pestis
gaacagccuguac

SEQ ID NO: 2261080 - RNA, 23 nt, Yersinia pestis
gaaagguagaucggggacaggcu

SEQ ID NO: 2261081 - RNA, 17 nt, Yersinia pestis
gaaagguaugugccaaa

SEQ ID NO: 2261082 - RNA, 23 nt, Yersinia pestis
gaaagcuucaacuuccagugcca

SEQ ID NO: 2261083 - RNA, 17 nt, Yersinia pestis
gaaaggaacaaaagaga

SEQ ID NO: 2261084 - RNA, 21 nt, Yersinia pestis
gaaaggccggauguaaaacac

SEQ ID NO: 2261085 - RNA, 21 nt, Yersinia pestis
gaaagcgccugugggcggcuu

SEQ ID NO: 2261086 - RNA, 17 nt, Yersinia pestis
gaaagcguauuaucugc

SEQ ID NO: 2261087 - RNA, 19 nt, Yersinia pestis
gaaagcauggcagguauca

SEQ ID NO: 2261088 - RNA, 14 nt, Yersinia pestis
gaaauaccccucac

SEQ ID NO: 2261089 - RNA, 20 nt, Yersinia pestis
gaaauacaggcuauauugcu

SEQ ID NO: 2261090 - RNA, 12 nt, Yersinia pestis
gaaauagcacca

SEQ ID NO: 2261091 - RNA, 21 nt, Yersinia pestis
gaaauagcugcuucugaacca

SEQ ID NO: 2261092 - RNA, 13 nt, Yersinia pestis
gaaauagaaaacc

SEQ ID NO: 2261093 - RNA, 13 nt, Yersinia pestis
gaaauacuuauuu

SEQ ID NO: 2261094 - RNA, 16 nt, Yersinia pestis
gaaauaucaggaugaa

SEQ ID NO: 2261095 - RNA, 16 nt, Yersinia pestis
gaaauagucgcgcugu

SEQ ID NO: 2261096 - RNA, 15 nt, Yersinia pestis
gaaauauugugcucc

SEQ ID NO: 2261097 - RNA, 16 nt, Yersinia pestis
gaaauauugugcuccc

SEQ ID NO: 2261098 - RNA, 21 nt, Yersinia pestis
gaaaguugagcagcaauaacu

SEQ ID NO: 2261099 - RNA, 18 nt, Yersinia pestis
gaaauaaaaaccgcagca

SEQ ID NO: 2261100 - RNA, 17 nt, Yersinia pestis
gaaauaaauucaucuca

SEQ ID NO: 2261101 - RNA, 13 nt, Yersinia pestis
gaaauaaauaagu

SEQ ID NO: 2261102 - RNA, 18 nt, Yersinia pestis
gaaauaaauaaguucaga

SEQ ID NO: 2261103 - RNA, 19 nt, Yersinia pestis
gaaauaacuggugaugcuc

SEQ ID NO: 2261104 - RNA, 17 nt, Yersinia pestis
gaaauaacugccagggc

SEQ ID NO: 2261105 - RNA, 12 nt, Yersinia pestis
gaaauaaugguu

SEQ ID NO: 2261106 - RNA, 14 nt, Yersinia pestis
gaaacuaagagucc

SEQ ID NO: 2261107 - RNA, 19 nt, Yersinia pestis
gaaacuccagucacuggcc

SEQ ID NO: 2261108 - RNA, 16 nt, Yersinia pestis
gaaacugaucacuggc

SEQ ID NO: 2261109 - RNA, 21 nt, Yersinia pestis
gaaacugccgccaccauauca

SEQ ID NO: 2261110 - RNA, 23 nt, Yersinia pestis
gaaacuggagaucugcuguaggu

SEQ ID NO: 2261111 - RNA, 13 nt, Yersinia pestis
gaaagaaaaauag

SEQ ID NO: 2261112 - RNA, 15 nt, Yersinia pestis
gaaagaaaaauagac

SEQ ID NO: 2261113 - RNA, 14 nt, Yersinia pestis
gaaacuucaaaauc

SEQ ID NO: 2261114 - RNA, 15 nt, Yersinia pestis
gaaacuucaaaauca

SEQ ID NO: 2261115 - RNA, 15 nt, Yersinia pestis
gaaacuucauuucag

SEQ ID NO: 2261116 - RNA, 14 nt, Yersinia pestis
gaaagagccagcac

SEQ ID NO: 2261117 - RNA, 19 nt, Yersinia pestis
gaaagaaauaaaagaaaac

SEQ ID NO: 2261118 - RNA, 16 nt, Yersinia pestis
gaaagaaauaaaagaa

SEQ ID NO: 2261119 - RNA, 18 nt, Yersinia pestis
gaaacagcccagauggca

SEQ ID NO: 2261120 - RNA, 15 nt, Yersinia pestis
gaaacaucuucauuu

SEQ ID NO: 2261121 - RNA, 15 nt, Yersinia pestis
gaaaccaaaaccuuu

SEQ ID NO: 2261122 - RNA, 15 nt, Yersinia pestis
gaaaccagcggcagc

SEQ ID NO: 2261123 - RNA, 17 nt, Yersinia pestis
gaaacccacauaucucc

SEQ ID NO: 2261124 - RNA, 17 nt, Yersinia pestis
gaaacgauuacccacca

SEQ ID NO: 2261125 - RNA, 19 nt, Yersinia pestis
gaaacgccccgauaaacca

SEQ ID NO: 2261126 - RNA, 21 nt, Yersinia pestis
gaaaccgcugauaaccagcca

SEQ ID NO: 2261127 - RNA, 14 nt, Yersinia pestis
cuuuuuuauaauaa

SEQ ID NO: 2261128 - RNA, 17 nt, Yersinia pestis
cuuuuuuguugccacuc

SEQ ID NO: 2261129 - RNA, 10 nt, Yersinia pestis
cuuuuugcuu

SEQ ID NO: 2261130 - RNA, 17 nt, Yersinia pestis
cuuuuuggcaaacucag

SEQ ID NO: 2261131 - RNA, 16 nt, Yersinia pestis
cuuuuugugcuucaua

SEQ ID NO: 2261132 - RNA, 16 nt, Yersinia pestis
cuuuuuuaauaaaaaa

SEQ ID NO: 2261133 - RNA, 17 nt, Yersinia pestis
cuuuuuuaauaaaaaac

SEQ ID NO: 2261134 - RNA, 17 nt, Yersinia pestis
gaaaaacacuggcagcc

SEQ ID NO: 2261135 - RNA, 14 nt, Yersinia pestis
gaaaaaauaauguc

SEQ ID NO: 2261136 - RNA, 18 nt, Yersinia pestis
gaaaaaauaauggccaag

SEQ ID NO: 2261137 - RNA, 13 nt, Yersinia pestis
gaaaaaauaaugu

SEQ ID NO: 2261138 - RNA, 16 nt, Yersinia pestis
gaaaaaaucuuccuuu

SEQ ID NO: 2261139 - RNA, 22 nt, Yersinia pestis
gaaaaaauacgcuuucccccau

SEQ ID NO: 2261140 - RNA, 16 nt, Yersinia pestis
gaaaaaaauacuauca

SEQ ID NO: 2261141 - RNA, 15 nt, Yersinia pestis
gaaaaaaacagacua

SEQ ID NO: 2261142 - RNA, 17 nt, Yersinia pestis
gaaaacagccaccagcc

SEQ ID NO: 2261143 - RNA, 21 nt, Yersinia pestis
gaaaacagccaccagccaacu

SEQ ID NO: 2261144 - RNA, 14 nt, Yersinia pestis
gaaaacaagccagc

SEQ ID NO: 2261145 - RNA, 15 nt, Yersinia pestis
gaaaacaaguuucac

SEQ ID NO: 2261146 - RNA, 18 nt, Yersinia pestis
gaaaacccauaccacuga

SEQ ID NO: 2261147 - RNA, 18 nt, Yersinia pestis
gaaaaccuucagcaaaga

SEQ ID NO: 2261148 - RNA, 15 nt, Yersinia pestis
gaaaaauaacaggcu

SEQ ID NO: 2261149 - RNA, 18 nt, Yersinia pestis
gaaaaauaacaggcuggc

SEQ ID NO: 2261150 - RNA, 17 nt, Yersinia pestis
gaaaaaucacauacugg

SEQ ID NO: 2261151 - RNA, 14 nt, Yersinia pestis
gaaaaauguccauu

SEQ ID NO: 2261152 - RNA, 23 nt, Yersinia pestis
gaaaaaugagccgaccgucguaa

SEQ ID NO: 2261153 - RNA, 22 nt, Yersinia pestis
gaaaaagcaugguuggucucga

SEQ ID NO: 2261154 - RNA, 14 nt, Yersinia pestis
gaaaaugcggcggc

SEQ ID NO: 2261155 - RNA, 14 nt, Yersinia pestis
gaaaaucaugaaau

SEQ ID NO: 2261156 - RNA, 21 nt, Yersinia pestis
gaaaauauucuaaguaaaaca

SEQ ID NO: 2261157 - RNA, 20 nt, Yersinia pestis
gaaaaugguuagauuacagc

SEQ ID NO: 2261158 - RNA, 16 nt, Yersinia pestis
gaaaauguccauaaua

SEQ ID NO: 2261159 - RNA, 19 nt, Yersinia pestis
gaaaauuuacccugcuaca

SEQ ID NO: 2261160 - RNA, 19 nt, Yersinia pestis
gaaaauuucucuuuuauuc

SEQ ID NO: 2261161 - RNA, 20 nt, Yersinia pestis
gaaaauuucucuuuuauucu

SEQ ID NO: 2261162 - RNA, 11 nt, Yersinia pestis
gaaacaaauac

SEQ ID NO: 2261163 - RNA, 15 nt, Yersinia pestis
gaaacaaaaccaacc

SEQ ID NO: 2261164 - RNA, 20 nt, Yersinia pestis
gaaacaaaaccaaccccacg

SEQ ID NO: 2261165 - RNA, 14 nt, Yersinia pestis
gaaacaaaaccuaa

SEQ ID NO: 2261166 - RNA, 19 nt, Yersinia pestis
gaaacaccacgcccaauuc

SEQ ID NO: 2261167 - RNA, 13 nt, Yersinia pestis
gaaaagcaccgca

SEQ ID NO: 2261168 - RNA, 14 nt, Yersinia pestis
gaaaaggcagagag

SEQ ID NO: 2261169 - RNA, 17 nt, Yersinia pestis
gaaaacguuaacugcag

SEQ ID NO: 2261170 - RNA, 24 nt, Yersinia pestis
gaaaacguuaacugcaguaaaaau

SEQ ID NO: 2261171 - RNA, 11 nt, Yersinia pestis
gaaaauaauga

SEQ ID NO: 2261172 - RNA, 19 nt, Yersinia pestis
gaaaauaccgcgaucaaca

SEQ ID NO: 2261173 - RNA, 14 nt, Yersinia pestis
gaaaauagccaacc

SEQ ID NO: 2261174 - RNA, 19 nt, Yersinia pestis
gaaaaguggcuaucugaaa

SEQ ID NO: 2261175 - RNA, 17 nt, Yersinia pestis
gaaaagguuaacugcag

SEQ ID NO: 2261176 - RNA, 15 nt, Yersinia pestis
cuuuuugccaauaau

SEQ ID NO: 2261177 - RNA, 17 nt, Yersinia pestis
cuuuuugcccgcgcuuc

SEQ ID NO: 2261178 - RNA, 21 nt, Yersinia pestis
cuuuuugcaucgcuucugaac

SEQ ID NO: 2261179 - RNA, 15 nt, Yersinia pestis
cuuuuucuuuuuaac

SEQ ID NO: 2261180 - RNA, 15 nt, Yersinia pestis
cuuuuuccacacccu

SEQ ID NO: 2261181 - RNA, 20 nt, Yersinia pestis
cuuuuucacacgcccaggcc

SEQ ID NO: 2261182 - RNA, 19 nt, Yersinia pestis
cuuuuucagugaugagaau

SEQ ID NO: 2261183 - RNA, 14 nt, Yersinia pestis
cuuuuuacuuuuua

SEQ ID NO: 2261184 - RNA, 19 nt, Yersinia pestis
cuuuuuacgccuauccuca

SEQ ID NO: 2261185 - RNA, 13 nt, Yersinia pestis
cuuuuuaaauacc

SEQ ID NO: 2261186 - RNA, 19 nt, Yersinia pestis
cuuuuuauguaacaacuga

SEQ ID NO: 2261187 - RNA, 20 nt, Yersinia pestis
cuuuuucaaucacuucugcu

SEQ ID NO: 2261188 - RNA, 13 nt, Yersinia pestis
cuuuuuauuuaag

SEQ ID NO: 2261189 - RNA, 22 nt, Yersinia pestis
cuuuucuuuaugucuuuuucuu

SEQ ID NO: 2261190 - RNA, 13 nt, Yersinia pestis
cuuuucugccuau

SEQ ID NO: 2261191 - RNA, 17 nt, Yersinia pestis
cuuuugcauauuucucu

SEQ ID NO: 2261192 - RNA, 18 nt, Yersinia pestis
cuuuugcauauuucucuu

SEQ ID NO: 2261193 - RNA, 20 nt, Yersinia pestis
cuuuugcauauuucucuuug

SEQ ID NO: 2261194 - RNA, 15 nt, Yersinia pestis
cuuuuggcagcacca

SEQ ID NO: 2261195 - RNA, 22 nt, Yersinia pestis
cuuuugggucaggguaagcuga

SEQ ID NO: 2261196 - RNA, 17 nt, Yersinia pestis
cuuuugcugcacugcuc

SEQ ID NO: 2261197 - RNA, 19 nt, Yersinia pestis
cuuuucaguuuuaauuuau

SEQ ID NO: 2261198 - RNA, 20 nt, Yersinia pestis
cuuuucaucgcauaggccaa

SEQ ID NO: 2261199 - RNA, 13 nt, Yersinia pestis
cuuuuauuuuuac

SEQ ID NO: 2261200 - RNA, 18 nt, Yersinia pestis
cuuuuccgccaugagaac

SEQ ID NO: 2261201 - RNA, 20 nt, Yersinia pestis
cuuuuccgccaugagaacca

SEQ ID NO: 2261202 - RNA, 21 nt, Yersinia pestis
cuuuuauugucuuuaauaaaa

SEQ ID NO: 2261203 - RNA, 17 nt, Yersinia pestis
cuuuuaucaacuucaug

SEQ ID NO: 2261204 - RNA, 18 nt, Yersinia pestis
cuuuuagugaggggaacc

SEQ ID NO: 2261205 - RNA, 21 nt, Yersinia pestis
cuuuuacugguucauuuucca

SEQ ID NO: 2261206 - RNA, 17 nt, Yersinia pestis
cuuuguguugaacuuua

SEQ ID NO: 2261207 - RNA, 23 nt, Yersinia pestis
cuuugucaauaaccucagccuca

SEQ ID NO: 2261208 - RNA, 22 nt, Yersinia pestis
cuuucuuuucgcuauuucucuc

SEQ ID NO: 2261209 - RNA, 17 nt, Yersinia pestis
cuuuguuauccaucaac

SEQ ID NO: 2261210 - RNA, 22 nt, Yersinia pestis
cuuuuaaaacuucccgcacaau

SEQ ID NO: 2261211 - RNA, 22 nt, Yersinia pestis
cuuuuacaaauuugacauuucc

SEQ ID NO: 2261212 - RNA, 18 nt, Yersinia pestis
cuuuuaacguuagagcac

SEQ ID NO: 2261213 - RNA, 12 nt, Yersinia pestis
aaaaaaagacac

SEQ ID NO: 2261214 - RNA, 17 nt, Yersinia pestis
aaaaaaagaagaaaaau

SEQ ID NO: 2261215 - RNA, 14 nt, Yersinia pestis
aaaaaaaagaaaau

SEQ ID NO: 2261216 - RNA, 16 nt, Yersinia pestis
aaaaaagaaaauggcu

SEQ ID NO: 2261217 - RNA, 11 nt, Yersinia pestis
aaaaaaauaaa

SEQ ID NO: 2261218 - RNA, 13 nt, Yersinia pestis
aaaaaauuaucau

SEQ ID NO: 2261219 - RNA, 23 nt, Yersinia pestis
aaaaacaaaugauuauuuauuua

SEQ ID NO: 2261220 - RNA, 19 nt, Yersinia pestis
aaaaaagaguaaauaaaua

SEQ ID NO: 2261221 - RNA, 18 nt, Yersinia pestis
aaaaaacggugaacauuu

SEQ ID NO: 2261222 - RNA, 16 nt, Yersinia pestis
aaaaaacuaagggcga

SEQ ID NO: 2261223 - RNA, 21 nt, Yersinia pestis
aaaaaaugccagccccaauca

SEQ ID NO: 2261224 - RNA, 18 nt, Yersinia pestis
aaaaaauuaaaauaauga

SEQ ID NO: 2261225 - RNA, 13 nt, Yersinia pestis
aaaaaauuaaaau

SEQ ID NO: 2261226 - RNA, 16 nt, Yersinia pestis
aaaaaauuaaaauaau

SEQ ID NO: 2261227 - RNA, 13 nt, Yersinia pestis
aaaacaaaguagu

SEQ ID NO: 2261228 - RNA, 14 nt, Yersinia pestis
aaaacaaauaauua

SEQ ID NO: 2261229 - RNA, 17 nt, Yersinia pestis
aaaacaacccgaauuaa

SEQ ID NO: 2261230 - RNA, 23 nt, Yersinia pestis
aaaacaacccgaauuaauaaaac

SEQ ID NO: 2261231 - RNA, 21 nt, Yersinia pestis
aaaacaguuacuccuacacca

SEQ ID NO: 2261232 - RNA, 22 nt, Yersinia pestis
aaaacaguucggucuauaaaac

SEQ ID NO: 2261233 - RNA, 20 nt, Yersinia pestis
aaaacaggaucuuauuuaac

SEQ ID NO: 2261234 - RNA, 21 nt, Yersinia pestis
aaaacaggaucuuauuuaaca

SEQ ID NO: 2261235 - RNA, 22 nt, Yersinia pestis
aaaaccacugaccuauugauaa

SEQ ID NO: 2261236 - RNA, 12 nt, Yersinia pestis
aaaaccacugac

SEQ ID NO: 2261237 - RNA, 15 nt, Yersinia pestis
aaaaccacugaccua

SEQ ID NO: 2261238 - RNA, 21 nt, Yersinia pestis
aaaaccgccccccauccccaa

SEQ ID NO: 2261239 - RNA, 19 nt, Yersinia pestis
aaaaccgcagcagacaacu

SEQ ID NO: 2261240 - RNA, 21 nt, Yersinia pestis
aaaaccgcagcagacaacuga

SEQ ID NO: 2261241 - RNA, 18 nt, Yersinia pestis
aaaaccggagucaaucau

SEQ ID NO: 2261242 - RNA, 21 nt, Yersinia pestis
aaaaccggcguaaauaaaagc

SEQ ID NO: 2261243 - RNA, 18 nt, Yersinia pestis
aaaaccgugacuaaaaca

SEQ ID NO: 2261244 - RNA, 21 nt, Yersinia pestis
aaaaccuuuacaauuacacac

SEQ ID NO: 2261245 - RNA, 22 nt, Yersinia pestis
aaaaccuuuauguaguucaguc

SEQ ID NO: 2261246 - RNA, 18 nt, Yersinia pestis
aaaaccugcuugaaagca

SEQ ID NO: 2261247 - RNA, 20 nt, Yersinia pestis
aaaaccugcuugaaagcacc

SEQ ID NO: 2261248 - RNA, 14 nt, Yersinia pestis
aaaaccuccggcua

SEQ ID NO: 2261249 - RNA, 18 nt, Yersinia pestis
aaaaccuccggcuaugcc

SEQ ID NO: 2261250 - RNA, 20 nt, Yersinia pestis
aaaaaucuuguuaauuuaaa

SEQ ID NO: 2261251 - RNA, 17 nt, Yersinia pestis
aaaaauggaguuuuacu

SEQ ID NO: 2261252 - RNA, 14 nt, Yersinia pestis
aaaaaguguugacg

SEQ ID NO: 2261253 - RNA, 21 nt, Yersinia pestis
aaaaagugcuauccucuuaau

SEQ ID NO: 2261254 - RNA, 23 nt, Yersinia pestis
aaaaagugcuauccucuuaaugu

SEQ ID NO: 2261255 - RNA, 21 nt, Yersinia pestis
aaaaacguuacugcucgccca

SEQ ID NO: 2261256 - RNA, 17 nt, Yersinia pestis
aaaaacgccuccaguga

SEQ ID NO: 2261257 - RNA, 23 nt, Yersinia pestis
aaaaacucgcgccugaaaucauu

SEQ ID NO: 2261258 - RNA, 20 nt, Yersinia pestis
aaaaacugcggcaauaagca

SEQ ID NO: 2261259 - RNA, 17 nt, Yersinia pestis
aaaaacuuaucuaaaaa

SEQ ID NO: 2261260 - RNA, 20 nt, Yersinia pestis
aaaaacugugcaaauggcuu

SEQ ID NO: 2261261 - RNA, 17 nt, Yersinia pestis
aaaaacgcacgaaaaca

SEQ ID NO: 2261262 - RNA, 19 nt, Yersinia pestis
aaaaacgccaucaauaauu

SEQ ID NO: 2261263 - RNA, 14 nt, Yersinia pestis
aaaaacccucuuca

SEQ ID NO: 2261264 - RNA, 23 nt, Yersinia pestis
aaaaacccucuucaaucggauaa

SEQ ID NO: 2261265 - RNA, 12 nt, Yersinia pestis
aaaaaccgcagc

SEQ ID NO: 2261266 - RNA, 19 nt, Yersinia pestis
aaaaaccggcguaaauaaa

SEQ ID NO: 2261267 - RNA, 16 nt, Yersinia pestis
aaaaaccuccggcuau

SEQ ID NO: 2261268 - RNA, 12 nt, Yersinia pestis
aaaaaccuccgg

SEQ ID NO: 2261269 - RNA, 18 nt, Yersinia pestis
aaaaacacagguucucca

SEQ ID NO: 2261270 - RNA, 17 nt, Yersinia pestis
aaaaacgccaucaauaa

SEQ ID NO: 2261271 - RNA, 15 nt, Yersinia pestis
aaaaacgcaacacag

SEQ ID NO: 2261272 - RNA, 23 nt, Yersinia pestis
aaaaacggacgaccuguagcuuu

SEQ ID NO: 2261273 - RNA, 19 nt, Yersinia pestis
aaaaacccauuaaaaacaa

SEQ ID NO: 2261274 - RNA, 17 nt, Yersinia pestis
aaaaacugaaaaaggca

SEQ ID NO: 2261275 - RNA, 13 nt, Yersinia pestis
aaaaagccugaau

SEQ ID NO: 2261276 - RNA, 21 nt, Yersinia pestis
aaaaaggcaccagcgcacuga

SEQ ID NO: 2261277 - RNA, 22 nt, Yersinia pestis
aaaaaggauuuuauuaaaucac

SEQ ID NO: 2261278 - RNA, 21 nt, Yersinia pestis
aaaaagguggccauuacgcca

SEQ ID NO: 2261279 - RNA, 22 nt, Yersinia pestis
aaaaagaaugcgaagaaaaaca

SEQ ID NO: 2261280 - RNA, 18 nt, Yersinia pestis
aaaaagaauuaauaaaua

SEQ ID NO: 2261281 - RNA, 11 nt, Yersinia pestis
aaaaagaaaau

SEQ ID NO: 2261282 - RNA, 14 nt, Yersinia pestis
aaaaagaaaaaaac

SEQ ID NO: 2261283 - RNA, 14 nt, Yersinia pestis
aaaaacuuuuauug

SEQ ID NO: 2261284 - RNA, 13 nt, Yersinia pestis
aaaaagagucagu

SEQ ID NO: 2261285 - RNA, 14 nt, Yersinia pestis
aaaaagacacuaac

SEQ ID NO: 2261286 - RNA, 17 nt, Yersinia pestis
aaaaagcagcaaacgaa

SEQ ID NO: 2261287 - RNA, 16 nt, Yersinia pestis
aaaauacccaacaggu

SEQ ID NO: 2261288 - RNA, 13 nt, Yersinia pestis
aaaauacaaccaa

SEQ ID NO: 2261289 - RNA, 15 nt, Yersinia pestis
aaaauacaaccaaca

SEQ ID NO: 2261290 - RNA, 21 nt, Yersinia pestis
aaaauacaaccaacaaacaau

SEQ ID NO: 2261291 - RNA, 19 nt, Yersinia pestis
aaaauaugauaguguaaaa

SEQ ID NO: 2261292 - RNA, 14 nt, Yersinia pestis
aaaauaucuuucaa

SEQ ID NO: 2261293 - RNA, 17 nt, Yersinia pestis
aaaauaucgcgcuucag

SEQ ID NO: 2261294 - RNA, 13 nt, Yersinia pestis
aaaauauccagca

SEQ ID NO: 2261295 - RNA, 13 nt, Yersinia pestis
aaaauaugcccca

SEQ ID NO: 2261296 - RNA, 16 nt, Yersinia pestis
aaaauauccagcaacg

SEQ ID NO: 2261297 - RNA, 18 nt, Yersinia pestis
aaaaucaguuuacaugau

SEQ ID NO: 2261298 - RNA, 22 nt, Yersinia pestis
aaaaucaguaccgacaccaaua

SEQ ID NO: 2261299 - RNA, 15 nt, Yersinia pestis
aaaaucaaaaaugau

SEQ ID NO: 2261300 - RNA, 13 nt, Yersinia pestis
aaaaucaaaacag

SEQ ID NO: 2261301 - RNA, 18 nt, Yersinia pestis
aaaaucuuucuguucagc

SEQ ID NO: 2261302 - RNA, 16 nt, Yersinia pestis
aaaaucuuguuaauuu

SEQ ID NO: 2261303 - RNA, 13 nt, Yersinia pestis
aaaaugguuucag

SEQ ID NO: 2261304 - RNA, 22 nt, Yersinia pestis
aaaauggguauauuuaccaaaa

SEQ ID NO: 2261305 - RNA, 19 nt, Yersinia pestis
aaaauggcuuuuuuaauaa

SEQ ID NO: 2261306 - RNA, 18 nt, Yersinia pestis
aaaauggcuuuuuuaaua

SEQ ID NO: 2261307 - RNA, 22 nt, Yersinia pestis
aaaaugagcacggacagcagca

SEQ ID NO: 2261308 - RNA, 14 nt, Yersinia pestis
aaaaugagccugaa

SEQ ID NO: 2261309 - RNA, 13 nt, Yersinia pestis
aaaauuaaaauaa

SEQ ID NO: 2261310 - RNA, 12 nt, Yersinia pestis
aaaauuaacuua

SEQ ID NO: 2261311 - RNA, 14 nt, Yersinia pestis
aaaagguaaacaga

SEQ ID NO: 2261312 - RNA, 15 nt, Yersinia pestis
aaaagucagcaaauc

SEQ ID NO: 2261313 - RNA, 17 nt, Yersinia pestis
aaaagguuaacugcagu

SEQ ID NO: 2261314 - RNA, 17 nt, Yersinia pestis
aaaagucagcaaaucaa

SEQ ID NO: 2261315 - RNA, 14 nt, Yersinia pestis
aaaaggauggccca

SEQ ID NO: 2261316 - RNA, 15 nt, Yersinia pestis
aaaauaaauuuauuu

SEQ ID NO: 2261317 - RNA, 16 nt, Yersinia pestis
aaaagucuaucucggc

SEQ ID NO: 2261318 - RNA, 14 nt, Yersinia pestis
aaaaguuuuuugaa

SEQ ID NO: 2261319 - RNA, 19 nt, Yersinia pestis
aaaaguuuuuugaaauuag

SEQ ID NO: 2261320 - RNA, 21 nt, Yersinia pestis
aaaaguuucagcguggaauua

SEQ ID NO: 2261321 - RNA, 18 nt, Yersinia pestis
aaaaagaaauuuuuagaa

SEQ ID NO: 2261322 - RNA, 17 nt, Yersinia pestis
aaaaagaaaaaaacaga

SEQ ID NO: 2261323 - RNA, 19 nt, Yersinia pestis
aaaaacugugcaaauggcu

SEQ ID NO: 2261324 - RNA, 23 nt, Yersinia pestis
aaaagcgccuuuuauucuuuggu

SEQ ID NO: 2261325 - RNA, 18 nt, Yersinia pestis
aaaagcgccuuuuauucu

SEQ ID NO: 2261326 - RNA, 23 nt, Yersinia pestis
aaaacgauuagcuugugugcuua

SEQ ID NO: 2261327 - RNA, 16 nt, Yersinia pestis
aaaacgcacgaaaaca

SEQ ID NO: 2261328 - RNA, 21 nt, Yersinia pestis
aaaacgcccuugccauaaaug

SEQ ID NO: 2261329 - RNA, 17 nt, Yersinia pestis
aaacccaccugaaucuc

SEQ ID NO: 2261330 - RNA, 12 nt, Yersinia pestis
aaaccauuuuac

SEQ ID NO: 2261331 - RNA, 21 nt, Yersinia pestis
aaaccauggcucaccauaaau

SEQ ID NO: 2261332 - RNA, 23 nt, Yersinia pestis
aaaccauauuauuuacaaaccac

SEQ ID NO: 2261333 - RNA, 18 nt, Yersinia pestis
aaaccaucugaugcaggu

SEQ ID NO: 2261334 - RNA, 22 nt, Yersinia pestis
aaaccguacauuaaaugaauac

SEQ ID NO: 2261335 - RNA, 22 nt, Yersinia pestis
aaaccgggccuaauuuaacuuu

SEQ ID NO: 2261336 - RNA, 19 nt, Yersinia pestis
aaaccggcuaacgaggcau

SEQ ID NO: 2261337 - RNA, 16 nt, Yersinia pestis
aaaccgcagcagacaa

SEQ ID NO: 2261338 - RNA, 17 nt, Yersinia pestis
aaaccgccuucuggugg

SEQ ID NO: 2261339 - RNA, 16 nt, Yersinia pestis
aaaccgcuauaucauc

SEQ ID NO: 2261340 - RNA, 19 nt, Yersinia pestis
aaaccgcuggugacggcuu

SEQ ID NO: 2261341 - RNA, 14 nt, Yersinia pestis
aaaccggacauaau

SEQ ID NO: 2261342 - RNA, 22 nt, Yersinia pestis
aaacccucuguagagaaauuca

SEQ ID NO: 2261343 - RNA, 17 nt, Yersinia pestis
aaacaucaugacaaaaa

SEQ ID NO: 2261344 - RNA, 22 nt, Yersinia pestis
aaacauggcucucuuuuuucuc

SEQ ID NO: 2261345 - RNA, 20 nt, Yersinia pestis
aaacauuuauguaugauauu

SEQ ID NO: 2261346 - RNA, 23 nt, Yersinia pestis
aaacauuguuaccuaaccaaaca

SEQ ID NO: 2261347 - RNA, 17 nt, Yersinia pestis
aaaccaacugaaacugg

SEQ ID NO: 2261348 - RNA, 16 nt, Yersinia pestis
aaaccaagaagacuaa

SEQ ID NO: 2261349 - RNA, 21 nt, Yersinia pestis
aaaccaacaauauucgcagcc

SEQ ID NO: 2261350 - RNA, 22 nt, Yersinia pestis
aaacauuuucaucugaccaaac

SEQ ID NO: 2261351 - RNA, 15 nt, Yersinia pestis
aaaccacauuuuuua

SEQ ID NO: 2261352 - RNA, 18 nt, Yersinia pestis
aaaccaccaaaauagcgg

SEQ ID NO: 2261353 - RNA, 10 nt, Yersinia pestis
aaaccacuga

SEQ ID NO: 2261354 - RNA, 14 nt, Yersinia pestis
aaaccacugaccua

SEQ ID NO: 2261355 - RNA, 21 nt, Yersinia pestis
aaaccacugaccuauugauaa

SEQ ID NO: 2261356 - RNA, 12 nt, Yersinia pestis
aaaccacuuggc

SEQ ID NO: 2261357 - RNA, 19 nt, Yersinia pestis
aaacagauaacucagggcg

SEQ ID NO: 2261358 - RNA, 15 nt, Yersinia pestis
aaacagcaacaccau

SEQ ID NO: 2261359 - RNA, 22 nt, Yersinia pestis
aaacagcacgguaaacgcaucc

SEQ ID NO: 2261360 - RNA, 21 nt, Yersinia pestis
aaacagaacccccgcgaacag

SEQ ID NO: 2261361 - RNA, 20 nt, Yersinia pestis
aaacacuuaugaucuugaau

SEQ ID NO: 2261362 - RNA, 21 nt, Yersinia pestis
aaacacuuauuugaaauacuu

SEQ ID NO: 2261363 - RNA, 22 nt, Yersinia pestis
aaacagccaccagccaacuuuc

SEQ ID NO: 2261364 - RNA, 16 nt, Yersinia pestis
aaacagggcagaaaau

SEQ ID NO: 2261365 - RNA, 13 nt, Yersinia pestis
aaacaguagcagg

SEQ ID NO: 2261366 - RNA, 18 nt, Yersinia pestis
aaacaguuaaagguaaaa

SEQ ID NO: 2261367 - RNA, 22 nt, Yersinia pestis
aaacaguuacuccuacaccauu

SEQ ID NO: 2261368 - RNA, 15 nt, Yersinia pestis
aaacagugucacuuc

SEQ ID NO: 2261369 - RNA, 13 nt, Yersinia pestis
aaacauaaaaaau

SEQ ID NO: 2261370 - RNA, 16 nt, Yersinia pestis
aaacacaucacgcuua

SEQ ID NO: 2261371 - RNA, 13 nt, Yersinia pestis
aaacaauuucgaa

SEQ ID NO: 2261372 - RNA, 16 nt, Yersinia pestis
aaacacuuagccagca

SEQ ID NO: 2261373 - RNA, 15 nt, Yersinia pestis
aaacacgcauaugaa

SEQ ID NO: 2261374 - RNA, 23 nt, Yersinia pestis
aaacaauaaacagacuaaaaacc

SEQ ID NO: 2261375 - RNA, 19 nt, Yersinia pestis
aaacaaucugaugaauuaa

SEQ ID NO: 2261376 - RNA, 22 nt, Yersinia pestis
aaacaaugugccgcgcaaccau

SEQ ID NO: 2261377 - RNA, 17 nt, Yersinia pestis
aaaauugacgaaaguua

SEQ ID NO: 2261378 - RNA, 16 nt, Yersinia pestis
aaauuuuuuauauucc

SEQ ID NO: 2261379 - RNA, 17 nt, Yersinia pestis
aaauuuuuuauauucca

SEQ ID NO: 2261380 - RNA, 13 nt, Yersinia pestis
aaauuuuuauaua

SEQ ID NO: 2261381 - RNA, 20 nt, Yersinia pestis
aaauuuuuaccuucuacaaa

SEQ ID NO: 2261382 - RNA, 15 nt, Yersinia pestis
aacaaacacauggcu

SEQ ID NO: 2261383 - RNA, 23 nt, Yersinia pestis
aacaaaauagggcgccccgauaa

SEQ ID NO: 2261384 - RNA, 16 nt, Yersinia pestis
aacaaaauagggcgcc

SEQ ID NO: 2261385 - RNA, 20 nt, Yersinia pestis
aacaaaaugcgguggcacug

SEQ ID NO: 2261386 - RNA, 19 nt, Yersinia pestis
aacaaacagccgaucaacc

SEQ ID NO: 2261387 - RNA, 14 nt, Yersinia pestis
aacaaacacaucca

SEQ ID NO: 2261388 - RNA, 12 nt, Yersinia pestis
aacaaauaauua

SEQ ID NO: 2261389 - RNA, 16 nt, Yersinia pestis
aacaaaugaacccuuu

SEQ ID NO: 2261390 - RNA, 13 nt, Yersinia pestis
aacaaauucggcu

SEQ ID NO: 2261391 - RNA, 20 nt, Yersinia pestis
aacaaauguuuaauggcauu

SEQ ID NO: 2261392 - RNA, 12 nt, Yersinia pestis
aacaacagucaa

SEQ ID NO: 2261393 - RNA, 23 nt, Yersinia pestis
aacaacccauuuccccuuucugg

SEQ ID NO: 2261394 - RNA, 14 nt, Yersinia pestis
aacaagaacaccag

SEQ ID NO: 2261395 - RNA, 23 nt, Yersinia pestis
aacaagacugcuaauaccaccac

SEQ ID NO: 2261396 - RNA, 17 nt, Yersinia pestis
aacaagccccacaguac

SEQ ID NO: 2261397 - RNA, 21 nt, Yersinia pestis
aacaagcgaccaucaugaaua

SEQ ID NO: 2261398 - RNA, 16 nt, Yersinia pestis
aacaacuggugucaau

SEQ ID NO: 2261399 - RNA, 18 nt, Yersinia pestis
aacaaccuaaaaaaaaca

SEQ ID NO: 2261400 - RNA, 14 nt, Yersinia pestis
aacaacgaaacaca

SEQ ID NO: 2261401 - RNA, 19 nt, Yersinia pestis
aacaaccuaaaaaaaacaa

SEQ ID NO: 2261402 - RNA, 16 nt, Yersinia pestis
aacaacgucauuugug

SEQ ID NO: 2261403 - RNA, 16 nt, Yersinia pestis
aaauuuaauaaaaacc

SEQ ID NO: 2261404 - RNA, 11 nt, Yersinia pestis
aaauuuuauga

SEQ ID NO: 2261405 - RNA, 20 nt, Yersinia pestis
aaauuugcaguauucaggug

SEQ ID NO: 2261406 - RNA, 17 nt, Yersinia pestis
aaauuugacauuuccuu

SEQ ID NO: 2261407 - RNA, 21 nt, Yersinia pestis
aaauuucacugugcuuuucuu

SEQ ID NO: 2261408 - RNA, 11 nt, Yersinia pestis
aaauuucaaaa

SEQ ID NO: 2261409 - RNA, 14 nt, Yersinia pestis
aaauugagauauuu

SEQ ID NO: 2261410 - RNA, 23 nt, Yersinia pestis
aaauugacuuuaaaaaaauuauc

SEQ ID NO: 2261411 - RNA, 22 nt, Yersinia pestis
aaauucaaccucuuguaaacca

SEQ ID NO: 2261412 - RNA, 13 nt, Yersinia pestis
aaauucaaauauc

SEQ ID NO: 2261413 - RNA, 20 nt, Yersinia pestis
aaauucaucuuuaacaacaa

SEQ ID NO: 2261414 - RNA, 14 nt, Yersinia pestis
aaauucaucucacg

SEQ ID NO: 2261415 - RNA, 23 nt, Yersinia pestis
aaauugcacaugcagcauuucag

SEQ ID NO: 2261416 - RNA, 20 nt, Yersinia pestis
aaauugcgcccggcccacuu

SEQ ID NO: 2261417 - RNA, 17 nt, Yersinia pestis
aaauugcugaaaaaaaa

SEQ ID NO: 2261418 - RNA, 14 nt, Yersinia pestis
aaauugcugaaaaa

SEQ ID NO: 2261419 - RNA, 13 nt, Yersinia pestis
aaaucgaaauuaa

SEQ ID NO: 2261420 - RNA, 19 nt, Yersinia pestis
aaauccugaauaauacugu

SEQ ID NO: 2261421 - RNA, 15 nt, Yersinia pestis
aaaucggcggccaug

SEQ ID NO: 2261422 - RNA, 20 nt, Yersinia pestis
aaauccgugcugguccuuuu

SEQ ID NO: 2261423 - RNA, 20 nt, Yersinia pestis
aaauauggguuaaaaacuuu

SEQ ID NO: 2261424 - RNA, 22 nt, Yersinia pestis
aaauauggguuaaaaacuuuua

SEQ ID NO: 2261425 - RNA, 18 nt, Yersinia pestis
aaauauggguuaaaaacu

SEQ ID NO: 2261426 - RNA, 12 nt, Yersinia pestis
aaauauuaacau

SEQ ID NO: 2261427 - RNA, 23 nt, Yersinia pestis
aaauccaccagcgggcggcagau

SEQ ID NO: 2261428 - RNA, 16 nt, Yersinia pestis
aaauccaucaauaggu

SEQ ID NO: 2261429 - RNA, 15 nt, Yersinia pestis
aaaucccagcagcaa

SEQ ID NO: 2261430 - RNA, 17 nt, Yersinia pestis
aaaucccccaccaguaa

SEQ ID NO: 2261431 - RNA, 15 nt, Yersinia pestis
aaauccccauuccaa

SEQ ID NO: 2261432 - RNA, 20 nt, Yersinia pestis
aaaucccgcuugucgcccug

SEQ ID NO: 2261433 - RNA, 21 nt, Yersinia pestis
aaaucccggcauauuauuugu

SEQ ID NO: 2261434 - RNA, 13 nt, Yersinia pestis
aaaugacauucuu

SEQ ID NO: 2261435 - RNA, 21 nt, Yersinia pestis
aaaugaccaacuguaaaaucu

SEQ ID NO: 2261436 - RNA, 12 nt, Yersinia pestis
aaaugacacuuu

SEQ ID NO: 2261437 - RNA, 16 nt, Yersinia pestis
aaaucuuuguuacaua

SEQ ID NO: 2261438 - RNA, 21 nt, Yersinia pestis
aaaugacuaucccuucaauca

SEQ ID NO: 2261439 - RNA, 16 nt, Yersinia pestis
aaaugacuaucccuuc

SEQ ID NO: 2261440 - RNA, 12 nt, Yersinia pestis
aaaucugcggca

SEQ ID NO: 2261441 - RNA, 16 nt, Yersinia pestis
aaaucugcuccaucaa

SEQ ID NO: 2261442 - RNA, 20 nt, Yersinia pestis
aaaucuccuguggcacauca

SEQ ID NO: 2261443 - RNA, 22 nt, Yersinia pestis
aaaucuccuguggcacaucaau

SEQ ID NO: 2261444 - RNA, 15 nt, Yersinia pestis
aaaucugauacugaa

SEQ ID NO: 2261445 - RNA, 23 nt, Yersinia pestis
aaaucucuugauuaccaauaauu

SEQ ID NO: 2261446 - RNA, 19 nt, Yersinia pestis
aaaucguauaacauaauaa

SEQ ID NO: 2261447 - RNA, 16 nt, Yersinia pestis
aaaucguauuaucaau

SEQ ID NO: 2261448 - RNA, 22 nt, Yersinia pestis
aaaucguauuaucaauagggca

SEQ ID NO: 2261449 - RNA, 19 nt, Yersinia pestis
aaauggcuuuuuuaauaaa

SEQ ID NO: 2261450 - RNA, 18 nt, Yersinia pestis
aaaugggccacaggcugc

SEQ ID NO: 2261451 - RNA, 23 nt, Yersinia pestis
aaauggcuuuuuuaauaaaaaac

SEQ ID NO: 2261452 - RNA, 18 nt, Yersinia pestis
aaauggguauauuuacca

SEQ ID NO: 2261453 - RNA, 19 nt, Yersinia pestis
aaaugauaauaaaaaaacg

SEQ ID NO: 2261454 - RNA, 19 nt, Yersinia pestis
aaaugcaccgcccagauuc

SEQ ID NO: 2261455 - RNA, 14 nt, Yersinia pestis
aaaugucagcguuu

SEQ ID NO: 2261456 - RNA, 21 nt, Yersinia pestis
aaaugucgaaagauagcaaaa

SEQ ID NO: 2261457 - RNA, 13 nt, Yersinia pestis
aaauguauaaaaa

SEQ ID NO: 2261458 - RNA, 16 nt, Yersinia pestis
aaauguaagcuacuaa

SEQ ID NO: 2261459 - RNA, 16 nt, Yersinia pestis
aaauggucaguuuaau

SEQ ID NO: 2261460 - RNA, 15 nt, Yersinia pestis
aaauuaguuaauuua

SEQ ID NO: 2261461 - RNA, 14 nt, Yersinia pestis
aaauuauuuagaaa

SEQ ID NO: 2261462 - RNA, 16 nt, Yersinia pestis
aaauuauuuagaaacc

SEQ ID NO: 2261463 - RNA, 23 nt, Yersinia pestis
aaauuauuuagaaacccggauuc

SEQ ID NO: 2261464 - RNA, 21 nt, Yersinia pestis
aaauucaaaauagaggaaaua

SEQ ID NO: 2261465 - RNA, 23 nt, Yersinia pestis
aaauuauuuuagguccagauuuc

SEQ ID NO: 2261466 - RNA, 22 nt, Yersinia pestis
aaauuacucguauaaaaaauaa

SEQ ID NO: 2261467 - RNA, 23 nt, Yersinia pestis
aaauuacucguauaaaaaauaag

SEQ ID NO: 2261468 - RNA, 19 nt, Yersinia pestis
aaauuacucguauaaaaaa

SEQ ID NO: 2261469 - RNA, 23 nt, Yersinia pestis
aaauuagcagggcauucgccuga

SEQ ID NO: 2261470 - RNA, 14 nt, Yersinia pestis
aaauuaaucuugua

SEQ ID NO: 2261471 - RNA, 15 nt, Yersinia pestis
aaauuaauauuuaaa

SEQ ID NO: 2261472 - RNA, 12 nt, Yersinia pestis
aaauuaauaggu

SEQ ID NO: 2261473 - RNA, 15 nt, Yersinia pestis
aaaaagauaauaaaa

SEQ ID NO: 2261474 - RNA, 18 nt, Yersinia pestis
aaaaagauaauaaaacuc

SEQ ID NO: 2261475 - RNA, 12 nt, Yersinia pestis
aaaaagauggcu

SEQ ID NO: 2261476 - RNA, 13 nt, Yersinia pestis
aaauuaaaauaau

SEQ ID NO: 2261477 - RNA, 17 nt, Yersinia pestis
aaauuaaaauaaugagu

SEQ ID NO: 2261478 - RNA, 13 nt, Yersinia pestis
aaauuaaaacuga

SEQ ID NO: 2261479 - RNA, 15 nt, Yersinia pestis
aaauuaaaacugaaa

SEQ ID NO: 2261480 - RNA, 12 nt, Yersinia pestis
aaauuaaaaauu

SEQ ID NO: 2261481 - RNA, 13 nt, Yersinia pestis
aaaguagaaauaa

SEQ ID NO: 2261482 - RNA, 12 nt, Yersinia pestis
aaaguagccaau

SEQ ID NO: 2261483 - RNA, 13 nt, Yersinia pestis
aaagucuuaaucu

SEQ ID NO: 2261484 - RNA, 18 nt, Yersinia pestis
aaagugcuauccucuuaa

SEQ ID NO: 2261485 - RNA, 15 nt, Yersinia pestis
aaagugacgaaugag

SEQ ID NO: 2261486 - RNA, 22 nt, Yersinia pestis
aaagugcuauccucuuaauguc

SEQ ID NO: 2261487 - RNA, 23 nt, Yersinia pestis
aaaguggcauaaccaaucaucac

SEQ ID NO: 2261488 - RNA, 22 nt, Yersinia pestis
aaaguggugagcugaucugcca

SEQ ID NO: 2261489 - RNA, 19 nt, Yersinia pestis
aaauaaaguccagaggccg

SEQ ID NO: 2261490 - RNA, 11 nt, Yersinia pestis
aaauaaauaag

SEQ ID NO: 2261491 - RNA, 11 nt, Yersinia pestis
aaauaaaaaug

SEQ ID NO: 2261492 - RNA, 21 nt, Yersinia pestis
aaauaaacgggcuuccaucag

SEQ ID NO: 2261493 - RNA, 15 nt, Yersinia pestis
aaaguuuuuugaaau

SEQ ID NO: 2261494 - RNA, 21 nt, Yersinia pestis
aaaguugagcagcaauaacuc

SEQ ID NO: 2261495 - RNA, 20 nt, Yersinia pestis
aaaguuuauaugcuugacug

SEQ ID NO: 2261496 - RNA, 18 nt, Yersinia pestis
aaaguuauguuuuuccuu

SEQ ID NO: 2261497 - RNA, 16 nt, Yersinia pestis
aaaguucuucgaucaa

SEQ ID NO: 2261498 - RNA, 14 nt, Yersinia pestis
aaaguuaucaccaa

SEQ ID NO: 2261499 - RNA, 16 nt, Yersinia pestis
aaauacauaucaacac

SEQ ID NO: 2261500 - RNA, 23 nt, Yersinia pestis
aaauacaggggcguuauugagaa

SEQ ID NO: 2261501 - RNA, 13 nt, Yersinia pestis
aaauacaaccaac

SEQ ID NO: 2261502 - RNA, 15 nt, Yersinia pestis
aaauacaaccaacaa

SEQ ID NO: 2261503 - RNA, 14 nt, Yersinia pestis
aaauaauggccaag

SEQ ID NO: 2261504 - RNA, 23 nt, Yersinia pestis
aaauaauuuguauucucaucauc

SEQ ID NO: 2261505 - RNA, 15 nt, Yersinia pestis
aaauaaugguuucca

SEQ ID NO: 2261506 - RNA, 22 nt, Yersinia pestis
aaauacgaucaacucaacuuua

SEQ ID NO: 2261507 - RNA, 19 nt, Yersinia pestis
aaauaccggauuguucagc

SEQ ID NO: 2261508 - RNA, 20 nt, Yersinia pestis
aaauacauccauguaggcuc

SEQ ID NO: 2261509 - RNA, 18 nt, Yersinia pestis
aaauacccagcuucuuuu

SEQ ID NO: 2261510 - RNA, 22 nt, Yersinia pestis
aaauacccagcuucuuuuaaag

SEQ ID NO: 2261511 - RNA, 20 nt, Yersinia pestis
aaauaccgcgaucaacaaga

SEQ ID NO: 2261512 - RNA, 16 nt, Yersinia pestis
aaauauggcggcauca

SEQ ID NO: 2261513 - RNA, 20 nt, Yersinia pestis
aaauaucuuucagcaccaua

SEQ ID NO: 2261514 - RNA, 16 nt, Yersinia pestis
aaauauccugcucagc

SEQ ID NO: 2261515 - RNA, 20 nt, Yersinia pestis
aaauauccugcucagcuaaa

SEQ ID NO: 2261516 - RNA, 19 nt, Yersinia pestis
aaauaucauccccuuucug

SEQ ID NO: 2261517 - RNA, 15 nt, Yersinia pestis
aaauaucauuaacaa

SEQ ID NO: 2261518 - RNA, 13 nt, Yersinia pestis
aaauaucacuuuu

SEQ ID NO: 2261519 - RNA, 15 nt, Yersinia pestis
aaauauaaccaaagu

SEQ ID NO: 2261520 - RNA, 16 nt, Yersinia pestis
aaauagacucaacaaa

SEQ ID NO: 2261521 - RNA, 20 nt, Yersinia pestis
aaauagauagcaaucaauaa

SEQ ID NO: 2261522 - RNA, 17 nt, Yersinia pestis
aaauagaggaaauaaau

SEQ ID NO: 2261523 - RNA, 20 nt, Yersinia pestis
aaagaaugcgaagaaaaaca

SEQ ID NO: 2261524 - RNA, 12 nt, Yersinia pestis
aaagaagaauaa

SEQ ID NO: 2261525 - RNA, 20 nt, Yersinia pestis
aaagaagacgaguaaugaaa

SEQ ID NO: 2261526 - RNA, 21 nt, Yersinia pestis
aaagaagacgaguaaugaaau

SEQ ID NO: 2261527 - RNA, 20 nt, Yersinia pestis
aaagaaccgguguaccgacc

SEQ ID NO: 2261528 - RNA, 14 nt, Yersinia pestis
aaagaaauuuuuag

SEQ ID NO: 2261529 - RNA, 17 nt, Yersinia pestis
aaagaaauaaaagaaaa

SEQ ID NO: 2261530 - RNA, 14 nt, Yersinia pestis
aaagaaauaaucau

SEQ ID NO: 2261531 - RNA, 15 nt, Yersinia pestis
aaagaaaauggcuuu

SEQ ID NO: 2261532 - RNA, 15 nt, Yersinia pestis
aaaccguuugccguu

SEQ ID NO: 2261533 - RNA, 17 nt, Yersinia pestis
aaaccuaacgccaaaau

SEQ ID NO: 2261534 - RNA, 21 nt, Yersinia pestis
aaaccgugauugguuuauccc

SEQ ID NO: 2261535 - RNA, 19 nt, Yersinia pestis
aaaccgugauugguuuauc

SEQ ID NO: 2261536 - RNA, 16 nt, Yersinia pestis
aaagaguaaauaaaua

SEQ ID NO: 2261537 - RNA, 13 nt, Yersinia pestis
aaagagugaaaua

SEQ ID NO: 2261538 - RNA, 19 nt, Yersinia pestis
aaagaggccagcuucccug

SEQ ID NO: 2261539 - RNA, 18 nt, Yersinia pestis
aaagacccaauacaccac

SEQ ID NO: 2261540 - RNA, 17 nt, Yersinia pestis
aaagcacagacaaacaa

SEQ ID NO: 2261541 - RNA, 18 nt, Yersinia pestis
aaagcacagacaaacaac

SEQ ID NO: 2261542 - RNA, 16 nt, Yersinia pestis
aaagcacagacaaaca

SEQ ID NO: 2261543 - RNA, 12 nt, Yersinia pestis
aaagauuaagac

SEQ ID NO: 2261544 - RNA, 16 nt, Yersinia pestis
aaagauuaagacuuuc

SEQ ID NO: 2261545 - RNA, 18 nt, Yersinia pestis
aaagauuauguagauccc

SEQ ID NO: 2261546 - RNA, 16 nt, Yersinia pestis
aaagauucauaaaaaa

SEQ ID NO: 2261547 - RNA, 20 nt, Yersinia pestis
aaagauucauaaaaaaagaa

SEQ ID NO: 2261548 - RNA, 21 nt, Yersinia pestis
aaagcuuccaauauugagcag

SEQ ID NO: 2261549 - RNA, 20 nt, Yersinia pestis
aaagcugaucgcuaaaaagc

SEQ ID NO: 2261550 - RNA, 18 nt, Yersinia pestis
aaaggauuugaagacaac

SEQ ID NO: 2261551 - RNA, 19 nt, Yersinia pestis
aaaggauuuuauuaaauca

SEQ ID NO: 2261552 - RNA, 23 nt, Yersinia pestis
aaaggauuugaagacaacucuuc

SEQ ID NO: 2261553 - RNA, 21 nt, Yersinia pestis
aaaggauggcccaagccaucc

SEQ ID NO: 2261554 - RNA, 20 nt, Yersinia pestis
aaaguaacuugccguaaaau

SEQ ID NO: 2261555 - RNA, 20 nt, Yersinia pestis
aaagguaugugccaaaaaaa

SEQ ID NO: 2261556 - RNA, 21 nt, Yersinia pestis
aaagguaugugccaaaaaaag

SEQ ID NO: 2261557 - RNA, 11 nt, Yersinia pestis
aaagguaaaca

SEQ ID NO: 2261558 - RNA, 16 nt, Yersinia pestis
aaaggcuauuuaaauu

SEQ ID NO: 2261559 - RNA, 12 nt, Yersinia pestis
aaagcagugcug

SEQ ID NO: 2261560 - RNA, 14 nt, Yersinia pestis
aaagcagugcugaa

SEQ ID NO: 2261561 - RNA, 20 nt, Yersinia pestis
aaagcaggccuucuaacucu

SEQ ID NO: 2261562 - RNA, 19 nt, Yersinia pestis
aaagcaucaaucaucugcu

SEQ ID NO: 2261563 - RNA, 17 nt, Yersinia pestis
aaagccugaauucugua

SEQ ID NO: 2261564 - RNA, 19 nt, Yersinia pestis
aaagccugaauucuguaga

SEQ ID NO: 2261565 - RNA, 18 nt, Yersinia pestis
aaagccuuucagcgcugc

SEQ ID NO: 2261566 - RNA, 22 nt, Yersinia pestis
aaagcgcguaucguccagcagc

SEQ ID NO: 2261567 - RNA, 22 nt, Yersinia pestis
aaagcgcuggcgauaaucucgu

SEQ ID NO: 2261568 - RNA, 15 nt, Yersinia pestis
aaagcggaucguguu

SEQ ID NO: 2261569 - RNA, 22 nt, Yersinia pestis
aaagcggaucucuucagcaauu

SEQ ID NO: 2261570 - RNA, 18 nt, Yersinia pestis
aaagcgccuuccuuuuau

SEQ ID NO: 2261571 - RNA, 23 nt, Yersinia pestis
aaagcucuacacugauugaaguc

SEQ ID NO: 2261572 - RNA, 20 nt, Yersinia pestis
aaagcguccgcgccagggag

SEQ ID NO: 2261573 - RNA, 19 nt, Yersinia pestis
aaagcgggccagcaaccac

SEQ ID NO: 2261574 - RNA, 14 nt, Yersinia pestis
aaagcgguuaucac

SEQ ID NO: 2261575 - RNA, 22 nt, Yersinia pestis
aaagcguccgcgccaaggaagg

SEQ ID NO: 2261576 - RNA, 23 nt, Yersinia pestis
aaagcguccgcgccaaggcaagg

SEQ ID NO: 2261577 - RNA, 15 nt, Yersinia pestis
aaagcuauucaucug

SEQ ID NO: 2261578 - RNA, 22 nt, Yersinia pestis
aacagugucacuuccgccgcca

SEQ ID NO: 2261579 - RNA, 13 nt, Yersinia pestis
aacaguucaaaca

SEQ ID NO: 2261580 - RNA, 22 nt, Yersinia pestis
aacagugauucgcucgcauaaa

SEQ ID NO: 2261581 - RNA, 23 nt, Yersinia pestis
aacauaaagcuauuacugcucgg

SEQ ID NO: 2261582 - RNA, 16 nt, Yersinia pestis
aacauaaaaaugcacu

SEQ ID NO: 2261583 - RNA, 22 nt, Yersinia pestis
aacauaaaaaaugccagcccca

SEQ ID NO: 2261584 - RNA, 15 nt, Yersinia pestis
aacaguuguuucaau

SEQ ID NO: 2261585 - RNA, 19 nt, Yersinia pestis
aacaguuguuucaauaaau

SEQ ID NO: 2261586 - RNA, 23 nt, Yersinia pestis
aacauagcuauuggcugauucaa

SEQ ID NO: 2261587 - RNA, 17 nt, Yersinia pestis
aacauauaaaccagcca

SEQ ID NO: 2261588 - RNA, 20 nt, Yersinia pestis
aacauauaaaccagccagug

SEQ ID NO: 2261589 - RNA, 17 nt, Yersinia pestis
aacauaguugaauaacu

SEQ ID NO: 2261590 - RNA, 20 nt, Yersinia pestis
aacauaucaauaagugcaaa

SEQ ID NO: 2261591 - RNA, 23 nt, Yersinia pestis
aacaucaauguauuaauuugguu

SEQ ID NO: 2261592 - RNA, 22 nt, Yersinia pestis
aacaucgacaccaagacugaag

SEQ ID NO: 2261593 - RNA, 14 nt, Yersinia pestis
aacaucgcggaugc

SEQ ID NO: 2261594 - RNA, 14 nt, Yersinia pestis
aacaucgcccuuuu

SEQ ID NO: 2261595 - RNA, 15 nt, Yersinia pestis
aacagcuucgccacc

SEQ ID NO: 2261596 - RNA, 22 nt, Yersinia pestis
aacagcuucgccaccagauagu

SEQ ID NO: 2261597 - RNA, 14 nt, Yersinia pestis
aacagcuucgccac

SEQ ID NO: 2261598 - RNA, 13 nt, Yersinia pestis
aacagcucacucg

SEQ ID NO: 2261599 - RNA, 19 nt, Yersinia pestis
aacagcuaaucauugcaau

SEQ ID NO: 2261600 - RNA, 15 nt, Yersinia pestis
aacagcuaaaaugau

SEQ ID NO: 2261601 - RNA, 16 nt, Yersinia pestis
aacaaggcaaauagag

SEQ ID NO: 2261602 - RNA, 16 nt, Yersinia pestis
aacaagggguuucaga

SEQ ID NO: 2261603 - RNA, 18 nt, Yersinia pestis
aacagcgcucauagcaaa

SEQ ID NO: 2261604 - RNA, 18 nt, Yersinia pestis
aacaggcgaguuucccuu

SEQ ID NO: 2261605 - RNA, 16 nt, Yersinia pestis
aacagucauuaacaca

SEQ ID NO: 2261606 - RNA, 22 nt, Yersinia pestis
aacagguuggcgguacggucac

SEQ ID NO: 2261607 - RNA, 21 nt, Yersinia pestis
aacaguaauaccccacccaga

SEQ ID NO: 2261608 - RNA, 12 nt, Yersinia pestis
aacauuucauuc

SEQ ID NO: 2261609 - RNA, 18 nt, Yersinia pestis
aacaugggguaaucccga

SEQ ID NO: 2261610 - RNA, 15 nt, Yersinia pestis
aacauuuuuagcuuc

SEQ ID NO: 2261611 - RNA, 14 nt, Yersinia pestis
aacaugccauugau

SEQ ID NO: 2261612 - RNA, 21 nt, Yersinia pestis
aacaugcugaagccagcaccg

SEQ ID NO: 2261613 - RNA, 12 nt, Yersinia pestis
aacaugcugaag

SEQ ID NO: 2261614 - RNA, 17 nt, Yersinia pestis
aacaugcugaagccagc

SEQ ID NO: 2261615 - RNA, 19 nt, Yersinia pestis
aacaugcugaagccagcac

SEQ ID NO: 2261616 - RNA, 16 nt, Yersinia pestis
aacauggacggcauau

SEQ ID NO: 2261617 - RNA, 14 nt, Yersinia pestis
aacaucuaccucug

SEQ ID NO: 2261618 - RNA, 13 nt, Yersinia pestis
aaccaaacauugu

SEQ ID NO: 2261619 - RNA, 24 nt, Yersinia pestis
aaccaaaauauucgcauugugcuu

SEQ ID NO: 2261620 - RNA, 12 nt, Yersinia pestis
aaccaaaaccuu

SEQ ID NO: 2261621 - RNA, 12 nt, Yersinia pestis
aaccaaaagccc

SEQ ID NO: 2261622 - RNA, 14 nt, Yersinia pestis
aacauuuuuucuuu

SEQ ID NO: 2261623 - RNA, 20 nt, Yersinia pestis
aaccacauuccagaccggca

SEQ ID NO: 2261624 - RNA, 21 nt, Yersinia pestis
aaccacauuuuuuaaaaccaa

SEQ ID NO: 2261625 - RNA, 18 nt, Yersinia pestis
aaccaccuaauacagcac

SEQ ID NO: 2261626 - RNA, 20 nt, Yersinia pestis
aaccacccgacaucaagaaa

SEQ ID NO: 2261627 - RNA, 19 nt, Yersinia pestis
aacccauuugcacagcauu

SEQ ID NO: 2261628 - RNA, 21 nt, Yersinia pestis
aacccauuugcacagcauuua

SEQ ID NO: 2261629 - RNA, 22 nt, Yersinia pestis
aacccauuugcacagcauuuau

SEQ ID NO: 2261630 - RNA, 20 nt, Yersinia pestis
aaccaguucugguagcugcu

SEQ ID NO: 2261631 - RNA, 20 nt, Yersinia pestis
aaccauaaaauaaauaauuu

SEQ ID NO: 2261632 - RNA, 16 nt, Yersinia pestis
aacccccugcuaggca

SEQ ID NO: 2261633 - RNA, 22 nt, Yersinia pestis
aacccgauuaccguagauaauu

SEQ ID NO: 2261634 - RNA, 21 nt, Yersinia pestis
aaccagcguucuaucaaugcc

SEQ ID NO: 2261635 - RNA, 21 nt, Yersinia pestis
aaccaggucaguuuuacccuu

SEQ ID NO: 2261636 - RNA, 20 nt, Yersinia pestis
aaccaggccgccaucaucau

SEQ ID NO: 2261637 - RNA, 11 nt, Yersinia pestis
aaccagcaagc

SEQ ID NO: 2261638 - RNA, 17 nt, Yersinia pestis
aaccagauaacaacaaa

SEQ ID NO: 2261639 - RNA, 13 nt, Yersinia pestis
aaccagagucagu

SEQ ID NO: 2261640 - RNA, 14 nt, Yersinia pestis
aaccagagacagca

SEQ ID NO: 2261641 - RNA, 19 nt, Yersinia pestis
aaccagagacagcaacaaa

SEQ ID NO: 2261642 - RNA, 21 nt, Yersinia pestis
aaccagagcggagccucaguu

SEQ ID NO: 2261643 - RNA, 15 nt, Yersinia pestis
aaccuugaucaaaaa

SEQ ID NO: 2261644 - RNA, 19 nt, Yersinia pestis
aaccuucgccuuucaguuc

SEQ ID NO: 2261645 - RNA, 20 nt, Yersinia pestis
aaccuuuauguaguucaguc

SEQ ID NO: 2261646 - RNA, 18 nt, Yersinia pestis
aaccuuuauguaacacau

SEQ ID NO: 2261647 - RNA, 18 nt, Yersinia pestis
aacgaacacaguccuguu

SEQ ID NO: 2261648 - RNA, 18 nt, Yersinia pestis
aacgaaacuaacgcguga

SEQ ID NO: 2261649 - RNA, 16 nt, Yersinia pestis
aaccugcaauuuuuag

SEQ ID NO: 2261650 - RNA, 18 nt, Yersinia pestis
aaccucuucuuccgccac

SEQ ID NO: 2261651 - RNA, 18 nt, Yersinia pestis
aaccugacccgaucugug

SEQ ID NO: 2261652 - RNA, 21 nt, Yersinia pestis
aaccucgguggcucaauccaa

SEQ ID NO: 2261653 - RNA, 21 nt, Yersinia pestis
aaccuggcaccggacaaacca

SEQ ID NO: 2261654 - RNA, 15 nt, Yersinia pestis
aaccugugugaccuc

SEQ ID NO: 2261655 - RNA, 18 nt, Yersinia pestis
aaccugucgcagaaaaca

SEQ ID NO: 2261656 - RNA, 24 nt, Yersinia pestis
aaccuuauuuuugcauauaaaaca

SEQ ID NO: 2261657 - RNA, 22 nt, Yersinia pestis
aaccuguuacaucagagcucaa

SEQ ID NO: 2261658 - RNA, 13 nt, Yersinia pestis
aaccguucaguuu

SEQ ID NO: 2261659 - RNA, 17 nt, Yersinia pestis
aaccguuuuuucaacug

SEQ ID NO: 2261660 - RNA, 21 nt, Yersinia pestis
aaccgugcaccauacccuuug

SEQ ID NO: 2261661 - RNA, 20 nt, Yersinia pestis
aaccgguauugaccagauag

SEQ ID NO: 2261662 - RNA, 17 nt, Yersinia pestis
aacccgcuaacaugcca

SEQ ID NO: 2261663 - RNA, 17 nt, Yersinia pestis
aacccgcgggagucagu

SEQ ID NO: 2261664 - RNA, 22 nt, Yersinia pestis
aaccgggggcguauuaucggau

SEQ ID NO: 2261665 - RNA, 22 nt, Yersinia pestis
aaccgggguucgcaaugaaccc

SEQ ID NO: 2261666 - RNA, 17 nt, Yersinia pestis
aaccucaaaaggauggc

SEQ ID NO: 2261667 - RNA, 13 nt, Yersinia pestis
aaccucagccuca

SEQ ID NO: 2261668 - RNA, 14 nt, Yersinia pestis
aaccucagccucau

SEQ ID NO: 2261669 - RNA, 17 nt, Yersinia pestis
aaccucagccucauuca

SEQ ID NO: 2261670 - RNA, 19 nt, Yersinia pestis
aaccucacacgauuuuuac

SEQ ID NO: 2261671 - RNA, 17 nt, Yersinia pestis
aaccuauuaucccaguu

SEQ ID NO: 2261672 - RNA, 14 nt, Yersinia pestis
aaccuaccaccuac

SEQ ID NO: 2261673 - RNA, 19 nt, Yersinia pestis
aaccuaaucucuacauuua

SEQ ID NO: 2261674 - RNA, 12 nt, Yersinia pestis
aaccuaauacuu

SEQ ID NO: 2261675 - RNA, 17 nt, Yersinia pestis
aacgaauuucauuuuaa

SEQ ID NO: 2261676 - RNA, 21 nt, Yersinia pestis
aacgaacgcucuuuaacaauu

SEQ ID NO: 2261677 - RNA, 22 nt, Yersinia pestis
aacgaagucgauaugagucagu

SEQ ID NO: 2261678 - RNA, 15 nt, Yersinia pestis
aacgaaguuagaccc

SEQ ID NO: 2261679 - RNA, 18 nt, Yersinia pestis
aacgaauaauucagauaa

SEQ ID NO: 2261680 - RNA, 19 nt, Yersinia pestis
aacgaccaauuucaauaau

SEQ ID NO: 2261681 - RNA, 24 nt, Yersinia pestis
aacgacggccaaacguauugguaa

SEQ ID NO: 2261682 - RNA, 15 nt, Yersinia pestis
aacgaguuuccaguu

SEQ ID NO: 2261683 - RNA, 18 nt, Yersinia pestis
aacgaguuuccaguucaa

SEQ ID NO: 2261684 - RNA, 14 nt, Yersinia pestis
aacgcacugagagc

SEQ ID NO: 2261685 - RNA, 21 nt, Yersinia pestis
aacgcaggcacugcagaaaau

SEQ ID NO: 2261686 - RNA, 17 nt, Yersinia pestis
aacgccaaacaguaaau

SEQ ID NO: 2261687 - RNA, 12 nt, Yersinia pestis
aacgcuaagcgu

SEQ ID NO: 2261688 - RNA, 12 nt, Yersinia pestis
aacgcucccucc

SEQ ID NO: 2261689 - RNA, 23 nt, Yersinia pestis
aacgcuccgguuuucacccccac

SEQ ID NO: 2261690 - RNA, 17 nt, Yersinia pestis
aacggcacguuuccccu

SEQ ID NO: 2261691 - RNA, 16 nt, Yersinia pestis
aacggcacaucccaau

SEQ ID NO: 2261692 - RNA, 16 nt, Yersinia pestis
aacggcaaugaccauc

SEQ ID NO: 2261693 - RNA, 16 nt, Yersinia pestis
aacgccaacugcggca

SEQ ID NO: 2261694 - RNA, 15 nt, Yersinia pestis
aacgcgucacuggcc

SEQ ID NO: 2261695 - RNA, 22 nt, Yersinia pestis
aacugcauuucaauucguucaa

SEQ ID NO: 2261696 - RNA, 18 nt, Yersinia pestis
aacugaucguuugauuaa

SEQ ID NO: 2261697 - RNA, 21 nt, Yersinia pestis
aacugcgauaacguauugcug

SEQ ID NO: 2261698 - RNA, 22 nt, Yersinia pestis
aacugugccaaugccucuucaa

SEQ ID NO: 2261699 - RNA, 17 nt, Yersinia pestis
aacuguggcaugacuga

SEQ ID NO: 2261700 - RNA, 16 nt, Yersinia pestis
aacuguaaaaucuuuc

SEQ ID NO: 2261701 - RNA, 13 nt, Yersinia pestis
aacugcgaccaaa

SEQ ID NO: 2261702 - RNA, 14 nt, Yersinia pestis
aacuguaaggccaa

SEQ ID NO: 2261703 - RNA, 19 nt, Yersinia pestis
aacuguaaggccaaacccg

SEQ ID NO: 2261704 - RNA, 12 nt, Yersinia pestis
aacuucagagcc

SEQ ID NO: 2261705 - RNA, 17 nt, Yersinia pestis
aacuucaguuacucacu

SEQ ID NO: 2261706 - RNA, 13 nt, Yersinia pestis
aacuguucuuauu

SEQ ID NO: 2261707 - RNA, 20 nt, Yersinia pestis
aacuguucuuauugcuaucu

SEQ ID NO: 2261708 - RNA, 23 nt, Yersinia pestis
aacuguucuuauugcuaucuguu

SEQ ID NO: 2261709 - RNA, 16 nt, Yersinia pestis
aacuguguuuauacca

SEQ ID NO: 2261710 - RNA, 15 nt, Yersinia pestis
aacuuccuaacaaua

SEQ ID NO: 2261711 - RNA, 21 nt, Yersinia pestis
aacuuccuaacaauauuacca

SEQ ID NO: 2261712 - RNA, 16 nt, Yersinia pestis
aacuucccgcacaauu

SEQ ID NO: 2261713 - RNA, 22 nt, Yersinia pestis
aacuuccuuugcccuuacuauu

SEQ ID NO: 2261714 - RNA, 17 nt, Yersinia pestis
aacuucgaaagaaauaa

SEQ ID NO: 2261715 - RNA, 18 nt, Yersinia pestis
aacuucgaaagaaauaaa

SEQ ID NO: 2261716 - RNA, 18 nt, Yersinia pestis
aacuuucaucccuuuagc

SEQ ID NO: 2261717 - RNA, 14 nt, Yersinia pestis
aacuuuaucagucu

SEQ ID NO: 2261718 - RNA, 15 nt, Yersinia pestis
aacuuuaucagucug

SEQ ID NO: 2261719 - RNA, 14 nt, Yersinia pestis
aacuuguucauaua

SEQ ID NO: 2261720 - RNA, 19 nt, Yersinia pestis
aacuuuaauaugcaaaaaa

SEQ ID NO: 2261721 - RNA, 20 nt, Yersinia pestis
aacuuuuauugucuuuaaua

SEQ ID NO: 2261722 - RNA, 13 nt, Yersinia pestis
aacuuuggcaaag

SEQ ID NO: 2261723 - RNA, 20 nt, Yersinia pestis
aacuuuggguauaugacugu

SEQ ID NO: 2261724 - RNA, 22 nt, Yersinia pestis
aacuuugcuuugacuaauacug

SEQ ID NO: 2261725 - RNA, 13 nt, Yersinia pestis
aagaaaaucacuu

SEQ ID NO: 2261726 - RNA, 20 nt, Yersinia pestis
aacuuuuuguugcaccaacg

SEQ ID NO: 2261727 - RNA, 18 nt, Yersinia pestis
aacuuuuuucauccuaaa

SEQ ID NO: 2261728 - RNA, 21 nt, Yersinia pestis
aacuuuuuucuuaaggacccg

SEQ ID NO: 2261729 - RNA, 13 nt, Yersinia pestis
aacuuuuuucauc

SEQ ID NO: 2261730 - RNA, 19 nt, Yersinia pestis
aacucuacauugacuaauu

SEQ ID NO: 2261731 - RNA, 14 nt, Yersinia pestis
aacugacugaaguu

SEQ ID NO: 2261732 - RNA, 21 nt, Yersinia pestis
aacugacccaagguacuauug

SEQ ID NO: 2261733 - RNA, 19 nt, Yersinia pestis
aacugacacacaccaguga

SEQ ID NO: 2261734 - RNA, 15 nt, Yersinia pestis
aacucugaugaaauc

SEQ ID NO: 2261735 - RNA, 16 nt, Yersinia pestis
aacucuggcacuggca

SEQ ID NO: 2261736 - RNA, 17 nt, Yersinia pestis
aacucuggcacuggcaa

SEQ ID NO: 2261737 - RNA, 17 nt, Yersinia pestis
aacucgagcauuugacc

SEQ ID NO: 2261738 - RNA, 18 nt, Yersinia pestis
aacucgccuucagguaau

SEQ ID NO: 2261739 - RNA, 20 nt, Yersinia pestis
aacuccaggguaauaaguga

SEQ ID NO: 2261740 - RNA, 23 nt, Yersinia pestis
aacuccaggguaauaagugauca

SEQ ID NO: 2261741 - RNA, 20 nt, Yersinia pestis
aacuccaggucgaucgacuu

SEQ ID NO: 2261742 - RNA, 21 nt, Yersinia pestis
aacucccgauucagcucugcc

SEQ ID NO: 2261743 - RNA, 11 nt, Yersinia pestis
aacgggcuucc

SEQ ID NO: 2261744 - RNA, 12 nt, Yersinia pestis
aacuauuaacuc

SEQ ID NO: 2261745 - RNA, 12 nt, Yersinia pestis
aacgggcggcug

SEQ ID NO: 2261746 - RNA, 20 nt, Yersinia pestis
aacgggccgcauucaccacc

SEQ ID NO: 2261747 - RNA, 14 nt, Yersinia pestis
aacgggcaaccugu

SEQ ID NO: 2261748 - RNA, 21 nt, Yersinia pestis
aacucacgguuucuaaaaaau

SEQ ID NO: 2261749 - RNA, 16 nt, Yersinia pestis
aacucagccaucaguu

SEQ ID NO: 2261750 - RNA, 14 nt, Yersinia pestis
aacucacaaaauaa

SEQ ID NO: 2261751 - RNA, 21 nt, Yersinia pestis
aacucauuuaucuaaaacugc

SEQ ID NO: 2261752 - RNA, 12 nt, Yersinia pestis
aacucaucagcg

SEQ ID NO: 2261753 - RNA, 15 nt, Yersinia pestis
aagacuucagcccau

SEQ ID NO: 2261754 - RNA, 17 nt, Yersinia pestis
aagacuuuccacaacag

SEQ ID NO: 2261755 - RNA, 15 nt, Yersinia pestis
aagagaacggagaga

SEQ ID NO: 2261756 - RNA, 14 nt, Yersinia pestis
aagagaaaagcaga

SEQ ID NO: 2261757 - RNA, 15 nt, Yersinia pestis
aagagaaaagcagac

SEQ ID NO: 2261758 - RNA, 11 nt, Yersinia pestis
aagacugaagu

SEQ ID NO: 2261759 - RNA, 19 nt, Yersinia pestis
aagacgaguaaugaaaucu

SEQ ID NO: 2261760 - RNA, 21 nt, Yersinia pestis
aagacgccguaaauacaucca

SEQ ID NO: 2261761 - RNA, 17 nt, Yersinia pestis
aagaccuguugaucuuc

SEQ ID NO: 2261762 - RNA, 16 nt, Yersinia pestis
aagacgaguaaugaaa

SEQ ID NO: 2261763 - RNA, 16 nt, Yersinia pestis
aagacgaauagaaccg

SEQ ID NO: 2261764 - RNA, 21 nt, Yersinia pestis
aagaccgcuuuaucaaagaau

SEQ ID NO: 2261765 - RNA, 23 nt, Yersinia pestis
aagaccgcuuuaucaaagaauuc

SEQ ID NO: 2261766 - RNA, 20 nt, Yersinia pestis
aagaccugccaauuccuuag

SEQ ID NO: 2261767 - RNA, 16 nt, Yersinia pestis
aagacaacaaacagua

SEQ ID NO: 2261768 - RNA, 22 nt, Yersinia pestis
aagacaauaaaucgccacgcca

SEQ ID NO: 2261769 - RNA, 19 nt, Yersinia pestis
aagacaauagagucacaga

SEQ ID NO: 2261770 - RNA, 13 nt, Yersinia pestis
aagacauaucaca

SEQ ID NO: 2261771 - RNA, 20 nt, Yersinia pestis
aagacauaucacaguuaaaa

SEQ ID NO: 2261772 - RNA, 22 nt, Yersinia pestis
aagacauaucacaguuaaaaau

SEQ ID NO: 2261773 - RNA, 22 nt, Yersinia pestis
aagacauaaugccggcggccca

SEQ ID NO: 2261774 - RNA, 16 nt, Yersinia pestis
aagaauugcagauacc

SEQ ID NO: 2261775 - RNA, 14 nt, Yersinia pestis
aagaauugcgcagc

SEQ ID NO: 2261776 - RNA, 18 nt, Yersinia pestis
aagaauugagguaaacca

SEQ ID NO: 2261777 - RNA, 20 nt, Yersinia pestis
aagaaugcgaagaaaaacac

SEQ ID NO: 2261778 - RNA, 18 nt, Yersinia pestis
aagaaugccugccgcaau

SEQ ID NO: 2261779 - RNA, 19 nt, Yersinia pestis
aagaauccucugaauaaaa

SEQ ID NO: 2261780 - RNA, 11 nt, Yersinia pestis
aagaaauaaaa

SEQ ID NO: 2261781 - RNA, 13 nt, Yersinia pestis
aagaaauaaaaga

SEQ ID NO: 2261782 - RNA, 17 nt, Yersinia pestis
aagaaauaaaagaaaac

SEQ ID NO: 2261783 - RNA, 18 nt, Yersinia pestis
aagaaauaaaagaaaacc

SEQ ID NO: 2261784 - RNA, 18 nt, Yersinia pestis
aagauaaugaagauuuaa

SEQ ID NO: 2261785 - RNA, 15 nt, Yersinia pestis
aagaguccuuaaaaa

SEQ ID NO: 2261786 - RNA, 20 nt, Yersinia pestis
aagaguccuuaaaaacccau

SEQ ID NO: 2261787 - RNA, 16 nt, Yersinia pestis
aagagucgcaaaacuu

SEQ ID NO: 2261788 - RNA, 22 nt, Yersinia pestis
aagagucgcuuugggauucaau

SEQ ID NO: 2261789 - RNA, 22 nt, Yersinia pestis
aagaguccagcacugguagcau

SEQ ID NO: 2261790 - RNA, 13 nt, Yersinia pestis
aagaucaaaagca

SEQ ID NO: 2261791 - RNA, 22 nt, Yersinia pestis
aagauagacauauuguccaaca

SEQ ID NO: 2261792 - RNA, 16 nt, Yersinia pestis
aagauagccacuaacu

SEQ ID NO: 2261793 - RNA, 14 nt, Yersinia pestis
aagauagcugucag

SEQ ID NO: 2261794 - RNA, 14 nt, Yersinia pestis
aagauagcaaaaga

SEQ ID NO: 2261795 - RNA, 17 nt, Yersinia pestis
aagagaugaaauuuuau

SEQ ID NO: 2261796 - RNA, 11 nt, Yersinia pestis
aagagaugacc

SEQ ID NO: 2261797 - RNA, 22 nt, Yersinia pestis
aagagauguucgcagaaaagag

SEQ ID NO: 2261798 - RNA, 23 nt, Yersinia pestis
aagagauaaaucggcggccaugu

SEQ ID NO: 2261799 - RNA, 14 nt, Yersinia pestis
aagagacugggcug

SEQ ID NO: 2261800 - RNA, 20 nt, Yersinia pestis
aagagcccgcaacgggagag

SEQ ID NO: 2261801 - RNA, 14 nt, Yersinia pestis
aagagcgauugacu

SEQ ID NO: 2261802 - RNA, 15 nt, Yersinia pestis
aagagcgccucacug

SEQ ID NO: 2261803 - RNA, 23 nt, Yersinia pestis
aagagcgacucaauaauauggga

SEQ ID NO: 2261804 - RNA, 22 nt, Yersinia pestis
aagagcgauugacugaauguga

SEQ ID NO: 2261805 - RNA, 14 nt, Yersinia pestis
aagaggaaaugccg

SEQ ID NO: 2261806 - RNA, 16 nt, Yersinia pestis
aagaguacgaacagag

SEQ ID NO: 2261807 - RNA, 21 nt, Yersinia pestis
aagagguguucuugaaaaaau

SEQ ID NO: 2261808 - RNA, 16 nt, Yersinia pestis
aagaguaaauaaauau

SEQ ID NO: 2261809 - RNA, 17 nt, Yersinia pestis
aauaagaucccagagau

SEQ ID NO: 2261810 - RNA, 20 nt, Yersinia pestis
aauaacuucgcgaacacaau

SEQ ID NO: 2261811 - RNA, 19 nt, Yersinia pestis
aauaacuuauuacaccuua

SEQ ID NO: 2261812 - RNA, 23 nt, Yersinia pestis
aauaacuuauuacaccuuaaaac

SEQ ID NO: 2261813 - RNA, 17 nt, Yersinia pestis
aauaacccuugccaccu

SEQ ID NO: 2261814 - RNA, 20 nt, Yersinia pestis
aauaacugggauauucugga

SEQ ID NO: 2261815 - RNA, 23 nt, Yersinia pestis
aauaacugggccacgaugugaag

SEQ ID NO: 2261816 - RNA, 23 nt, Yersinia pestis
aauaacugccagggcguuuacca

SEQ ID NO: 2261817 - RNA, 22 nt, Yersinia pestis
aauaaccauuuauauaacagcc

SEQ ID NO: 2261818 - RNA, 19 nt, Yersinia pestis
aauaaaugucacuugcccu

SEQ ID NO: 2261819 - RNA, 16 nt, Yersinia pestis
aaguuuaaucaguucu

SEQ ID NO: 2261820 - RNA, 23 nt, Yersinia pestis
aaguugaugggaggaaacugccg

SEQ ID NO: 2261821 - RNA, 19 nt, Yersinia pestis
aaguugauaacgccggaua

SEQ ID NO: 2261822 - RNA, 15 nt, Yersinia pestis
aaguugauaaagcug

SEQ ID NO: 2261823 - RNA, 13 nt, Yersinia pestis
aauaagggccacc

SEQ ID NO: 2261824 - RNA, 17 nt, Yersinia pestis
aauaaggcuuaccgccu

SEQ ID NO: 2261825 - RNA, 18 nt, Yersinia pestis
aauaaggcgaauaugauu

SEQ ID NO: 2261826 - RNA, 21 nt, Yersinia pestis
aauaaggcgaauaugauuaau

SEQ ID NO: 2261827 - RNA, 21 nt, Yersinia pestis
aauaagucaaugcauuguaaa

SEQ ID NO: 2261828 - RNA, 22 nt, Yersinia pestis
aauaagucacuuuccuuugcuu

SEQ ID NO: 2261829 - RNA, 23 nt, Yersinia pestis
aauaaguaggcaucugccacacu

SEQ ID NO: 2261830 - RNA, 19 nt, Yersinia pestis
aauaagugcaaacuuaaaa

SEQ ID NO: 2261831 - RNA, 20 nt, Yersinia pestis
aauaagugcaaacuuaaaaa

SEQ ID NO: 2261832 - RNA, 17 nt, Yersinia pestis
aauaaguguuucaaaua

SEQ ID NO: 2261833 - RNA, 19 nt, Yersinia pestis
aauaaguguuucaaauaag

SEQ ID NO: 2261834 - RNA, 22 nt, Yersinia pestis
aauaaguucagguugaaauaaa

SEQ ID NO: 2261835 - RNA, 21 nt, Yersinia pestis
aauaaguuacgucagaaauaa

SEQ ID NO: 2261836 - RNA, 22 nt, Yersinia pestis
aauaaguuacgucagaaauaaa

SEQ ID NO: 2261837 - RNA, 17 nt, Yersinia pestis
aauaaguugaaccauaa

SEQ ID NO: 2261838 - RNA, 13 nt, Yersinia pestis
aauaauaaaaaaa

SEQ ID NO: 2261839 - RNA, 13 nt, Yersinia pestis
aauaauaacgaau

SEQ ID NO: 2261840 - RNA, 24 nt, Yersinia pestis
aauaauaacgguuuuaacaucauu

SEQ ID NO: 2261841 - RNA, 17 nt, Yersinia pestis
aaaaauaaguaacauuu

SEQ ID NO: 2261842 - RNA, 13 nt, Yersinia pestis
aaaaauaaauucu

SEQ ID NO: 2261843 - RNA, 21 nt, Yersinia pestis
aauaagccagauaucacucag

SEQ ID NO: 2261844 - RNA, 18 nt, Yersinia pestis
aauaagcuaucauuaaau

SEQ ID NO: 2261845 - RNA, 12 nt, Yersinia pestis
aauaagcguagg

SEQ ID NO: 2261846 - RNA, 21 nt, Yersinia pestis
aauaauguccccuugaguauc

SEQ ID NO: 2261847 - RNA, 13 nt, Yersinia pestis
aauaauuuuaugg

SEQ ID NO: 2261848 - RNA, 14 nt, Yersinia pestis
aauaauuuguaaau

SEQ ID NO: 2261849 - RNA, 22 nt, Yersinia pestis
aaaaaucuuguuaauuuaaaca

SEQ ID NO: 2261850 - RNA, 16 nt, Yersinia pestis
aaaaaucuuguuaauu

SEQ ID NO: 2261851 - RNA, 21 nt, Yersinia pestis
aauaaugaccacgcaucaaua

SEQ ID NO: 2261852 - RNA, 16 nt, Yersinia pestis
aauaaugaauuauuag

SEQ ID NO: 2261853 - RNA, 23 nt, Yersinia pestis
aaaaauagacagcaguuaaugcu

SEQ ID NO: 2261854 - RNA, 16 nt, Yersinia pestis
aauaauagauaguacu

SEQ ID NO: 2261855 - RNA, 18 nt, Yersinia pestis
aauacccaaaauuugcuu

SEQ ID NO: 2261856 - RNA, 20 nt, Yersinia pestis
aauaccauuucuuauaucug

SEQ ID NO: 2261857 - RNA, 13 nt, Yersinia pestis
aauaccauuuuag

SEQ ID NO: 2261858 - RNA, 19 nt, Yersinia pestis
aauaccauuuucagacuga

SEQ ID NO: 2261859 - RNA, 14 nt, Yersinia pestis
aauaccauauaccc

SEQ ID NO: 2261860 - RNA, 13 nt, Yersinia pestis
aauacagcaaaua

SEQ ID NO: 2261861 - RNA, 20 nt, Yersinia pestis
aauacauguacuagaucaca

SEQ ID NO: 2261862 - RNA, 20 nt, Yersinia pestis
aauacauugucgcacuugau

SEQ ID NO: 2261863 - RNA, 21 nt, Yersinia pestis
aauacacucguggugauuaau

SEQ ID NO: 2261864 - RNA, 16 nt, Yersinia pestis
aauaccaaaaaucucu

SEQ ID NO: 2261865 - RNA, 13 nt, Yersinia pestis
aauaccaaauuua

SEQ ID NO: 2261866 - RNA, 14 nt, Yersinia pestis
aauaccaaauuuac

SEQ ID NO: 2261867 - RNA, 13 nt, Yersinia pestis
aauaccacaacau

SEQ ID NO: 2261868 - RNA, 14 nt, Yersinia pestis
aauaccacaacauu

SEQ ID NO: 2261869 - RNA, 18 nt, Yersinia pestis
aauaccacuagcagagca

SEQ ID NO: 2261870 - RNA, 17 nt, Yersinia pestis
aauaccagaugcauaua

SEQ ID NO: 2261871 - RNA, 13 nt, Yersinia pestis
aauagcgcugcau

SEQ ID NO: 2261872 - RNA, 18 nt, Yersinia pestis
aauagcaccgagcaugcu

SEQ ID NO: 2261873 - RNA, 19 nt, Yersinia pestis
aauagcuggcggauaaaaa

SEQ ID NO: 2261874 - RNA, 22 nt, Yersinia pestis
aauagcugguagugauccccca

SEQ ID NO: 2261875 - RNA, 19 nt, Yersinia pestis
aauagcuaccccuucaguc

SEQ ID NO: 2261876 - RNA, 21 nt, Yersinia pestis
aauagcuaccccuucagucag

SEQ ID NO: 2261877 - RNA, 23 nt, Yersinia pestis
aauagcuaucuugccuguugaua

SEQ ID NO: 2261878 - RNA, 15 nt, Yersinia pestis
aauagaagguaauca

SEQ ID NO: 2261879 - RNA, 20 nt, Yersinia pestis
aauagaagguuaaauuuaau

SEQ ID NO: 2261880 - RNA, 21 nt, Yersinia pestis
aauaccuuacuguaucaauac

SEQ ID NO: 2261881 - RNA, 22 nt, Yersinia pestis
aauaccuaaaauuaucgcaauu

SEQ ID NO: 2261882 - RNA, 23 nt, Yersinia pestis
aauaccguuuucuuucaacugcu

SEQ ID NO: 2261883 - RNA, 18 nt, Yersinia pestis
aauagcaaacccaccuga

SEQ ID NO: 2261884 - RNA, 16 nt, Yersinia pestis
aauagcaaaacugagg

SEQ ID NO: 2261885 - RNA, 18 nt, Yersinia pestis
aauagaccguagaaacua

SEQ ID NO: 2261886 - RNA, 17 nt, Yersinia pestis
aauagacgaauggccgc

SEQ ID NO: 2261887 - RNA, 14 nt, Yersinia pestis
aauagauaguacuu

SEQ ID NO: 2261888 - RNA, 20 nt, Yersinia pestis
aauagauaucgaaacacaua

SEQ ID NO: 2261889 - RNA, 14 nt, Yersinia pestis
aauagauaguacgu

SEQ ID NO: 2261890 - RNA, 13 nt, Yersinia pestis
aauaguagaucua

SEQ ID NO: 2261891 - RNA, 16 nt, Yersinia pestis
aauagguaaauccaga

SEQ ID NO: 2261892 - RNA, 19 nt, Yersinia pestis
aauagguaaauccagauca

SEQ ID NO: 2261893 - RNA, 14 nt, Yersinia pestis
aauaggcugcgcau

SEQ ID NO: 2261894 - RNA, 19 nt, Yersinia pestis
aauagggcgccccgauaaa

SEQ ID NO: 2261895 - RNA, 14 nt, Yersinia pestis
aauaggucaguggu

SEQ ID NO: 2261896 - RNA, 14 nt, Yersinia pestis
aauaggcgucagca

SEQ ID NO: 2261897 - RNA, 16 nt, Yersinia pestis
aauaggauuuucauga

SEQ ID NO: 2261898 - RNA, 20 nt, Yersinia pestis
aauaguguguguauuuaaaa

SEQ ID NO: 2261899 - RNA, 23 nt, Yersinia pestis
aauaguguguguauuuaaaagau

SEQ ID NO: 2261900 - RNA, 16 nt, Yersinia pestis
aauagucauauauuuu

SEQ ID NO: 2261901 - RNA, 15 nt, Yersinia pestis
aauagucauauauuu

SEQ ID NO: 2261902 - RNA, 21 nt, Yersinia pestis
aauagucagugggcuauuuau

SEQ ID NO: 2261903 - RNA, 13 nt, Yersinia pestis
aauauaacaaugu

SEQ ID NO: 2261904 - RNA, 13 nt, Yersinia pestis
aauauaaauuuaa

SEQ ID NO: 2261905 - RNA, 14 nt, Yersinia pestis
aauauaaauuuaau

SEQ ID NO: 2261906 - RNA, 18 nt, Yersinia pestis
aauauaaauuuaauaaaa

SEQ ID NO: 2261907 - RNA, 20 nt, Yersinia pestis
aauauaaaagcacagacaaa

SEQ ID NO: 2261908 - RNA, 18 nt, Yersinia pestis
aauauaaaagcacagaca

SEQ ID NO: 2261909 - RNA, 21 nt, Yersinia pestis
aauauagcaaucauuuauaua

SEQ ID NO: 2261910 - RNA, 20 nt, Yersinia pestis
aauauacuguuaacucgcca

SEQ ID NO: 2261911 - RNA, 14 nt, Yersinia pestis
aauauaauuucaaa

SEQ ID NO: 2261912 - RNA, 17 nt, Yersinia pestis
aauauaauacuuaaguc

SEQ ID NO: 2261913 - RNA, 17 nt, Yersinia pestis
aauauauaaaauaaauu

SEQ ID NO: 2261914 - RNA, 14 nt, Yersinia pestis
aauauaguugaucu

SEQ ID NO: 2261915 - RNA, 14 nt, Yersinia pestis
aauaucaaaacuga

SEQ ID NO: 2261916 - RNA, 18 nt, Yersinia pestis
aauaucaaaacugauuaa

SEQ ID NO: 2261917 - RNA, 18 nt, Yersinia pestis
aauaucaagucuugaaga

SEQ ID NO: 2261918 - RNA, 17 nt, Yersinia pestis
aauauaugauaccaaac

SEQ ID NO: 2261919 - RNA, 22 nt, Yersinia pestis
aauaucugccaccgcacaguua

SEQ ID NO: 2261920 - RNA, 15 nt, Yersinia pestis
aauaucgguaaaaaa

SEQ ID NO: 2261921 - RNA, 18 nt, Yersinia pestis
aauaucgguaaaaaauca

SEQ ID NO: 2261922 - RNA, 16 nt, Yersinia pestis
aauaucaccauauuca

SEQ ID NO: 2261923 - RNA, 13 nt, Yersinia pestis
aauaucaaugaaa

SEQ ID NO: 2261924 - RNA, 15 nt, Yersinia pestis
aauaucacugauauc

SEQ ID NO: 2261925 - RNA, 13 nt, Yersinia pestis
aauaucaucaucu

SEQ ID NO: 2261926 - RNA, 12 nt, Yersinia pestis
aauaucaucauc

SEQ ID NO: 2261927 - RNA, 21 nt, Yersinia pestis
aauaucagugacaccauugau

SEQ ID NO: 2261928 - RNA, 17 nt, Yersinia pestis
aauaucccgagaaacaa

SEQ ID NO: 2261929 - RNA, 14 nt, Yersinia pestis
aauauccaauggug

SEQ ID NO: 2261930 - RNA, 13 nt, Yersinia pestis
aauaucauuauuu

SEQ ID NO: 2261931 - RNA, 20 nt, Yersinia pestis
aauaucauccccuuucugcu

SEQ ID NO: 2261932 - RNA, 20 nt, Yersinia pestis
aaggggcguuuaaugccccu

SEQ ID NO: 2261933 - RNA, 18 nt, Yersinia pestis
aagggggggaagcucccc

SEQ ID NO: 2261934 - RNA, 14 nt, Yersinia pestis
aaguaaaauaaaaa

SEQ ID NO: 2261935 - RNA, 23 nt, Yersinia pestis
aaguaaagaaccccccaccauca

SEQ ID NO: 2261936 - RNA, 19 nt, Yersinia pestis
aaggcuuuugggucagggu

SEQ ID NO: 2261937 - RNA, 17 nt, Yersinia pestis
aaggggagccacacacu

SEQ ID NO: 2261938 - RNA, 15 nt, Yersinia pestis
aagggcgcagccccc

SEQ ID NO: 2261939 - RNA, 15 nt, Yersinia pestis
aagggcgcaucccca

SEQ ID NO: 2261940 - RNA, 21 nt, Yersinia pestis
aaguaauuuaucaguagucaa

SEQ ID NO: 2261941 - RNA, 20 nt, Yersinia pestis
aaguacaaggggcaucugcu

SEQ ID NO: 2261942 - RNA, 19 nt, Yersinia pestis
aaguacggugccagcagca

SEQ ID NO: 2261943 - RNA, 13 nt, Yersinia pestis
aaguacuaucuau

SEQ ID NO: 2261944 - RNA, 19 nt, Yersinia pestis
aaguacuuccaauaaguga

SEQ ID NO: 2261945 - RNA, 13 nt, Yersinia pestis
aagucagcaaauc

SEQ ID NO: 2261946 - RNA, 19 nt, Yersinia pestis
aagucacuuaaacccuuuc

SEQ ID NO: 2261947 - RNA, 16 nt, Yersinia pestis
aagucacgcacccacc

SEQ ID NO: 2261948 - RNA, 13 nt, Yersinia pestis
aaguaugcagggu

SEQ ID NO: 2261949 - RNA, 21 nt, Yersinia pestis
aaguaggcuuauuaugacaac

SEQ ID NO: 2261950 - RNA, 20 nt, Yersinia pestis
aagucgugaucguuuuaugg

SEQ ID NO: 2261951 - RNA, 16 nt, Yersinia pestis
aagucugaaaugauca

SEQ ID NO: 2261952 - RNA, 15 nt, Yersinia pestis
aagugaacaugauga

SEQ ID NO: 2261953 - RNA, 17 nt, Yersinia pestis
aagucaugguacaacug

SEQ ID NO: 2261954 - RNA, 14 nt, Yersinia pestis
aagucccucccuuc

SEQ ID NO: 2261955 - RNA, 18 nt, Yersinia pestis
aagugcaucgggagccac

SEQ ID NO: 2261956 - RNA, 14 nt, Yersinia pestis
aaguguuucaaaua

SEQ ID NO: 2261957 - RNA, 15 nt, Yersinia pestis
aaguuaaaaagccug

SEQ ID NO: 2261958 - RNA, 18 nt, Yersinia pestis
aaguuaaacaauguuaaa

SEQ ID NO: 2261959 - RNA, 22 nt, Yersinia pestis
aaguuaaacaauguuaaacuuu

SEQ ID NO: 2261960 - RNA, 12 nt, Yersinia pestis
aaguuaaauaug

SEQ ID NO: 2261961 - RNA, 16 nt, Yersinia pestis
aaguuaacgcuuuaau

SEQ ID NO: 2261962 - RNA, 13 nt, Yersinia pestis
aaguugaauaaga

SEQ ID NO: 2261963 - RNA, 19 nt, Yersinia pestis
aaguucagguugaaauaaa

SEQ ID NO: 2261964 - RNA, 18 nt, Yersinia pestis
aaguuauuucagccaugg

SEQ ID NO: 2261965 - RNA, 21 nt, Yersinia pestis
aaguuauuucagccaugggcu

SEQ ID NO: 2261966 - RNA, 19 nt, Yersinia pestis
aaguucaagaaccgaaaua

SEQ ID NO: 2261967 - RNA, 17 nt, Yersinia pestis
aaguucacaugaugaau

SEQ ID NO: 2261968 - RNA, 14 nt, Yersinia pestis
aaggcucuguuacc

SEQ ID NO: 2261969 - RNA, 16 nt, Yersinia pestis
aaggcuuuauauugcc

SEQ ID NO: 2261970 - RNA, 20 nt, Yersinia pestis
aaggcuggucagcggagcag

SEQ ID NO: 2261971 - RNA, 14 nt, Yersinia pestis
aaggcuauuuuuau

SEQ ID NO: 2261972 - RNA, 14 nt, Yersinia pestis
aaggccgaucaaca

SEQ ID NO: 2261973 - RNA, 20 nt, Yersinia pestis
aaggccgcgauaaaaaauaa

SEQ ID NO: 2261974 - RNA, 19 nt, Yersinia pestis
aaggccggauguaaaacac

SEQ ID NO: 2261975 - RNA, 23 nt, Yersinia pestis
aaggcacaucuccagaauauaaa

SEQ ID NO: 2261976 - RNA, 14 nt, Yersinia pestis
aaggccaauuggcu

SEQ ID NO: 2261977 - RNA, 19 nt, Yersinia pestis
aaggaauuucacggagaag

SEQ ID NO: 2261978 - RNA, 16 nt, Yersinia pestis
aaggacacgauuuuua

SEQ ID NO: 2261979 - RNA, 21 nt, Yersinia pestis
aaggacaguaauauuuucauc

SEQ ID NO: 2261980 - RNA, 14 nt, Yersinia pestis
aaggaugaauaaau

SEQ ID NO: 2261981 - RNA, 17 nt, Yersinia pestis
aaggauggcccaagcca

SEQ ID NO: 2261982 - RNA, 18 nt, Yersinia pestis
aaggauggucaacauugc

SEQ ID NO: 2261983 - RNA, 21 nt, Yersinia pestis
aagcuggagccauaaguaaag

SEQ ID NO: 2261984 - RNA, 20 nt, Yersinia pestis
aagcuggcgcacucauccuc

SEQ ID NO: 2261985 - RNA, 14 nt, Yersinia pestis
aagcugggaaggcg

SEQ ID NO: 2261986 - RNA, 11 nt, Yersinia pestis
aagcucaagcu

SEQ ID NO: 2261987 - RNA, 12 nt, Yersinia pestis
aagcucaagcug

SEQ ID NO: 2261988 - RNA, 19 nt, Yersinia pestis
aagcucauaugcagcaucc

SEQ ID NO: 2261989 - RNA, 15 nt, Yersinia pestis
aagcuagucgcccgg

SEQ ID NO: 2261990 - RNA, 18 nt, Yersinia pestis
aagcuacagcucagacug

SEQ ID NO: 2261991 - RNA, 13 nt, Yersinia pestis
aagcgguaaaugg

SEQ ID NO: 2261992 - RNA, 23 nt, Yersinia pestis
aagcgccugugggcggcuuucau

SEQ ID NO: 2261993 - RNA, 20 nt, Yersinia pestis
aagcgccguaaaaagcagca

SEQ ID NO: 2261994 - RNA, 12 nt, Yersinia pestis
aagcgcagugcu

SEQ ID NO: 2261995 - RNA, 18 nt, Yersinia pestis
aagcgcagugcucauuaa

SEQ ID NO: 2261996 - RNA, 13 nt, Yersinia pestis
aagcgaugggggg

SEQ ID NO: 2261997 - RNA, 13 nt, Yersinia pestis
aagauccaguuca

SEQ ID NO: 2261998 - RNA, 15 nt, Yersinia pestis
aagccgugaccaaag

SEQ ID NO: 2261999 - RNA, 22 nt, Yersinia pestis
aagcgaucgaccgaguguaaaa

SEQ ID NO: 2262000 - RNA, 19 nt, Yersinia pestis
aagccucaugaaugaggcu

SEQ ID NO: 2262001 - RNA, 16 nt, Yersinia pestis
aagccucaugaaugag

SEQ ID NO: 2262002 - RNA, 11 nt, Yersinia pestis
aagccugugcu

SEQ ID NO: 2262003 - RNA, 15 nt, Yersinia pestis
aauuuuuuauauucc

SEQ ID NO: 2262004 - RNA, 22 nt, Yersinia pestis
aauuuuuuauauuccacauaca

SEQ ID NO: 2262005 - RNA, 20 nt, Yersinia pestis
acaacgcuuaucaaagugcu

SEQ ID NO: 2262006 - RNA, 13 nt, Yersinia pestis
acaacuugcugga

SEQ ID NO: 2262007 - RNA, 16 nt, Yersinia pestis
acaacuugcuggaggc

SEQ ID NO: 2262008 - RNA, 13 nt, Yersinia pestis
acaacuuucccag

SEQ ID NO: 2262009 - RNA, 15 nt, Yersinia pestis
acaacuuucccaguc

SEQ ID NO: 2262010 - RNA, 14 nt, Yersinia pestis
acaacuuccacaca

SEQ ID NO: 2262011 - RNA, 15 nt, Yersinia pestis
acaacuuccacacaa

SEQ ID NO: 2262012 - RNA, 11 nt, Yersinia pestis
acaacuucuuc

SEQ ID NO: 2262013 - RNA, 18 nt, Yersinia pestis
acaacugguuaucacugu

SEQ ID NO: 2262014 - RNA, 13 nt, Yersinia pestis
acaacugaaaaua

SEQ ID NO: 2262015 - RNA, 18 nt, Yersinia pestis
acaacugacaacaucaaa

SEQ ID NO: 2262016 - RNA, 19 nt, Yersinia pestis
acaacguccagaacaauac

SEQ ID NO: 2262017 - RNA, 20 nt, Yersinia pestis
acaacguguccgcaccauuc

SEQ ID NO: 2262018 - RNA, 14 nt, Yersinia pestis
acaacguuucugga

SEQ ID NO: 2262019 - RNA, 20 nt, Yersinia pestis
acaacguuuaguaaucaaua

SEQ ID NO: 2262020 - RNA, 13 nt, Yersinia pestis
acaauaaaucaau

SEQ ID NO: 2262021 - RNA, 22 nt, Yersinia pestis
acaauaacgcugaauacacucg

SEQ ID NO: 2262022 - RNA, 18 nt, Yersinia pestis
acaauaauaagccgcagg

SEQ ID NO: 2262023 - RNA, 16 nt, Yersinia pestis
acaauauaauaaugcu

SEQ ID NO: 2262024 - RNA, 15 nt, Yersinia pestis
acaagucagugauuc

SEQ ID NO: 2262025 - RNA, 20 nt, Yersinia pestis
acaagcgaccaucaugaaua

SEQ ID NO: 2262026 - RNA, 21 nt, Yersinia pestis
acaagccagcgaggcuucuca

SEQ ID NO: 2262027 - RNA, 14 nt, Yersinia pestis
acaagccauuucac

SEQ ID NO: 2262028 - RNA, 15 nt, Yersinia pestis
acaagccauuucacc

SEQ ID NO: 2262029 - RNA, 21 nt, Yersinia pestis
acaagcacucaaugucaugca

SEQ ID NO: 2262030 - RNA, 19 nt, Yersinia pestis
acaagauaaauaccgccaa

SEQ ID NO: 2262031 - RNA, 14 nt, Yersinia pestis
acaagaucccaagc

SEQ ID NO: 2262032 - RNA, 23 nt, Yersinia pestis
acacaccugcaacguuaaagaug

SEQ ID NO: 2262033 - RNA, 12 nt, Yersinia pestis
acacagcccugc

SEQ ID NO: 2262034 - RNA, 24 nt, Yersinia pestis
acacagcccugccuggcaggaagc

SEQ ID NO: 2262035 - RNA, 19 nt, Yersinia pestis
acacagucugucguacuuu

SEQ ID NO: 2262036 - RNA, 16 nt, Yersinia pestis
acacagugaugaccau

SEQ ID NO: 2262037 - RNA, 20 nt, Yersinia pestis
acacagucgcacugauagca

SEQ ID NO: 2262038 - RNA, 21 nt, Yersinia pestis
acacagucgcacugauagcaa

SEQ ID NO: 2262039 - RNA, 14 nt, Yersinia pestis
acaccaucaacaug

SEQ ID NO: 2262040 - RNA, 13 nt, Yersinia pestis
acaccagcauccu

SEQ ID NO: 2262041 - RNA, 15 nt, Yersinia pestis
acacauaaccaucaa

SEQ ID NO: 2262042 - RNA, 17 nt, Yersinia pestis
acacaucaaaauuaggu

SEQ ID NO: 2262043 - RNA, 22 nt, Yersinia pestis
acaccagagaugauagcaaugu

SEQ ID NO: 2262044 - RNA, 22 nt, Yersinia pestis
acaaugucacgcuuuaaaacug

SEQ ID NO: 2262045 - RNA, 17 nt, Yersinia pestis
acaaugguucaucauuu

SEQ ID NO: 2262046 - RNA, 18 nt, Yersinia pestis
acaaugguugaaugacca

SEQ ID NO: 2262047 - RNA, 16 nt, Yersinia pestis
acaauggccggacuca

SEQ ID NO: 2262048 - RNA, 22 nt, Yersinia pestis
acaaugaacuguguuuauacca

SEQ ID NO: 2262049 - RNA, 14 nt, Yersinia pestis
acaauuauagccaa

SEQ ID NO: 2262050 - RNA, 15 nt, Yersinia pestis
acaauuauagccaaa

SEQ ID NO: 2262051 - RNA, 22 nt, Yersinia pestis
acaaugugccgcgcaaccaucc

SEQ ID NO: 2262052 - RNA, 19 nt, Yersinia pestis
acaauuaauaugccgacaa

SEQ ID NO: 2262053 - RNA, 13 nt, Yersinia pestis
acaauuaacacuu

SEQ ID NO: 2262054 - RNA, 16 nt, Yersinia pestis
acaauuaacacuuauu

SEQ ID NO: 2262055 - RNA, 15 nt, Yersinia pestis
acaauuuccauauca

SEQ ID NO: 2262056 - RNA, 15 nt, Yersinia pestis
acacacagcaauaca

SEQ ID NO: 2262057 - RNA, 18 nt, Yersinia pestis
acacacagcaauacaugu

SEQ ID NO: 2262058 - RNA, 21 nt, Yersinia pestis
acacaccagucugcauacaga

SEQ ID NO: 2262059 - RNA, 15 nt, Yersinia pestis
acacaauacauagaa

SEQ ID NO: 2262060 - RNA, 13 nt, Yersinia pestis
acacaauuuuuag

SEQ ID NO: 2262061 - RNA, 16 nt, Yersinia pestis
acagcacggcaacagg

SEQ ID NO: 2262062 - RNA, 16 nt, Yersinia pestis
acagcacgguaaccuu

SEQ ID NO: 2262063 - RNA, 18 nt, Yersinia pestis
acagcagaacaaaacaag

SEQ ID NO: 2262064 - RNA, 19 nt, Yersinia pestis
acagcagaacaaaacaagc

SEQ ID NO: 2262065 - RNA, 15 nt, Yersinia pestis
acagcacguaccgcu

SEQ ID NO: 2262066 - RNA, 14 nt, Yersinia pestis
acagcacucaguac

SEQ ID NO: 2262067 - RNA, 19 nt, Yersinia pestis
acagauuauuucagcuuca

SEQ ID NO: 2262068 - RNA, 18 nt, Yersinia pestis
acagauuuuccauccccu

SEQ ID NO: 2262069 - RNA, 14 nt, Yersinia pestis
acagauugcaggaa

SEQ ID NO: 2262070 - RNA, 17 nt, Yersinia pestis
acagcaccauuaucuuc

SEQ ID NO: 2262071 - RNA, 22 nt, Yersinia pestis
acagaucauuaggccacuuaac

SEQ ID NO: 2262072 - RNA, 19 nt, Yersinia pestis
acagaucacccgcaaaacu

SEQ ID NO: 2262073 - RNA, 21 nt, Yersinia pestis
acagaucacccgcaaaacuga

SEQ ID NO: 2262074 - RNA, 23 nt, Yersinia pestis
acagauaaagcuugaucacaauc

SEQ ID NO: 2262075 - RNA, 14 nt, Yersinia pestis
acagauaauaugac

SEQ ID NO: 2262076 - RNA, 14 nt, Yersinia pestis
acagagccuuauag

SEQ ID NO: 2262077 - RNA, 19 nt, Yersinia pestis
acagcucggccagcauuca

SEQ ID NO: 2262078 - RNA, 17 nt, Yersinia pestis
acagcgcggcuaaauau

SEQ ID NO: 2262079 - RNA, 19 nt, Yersinia pestis
acagcgcuuggugaugcug

SEQ ID NO: 2262080 - RNA, 17 nt, Yersinia pestis
acagcauuuaugcugcc

SEQ ID NO: 2262081 - RNA, 17 nt, Yersinia pestis
acagcauucugcuucca

SEQ ID NO: 2262082 - RNA, 17 nt, Yersinia pestis
acagccccaaccaucuc

SEQ ID NO: 2262083 - RNA, 21 nt, Yersinia pestis
acagcccuuguaauuaaaaaa

SEQ ID NO: 2262084 - RNA, 16 nt, Yersinia pestis
acacuguuuaguucac

SEQ ID NO: 2262085 - RNA, 21 nt, Yersinia pestis
acacuuaauugguuuauaaca

SEQ ID NO: 2262086 - RNA, 20 nt, Yersinia pestis
acacuuauuaaccuacugac

SEQ ID NO: 2262087 - RNA, 22 nt, Yersinia pestis
acacuuauuaaccuacugacau

SEQ ID NO: 2262088 - RNA, 18 nt, Yersinia pestis
acacuuauuugaaauacu

SEQ ID NO: 2262089 - RNA, 15 nt, Yersinia pestis
acacugccugaugcu

SEQ ID NO: 2262090 - RNA, 16 nt, Yersinia pestis
acacugucaucacugc

SEQ ID NO: 2262091 - RNA, 19 nt, Yersinia pestis
acacugucaucacugcuau

SEQ ID NO: 2262092 - RNA, 22 nt, Yersinia pestis
acacucagaugaaaaacugugc

SEQ ID NO: 2262093 - RNA, 17 nt, Yersinia pestis
acacuacagccggauag

SEQ ID NO: 2262094 - RNA, 19 nt, Yersinia pestis
acacuauacccaaguuacu

SEQ ID NO: 2262095 - RNA, 22 nt, Yersinia pestis
acacccuuucguguugcuggau

SEQ ID NO: 2262096 - RNA, 20 nt, Yersinia pestis
acacccucucuuuccagcaa

SEQ ID NO: 2262097 - RNA, 17 nt, Yersinia pestis
acacccuccuauuaaua

SEQ ID NO: 2262098 - RNA, 21 nt, Yersinia pestis
acacccucucuuuccagcaaa

SEQ ID NO: 2262099 - RNA, 23 nt, Yersinia pestis
acacccucucuuuccagcaaaag

SEQ ID NO: 2262100 - RNA, 12 nt, Yersinia pestis
acaccauuucca

SEQ ID NO: 2262101 - RNA, 17 nt, Yersinia pestis
acaccauuuccaggcua

SEQ ID NO: 2262102 - RNA, 22 nt, Yersinia pestis
acacccguuccuucagccacca

SEQ ID NO: 2262103 - RNA, 19 nt, Yersinia pestis
acacccucaacucaaaaca

SEQ ID NO: 2262104 - RNA, 11 nt, Yersinia pestis
acagaaaucaa

SEQ ID NO: 2262105 - RNA, 12 nt, Yersinia pestis
acagaaaucaau

SEQ ID NO: 2262106 - RNA, 13 nt, Yersinia pestis
acagaacgcaauc

SEQ ID NO: 2262107 - RNA, 22 nt, Yersinia pestis
acagaacccccgcgaacagcag

SEQ ID NO: 2262108 - RNA, 22 nt, Yersinia pestis
acacuucgccgggucaggaaga

SEQ ID NO: 2262109 - RNA, 15 nt, Yersinia pestis
acacuugcucuacca

SEQ ID NO: 2262110 - RNA, 23 nt, Yersinia pestis
acacuuuugcuggugucacaauc

SEQ ID NO: 2262111 - RNA, 19 nt, Yersinia pestis
acacuuuuacaggccauua

SEQ ID NO: 2262112 - RNA, 15 nt, Yersinia pestis
acagacacagcaaca

SEQ ID NO: 2262113 - RNA, 15 nt, Yersinia pestis
acagacaaacaaccu

SEQ ID NO: 2262114 - RNA, 22 nt, Yersinia pestis
acaugguccacagucaguucau

SEQ ID NO: 2262115 - RNA, 19 nt, Yersinia pestis
acauggcggcagcacagag

SEQ ID NO: 2262116 - RNA, 18 nt, Yersinia pestis
acauggcucucuuuuuuc

SEQ ID NO: 2262117 - RNA, 17 nt, Yersinia pestis
acauggcaacgacuggg

SEQ ID NO: 2262118 - RNA, 13 nt, Yersinia pestis
acaugcuguucac

SEQ ID NO: 2262119 - RNA, 18 nt, Yersinia pestis
acaugauugaaaaacaga

SEQ ID NO: 2262120 - RNA, 21 nt, Yersinia pestis
acaugauuaaaucaagcugcu

SEQ ID NO: 2262121 - RNA, 18 nt, Yersinia pestis
acaugccacauagcguca

SEQ ID NO: 2262122 - RNA, 21 nt, Yersinia pestis
acaugcagcccgaccaaacgg

SEQ ID NO: 2262123 - RNA, 24 nt, Yersinia pestis
acaucuuugcugccaucagccgga

SEQ ID NO: 2262124 - RNA, 22 nt, Yersinia pestis
acaucuugcgccgaaauaaaac

SEQ ID NO: 2262125 - RNA, 20 nt, Yersinia pestis
acaucgaccauagagcaacc

SEQ ID NO: 2262126 - RNA, 15 nt, Yersinia pestis
acauuggaauuuucu

SEQ ID NO: 2262127 - RNA, 23 nt, Yersinia pestis
acauucugauagugauuuuuuuc

SEQ ID NO: 2262128 - RNA, 12 nt, Yersinia pestis
acauuauuauuu

SEQ ID NO: 2262129 - RNA, 14 nt, Yersinia pestis
acauuauuauuuac

SEQ ID NO: 2262130 - RNA, 21 nt, Yersinia pestis
acauuauuauuuacaaaccau

SEQ ID NO: 2262131 - RNA, 16 nt, Yersinia pestis
acauuaacuucagguu

SEQ ID NO: 2262132 - RNA, 18 nt, Yersinia pestis
acauuccacaaauuuuua

SEQ ID NO: 2262133 - RNA, 18 nt, Yersinia pestis
acauuccaguaaaaaaau

SEQ ID NO: 2262134 - RNA, 20 nt, Yersinia pestis
acauuccaguaaaaaaauag

SEQ ID NO: 2262135 - RNA, 16 nt, Yersinia pestis
acauuccaguaaaaaa

SEQ ID NO: 2262136 - RNA, 16 nt, Yersinia pestis
acauuauuuuucaccu

SEQ ID NO: 2262137 - RNA, 20 nt, Yersinia pestis
acaucaaagguuucacaugu

SEQ ID NO: 2262138 - RNA, 15 nt, Yersinia pestis
acauccauguaggcu

SEQ ID NO: 2262139 - RNA, 17 nt, Yersinia pestis
acauccauguaggcucg

SEQ ID NO: 2262140 - RNA, 21 nt, Yersinia pestis
acauauauaauacuauuugua

SEQ ID NO: 2262141 - RNA, 20 nt, Yersinia pestis
acauauaaaccagccaguga

SEQ ID NO: 2262142 - RNA, 16 nt, Yersinia pestis
acauauaaccaucaaa

SEQ ID NO: 2262143 - RNA, 18 nt, Yersinia pestis
acauaucacaguuaaaaa

SEQ ID NO: 2262144 - RNA, 21 nt, Yersinia pestis
acauaucuuuauuaucaaugg

SEQ ID NO: 2262145 - RNA, 15 nt, Yersinia pestis
acauauugguaauuu

SEQ ID NO: 2262146 - RNA, 10 nt, Yersinia pestis
acauauguug

SEQ ID NO: 2262147 - RNA, 19 nt, Yersinia pestis
acauagcacccaauguaua

SEQ ID NO: 2262148 - RNA, 14 nt, Yersinia pestis
acauagguuuuuuc

SEQ ID NO: 2262149 - RNA, 16 nt, Yersinia pestis
acauacgucuccauuu

SEQ ID NO: 2262150 - RNA, 20 nt, Yersinia pestis
acauacgucuccauuucaac

SEQ ID NO: 2262151 - RNA, 12 nt, Yersinia pestis
acauaccacaca

SEQ ID NO: 2262152 - RNA, 21 nt, Yersinia pestis
acauaccccauuuaucgccaa

SEQ ID NO: 2262153 - RNA, 21 nt, Yersinia pestis
acaggccgcuuccgauaacca

SEQ ID NO: 2262154 - RNA, 17 nt, Yersinia pestis
accaauagucacgucuu

SEQ ID NO: 2262155 - RNA, 23 nt, Yersinia pestis
accaauauugcggauucacccau

SEQ ID NO: 2262156 - RNA, 15 nt, Yersinia pestis
accaauaucauaaua

SEQ ID NO: 2262157 - RNA, 13 nt, Yersinia pestis
accaauaauuaau

SEQ ID NO: 2262158 - RNA, 24 nt, Yersinia pestis
accaauaaucgggaaauugugauu

SEQ ID NO: 2262159 - RNA, 22 nt, Yersinia pestis
accaauagaccguagaaacuaa

SEQ ID NO: 2262160 - RNA, 15 nt, Yersinia pestis
accaauagauuucac

SEQ ID NO: 2262161 - RNA, 16 nt, Yersinia pestis
accaauagauuucacu

SEQ ID NO: 2262162 - RNA, 14 nt, Yersinia pestis
accaauccaugcca

SEQ ID NO: 2262163 - RNA, 13 nt, Yersinia pestis
accaaugauuaac

SEQ ID NO: 2262164 - RNA, 22 nt, Yersinia pestis
accaaugaauuacguuuuggau

SEQ ID NO: 2262165 - RNA, 18 nt, Yersinia pestis
accaaugacuaauugugc

SEQ ID NO: 2262166 - RNA, 17 nt, Yersinia pestis
accaaugccgguccaga

SEQ ID NO: 2262167 - RNA, 16 nt, Yersinia pestis
accaauggaaaauaca

SEQ ID NO: 2262168 - RNA, 13 nt, Yersinia pestis
accaaguccauga

SEQ ID NO: 2262169 - RNA, 17 nt, Yersinia pestis
accaaguucggagauuu

SEQ ID NO: 2262170 - RNA, 14 nt, Yersinia pestis
accaagcuuugccu

SEQ ID NO: 2262171 - RNA, 15 nt, Yersinia pestis
accaaggaaaccacc

SEQ ID NO: 2262172 - RNA, 18 nt, Yersinia pestis
accaaggaaaccaccuaa

SEQ ID NO: 2262173 - RNA, 22 nt, Yersinia pestis
accaaccuugggggaccagcac

SEQ ID NO: 2262174 - RNA, 19 nt, Yersinia pestis
accaacgaaaucacccggc

SEQ ID NO: 2262175 - RNA, 19 nt, Yersinia pestis
accaacggcccaauauuga

SEQ ID NO: 2262176 - RNA, 14 nt, Yersinia pestis
accaauucaucagc

SEQ ID NO: 2262177 - RNA, 15 nt, Yersinia pestis
accaauucaucagcg

SEQ ID NO: 2262178 - RNA, 17 nt, Yersinia pestis
accaaugguuucaccgu

SEQ ID NO: 2262179 - RNA, 19 nt, Yersinia pestis
accaauuuucccaagccua

SEQ ID NO: 2262180 - RNA, 22 nt, Yersinia pestis
accacaacauuagggccaccag

SEQ ID NO: 2262181 - RNA, 14 nt, Yersinia pestis
accacaaugauuuc

SEQ ID NO: 2262182 - RNA, 13 nt, Yersinia pestis
accacaacgacag

SEQ ID NO: 2262183 - RNA, 17 nt, Yersinia pestis
accaccaacuccugccu

SEQ ID NO: 2262184 - RNA, 19 nt, Yersinia pestis
accaccaacuccugccuac

SEQ ID NO: 2262185 - RNA, 13 nt, Yersinia pestis
accaccaccaacc

SEQ ID NO: 2262186 - RNA, 12 nt, Yersinia pestis
accaccaccaca

SEQ ID NO: 2262187 - RNA, 14 nt, Yersinia pestis
accaccaccacaaa

SEQ ID NO: 2262188 - RNA, 13 nt, Yersinia pestis
accacaucaaacc

SEQ ID NO: 2262189 - RNA, 15 nt, Yersinia pestis
accacaucacgcagc

SEQ ID NO: 2262190 - RNA, 15 nt, Yersinia pestis
accacaccggcugca

SEQ ID NO: 2262191 - RNA, 18 nt, Yersinia pestis
accacagauaaauaaaau

SEQ ID NO: 2262192 - RNA, 19 nt, Yersinia pestis
accacacugagcaccgcag

SEQ ID NO: 2262193 - RNA, 20 nt, Yersinia pestis
accacacugagcaccgcagg

SEQ ID NO: 2262194 - RNA, 22 nt, Yersinia pestis
accacacugagcaccgcaggaa

SEQ ID NO: 2262195 - RNA, 19 nt, Yersinia pestis
accacagauaaauaaaaua

SEQ ID NO: 2262196 - RNA, 15 nt, Yersinia pestis
accacguugaauauu

SEQ ID NO: 2262197 - RNA, 18 nt, Yersinia pestis
accacgcaucaauaauaa

SEQ ID NO: 2262198 - RNA, 14 nt, Yersinia pestis
accacuaguuaaaa

SEQ ID NO: 2262199 - RNA, 12 nt, Yersinia pestis
accacuaaacca

SEQ ID NO: 2262200 - RNA, 15 nt, Yersinia pestis
accacuaaaccacau

SEQ ID NO: 2262201 - RNA, 17 nt, Yersinia pestis
accacuaaaccacauaa

SEQ ID NO: 2262202 - RNA, 21 nt, Yersinia pestis
accacugccacacuuuugcug

SEQ ID NO: 2262203 - RNA, 14 nt, Yersinia pestis
accacugaccuauu

SEQ ID NO: 2262204 - RNA, 12 nt, Yersinia pestis
accacugaccua

SEQ ID NO: 2262205 - RNA, 18 nt, Yersinia pestis
accacugacaaaaacagc

SEQ ID NO: 2262206 - RNA, 19 nt, Yersinia pestis
accacuugcuaccaagacu

SEQ ID NO: 2262207 - RNA, 17 nt, Yersinia pestis
accacgaagagcgccuc

SEQ ID NO: 2262208 - RNA, 17 nt, Yersinia pestis
accacgacgaucuuguu

SEQ ID NO: 2262209 - RNA, 19 nt, Yersinia pestis
accacgaaaaaauggcagc

SEQ ID NO: 2262210 - RNA, 19 nt, Yersinia pestis
accaccuaauacagcacca

SEQ ID NO: 2262211 - RNA, 14 nt, Yersinia pestis
accaccuacaaccu

SEQ ID NO: 2262212 - RNA, 19 nt, Yersinia pestis
accaccuacaaccuaccac

SEQ ID NO: 2262213 - RNA, 17 nt, Yersinia pestis
accaccuaccaccuaca

SEQ ID NO: 2262214 - RNA, 18 nt, Yersinia pestis
accaccuaccaccuacaa

SEQ ID NO: 2262215 - RNA, 20 nt, Yersinia pestis
accaccgucaagacaacaaa

SEQ ID NO: 2262216 - RNA, 19 nt, Yersinia pestis
accaccgccgcaacaauaa

SEQ ID NO: 2262217 - RNA, 16 nt, Yersinia pestis
accaccggguuuagua

SEQ ID NO: 2262218 - RNA, 13 nt, Yersinia pestis
accaccgucaaga

SEQ ID NO: 2262219 - RNA, 17 nt, Yersinia pestis
accacccguugcauuuu

SEQ ID NO: 2262220 - RNA, 20 nt, Yersinia pestis
accaccgacaccacgaucag

SEQ ID NO: 2262221 - RNA, 15 nt, Yersinia pestis
accaccauuaacaag

SEQ ID NO: 2262222 - RNA, 23 nt, Yersinia pestis
aauuucccuagcgaaguauuaau

SEQ ID NO: 2262223 - RNA, 16 nt, Yersinia pestis
aauuucgaaaacucaa

SEQ ID NO: 2262224 - RNA, 16 nt, Yersinia pestis
aauuucuguuaccaga

SEQ ID NO: 2262225 - RNA, 23 nt, Yersinia pestis
aauuucuugaggugcuugaacaa

SEQ ID NO: 2262226 - RNA, 10 nt, Yersinia pestis
aauuucucuu

SEQ ID NO: 2262227 - RNA, 19 nt, Yersinia pestis
aauuucagauaaaaauaau

SEQ ID NO: 2262228 - RNA, 13 nt, Yersinia pestis
aauuucagauaaa

SEQ ID NO: 2262229 - RNA, 23 nt, Yersinia pestis
aauuucagcagcacguucaccaa

SEQ ID NO: 2262230 - RNA, 22 nt, Yersinia pestis
aauuucaggucgauuacauacu

SEQ ID NO: 2262231 - RNA, 20 nt, Yersinia pestis
aauuucaggucgauuacaua

SEQ ID NO: 2262232 - RNA, 18 nt, Yersinia pestis
aauuucacuggcaccgcu

SEQ ID NO: 2262233 - RNA, 18 nt, Yersinia pestis
aauuuccaguucaacacc

SEQ ID NO: 2262234 - RNA, 20 nt, Yersinia pestis
aauuucauuuuaaaaucgua

SEQ ID NO: 2262235 - RNA, 19 nt, Yersinia pestis
aauuucaucucaauaacua

SEQ ID NO: 2262236 - RNA, 13 nt, Yersinia pestis
aauuucauuuacg

SEQ ID NO: 2262237 - RNA, 23 nt, Yersinia pestis
aauuuagccgcccucucuagauu

SEQ ID NO: 2262238 - RNA, 14 nt, Yersinia pestis
aauuuagcaaagcg

SEQ ID NO: 2262239 - RNA, 14 nt, Yersinia pestis
aauuuaucaguagu

SEQ ID NO: 2262240 - RNA, 22 nt, Yersinia pestis
aauuuaucaguagucaauacaa

SEQ ID NO: 2262241 - RNA, 21 nt, Yersinia pestis
aauuuauccuguacauauaua

SEQ ID NO: 2262242 - RNA, 13 nt, Yersinia pestis
aauuuauccaacu

SEQ ID NO: 2262243 - RNA, 22 nt, Yersinia pestis
aauuuaucucuaucaauauaua

SEQ ID NO: 2262244 - RNA, 16 nt, Yersinia pestis
aauuuauuucagauuu

SEQ ID NO: 2262245 - RNA, 12 nt, Yersinia pestis
aauuuauuuuca

SEQ ID NO: 2262246 - RNA, 13 nt, Yersinia pestis
aauuuaugauuaa

SEQ ID NO: 2262247 - RNA, 13 nt, Yersinia pestis
aauuuauuauuua

SEQ ID NO: 2262248 - RNA, 18 nt, Yersinia pestis
aauuuaacuuucaucccu

SEQ ID NO: 2262249 - RNA, 16 nt, Yersinia pestis
aauuuaaauaaaauaa

SEQ ID NO: 2262250 - RNA, 22 nt, Yersinia pestis
aauuuaaaguuuuuuauuuaua

SEQ ID NO: 2262251 - RNA, 22 nt, Yersinia pestis
aauugcggucagcauacuggcu

SEQ ID NO: 2262252 - RNA, 12 nt, Yersinia pestis
aauuuuucccuu

SEQ ID NO: 2262253 - RNA, 15 nt, Yersinia pestis
aauuuuuacauucca

SEQ ID NO: 2262254 - RNA, 21 nt, Yersinia pestis
aauuuuguacaacuucuucau

SEQ ID NO: 2262255 - RNA, 16 nt, Yersinia pestis
aauuuugguacaggug

SEQ ID NO: 2262256 - RNA, 16 nt, Yersinia pestis
aauuuuauucagcaag

SEQ ID NO: 2262257 - RNA, 13 nt, Yersinia pestis
aauuuuauucagc

SEQ ID NO: 2262258 - RNA, 19 nt, Yersinia pestis
aauuuuaaaggcaacgaag

SEQ ID NO: 2262259 - RNA, 21 nt, Yersinia pestis
aauuuuaaguuaauguuuaua

SEQ ID NO: 2262260 - RNA, 15 nt, Yersinia pestis
aauuuuacguucaga

SEQ ID NO: 2262261 - RNA, 16 nt, Yersinia pestis
aauuugguagaacugc

SEQ ID NO: 2262262 - RNA, 21 nt, Yersinia pestis
aauuugguucacggaaaguag

SEQ ID NO: 2262263 - RNA, 19 nt, Yersinia pestis
aauuugcuccuggcaugca

SEQ ID NO: 2262264 - RNA, 16 nt, Yersinia pestis
aauuugcaaagaaaua

SEQ ID NO: 2262265 - RNA, 13 nt, Yersinia pestis
aauuugaucacca

SEQ ID NO: 2262266 - RNA, 16 nt, Yersinia pestis
aauuauuuuauuuaaa

SEQ ID NO: 2262267 - RNA, 12 nt, Yersinia pestis
aauuauuucucu

SEQ ID NO: 2262268 - RNA, 18 nt, Yersinia pestis
aauuauuucucugaugaa

SEQ ID NO: 2262269 - RNA, 14 nt, Yersinia pestis
aauuauuucaguag

SEQ ID NO: 2262270 - RNA, 12 nt, Yersinia pestis
aauuauuaaaua

SEQ ID NO: 2262271 - RNA, 13 nt, Yersinia pestis
aauuauuaaauaa

SEQ ID NO: 2262272 - RNA, 18 nt, Yersinia pestis
aauuaucuuauccacagc

SEQ ID NO: 2262273 - RNA, 19 nt, Yersinia pestis
aauuaucuuauccacagca

SEQ ID NO: 2262274 - RNA, 20 nt, Yersinia pestis
aauuaucuuauccacagcau

SEQ ID NO: 2262275 - RNA, 19 nt, Yersinia pestis
aauuaugacguucaguagu

SEQ ID NO: 2262276 - RNA, 16 nt, Yersinia pestis
aauuagcacauaugca

SEQ ID NO: 2262277 - RNA, 22 nt, Yersinia pestis
aauuagcugaucgggcuuuaca

SEQ ID NO: 2262278 - RNA, 14 nt, Yersinia pestis
aauuagcgaaauau

SEQ ID NO: 2262279 - RNA, 20 nt, Yersinia pestis
aauuacugacgcuuauccug

SEQ ID NO: 2262280 - RNA, 20 nt, Yersinia pestis
aauuacucguauaaaaaaua

SEQ ID NO: 2262281 - RNA, 11 nt, Yersinia pestis
aauuaauaucc

SEQ ID NO: 2262282 - RNA, 16 nt, Yersinia pestis
aauuaauaucuuuaaa

SEQ ID NO: 2262283 - RNA, 17 nt, Yersinia pestis
aauuaauaucuuuaaau

SEQ ID NO: 2262284 - RNA, 19 nt, Yersinia pestis
aauuaauaucuuuaaauua

SEQ ID NO: 2262285 - RNA, 12 nt, Yersinia pestis
aauuaauauuua

SEQ ID NO: 2262286 - RNA, 12 nt, Yersinia pestis
aauuaaggaaaa

SEQ ID NO: 2262287 - RNA, 21 nt, Yersinia pestis
aauggguauauuuaccaaaag

SEQ ID NO: 2262288 - RNA, 23 nt, Yersinia pestis
aauggguuugguuauuaugauug

SEQ ID NO: 2262289 - RNA, 12 nt, Yersinia pestis
aauggguauauu

SEQ ID NO: 2262290 - RNA, 18 nt, Yersinia pestis
aaugguauuugaaauauu

SEQ ID NO: 2262291 - RNA, 18 nt, Yersinia pestis
aauggugcuauuucuggc

SEQ ID NO: 2262292 - RNA, 15 nt, Yersinia pestis
aauuaaucaauuaaa

SEQ ID NO: 2262293 - RNA, 16 nt, Yersinia pestis
aauuaaucaauuaaau

SEQ ID NO: 2262294 - RNA, 20 nt, Yersinia pestis
aauuaauuacuuuauuuaaa

SEQ ID NO: 2262295 - RNA, 18 nt, Yersinia pestis
aauuaaucuaauuucaaa

SEQ ID NO: 2262296 - RNA, 19 nt, Yersinia pestis
aauuaaucuaauuucaaau

SEQ ID NO: 2262297 - RNA, 19 nt, Yersinia pestis
aauuaauuuauuuucauua

SEQ ID NO: 2262298 - RNA, 13 nt, Yersinia pestis
aauuacacacccu

SEQ ID NO: 2262299 - RNA, 21 nt, Yersinia pestis
aauuacacacccucaacucaa

SEQ ID NO: 2262300 - RNA, 16 nt, Yersinia pestis
aauugaucugauauua

SEQ ID NO: 2262301 - RNA, 13 nt, Yersinia pestis
aauugauccugug

SEQ ID NO: 2262302 - RNA, 12 nt, Yersinia pestis
aauugauaugau

SEQ ID NO: 2262303 - RNA, 22 nt, Yersinia pestis
aauugauauuauuuauaugaua

SEQ ID NO: 2262304 - RNA, 19 nt, Yersinia pestis
aauugaguaacugauuaau

SEQ ID NO: 2262305 - RNA, 21 nt, Yersinia pestis
aauucuuucaacgcauccaaa

SEQ ID NO: 2262306 - RNA, 22 nt, Yersinia pestis
aauugaccauagagagaaaaag

SEQ ID NO: 2262307 - RNA, 13 nt, Yersinia pestis
aauuccuauaaau

SEQ ID NO: 2262308 - RNA, 13 nt, Yersinia pestis
aauucaaauauca

SEQ ID NO: 2262309 - RNA, 14 nt, Yersinia pestis
aauucaaauaucau

SEQ ID NO: 2262310 - RNA, 16 nt, Yersinia pestis
aauucaaaauguauua

SEQ ID NO: 2262311 - RNA, 18 nt, Yersinia pestis
aauucaauccauugaucu

SEQ ID NO: 2262312 - RNA, 21 nt, Yersinia pestis
aauucgggaucaugaugauca

SEQ ID NO: 2262313 - RNA, 19 nt, Yersinia pestis
aauucguagcuaucuuugc

SEQ ID NO: 2262314 - RNA, 17 nt, Yersinia pestis
aauucuguagaguaaaa

SEQ ID NO: 2262315 - RNA, 18 nt, Yersinia pestis
aauucuuaggauaaccaa

SEQ ID NO: 2262316 - RNA, 14 nt, Yersinia pestis
aaucuuugagcacc

SEQ ID NO: 2262317 - RNA, 18 nt, Yersinia pestis
aaucuuugccuauuucag

SEQ ID NO: 2262318 - RNA, 12 nt, Yersinia pestis
aaucuuguuaau

SEQ ID NO: 2262319 - RNA, 22 nt, Yersinia pestis
aaugaaauugggggucagggcg

SEQ ID NO: 2262320 - RNA, 21 nt, Yersinia pestis
aaugagcacggacagcagcac

SEQ ID NO: 2262321 - RNA, 22 nt, Yersinia pestis
aaugagaagugagaagugaaaa

SEQ ID NO: 2262322 - RNA, 18 nt, Yersinia pestis
aaugacucgauaacccaa

SEQ ID NO: 2262323 - RNA, 16 nt, Yersinia pestis
aaugauaauaaaaaaa

SEQ ID NO: 2262324 - RNA, 20 nt, Yersinia pestis
aaugaguuuuguccugagcc

SEQ ID NO: 2262325 - RNA, 20 nt, Yersinia pestis
aaugauacgugcuauagaaa

SEQ ID NO: 2262326 - RNA, 12 nt, Yersinia pestis
aaugauagcgag

SEQ ID NO: 2262327 - RNA, 20 nt, Yersinia pestis
aaugagguuuacauuuaaac

SEQ ID NO: 2262328 - RNA, 13 nt, Yersinia pestis
aaugaggcugagg

SEQ ID NO: 2262329 - RNA, 15 nt, Yersinia pestis
aaugagugacaacau

SEQ ID NO: 2262330 - RNA, 18 nt, Yersinia pestis
aaugagugauauccgcca

SEQ ID NO: 2262331 - RNA, 22 nt, Yersinia pestis
aaugacuaauugugcagcauca

SEQ ID NO: 2262332 - RNA, 22 nt, Yersinia pestis
aaugaccacgcaucaauaauaa

SEQ ID NO: 2262333 - RNA, 18 nt, Yersinia pestis
aaugaccaagguuauaca

SEQ ID NO: 2262334 - RNA, 14 nt, Yersinia pestis
aaugacauauucaa

SEQ ID NO: 2262335 - RNA, 21 nt, Yersinia pestis
aaugacagcaucaauaucgcc

SEQ ID NO: 2262336 - RNA, 19 nt, Yersinia pestis
aaugcagguuuugccagau

SEQ ID NO: 2262337 - RNA, 18 nt, Yersinia pestis
aaugcauccaagccauca

SEQ ID NO: 2262338 - RNA, 23 nt, Yersinia pestis
aaugauucauugaguuaucuccu

SEQ ID NO: 2262339 - RNA, 20 nt, Yersinia pestis
aaugauuauugaccagauag

SEQ ID NO: 2262340 - RNA, 14 nt, Yersinia pestis
aaugauucagugau

SEQ ID NO: 2262341 - RNA, 17 nt, Yersinia pestis
aaugauugauuaucaag

SEQ ID NO: 2262342 - RNA, 23 nt, Yersinia pestis
aaugauugauuaucaaguuaaau

SEQ ID NO: 2262343 - RNA, 16 nt, Yersinia pestis
aaugcccauugcgguu

SEQ ID NO: 2262344 - RNA, 19 nt, Yersinia pestis
aaugccccacuucacgcac

SEQ ID NO: 2262345 - RNA, 14 nt, Yersinia pestis
aaugccccuuuuuu

SEQ ID NO: 2262346 - RNA, 18 nt, Yersinia pestis
aaugcccgucauauuuaa

SEQ ID NO: 2262347 - RNA, 14 nt, Yersinia pestis
aaugccgagaacag

SEQ ID NO: 2262348 - RNA, 18 nt, Yersinia pestis
aaugccgcugaucaggaa

SEQ ID NO: 2262349 - RNA, 13 nt, Yersinia pestis
aaugauggcggcu

SEQ ID NO: 2262350 - RNA, 18 nt, Yersinia pestis
aaugaucgucaauguaac

SEQ ID NO: 2262351 - RNA, 18 nt, Yersinia pestis
aauggcuggcaaggcacg

SEQ ID NO: 2262352 - RNA, 13 nt, Yersinia pestis
aauggcugccccc

SEQ ID NO: 2262353 - RNA, 23 nt, Yersinia pestis
aaugggcuaccgacaagauugcc

SEQ ID NO: 2262354 - RNA, 23 nt, Yersinia pestis
aauggcuuuuuuaauaaaaaacu

SEQ ID NO: 2262355 - RNA, 17 nt, Yersinia pestis
aauggcaaaacagauau

SEQ ID NO: 2262356 - RNA, 13 nt, Yersinia pestis
aauggcaauggcc

SEQ ID NO: 2262357 - RNA, 18 nt, Yersinia pestis
aauggcaccucaucccaa

SEQ ID NO: 2262358 - RNA, 17 nt, Yersinia pestis
aaugcguuauaaccaug

SEQ ID NO: 2262359 - RNA, 20 nt, Yersinia pestis
aaugccggcggcccauaucc

SEQ ID NO: 2262360 - RNA, 16 nt, Yersinia pestis
aaugcucgcucaucau

SEQ ID NO: 2262361 - RNA, 21 nt, Yersinia pestis
aaugcucgcucaucauaaaaa

SEQ ID NO: 2262362 - RNA, 19 nt, Yersinia pestis
aaugcucaucaaguauuuu

SEQ ID NO: 2262363 - RNA, 12 nt, Yersinia pestis
aaugcuauauuu

SEQ ID NO: 2262364 - RNA, 21 nt, Yersinia pestis
aaugcuacuuaacguugagaa

SEQ ID NO: 2262365 - RNA, 12 nt, Yersinia pestis
aaucgaaacacc

SEQ ID NO: 2262366 - RNA, 14 nt, Yersinia pestis
aaucgaaacaccac

SEQ ID NO: 2262367 - RNA, 18 nt, Yersinia pestis
aaucgaacccuucagcau

SEQ ID NO: 2262368 - RNA, 18 nt, Yersinia pestis
aaucgcccaaugucagga

SEQ ID NO: 2262369 - RNA, 17 nt, Yersinia pestis
aaucgacggaaacagca

SEQ ID NO: 2262370 - RNA, 18 nt, Yersinia pestis
aaucgacggaaacagcac

SEQ ID NO: 2262371 - RNA, 16 nt, Yersinia pestis
aaucgccgaaaucuca

SEQ ID NO: 2262372 - RNA, 19 nt, Yersinia pestis
aaucgcguucagagcagca

SEQ ID NO: 2262373 - RNA, 23 nt, Yersinia pestis
aaucgccguuacccccuucacca

SEQ ID NO: 2262374 - RNA, 13 nt, Yersinia pestis
aauccuguagcuc

SEQ ID NO: 2262375 - RNA, 17 nt, Yersinia pestis
aauccugaauaauacug

SEQ ID NO: 2262376 - RNA, 17 nt, Yersinia pestis
aauccccagaagcgcac

SEQ ID NO: 2262377 - RNA, 18 nt, Yersinia pestis
aauccccaugaugauauc

SEQ ID NO: 2262378 - RNA, 19 nt, Yersinia pestis
aaucccgauauaaauaaaa

SEQ ID NO: 2262379 - RNA, 16 nt, Yersinia pestis
aaucccgggaauaauc

SEQ ID NO: 2262380 - RNA, 22 nt, Yersinia pestis
aauccccggucacuuaaauaac

SEQ ID NO: 2262381 - RNA, 16 nt, Yersinia pestis
aauccccggaccagcc

SEQ ID NO: 2262382 - RNA, 13 nt, Yersinia pestis
aaucgcuuucgga

SEQ ID NO: 2262383 - RNA, 14 nt, Yersinia pestis
aaucggauaaccgc

SEQ ID NO: 2262384 - RNA, 20 nt, Yersinia pestis
aaucggauggucauccacaa

SEQ ID NO: 2262385 - RNA, 22 nt, Yersinia pestis
aaucgcucugcguuuuucccug

SEQ ID NO: 2262386 - RNA, 18 nt, Yersinia pestis
aaucgguagacacaaggg

SEQ ID NO: 2262387 - RNA, 16 nt, Yersinia pestis
aaucgggugauaaagg

SEQ ID NO: 2262388 - RNA, 14 nt, Yersinia pestis
aaucuaacgccgga

SEQ ID NO: 2262389 - RNA, 14 nt, Yersinia pestis
aaucuagaacuauu

SEQ ID NO: 2262390 - RNA, 21 nt, Yersinia pestis
aaucguuuuaauuugccuuca

SEQ ID NO: 2262391 - RNA, 16 nt, Yersinia pestis
aaucuccuccggagag

SEQ ID NO: 2262392 - RNA, 22 nt, Yersinia pestis
aaucucguuaucagccacauca

SEQ ID NO: 2262393 - RNA, 14 nt, Yersinia pestis
aaucuauuaauauc

SEQ ID NO: 2262394 - RNA, 22 nt, Yersinia pestis
aaucuaucgauacccuucaucu

SEQ ID NO: 2262395 - RNA, 16 nt, Yersinia pestis
aaucuccaucauggcu

SEQ ID NO: 2262396 - RNA, 17 nt, Yersinia pestis
aaaaauuaaaauaauga

SEQ ID NO: 2262397 - RNA, 17 nt, Yersinia pestis
aaucauacgcagccuga

SEQ ID NO: 2262398 - RNA, 15 nt, Yersinia pestis
aaucagcugauauga

SEQ ID NO: 2262399 - RNA, 20 nt, Yersinia pestis
aaucagcugauaugaaaaau

SEQ ID NO: 2262400 - RNA, 17 nt, Yersinia pestis
aaucagcugauaugaaa

SEQ ID NO: 2262401 - RNA, 19 nt, Yersinia pestis
aaucaggugaacguuggcu

SEQ ID NO: 2262402 - RNA, 13 nt, Yersinia pestis
aaucaguaaauau

SEQ ID NO: 2262403 - RNA, 20 nt, Yersinia pestis
aaucaguacuauucacgagc

SEQ ID NO: 2262404 - RNA, 19 nt, Yersinia pestis
aaucaguaccaccaccaca

SEQ ID NO: 2262405 - RNA, 15 nt, Yersinia pestis
aaucagugacaagaa

SEQ ID NO: 2262406 - RNA, 14 nt, Yersinia pestis
aaucagugcaauaa

SEQ ID NO: 2262407 - RNA, 21 nt, Yersinia pestis
aauaugauaguguaaaaacca

SEQ ID NO: 2262408 - RNA, 21 nt, Yersinia pestis
aaucagcaucuuaccggccuc

SEQ ID NO: 2262409 - RNA, 21 nt, Yersinia pestis
aaucagccacuuccuguuuau

SEQ ID NO: 2262410 - RNA, 14 nt, Yersinia pestis
aaucagcauucuca

SEQ ID NO: 2262411 - RNA, 20 nt, Yersinia pestis
aaucagcgugguauaaaugg

SEQ ID NO: 2262412 - RNA, 16 nt, Yersinia pestis
aaucagcuaauaucau

SEQ ID NO: 2262413 - RNA, 22 nt, Yersinia pestis
aaucaucagggaauugacuaaa

SEQ ID NO: 2262414 - RNA, 14 nt, Yersinia pestis
aaucaucaucccag

SEQ ID NO: 2262415 - RNA, 16 nt, Yersinia pestis
aaucaucaucccaguc

SEQ ID NO: 2262416 - RNA, 15 nt, Yersinia pestis
aaucaucaucacaaa

SEQ ID NO: 2262417 - RNA, 19 nt, Yersinia pestis
aaaaauucacaacagugca

SEQ ID NO: 2262418 - RNA, 18 nt, Yersinia pestis
aaucaucuacaacaucau

SEQ ID NO: 2262419 - RNA, 22 nt, Yersinia pestis
aauccaaccuauauagcccagc

SEQ ID NO: 2262420 - RNA, 14 nt, Yersinia pestis
aauccaacucaccu

SEQ ID NO: 2262421 - RNA, 21 nt, Yersinia pestis
aauccaaaugcccauuaguaa

SEQ ID NO: 2262422 - RNA, 18 nt, Yersinia pestis
aaucauucugucaucaag

SEQ ID NO: 2262423 - RNA, 19 nt, Yersinia pestis
aaucauugagaucaguuca

SEQ ID NO: 2262424 - RNA, 15 nt, Yersinia pestis
aaucauugcaaugcu

SEQ ID NO: 2262425 - RNA, 21 nt, Yersinia pestis
aauccaccacugauaggucau

SEQ ID NO: 2262426 - RNA, 14 nt, Yersinia pestis
acugagauuugcca

SEQ ID NO: 2262427 - RNA, 11 nt, Yersinia pestis
acugagcaccg

SEQ ID NO: 2262428 - RNA, 18 nt, Yersinia pestis
acugaaaguagaaauaaa

SEQ ID NO: 2262429 - RNA, 15 nt, Yersinia pestis
acugagauaaucccu

SEQ ID NO: 2262430 - RNA, 19 nt, Yersinia pestis
acugaaaguagaaauaaaa

SEQ ID NO: 2262431 - RNA, 12 nt, Yersinia pestis
acugaaauaaac

SEQ ID NO: 2262432 - RNA, 21 nt, Yersinia pestis
acugaaauaaacaagccauuc

SEQ ID NO: 2262433 - RNA, 17 nt, Yersinia pestis
acugaaaagaggcacac

SEQ ID NO: 2262434 - RNA, 12 nt, Yersinia pestis
acucuuuguuac

SEQ ID NO: 2262435 - RNA, 12 nt, Yersinia pestis
acugaucauuau

SEQ ID NO: 2262436 - RNA, 16 nt, Yersinia pestis
acugauauaaagcauu

SEQ ID NO: 2262437 - RNA, 13 nt, Yersinia pestis
acugauugaccau

SEQ ID NO: 2262438 - RNA, 18 nt, Yersinia pestis
acugaguuggaaaugaca

SEQ ID NO: 2262439 - RNA, 12 nt, Yersinia pestis
acugauacaaca

SEQ ID NO: 2262440 - RNA, 16 nt, Yersinia pestis
acugauagcggcucug

SEQ ID NO: 2262441 - RNA, 18 nt, Yersinia pestis
acugauaggucauauaca

SEQ ID NO: 2262442 - RNA, 20 nt, Yersinia pestis
acugauuggauaaaauauua

SEQ ID NO: 2262443 - RNA, 21 nt, Yersinia pestis
acugcauagcuaaccuuaacu

SEQ ID NO: 2262444 - RNA, 17 nt, Yersinia pestis
acugcuuuuuacacucg

SEQ ID NO: 2262445 - RNA, 13 nt, Yersinia pestis
acuggaagaaacc

SEQ ID NO: 2262446 - RNA, 16 nt, Yersinia pestis
acuggaucacaaugca

SEQ ID NO: 2262447 - RNA, 15 nt, Yersinia pestis
acugcugauuuugua

SEQ ID NO: 2262448 - RNA, 16 nt, Yersinia pestis
acugcugauuuuguag

SEQ ID NO: 2262449 - RNA, 16 nt, Yersinia pestis
acugcugcaacucauu

SEQ ID NO: 2262450 - RNA, 15 nt, Yersinia pestis
acugcugacaacccc

SEQ ID NO: 2262451 - RNA, 15 nt, Yersinia pestis
acugcugacaacccu

SEQ ID NO: 2262452 - RNA, 14 nt, Yersinia pestis
acugcguacucacc

SEQ ID NO: 2262453 - RNA, 21 nt, Yersinia pestis
acugcucgcccaagcggcugg

SEQ ID NO: 2262454 - RNA, 12 nt, Yersinia pestis
acugcugacaaa

SEQ ID NO: 2262455 - RNA, 12 nt, Yersinia pestis
acugcugacaac

SEQ ID NO: 2262456 - RNA, 16 nt, Yersinia pestis
acugcucuaucucuuc

SEQ ID NO: 2262457 - RNA, 15 nt, Yersinia pestis
acugcucuuucccuu

SEQ ID NO: 2262458 - RNA, 18 nt, Yersinia pestis
acugcgcaaauccugaau

SEQ ID NO: 2262459 - RNA, 15 nt, Yersinia pestis
acugccaccaaaugc

SEQ ID NO: 2262460 - RNA, 22 nt, Yersinia pestis
acugcgaccaaaagccaccgca

SEQ ID NO: 2262461 - RNA, 13 nt, Yersinia pestis
acugcauugcguu

SEQ ID NO: 2262462 - RNA, 14 nt, Yersinia pestis
acugcauuaucuaa

SEQ ID NO: 2262463 - RNA, 15 nt, Yersinia pestis
acugccaauauugac

SEQ ID NO: 2262464 - RNA, 13 nt, Yersinia pestis
acugccaaucgcu

SEQ ID NO: 2262465 - RNA, 21 nt, Yersinia pestis
acuauuuuugacuuuaauuaa

SEQ ID NO: 2262466 - RNA, 22 nt, Yersinia pestis
acuauuuuugacuuuaauuaaa

SEQ ID NO: 2262467 - RNA, 23 nt, Yersinia pestis
acuauuuuugacuuuaauuaaaa

SEQ ID NO: 2262468 - RNA, 18 nt, Yersinia pestis
acuauuuucauuguucuu

SEQ ID NO: 2262469 - RNA, 16 nt, Yersinia pestis
acucaaaaaaaauaca

SEQ ID NO: 2262470 - RNA, 18 nt, Yersinia pestis
acuccggcaucauccuca

SEQ ID NO: 2262471 - RNA, 17 nt, Yersinia pestis
acucccgccaagaaacg

SEQ ID NO: 2262472 - RNA, 21 nt, Yersinia pestis
acucccgauucagcucugcca

SEQ ID NO: 2262473 - RNA, 19 nt, Yersinia pestis
acuccccuggcaggccagc

SEQ ID NO: 2262474 - RNA, 23 nt, Yersinia pestis
acuccccuggcaggccagcgaca

SEQ ID NO: 2262475 - RNA, 16 nt, Yersinia pestis
acucccggcagcacug

SEQ ID NO: 2262476 - RNA, 21 nt, Yersinia pestis
acuccuuuguuauuucuggga

SEQ ID NO: 2262477 - RNA, 22 nt, Yersinia pestis
acuccucuuucuuaauaauauc

SEQ ID NO: 2262478 - RNA, 16 nt, Yersinia pestis
acuccucugccuaucc

SEQ ID NO: 2262479 - RNA, 19 nt, Yersinia pestis
acuccucuuucuuaauaau

SEQ ID NO: 2262480 - RNA, 14 nt, Yersinia pestis
acucgagcauuuga

SEQ ID NO: 2262481 - RNA, 15 nt, Yersinia pestis
acucgaauuauuugg

SEQ ID NO: 2262482 - RNA, 22 nt, Yersinia pestis
acucggcgguuugagccaccgc

SEQ ID NO: 2262483 - RNA, 15 nt, Yersinia pestis
acucgauagaaaaag

SEQ ID NO: 2262484 - RNA, 15 nt, Yersinia pestis
acucucccucaguga

SEQ ID NO: 2262485 - RNA, 22 nt, Yersinia pestis
acucuacauugacuaauuaaua

SEQ ID NO: 2262486 - RNA, 12 nt, Yersinia pestis
acucguuuuaca

SEQ ID NO: 2262487 - RNA, 14 nt, Yersinia pestis
acucucgaaaaugu

SEQ ID NO: 2262488 - RNA, 16 nt, Yersinia pestis
acucucgccaaacaaa

SEQ ID NO: 2262489 - RNA, 19 nt, Yersinia pestis
acucucuucaucagucacu

SEQ ID NO: 2262490 - RNA, 21 nt, Yersinia pestis
acucugcggcaggcugaucuu

SEQ ID NO: 2262491 - RNA, 15 nt, Yersinia pestis
acucugcuaccagga

SEQ ID NO: 2262492 - RNA, 23 nt, Yersinia pestis
acucuucgugcuuauuuugcuug

SEQ ID NO: 2262493 - RNA, 13 nt, Yersinia pestis
acucuucuuuacu

SEQ ID NO: 2262494 - RNA, 15 nt, Yersinia pestis
acucuugagaaauga

SEQ ID NO: 2262495 - RNA, 16 nt, Yersinia pestis
acucuugagaaaugaa

SEQ ID NO: 2262496 - RNA, 21 nt, Yersinia pestis
acucuugcacuuuuacugguu

SEQ ID NO: 2262497 - RNA, 12 nt, Yersinia pestis
acucuuccaacu

SEQ ID NO: 2262498 - RNA, 18 nt, Yersinia pestis
acucuucagccuauccuc

SEQ ID NO: 2262499 - RNA, 19 nt, Yersinia pestis
acucuucagccuauccuca

SEQ ID NO: 2262500 - RNA, 16 nt, Yersinia pestis
acucuggcacuggcaa

SEQ ID NO: 2262501 - RNA, 23 nt, Yersinia pestis
acucugggccgugaguuuucgau

SEQ ID NO: 2262502 - RNA, 17 nt, Yersinia pestis
acucuggauggguaaug

SEQ ID NO: 2262503 - RNA, 20 nt, Yersinia pestis
acucuggauggguaaugcau

SEQ ID NO: 2262504 - RNA, 20 nt, Yersinia pestis
acucuguagcacauuuaagc

SEQ ID NO: 2262505 - RNA, 15 nt, Yersinia pestis
acucuguaccgcccg

SEQ ID NO: 2262506 - RNA, 12 nt, Yersinia pestis
acuuccauuccg

SEQ ID NO: 2262507 - RNA, 13 nt, Yersinia pestis
acuuccgccgcca

SEQ ID NO: 2262508 - RNA, 20 nt, Yersinia pestis
acuucccgcacaauuccagg

SEQ ID NO: 2262509 - RNA, 19 nt, Yersinia pestis
acuucauuggcuugguugu

SEQ ID NO: 2262510 - RNA, 19 nt, Yersinia pestis
acuucaugacuaccuugcu

SEQ ID NO: 2262511 - RNA, 14 nt, Yersinia pestis
acuucaucuuuuuu

SEQ ID NO: 2262512 - RNA, 21 nt, Yersinia pestis
acuucaucauucauuuuaaaa

SEQ ID NO: 2262513 - RNA, 13 nt, Yersinia pestis
acuucgaaagaaa

SEQ ID NO: 2262514 - RNA, 15 nt, Yersinia pestis
acuucgaaagaaaua

SEQ ID NO: 2262515 - RNA, 16 nt, Yersinia pestis
acuucgaaagaaauaa

SEQ ID NO: 2262516 - RNA, 17 nt, Yersinia pestis
acuucgaaagaaauaaa

SEQ ID NO: 2262517 - RNA, 22 nt, Yersinia pestis
acuucgaaagaaauaaaagaaa

SEQ ID NO: 2262518 - RNA, 16 nt, Yersinia pestis
acuucgaugauuauuu

SEQ ID NO: 2262519 - RNA, 23 nt, Yersinia pestis
acuuccgccgccaacagugaaua

SEQ ID NO: 2262520 - RNA, 15 nt, Yersinia pestis
acuucgauucaucau

SEQ ID NO: 2262521 - RNA, 21 nt, Yersinia pestis
acuucgccaggucaggaagag

SEQ ID NO: 2262522 - RNA, 17 nt, Yersinia pestis
acuucgccaggucagga

SEQ ID NO: 2262523 - RNA, 16 nt, Yersinia pestis
acuucgcgaacacaau

SEQ ID NO: 2262524 - RNA, 20 nt, Yersinia pestis
acuucggggcguaaaugaug

SEQ ID NO: 2262525 - RNA, 19 nt, Yersinia pestis
acuucuuauuaaucaagau

SEQ ID NO: 2262526 - RNA, 21 nt, Yersinia pestis
acuucuuucacuaaugaggaa

SEQ ID NO: 2262527 - RNA, 15 nt, Yersinia pestis
acuucuuauuaauca

SEQ ID NO: 2262528 - RNA, 13 nt, Yersinia pestis
acuucggucaaga

SEQ ID NO: 2262529 - RNA, 13 nt, Yersinia pestis
acuucgucugccc

SEQ ID NO: 2262530 - RNA, 15 nt, Yersinia pestis
acuucuacauagaaa

SEQ ID NO: 2262531 - RNA, 14 nt, Yersinia pestis
acuucucugacaca

SEQ ID NO: 2262532 - RNA, 19 nt, Yersinia pestis
acuucucugacacacaaau

SEQ ID NO: 2262533 - RNA, 21 nt, Yersinia pestis
acuucuccuguauuugguuau

SEQ ID NO: 2262534 - RNA, 13 nt, Yersinia pestis
acuucaauaccaa

SEQ ID NO: 2262535 - RNA, 17 nt, Yersinia pestis
acuucaaucacuuuaua

SEQ ID NO: 2262536 - RNA, 22 nt, Yersinia pestis
acuucaaaugacauucuuuggu

SEQ ID NO: 2262537 - RNA, 20 nt, Yersinia pestis
acuucaauguuuuuauccaa

SEQ ID NO: 2262538 - RNA, 12 nt, Yersinia pestis
acuucaggccaa

SEQ ID NO: 2262539 - RNA, 16 nt, Yersinia pestis
acuucaguuacucacu

SEQ ID NO: 2262540 - RNA, 12 nt, Yersinia pestis
acuucauaaaua

SEQ ID NO: 2262541 - RNA, 23 nt, Yersinia pestis
acuucagcucccgccgcaacagu

SEQ ID NO: 2262542 - RNA, 24 nt, Yersinia pestis
acuucaauuuggccauuaaccuaa

SEQ ID NO: 2262543 - RNA, 22 nt, Yersinia pestis
acuuauuacaccuuaaaacagc

SEQ ID NO: 2262544 - RNA, 12 nt, Yersinia pestis
acuuauggguuu

SEQ ID NO: 2262545 - RNA, 16 nt, Yersinia pestis
acuucaaaacuaauau

SEQ ID NO: 2262546 - RNA, 15 nt, Yersinia pestis
acuuauuugaaacac

SEQ ID NO: 2262547 - RNA, 19 nt, Yersinia pestis
acuuagcccuucagcggug

SEQ ID NO: 2262548 - RNA, 14 nt, Yersinia pestis
acuuaucuaaaaaa

SEQ ID NO: 2262549 - RNA, 15 nt, Yersinia pestis
acuuaucuaaaaaac

SEQ ID NO: 2262550 - RNA, 17 nt, Yersinia pestis
acuuaucuaaaaaacca

SEQ ID NO: 2262551 - RNA, 17 nt, Yersinia pestis
acuuaucugagccuuca

SEQ ID NO: 2262552 - RNA, 23 nt, Yersinia pestis
acuuacuguauuaccucacguuu

SEQ ID NO: 2262553 - RNA, 12 nt, Yersinia pestis
acugugccaacc

SEQ ID NO: 2262554 - RNA, 18 nt, Yersinia pestis
acuguucugggggugaua

SEQ ID NO: 2262555 - RNA, 18 nt, Yersinia pestis
acuguugaugcagaugac

SEQ ID NO: 2262556 - RNA, 15 nt, Yersinia pestis
acuggcaggaaaucu

SEQ ID NO: 2262557 - RNA, 18 nt, Yersinia pestis
acugucuauuuuuauaau

SEQ ID NO: 2262558 - RNA, 12 nt, Yersinia pestis
acuggcagauag

SEQ ID NO: 2262559 - RNA, 17 nt, Yersinia pestis
acuggaugagccgcagc

SEQ ID NO: 2262560 - RNA, 16 nt, Yersinia pestis
acuuaauugguuuaua

SEQ ID NO: 2262561 - RNA, 15 nt, Yersinia pestis
acuuacugaucaaua

SEQ ID NO: 2262562 - RNA, 15 nt, Yersinia pestis
acuuaccugaguaag

SEQ ID NO: 2262563 - RNA, 17 nt, Yersinia pestis
acuuacccgaaucacuu

SEQ ID NO: 2262564 - RNA, 18 nt, Yersinia pestis
acuuacccgaaucacuua

SEQ ID NO: 2262565 - RNA, 15 nt, Yersinia pestis
acuuaaaaguaggcu

SEQ ID NO: 2262566 - RNA, 22 nt, Yersinia pestis
acuaauacucuguuaccaaugg

SEQ ID NO: 2262567 - RNA, 15 nt, Yersinia pestis
acuaauagcauuuuu

SEQ ID NO: 2262568 - RNA, 17 nt, Yersinia pestis
acuaauagcauuuuucg

SEQ ID NO: 2262569 - RNA, 15 nt, Yersinia pestis
acuaauaauaauuaa

SEQ ID NO: 2262570 - RNA, 15 nt, Yersinia pestis
acuaauggagagaug

SEQ ID NO: 2262571 - RNA, 13 nt, Yersinia pestis
acuaauguuuguu

SEQ ID NO: 2262572 - RNA, 22 nt, Yersinia pestis
acuaagggcgauagacuuucac

SEQ ID NO: 2262573 - RNA, 21 nt, Yersinia pestis
acuaagcagauggucaacuaa

SEQ ID NO: 2262574 - RNA, 18 nt, Yersinia pestis
acuaagagucacagcauu

SEQ ID NO: 2262575 - RNA, 13 nt, Yersinia pestis
acuaaccucugca

SEQ ID NO: 2262576 - RNA, 18 nt, Yersinia pestis
acuaucaaacucaccauu

SEQ ID NO: 2262577 - RNA, 21 nt, Yersinia pestis
acuauauucucauugcccccu

SEQ ID NO: 2262578 - RNA, 17 nt, Yersinia pestis
acuauaggcuauuuuac

SEQ ID NO: 2262579 - RNA, 21 nt, Yersinia pestis
acuauacccaaguuacuucaa

SEQ ID NO: 2262580 - RNA, 16 nt, Yersinia pestis
acuauuucagacauac

SEQ ID NO: 2262581 - RNA, 21 nt, Yersinia pestis
acuauuucguguauaucacua

SEQ ID NO: 2262582 - RNA, 14 nt, Yersinia pestis
acuauuaauuuuau

SEQ ID NO: 2262583 - RNA, 22 nt, Yersinia pestis
acuauucgcuuuauauccccug

SEQ ID NO: 2262584 - RNA, 12 nt, Yersinia pestis
acuauucugcuu

SEQ ID NO: 2262585 - RNA, 18 nt, Yersinia pestis
acuauuccgucgauaucu

SEQ ID NO: 2262586 - RNA, 16 nt, Yersinia pestis
acuaccaaaauuuaaa

SEQ ID NO: 2262587 - RNA, 23 nt, Yersinia pestis
acuacccuaucgucacagcaauu

SEQ ID NO: 2262588 - RNA, 18 nt, Yersinia pestis
acuaccgaucaucaggca

SEQ ID NO: 2262589 - RNA, 15 nt, Yersinia pestis
acuagccuaacuggc

SEQ ID NO: 2262590 - RNA, 17 nt, Yersinia pestis
acuagccauuuggugau

SEQ ID NO: 2262591 - RNA, 16 nt, Yersinia pestis
acuagcagagcacgca

SEQ ID NO: 2262592 - RNA, 15 nt, Yersinia pestis
acuaaaauaucaaau

SEQ ID NO: 2262593 - RNA, 21 nt, Yersinia pestis
acuaaaaccugcuugaaagca

SEQ ID NO: 2262594 - RNA, 13 nt, Yersinia pestis
acguuuuauucac

SEQ ID NO: 2262595 - RNA, 13 nt, Yersinia pestis
acuaaaccacaua

SEQ ID NO: 2262596 - RNA, 13 nt, Yersinia pestis
acuaaaccuugaa

SEQ ID NO: 2262597 - RNA, 20 nt, Yersinia pestis
acuaaagccgauuuagacaa

SEQ ID NO: 2262598 - RNA, 16 nt, Yersinia pestis
acuaaauaauccagaa

SEQ ID NO: 2262599 - RNA, 15 nt, Yersinia pestis
acuaaauuaaaugca

SEQ ID NO: 2262600 - RNA, 14 nt, Yersinia pestis
acguugccagccau

SEQ ID NO: 2262601 - RNA, 15 nt, Yersinia pestis
acguuggcuucaccu

SEQ ID NO: 2262602 - RNA, 21 nt, Yersinia pestis
acguuguuuucccucagccaa

SEQ ID NO: 2262603 - RNA, 12 nt, Yersinia pestis
acguucugccaa

SEQ ID NO: 2262604 - RNA, 15 nt, Yersinia pestis
acguucagcacugcu

SEQ ID NO: 2262605 - RNA, 13 nt, Yersinia pestis
acguucaaaugau

SEQ ID NO: 2262606 - RNA, 18 nt, Yersinia pestis
acguucaacgaccucauc

SEQ ID NO: 2262607 - RNA, 14 nt, Yersinia pestis
acgugcuauagaaa

SEQ ID NO: 2262608 - RNA, 22 nt, Yersinia pestis
acgugcguuuuugaaauaccac

SEQ ID NO: 2262609 - RNA, 16 nt, Yersinia pestis
acguuauuauugauua

SEQ ID NO: 2262610 - RNA, 18 nt, Yersinia pestis
acguuaucucaaccaguu

SEQ ID NO: 2262611 - RNA, 15 nt, Yersinia pestis
acguuauaacucaag

SEQ ID NO: 2262612 - RNA, 12 nt, Yersinia pestis
acguuagagcac

SEQ ID NO: 2262613 - RNA, 13 nt, Yersinia pestis
acguggaccauuu

SEQ ID NO: 2262614 - RNA, 16 nt, Yersinia pestis
acgugagaauugcugc

SEQ ID NO: 2262615 - RNA, 17 nt, Yersinia pestis
acguagcugaauugcuu

SEQ ID NO: 2262616 - RNA, 17 nt, Yersinia pestis
acgucugcaauagcuca

SEQ ID NO: 2262617 - RNA, 12 nt, Yersinia pestis
acgucugcaucg

SEQ ID NO: 2262618 - RNA, 13 nt, Yersinia pestis
acgccauccacuc

SEQ ID NO: 2262619 - RNA, 18 nt, Yersinia pestis
acgcugaaacuuuucagu

SEQ ID NO: 2262620 - RNA, 21 nt, Yersinia pestis
acgcucgguuguucagcacca

SEQ ID NO: 2262621 - RNA, 15 nt, Yersinia pestis
acgcuguuggguugu

SEQ ID NO: 2262622 - RNA, 16 nt, Yersinia pestis
acgcugaauacacucg

SEQ ID NO: 2262623 - RNA, 15 nt, Yersinia pestis
acgcugauagccaau

SEQ ID NO: 2262624 - RNA, 19 nt, Yersinia pestis
acgcugcaccgcugauaac

SEQ ID NO: 2262625 - RNA, 15 nt, Yersinia pestis
acgcuuuacuccucu

SEQ ID NO: 2262626 - RNA, 20 nt, Yersinia pestis
acgcuuuacuccucugccua

SEQ ID NO: 2262627 - RNA, 23 nt, Yersinia pestis
acgcuuuacuccucugccuaucc

SEQ ID NO: 2262628 - RNA, 23 nt, Yersinia pestis
acgcuuuacucuucagccuaucc

SEQ ID NO: 2262629 - RNA, 22 nt, Yersinia pestis
acgcuuuaaaacuguggcugaa

SEQ ID NO: 2262630 - RNA, 19 nt, Yersinia pestis
acgcuugauggccacacug

SEQ ID NO: 2262631 - RNA, 22 nt, Yersinia pestis
acgcuuucaggagugaauuucu

SEQ ID NO: 2262632 - RNA, 15 nt, Yersinia pestis
acggaacucaucuuu

SEQ ID NO: 2262633 - RNA, 14 nt, Yersinia pestis
acggaucacgcugu

SEQ ID NO: 2262634 - RNA, 19 nt, Yersinia pestis
acggacuaauacggguuuc

SEQ ID NO: 2262635 - RNA, 17 nt, Yersinia pestis
acggacaguugugucag

SEQ ID NO: 2262636 - RNA, 21 nt, Yersinia pestis
acggacacauaaguguauucg

SEQ ID NO: 2262637 - RNA, 18 nt, Yersinia pestis
acggacauuuuacucccu

SEQ ID NO: 2262638 - RNA, 19 nt, Yersinia pestis
acggacauuuuacucccug

SEQ ID NO: 2262639 - RNA, 15 nt, Yersinia pestis
acggagaauaaaaau

SEQ ID NO: 2262640 - RNA, 18 nt, Yersinia pestis
acggagcguacacgcagu

SEQ ID NO: 2262641 - RNA, 14 nt, Yersinia pestis
acggcucaggugcu

SEQ ID NO: 2262642 - RNA, 22 nt, Yersinia pestis
acggcucaucgcuaaccgccag

SEQ ID NO: 2262643 - RNA, 18 nt, Yersinia pestis
acgggcggaauacgccag

SEQ ID NO: 2262644 - RNA, 19 nt, Yersinia pestis
acgggccgcauucaccacc

SEQ ID NO: 2262645 - RNA, 14 nt, Yersinia pestis
acggcguuugacaa

SEQ ID NO: 2262646 - RNA, 16 nt, Yersinia pestis
acggcguuugacaaua

SEQ ID NO: 2262647 - RNA, 15 nt, Yersinia pestis
acggcgucuuuacga

SEQ ID NO: 2262648 - RNA, 22 nt, Yersinia pestis
acggcgucuuuacgaucugccu

SEQ ID NO: 2262649 - RNA, 20 nt, Yersinia pestis
acggcgcagggcgauaucca

SEQ ID NO: 2262650 - RNA, 13 nt, Yersinia pestis
acguacuaucuau

SEQ ID NO: 2262651 - RNA, 15 nt, Yersinia pestis
acguagacauaaauu

SEQ ID NO: 2262652 - RNA, 19 nt, Yersinia pestis
acguaauauguauuuagga

SEQ ID NO: 2262653 - RNA, 20 nt, Yersinia pestis
acgguuugaucaacaugggu

SEQ ID NO: 2262654 - RNA, 15 nt, Yersinia pestis
acgguaaggccgcga

SEQ ID NO: 2262655 - RNA, 16 nt, Yersinia pestis
acgguggcccucugcc

SEQ ID NO: 2262656 - RNA, 16 nt, Yersinia pestis
acgguaccgcagguca

SEQ ID NO: 2262657 - RNA, 15 nt, Yersinia pestis
acggugaggauaggc

SEQ ID NO: 2262658 - RNA, 15 nt, Yersinia pestis
accucuucagguaag

SEQ ID NO: 2262659 - RNA, 24 nt, Yersinia pestis
accucuuccucgccguagcauuca

SEQ ID NO: 2262660 - RNA, 13 nt, Yersinia pestis
accucucgccggu

SEQ ID NO: 2262661 - RNA, 19 nt, Yersinia pestis
accucugcaaugcccagag

SEQ ID NO: 2262662 - RNA, 21 nt, Yersinia pestis
accucugcgaagccgcugcaa

SEQ ID NO: 2262663 - RNA, 16 nt, Yersinia pestis
accugaaccugacgca

SEQ ID NO: 2262664 - RNA, 14 nt, Yersinia pestis
accugacuguggcu

SEQ ID NO: 2262665 - RNA, 24 nt, Yersinia pestis
accugaaucgauaaacccgugcuc

SEQ ID NO: 2262666 - RNA, 15 nt, Yersinia pestis
accugaaugccauuc

SEQ ID NO: 2262667 - RNA, 18 nt, Yersinia pestis
accucuaaucuccucucc

SEQ ID NO: 2262668 - RNA, 14 nt, Yersinia pestis
accucguuggcuac

SEQ ID NO: 2262669 - RNA, 16 nt, Yersinia pestis
accucgcccuuucuug

SEQ ID NO: 2262670 - RNA, 18 nt, Yersinia pestis
accucgcccuuucuuguu

SEQ ID NO: 2262671 - RNA, 21 nt, Yersinia pestis
accuaucgccgccgccagccc

SEQ ID NO: 2262672 - RNA, 16 nt, Yersinia pestis
accuaguagauaauca

SEQ ID NO: 2262673 - RNA, 18 nt, Yersinia pestis
accuauaauuaacagcau

SEQ ID NO: 2262674 - RNA, 16 nt, Yersinia pestis
accuagguucuggacu

SEQ ID NO: 2262675 - RNA, 23 nt, Yersinia pestis
accggucgcguaccuucacauuu

SEQ ID NO: 2262676 - RNA, 18 nt, Yersinia pestis
accggugacguuggaucc

SEQ ID NO: 2262677 - RNA, 15 nt, Yersinia pestis
accuccguaggccaa

SEQ ID NO: 2262678 - RNA, 19 nt, Yersinia pestis
accuccggggccugcggcc

SEQ ID NO: 2262679 - RNA, 17 nt, Yersinia pestis
accucgaaaucauccgc

SEQ ID NO: 2262680 - RNA, 21 nt, Yersinia pestis
accucgaagggauaucucacc

SEQ ID NO: 2262681 - RNA, 16 nt, Yersinia pestis
accucaccucugcgaa

SEQ ID NO: 2262682 - RNA, 23 nt, Yersinia pestis
accucaccucugcgaagccgcug

SEQ ID NO: 2262683 - RNA, 22 nt, Yersinia pestis
accucaccguuaauggcaccau

SEQ ID NO: 2262684 - RNA, 19 nt, Yersinia pestis
accucaaccugccagccug

SEQ ID NO: 2262685 - RNA, 18 nt, Yersinia pestis
accucacacgauuuuuac

SEQ ID NO: 2262686 - RNA, 17 nt, Yersinia pestis
accugaggauaaaaacu

SEQ ID NO: 2262687 - RNA, 13 nt, Yersinia pestis
accugagccaauc

SEQ ID NO: 2262688 - RNA, 16 nt, Yersinia pestis
accugaucgugccauu

SEQ ID NO: 2262689 - RNA, 20 nt, Yersinia pestis
accuguuuuuguuguucuug

SEQ ID NO: 2262690 - RNA, 22 nt, Yersinia pestis
accuguucccguucagccucug

SEQ ID NO: 2262691 - RNA, 17 nt, Yersinia pestis
accugguuaucggccau

SEQ ID NO: 2262692 - RNA, 15 nt, Yersinia pestis
accuucccauccuag

SEQ ID NO: 2262693 - RNA, 19 nt, Yersinia pestis
accuucccguccacuuuca

SEQ ID NO: 2262694 - RNA, 20 nt, Yersinia pestis
accuucccguccacuuucac

SEQ ID NO: 2262695 - RNA, 20 nt, Yersinia pestis
accuuccgucccaagaaaag

SEQ ID NO: 2262696 - RNA, 22 nt, Yersinia pestis
accuuccgucccaagaaaagca

SEQ ID NO: 2262697 - RNA, 18 nt, Yersinia pestis
accuuccgucccaagaaa

SEQ ID NO: 2262698 - RNA, 20 nt, Yersinia pestis
accuuauuggcccuuuuugc

SEQ ID NO: 2262699 - RNA, 23 nt, Yersinia pestis
accuuauuuuugcauauaaaaca

SEQ ID NO: 2262700 - RNA, 13 nt, Yersinia pestis
accuuaucaccaa

SEQ ID NO: 2262701 - RNA, 22 nt, Yersinia pestis
accuuacuucaaaacuaauauu

SEQ ID NO: 2262702 - RNA, 21 nt, Yersinia pestis
accuuauauaacuagcaagga

SEQ ID NO: 2262703 - RNA, 14 nt, Yersinia pestis
accuuacugcauca

SEQ ID NO: 2262704 - RNA, 22 nt, Yersinia pestis
accuguuuuuguuguucuugau

SEQ ID NO: 2262705 - RNA, 16 nt, Yersinia pestis
accuuaaccaacauga

SEQ ID NO: 2262706 - RNA, 16 nt, Yersinia pestis
accuuaaguaaguuua

SEQ ID NO: 2262707 - RNA, 22 nt, Yersinia pestis
accuugauuaauaacaguaaua

SEQ ID NO: 2262708 - RNA, 14 nt, Yersinia pestis
accuucgagagcua

SEQ ID NO: 2262709 - RNA, 19 nt, Yersinia pestis
accuuuacaauuacacacc

SEQ ID NO: 2262710 - RNA, 16 nt, Yersinia pestis
acgaacagccccaacc

SEQ ID NO: 2262711 - RNA, 18 nt, Yersinia pestis
acgaacagugccaacagc

SEQ ID NO: 2262712 - RNA, 22 nt, Yersinia pestis
acgaacagugccaacagcgaga

SEQ ID NO: 2262713 - RNA, 23 nt, Yersinia pestis
acgaaaugucgaaagauagcaaa

SEQ ID NO: 2262714 - RNA, 23 nt, Yersinia pestis
acgaacagugccaacagcgagau

SEQ ID NO: 2262715 - RNA, 13 nt, Yersinia pestis
acgaaauacuuau

SEQ ID NO: 2262716 - RNA, 14 nt, Yersinia pestis
acgaaaaccuaaua

SEQ ID NO: 2262717 - RNA, 20 nt, Yersinia pestis
acgaguaaaaagauggccuc

SEQ ID NO: 2262718 - RNA, 21 nt, Yersinia pestis
acgaggacuuccugcccagcg

SEQ ID NO: 2262719 - RNA, 17 nt, Yersinia pestis
acgagagaucguaggcu

SEQ ID NO: 2262720 - RNA, 23 nt, Yersinia pestis
acgagcuucaccuuuguguugaa

SEQ ID NO: 2262721 - RNA, 16 nt, Yersinia pestis
acgauagccagugaca

SEQ ID NO: 2262722 - RNA, 14 nt, Yersinia pestis
acgaucaguggcac

SEQ ID NO: 2262723 - RNA, 14 nt, Yersinia pestis
acgaucauuauaua

SEQ ID NO: 2262724 - RNA, 16 nt, Yersinia pestis
acgaguaaauagcaaa

SEQ ID NO: 2262725 - RNA, 16 nt, Yersinia pestis
acgauacgacuucuua

SEQ ID NO: 2262726 - RNA, 14 nt, Yersinia pestis
acgacuuuuccaca

SEQ ID NO: 2262727 - RNA, 17 nt, Yersinia pestis
acgaucuuguucaccaa

SEQ ID NO: 2262728 - RNA, 20 nt, Yersinia pestis
acgaucugccuguucucucc

SEQ ID NO: 2262729 - RNA, 15 nt, Yersinia pestis
acgauccugccagac

SEQ ID NO: 2262730 - RNA, 19 nt, Yersinia pestis
acgauuguuacgccuucag

SEQ ID NO: 2262731 - RNA, 22 nt, Yersinia pestis
acgauugcacuggcuaauacca

SEQ ID NO: 2262732 - RNA, 15 nt, Yersinia pestis
acgauuauuaaacua

SEQ ID NO: 2262733 - RNA, 17 nt, Yersinia pestis
acgauuaccugcauauc

SEQ ID NO: 2262734 - RNA, 20 nt, Yersinia pestis
acgauuaccugcauauccuc

SEQ ID NO: 2262735 - RNA, 17 nt, Yersinia pestis
acgcaaagggcaacaau

SEQ ID NO: 2262736 - RNA, 20 nt, Yersinia pestis
acgcaaagggcaacaauaua

SEQ ID NO: 2262737 - RNA, 16 nt, Yersinia pestis
acgcaaacggguggcc

SEQ ID NO: 2262738 - RNA, 15 nt, Yersinia pestis
acgcaaaccccgaac

SEQ ID NO: 2262739 - RNA, 17 nt, Yersinia pestis
acgccaaguaugcaggc

SEQ ID NO: 2262740 - RNA, 17 nt, Yersinia pestis
acgccaccagcgccaug

SEQ ID NO: 2262741 - RNA, 19 nt, Yersinia pestis
acgccaguaaacagccagc

SEQ ID NO: 2262742 - RNA, 22 nt, Yersinia pestis
acgccaguaaacagccagcauc

SEQ ID NO: 2262743 - RNA, 16 nt, Yersinia pestis
acgccagccucugcgc

SEQ ID NO: 2262744 - RNA, 19 nt, Yersinia pestis
acgccacuacgaccccaac

SEQ ID NO: 2262745 - RNA, 15 nt, Yersinia pestis
acgcaguacgugacg

SEQ ID NO: 2262746 - RNA, 22 nt, Yersinia pestis
acgcauuacucucgccaaacaa

SEQ ID NO: 2262747 - RNA, 21 nt, Yersinia pestis
acgcacacgaaucaggcggcu

SEQ ID NO: 2262748 - RNA, 16 nt, Yersinia pestis
acgcaccauccagcaa

SEQ ID NO: 2262749 - RNA, 15 nt, Yersinia pestis
acgcaauaucaaaac

SEQ ID NO: 2262750 - RNA, 17 nt, Yersinia pestis
acgcaaguaaaagucag

SEQ ID NO: 2262751 - RNA, 22 nt, Yersinia pestis
acgcaacacagucgcacugaua

SEQ ID NO: 2262752 - RNA, 22 nt, Yersinia pestis
acgcagcuccagcgucacuuca

SEQ ID NO: 2262753 - RNA, 19 nt, Yersinia pestis
acgcaggcacugcagaaaa

SEQ ID NO: 2262754 - RNA, 14 nt, Yersinia pestis
acgcagagaugaau

SEQ ID NO: 2262755 - RNA, 23 nt, Yersinia pestis
accgccugugacgcuugaauaua

SEQ ID NO: 2262756 - RNA, 13 nt, Yersinia pestis
accgcgcaggagc

SEQ ID NO: 2262757 - RNA, 12 nt, Yersinia pestis
accgcugauaac

SEQ ID NO: 2262758 - RNA, 20 nt, Yersinia pestis
accgcugauaaccagccaac

SEQ ID NO: 2262759 - RNA, 16 nt, Yersinia pestis
accgcgcucugcuggg

SEQ ID NO: 2262760 - RNA, 23 nt, Yersinia pestis
accgcuguaaaugcgugguaaac

SEQ ID NO: 2262761 - RNA, 21 nt, Yersinia pestis
accggauaaaacaauagcuga

SEQ ID NO: 2262762 - RNA, 12 nt, Yersinia pestis
accggauacaaa

SEQ ID NO: 2262763 - RNA, 21 nt, Yersinia pestis
accgcugcuaccagcagugca

SEQ ID NO: 2262764 - RNA, 15 nt, Yersinia pestis
accgcugcccggcuc

SEQ ID NO: 2262765 - RNA, 21 nt, Yersinia pestis
accggcaacugccgcuucagu

SEQ ID NO: 2262766 - RNA, 12 nt, Yersinia pestis
accggcaccaau

SEQ ID NO: 2262767 - RNA, 21 nt, Yersinia pestis
accggcugauguucugccaac

SEQ ID NO: 2262768 - RNA, 19 nt, Yersinia pestis
accggcuaauaccaggcug

SEQ ID NO: 2262769 - RNA, 16 nt, Yersinia pestis
accggcuccugccgca

SEQ ID NO: 2262770 - RNA, 23 nt, Yersinia pestis
accggcgguuaucacaucaucca

SEQ ID NO: 2262771 - RNA, 13 nt, Yersinia pestis
accgcaccacgau

SEQ ID NO: 2262772 - RNA, 18 nt, Yersinia pestis
accgaugagugaaaucuc

SEQ ID NO: 2262773 - RNA, 16 nt, Yersinia pestis
accgaucacuauauac

SEQ ID NO: 2262774 - RNA, 23 nt, Yersinia pestis
acccguugcauuuuucuguucag

SEQ ID NO: 2262775 - RNA, 17 nt, Yersinia pestis
acccguugcaaggccuc

SEQ ID NO: 2262776 - RNA, 22 nt, Yersinia pestis
acccuccaauaauucgugaaaa

SEQ ID NO: 2262777 - RNA, 21 nt, Yersinia pestis
acccugaaggcugauuaauau

SEQ ID NO: 2262778 - RNA, 16 nt, Yersinia pestis
accgcagucgauaaac

SEQ ID NO: 2262779 - RNA, 16 nt, Yersinia pestis
accgcagauaaaagaa

SEQ ID NO: 2262780 - RNA, 14 nt, Yersinia pestis
accgcauucccugc

SEQ ID NO: 2262781 - RNA, 13 nt, Yersinia pestis
accgccaaaucca

SEQ ID NO: 2262782 - RNA, 14 nt, Yersinia pestis
accgccaaaugaaa

SEQ ID NO: 2262783 - RNA, 15 nt, Yersinia pestis
accgccaaauacaaa

SEQ ID NO: 2262784 - RNA, 13 nt, Yersinia pestis
accgcauuuucaa

SEQ ID NO: 2262785 - RNA, 17 nt, Yersinia pestis
accgccacagcaacagg

SEQ ID NO: 2262786 - RNA, 22 nt, Yersinia pestis
accgccagugccgcggcggcca

SEQ ID NO: 2262787 - RNA, 12 nt, Yersinia pestis
accgcccucuug

SEQ ID NO: 2262788 - RNA, 20 nt, Yersinia pestis
accgccgcaacaauaaagcg

SEQ ID NO: 2262789 - RNA, 20 nt, Yersinia pestis
accgcccccuccaauaacua

SEQ ID NO: 2262790 - RNA, 21 nt, Yersinia pestis
accauuugcccuggagcaaga

SEQ ID NO: 2262791 - RNA, 14 nt, Yersinia pestis
acccaaaggcuggc

SEQ ID NO: 2262792 - RNA, 15 nt, Yersinia pestis
acccaaccccaucag

SEQ ID NO: 2262793 - RNA, 22 nt, Yersinia pestis
acccaacaguaccuucuaucgu

SEQ ID NO: 2262794 - RNA, 17 nt, Yersinia pestis
acccaacaguaccuucu

SEQ ID NO: 2262795 - RNA, 17 nt, Yersinia pestis
acccacaccgcagcagu

SEQ ID NO: 2262796 - RNA, 13 nt, Yersinia pestis
acccaacuuuuuu

SEQ ID NO: 2262797 - RNA, 22 nt, Yersinia pestis
acccaacuuuuuuaccacauuu

SEQ ID NO: 2262798 - RNA, 19 nt, Yersinia pestis
acccaagggcuauugcugu

SEQ ID NO: 2262799 - RNA, 19 nt, Yersinia pestis
acccaauaaccccgugcca

SEQ ID NO: 2262800 - RNA, 16 nt, Yersinia pestis
accauugauaauaaua

SEQ ID NO: 2262801 - RNA, 14 nt, Yersinia pestis
accauuaacaaugu

SEQ ID NO: 2262802 - RNA, 16 nt, Yersinia pestis
accauguucuggcaga

SEQ ID NO: 2262803 - RNA, 12 nt, Yersinia pestis
accauguccaug

SEQ ID NO: 2262804 - RNA, 14 nt, Yersinia pestis
accauucagccacu

SEQ ID NO: 2262805 - RNA, 16 nt, Yersinia pestis
accauuccgccaacag

SEQ ID NO: 2262806 - RNA, 13 nt, Yersinia pestis
accaugccuucug

SEQ ID NO: 2262807 - RNA, 22 nt, Yersinia pestis
accaugcgauacgcccgcccca

SEQ ID NO: 2262808 - RNA, 21 nt, Yersinia pestis
accaugcugcuugauuugcug

SEQ ID NO: 2262809 - RNA, 14 nt, Yersinia pestis
accauggcaggucu

SEQ ID NO: 2262810 - RNA, 24 nt, Yersinia pestis
accaugcuuauugccaugcuuguc

SEQ ID NO: 2262811 - RNA, 16 nt, Yersinia pestis
accaugagugaaaaua

SEQ ID NO: 2262812 - RNA, 20 nt, Yersinia pestis
accauccgacugcagaaaau

SEQ ID NO: 2262813 - RNA, 20 nt, Yersinia pestis
accaucacggucaugcggcc

SEQ ID NO: 2262814 - RNA, 18 nt, Yersinia pestis
accaucacucugcuacug

SEQ ID NO: 2262815 - RNA, 12 nt, Yersinia pestis
accauccagugc

SEQ ID NO: 2262816 - RNA, 19 nt, Yersinia pestis
accaucagguguuguauaa

SEQ ID NO: 2262817 - RNA, 16 nt, Yersinia pestis
accauccccagaacag

SEQ ID NO: 2262818 - RNA, 17 nt, Yersinia pestis
accauccccagaacagc

SEQ ID NO: 2262819 - RNA, 20 nt, Yersinia pestis
accauccccugucuugccag

SEQ ID NO: 2262820 - RNA, 12 nt, Yersinia pestis
accaucaccauc

SEQ ID NO: 2262821 - RNA, 22 nt, Yersinia pestis
accaucaaauacacauaaccau

SEQ ID NO: 2262822 - RNA, 14 nt, Yersinia pestis
accaucaacucagg

SEQ ID NO: 2262823 - RNA, 17 nt, Yersinia pestis
accaucaaggacuucau

SEQ ID NO: 2262824 - RNA, 19 nt, Yersinia pestis
accaucaauauaagagaaa

SEQ ID NO: 2262825 - RNA, 22 nt, Yersinia pestis
accauacagcagucaaaaugaa

SEQ ID NO: 2262826 - RNA, 13 nt, Yersinia pestis
accauacagcagu

SEQ ID NO: 2262827 - RNA, 13 nt, Yersinia pestis
accauagagcaac

SEQ ID NO: 2262828 - RNA, 21 nt, Yersinia pestis
accauagagcaaccguuacaa

SEQ ID NO: 2262829 - RNA, 14 nt, Yersinia pestis
accagaaaguuuaa

SEQ ID NO: 2262830 - RNA, 17 nt, Yersinia pestis
acccgcgcagccuaaaa

SEQ ID NO: 2262831 - RNA, 16 nt, Yersinia pestis
acccgcgggagucagu

SEQ ID NO: 2262832 - RNA, 18 nt, Yersinia pestis
acccgcuaauucaccaau

SEQ ID NO: 2262833 - RNA, 22 nt, Yersinia pestis
accccuucaccgggaucuauca

SEQ ID NO: 2262834 - RNA, 16 nt, Yersinia pestis
accccugucuuauuuu

SEQ ID NO: 2262835 - RNA, 18 nt, Yersinia pestis
accccugucuuauuuuuu

SEQ ID NO: 2262836 - RNA, 18 nt, Yersinia pestis
accccuucgagcaccgcg

SEQ ID NO: 2262837 - RNA, 14 nt, Yersinia pestis
accccuuggcucuc

SEQ ID NO: 2262838 - RNA, 16 nt, Yersinia pestis
acccgccucuaaaucu

SEQ ID NO: 2262839 - RNA, 23 nt, Yersinia pestis
acccggccuugcccaucaaccac

SEQ ID NO: 2262840 - RNA, 19 nt, Yersinia pestis
acccgucauccuucaaguu

SEQ ID NO: 2262841 - RNA, 15 nt, Yersinia pestis
acccgcuguuucucu

SEQ ID NO: 2262842 - RNA, 19 nt, Yersinia pestis
acccgcucugucagcccua

SEQ ID NO: 2262843 - RNA, 17 nt, Yersinia pestis
acccgcuugucuugaaa

SEQ ID NO: 2262844 - RNA, 20 nt, Yersinia pestis
acccgcuucguccgcuuagc

SEQ ID NO: 2262845 - RNA, 20 nt, Yersinia pestis
acccauauuggcaauauuca

SEQ ID NO: 2262846 - RNA, 14 nt, Yersinia pestis
acccacauucaggc

SEQ ID NO: 2262847 - RNA, 22 nt, Yersinia pestis
acccacaucccggcagcaguug

SEQ ID NO: 2262848 - RNA, 14 nt, Yersinia pestis
accccacaaccugc

SEQ ID NO: 2262849 - RNA, 23 nt, Yersinia pestis
accccaauucuuaggucaucguc

SEQ ID NO: 2262850 - RNA, 19 nt, Yersinia pestis
accccacaaccugcgccac

SEQ ID NO: 2262851 - RNA, 16 nt, Yersinia pestis
accccagcaaagccaa

SEQ ID NO: 2262852 - RNA, 19 nt, Yersinia pestis
acccauggagauugccuca

SEQ ID NO: 2262853 - RNA, 14 nt, Yersinia pestis
accccauugcacca

SEQ ID NO: 2262854 - RNA, 22 nt, Yersinia pestis
accccagucacugacuuguugu

SEQ ID NO: 2262855 - RNA, 19 nt, Yersinia pestis
accccgcguugucagccau

SEQ ID NO: 2262856 - RNA, 12 nt, Yersinia pestis
accccccaccau

SEQ ID NO: 2262857 - RNA, 23 nt, Yersinia pestis
agaaaggacaguaauauuuucau

SEQ ID NO: 2262858 - RNA, 14 nt, Yersinia pestis
agaaaggauuugaa

SEQ ID NO: 2262859 - RNA, 23 nt, Yersinia pestis
agaaagguaugugccaaaaaaag

SEQ ID NO: 2262860 - RNA, 21 nt, Yersinia pestis
agaaagguaugugccaaaaaa

SEQ ID NO: 2262861 - RNA, 15 nt, Yersinia pestis
agaaagugacacauu

SEQ ID NO: 2262862 - RNA, 13 nt, Yersinia pestis
agaaauaaaagaa

SEQ ID NO: 2262863 - RNA, 13 nt, Yersinia pestis
agaaauaaaaacc

SEQ ID NO: 2262864 - RNA, 13 nt, Yersinia pestis
agaaauaaauuca

SEQ ID NO: 2262865 - RNA, 14 nt, Yersinia pestis
agaaauaaauucau

SEQ ID NO: 2262866 - RNA, 15 nt, Yersinia pestis
agaaauaaguugaac

SEQ ID NO: 2262867 - RNA, 24 nt, Yersinia pestis
agaaacccguauuaguccguagaa

SEQ ID NO: 2262868 - RNA, 19 nt, Yersinia pestis
acuugauuaacaucgccac

SEQ ID NO: 2262869 - RNA, 14 nt, Yersinia pestis
acuugauucaccag

SEQ ID NO: 2262870 - RNA, 18 nt, Yersinia pestis
agaaaacaaucuggcagc

SEQ ID NO: 2262871 - RNA, 16 nt, Yersinia pestis
agaaacagcagguggu

SEQ ID NO: 2262872 - RNA, 16 nt, Yersinia pestis
agaaacauuaaaccca

SEQ ID NO: 2262873 - RNA, 16 nt, Yersinia pestis
agaagcguaaagcacc

SEQ ID NO: 2262874 - RNA, 21 nt, Yersinia pestis
agaagcguaaagcacccacac

SEQ ID NO: 2262875 - RNA, 18 nt, Yersinia pestis
agaaggcgaguuucucug

SEQ ID NO: 2262876 - RNA, 14 nt, Yersinia pestis
agaaggaauuucac

SEQ ID NO: 2262877 - RNA, 15 nt, Yersinia pestis
agaacugauuucagg

SEQ ID NO: 2262878 - RNA, 12 nt, Yersinia pestis
agaacuggcugg

SEQ ID NO: 2262879 - RNA, 20 nt, Yersinia pestis
agaaccggggcgauacacca

SEQ ID NO: 2262880 - RNA, 21 nt, Yersinia pestis
agaacaggcagaucguaaaga

SEQ ID NO: 2262881 - RNA, 21 nt, Yersinia pestis
agaacagguuuuuuccccaug

SEQ ID NO: 2262882 - RNA, 22 nt, Yersinia pestis
agaaccgacaagcgcugcgcca

SEQ ID NO: 2262883 - RNA, 16 nt, Yersinia pestis
agaacaucugccaggc

SEQ ID NO: 2262884 - RNA, 22 nt, Yersinia pestis
agaaccccccaccaucaacaua

SEQ ID NO: 2262885 - RNA, 20 nt, Yersinia pestis
agaacccccgcgaacagcag

SEQ ID NO: 2262886 - RNA, 21 nt, Yersinia pestis
agaacccccgcgaacagcaga

SEQ ID NO: 2262887 - RNA, 12 nt, Yersinia pestis
agaacacuguua

SEQ ID NO: 2262888 - RNA, 16 nt, Yersinia pestis
agaaauauaacugcga

SEQ ID NO: 2262889 - RNA, 21 nt, Yersinia pestis
aaaacaauuucgaaaacucaa

SEQ ID NO: 2262890 - RNA, 15 nt, Yersinia pestis
agaauccacauaaaa

SEQ ID NO: 2262891 - RNA, 20 nt, Yersinia pestis
agaauccacauaaaaagaaa

SEQ ID NO: 2262892 - RNA, 15 nt, Yersinia pestis
agaaggcuagucugu

SEQ ID NO: 2262893 - RNA, 14 nt, Yersinia pestis
agaagguuaaauuu

SEQ ID NO: 2262894 - RNA, 14 nt, Yersinia pestis
agaagguaagccag

SEQ ID NO: 2262895 - RNA, 16 nt, Yersinia pestis
agaagguuuaguuggc

SEQ ID NO: 2262896 - RNA, 14 nt, Yersinia pestis
agaaguagaaugag

SEQ ID NO: 2262897 - RNA, 21 nt, Yersinia pestis
agaauugcagauaccacauca

SEQ ID NO: 2262898 - RNA, 19 nt, Yersinia pestis
agaauuaaggaaacucaug

SEQ ID NO: 2262899 - RNA, 22 nt, Yersinia pestis
agaaugucaugguuaaacugac

SEQ ID NO: 2262900 - RNA, 14 nt, Yersinia pestis
agacaacucuucua

SEQ ID NO: 2262901 - RNA, 17 nt, Yersinia pestis
agacaagagcaauggcg

SEQ ID NO: 2262902 - RNA, 22 nt, Yersinia pestis
agacaaccacccgacaucaaga

SEQ ID NO: 2262903 - RNA, 11 nt, Yersinia pestis
agaauuuugca

SEQ ID NO: 2262904 - RNA, 23 nt, Yersinia pestis
agaauuuucucauuaauaaugau

SEQ ID NO: 2262905 - RNA, 14 nt, Yersinia pestis
agacaaacaaccua

SEQ ID NO: 2262906 - RNA, 17 nt, Yersinia pestis
agacaauuaacacuuau

SEQ ID NO: 2262907 - RNA, 16 nt, Yersinia pestis
agacacaagauaaaua

SEQ ID NO: 2262908 - RNA, 14 nt, Yersinia pestis
agacacagcaacaa

SEQ ID NO: 2262909 - RNA, 13 nt, Yersinia pestis
agacacaagauaa

SEQ ID NO: 2262910 - RNA, 14 nt, Yersinia pestis
agacagcaguuaau

SEQ ID NO: 2262911 - RNA, 18 nt, Yersinia pestis
agacagcaguuaaugcuu

SEQ ID NO: 2262912 - RNA, 17 nt, Yersinia pestis
agacacugacaucauca

SEQ ID NO: 2262913 - RNA, 23 nt, Yersinia pestis
agacacuaaccagacgcaaccaa

SEQ ID NO: 2262914 - RNA, 15 nt, Yersinia pestis
aaaacagcaacacca

SEQ ID NO: 2262915 - RNA, 19 nt, Yersinia pestis
aaaacagcagccaccaaaa

SEQ ID NO: 2262916 - RNA, 20 nt, Yersinia pestis
aaaacagcagccaccaaaaa

SEQ ID NO: 2262917 - RNA, 22 nt, Yersinia pestis
aaaacagcgaucuauucucugu

SEQ ID NO: 2262918 - RNA, 20 nt, Yersinia pestis
aaaacaggcgaguuucccuu

SEQ ID NO: 2262919 - RNA, 13 nt, Yersinia pestis
agacaugauuaaa

SEQ ID NO: 2262920 - RNA, 13 nt, Yersinia pestis
agacaguaacuaa

SEQ ID NO: 2262921 - RNA, 20 nt, Yersinia pestis
agacagggggauaaaaaccc

SEQ ID NO: 2262922 - RNA, 20 nt, Yersinia pestis
agacauauuguccaacaucu

SEQ ID NO: 2262923 - RNA, 16 nt, Yersinia pestis
agacauaucacaguua

SEQ ID NO: 2262924 - RNA, 12 nt, Yersinia pestis
agacauaaugcc

SEQ ID NO: 2262925 - RNA, 22 nt, Yersinia pestis
agacauaaagcccgcuucaaag

SEQ ID NO: 2262926 - RNA, 20 nt, Yersinia pestis
agaccaaauagcaagccaaa

SEQ ID NO: 2262927 - RNA, 14 nt, Yersinia pestis
agaccacagauaaa

SEQ ID NO: 2262928 - RNA, 13 nt, Yersinia pestis
agaccaccaacuc

SEQ ID NO: 2262929 - RNA, 16 nt, Yersinia pestis
agaccagauaaucgcc

SEQ ID NO: 2262930 - RNA, 15 nt, Yersinia pestis
agagaucguaggcuu

SEQ ID NO: 2262931 - RNA, 22 nt, Yersinia pestis
agagaucauguaguacuuaccu

SEQ ID NO: 2262932 - RNA, 19 nt, Yersinia pestis
agagaucccgugccagauc

SEQ ID NO: 2262933 - RNA, 18 nt, Yersinia pestis
agagcacaacggaaggcc

SEQ ID NO: 2262934 - RNA, 19 nt, Yersinia pestis
agacuaaacgcuaccauga

SEQ ID NO: 2262935 - RNA, 23 nt, Yersinia pestis
agacguccauaaucuggaagcgc

SEQ ID NO: 2262936 - RNA, 15 nt, Yersinia pestis
agacgucauaaauau

SEQ ID NO: 2262937 - RNA, 22 nt, Yersinia pestis
agacgugcguuuuugaaauacc

SEQ ID NO: 2262938 - RNA, 12 nt, Yersinia pestis
agagcauaaccc

SEQ ID NO: 2262939 - RNA, 20 nt, Yersinia pestis
agagcauagacgaaggcacg

SEQ ID NO: 2262940 - RNA, 23 nt, Yersinia pestis
agagccucuauuaccucaauacg

SEQ ID NO: 2262941 - RNA, 18 nt, Yersinia pestis
agagccugaaucugaaug

SEQ ID NO: 2262942 - RNA, 16 nt, Yersinia pestis
agagccuuauaggcgc

SEQ ID NO: 2262943 - RNA, 23 nt, Yersinia pestis
agagccuuauaggcgcauaugaa

SEQ ID NO: 2262944 - RNA, 14 nt, Yersinia pestis
agagcgacucaaua

SEQ ID NO: 2262945 - RNA, 22 nt, Yersinia pestis
agagcgauugacugaaugugaa

SEQ ID NO: 2262946 - RNA, 18 nt, Yersinia pestis
agagcgauugacugaaug

SEQ ID NO: 2262947 - RNA, 16 nt, Yersinia pestis
agagcgauugacugaa

SEQ ID NO: 2262948 - RNA, 13 nt, Yersinia pestis
agaggaaauaaau

SEQ ID NO: 2262949 - RNA, 14 nt, Yersinia pestis
agaggcaaugauuu

SEQ ID NO: 2262950 - RNA, 16 nt, Yersinia pestis
agaguaacggaggggc

SEQ ID NO: 2262951 - RNA, 13 nt, Yersinia pestis
agagguuacgaug

SEQ ID NO: 2262952 - RNA, 16 nt, Yersinia pestis
agagguuaaauuguuc

SEQ ID NO: 2262953 - RNA, 23 nt, Yersinia pestis
agaggcugaaggcgcuccccugc

SEQ ID NO: 2262954 - RNA, 22 nt, Yersinia pestis
agauaugcauuauugauguuau

SEQ ID NO: 2262955 - RNA, 21 nt, Yersinia pestis
agauaucuuugaguugcguua

SEQ ID NO: 2262956 - RNA, 15 nt, Yersinia pestis
agauaugaucaaaaa

SEQ ID NO: 2262957 - RNA, 19 nt, Yersinia pestis
agauaugccaggcaucauc

SEQ ID NO: 2262958 - RNA, 15 nt, Yersinia pestis
agauauuacuucuuu

SEQ ID NO: 2262959 - RNA, 22 nt, Yersinia pestis
agauagcgaaucacaucauuca

SEQ ID NO: 2262960 - RNA, 14 nt, Yersinia pestis
agauagcaucaucc

SEQ ID NO: 2262961 - RNA, 16 nt, Yersinia pestis
agauagccggauuauu

SEQ ID NO: 2262962 - RNA, 21 nt, Yersinia pestis
agauaucgaaacacauacaaa

SEQ ID NO: 2262963 - RNA, 20 nt, Yersinia pestis
agauccuccauauccucaag

SEQ ID NO: 2262964 - RNA, 23 nt, Yersinia pestis
agauccugccgccucugcuccgg

SEQ ID NO: 2262965 - RNA, 17 nt, Yersinia pestis
agaucauuuuuuuccac

SEQ ID NO: 2262966 - RNA, 16 nt, Yersinia pestis
agauccaccacaucau

SEQ ID NO: 2262967 - RNA, 17 nt, Yersinia pestis
agauccagaauuucauu

SEQ ID NO: 2262968 - RNA, 13 nt, Yersinia pestis
agauccagaacac

SEQ ID NO: 2262969 - RNA, 22 nt, Yersinia pestis
agaucauguaguacuuaccuuc

SEQ ID NO: 2262970 - RNA, 14 nt, Yersinia pestis
agaucagugccagu

SEQ ID NO: 2262971 - RNA, 20 nt, Yersinia pestis
agaucagcacggaaccccug

SEQ ID NO: 2262972 - RNA, 22 nt, Yersinia pestis
agauagaaaucacugaugagcu

SEQ ID NO: 2262973 - RNA, 22 nt, Yersinia pestis
agauagaccccuucuuccagca

SEQ ID NO: 2262974 - RNA, 11 nt, Yersinia pestis
agauagagcag

SEQ ID NO: 2262975 - RNA, 19 nt, Yersinia pestis
agauacuugcguucacccc

SEQ ID NO: 2262976 - RNA, 14 nt, Yersinia pestis
agauagcaaaagaa

SEQ ID NO: 2262977 - RNA, 22 nt, Yersinia pestis
agauacggcuccagaacaucuu

SEQ ID NO: 2262978 - RNA, 13 nt, Yersinia pestis
agaguaaguaaaa

SEQ ID NO: 2262979 - RNA, 15 nt, Yersinia pestis
agaguaaguaaaaag

SEQ ID NO: 2262980 - RNA, 17 nt, Yersinia pestis
agaguguucauaaauua

SEQ ID NO: 2262981 - RNA, 21 nt, Yersinia pestis
agaguguucauaaauuaaaac

SEQ ID NO: 2262982 - RNA, 12 nt, Yersinia pestis
agaguugcaguu

SEQ ID NO: 2262983 - RNA, 17 nt, Yersinia pestis
agaguugcucacccauu

SEQ ID NO: 2262984 - RNA, 23 nt, Yersinia pestis
agaguugauccgauaaacuucac

SEQ ID NO: 2262985 - RNA, 17 nt, Yersinia pestis
agauaaacaaacaucau

SEQ ID NO: 2262986 - RNA, 16 nt, Yersinia pestis
agauaagaucucagca

SEQ ID NO: 2262987 - RNA, 22 nt, Yersinia pestis
agaugucgcccgucuggcaggg

SEQ ID NO: 2262988 - RNA, 16 nt, Yersinia pestis
agaugucccagaaaua

SEQ ID NO: 2262989 - RNA, 18 nt, Yersinia pestis
agaugucccagaaauauu

SEQ ID NO: 2262990 - RNA, 15 nt, Yersinia pestis
agauguauccaaggc

SEQ ID NO: 2262991 - RNA, 17 nt, Yersinia pestis
agauguagguaggcagc

SEQ ID NO: 2262992 - RNA, 15 nt, Yersinia pestis
agauggcgaucaagc

SEQ ID NO: 2262993 - RNA, 17 nt, Yersinia pestis
agauggcgaucaagccc

SEQ ID NO: 2262994 - RNA, 21 nt, Yersinia pestis
agauggcagugacauuaccug

SEQ ID NO: 2262995 - RNA, 19 nt, Yersinia pestis
agaugccuauuugcagaaa

SEQ ID NO: 2262996 - RNA, 21 nt, Yersinia pestis
agaugccgcacacaucugucg

SEQ ID NO: 2262997 - RNA, 14 nt, Yersinia pestis
agaugccaaucaaa

SEQ ID NO: 2262998 - RNA, 20 nt, Yersinia pestis
agaugagaaucucuccagug

SEQ ID NO: 2262999 - RNA, 15 nt, Yersinia pestis
agaugagugguuuau

SEQ ID NO: 2263000 - RNA, 15 nt, Yersinia pestis
agaugaauacgcuuu

SEQ ID NO: 2263001 - RNA, 16 nt, Yersinia pestis
aaaacccauuaaaaac

SEQ ID NO: 2263002 - RNA, 22 nt, Yersinia pestis
aaaacccauaaguccuuaaaaa

SEQ ID NO: 2263003 - RNA, 21 nt, Yersinia pestis
agauuaguuuuagacgucaga

SEQ ID NO: 2263004 - RNA, 12 nt, Yersinia pestis
agauucagcugc

SEQ ID NO: 2263005 - RNA, 16 nt, Yersinia pestis
agauucauuagccagc

SEQ ID NO: 2263006 - RNA, 21 nt, Yersinia pestis
agauuagucuuagacgucaga

SEQ ID NO: 2263007 - RNA, 23 nt, Yersinia pestis
agauuagucuuagacgucagauu

SEQ ID NO: 2263008 - RNA, 19 nt, Yersinia pestis
agauguucgcagaaaagag

SEQ ID NO: 2263009 - RNA, 12 nt, Yersinia pestis
agauucuagcau

SEQ ID NO: 2263010 - RNA, 16 nt, Yersinia pestis
agauucuagcaucgcc

SEQ ID NO: 2263011 - RNA, 21 nt, Yersinia pestis
agauuguuuauaaauuaaaaa

SEQ ID NO: 2263012 - RNA, 18 nt, Yersinia pestis
agauuuaaccccaauucu

SEQ ID NO: 2263013 - RNA, 19 nt, Yersinia pestis
agauuucaucauucaauac

SEQ ID NO: 2263014 - RNA, 21 nt, Yersinia pestis
agauuucaucggcaaaaacag

SEQ ID NO: 2263015 - RNA, 22 nt, Yersinia pestis
agauuucaucggcaaaaacagu

SEQ ID NO: 2263016 - RNA, 16 nt, Yersinia pestis
agauuugguauuacgc

SEQ ID NO: 2263017 - RNA, 21 nt, Yersinia pestis
agcaaaaaaacugacugccau

SEQ ID NO: 2263018 - RNA, 18 nt, Yersinia pestis
agauuuucuuucaggcug

SEQ ID NO: 2263019 - RNA, 17 nt, Yersinia pestis
agauuuuccauccccug

SEQ ID NO: 2263020 - RNA, 16 nt, Yersinia pestis
agcaaaaggauuaaua

SEQ ID NO: 2263021 - RNA, 20 nt, Yersinia pestis
agcaaacucagccaauccag

SEQ ID NO: 2263022 - RNA, 16 nt, Yersinia pestis
agcaaacgucccgcuu

SEQ ID NO: 2263023 - RNA, 14 nt, Yersinia pestis
agcaaaucaaacaa

SEQ ID NO: 2263024 - RNA, 13 nt, Yersinia pestis
agcaaaucacauu

SEQ ID NO: 2263025 - RNA, 17 nt, Yersinia pestis
agcaaaguauuuauaca

SEQ ID NO: 2263026 - RNA, 16 nt, Yersinia pestis
agcaaauaaacaaaau

SEQ ID NO: 2263027 - RNA, 14 nt, Yersinia pestis
agcaacaaacagcc

SEQ ID NO: 2263028 - RNA, 15 nt, Yersinia pestis
agcaaauugcugaaa

SEQ ID NO: 2263029 - RNA, 20 nt, Yersinia pestis
agcaaauugcugaaaaaaaa

SEQ ID NO: 2263030 - RNA, 16 nt, Yersinia pestis
agccagcacacagaug

SEQ ID NO: 2263031 - RNA, 17 nt, Yersinia pestis
agccagcacacagaugc

SEQ ID NO: 2263032 - RNA, 21 nt, Yersinia pestis
agccagauaggcgaaauugac

SEQ ID NO: 2263033 - RNA, 18 nt, Yersinia pestis
agccagcgccgugccaga

SEQ ID NO: 2263034 - RNA, 22 nt, Yersinia pestis
agccagcgccgugccagaaaca

SEQ ID NO: 2263035 - RNA, 16 nt, Yersinia pestis
agccagcgucaucaca

SEQ ID NO: 2263036 - RNA, 15 nt, Yersinia pestis
agccaccccguggca

SEQ ID NO: 2263037 - RNA, 14 nt, Yersinia pestis
agccaccgcacacu

SEQ ID NO: 2263038 - RNA, 14 nt, Yersinia pestis
agccacgaguuuuc

SEQ ID NO: 2263039 - RNA, 14 nt, Yersinia pestis
agccacgcguaauc

SEQ ID NO: 2263040 - RNA, 16 nt, Yersinia pestis
agccaagcaaccuugu

SEQ ID NO: 2263041 - RNA, 23 nt, Yersinia pestis
agccaagcaagcggcagcgcugg

SEQ ID NO: 2263042 - RNA, 20 nt, Yersinia pestis
agccaagacuuuccacaaca

SEQ ID NO: 2263043 - RNA, 22 nt, Yersinia pestis
agccaagacuuuccacaacaga

SEQ ID NO: 2263044 - RNA, 13 nt, Yersinia pestis
agccaacggagcg

SEQ ID NO: 2263045 - RNA, 13 nt, Yersinia pestis
agcaugcccagcc

SEQ ID NO: 2263046 - RNA, 15 nt, Yersinia pestis
agcauggaagauauc

SEQ ID NO: 2263047 - RNA, 13 nt, Yersinia pestis
agcaugcauccau

SEQ ID NO: 2263048 - RNA, 14 nt, Yersinia pestis
agccauauuuuaaa

SEQ ID NO: 2263049 - RNA, 13 nt, Yersinia pestis
agccaucgccauc

SEQ ID NO: 2263050 - RNA, 18 nt, Yersinia pestis
agccagugucaggaugau

SEQ ID NO: 2263051 - RNA, 14 nt, Yersinia pestis
agccauaauaaugc

SEQ ID NO: 2263052 - RNA, 15 nt, Yersinia pestis
agccagugcgggaga

SEQ ID NO: 2263053 - RNA, 16 nt, Yersinia pestis
agcccaacugacugaa

SEQ ID NO: 2263054 - RNA, 13 nt, Yersinia pestis
agcccaagagaaa

SEQ ID NO: 2263055 - RNA, 21 nt, Yersinia pestis
agcccaauucguauuccucaa

SEQ ID NO: 2263056 - RNA, 22 nt, Yersinia pestis
agccauugagcgaagaagagau

SEQ ID NO: 2263057 - RNA, 15 nt, Yersinia pestis
agccauuucaguaac

SEQ ID NO: 2263058 - RNA, 16 nt, Yersinia pestis
agccauuucaaaacgc

SEQ ID NO: 2263059 - RNA, 17 nt, Yersinia pestis
agccauucagcagcaag

SEQ ID NO: 2263060 - RNA, 18 nt, Yersinia pestis
agccauucagcagcaaga

SEQ ID NO: 2263061 - RNA, 18 nt, Yersinia pestis
agcccuuauucaaagaau

SEQ ID NO: 2263062 - RNA, 20 nt, Yersinia pestis
agcccuucgcaccgccgcca

SEQ ID NO: 2263063 - RNA, 23 nt, Yersinia pestis
agccgcagaugccagacuugggu

SEQ ID NO: 2263064 - RNA, 14 nt, Yersinia pestis
agccgauaaucaau

SEQ ID NO: 2263065 - RNA, 21 nt, Yersinia pestis
agccgauaaucccugccagaa

SEQ ID NO: 2263066 - RNA, 19 nt, Yersinia pestis
agccgagcaagugaauaac

SEQ ID NO: 2263067 - RNA, 19 nt, Yersinia pestis
agcccgcaacgggagagaa

SEQ ID NO: 2263068 - RNA, 22 nt, Yersinia pestis
agcccggcucauccgccaagau

SEQ ID NO: 2263069 - RNA, 20 nt, Yersinia pestis
agccccuuugaacugcaccc

SEQ ID NO: 2263070 - RNA, 17 nt, Yersinia pestis
agccccucgaaaauaac

SEQ ID NO: 2263071 - RNA, 14 nt, Yersinia pestis
agccccugccagaa

SEQ ID NO: 2263072 - RNA, 13 nt, Yersinia pestis
agcccccagggaa

SEQ ID NO: 2263073 - RNA, 21 nt, Yersinia pestis
agcccccaaaguagaacuggc

SEQ ID NO: 2263074 - RNA, 15 nt, Yersinia pestis
agcccauccuguuca

SEQ ID NO: 2263075 - RNA, 16 nt, Yersinia pestis
agcccauagccauggc

SEQ ID NO: 2263076 - RNA, 16 nt, Yersinia pestis
agcccaguauugcaga

SEQ ID NO: 2263077 - RNA, 19 nt, Yersinia pestis
agcccaguauugcagagca

SEQ ID NO: 2263078 - RNA, 12 nt, Yersinia pestis
agcccauugcug

SEQ ID NO: 2263079 - RNA, 20 nt, Yersinia pestis
agccccaaaugccagcgaaa

SEQ ID NO: 2263080 - RNA, 19 nt, Yersinia pestis
agcccacgaggacaggugg

SEQ ID NO: 2263081 - RNA, 16 nt, Yersinia pestis
agcccagauggcaauc

SEQ ID NO: 2263082 - RNA, 17 nt, Yersinia pestis
agcccaggcgacgcagu

SEQ ID NO: 2263083 - RNA, 20 nt, Yersinia pestis
agcagcauccugaacuuccu

SEQ ID NO: 2263084 - RNA, 21 nt, Yersinia pestis
agcagcaucuggcgcagagua

SEQ ID NO: 2263085 - RNA, 18 nt, Yersinia pestis
agcagccaccaaaaaacg

SEQ ID NO: 2263086 - RNA, 17 nt, Yersinia pestis
agcagcaccaauaucaa

SEQ ID NO: 2263087 - RNA, 18 nt, Yersinia pestis
agcagagucgcaaaaaau

SEQ ID NO: 2263088 - RNA, 12 nt, Yersinia pestis
agcagagaauga

SEQ ID NO: 2263089 - RNA, 14 nt, Yersinia pestis
agcagcaaacgccu

SEQ ID NO: 2263090 - RNA, 13 nt, Yersinia pestis
agcagaacaaaac

SEQ ID NO: 2263091 - RNA, 14 nt, Yersinia pestis
agcagaaagcagca

SEQ ID NO: 2263092 - RNA, 17 nt, Yersinia pestis
agcagaaagcagcagcu

SEQ ID NO: 2263093 - RNA, 18 nt, Yersinia pestis
agcagaaagcagcagcuu

SEQ ID NO: 2263094 - RNA, 20 nt, Yersinia pestis
agcagaaaagcgaaggggcg

SEQ ID NO: 2263095 - RNA, 13 nt, Yersinia pestis
agcagaaagcagc

SEQ ID NO: 2263096 - RNA, 20 nt, Yersinia pestis
agcaccuaucgccgccgcca

SEQ ID NO: 2263097 - RNA, 23 nt, Yersinia pestis
agcaacgaaaugucgaaagauag

SEQ ID NO: 2263098 - RNA, 17 nt, Yersinia pestis
agcaaccaaccuugauc

SEQ ID NO: 2263099 - RNA, 22 nt, Yersinia pestis
agcaaccauuuuauugccagag

SEQ ID NO: 2263100 - RNA, 20 nt, Yersinia pestis
agcacgaaccugagcgauca

SEQ ID NO: 2263101 - RNA, 19 nt, Yersinia pestis
agcacgaccuugccaaggu

SEQ ID NO: 2263102 - RNA, 21 nt, Yersinia pestis
agcacguuuuucagcuucuuc

SEQ ID NO: 2263103 - RNA, 21 nt, Yersinia pestis
agcacguucaccaaagcaaug

SEQ ID NO: 2263104 - RNA, 22 nt, Yersinia pestis
agcacuaucacaucaaauuuuu

SEQ ID NO: 2263105 - RNA, 21 nt, Yersinia pestis
agcacucaaugucaugcaauu

SEQ ID NO: 2263106 - RNA, 13 nt, Yersinia pestis
agcacucaguaca

SEQ ID NO: 2263107 - RNA, 15 nt, Yersinia pestis
agcacucauaaugcu

SEQ ID NO: 2263108 - RNA, 16 nt, Yersinia pestis
agcacuccccgcccgu

SEQ ID NO: 2263109 - RNA, 22 nt, Yersinia pestis
agcaucauaagacuaacagaau

SEQ ID NO: 2263110 - RNA, 15 nt, Yersinia pestis
agcaucauccagcuc

SEQ ID NO: 2263111 - RNA, 16 nt, Yersinia pestis
agcaucacugucuauu

SEQ ID NO: 2263112 - RNA, 20 nt, Yersinia pestis
agcaucacugucuauuuuua

SEQ ID NO: 2263113 - RNA, 14 nt, Yersinia pestis
agcaucacuucaua

SEQ ID NO: 2263114 - RNA, 17 nt, Yersinia pestis
agcaucgcggaaccuuu

SEQ ID NO: 2263115 - RNA, 21 nt, Yersinia pestis
agcagugucagggcaauaaca

SEQ ID NO: 2263116 - RNA, 23 nt, Yersinia pestis
agcagugucagggcaauaacaaa

SEQ ID NO: 2263117 - RNA, 15 nt, Yersinia pestis
agcagugauuucagu

SEQ ID NO: 2263118 - RNA, 14 nt, Yersinia pestis
agcagucugaggug

SEQ ID NO: 2263119 - RNA, 23 nt, Yersinia pestis
agcagucugagccucaugaauga

SEQ ID NO: 2263120 - RNA, 15 nt, Yersinia pestis
agcagucugaagggu

SEQ ID NO: 2263121 - RNA, 19 nt, Yersinia pestis
agcagucugagccucauga

SEQ ID NO: 2263122 - RNA, 21 nt, Yersinia pestis
agcagucugagccucaugaau

SEQ ID NO: 2263123 - RNA, 13 nt, Yersinia pestis
agcagucagcaug

SEQ ID NO: 2263124 - RNA, 11 nt, Yersinia pestis
agcaguagcca

SEQ ID NO: 2263125 - RNA, 23 nt, Yersinia pestis
agcauaccgguuugggcaucaac

SEQ ID NO: 2263126 - RNA, 21 nt, Yersinia pestis
agcauacguugccagccaucu

SEQ ID NO: 2263127 - RNA, 18 nt, Yersinia pestis
agcauagacgaaggcacg

SEQ ID NO: 2263128 - RNA, 17 nt, Yersinia pestis
agcaguaauagcaaaaa

SEQ ID NO: 2263129 - RNA, 16 nt, Yersinia pestis
agcaggcagagcaagg

SEQ ID NO: 2263130 - RNA, 14 nt, Yersinia pestis
agcagcucaaaauc

SEQ ID NO: 2263131 - RNA, 19 nt, Yersinia pestis
agcagcgcccaacaggugc

SEQ ID NO: 2263132 - RNA, 21 nt, Yersinia pestis
agcagcgcuggcuauccugaa

SEQ ID NO: 2263133 - RNA, 17 nt, Yersinia pestis
agcagcgcgcuacuccc

SEQ ID NO: 2263134 - RNA, 14 nt, Yersinia pestis
agccuuaacugcau

SEQ ID NO: 2263135 - RNA, 14 nt, Yersinia pestis
agccugugcagccg

SEQ ID NO: 2263136 - RNA, 14 nt, Yersinia pestis
agccuguuaauaau

SEQ ID NO: 2263137 - RNA, 12 nt, Yersinia pestis
agcgaauaaaua

SEQ ID NO: 2263138 - RNA, 19 nt, Yersinia pestis
agccuggaagcaaaagccc

SEQ ID NO: 2263139 - RNA, 20 nt, Yersinia pestis
agccugcguuaaaaccaccu

SEQ ID NO: 2263140 - RNA, 20 nt, Yersinia pestis
agccugcacggcucaggugc

SEQ ID NO: 2263141 - RNA, 15 nt, Yersinia pestis
agccugcccccgacg

SEQ ID NO: 2263142 - RNA, 15 nt, Yersinia pestis
agccugcaccucauc

SEQ ID NO: 2263143 - RNA, 15 nt, Yersinia pestis
agccgcauuguucgg

SEQ ID NO: 2263144 - RNA, 22 nt, Yersinia pestis
agcgagaggaggccugcuuaac

SEQ ID NO: 2263145 - RNA, 11 nt, Yersinia pestis
agcgaggauaa

SEQ ID NO: 2263146 - RNA, 16 nt, Yersinia pestis
agcgacaaccuguagc

SEQ ID NO: 2263147 - RNA, 17 nt, Yersinia pestis
agcgacaaaagugucau

SEQ ID NO: 2263148 - RNA, 13 nt, Yersinia pestis
agcgacaaccugu

SEQ ID NO: 2263149 - RNA, 17 nt, Yersinia pestis
agcgaauggcaauggcc

SEQ ID NO: 2263150 - RNA, 14 nt, Yersinia pestis
agcgauagccugau

SEQ ID NO: 2263151 - RNA, 18 nt, Yersinia pestis
agcgaguucccgauuauu

SEQ ID NO: 2263152 - RNA, 21 nt, Yersinia pestis
agcgagggccuuucugaacaa

SEQ ID NO: 2263153 - RNA, 14 nt, Yersinia pestis
agcgaggcuucuca

SEQ ID NO: 2263154 - RNA, 20 nt, Yersinia pestis
agcgaucucauuuagcauua

SEQ ID NO: 2263155 - RNA, 14 nt, Yersinia pestis
agcgaucagcaacg

SEQ ID NO: 2263156 - RNA, 14 nt, Yersinia pestis
agcgaucagcaaua

SEQ ID NO: 2263157 - RNA, 18 nt, Yersinia pestis
agcgaugaggcucuucug

SEQ ID NO: 2263158 - RNA, 17 nt, Yersinia pestis
agcgccugugggcggcu

SEQ ID NO: 2263159 - RNA, 11 nt, Yersinia pestis
agcgccugccc

SEQ ID NO: 2263160 - RNA, 22 nt, Yersinia pestis
agcgccgauauacaccccauca

SEQ ID NO: 2263161 - RNA, 22 nt, Yersinia pestis
agcgccgauggugugcagcaag

SEQ ID NO: 2263162 - RNA, 16 nt, Yersinia pestis
agcgcaauucagccuc

SEQ ID NO: 2263163 - RNA, 17 nt, Yersinia pestis
agcgcaucggaaaucug

SEQ ID NO: 2263164 - RNA, 18 nt, Yersinia pestis
agcggcguuguucucugg

SEQ ID NO: 2263165 - RNA, 19 nt, Yersinia pestis
agcgggcuaaaugcucgcu

SEQ ID NO: 2263166 - RNA, 13 nt, Yersinia pestis
agcggggcaaaaa

SEQ ID NO: 2263167 - RNA, 20 nt, Yersinia pestis
agcggggcggauaguuuuua

SEQ ID NO: 2263168 - RNA, 22 nt, Yersinia pestis
agcgcuaagcccgugauaaauc

SEQ ID NO: 2263169 - RNA, 14 nt, Yersinia pestis
agcgcucagcgcca

SEQ ID NO: 2263170 - RNA, 14 nt, Yersinia pestis
agcggccagcuugc

SEQ ID NO: 2263171 - RNA, 16 nt, Yersinia pestis
agcggcgggcuaaccc

SEQ ID NO: 2263172 - RNA, 18 nt, Yersinia pestis
agcguaaagaggccagcu

SEQ ID NO: 2263173 - RNA, 22 nt, Yersinia pestis
agcguaacuccuuuguuauuuc

SEQ ID NO: 2263174 - RNA, 15 nt, Yersinia pestis
agcgguuuauauuuu

SEQ ID NO: 2263175 - RNA, 20 nt, Yersinia pestis
agcgguugggcuaaccagug

SEQ ID NO: 2263176 - RNA, 21 nt, Yersinia pestis
agcgucaugauagacagcaaa

SEQ ID NO: 2263177 - RNA, 15 nt, Yersinia pestis
agcguccauaaaccc

SEQ ID NO: 2263178 - RNA, 21 nt, Yersinia pestis
agcgucuucugugauuuguca

SEQ ID NO: 2263179 - RNA, 20 nt, Yersinia pestis
agcguucaaaucugcucccg

SEQ ID NO: 2263180 - RNA, 15 nt, Yersinia pestis
agcguucaucgcccu

SEQ ID NO: 2263181 - RNA, 20 nt, Yersinia pestis
agcguuaauuauagugaaaa

SEQ ID NO: 2263182 - RNA, 21 nt, Yersinia pestis
agcguggaauuaauaucccac

SEQ ID NO: 2263183 - RNA, 22 nt, Yersinia pestis
agcgugcgguagaccaccaacu

SEQ ID NO: 2263184 - RNA, 16 nt, Yersinia pestis
agcgugcgcuccauuu

SEQ ID NO: 2263185 - RNA, 19 nt, Yersinia pestis
agcucaauacgguaaucug

SEQ ID NO: 2263186 - RNA, 13 nt, Yersinia pestis
agcucaaucacau

SEQ ID NO: 2263187 - RNA, 14 nt, Yersinia pestis
agcucaaucacauc

SEQ ID NO: 2263188 - RNA, 17 nt, Yersinia pestis
agcuauuggcugauuca

SEQ ID NO: 2263189 - RNA, 17 nt, Yersinia pestis
agcucaagggcacaguu

SEQ ID NO: 2263190 - RNA, 13 nt, Yersinia pestis
agcucaagcuggu

SEQ ID NO: 2263191 - RNA, 13 nt, Yersinia pestis
agcucaagcuggc

SEQ ID NO: 2263192 - RNA, 13 nt, Yersinia pestis
agcuaucauuaaa

SEQ ID NO: 2263193 - RNA, 20 nt, Yersinia pestis
agcguuuauuggcuuggaca

SEQ ID NO: 2263194 - RNA, 14 nt, Yersinia pestis
agcuaaaaugaucu

SEQ ID NO: 2263195 - RNA, 13 nt, Yersinia pestis
agcuaagcucuuc

SEQ ID NO: 2263196 - RNA, 17 nt, Yersinia pestis
agcuaaccuuaacugca

SEQ ID NO: 2263197 - RNA, 18 nt, Yersinia pestis
agcuaaccuuaacugcau

SEQ ID NO: 2263198 - RNA, 22 nt, Yersinia pestis
agcuaacgcuuucagguuguua

SEQ ID NO: 2263199 - RNA, 14 nt, Yersinia pestis
agcuaacagugacc

SEQ ID NO: 2263200 - RNA, 17 nt, Yersinia pestis
agcuaacaaaaccggga

SEQ ID NO: 2263201 - RNA, 20 nt, Yersinia pestis
agcuaaugcucgcucaucau

SEQ ID NO: 2263202 - RNA, 17 nt, Yersinia pestis
agcuaauaauuguucau

SEQ ID NO: 2263203 - RNA, 14 nt, Yersinia pestis
agcuaaucauugca

SEQ ID NO: 2263204 - RNA, 19 nt, Yersinia pestis
agcuacugcacgcauucuu

SEQ ID NO: 2263205 - RNA, 18 nt, Yersinia pestis
aguaacacuucagacuga

SEQ ID NO: 2263206 - RNA, 23 nt, Yersinia pestis
aguaaauucgggcuuuaauacaa

SEQ ID NO: 2263207 - RNA, 23 nt, Yersinia pestis
aguaacaccagcauccugcaaau

SEQ ID NO: 2263208 - RNA, 15 nt, Yersinia pestis
aguaagucuuuccua

SEQ ID NO: 2263209 - RNA, 12 nt, Yersinia pestis
aguaagguuuua

SEQ ID NO: 2263210 - RNA, 20 nt, Yersinia pestis
aguaaccccuucgagcaccg

SEQ ID NO: 2263211 - RNA, 23 nt, Yersinia pestis
aguaacccagccccuaacagcag

SEQ ID NO: 2263212 - RNA, 22 nt, Yersinia pestis
aguaaccccuucgagcaccgcg

SEQ ID NO: 2263213 - RNA, 17 nt, Yersinia pestis
aguaaucagaguaacua

SEQ ID NO: 2263214 - RNA, 15 nt, Yersinia pestis
aguaccaccaccaca

SEQ ID NO: 2263215 - RNA, 21 nt, Yersinia pestis
aguacaaaaaacaaaccgggg

SEQ ID NO: 2263216 - RNA, 13 nt, Yersinia pestis
aguacaaaaaaca

SEQ ID NO: 2263217 - RNA, 15 nt, Yersinia pestis
aguacaaaaaacaaa

SEQ ID NO: 2263218 - RNA, 18 nt, Yersinia pestis
agguugcagcuaaacacg

SEQ ID NO: 2263219 - RNA, 15 nt, Yersinia pestis
agguugcagcuaaac

SEQ ID NO: 2263220 - RNA, 17 nt, Yersinia pestis
aguaaaagucagcaaau

SEQ ID NO: 2263221 - RNA, 21 nt, Yersinia pestis
aguaaaacugauauaaagcau

SEQ ID NO: 2263222 - RNA, 14 nt, Yersinia pestis
aguaaaccaauuuu

SEQ ID NO: 2263223 - RNA, 22 nt, Yersinia pestis
aguaaaccaauuuuaaugguuu

SEQ ID NO: 2263224 - RNA, 14 nt, Yersinia pestis
aguaaacaccuuca

SEQ ID NO: 2263225 - RNA, 16 nt, Yersinia pestis
agguuuggccuaacaa

SEQ ID NO: 2263226 - RNA, 23 nt, Yersinia pestis
aguaaaaauauuaacugcaguga

SEQ ID NO: 2263227 - RNA, 22 nt, Yersinia pestis
aguaaaaauauuaacugcagug

SEQ ID NO: 2263228 - RNA, 14 nt, Yersinia pestis
aguaguaaaaccua

SEQ ID NO: 2263229 - RNA, 23 nt, Yersinia pestis
aguaguaaaaccuagcugcugca

SEQ ID NO: 2263230 - RNA, 20 nt, Yersinia pestis
aguaggcuuauuaugacaac

SEQ ID NO: 2263231 - RNA, 21 nt, Yersinia pestis
aguaggcaucugccacacuga

SEQ ID NO: 2263232 - RNA, 13 nt, Yersinia pestis
aguagucagagcg

SEQ ID NO: 2263233 - RNA, 19 nt, Yersinia pestis
aguaguggaaaaacugaaa

SEQ ID NO: 2263234 - RNA, 22 nt, Yersinia pestis
aguagcaauaaggugccacaca

SEQ ID NO: 2263235 - RNA, 13 nt, Yersinia pestis
aguagagcuucca

SEQ ID NO: 2263236 - RNA, 23 nt, Yersinia pestis
aguagcccagccggaacauguac

SEQ ID NO: 2263237 - RNA, 16 nt, Yersinia pestis
aguaugguuaaucuac

SEQ ID NO: 2263238 - RNA, 19 nt, Yersinia pestis
aguauguuugauuaagccg

SEQ ID NO: 2263239 - RNA, 19 nt, Yersinia pestis
aguauuuauuccacagagu

SEQ ID NO: 2263240 - RNA, 20 nt, Yersinia pestis
aguauuuauuccacagagua

SEQ ID NO: 2263241 - RNA, 19 nt, Yersinia pestis
aguauuuaacgccaccaau

SEQ ID NO: 2263242 - RNA, 22 nt, Yersinia pestis
aguauugcugaguaaauuaaau

SEQ ID NO: 2263243 - RNA, 13 nt, Yersinia pestis
aguauuccccacu

SEQ ID NO: 2263244 - RNA, 23 nt, Yersinia pestis
aguauucuuaucaaucaaaaaau

SEQ ID NO: 2263245 - RNA, 13 nt, Yersinia pestis
aguaucaccagau

SEQ ID NO: 2263246 - RNA, 16 nt, Yersinia pestis
aguauacuaaaacagc

SEQ ID NO: 2263247 - RNA, 13 nt, Yersinia pestis
aguaucuggggua

SEQ ID NO: 2263248 - RNA, 17 nt, Yersinia pestis
aguaucgaagacaaaca

SEQ ID NO: 2263249 - RNA, 21 nt, Yersinia pestis
aguauccgcgccagacuggcc

SEQ ID NO: 2263250 - RNA, 23 nt, Yersinia pestis
aguaucgcuaucaccggaugaaa

SEQ ID NO: 2263251 - RNA, 18 nt, Yersinia pestis
agggaacggauagagggc

SEQ ID NO: 2263252 - RNA, 14 nt, Yersinia pestis
aggcuuuuuacuuu

SEQ ID NO: 2263253 - RNA, 17 nt, Yersinia pestis
aggcuuggcgggcuggc

SEQ ID NO: 2263254 - RNA, 19 nt, Yersinia pestis
aggcuuuaaccugcacuuu

SEQ ID NO: 2263255 - RNA, 13 nt, Yersinia pestis
aggcuuucacgcu

SEQ ID NO: 2263256 - RNA, 22 nt, Yersinia pestis
aggcuuuauugagcgaugacaa

SEQ ID NO: 2263257 - RNA, 19 nt, Yersinia pestis
agggauucugucagagcua

SEQ ID NO: 2263258 - RNA, 13 nt, Yersinia pestis
agggaguucauca

SEQ ID NO: 2263259 - RNA, 17 nt, Yersinia pestis
agggacacaauuagcug

SEQ ID NO: 2263260 - RNA, 21 nt, Yersinia pestis
agggaaguuucuuacuaaaau

SEQ ID NO: 2263261 - RNA, 18 nt, Yersinia pestis
agggacgcgaaucccccc

SEQ ID NO: 2263262 - RNA, 15 nt, Yersinia pestis
agggcugucagccac

SEQ ID NO: 2263263 - RNA, 22 nt, Yersinia pestis
agggcuucuggcgugucaucuu

SEQ ID NO: 2263264 - RNA, 18 nt, Yersinia pestis
aggggccaauaggccccu

SEQ ID NO: 2263265 - RNA, 19 nt, Yersinia pestis
aggggcguuuaaugccccu

SEQ ID NO: 2263266 - RNA, 20 nt, Yersinia pestis
aggggcguuuaaugccccug

SEQ ID NO: 2263267 - RNA, 14 nt, Yersinia pestis
aggggcucacccgu

SEQ ID NO: 2263268 - RNA, 20 nt, Yersinia pestis
agggccacuucgguggcccu

SEQ ID NO: 2263269 - RNA, 14 nt, Yersinia pestis
agggcuaaaauggc

SEQ ID NO: 2263270 - RNA, 15 nt, Yersinia pestis
aggucgggcgcugag

SEQ ID NO: 2263271 - RNA, 15 nt, Yersinia pestis
aggugcuuauuuauu

SEQ ID NO: 2263272 - RNA, 17 nt, Yersinia pestis
aggugcaguuucuaccg

SEQ ID NO: 2263273 - RNA, 21 nt, Yersinia pestis
aggugcauccacauauauaga

SEQ ID NO: 2263274 - RNA, 18 nt, Yersinia pestis
agguaugugccaaaaaaa

SEQ ID NO: 2263275 - RNA, 14 nt, Yersinia pestis
aggucgccucuggg

SEQ ID NO: 2263276 - RNA, 18 nt, Yersinia pestis
agguaguuacagcaaaua

SEQ ID NO: 2263277 - RNA, 21 nt, Yersinia pestis
agguauaaccauuaacaauau

SEQ ID NO: 2263278 - RNA, 15 nt, Yersinia pestis
agguacggccagcaa

SEQ ID NO: 2263279 - RNA, 17 nt, Yersinia pestis
agguacggccagcaaug

SEQ ID NO: 2263280 - RNA, 16 nt, Yersinia pestis
agguaccccauaaauc

SEQ ID NO: 2263281 - RNA, 15 nt, Yersinia pestis
agguaagaaagagau

SEQ ID NO: 2263282 - RNA, 12 nt, Yersinia pestis
agguaauuaaac

SEQ ID NO: 2263283 - RNA, 12 nt, Yersinia pestis
aggguauaugga

SEQ ID NO: 2263284 - RNA, 14 nt, Yersinia pestis
agggugaugacaau

SEQ ID NO: 2263285 - RNA, 14 nt, Yersinia pestis
agguaauaccaaug

SEQ ID NO: 2263286 - RNA, 16 nt, Yersinia pestis
agguaaucagacugcu

SEQ ID NO: 2263287 - RNA, 17 nt, Yersinia pestis
agguaaucagacugcug

SEQ ID NO: 2263288 - RNA, 18 nt, Yersinia pestis
agguaaucagacugcuga

SEQ ID NO: 2263289 - RNA, 19 nt, Yersinia pestis
agguaaucagacugcugac

SEQ ID NO: 2263290 - RNA, 19 nt, Yersinia pestis
agguaagccuuucuccaca

SEQ ID NO: 2263291 - RNA, 12 nt, Yersinia pestis
agguaagaaaga

SEQ ID NO: 2263292 - RNA, 20 nt, Yersinia pestis
agguaacgggagauuaauac

SEQ ID NO: 2263293 - RNA, 16 nt, Yersinia pestis
aggguggagagaaagg

SEQ ID NO: 2263294 - RNA, 18 nt, Yersinia pestis
aggcaucucacgaugccu

SEQ ID NO: 2263295 - RNA, 13 nt, Yersinia pestis
aggcaucugccac

SEQ ID NO: 2263296 - RNA, 16 nt, Yersinia pestis
aggcacugcagaaaau

SEQ ID NO: 2263297 - RNA, 22 nt, Yersinia pestis
aggcacuuugucaauaaccuca

SEQ ID NO: 2263298 - RNA, 13 nt, Yersinia pestis
aggcagaaauaau

SEQ ID NO: 2263299 - RNA, 16 nt, Yersinia pestis
aggcacgugccgcugg

SEQ ID NO: 2263300 - RNA, 17 nt, Yersinia pestis
aggcacgugccgcuggg

SEQ ID NO: 2263301 - RNA, 15 nt, Yersinia pestis
aggcacugcagaaaa

SEQ ID NO: 2263302 - RNA, 16 nt, Yersinia pestis
aggcacgagcggugga

SEQ ID NO: 2263303 - RNA, 12 nt, Yersinia pestis
aggccaaccucu

SEQ ID NO: 2263304 - RNA, 13 nt, Yersinia pestis
aggccaacacuca

SEQ ID NO: 2263305 - RNA, 15 nt, Yersinia pestis
aggcauuggcgcuca

SEQ ID NO: 2263306 - RNA, 15 nt, Yersinia pestis
aggccaauuuggcca

SEQ ID NO: 2263307 - RNA, 12 nt, Yersinia pestis
aggccauuggca

SEQ ID NO: 2263308 - RNA, 15 nt, Yersinia pestis
aggagcccucuguca

SEQ ID NO: 2263309 - RNA, 19 nt, Yersinia pestis
aggauuccguuuuacccuc

SEQ ID NO: 2263310 - RNA, 16 nt, Yersinia pestis
aggauugaccaauaaa

SEQ ID NO: 2263311 - RNA, 16 nt, Yersinia pestis
aggcaacaacacccga

SEQ ID NO: 2263312 - RNA, 19 nt, Yersinia pestis
aggcaacgaccuuuaucac

SEQ ID NO: 2263313 - RNA, 18 nt, Yersinia pestis
aggcaaccuuggugaaga

SEQ ID NO: 2263314 - RNA, 21 nt, Yersinia pestis
aggauuuuccgcagcucaccu

SEQ ID NO: 2263315 - RNA, 16 nt, Yersinia pestis
aggcaccagcgcacug

SEQ ID NO: 2263316 - RNA, 11 nt, Yersinia pestis
aggcaagaaac

SEQ ID NO: 2263317 - RNA, 15 nt, Yersinia pestis
aggcaagcaaccgca

SEQ ID NO: 2263318 - RNA, 18 nt, Yersinia pestis
aggcaagaacauuuccac

SEQ ID NO: 2263319 - RNA, 18 nt, Yersinia pestis
aggccuauaacccccaca

SEQ ID NO: 2263320 - RNA, 13 nt, Yersinia pestis
aggccgccaaaua

SEQ ID NO: 2263321 - RNA, 16 nt, Yersinia pestis
aggccccucggggccu

SEQ ID NO: 2263322 - RNA, 21 nt, Yersinia pestis
aggccgaucaacaggccaccu

SEQ ID NO: 2263323 - RNA, 15 nt, Yersinia pestis
aggcgcauaugaaaa

SEQ ID NO: 2263324 - RNA, 17 nt, Yersinia pestis
aggcgcauaugaaaaac

SEQ ID NO: 2263325 - RNA, 19 nt, Yersinia pestis
aggcgcauaugaaaaaccu

SEQ ID NO: 2263326 - RNA, 20 nt, Yersinia pestis
aggaagggguucuuccaacg

SEQ ID NO: 2263327 - RNA, 16 nt, Yersinia pestis
aggaaguccaguaaua

SEQ ID NO: 2263328 - RNA, 20 nt, Yersinia pestis
aggagauuucagacugcuga

SEQ ID NO: 2263329 - RNA, 22 nt, Yersinia pestis
aggagcaaaaggccccguaauc

SEQ ID NO: 2263330 - RNA, 21 nt, Yersinia pestis
aggagacagggggauaaaaac

SEQ ID NO: 2263331 - RNA, 20 nt, Yersinia pestis
aggacucugcgcucauacuc

SEQ ID NO: 2263332 - RNA, 19 nt, Yersinia pestis
aggagaaacauuaaaccca

SEQ ID NO: 2263333 - RNA, 13 nt, Yersinia pestis
aggacuuccugcc

SEQ ID NO: 2263334 - RNA, 17 nt, Yersinia pestis
aggacuuauggguuuuu

SEQ ID NO: 2263335 - RNA, 14 nt, Yersinia pestis
aggaagauaucgcu

SEQ ID NO: 2263336 - RNA, 21 nt, Yersinia pestis
aggaagcguauaagcagggga

SEQ ID NO: 2263337 - RNA, 15 nt, Yersinia pestis
aggaagagaaaagca

SEQ ID NO: 2263338 - RNA, 19 nt, Yersinia pestis
aggaaaggccggauguaaa

SEQ ID NO: 2263339 - RNA, 18 nt, Yersinia pestis
agcuuugccuaacggcau

SEQ ID NO: 2263340 - RNA, 22 nt, Yersinia pestis
aggaaaggccggauguaaaaca

SEQ ID NO: 2263341 - RNA, 21 nt, Yersinia pestis
aggaaaggccggauguaaaac

SEQ ID NO: 2263342 - RNA, 15 nt, Yersinia pestis
agcuguauugcccga

SEQ ID NO: 2263343 - RNA, 20 nt, Yersinia pestis
agcuguacuaaagguguacu

SEQ ID NO: 2263344 - RNA, 19 nt, Yersinia pestis
agcuguagaacuuguucau

SEQ ID NO: 2263345 - RNA, 17 nt, Yersinia pestis
agcuuaaucaucaucac

SEQ ID NO: 2263346 - RNA, 18 nt, Yersinia pestis
agcugcuuuugcugaugc

SEQ ID NO: 2263347 - RNA, 22 nt, Yersinia pestis
agcugcuuuugcugaugcaccg

SEQ ID NO: 2263348 - RNA, 23 nt, Yersinia pestis
agcugcugcaagaguccagcacu

SEQ ID NO: 2263349 - RNA, 19 nt, Yersinia pestis
agcugccaggcaauuucuu

SEQ ID NO: 2263350 - RNA, 17 nt, Yersinia pestis
agcuuauccauuacagc

SEQ ID NO: 2263351 - RNA, 12 nt, Yersinia pestis
agcuuagcccac

SEQ ID NO: 2263352 - RNA, 18 nt, Yersinia pestis
agcuuccaacugauaaac

SEQ ID NO: 2263353 - RNA, 17 nt, Yersinia pestis
agcuuccgcuucaacuu

SEQ ID NO: 2263354 - RNA, 22 nt, Yersinia pestis
agcuugguaaugcgcaccagcu

SEQ ID NO: 2263355 - RNA, 23 nt, Yersinia pestis
agcuugguaaugcgcaccagcuc

SEQ ID NO: 2263356 - RNA, 11 nt, Yersinia pestis
agcuugauucg

SEQ ID NO: 2263357 - RNA, 21 nt, Yersinia pestis
agcuugcaacaaaauggccuu

SEQ ID NO: 2263358 - RNA, 20 nt, Yersinia pestis
agcuugauagggcugaagac

SEQ ID NO: 2263359 - RNA, 14 nt, Yersinia pestis
agcuucucgcacca

SEQ ID NO: 2263360 - RNA, 15 nt, Yersinia pestis
auaaccgccggauaa

SEQ ID NO: 2263361 - RNA, 22 nt, Yersinia pestis
auaaccgcgaagaggguuuuuu

SEQ ID NO: 2263362 - RNA, 14 nt, Yersinia pestis
auaaccguuuuuuc

SEQ ID NO: 2263363 - RNA, 23 nt, Yersinia pestis
auaaccucgguggcucaauccaa

SEQ ID NO: 2263364 - RNA, 13 nt, Yersinia pestis
auaaccucagccu

SEQ ID NO: 2263365 - RNA, 16 nt, Yersinia pestis
auaaccucagccucau

SEQ ID NO: 2263366 - RNA, 21 nt, Yersinia pestis
auaaccucagccucauucaug

SEQ ID NO: 2263367 - RNA, 22 nt, Yersinia pestis
auaacccaaugccauagcugcu

SEQ ID NO: 2263368 - RNA, 23 nt, Yersinia pestis
auaacccgccuagcaucauaaau

SEQ ID NO: 2263369 - RNA, 12 nt, Yersinia pestis
auaaccagcagc

SEQ ID NO: 2263370 - RNA, 23 nt, Yersinia pestis
auaaccagccaaccaucaucaau

SEQ ID NO: 2263371 - RNA, 22 nt, Yersinia pestis
auaaccaugauguuaggcguuu

SEQ ID NO: 2263372 - RNA, 15 nt, Yersinia pestis
auaacuucauuuuuc

SEQ ID NO: 2263373 - RNA, 22 nt, Yersinia pestis
auaacugguccaacuaaacagg

SEQ ID NO: 2263374 - RNA, 16 nt, Yersinia pestis
auaaccucaggggcca

SEQ ID NO: 2263375 - RNA, 22 nt, Yersinia pestis
auaacgcuuuuucauugguaau

SEQ ID NO: 2263376 - RNA, 16 nt, Yersinia pestis
auaacggcgguaccag

SEQ ID NO: 2263377 - RNA, 21 nt, Yersinia pestis
auaacggcguucuaaaugcug

SEQ ID NO: 2263378 - RNA, 22 nt, Yersinia pestis
auaacaaguuacauuuuuaaca

SEQ ID NO: 2263379 - RNA, 15 nt, Yersinia pestis
auaacaauaaaaucu

SEQ ID NO: 2263380 - RNA, 15 nt, Yersinia pestis
auaaauccaucaaua

SEQ ID NO: 2263381 - RNA, 19 nt, Yersinia pestis
auaaaucgcccaacccccc

SEQ ID NO: 2263382 - RNA, 18 nt, Yersinia pestis
auaaaucgcauuuuuaag

SEQ ID NO: 2263383 - RNA, 20 nt, Yersinia pestis
auaacacggccuauugaaua

SEQ ID NO: 2263384 - RNA, 14 nt, Yersinia pestis
auaacagauauuac

SEQ ID NO: 2263385 - RNA, 20 nt, Yersinia pestis
auaacagauauuacgcagcc

SEQ ID NO: 2263386 - RNA, 17 nt, Yersinia pestis
auaacagggaggccagc

SEQ ID NO: 2263387 - RNA, 23 nt, Yersinia pestis
auaacacccauuugcccgaauca

SEQ ID NO: 2263388 - RNA, 21 nt, Yersinia pestis
auaaccacaacgacagccaaa

SEQ ID NO: 2263389 - RNA, 15 nt, Yersinia pestis
auaaccaaaagcccc

SEQ ID NO: 2263390 - RNA, 16 nt, Yersinia pestis
auaacauuuuuucuuu

SEQ ID NO: 2263391 - RNA, 15 nt, Yersinia pestis
auaacauccuaaaaa

SEQ ID NO: 2263392 - RNA, 18 nt, Yersinia pestis
auaacauaauaaauuaau

SEQ ID NO: 2263393 - RNA, 17 nt, Yersinia pestis
auaacauccauguaagc

SEQ ID NO: 2263394 - RNA, 23 nt, Yersinia pestis
auaaauaaccgagcgugaagagc

SEQ ID NO: 2263395 - RNA, 15 nt, Yersinia pestis
auaaauacaaaauua

SEQ ID NO: 2263396 - RNA, 13 nt, Yersinia pestis
auaaauaccaauu

SEQ ID NO: 2263397 - RNA, 14 nt, Yersinia pestis
auaaauaccaauuu

SEQ ID NO: 2263398 - RNA, 19 nt, Yersinia pestis
auaaauaauuuguaaauuu

SEQ ID NO: 2263399 - RNA, 14 nt, Yersinia pestis
auaaauaauaucaa

SEQ ID NO: 2263400 - RNA, 17 nt, Yersinia pestis
auaaauaucauuaacaa

SEQ ID NO: 2263401 - RNA, 22 nt, Yersinia pestis
auaaauacucuugagaaaugaa

SEQ ID NO: 2263402 - RNA, 20 nt, Yersinia pestis
auaaauaccgccaaauacaa

SEQ ID NO: 2263403 - RNA, 14 nt, Yersinia pestis
auaaauauccuccg

SEQ ID NO: 2263404 - RNA, 20 nt, Yersinia pestis
auaaauauccucggccagug

SEQ ID NO: 2263405 - RNA, 24 nt, Yersinia pestis
auaaagcggaucucuucagcaauu

SEQ ID NO: 2263406 - RNA, 23 nt, Yersinia pestis
auaaagccauuggucaaucuaga

SEQ ID NO: 2263407 - RNA, 16 nt, Yersinia pestis
auaaagcauuuaucau

SEQ ID NO: 2263408 - RNA, 20 nt, Yersinia pestis
auaaagcaucagacugcucu

SEQ ID NO: 2263409 - RNA, 16 nt, Yersinia pestis
auaaagccguuaucaa

SEQ ID NO: 2263410 - RNA, 20 nt, Yersinia pestis
auaaaguaaaagccagucag

SEQ ID NO: 2263411 - RNA, 14 nt, Yersinia pestis
auaaagguuugcca

SEQ ID NO: 2263412 - RNA, 14 nt, Yersinia pestis
auaaagcaucagac

SEQ ID NO: 2263413 - RNA, 20 nt, Yersinia pestis
auaaaccuacagccaucggu

SEQ ID NO: 2263414 - RNA, 18 nt, Yersinia pestis
auaaaccgugauugguuu

SEQ ID NO: 2263415 - RNA, 21 nt, Yersinia pestis
auaaacgaccauuucucugau

SEQ ID NO: 2263416 - RNA, 13 nt, Yersinia pestis
auaaaccugauuu

SEQ ID NO: 2263417 - RNA, 15 nt, Yersinia pestis
auaaaauuacccagc

SEQ ID NO: 2263418 - RNA, 17 nt, Yersinia pestis
auaaacaaaauagggcg

SEQ ID NO: 2263419 - RNA, 11 nt, Yersinia pestis
auaaaccaaau

SEQ ID NO: 2263420 - RNA, 21 nt, Yersinia pestis
auaaacaaucugaugaauuaa

SEQ ID NO: 2263421 - RNA, 22 nt, Yersinia pestis
auaaaccaauaucugccaauuc

SEQ ID NO: 2263422 - RNA, 16 nt, Yersinia pestis
auaaaccaaaugguua

SEQ ID NO: 2263423 - RNA, 21 nt, Yersinia pestis
aguuuuauacccguuauaccu

SEQ ID NO: 2263424 - RNA, 21 nt, Yersinia pestis
aguuuuagaugucagauuagu

SEQ ID NO: 2263425 - RNA, 14 nt, Yersinia pestis
aguuuuagacguca

SEQ ID NO: 2263426 - RNA, 13 nt, Yersinia pestis
auaaaaucaaaac

SEQ ID NO: 2263427 - RNA, 12 nt, Yersinia pestis
auaaaauauuau

SEQ ID NO: 2263428 - RNA, 11 nt, Yersinia pestis
auaaaauagcc

SEQ ID NO: 2263429 - RNA, 13 nt, Yersinia pestis
auaaaaucuuaau

SEQ ID NO: 2263430 - RNA, 18 nt, Yersinia pestis
auaagaaaucaucagcau

SEQ ID NO: 2263431 - RNA, 14 nt, Yersinia pestis
auaagugaauaaau

SEQ ID NO: 2263432 - RNA, 22 nt, Yersinia pestis
auaagugaauaacgcugaauaa

SEQ ID NO: 2263433 - RNA, 20 nt, Yersinia pestis
auaaguuagcgugagaauaa

SEQ ID NO: 2263434 - RNA, 12 nt, Yersinia pestis
auaaguuauuuc

SEQ ID NO: 2263435 - RNA, 17 nt, Yersinia pestis
auaaguuauuucagcca

SEQ ID NO: 2263436 - RNA, 20 nt, Yersinia pestis
auaaguuauuucagccaugg

SEQ ID NO: 2263437 - RNA, 21 nt, Yersinia pestis
auaaguuccggcagauaugau

SEQ ID NO: 2263438 - RNA, 14 nt, Yersinia pestis
auaaguuugaugua

SEQ ID NO: 2263439 - RNA, 23 nt, Yersinia pestis
auaaguugauaacgccggauaaa

SEQ ID NO: 2263440 - RNA, 13 nt, Yersinia pestis
auaaguugaacca

SEQ ID NO: 2263441 - RNA, 22 nt, Yersinia pestis
auaaguuacgucagaaauaaau

SEQ ID NO: 2263442 - RNA, 18 nt, Yersinia pestis
auaaguguuucaaauaag

SEQ ID NO: 2263443 - RNA, 20 nt, Yersinia pestis
auaaguguuucaaauaagua

SEQ ID NO: 2263444 - RNA, 11 nt, Yersinia pestis
auaaguuuuaa

SEQ ID NO: 2263445 - RNA, 11 nt, Yersinia pestis
auaauaaaaaa

SEQ ID NO: 2263446 - RNA, 15 nt, Yersinia pestis
auaauaaaaaaaaau

SEQ ID NO: 2263447 - RNA, 12 nt, Yersinia pestis
auaauaaauuaa

SEQ ID NO: 2263448 - RNA, 20 nt, Yersinia pestis
auaauaauucugcuauuaau

SEQ ID NO: 2263449 - RNA, 13 nt, Yersinia pestis
auaauaauauuga

SEQ ID NO: 2263450 - RNA, 20 nt, Yersinia pestis
auaauaagggcgcauauccu

SEQ ID NO: 2263451 - RNA, 16 nt, Yersinia pestis
auaauacgaucagcgu

SEQ ID NO: 2263452 - RNA, 18 nt, Yersinia pestis
auaauacgaaauacuuau

SEQ ID NO: 2263453 - RNA, 13 nt, Yersinia pestis
auaaucaccagac

SEQ ID NO: 2263454 - RNA, 20 nt, Yersinia pestis
auaauccgguuagcaaaaaa

SEQ ID NO: 2263455 - RNA, 17 nt, Yersinia pestis
auaaucaucuacaacau

SEQ ID NO: 2263456 - RNA, 19 nt, Yersinia pestis
auaaucaccagacaaccaa

SEQ ID NO: 2263457 - RNA, 12 nt, Yersinia pestis
auaaucaucuac

SEQ ID NO: 2263458 - RNA, 14 nt, Yersinia pestis
auaaucaccuucaa

SEQ ID NO: 2263459 - RNA, 15 nt, Yersinia pestis
auaaucaccagacaa

SEQ ID NO: 2263460 - RNA, 13 nt, Yersinia pestis
auaaugacauaau

SEQ ID NO: 2263461 - RNA, 14 nt, Yersinia pestis
auaaugagccauaa

SEQ ID NO: 2263462 - RNA, 16 nt, Yersinia pestis
auaaucuuuacugcau

SEQ ID NO: 2263463 - RNA, 16 nt, Yersinia pestis
auaaucuuaaguaaau

SEQ ID NO: 2263464 - RNA, 22 nt, Yersinia pestis
auaauugaguggcgaucuuaau

SEQ ID NO: 2263465 - RNA, 18 nt, Yersinia pestis
auaauucugccgacuaau

SEQ ID NO: 2263466 - RNA, 13 nt, Yersinia pestis
auaauucugcuau

SEQ ID NO: 2263467 - RNA, 16 nt, Yersinia pestis
auaauuucaaaguaaa

SEQ ID NO: 2263468 - RNA, 13 nt, Yersinia pestis
auaauuucagcag

SEQ ID NO: 2263469 - RNA, 14 nt, Yersinia pestis
auaauuuauuucag

SEQ ID NO: 2263470 - RNA, 15 nt, Yersinia pestis
auaauuuagcaaagc

SEQ ID NO: 2263471 - RNA, 21 nt, Yersinia pestis
auaauuguucauaaaccugau

SEQ ID NO: 2263472 - RNA, 14 nt, Yersinia pestis
auaauuugccuggc

SEQ ID NO: 2263473 - RNA, 22 nt, Yersinia pestis
auaauuuguauucucaucauca

SEQ ID NO: 2263474 - RNA, 21 nt, Yersinia pestis
auaauuucuacgccgucauca

SEQ ID NO: 2263475 - RNA, 23 nt, Yersinia pestis
auaauuucuacgccgucaucauc

SEQ ID NO: 2263476 - RNA, 14 nt, Yersinia pestis
auaauuuugaugcu

SEQ ID NO: 2263477 - RNA, 21 nt, Yersinia pestis
auaauuuuuacgauaucacca

SEQ ID NO: 2263478 - RNA, 18 nt, Yersinia pestis
auacaauccaaccuauau

SEQ ID NO: 2263479 - RNA, 15 nt, Yersinia pestis
auacaauuauuuuua

SEQ ID NO: 2263480 - RNA, 17 nt, Yersinia pestis
auacacaugaaaaucaa

SEQ ID NO: 2263481 - RNA, 20 nt, Yersinia pestis
auacaauugccugauuuuua

SEQ ID NO: 2263482 - RNA, 11 nt, Yersinia pestis
auacaauuuuu

SEQ ID NO: 2263483 - RNA, 16 nt, Yersinia pestis
auacaaccaacaaaca

SEQ ID NO: 2263484 - RNA, 22 nt, Yersinia pestis
auacaacaacgggucacagcca

SEQ ID NO: 2263485 - RNA, 15 nt, Yersinia pestis
auacaaccauuucaa

SEQ ID NO: 2263486 - RNA, 18 nt, Yersinia pestis
auacaaggcacaucucca

SEQ ID NO: 2263487 - RNA, 18 nt, Yersinia pestis
auacaaccaacaaacaau

SEQ ID NO: 2263488 - RNA, 18 nt, Yersinia pestis
auacaaccccacaccucg

SEQ ID NO: 2263489 - RNA, 16 nt, Yersinia pestis
auacagccagcgggcg

SEQ ID NO: 2263490 - RNA, 20 nt, Yersinia pestis
auacacucguggugauuaau

SEQ ID NO: 2263491 - RNA, 18 nt, Yersinia pestis
auacacuugcucuaccac

SEQ ID NO: 2263492 - RNA, 14 nt, Yersinia pestis
auacaccgcaccac

SEQ ID NO: 2263493 - RNA, 9 nt, Yersinia pestis
auacaccaa

SEQ ID NO: 2263494 - RNA, 23 nt, Yersinia pestis
auacaccauuuccaggcuaccaa

SEQ ID NO: 2263495 - RNA, 21 nt, Yersinia pestis
auacacccgaaggccauugcc

SEQ ID NO: 2263496 - RNA, 11 nt, Yersinia pestis
auacacgcuuc

SEQ ID NO: 2263497 - RNA, 20 nt, Yersinia pestis
auacacuccauuaauuuauu

SEQ ID NO: 2263498 - RNA, 19 nt, Yersinia pestis
agucuuuuuaauaugugac

SEQ ID NO: 2263499 - RNA, 13 nt, Yersinia pestis
agugaaaaaugag

SEQ ID NO: 2263500 - RNA, 22 nt, Yersinia pestis
agugaaaacguuaacugcagua

SEQ ID NO: 2263501 - RNA, 15 nt, Yersinia pestis
agugaagauuuuuga

SEQ ID NO: 2263502 - RNA, 14 nt, Yersinia pestis
agucugagggccac

SEQ ID NO: 2263503 - RNA, 20 nt, Yersinia pestis
agucugagguggccauuacg

SEQ ID NO: 2263504 - RNA, 19 nt, Yersinia pestis
agucugaaaugaucaccgc

SEQ ID NO: 2263505 - RNA, 14 nt, Yersinia pestis
agucugaggagcca

SEQ ID NO: 2263506 - RNA, 20 nt, Yersinia pestis
agucugaaggguauugaaga

SEQ ID NO: 2263507 - RNA, 19 nt, Yersinia pestis
agucucuguggauugccaa

SEQ ID NO: 2263508 - RNA, 20 nt, Yersinia pestis
agucucuguggauugccaaa

SEQ ID NO: 2263509 - RNA, 15 nt, Yersinia pestis
aguccucucaccaag

SEQ ID NO: 2263510 - RNA, 18 nt, Yersinia pestis
aguccuccuugagauccu

SEQ ID NO: 2263511 - RNA, 17 nt, Yersinia pestis
agucgaugaaacacaac

SEQ ID NO: 2263512 - RNA, 22 nt, Yersinia pestis
agucgcgauaaaauucagccac

SEQ ID NO: 2263513 - RNA, 20 nt, Yersinia pestis
agucgcuucauccgcgcuga

SEQ ID NO: 2263514 - RNA, 14 nt, Yersinia pestis
aguauuuguaguga

SEQ ID NO: 2263515 - RNA, 20 nt, Yersinia pestis
agucaaaacaauaucuauuu

SEQ ID NO: 2263516 - RNA, 12 nt, Yersinia pestis
agucaaaacaau

SEQ ID NO: 2263517 - RNA, 14 nt, Yersinia pestis
agucaaaacaauau

SEQ ID NO: 2263518 - RNA, 20 nt, Yersinia pestis
agucaaauuuaaaguuuuuu

SEQ ID NO: 2263519 - RNA, 13 nt, Yersinia pestis
aguccguagaaau

SEQ ID NO: 2263520 - RNA, 15 nt, Yersinia pestis
aguccguuaaaaaau

SEQ ID NO: 2263521 - RNA, 22 nt, Yersinia pestis
aguccguuaaaaaauucaucuu

SEQ ID NO: 2263522 - RNA, 18 nt, Yersinia pestis
aguguaucaauaggauuu

SEQ ID NO: 2263523 - RNA, 22 nt, Yersinia pestis
aguggucggccauuuacccguc

SEQ ID NO: 2263524 - RNA, 15 nt, Yersinia pestis
aguggcacaaauaaa

SEQ ID NO: 2263525 - RNA, 17 nt, Yersinia pestis
aguggcauaaccaauca

SEQ ID NO: 2263526 - RNA, 15 nt, Yersinia pestis
aguggcaucaauaua

SEQ ID NO: 2263527 - RNA, 15 nt, Yersinia pestis
agugcuucaaauccu

SEQ ID NO: 2263528 - RNA, 16 nt, Yersinia pestis
agugcuuaacccacca

SEQ ID NO: 2263529 - RNA, 22 nt, Yersinia pestis
agugcugguugagauuaucagc

SEQ ID NO: 2263530 - RNA, 13 nt, Yersinia pestis
aguggaucugggg

SEQ ID NO: 2263531 - RNA, 22 nt, Yersinia pestis
agugcugccgcaacggcaccuc

SEQ ID NO: 2263532 - RNA, 13 nt, Yersinia pestis
agugcugaucacc

SEQ ID NO: 2263533 - RNA, 13 nt, Yersinia pestis
agugcgguaacca

SEQ ID NO: 2263534 - RNA, 22 nt, Yersinia pestis
agugcgguaaccagcaucagua

SEQ ID NO: 2263535 - RNA, 22 nt, Yersinia pestis
agugccgcggcggccagcggca

SEQ ID NO: 2263536 - RNA, 14 nt, Yersinia pestis
agugcagccaagau

SEQ ID NO: 2263537 - RNA, 21 nt, Yersinia pestis
agugcaauuauuuagccugcc

SEQ ID NO: 2263538 - RNA, 22 nt, Yersinia pestis
agugcacagauaggagaagguu

SEQ ID NO: 2263539 - RNA, 12 nt, Yersinia pestis
agugcacugaac

SEQ ID NO: 2263540 - RNA, 18 nt, Yersinia pestis
agugcagaucugcccccc

SEQ ID NO: 2263541 - RNA, 22 nt, Yersinia pestis
agugcauuaucuuuaauuuuuc

SEQ ID NO: 2263542 - RNA, 16 nt, Yersinia pestis
agugcauccccacuga

SEQ ID NO: 2263543 - RNA, 17 nt, Yersinia pestis
agugcauuaucuuuaau

SEQ ID NO: 2263544 - RNA, 17 nt, Yersinia pestis
agugccaaaauaucuuc

SEQ ID NO: 2263545 - RNA, 20 nt, Yersinia pestis
agugcauugcagaaagcuga

SEQ ID NO: 2263546 - RNA, 22 nt, Yersinia pestis
agugccaucgccaacaggccua

SEQ ID NO: 2263547 - RNA, 18 nt, Yersinia pestis
agugauucgagugcguga

SEQ ID NO: 2263548 - RNA, 21 nt, Yersinia pestis
agugauuauagcggcaaggau

SEQ ID NO: 2263549 - RNA, 22 nt, Yersinia pestis
agugauucgggugagugagcgc

SEQ ID NO: 2263550 - RNA, 14 nt, Yersinia pestis
agugauuuuaacca

SEQ ID NO: 2263551 - RNA, 16 nt, Yersinia pestis
agugcaacauuaaaaa

SEQ ID NO: 2263552 - RNA, 19 nt, Yersinia pestis
agugcaaccaacaccaaug

SEQ ID NO: 2263553 - RNA, 16 nt, Yersinia pestis
agugaaguaucaccac

SEQ ID NO: 2263554 - RNA, 11 nt, Yersinia pestis
agugaaucagc

SEQ ID NO: 2263555 - RNA, 15 nt, Yersinia pestis
agugauauaacccag

SEQ ID NO: 2263556 - RNA, 15 nt, Yersinia pestis
agugauagcgggccu

SEQ ID NO: 2263557 - RNA, 16 nt, Yersinia pestis
agugaaugcugcgugu

SEQ ID NO: 2263558 - RNA, 15 nt, Yersinia pestis
agugaucaaugacuu

SEQ ID NO: 2263559 - RNA, 19 nt, Yersinia pestis
aguugucuauuuucauuau

SEQ ID NO: 2263560 - RNA, 15 nt, Yersinia pestis
aguugcaguucauca

SEQ ID NO: 2263561 - RNA, 17 nt, Yersinia pestis
aguugcaguucaucaau

SEQ ID NO: 2263562 - RNA, 21 nt, Yersinia pestis
aguugccguuugaugcgcuga

SEQ ID NO: 2263563 - RNA, 17 nt, Yersinia pestis
aguugcccuaaacagca

SEQ ID NO: 2263564 - RNA, 23 nt, Yersinia pestis
aguuuagucuagucuagcugcgc

SEQ ID NO: 2263565 - RNA, 13 nt, Yersinia pestis
aguuuauaugcuu

SEQ ID NO: 2263566 - RNA, 14 nt, Yersinia pestis
aguuuauuuaagcu

SEQ ID NO: 2263567 - RNA, 19 nt, Yersinia pestis
aguuuauuuucccuuucuc

SEQ ID NO: 2263568 - RNA, 21 nt, Yersinia pestis
aguuuauuuucccuuucucag

SEQ ID NO: 2263569 - RNA, 13 nt, Yersinia pestis
aguuuauuuuccc

SEQ ID NO: 2263570 - RNA, 17 nt, Yersinia pestis
aguuuauggaaauuauu

SEQ ID NO: 2263571 - RNA, 21 nt, Yersinia pestis
aguuuauggaaauuauuuaga

SEQ ID NO: 2263572 - RNA, 18 nt, Yersinia pestis
aguuuaaucaguucuuua

SEQ ID NO: 2263573 - RNA, 20 nt, Yersinia pestis
aguuugguaauacugagacc

SEQ ID NO: 2263574 - RNA, 21 nt, Yersinia pestis
aguuuuaaacgucagauuagu

SEQ ID NO: 2263575 - RNA, 18 nt, Yersinia pestis
aguuuuaaacgucagauu

SEQ ID NO: 2263576 - RNA, 17 nt, Yersinia pestis
aguuugauguagcagau

SEQ ID NO: 2263577 - RNA, 15 nt, Yersinia pestis
aguuugacgcuguau

SEQ ID NO: 2263578 - RNA, 14 nt, Yersinia pestis
aguuuccaguucaa

SEQ ID NO: 2263579 - RNA, 16 nt, Yersinia pestis
aguuucacccucugcg

SEQ ID NO: 2263580 - RNA, 16 nt, Yersinia pestis
aguuucacuuucaacu

SEQ ID NO: 2263581 - RNA, 21 nt, Yersinia pestis
aguucugcgccccccggauac

SEQ ID NO: 2263582 - RNA, 19 nt, Yersinia pestis
aguucuggaucggcauacu

SEQ ID NO: 2263583 - RNA, 20 nt, Yersinia pestis
aguucuguaucgcuagggau

SEQ ID NO: 2263584 - RNA, 22 nt, Yersinia pestis
aguucugguagcugcucacgau

SEQ ID NO: 2263585 - RNA, 18 nt, Yersinia pestis
aguucuucugauaaaaca

SEQ ID NO: 2263586 - RNA, 16 nt, Yersinia pestis
aguugauaaagcugga

SEQ ID NO: 2263587 - RNA, 23 nt, Yersinia pestis
aguugauauaccgauuaccgggu

SEQ ID NO: 2263588 - RNA, 14 nt, Yersinia pestis
aguugaucacccgc

SEQ ID NO: 2263589 - RNA, 14 nt, Yersinia pestis
aguucguucccugu

SEQ ID NO: 2263590 - RNA, 21 nt, Yersinia pestis
aguucguauguuuuuaacaaa

SEQ ID NO: 2263591 - RNA, 18 nt, Yersinia pestis
aguucgguugccaaaauu

SEQ ID NO: 2263592 - RNA, 16 nt, Yersinia pestis
aguucauuuugaccag

SEQ ID NO: 2263593 - RNA, 20 nt, Yersinia pestis
aguucauuuugaccagcaua

SEQ ID NO: 2263594 - RNA, 11 nt, Yersinia pestis
aguucauucgc

SEQ ID NO: 2263595 - RNA, 13 nt, Yersinia pestis
aguuccagcccca

SEQ ID NO: 2263596 - RNA, 13 nt, Yersinia pestis
aguuauucccauc

SEQ ID NO: 2263597 - RNA, 16 nt, Yersinia pestis
aguuauuauuuuuaau

SEQ ID NO: 2263598 - RNA, 15 nt, Yersinia pestis
aguucacaugaugaa

SEQ ID NO: 2263599 - RNA, 12 nt, Yersinia pestis
aguuauucugau

SEQ ID NO: 2263600 - RNA, 21 nt, Yersinia pestis
aguucaccagcuugggugaag

SEQ ID NO: 2263601 - RNA, 20 nt, Yersinia pestis
aguucacugaguugcuggaa

SEQ ID NO: 2263602 - RNA, 16 nt, Yersinia pestis
aguucacucuguuuua

SEQ ID NO: 2263603 - RNA, 21 nt, Yersinia pestis
aguucagauuuagcgauauaa

SEQ ID NO: 2263604 - RNA, 14 nt, Yersinia pestis
aguucauggccaug

SEQ ID NO: 2263605 - RNA, 15 nt, Yersinia pestis
aguuagcaggcagca

SEQ ID NO: 2263606 - RNA, 21 nt, Yersinia pestis
aguuaucucccauuaauuaau

SEQ ID NO: 2263607 - RNA, 20 nt, Yersinia pestis
aguuaucuguuucaaauaag

SEQ ID NO: 2263608 - RNA, 21 nt, Yersinia pestis
aguuaucuguuucaaauaagu

SEQ ID NO: 2263609 - RNA, 17 nt, Yersinia pestis
aguuauccucgcucaca

SEQ ID NO: 2263610 - RNA, 20 nt, Yersinia pestis
aguguaugaguaucaauauu

SEQ ID NO: 2263611 - RNA, 23 nt, Yersinia pestis
aguguaugaguaucaauauugug

SEQ ID NO: 2263612 - RNA, 21 nt, Yersinia pestis
aguguauucgcaucuuccaaa

SEQ ID NO: 2263613 - RNA, 18 nt, Yersinia pestis
agugucagggcaauaaca

SEQ ID NO: 2263614 - RNA, 20 nt, Yersinia pestis
agugucagggcaauaacaaa

SEQ ID NO: 2263615 - RNA, 14 nt, Yersinia pestis
aguuaaucgcagca

SEQ ID NO: 2263616 - RNA, 19 nt, Yersinia pestis
aguuaauguguuuuuguca

SEQ ID NO: 2263617 - RNA, 16 nt, Yersinia pestis
aguuacaauaaaucaa

SEQ ID NO: 2263618 - RNA, 14 nt, Yersinia pestis
aguuaauuuucacc

SEQ ID NO: 2263619 - RNA, 22 nt, Yersinia pestis
aguuacaguagugaagauaaua

SEQ ID NO: 2263620 - RNA, 15 nt, Yersinia pestis
aguuacacagaauua

SEQ ID NO: 2263621 - RNA, 14 nt, Yersinia pestis
aguuacagcaaaua

SEQ ID NO: 2263622 - RNA, 15 nt, Yersinia pestis
aguuacgucagaaau

SEQ ID NO: 2263623 - RNA, 18 nt, Yersinia pestis
aguuacuccuacaccauu

SEQ ID NO: 2263624 - RNA, 21 nt, Yersinia pestis
aguuacuguaagauaauucga

SEQ ID NO: 2263625 - RNA, 19 nt, Yersinia pestis
augaagggggcuuauucua

SEQ ID NO: 2263626 - RNA, 22 nt, Yersinia pestis
augaaguuauccuccauucugc

SEQ ID NO: 2263627 - RNA, 12 nt, Yersinia pestis
augaaguuauuu

SEQ ID NO: 2263628 - RNA, 22 nt, Yersinia pestis
augaauuuauccuguacauaua

SEQ ID NO: 2263629 - RNA, 22 nt, Yersinia pestis
augaaugagguuuacauuuaaa

SEQ ID NO: 2263630 - RNA, 13 nt, Yersinia pestis
augaaugaggcug

SEQ ID NO: 2263631 - RNA, 14 nt, Yersinia pestis
augaaugaggcuga

SEQ ID NO: 2263632 - RNA, 16 nt, Yersinia pestis
augaaugaggcugagg

SEQ ID NO: 2263633 - RNA, 13 nt, Yersinia pestis
augaaccgccaau

SEQ ID NO: 2263634 - RNA, 13 nt, Yersinia pestis
augaacucaacuu

SEQ ID NO: 2263635 - RNA, 23 nt, Yersinia pestis
augaacguguuagguaauaccaa

SEQ ID NO: 2263636 - RNA, 18 nt, Yersinia pestis
augaacacagcuaaauua

SEQ ID NO: 2263637 - RNA, 17 nt, Yersinia pestis
aucuuuauuauuauuua

SEQ ID NO: 2263638 - RNA, 19 nt, Yersinia pestis
aucuuucauaucaaaagga

SEQ ID NO: 2263639 - RNA, 18 nt, Yersinia pestis
aucuucgcuuagucgcca

SEQ ID NO: 2263640 - RNA, 15 nt, Yersinia pestis
aucuuccuuuccauu

SEQ ID NO: 2263641 - RNA, 19 nt, Yersinia pestis
aucuuccuuuccauuuuca

SEQ ID NO: 2263642 - RNA, 21 nt, Yersinia pestis
augaaaguaagagucuggauu

SEQ ID NO: 2263643 - RNA, 19 nt, Yersinia pestis
augaaaaauacaaauauaa

SEQ ID NO: 2263644 - RNA, 14 nt, Yersinia pestis
augaaaaauacaaa

SEQ ID NO: 2263645 - RNA, 23 nt, Yersinia pestis
aucuuuuaguaacaaaaugcggu

SEQ ID NO: 2263646 - RNA, 21 nt, Yersinia pestis
aucuuuuacaaauuugacauu

SEQ ID NO: 2263647 - RNA, 20 nt, Yersinia pestis
augagcgcauugcacagguc

SEQ ID NO: 2263648 - RNA, 19 nt, Yersinia pestis
augagcgccaaauguagag

SEQ ID NO: 2263649 - RNA, 19 nt, Yersinia pestis
augagcuggcaaaacucag

SEQ ID NO: 2263650 - RNA, 13 nt, Yersinia pestis
augaggcucagac

SEQ ID NO: 2263651 - RNA, 21 nt, Yersinia pestis
augaggcucuucugggcugaa

SEQ ID NO: 2263652 - RNA, 13 nt, Yersinia pestis
augaguacuauuu

SEQ ID NO: 2263653 - RNA, 22 nt, Yersinia pestis
augaguaaaccguacauuaaau

SEQ ID NO: 2263654 - RNA, 18 nt, Yersinia pestis
augagugaaaauauguag

SEQ ID NO: 2263655 - RNA, 21 nt, Yersinia pestis
augagugaaaauauguaguug

SEQ ID NO: 2263656 - RNA, 19 nt, Yersinia pestis
augacaguauuugcagcgg

SEQ ID NO: 2263657 - RNA, 22 nt, Yersinia pestis
augacaguauuugcagcggaug

SEQ ID NO: 2263658 - RNA, 20 nt, Yersinia pestis
augacaguauuuguagugga

SEQ ID NO: 2263659 - RNA, 18 nt, Yersinia pestis
augacuaauugugcagca

SEQ ID NO: 2263660 - RNA, 19 nt, Yersinia pestis
augacuagguuauaauucc

SEQ ID NO: 2263661 - RNA, 16 nt, Yersinia pestis
augacuucuuccacuu

SEQ ID NO: 2263662 - RNA, 21 nt, Yersinia pestis
augaguuugaucacagcucuc

SEQ ID NO: 2263663 - RNA, 20 nt, Yersinia pestis
augauaaauacaaaauuaac

SEQ ID NO: 2263664 - RNA, 14 nt, Yersinia pestis
augauaaaacuauu

SEQ ID NO: 2263665 - RNA, 20 nt, Yersinia pestis
augauaaccacaacgacagc

SEQ ID NO: 2263666 - RNA, 16 nt, Yersinia pestis
augauaacaauaaaau

SEQ ID NO: 2263667 - RNA, 17 nt, Yersinia pestis
augauaacaauaaaauc

SEQ ID NO: 2263668 - RNA, 22 nt, Yersinia pestis
augauaaauucuugcgcuucau

SEQ ID NO: 2263669 - RNA, 18 nt, Yersinia pestis
augauagcgacacccuca

SEQ ID NO: 2263670 - RNA, 13 nt, Yersinia pestis
augauaaugccau

SEQ ID NO: 2263671 - RNA, 15 nt, Yersinia pestis
augauauugaugacg

SEQ ID NO: 2263672 - RNA, 13 nt, Yersinia pestis
augauauagcugu

SEQ ID NO: 2263673 - RNA, 19 nt, Yersinia pestis
augauauacccaccagaga

SEQ ID NO: 2263674 - RNA, 16 nt, Yersinia pestis
augaucaucaagccaa

SEQ ID NO: 2263675 - RNA, 14 nt, Yersinia pestis
augaucaaauuaua

SEQ ID NO: 2263676 - RNA, 17 nt, Yersinia pestis
aucgucacgaucaacca

SEQ ID NO: 2263677 - RNA, 15 nt, Yersinia pestis
aucgucacagcaauu

SEQ ID NO: 2263678 - RNA, 15 nt, Yersinia pestis
aucgucaagcaaugg

SEQ ID NO: 2263679 - RNA, 19 nt, Yersinia pestis
aucuacagacuccaaauua

SEQ ID NO: 2263680 - RNA, 17 nt, Yersinia pestis
aucuaauuucaaaugaa

SEQ ID NO: 2263681 - RNA, 13 nt, Yersinia pestis
aucuacaacauca

SEQ ID NO: 2263682 - RNA, 13 nt, Yersinia pestis
aucuauaucggcc

SEQ ID NO: 2263683 - RNA, 14 nt, Yersinia pestis
aucuaucuguucac

SEQ ID NO: 2263684 - RNA, 20 nt, Yersinia pestis
aucucagcagugaguuuauu

SEQ ID NO: 2263685 - RNA, 23 nt, Yersinia pestis
aucucagugagguuuuugauggu

SEQ ID NO: 2263686 - RNA, 13 nt, Yersinia pestis
aucucaccacgcc

SEQ ID NO: 2263687 - RNA, 15 nt, Yersinia pestis
aucucacucaggcgu

SEQ ID NO: 2263688 - RNA, 18 nt, Yersinia pestis
aucucacgcugaauaaca

SEQ ID NO: 2263689 - RNA, 16 nt, Yersinia pestis
aucuccagaagcauau

SEQ ID NO: 2263690 - RNA, 23 nt, Yersinia pestis
aucucaucaaucgucaauccaau

SEQ ID NO: 2263691 - RNA, 20 nt, Yersinia pestis
aucucauccagcaacucaag

SEQ ID NO: 2263692 - RNA, 19 nt, Yersinia pestis
aucucaucggcauacuccu

SEQ ID NO: 2263693 - RNA, 22 nt, Yersinia pestis
aucucauccauguuagagauaa

SEQ ID NO: 2263694 - RNA, 16 nt, Yersinia pestis
aucucaugacaaagaa

SEQ ID NO: 2263695 - RNA, 21 nt, Yersinia pestis
aucuccuguggcacaucaaua

SEQ ID NO: 2263696 - RNA, 14 nt, Yersinia pestis
aucucgacaaaucc

SEQ ID NO: 2263697 - RNA, 19 nt, Yersinia pestis
aucucgacaaauccuuuua

SEQ ID NO: 2263698 - RNA, 22 nt, Yersinia pestis
aucucgacaaauccuuuuaaaa

SEQ ID NO: 2263699 - RNA, 18 nt, Yersinia pestis
aucucgagguguuuuccc

SEQ ID NO: 2263700 - RNA, 20 nt, Yersinia pestis
aucucuuuauauucaauauc

SEQ ID NO: 2263701 - RNA, 21 nt, Yersinia pestis
aucucuuuauauucaauauca

SEQ ID NO: 2263702 - RNA, 23 nt, Yersinia pestis
aucucuggcaacggcacauccca

SEQ ID NO: 2263703 - RNA, 16 nt, Yersinia pestis
aucucugcgacaucag

SEQ ID NO: 2263704 - RNA, 15 nt, Yersinia pestis
aucucugccgcugaa

SEQ ID NO: 2263705 - RNA, 18 nt, Yersinia pestis
aucugaaacggugaggau

SEQ ID NO: 2263706 - RNA, 15 nt, Yersinia pestis
aucugaauggcccgc

SEQ ID NO: 2263707 - RNA, 15 nt, Yersinia pestis
aucugaccaaacauu

SEQ ID NO: 2263708 - RNA, 19 nt, Yersinia pestis
aucugacucuguaaaaauc

SEQ ID NO: 2263709 - RNA, 22 nt, Yersinia pestis
aucugcucccggcacuaagugu

SEQ ID NO: 2263710 - RNA, 23 nt, Yersinia pestis
aucugcucauuaccaauaccauu

SEQ ID NO: 2263711 - RNA, 16 nt, Yersinia pestis
aucugcggugaucacc

SEQ ID NO: 2263712 - RNA, 20 nt, Yersinia pestis
aucugcgguaaccaauaaca

SEQ ID NO: 2263713 - RNA, 16 nt, Yersinia pestis
aucuuaaauugaagag

SEQ ID NO: 2263714 - RNA, 13 nt, Yersinia pestis
aucuuaaaaauaa

SEQ ID NO: 2263715 - RNA, 16 nt, Yersinia pestis
aucuguuucaaauaag

SEQ ID NO: 2263716 - RNA, 20 nt, Yersinia pestis
aucuggcguagguaguggcu

SEQ ID NO: 2263717 - RNA, 20 nt, Yersinia pestis
aucuggcgauuuugcggcug

SEQ ID NO: 2263718 - RNA, 12 nt, Yersinia pestis
aucuggcuggca

SEQ ID NO: 2263719 - RNA, 13 nt, Yersinia pestis
aucuggcuggcau

SEQ ID NO: 2263720 - RNA, 17 nt, Yersinia pestis
aucugggcgacccaaag

SEQ ID NO: 2263721 - RNA, 19 nt, Yersinia pestis
aucugggcgacccaaagcu

SEQ ID NO: 2263722 - RNA, 19 nt, Yersinia pestis
aucugggcugcgcuuacca

SEQ ID NO: 2263723 - RNA, 17 nt, Yersinia pestis
aucuuauccacagcaug

SEQ ID NO: 2263724 - RNA, 19 nt, Yersinia pestis
aucuuaccuucaguuuauu

SEQ ID NO: 2263725 - RNA, 18 nt, Yersinia pestis
aucuuccacucuuucaau

SEQ ID NO: 2263726 - RNA, 13 nt, Yersinia pestis
aucuuccaaagga

SEQ ID NO: 2263727 - RNA, 15 nt, Yersinia pestis
aucuuccaaaggaag

SEQ ID NO: 2263728 - RNA, 16 nt, Yersinia pestis
aucuuccaaaggaagg

SEQ ID NO: 2263729 - RNA, 17 nt, Yersinia pestis
aucuucauugccuucua

SEQ ID NO: 2263730 - RNA, 15 nt, Yersinia pestis
aucuucacucagcgc

SEQ ID NO: 2263731 - RNA, 22 nt, Yersinia pestis
aucuucagaaacggugaaaaua

SEQ ID NO: 2263732 - RNA, 21 nt, Yersinia pestis
aucuucauccgcuccagccug

SEQ ID NO: 2263733 - RNA, 19 nt, Yersinia pestis
auccugugauucagccaac

SEQ ID NO: 2263734 - RNA, 24 nt, Yersinia pestis
auccuguacauauauaauacuauu

SEQ ID NO: 2263735 - RNA, 15 nt, Yersinia pestis
auccgcuccagccug

SEQ ID NO: 2263736 - RNA, 23 nt, Yersinia pestis
auccgcuggcggcguugucuuau

SEQ ID NO: 2263737 - RNA, 16 nt, Yersinia pestis
auccggauuaaauucu

SEQ ID NO: 2263738 - RNA, 20 nt, Yersinia pestis
auccuggccguguuuuuccc

SEQ ID NO: 2263739 - RNA, 12 nt, Yersinia pestis
aucgaaugauca

SEQ ID NO: 2263740 - RNA, 20 nt, Yersinia pestis
aucgaccgaguguaaaaagc

SEQ ID NO: 2263741 - RNA, 13 nt, Yersinia pestis
aucgaucaaccau

SEQ ID NO: 2263742 - RNA, 17 nt, Yersinia pestis
aucgcauugucacccac

SEQ ID NO: 2263743 - RNA, 12 nt, Yersinia pestis
aucgccaacacu

SEQ ID NO: 2263744 - RNA, 17 nt, Yersinia pestis
aucgccaacaggccuaa

SEQ ID NO: 2263745 - RNA, 14 nt, Yersinia pestis
aucgccaaagccgu

SEQ ID NO: 2263746 - RNA, 12 nt, Yersinia pestis
aucgccaauugg

SEQ ID NO: 2263747 - RNA, 16 nt, Yersinia pestis
aucgccaacauaagua

SEQ ID NO: 2263748 - RNA, 19 nt, Yersinia pestis
aucgccaauaaccgcagca

SEQ ID NO: 2263749 - RNA, 19 nt, Yersinia pestis
aucgccaauuggucaugau

SEQ ID NO: 2263750 - RNA, 16 nt, Yersinia pestis
aucgccagcugcaauu

SEQ ID NO: 2263751 - RNA, 20 nt, Yersinia pestis
aucgccagcugcaauugccg

SEQ ID NO: 2263752 - RNA, 23 nt, Yersinia pestis
aucgccagacuguucacaagcca

SEQ ID NO: 2263753 - RNA, 19 nt, Yersinia pestis
aucgccagcaaaucacauu

SEQ ID NO: 2263754 - RNA, 20 nt, Yersinia pestis
aucggccagugcgccggccu

SEQ ID NO: 2263755 - RNA, 15 nt, Yersinia pestis
aucggcauaaauggc

SEQ ID NO: 2263756 - RNA, 21 nt, Yersinia pestis
aucgcucugcguuuuucccug

SEQ ID NO: 2263757 - RNA, 13 nt, Yersinia pestis
aucgcucuucacg

SEQ ID NO: 2263758 - RNA, 19 nt, Yersinia pestis
aucgcucugcguuuuuccc

SEQ ID NO: 2263759 - RNA, 24 nt, Yersinia pestis
aucgcuuuuaugguuuugugucac

SEQ ID NO: 2263760 - RNA, 17 nt, Yersinia pestis
aucgcuuuuuacacugu

SEQ ID NO: 2263761 - RNA, 15 nt, Yersinia pestis
aucgcuaaauacugc

SEQ ID NO: 2263762 - RNA, 22 nt, Yersinia pestis
aucgcuaaccgccaguucugga

SEQ ID NO: 2263763 - RNA, 20 nt, Yersinia pestis
aucgcuacguacuaucuauu

SEQ ID NO: 2263764 - RNA, 21 nt, Yersinia pestis
aucgcgcccauccgcaggaag

SEQ ID NO: 2263765 - RNA, 13 nt, Yersinia pestis
aucgcgcuucagg

SEQ ID NO: 2263766 - RNA, 17 nt, Yersinia pestis
aucgccgccaauguuuc

SEQ ID NO: 2263767 - RNA, 21 nt, Yersinia pestis
aucgccgaaaucucaccacgc

SEQ ID NO: 2263768 - RNA, 16 nt, Yersinia pestis
aucgguuucagcuugc

SEQ ID NO: 2263769 - RNA, 15 nt, Yersinia pestis
aucgguuagcuacug

SEQ ID NO: 2263770 - RNA, 13 nt, Yersinia pestis
aucgguaaaucgc

SEQ ID NO: 2263771 - RNA, 17 nt, Yersinia pestis
aucgggagaugcaguaa

SEQ ID NO: 2263772 - RNA, 21 nt, Yersinia pestis
aucgggacgcguuugcuugcu

SEQ ID NO: 2263773 - RNA, 20 nt, Yersinia pestis
aucggcuguuaccaaacauu

SEQ ID NO: 2263774 - RNA, 21 nt, Yersinia pestis
aucgggcggauagccgaagaa

SEQ ID NO: 2263775 - RNA, 23 nt, Yersinia pestis
aucgggaugcgcucgcuugcugc

SEQ ID NO: 2263776 - RNA, 15 nt, Yersinia pestis
aucgggcuaucauca

SEQ ID NO: 2263777 - RNA, 15 nt, Yersinia pestis
aucggcgacauccac

SEQ ID NO: 2263778 - RNA, 14 nt, Yersinia pestis
aucggccugcgcug

SEQ ID NO: 2263779 - RNA, 20 nt, Yersinia pestis
aucggccugcgcugcuuuuu

SEQ ID NO: 2263780 - RNA, 17 nt, Yersinia pestis
auccgacugcagaaaau

SEQ ID NO: 2263781 - RNA, 21 nt, Yersinia pestis
auccgaccacugacaaaaaca

SEQ ID NO: 2263782 - RNA, 15 nt, Yersinia pestis
auccgcaggaagcaa

SEQ ID NO: 2263783 - RNA, 20 nt, Yersinia pestis
auccgccucggugaaauaag

SEQ ID NO: 2263784 - RNA, 21 nt, Yersinia pestis
auccgccugcuggccauuuac

SEQ ID NO: 2263785 - RNA, 20 nt, Yersinia pestis
aucccuucggcaugcaacuu

SEQ ID NO: 2263786 - RNA, 23 nt, Yersinia pestis
aucccuucugaaacuucaaaauc

SEQ ID NO: 2263787 - RNA, 14 nt, Yersinia pestis
aucccugugcugag

SEQ ID NO: 2263788 - RNA, 22 nt, Yersinia pestis
aucccuggcucaucaaaggagu

SEQ ID NO: 2263789 - RNA, 15 nt, Yersinia pestis
aucccuggguuugag

SEQ ID NO: 2263790 - RNA, 20 nt, Yersinia pestis
aucccuugcggcauagcaaa

SEQ ID NO: 2263791 - RNA, 15 nt, Yersinia pestis
aucccuugacugacc

SEQ ID NO: 2263792 - RNA, 13 nt, Yersinia pestis
auccgaaaaauau

SEQ ID NO: 2263793 - RNA, 24 nt, Yersinia pestis
aucccucacguuuagccaugaggu

SEQ ID NO: 2263794 - RNA, 15 nt, Yersinia pestis
aucccuauuuuuucc

SEQ ID NO: 2263795 - RNA, 16 nt, Yersinia pestis
auccauuacagcaccu

SEQ ID NO: 2263796 - RNA, 18 nt, Yersinia pestis
auccauuguauugcucag

SEQ ID NO: 2263797 - RNA, 18 nt, Yersinia pestis
auccauucggcuaaauaa

SEQ ID NO: 2263798 - RNA, 17 nt, Yersinia pestis
auccauuuucugccaac

SEQ ID NO: 2263799 - RNA, 18 nt, Yersinia pestis
auccaggaugguuaucaa

SEQ ID NO: 2263800 - RNA, 13 nt, Yersinia pestis
aucccgcuggaag

SEQ ID NO: 2263801 - RNA, 23 nt, Yersinia pestis
aucccaguuuuuaauuuaaacuc

SEQ ID NO: 2263802 - RNA, 12 nt, Yersinia pestis
auccaauaggau

SEQ ID NO: 2263803 - RNA, 19 nt, Yersinia pestis
auccaauaccaccaaugcg

SEQ ID NO: 2263804 - RNA, 18 nt, Yersinia pestis
auccaauaacaucaccua

SEQ ID NO: 2263805 - RNA, 15 nt, Yersinia pestis
auccaaggcagauau

SEQ ID NO: 2263806 - RNA, 23 nt, Yersinia pestis
auccaccagcgggcggcagauau

SEQ ID NO: 2263807 - RNA, 20 nt, Yersinia pestis
aucauuuuuuuauuaaguuu

SEQ ID NO: 2263808 - RNA, 23 nt, Yersinia pestis
aucauuuuuuuauuaaguuuuuc

SEQ ID NO: 2263809 - RNA, 22 nt, Yersinia pestis
aucauuuuuuuccacccgcugc

SEQ ID NO: 2263810 - RNA, 14 nt, Yersinia pestis
auccaaaaagcgcu

SEQ ID NO: 2263811 - RNA, 12 nt, Yersinia pestis
aucauuuuccug

SEQ ID NO: 2263812 - RNA, 17 nt, Yersinia pestis
aucauuuuccugcauau

SEQ ID NO: 2263813 - RNA, 18 nt, Yersinia pestis
aucauuuuccugcauauu

SEQ ID NO: 2263814 - RNA, 16 nt, Yersinia pestis
aucauuuuuuaucuug

SEQ ID NO: 2263815 - RNA, 21 nt, Yersinia pestis
auccagaauagagaaaucaaa

SEQ ID NO: 2263816 - RNA, 18 nt, Yersinia pestis
auccacuuauaucuccac

SEQ ID NO: 2263817 - RNA, 14 nt, Yersinia pestis
auccagaacaccaa

SEQ ID NO: 2263818 - RNA, 13 nt, Yersinia pestis
aucauuauugauu

SEQ ID NO: 2263819 - RNA, 17 nt, Yersinia pestis
aucauucaauuccugau

SEQ ID NO: 2263820 - RNA, 20 nt, Yersinia pestis
aucauuauauauuuuuucau

SEQ ID NO: 2263821 - RNA, 23 nt, Yersinia pestis
aaaagaaaauggcuuuuuuaaua

SEQ ID NO: 2263822 - RNA, 15 nt, Yersinia pestis
aucauuuauauagua

SEQ ID NO: 2263823 - RNA, 18 nt, Yersinia pestis
aucauucauuuuaaaaaa

SEQ ID NO: 2263824 - RNA, 21 nt, Yersinia pestis
aaaacuuuuauugucuuuaau

SEQ ID NO: 2263825 - RNA, 17 nt, Yersinia pestis
aaaacuuaucuaaaaaa

SEQ ID NO: 2263826 - RNA, 15 nt, Yersinia pestis
aucauuacaucaucu

SEQ ID NO: 2263827 - RNA, 16 nt, Yersinia pestis
aucauuacaucaucuu

SEQ ID NO: 2263828 - RNA, 21 nt, Yersinia pestis
aucauuacguaaucccagaaa

SEQ ID NO: 2263829 - RNA, 18 nt, Yersinia pestis
auaccuuaauuaacucuu

SEQ ID NO: 2263830 - RNA, 14 nt, Yersinia pestis
auaccuuuguaucc

SEQ ID NO: 2263831 - RNA, 22 nt, Yersinia pestis
auacgccaguuaggcaagaaca

SEQ ID NO: 2263832 - RNA, 14 nt, Yersinia pestis
auaccuuacugcau

SEQ ID NO: 2263833 - RNA, 12 nt, Yersinia pestis
auaccuuacugu

SEQ ID NO: 2263834 - RNA, 14 nt, Yersinia pestis
auaccuuacuucca

SEQ ID NO: 2263835 - RNA, 13 nt, Yersinia pestis
auaccucaagcug

SEQ ID NO: 2263836 - RNA, 20 nt, Yersinia pestis
auaccucaagcugcauguac

SEQ ID NO: 2263837 - RNA, 22 nt, Yersinia pestis
auaccucacuggcuuuauuaua

SEQ ID NO: 2263838 - RNA, 23 nt, Yersinia pestis
auaccggcuucacggguaaaaac

SEQ ID NO: 2263839 - RNA, 18 nt, Yersinia pestis
auaccgccacacaauaca

SEQ ID NO: 2263840 - RNA, 23 nt, Yersinia pestis
auaccgccaagcgccgugcauaa

SEQ ID NO: 2263841 - RNA, 16 nt, Yersinia pestis
auaccgccgguuuuug

SEQ ID NO: 2263842 - RNA, 16 nt, Yersinia pestis
auaccgcugcuaccag

SEQ ID NO: 2263843 - RNA, 19 nt, Yersinia pestis
auacaggcugacauuucuu

SEQ ID NO: 2263844 - RNA, 19 nt, Yersinia pestis
auacaggcuauauugcuga

SEQ ID NO: 2263845 - RNA, 15 nt, Yersinia pestis
auacuccauuugaac

SEQ ID NO: 2263846 - RNA, 17 nt, Yersinia pestis
auacucaugauggcacc

SEQ ID NO: 2263847 - RNA, 21 nt, Yersinia pestis
auacuccgcugagcauauaca

SEQ ID NO: 2263848 - RNA, 20 nt, Yersinia pestis
auacuauuuguaguuuuuca

SEQ ID NO: 2263849 - RNA, 17 nt, Yersinia pestis
auacgcuuccugcgcca

SEQ ID NO: 2263850 - RNA, 18 nt, Yersinia pestis
auacuuaucuguuuucca

SEQ ID NO: 2263851 - RNA, 18 nt, Yersinia pestis
auacugccgcacugccac

SEQ ID NO: 2263852 - RNA, 17 nt, Yersinia pestis
auacugccgaccauauc

SEQ ID NO: 2263853 - RNA, 18 nt, Yersinia pestis
auacugccgaccauaucu

SEQ ID NO: 2263854 - RNA, 21 nt, Yersinia pestis
auacuugaaacagcaggggcg

SEQ ID NO: 2263855 - RNA, 13 nt, Yersinia pestis
auacuuccuucaa

SEQ ID NO: 2263856 - RNA, 21 nt, Yersinia pestis
auagauacacuccauuaauuu

SEQ ID NO: 2263857 - RNA, 19 nt, Yersinia pestis
auagagugcaauuuuauug

SEQ ID NO: 2263858 - RNA, 20 nt, Yersinia pestis
auagagugaaguaucaccac

SEQ ID NO: 2263859 - RNA, 19 nt, Yersinia pestis
auagaucccauacccacua

SEQ ID NO: 2263860 - RNA, 17 nt, Yersinia pestis
auagauaucgaaacaca

SEQ ID NO: 2263861 - RNA, 14 nt, Yersinia pestis
auagauuuuuauag

SEQ ID NO: 2263862 - RNA, 15 nt, Yersinia pestis
auagcaaaaaaaaag

SEQ ID NO: 2263863 - RNA, 15 nt, Yersinia pestis
auagcaaaauugaga

SEQ ID NO: 2263864 - RNA, 21 nt, Yersinia pestis
auagauuaaucgaaacaccac

SEQ ID NO: 2263865 - RNA, 20 nt, Yersinia pestis
auacuuuuagccagcaacau

SEQ ID NO: 2263866 - RNA, 20 nt, Yersinia pestis
auagacuguuuuauuauaua

SEQ ID NO: 2263867 - RNA, 16 nt, Yersinia pestis
auagacuguuuuauua

SEQ ID NO: 2263868 - RNA, 16 nt, Yersinia pestis
auagcaccgagcaugc

SEQ ID NO: 2263869 - RNA, 17 nt, Yersinia pestis
auagauuucacuuuccc

SEQ ID NO: 2263870 - RNA, 23 nt, Yersinia pestis
auagcaauagaacugagaauaau

SEQ ID NO: 2263871 - RNA, 14 nt, Yersinia pestis
auagcaaucaauaa

SEQ ID NO: 2263872 - RNA, 21 nt, Yersinia pestis
auagcaaccggauacaaagug

SEQ ID NO: 2263873 - RNA, 14 nt, Yersinia pestis
auagcaacuaaaca

SEQ ID NO: 2263874 - RNA, 19 nt, Yersinia pestis
auagcaucauccagcucaa

SEQ ID NO: 2263875 - RNA, 12 nt, Yersinia pestis
auagcauaaaua

SEQ ID NO: 2263876 - RNA, 20 nt, Yersinia pestis
auagcagggccgguuaauug

SEQ ID NO: 2263877 - RNA, 16 nt, Yersinia pestis
auagcguugcuuccua

SEQ ID NO: 2263878 - RNA, 13 nt, Yersinia pestis
auagccuuuuugc

SEQ ID NO: 2263879 - RNA, 17 nt, Yersinia pestis
auagccggcucuucucg

SEQ ID NO: 2263880 - RNA, 20 nt, Yersinia pestis
auaguuuagauagaaaucac

SEQ ID NO: 2263881 - RNA, 13 nt, Yersinia pestis
auaguugaucuac

SEQ ID NO: 2263882 - RNA, 22 nt, Yersinia pestis
auaguugaucuaccugaaugcg

SEQ ID NO: 2263883 - RNA, 15 nt, Yersinia pestis
auauaaacauaaaaa

SEQ ID NO: 2263884 - RNA, 21 nt, Yersinia pestis
auauaaagcauuuaucauauu

SEQ ID NO: 2263885 - RNA, 17 nt, Yersinia pestis
auauaaaauaauaagau

SEQ ID NO: 2263886 - RNA, 15 nt, Yersinia pestis
auauaaaacacgcau

SEQ ID NO: 2263887 - RNA, 19 nt, Yersinia pestis
auauaaaagcacagacaaa

SEQ ID NO: 2263888 - RNA, 14 nt, Yersinia pestis
auaguuuuucuccu

SEQ ID NO: 2263889 - RNA, 17 nt, Yersinia pestis
auagucuuggaugcguu

SEQ ID NO: 2263890 - RNA, 15 nt, Yersinia pestis
auagugaguauguau

SEQ ID NO: 2263891 - RNA, 16 nt, Yersinia pestis
auaguggcacaaauaa

SEQ ID NO: 2263892 - RNA, 15 nt, Yersinia pestis
auagcugauugcucc

SEQ ID NO: 2263893 - RNA, 16 nt, Yersinia pestis
auagcuaaccuuaacu

SEQ ID NO: 2263894 - RNA, 16 nt, Yersinia pestis
auauacuuuacauaua

SEQ ID NO: 2263895 - RNA, 21 nt, Yersinia pestis
auauacggcggcuacugguag

SEQ ID NO: 2263896 - RNA, 23 nt, Yersinia pestis
auauagaaauaaggaauaacuuc

SEQ ID NO: 2263897 - RNA, 14 nt, Yersinia pestis
auauauagaaauaa

SEQ ID NO: 2263898 - RNA, 13 nt, Yersinia pestis
auauauccaaaau

SEQ ID NO: 2263899 - RNA, 15 nt, Yersinia pestis
auauauccaaaauaa

SEQ ID NO: 2263900 - RNA, 17 nt, Yersinia pestis
auauauccaaaauaauu

SEQ ID NO: 2263901 - RNA, 19 nt, Yersinia pestis
auauauccaggcacugcca

SEQ ID NO: 2263902 - RNA, 13 nt, Yersinia pestis
auauaauagcugg

SEQ ID NO: 2263903 - RNA, 21 nt, Yersinia pestis
auauaauacuuaagucaaauu

SEQ ID NO: 2263904 - RNA, 15 nt, Yersinia pestis
auauaauacgaaaua

SEQ ID NO: 2263905 - RNA, 17 nt, Yersinia pestis
auauaauacgaaauacu

SEQ ID NO: 2263906 - RNA, 18 nt, Yersinia pestis
auauaauacgaaauacuu

SEQ ID NO: 2263907 - RNA, 22 nt, Yersinia pestis
auauaagauuccuuaccugaug

SEQ ID NO: 2263908 - RNA, 21 nt, Yersinia pestis
auauaagauuccuuaccugau

SEQ ID NO: 2263909 - RNA, 20 nt, Yersinia pestis
auauaauugaagauuuaaau

SEQ ID NO: 2263910 - RNA, 15 nt, Yersinia pestis
auauaauucaauaua

SEQ ID NO: 2263911 - RNA, 19 nt, Yersinia pestis
auauacccguaauauuuca

SEQ ID NO: 2263912 - RNA, 16 nt, Yersinia pestis
auauacccaaagccag

SEQ ID NO: 2263913 - RNA, 16 nt, Yersinia pestis
auaugaacuuguucau

SEQ ID NO: 2263914 - RNA, 13 nt, Yersinia pestis
auaugaacaccug

SEQ ID NO: 2263915 - RNA, 16 nt, Yersinia pestis
auaucuuucaaguccu

SEQ ID NO: 2263916 - RNA, 18 nt, Yersinia pestis
auaucuuucaaguccugc

SEQ ID NO: 2263917 - RNA, 14 nt, Yersinia pestis
auaugaaaaaccuc

SEQ ID NO: 2263918 - RNA, 22 nt, Yersinia pestis
auaucuucggcggcuaaagcug

SEQ ID NO: 2263919 - RNA, 17 nt, Yersinia pestis
auaucuugaaccaauuu

SEQ ID NO: 2263920 - RNA, 15 nt, Yersinia pestis
auaucuuuaccuguu

SEQ ID NO: 2263921 - RNA, 16 nt, Yersinia pestis
auaugaucaguggggu

SEQ ID NO: 2263922 - RNA, 17 nt, Yersinia pestis
auaugauaguguaaaaa

SEQ ID NO: 2263923 - RNA, 16 nt, Yersinia pestis
auaugagcgaggaggu

SEQ ID NO: 2263924 - RNA, 20 nt, Yersinia pestis
auaucugugauaaccagcag

SEQ ID NO: 2263925 - RNA, 17 nt, Yersinia pestis
auaucugcucauuacca

SEQ ID NO: 2263926 - RNA, 16 nt, Yersinia pestis
auaucugcguuuucug

SEQ ID NO: 2263927 - RNA, 13 nt, Yersinia pestis
auaucucuuuauc

SEQ ID NO: 2263928 - RNA, 21 nt, Yersinia pestis
auaucucuacggcauguugca

SEQ ID NO: 2263929 - RNA, 18 nt, Yersinia pestis
auaucuccguugaaaccu

SEQ ID NO: 2263930 - RNA, 14 nt, Yersinia pestis
auaucuccguugaa

SEQ ID NO: 2263931 - RNA, 16 nt, Yersinia pestis
auaucuccguugaaac

SEQ ID NO: 2263932 - RNA, 12 nt, Yersinia pestis
auaucucuuuau

SEQ ID NO: 2263933 - RNA, 14 nt, Yersinia pestis
auaucugcauaacu

SEQ ID NO: 2263934 - RNA, 13 nt, Yersinia pestis
auaucuauuucca

SEQ ID NO: 2263935 - RNA, 18 nt, Yersinia pestis
auaucucaccgccaauau

SEQ ID NO: 2263936 - RNA, 21 nt, Yersinia pestis
auaucuaauuuauaaccuuuu

SEQ ID NO: 2263937 - RNA, 17 nt, Yersinia pestis
auaucuaacugauguau

SEQ ID NO: 2263938 - RNA, 21 nt, Yersinia pestis
auaucuaaguccaagacagaa

SEQ ID NO: 2263939 - RNA, 13 nt, Yersinia pestis
auaucuaacugau

SEQ ID NO: 2263940 - RNA, 14 nt, Yersinia pestis
auaucgacaaucac

SEQ ID NO: 2263941 - RNA, 16 nt, Yersinia pestis
auaucgaugacagcau

SEQ ID NO: 2263942 - RNA, 16 nt, Yersinia pestis
auaucgagguucgacu

SEQ ID NO: 2263943 - RNA, 17 nt, Yersinia pestis
auaucccgagaaacaaa

SEQ ID NO: 2263944 - RNA, 18 nt, Yersinia pestis
auaucccaauaauagcua

SEQ ID NO: 2263945 - RNA, 22 nt, Yersinia pestis
auaucccgagaaacaaaaccaa

SEQ ID NO: 2263946 - RNA, 14 nt, Yersinia pestis
auaucgcaauuaau

SEQ ID NO: 2263947 - RNA, 15 nt, Yersinia pestis
auaucaucagcagag

SEQ ID NO: 2263948 - RNA, 17 nt, Yersinia pestis
auaucaucuuuuucugc

SEQ ID NO: 2263949 - RNA, 12 nt, Yersinia pestis
auauauuuuucu

SEQ ID NO: 2263950 - RNA, 13 nt, Yersinia pestis
auaucaaaacuga

SEQ ID NO: 2263951 - RNA, 17 nt, Yersinia pestis
auaucaaaacugauuaa

SEQ ID NO: 2263952 - RNA, 21 nt, Yersinia pestis
auaucaaaaggauaaccuauu

SEQ ID NO: 2263953 - RNA, 16 nt, Yersinia pestis
auaucaaaauaaaaau

SEQ ID NO: 2263954 - RNA, 22 nt, Yersinia pestis
auauauugcucuaugccgcuau

SEQ ID NO: 2263955 - RNA, 20 nt, Yersinia pestis
aucaauguuggcccaagaua

SEQ ID NO: 2263956 - RNA, 17 nt, Yersinia pestis
aucaauuaaucaauuaa

SEQ ID NO: 2263957 - RNA, 17 nt, Yersinia pestis
aucaauggcaccucauc

SEQ ID NO: 2263958 - RNA, 19 nt, Yersinia pestis
aucaauggauucuugcugc

SEQ ID NO: 2263959 - RNA, 15 nt, Yersinia pestis
aucaauguuggccca

SEQ ID NO: 2263960 - RNA, 14 nt, Yersinia pestis
aucacgacuuuaau

SEQ ID NO: 2263961 - RNA, 22 nt, Yersinia pestis
aucacgcagcaggccauuuuca

SEQ ID NO: 2263962 - RNA, 19 nt, Yersinia pestis
aucacgcaaugccaguaca

SEQ ID NO: 2263963 - RNA, 16 nt, Yersinia pestis
aucacuucugcugcca

SEQ ID NO: 2263964 - RNA, 18 nt, Yersinia pestis
aucacgguucauuuuuag

SEQ ID NO: 2263965 - RNA, 15 nt, Yersinia pestis
aucacggguuuuucc

SEQ ID NO: 2263966 - RNA, 16 nt, Yersinia pestis
aucacgguacgcauga

SEQ ID NO: 2263967 - RNA, 21 nt, Yersinia pestis
aucacuugccagagcaauaac

SEQ ID NO: 2263968 - RNA, 21 nt, Yersinia pestis
aucagauuguuuauaaauuaa

SEQ ID NO: 2263969 - RNA, 14 nt, Yersinia pestis
aucagaugaugaug

SEQ ID NO: 2263970 - RNA, 18 nt, Yersinia pestis
aucagcaagcugcucaau

SEQ ID NO: 2263971 - RNA, 17 nt, Yersinia pestis
aucagcaucaauaaaau

SEQ ID NO: 2263972 - RNA, 19 nt, Yersinia pestis
aucagauacggcuccagaa

SEQ ID NO: 2263973 - RNA, 13 nt, Yersinia pestis
aucagagcucaau

SEQ ID NO: 2263974 - RNA, 19 nt, Yersinia pestis
aucagagucugucauggca

SEQ ID NO: 2263975 - RNA, 19 nt, Yersinia pestis
aucagacggcagcaacgaa

SEQ ID NO: 2263976 - RNA, 19 nt, Yersinia pestis
aucagaccuuuaggaaagc

SEQ ID NO: 2263977 - RNA, 18 nt, Yersinia pestis
aucagccauauguugcca

SEQ ID NO: 2263978 - RNA, 17 nt, Yersinia pestis
aucagcuuucugucgau

SEQ ID NO: 2263979 - RNA, 22 nt, Yersinia pestis
aucagcgcuagauuuucuuuca

SEQ ID NO: 2263980 - RNA, 15 nt, Yersinia pestis
aucagcgccugcugu

SEQ ID NO: 2263981 - RNA, 17 nt, Yersinia pestis
aucagcgccuuugcccc

SEQ ID NO: 2263982 - RNA, 16 nt, Yersinia pestis
aucagcgcccuugcca

SEQ ID NO: 2263983 - RNA, 22 nt, Yersinia pestis
aucagcgcccuugccagugcaa

SEQ ID NO: 2263984 - RNA, 13 nt, Yersinia pestis
aucaucgcacugu

SEQ ID NO: 2263985 - RNA, 22 nt, Yersinia pestis
aucaucgccacuugaaacauuc

SEQ ID NO: 2263986 - RNA, 20 nt, Yersinia pestis
aucauccaguuuggcugcca

SEQ ID NO: 2263987 - RNA, 22 nt, Yersinia pestis
aucauccaguuuggcugccaug

SEQ ID NO: 2263988 - RNA, 14 nt, Yersinia pestis
aucaucaucuugaa

SEQ ID NO: 2263989 - RNA, 18 nt, Yersinia pestis
aucaucaucuugaaaaua

SEQ ID NO: 2263990 - RNA, 15 nt, Yersinia pestis
aucaucaucuuuaau

SEQ ID NO: 2263991 - RNA, 22 nt, Yersinia pestis
aucauccaagcuguuacuuacu

SEQ ID NO: 2263992 - RNA, 22 nt, Yersinia pestis
aucaucccagucgucuucagcu

SEQ ID NO: 2263993 - RNA, 17 nt, Yersinia pestis
aucauccccuauauacc

SEQ ID NO: 2263994 - RNA, 12 nt, Yersinia pestis
aucaucaucaau

SEQ ID NO: 2263995 - RNA, 18 nt, Yersinia pestis
aucaucagggaauugacu

SEQ ID NO: 2263996 - RNA, 15 nt, Yersinia pestis
aucaucaggcaggua

SEQ ID NO: 2263997 - RNA, 14 nt, Yersinia pestis
aucaucaccauuca

SEQ ID NO: 2263998 - RNA, 14 nt, Yersinia pestis
aucauauuaacaua

SEQ ID NO: 2263999 - RNA, 19 nt, Yersinia pestis
aucauauguucgaucaaaa

SEQ ID NO: 2264000 - RNA, 17 nt, Yersinia pestis
aucauauuuuccugcac

SEQ ID NO: 2264001 - RNA, 21 nt, Yersinia pestis
aucaucacauucaaacacuua

SEQ ID NO: 2264002 - RNA, 16 nt, Yersinia pestis
aaaacgccuccaguga

SEQ ID NO: 2264003 - RNA, 16 nt, Yersinia pestis
aucaggccuucuuuuc

SEQ ID NO: 2264004 - RNA, 13 nt, Yersinia pestis
aucauauauuaaa

SEQ ID NO: 2264005 - RNA, 15 nt, Yersinia pestis
aucauagccauccca

SEQ ID NO: 2264006 - RNA, 14 nt, Yersinia pestis
aucauaagugcauu

SEQ ID NO: 2264007 - RNA, 12 nt, Yersinia pestis
aucaguggguca

SEQ ID NO: 2264008 - RNA, 14 nt, Yersinia pestis
aucauaaaaauaca

SEQ ID NO: 2264009 - RNA, 18 nt, Yersinia pestis
aucauaaaaauacauauc

SEQ ID NO: 2264010 - RNA, 20 nt, Yersinia pestis
aucagugggauagagaucag

SEQ ID NO: 2264011 - RNA, 11 nt, Yersinia pestis
aucaguggcac

SEQ ID NO: 2264012 - RNA, 15 nt, Yersinia pestis
aucagugaagagaua

SEQ ID NO: 2264013 - RNA, 17 nt, Yersinia pestis
aucaaaacugauuaaua

SEQ ID NO: 2264014 - RNA, 15 nt, Yersinia pestis
aucaaaagcaagacc

SEQ ID NO: 2264015 - RNA, 14 nt, Yersinia pestis
aucaaacauaaaaa

SEQ ID NO: 2264016 - RNA, 19 nt, Yersinia pestis
aucaaacaccgguacugag

SEQ ID NO: 2264017 - RNA, 20 nt, Yersinia pestis
aucaaacggcaacuucuaca

SEQ ID NO: 2264018 - RNA, 16 nt, Yersinia pestis
aucaaacggcuuuuua

SEQ ID NO: 2264019 - RNA, 14 nt, Yersinia pestis
aucaacaggccacc

SEQ ID NO: 2264020 - RNA, 16 nt, Yersinia pestis
aucaacagauuuucca

SEQ ID NO: 2264021 - RNA, 17 nt, Yersinia pestis
aucaacagauaugcauu

SEQ ID NO: 2264022 - RNA, 15 nt, Yersinia pestis
aucaacacauaaaau

SEQ ID NO: 2264023 - RNA, 13 nt, Yersinia pestis
aucaacacugccu

SEQ ID NO: 2264024 - RNA, 13 nt, Yersinia pestis
aucaagaucaaaa

SEQ ID NO: 2264025 - RNA, 21 nt, Yersinia pestis
aucaagacucaguaaauauaa

SEQ ID NO: 2264026 - RNA, 20 nt, Yersinia pestis
aucaaccgggauaucaaauu

SEQ ID NO: 2264027 - RNA, 14 nt, Yersinia pestis
aucaacgcccagcu

SEQ ID NO: 2264028 - RNA, 22 nt, Yersinia pestis
aucaacgccguauuuuauaucu

SEQ ID NO: 2264029 - RNA, 18 nt, Yersinia pestis
aucaacgcgccuuucggc

SEQ ID NO: 2264030 - RNA, 20 nt, Yersinia pestis
aucaauaagugcaaacuuaa

SEQ ID NO: 2264031 - RNA, 14 nt, Yersinia pestis
aucaauaagcuaca

SEQ ID NO: 2264032 - RNA, 21 nt, Yersinia pestis
aucaagugaaccaucaaggac

SEQ ID NO: 2264033 - RNA, 18 nt, Yersinia pestis
aucaauaaacucuuucau

SEQ ID NO: 2264034 - RNA, 16 nt, Yersinia pestis
aucaauaccuuacugc

SEQ ID NO: 2264035 - RNA, 17 nt, Yersinia pestis
aucaauacuguuaucac

SEQ ID NO: 2264036 - RNA, 12 nt, Yersinia pestis
aucaagcccgca

SEQ ID NO: 2264037 - RNA, 13 nt, Yersinia pestis
aucaagcccauga

SEQ ID NO: 2264038 - RNA, 24 nt, Yersinia pestis
aucaagcauacguugccagccauc

SEQ ID NO: 2264039 - RNA, 15 nt, Yersinia pestis
aucaaggauaagaau

SEQ ID NO: 2264040 - RNA, 14 nt, Yersinia pestis
aucaaggauaagca

SEQ ID NO: 2264041 - RNA, 19 nt, Yersinia pestis
aucaaggcggcagagccaa

SEQ ID NO: 2264042 - RNA, 16 nt, Yersinia pestis
aucaagucuugaagag

SEQ ID NO: 2264043 - RNA, 15 nt, Yersinia pestis
aucaaucguuuuaau

SEQ ID NO: 2264044 - RNA, 17 nt, Yersinia pestis
aucaaucguuuuaauuu

SEQ ID NO: 2264045 - RNA, 18 nt, Yersinia pestis
aucaaucguacuggcggc

SEQ ID NO: 2264046 - RNA, 15 nt, Yersinia pestis
aucaauggccagcgg

SEQ ID NO: 2264047 - RNA, 15 nt, Yersinia pestis
aucaaucaaaaaaua

SEQ ID NO: 2264048 - RNA, 23 nt, Yersinia pestis
aucaauaucccgagaaacaaaac

SEQ ID NO: 2264049 - RNA, 13 nt, Yersinia pestis
aucaauaggucag

SEQ ID NO: 2264050 - RNA, 14 nt, Yersinia pestis
aucaauaggucagu

SEQ ID NO: 2264051 - RNA, 19 nt, Yersinia pestis
aucaauauaacgcccggca

SEQ ID NO: 2264052 - RNA, 20 nt, Yersinia pestis
aucaaucagcggggcauuca

SEQ ID NO: 2264053 - RNA, 17 nt, Yersinia pestis
aucaauccuacauucag

SEQ ID NO: 2264054 - RNA, 13 nt, Yersinia pestis
aucaaucagcuga

SEQ ID NO: 2264055 - RNA, 19 nt, Yersinia pestis
aucaaucagcugauaugaa

SEQ ID NO: 2264056 - RNA, 19 nt, Yersinia pestis
auauugggccggagauaga

SEQ ID NO: 2264057 - RNA, 22 nt, Yersinia pestis
auauuggggggcaguuuuuuau

SEQ ID NO: 2264058 - RNA, 18 nt, Yersinia pestis
auauuggauaauaaccug

SEQ ID NO: 2264059 - RNA, 18 nt, Yersinia pestis
auauuggguaucgaugug

SEQ ID NO: 2264060 - RNA, 23 nt, Yersinia pestis
auauuggcaacaacagauaaagc

SEQ ID NO: 2264061 - RNA, 16 nt, Yersinia pestis
auauuggcaacaacag

SEQ ID NO: 2264062 - RNA, 19 nt, Yersinia pestis
auauuggccgucagcagau

SEQ ID NO: 2264063 - RNA, 23 nt, Yersinia pestis
auauuguggggccuuuauucauu

SEQ ID NO: 2264064 - RNA, 18 nt, Yersinia pestis
auauugucuuaugauaua

SEQ ID NO: 2264065 - RNA, 15 nt, Yersinia pestis
auauuguccaaagga

SEQ ID NO: 2264066 - RNA, 16 nt, Yersinia pestis
auauuuauuuuuucuu

SEQ ID NO: 2264067 - RNA, 23 nt, Yersinia pestis
auauuuauuuuuuuggcagauau

SEQ ID NO: 2264068 - RNA, 20 nt, Yersinia pestis
auauuuauuuuauugcguua

SEQ ID NO: 2264069 - RNA, 14 nt, Yersinia pestis
auauuuauuuuccc

SEQ ID NO: 2264070 - RNA, 14 nt, Yersinia pestis
auauuucaggcugu

SEQ ID NO: 2264071 - RNA, 13 nt, Yersinia pestis
auauuuaaagccu

SEQ ID NO: 2264072 - RNA, 21 nt, Yersinia pestis
aucaaaacggaugaugccgau

SEQ ID NO: 2264073 - RNA, 19 nt, Yersinia pestis
auauuuugcuuuaaauuca

SEQ ID NO: 2264074 - RNA, 13 nt, Yersinia pestis
auauuuuccugca

SEQ ID NO: 2264075 - RNA, 23 nt, Yersinia pestis
auauuuuaugcccccuauuaugc

SEQ ID NO: 2264076 - RNA, 12 nt, Yersinia pestis
auauuuuaaaua

SEQ ID NO: 2264077 - RNA, 20 nt, Yersinia pestis
auauuugggucgguaaccug

SEQ ID NO: 2264078 - RNA, 19 nt, Yersinia pestis
auauuuguuugaauuuuag

SEQ ID NO: 2264079 - RNA, 21 nt, Yersinia pestis
auauuucgguaggaauaaggu

SEQ ID NO: 2264080 - RNA, 20 nt, Yersinia pestis
auauuucgcccugcauauca

SEQ ID NO: 2264081 - RNA, 11 nt, Yersinia pestis
auauugagcag

SEQ ID NO: 2264082 - RNA, 21 nt, Yersinia pestis
auauugauaauggcauuuuca

SEQ ID NO: 2264083 - RNA, 18 nt, Yersinia pestis
auauugauagccacauca

SEQ ID NO: 2264084 - RNA, 16 nt, Yersinia pestis
auauugaauaaagccg

SEQ ID NO: 2264085 - RNA, 20 nt, Yersinia pestis
auauugaauaaccuacucca

SEQ ID NO: 2264086 - RNA, 15 nt, Yersinia pestis
auauuggauaauaac

SEQ ID NO: 2264087 - RNA, 13 nt, Yersinia pestis
auauugaugacug

SEQ ID NO: 2264088 - RNA, 23 nt, Yersinia pestis
auauugaugugaaacauaauuaa

SEQ ID NO: 2264089 - RNA, 16 nt, Yersinia pestis
auauugccaucgggca

SEQ ID NO: 2264090 - RNA, 15 nt, Yersinia pestis
auauugccaucuugu

SEQ ID NO: 2264091 - RNA, 14 nt, Yersinia pestis
auauucauuaaaaa

SEQ ID NO: 2264092 - RNA, 13 nt, Yersinia pestis
auauucauuaaaa

SEQ ID NO: 2264093 - RNA, 13 nt, Yersinia pestis
auauucauauuuc

SEQ ID NO: 2264094 - RNA, 19 nt, Yersinia pestis
auauucaccaccauuaaca

SEQ ID NO: 2264095 - RNA, 22 nt, Yersinia pestis
auauucaccaccauuaacaagc

SEQ ID NO: 2264096 - RNA, 15 nt, Yersinia pestis
auauucaccacacau

SEQ ID NO: 2264097 - RNA, 21 nt, Yersinia pestis
auauucaccacacauaccaca

SEQ ID NO: 2264098 - RNA, 14 nt, Yersinia pestis
auaugcaaaaaaag

SEQ ID NO: 2264099 - RNA, 18 nt, Yersinia pestis
auguugcgggaauagcuc

SEQ ID NO: 2264100 - RNA, 20 nt, Yersinia pestis
auguugcccuuaguuggcaa

SEQ ID NO: 2264101 - RNA, 20 nt, Yersinia pestis
auguugccgcuucauauccu

SEQ ID NO: 2264102 - RNA, 15 nt, Yersinia pestis
auguuguucaaugcg

SEQ ID NO: 2264103 - RNA, 17 nt, Yersinia pestis
auguccaguuaucaucg

SEQ ID NO: 2264104 - RNA, 23 nt, Yersinia pestis
auguccauguuaggauaggguuu

SEQ ID NO: 2264105 - RNA, 22 nt, Yersinia pestis
auguccucaccauuuauugcca

SEQ ID NO: 2264106 - RNA, 21 nt, Yersinia pestis
auguccucaccauuuauugcc

SEQ ID NO: 2264107 - RNA, 15 nt, Yersinia pestis
auguccucaccauuu

SEQ ID NO: 2264108 - RNA, 17 nt, Yersinia pestis
auguccucaccauuuau

SEQ ID NO: 2264109 - RNA, 16 nt, Yersinia pestis
auguucacaucgguca

SEQ ID NO: 2264110 - RNA, 14 nt, Yersinia pestis
auguugcaacaugc

SEQ ID NO: 2264111 - RNA, 13 nt, Yersinia pestis
auguuuugcugcc

SEQ ID NO: 2264112 - RNA, 17 nt, Yersinia pestis
auguuuugcugccauuu

SEQ ID NO: 2264113 - RNA, 12 nt, Yersinia pestis
auuaaaaacaaa

SEQ ID NO: 2264114 - RNA, 20 nt, Yersinia pestis
auuaaaaaauaauuuuaugg

SEQ ID NO: 2264115 - RNA, 16 nt, Yersinia pestis
auuaaaaaagguggcc

SEQ ID NO: 2264116 - RNA, 14 nt, Yersinia pestis
auguuuuugaccau

SEQ ID NO: 2264117 - RNA, 12 nt, Yersinia pestis
auuaaaauaaca

SEQ ID NO: 2264118 - RNA, 21 nt, Yersinia pestis
auuaaaaucacccgcaagaau

SEQ ID NO: 2264119 - RNA, 23 nt, Yersinia pestis
auuaaacagucuuauuacucauu

SEQ ID NO: 2264120 - RNA, 16 nt, Yersinia pestis
auuaaacagucuuauu

SEQ ID NO: 2264121 - RNA, 11 nt, Yersinia pestis
auuaaacagau

SEQ ID NO: 2264122 - RNA, 15 nt, Yersinia pestis
auuaaacuauuaacu

SEQ ID NO: 2264123 - RNA, 22 nt, Yersinia pestis
auuaaacgccugggauccauag

SEQ ID NO: 2264124 - RNA, 16 nt, Yersinia pestis
auuaaacgcucaucaa

SEQ ID NO: 2264125 - RNA, 19 nt, Yersinia pestis
auuaaacgucucuuuuuca

SEQ ID NO: 2264126 - RNA, 20 nt, Yersinia pestis
auuaaaguuuagcaaagcau

SEQ ID NO: 2264127 - RNA, 22 nt, Yersinia pestis
auuaauguacaccuaaaacaua

SEQ ID NO: 2264128 - RNA, 15 nt, Yersinia pestis
auuaauggucaaggu

SEQ ID NO: 2264129 - RNA, 17 nt, Yersinia pestis
auuaauggauagcugua

SEQ ID NO: 2264130 - RNA, 22 nt, Yersinia pestis
auuaauggauugaucauucucu

SEQ ID NO: 2264131 - RNA, 12 nt, Yersinia pestis
auuaauuauuuu

SEQ ID NO: 2264132 - RNA, 11 nt, Yersinia pestis
auuaauuauuc

SEQ ID NO: 2264133 - RNA, 12 nt, Yersinia pestis
auuaauuuauuu

SEQ ID NO: 2264134 - RNA, 15 nt, Yersinia pestis
auuaauuuaaacaac

SEQ ID NO: 2264135 - RNA, 13 nt, Yersinia pestis
auuaauuuaaaca

SEQ ID NO: 2264136 - RNA, 22 nt, Yersinia pestis
auuaauucuuuuugccaauaau

SEQ ID NO: 2264137 - RNA, 15 nt, Yersinia pestis
auuacaagugccaaa

SEQ ID NO: 2264138 - RNA, 12 nt, Yersinia pestis
auuaauuuuuca

SEQ ID NO: 2264139 - RNA, 16 nt, Yersinia pestis
auuaccaauaauuaau

SEQ ID NO: 2264140 - RNA, 17 nt, Yersinia pestis
auuaccaauaugaaauu

SEQ ID NO: 2264141 - RNA, 20 nt, Yersinia pestis
auuaccaauaugaaauuuca

SEQ ID NO: 2264142 - RNA, 14 nt, Yersinia pestis
aaaagcaugcccag

SEQ ID NO: 2264143 - RNA, 12 nt, Yersinia pestis
aaaagcagcagu

SEQ ID NO: 2264144 - RNA, 14 nt, Yersinia pestis
aaaagcagcaaacg

SEQ ID NO: 2264145 - RNA, 16 nt, Yersinia pestis
aaaagcagcaaacgaa

SEQ ID NO: 2264146 - RNA, 14 nt, Yersinia pestis
auuaaucaauuaau

SEQ ID NO: 2264147 - RNA, 15 nt, Yersinia pestis
auuaaucagcauuaa

SEQ ID NO: 2264148 - RNA, 20 nt, Yersinia pestis
aaaagccaccgcaucaauga

SEQ ID NO: 2264149 - RNA, 22 nt, Yersinia pestis
auuaauccucucuugaaaugau

SEQ ID NO: 2264150 - RNA, 18 nt, Yersinia pestis
auuaaucguuauaauauu

SEQ ID NO: 2264151 - RNA, 19 nt, Yersinia pestis
auuaaucguuauaauauua

SEQ ID NO: 2264152 - RNA, 21 nt, Yersinia pestis
auuaaucguuauaauauuaaa

SEQ ID NO: 2264153 - RNA, 21 nt, Yersinia pestis
auuaaucuaauuucaaaugaa

SEQ ID NO: 2264154 - RNA, 19 nt, Yersinia pestis
auuaaugagccuuaccccu

SEQ ID NO: 2264155 - RNA, 12 nt, Yersinia pestis
auuaaugauaac

SEQ ID NO: 2264156 - RNA, 14 nt, Yersinia pestis
auuaacacuuauua

SEQ ID NO: 2264157 - RNA, 12 nt, Yersinia pestis
auuaacacaucu

SEQ ID NO: 2264158 - RNA, 21 nt, Yersinia pestis
auuaacauuaauccucucuug

SEQ ID NO: 2264159 - RNA, 12 nt, Yersinia pestis
auuaacauccau

SEQ ID NO: 2264160 - RNA, 20 nt, Yersinia pestis
auuaaauuuuaugacacaua

SEQ ID NO: 2264161 - RNA, 16 nt, Yersinia pestis
auuaaguaagccgcac

SEQ ID NO: 2264162 - RNA, 22 nt, Yersinia pestis
aaaagcacagacaaacaaccua

SEQ ID NO: 2264163 - RNA, 14 nt, Yersinia pestis
aaaagcacagacaa

SEQ ID NO: 2264164 - RNA, 13 nt, Yersinia pestis
auucaauaucacu

SEQ ID NO: 2264165 - RNA, 21 nt, Yersinia pestis
auucaauccauugaucucauu

SEQ ID NO: 2264166 - RNA, 23 nt, Yersinia pestis
auucaauccauugaucucauucc

SEQ ID NO: 2264167 - RNA, 21 nt, Yersinia pestis
auucaacagccuuucccugaa

SEQ ID NO: 2264168 - RNA, 17 nt, Yersinia pestis
auucaacacucuacuuu

SEQ ID NO: 2264169 - RNA, 17 nt, Yersinia pestis
auucaacgcuguuucug

SEQ ID NO: 2264170 - RNA, 19 nt, Yersinia pestis
auucaaccaauuauccauc

SEQ ID NO: 2264171 - RNA, 18 nt, Yersinia pestis
auuauugaguaacauuaa

SEQ ID NO: 2264172 - RNA, 15 nt, Yersinia pestis
auuauugaccagaua

SEQ ID NO: 2264173 - RNA, 18 nt, Yersinia pestis
auuauucuucaccacgau

SEQ ID NO: 2264174 - RNA, 19 nt, Yersinia pestis
auuauucuucaccacgauu

SEQ ID NO: 2264175 - RNA, 13 nt, Yersinia pestis
auucaauugaucu

SEQ ID NO: 2264176 - RNA, 15 nt, Yersinia pestis
auucaauugaucuaa

SEQ ID NO: 2264177 - RNA, 19 nt, Yersinia pestis
auucaauugugcaaaauca

SEQ ID NO: 2264178 - RNA, 21 nt, Yersinia pestis
auucaauugugcaaaaucagc

SEQ ID NO: 2264179 - RNA, 23 nt, Yersinia pestis
auucaauugugcaaaaucagcau

SEQ ID NO: 2264180 - RNA, 22 nt, Yersinia pestis
auucacaacagugcaacauuaa

SEQ ID NO: 2264181 - RNA, 12 nt, Yersinia pestis
auucacagcaga

SEQ ID NO: 2264182 - RNA, 15 nt, Yersinia pestis
auucaccagcaauaa

SEQ ID NO: 2264183 - RNA, 16 nt, Yersinia pestis
auucaccagcaauaaa

SEQ ID NO: 2264184 - RNA, 17 nt, Yersinia pestis
auucaccaccauuaaca

SEQ ID NO: 2264185 - RNA, 15 nt, Yersinia pestis
auucaccacacauac

SEQ ID NO: 2264186 - RNA, 17 nt, Yersinia pestis
auucaccacacauacca

SEQ ID NO: 2264187 - RNA, 23 nt, Yersinia pestis
auucaccacacauaccacacaca

SEQ ID NO: 2264188 - RNA, 15 nt, Yersinia pestis
auucaccaccauauu

SEQ ID NO: 2264189 - RNA, 18 nt, Yersinia pestis
auucacguaugguuuuua

SEQ ID NO: 2264190 - RNA, 19 nt, Yersinia pestis
auucacucauaauuuugau

SEQ ID NO: 2264191 - RNA, 14 nt, Yersinia pestis
auucacgccuaucu

SEQ ID NO: 2264192 - RNA, 15 nt, Yersinia pestis
auucacccuuuaaau

SEQ ID NO: 2264193 - RNA, 22 nt, Yersinia pestis
auucaccuugauuaauaacagu

SEQ ID NO: 2264194 - RNA, 18 nt, Yersinia pestis
auucacgaauagcgguac

SEQ ID NO: 2264195 - RNA, 18 nt, Yersinia pestis
auucacgcaaggccaggu

SEQ ID NO: 2264196 - RNA, 23 nt, Yersinia pestis
auucacgagcuaacgcgucaauc

SEQ ID NO: 2264197 - RNA, 21 nt, Yersinia pestis
auucagaugagaaucucucca

SEQ ID NO: 2264198 - RNA, 17 nt, Yersinia pestis
auucagaggaaagagag

SEQ ID NO: 2264199 - RNA, 16 nt, Yersinia pestis
auucagaggaaagaga

SEQ ID NO: 2264200 - RNA, 16 nt, Yersinia pestis
auucacuuuccccugg

SEQ ID NO: 2264201 - RNA, 14 nt, Yersinia pestis
auucaguaaaaacu

SEQ ID NO: 2264202 - RNA, 17 nt, Yersinia pestis
auucaguacauaaaccg

SEQ ID NO: 2264203 - RNA, 19 nt, Yersinia pestis
auucaggccuugauggcua

SEQ ID NO: 2264204 - RNA, 20 nt, Yersinia pestis
auucagucaaucgcucuuca

SEQ ID NO: 2264205 - RNA, 13 nt, Yersinia pestis
auucauaaaaaaa

SEQ ID NO: 2264206 - RNA, 16 nt, Yersinia pestis
auucagcagcaagaaa

SEQ ID NO: 2264207 - RNA, 17 nt, Yersinia pestis
auucagccaacagcuga

SEQ ID NO: 2264208 - RNA, 16 nt, Yersinia pestis
auucagcgucagucaa

SEQ ID NO: 2264209 - RNA, 15 nt, Yersinia pestis
auucagcucugccag

SEQ ID NO: 2264210 - RNA, 13 nt, Yersinia pestis
auuaguuucaaau

SEQ ID NO: 2264211 - RNA, 18 nt, Yersinia pestis
auuagggcugacagagcg

SEQ ID NO: 2264212 - RNA, 17 nt, Yersinia pestis
auuaggauuuauuuuug

SEQ ID NO: 2264213 - RNA, 17 nt, Yersinia pestis
auuagcguuacagcuaa

SEQ ID NO: 2264214 - RNA, 21 nt, Yersinia pestis
auuagcggauuaauaaguaaa

SEQ ID NO: 2264215 - RNA, 13 nt, Yersinia pestis
auuacgccaccuu

SEQ ID NO: 2264216 - RNA, 17 nt, Yersinia pestis
auuacgccauccacuca

SEQ ID NO: 2264217 - RNA, 20 nt, Yersinia pestis
auuacccauaacuugagcac

SEQ ID NO: 2264218 - RNA, 14 nt, Yersinia pestis
auuaugaaaguaag

SEQ ID NO: 2264219 - RNA, 22 nt, Yersinia pestis
auuaugacaacugaaaauacua

SEQ ID NO: 2264220 - RNA, 14 nt, Yersinia pestis
auuauuaaugaaau

SEQ ID NO: 2264221 - RNA, 16 nt, Yersinia pestis
auuauuaaugaaauua

SEQ ID NO: 2264222 - RNA, 14 nt, Yersinia pestis
auuauuacuagaca

SEQ ID NO: 2264223 - RNA, 13 nt, Yersinia pestis
auuauuauuuaua

SEQ ID NO: 2264224 - RNA, 15 nt, Yersinia pestis
auuauucaacgugac

SEQ ID NO: 2264225 - RNA, 21 nt, Yersinia pestis
auuauucaucguaucgugcag

SEQ ID NO: 2264226 - RNA, 14 nt, Yersinia pestis
auuauauuuaauuu

SEQ ID NO: 2264227 - RNA, 17 nt, Yersinia pestis
auuauauuuaauuuaaa

SEQ ID NO: 2264228 - RNA, 19 nt, Yersinia pestis
auuauauuuaauuuaaaua

SEQ ID NO: 2264229 - RNA, 12 nt, Yersinia pestis
auuaucaucuuu

SEQ ID NO: 2264230 - RNA, 17 nt, Yersinia pestis
auuaucauauucaucaa

SEQ ID NO: 2264231 - RNA, 15 nt, Yersinia pestis
auuaucaucaauagc

SEQ ID NO: 2264232 - RNA, 19 nt, Yersinia pestis
augcugucacugucaaaac

SEQ ID NO: 2264233 - RNA, 13 nt, Yersinia pestis
auggcaacagcau

SEQ ID NO: 2264234 - RNA, 15 nt, Yersinia pestis
auggcaacagcaugg

SEQ ID NO: 2264235 - RNA, 19 nt, Yersinia pestis
auggcaaaggauaaugaua

SEQ ID NO: 2264236 - RNA, 14 nt, Yersinia pestis
augcugauaaaauu

SEQ ID NO: 2264237 - RNA, 15 nt, Yersinia pestis
augcugauuaaugag

SEQ ID NO: 2264238 - RNA, 21 nt, Yersinia pestis
augcuggcccaguagagcacu

SEQ ID NO: 2264239 - RNA, 22 nt, Yersinia pestis
augcuggcccaguagagcacuu

SEQ ID NO: 2264240 - RNA, 22 nt, Yersinia pestis
augcuggcuuuuuuguuuuuau

SEQ ID NO: 2264241 - RNA, 17 nt, Yersinia pestis
augcuggguauauauac

SEQ ID NO: 2264242 - RNA, 15 nt, Yersinia pestis
auggcccaagccauc

SEQ ID NO: 2264243 - RNA, 15 nt, Yersinia pestis
auggccaugaaucaa

SEQ ID NO: 2264244 - RNA, 20 nt, Yersinia pestis
auggcaccgugggcaaagaa

SEQ ID NO: 2264245 - RNA, 13 nt, Yersinia pestis
auggcauuuucag

SEQ ID NO: 2264246 - RNA, 14 nt, Yersinia pestis
auggccagacacug

SEQ ID NO: 2264247 - RNA, 16 nt, Yersinia pestis
auggcgcacauuacaa

SEQ ID NO: 2264248 - RNA, 18 nt, Yersinia pestis
auggcgaugaugauuauu

SEQ ID NO: 2264249 - RNA, 22 nt, Yersinia pestis
auggucaacuaaacagaucacc

SEQ ID NO: 2264250 - RNA, 13 nt, Yersinia pestis
auggucacccuca

SEQ ID NO: 2264251 - RNA, 19 nt, Yersinia pestis
auggguauauuuaccaaaa

SEQ ID NO: 2264252 - RNA, 20 nt, Yersinia pestis
auggguaauccccaccaaca

SEQ ID NO: 2264253 - RNA, 21 nt, Yersinia pestis
augggguuuauugguuauuuu

SEQ ID NO: 2264254 - RNA, 20 nt, Yersinia pestis
augggguaaucccgaaucaa

SEQ ID NO: 2264255 - RNA, 18 nt, Yersinia pestis
augggauauuaucgaaac

SEQ ID NO: 2264256 - RNA, 15 nt, Yersinia pestis
auggcuuauuucacu

SEQ ID NO: 2264257 - RNA, 17 nt, Yersinia pestis
auggcuuuggugaucau

SEQ ID NO: 2264258 - RNA, 22 nt, Yersinia pestis
auggcuuuagguugagaauuaa

SEQ ID NO: 2264259 - RNA, 14 nt, Yersinia pestis
auggcuuuaugacc

SEQ ID NO: 2264260 - RNA, 20 nt, Yersinia pestis
auggcggcuggaaaaccaau

SEQ ID NO: 2264261 - RNA, 21 nt, Yersinia pestis
augucaugauaaaacuauucu

SEQ ID NO: 2264262 - RNA, 20 nt, Yersinia pestis
augucaucuuccgucaguug

SEQ ID NO: 2264263 - RNA, 15 nt, Yersinia pestis
auguauucaagcgau

SEQ ID NO: 2264264 - RNA, 13 nt, Yersinia pestis
augucacuugccc

SEQ ID NO: 2264265 - RNA, 13 nt, Yersinia pestis
augucagauuagu

SEQ ID NO: 2264266 - RNA, 16 nt, Yersinia pestis
aaaagcaacuuggcac

SEQ ID NO: 2264267 - RNA, 13 nt, Yersinia pestis
aaaagaucugcau

SEQ ID NO: 2264268 - RNA, 22 nt, Yersinia pestis
aaaagaucugcauugauuaaau

SEQ ID NO: 2264269 - RNA, 20 nt, Yersinia pestis
auguauccaaggcagauauu

SEQ ID NO: 2264270 - RNA, 13 nt, Yersinia pestis
auguauaaagaau

SEQ ID NO: 2264271 - RNA, 19 nt, Yersinia pestis
auguauaaaaaagauaaua

SEQ ID NO: 2264272 - RNA, 18 nt, Yersinia pestis
auggucauaaaaucgaua

SEQ ID NO: 2264273 - RNA, 14 nt, Yersinia pestis
auggucauccacaa

SEQ ID NO: 2264274 - RNA, 15 nt, Yersinia pestis
auggucauccacaac

SEQ ID NO: 2264275 - RNA, 16 nt, Yersinia pestis
augguuuccaguacug

SEQ ID NO: 2264276 - RNA, 20 nt, Yersinia pestis
auguaaaacacgcaacacuu

SEQ ID NO: 2264277 - RNA, 15 nt, Yersinia pestis
auguacuacuucaua

SEQ ID NO: 2264278 - RNA, 17 nt, Yersinia pestis
auguaaggcaauaccaa

SEQ ID NO: 2264279 - RNA, 17 nt, Yersinia pestis
auguaauaaucuaaauu

SEQ ID NO: 2264280 - RNA, 14 nt, Yersinia pestis
auguagagauuagg

SEQ ID NO: 2264281 - RNA, 20 nt, Yersinia pestis
auguagggguacagcaggga

SEQ ID NO: 2264282 - RNA, 19 nt, Yersinia pestis
auguaguacuuaccuuccc

SEQ ID NO: 2264283 - RNA, 19 nt, Yersinia pestis
augcgucuuuagauuucac

SEQ ID NO: 2264284 - RNA, 15 nt, Yersinia pestis
augcguagagucagu

SEQ ID NO: 2264285 - RNA, 17 nt, Yersinia pestis
augcgguucuguaucau

SEQ ID NO: 2264286 - RNA, 22 nt, Yersinia pestis
augcggguuuuuuuacauauaa

SEQ ID NO: 2264287 - RNA, 14 nt, Yersinia pestis
augcggaagaaggc

SEQ ID NO: 2264288 - RNA, 13 nt, Yersinia pestis
augcgauuuuuga

SEQ ID NO: 2264289 - RNA, 21 nt, Yersinia pestis
augcucuucaccaaaggaagc

SEQ ID NO: 2264290 - RNA, 18 nt, Yersinia pestis
augcucuucauaagccag

SEQ ID NO: 2264291 - RNA, 23 nt, Yersinia pestis
augcucacugccgcguaauaaac

SEQ ID NO: 2264292 - RNA, 21 nt, Yersinia pestis
augcugaccccaaauuugaau

SEQ ID NO: 2264293 - RNA, 22 nt, Yersinia pestis
augcugaaucuguaagucauuc

SEQ ID NO: 2264294 - RNA, 23 nt, Yersinia pestis
augcugaaugaauuguuguaauu

SEQ ID NO: 2264295 - RNA, 15 nt, Yersinia pestis
augcucuuuuuaugc

SEQ ID NO: 2264296 - RNA, 20 nt, Yersinia pestis
augcugaacuugcucgggcg

SEQ ID NO: 2264297 - RNA, 12 nt, Yersinia pestis
augcuauauuug

SEQ ID NO: 2264298 - RNA, 21 nt, Yersinia pestis
augcuauauuuggcuuucagc

SEQ ID NO: 2264299 - RNA, 11 nt, Yersinia pestis
augcuauauuu

SEQ ID NO: 2264300 - RNA, 15 nt, Yersinia pestis
augcuagugauaaac

SEQ ID NO: 2264301 - RNA, 18 nt, Yersinia pestis
augcuauuuacugcauuc

SEQ ID NO: 2264302 - RNA, 20 nt, Yersinia pestis
augcucaaguguaaaagaua

SEQ ID NO: 2264303 - RNA, 21 nt, Yersinia pestis
augcucaaguguaaaagauag

SEQ ID NO: 2264304 - RNA, 20 nt, Yersinia pestis
aaaagagauccguuuaauca

SEQ ID NO: 2264305 - RNA, 18 nt, Yersinia pestis
augcuacggauugcaaau

SEQ ID NO: 2264306 - RNA, 16 nt, Yersinia pestis
augcuacuuguuuuuu

SEQ ID NO: 2264307 - RNA, 11 nt, Yersinia pestis
augcuaacucg

SEQ ID NO: 2264308 - RNA, 18 nt, Yersinia pestis
augcuaacaacuuccaca

SEQ ID NO: 2264309 - RNA, 12 nt, Yersinia pestis
augcuaaaaaac

SEQ ID NO: 2264310 - RNA, 15 nt, Yersinia pestis
augcguuggcucaga

SEQ ID NO: 2264311 - RNA, 22 nt, Yersinia pestis
augcguuggcucagauaauaac

SEQ ID NO: 2264312 - RNA, 18 nt, Yersinia pestis
augcguuggcugccuucc

SEQ ID NO: 2264313 - RNA, 15 nt, Yersinia pestis
augcguuguaauaac

SEQ ID NO: 2264314 - RNA, 12 nt, Yersinia pestis
augccagcccca

SEQ ID NO: 2264315 - RNA, 16 nt, Yersinia pestis
augccaacaacugggu

SEQ ID NO: 2264316 - RNA, 15 nt, Yersinia pestis
augcccaguuuacca

SEQ ID NO: 2264317 - RNA, 14 nt, Yersinia pestis
augccggugagcac

SEQ ID NO: 2264318 - RNA, 15 nt, Yersinia pestis
augccggugagcacg

SEQ ID NO: 2264319 - RNA, 17 nt, Yersinia pestis
augccggaaucagccag

SEQ ID NO: 2264320 - RNA, 14 nt, Yersinia pestis
augccggaggauau

SEQ ID NO: 2264321 - RNA, 22 nt, Yersinia pestis
augccggaggauauuuauuauu

SEQ ID NO: 2264322 - RNA, 17 nt, Yersinia pestis
augccgcugaucaggaa

SEQ ID NO: 2264323 - RNA, 15 nt, Yersinia pestis
augcagcuaaaagau

SEQ ID NO: 2264324 - RNA, 17 nt, Yersinia pestis
augcagcuaaaagaugc

SEQ ID NO: 2264325 - RNA, 18 nt, Yersinia pestis
augcacugaacaaugcca

SEQ ID NO: 2264326 - RNA, 19 nt, Yersinia pestis
augcagcuuagaguaagua

SEQ ID NO: 2264327 - RNA, 21 nt, Yersinia pestis
augcaggggggcguuaucacg

SEQ ID NO: 2264328 - RNA, 20 nt, Yersinia pestis
augcaccgcccagauucauu

SEQ ID NO: 2264329 - RNA, 16 nt, Yersinia pestis
augcaccuacaaauuu

SEQ ID NO: 2264330 - RNA, 19 nt, Yersinia pestis
augcauccaagccaucauu

SEQ ID NO: 2264331 - RNA, 12 nt, Yersinia pestis
augcauauguag

SEQ ID NO: 2264332 - RNA, 15 nt, Yersinia pestis
augcaucgcaucaga

SEQ ID NO: 2264333 - RNA, 22 nt, Yersinia pestis
augcaguuaagguuagcuaugc

SEQ ID NO: 2264334 - RNA, 12 nt, Yersinia pestis
augcaguaaaua

SEQ ID NO: 2264335 - RNA, 14 nt, Yersinia pestis
augcaguaaauagu

SEQ ID NO: 2264336 - RNA, 23 nt, Yersinia pestis
auuuacauaauaaccauuuauau

SEQ ID NO: 2264337 - RNA, 20 nt, Yersinia pestis
auuuacaccgugcaauagcu

SEQ ID NO: 2264338 - RNA, 11 nt, Yersinia pestis
auuuacaaacc

SEQ ID NO: 2264339 - RNA, 13 nt, Yersinia pestis
auuuacaaaccac

SEQ ID NO: 2264340 - RNA, 13 nt, Yersinia pestis
auuuacaaauaac

SEQ ID NO: 2264341 - RNA, 23 nt, Yersinia pestis
auuuacaaauaaccgccaaaaua

SEQ ID NO: 2264342 - RNA, 18 nt, Yersinia pestis
auuuacggcuuuucgcuc

SEQ ID NO: 2264343 - RNA, 12 nt, Yersinia pestis
auuuaccugcuc

SEQ ID NO: 2264344 - RNA, 18 nt, Yersinia pestis
auuuaccugcucaacugc

SEQ ID NO: 2264345 - RNA, 18 nt, Yersinia pestis
auuuacucguuuuacauu

SEQ ID NO: 2264346 - RNA, 21 nt, Yersinia pestis
auuuacuccccaaagccuacg

SEQ ID NO: 2264347 - RNA, 13 nt, Yersinia pestis
auuuagacucugc

SEQ ID NO: 2264348 - RNA, 23 nt, Yersinia pestis
auuuagcauuauucuucaccacg

SEQ ID NO: 2264349 - RNA, 17 nt, Yersinia pestis
auuuagccauucaaaaa

SEQ ID NO: 2264350 - RNA, 22 nt, Yersinia pestis
auuuagcaaagcgauaucguua

SEQ ID NO: 2264351 - RNA, 11 nt, Yersinia pestis
auuuaauuaaa

SEQ ID NO: 2264352 - RNA, 13 nt, Yersinia pestis
auuuaauccaacg

SEQ ID NO: 2264353 - RNA, 15 nt, Yersinia pestis
auuuaauuaaaugua

SEQ ID NO: 2264354 - RNA, 20 nt, Yersinia pestis
auuuaauuaaauguauaaaa

SEQ ID NO: 2264355 - RNA, 22 nt, Yersinia pestis
auuuaauuaaauguauaaaaaa

SEQ ID NO: 2264356 - RNA, 17 nt, Yersinia pestis
auuuaauuuaaauaaaa

SEQ ID NO: 2264357 - RNA, 22 nt, Yersinia pestis
auuuaagcugaaauuuuuuaau

SEQ ID NO: 2264358 - RNA, 13 nt, Yersinia pestis
auuuaaacacuca

SEQ ID NO: 2264359 - RNA, 14 nt, Yersinia pestis
auuuaaacacucaa

SEQ ID NO: 2264360 - RNA, 16 nt, Yersinia pestis
auuguuuugacuaaaa

SEQ ID NO: 2264361 - RNA, 17 nt, Yersinia pestis
auuguuuugacuaaaau

SEQ ID NO: 2264362 - RNA, 22 nt, Yersinia pestis
auuguuuuacguucagcacugc

SEQ ID NO: 2264363 - RNA, 13 nt, Yersinia pestis
auugugcggcugg

SEQ ID NO: 2264364 - RNA, 15 nt, Yersinia pestis
auugugagcuauucc

SEQ ID NO: 2264365 - RNA, 17 nt, Yersinia pestis
auuggcgagcaugacac

SEQ ID NO: 2264366 - RNA, 19 nt, Yersinia pestis
auuggccgacugacacaaa

SEQ ID NO: 2264367 - RNA, 16 nt, Yersinia pestis
auuggguaaucucuuu

SEQ ID NO: 2264368 - RNA, 23 nt, Yersinia pestis
auuggauaauuugccuggcgaau

SEQ ID NO: 2264369 - RNA, 16 nt, Yersinia pestis
auuggacccgucacca

SEQ ID NO: 2264370 - RNA, 20 nt, Yersinia pestis
auuggagucgcauguaggca

SEQ ID NO: 2264371 - RNA, 22 nt, Yersinia pestis
auugucacccacuaauggguua

SEQ ID NO: 2264372 - RNA, 13 nt, Yersinia pestis
auugucaaucacu

SEQ ID NO: 2264373 - RNA, 15 nt, Yersinia pestis
auuguauaaaacacc

SEQ ID NO: 2264374 - RNA, 21 nt, Yersinia pestis
auuggucagguuaacaaacac

SEQ ID NO: 2264375 - RNA, 19 nt, Yersinia pestis
auugcuuugcgauacacca

SEQ ID NO: 2264376 - RNA, 16 nt, Yersinia pestis
auugcugaaaaaaaac

SEQ ID NO: 2264377 - RNA, 15 nt, Yersinia pestis
auugcucagggccac

SEQ ID NO: 2264378 - RNA, 21 nt, Yersinia pestis
auugcucuggauagcagagaa

SEQ ID NO: 2264379 - RNA, 20 nt, Yersinia pestis
auugcuccuuacuauuuuca

SEQ ID NO: 2264380 - RNA, 16 nt, Yersinia pestis
auugauauauagaaau

SEQ ID NO: 2264381 - RNA, 17 nt, Yersinia pestis
auugauccaaauggcug

SEQ ID NO: 2264382 - RNA, 12 nt, Yersinia pestis
auugauccaggg

SEQ ID NO: 2264383 - RNA, 18 nt, Yersinia pestis
auugauccccaaauacug

SEQ ID NO: 2264384 - RNA, 18 nt, Yersinia pestis
auugauagccacaucauu

SEQ ID NO: 2264385 - RNA, 19 nt, Yersinia pestis
auugauaauggcauuuuca

SEQ ID NO: 2264386 - RNA, 14 nt, Yersinia pestis
auugauaaaaccac

SEQ ID NO: 2264387 - RNA, 13 nt, Yersinia pestis
auugauaaaaccg

SEQ ID NO: 2264388 - RNA, 17 nt, Yersinia pestis
auugauaaaaguaauuu

SEQ ID NO: 2264389 - RNA, 21 nt, Yersinia pestis
auugauaaaaguaauuuauca

SEQ ID NO: 2264390 - RNA, 14 nt, Yersinia pestis
auugauugcuuacc

SEQ ID NO: 2264391 - RNA, 19 nt, Yersinia pestis
auuccgcuucacauuugaa

SEQ ID NO: 2264392 - RNA, 22 nt, Yersinia pestis
auuccgcuucacauuugaaaug

SEQ ID NO: 2264393 - RNA, 18 nt, Yersinia pestis
auuccucucugaaucacu

SEQ ID NO: 2264394 - RNA, 16 nt, Yersinia pestis
auuccgccaacaggau

SEQ ID NO: 2264395 - RNA, 17 nt, Yersinia pestis
auuccgccuguuuucag

SEQ ID NO: 2264396 - RNA, 19 nt, Yersinia pestis
auuccgccuguuuucaggc

SEQ ID NO: 2264397 - RNA, 18 nt, Yersinia pestis
auuccccccagucacuac

SEQ ID NO: 2264398 - RNA, 22 nt, Yersinia pestis
auucccaucgaacgcgucacug

SEQ ID NO: 2264399 - RNA, 13 nt, Yersinia pestis
auucccagccacu

SEQ ID NO: 2264400 - RNA, 20 nt, Yersinia pestis
auucauaccuguacuuugau

SEQ ID NO: 2264401 - RNA, 11 nt, Yersinia pestis
auuccagaccg

SEQ ID NO: 2264402 - RNA, 17 nt, Yersinia pestis
auuccagagugccggga

SEQ ID NO: 2264403 - RNA, 16 nt, Yersinia pestis
auucauaccgcagaua

SEQ ID NO: 2264404 - RNA, 20 nt, Yersinia pestis
auucuaccuggcucaaauuu

SEQ ID NO: 2264405 - RNA, 12 nt, Yersinia pestis
auucuagcaaca

SEQ ID NO: 2264406 - RNA, 13 nt, Yersinia pestis
auucuagcaacau

SEQ ID NO: 2264407 - RNA, 21 nt, Yersinia pestis
auucgggcaacuaauucuuag

SEQ ID NO: 2264408 - RNA, 16 nt, Yersinia pestis
auucgauaaaaggcua

SEQ ID NO: 2264409 - RNA, 21 nt, Yersinia pestis
auucgcaucuuccaaaggaag

SEQ ID NO: 2264410 - RNA, 22 nt, Yersinia pestis
auucgcaucuuccaaaggaagg

SEQ ID NO: 2264411 - RNA, 13 nt, Yersinia pestis
auucgccagauac

SEQ ID NO: 2264412 - RNA, 15 nt, Yersinia pestis
auucgagugugauga

SEQ ID NO: 2264413 - RNA, 19 nt, Yersinia pestis
auucuuaucaaucaaaaaa

SEQ ID NO: 2264414 - RNA, 18 nt, Yersinia pestis
auucuuaucaaucaaaaa

SEQ ID NO: 2264415 - RNA, 19 nt, Yersinia pestis
auucucccgauacccauuu

SEQ ID NO: 2264416 - RNA, 13 nt, Yersinia pestis
auucucccauuua

SEQ ID NO: 2264417 - RNA, 14 nt, Yersinia pestis
auucucccauuuau

SEQ ID NO: 2264418 - RNA, 18 nt, Yersinia pestis
auucuguagaguaaaacu

SEQ ID NO: 2264419 - RNA, 18 nt, Yersinia pestis
auucuuaccguuucagau

SEQ ID NO: 2264420 - RNA, 21 nt, Yersinia pestis
auucucauugcccccuucaau

SEQ ID NO: 2264421 - RNA, 21 nt, Yersinia pestis
auugagguugccgguaaugau

SEQ ID NO: 2264422 - RNA, 16 nt, Yersinia pestis
auugaguaacauuaau

SEQ ID NO: 2264423 - RNA, 16 nt, Yersinia pestis
auugacugaaugugaa

SEQ ID NO: 2264424 - RNA, 18 nt, Yersinia pestis
auugagagaaaugcucau

SEQ ID NO: 2264425 - RNA, 23 nt, Yersinia pestis
auugagacccguuacugcaucua

SEQ ID NO: 2264426 - RNA, 24 nt, Yersinia pestis
auugagcauaucaaucagcaucuu

SEQ ID NO: 2264427 - RNA, 16 nt, Yersinia pestis
auugagcauaucaauc

SEQ ID NO: 2264428 - RNA, 21 nt, Yersinia pestis
auugaauaacuucgcgaacac

SEQ ID NO: 2264429 - RNA, 19 nt, Yersinia pestis
auugaagggcaaaacguga

SEQ ID NO: 2264430 - RNA, 20 nt, Yersinia pestis
auugaagugauauagaaagc

SEQ ID NO: 2264431 - RNA, 11 nt, Yersinia pestis
auugaagaguu

SEQ ID NO: 2264432 - RNA, 16 nt, Yersinia pestis
auugacaggugguucu

SEQ ID NO: 2264433 - RNA, 20 nt, Yersinia pestis
auugaccauagagagaaaaa

SEQ ID NO: 2264434 - RNA, 16 nt, Yersinia pestis
auugaccagauagcug

SEQ ID NO: 2264435 - RNA, 19 nt, Yersinia pestis
auuuuaugaauuaauuuau

SEQ ID NO: 2264436 - RNA, 15 nt, Yersinia pestis
auuuuaugcccccua

SEQ ID NO: 2264437 - RNA, 21 nt, Yersinia pestis
auuuucccagugcguacgcca

SEQ ID NO: 2264438 - RNA, 21 nt, Yersinia pestis
auuuuccagaugaauauguuc

SEQ ID NO: 2264439 - RNA, 14 nt, Yersinia pestis
auuuucccucugcc

SEQ ID NO: 2264440 - RNA, 15 nt, Yersinia pestis
auuuucccugugcaa

SEQ ID NO: 2264441 - RNA, 17 nt, Yersinia pestis
auuuucccugugcaauc

SEQ ID NO: 2264442 - RNA, 19 nt, Yersinia pestis
auuuuccgcagcucaccua

SEQ ID NO: 2264443 - RNA, 19 nt, Yersinia pestis
auuuucccugugcaaucaa

SEQ ID NO: 2264444 - RNA, 19 nt, Yersinia pestis
auuuucugauguguauauu

SEQ ID NO: 2264445 - RNA, 22 nt, Yersinia pestis
auuuugcacacgauuaccugca

SEQ ID NO: 2264446 - RNA, 12 nt, Yersinia pestis
auuuugcagcgc

SEQ ID NO: 2264447 - RNA, 19 nt, Yersinia pestis
auuuugaggauauuagggc

SEQ ID NO: 2264448 - RNA, 18 nt, Yersinia pestis
auuuugucaugaaaaucu

SEQ ID NO: 2264449 - RNA, 16 nt, Yersinia pestis
auuuuguagcccacug

SEQ ID NO: 2264450 - RNA, 19 nt, Yersinia pestis
auuuugcgucaccaggcca

SEQ ID NO: 2264451 - RNA, 21 nt, Yersinia pestis
caaaacaauaucuauuugagu

SEQ ID NO: 2264452 - RNA, 18 nt, Yersinia pestis
caaaacagccuaaggcca

SEQ ID NO: 2264453 - RNA, 19 nt, Yersinia pestis
caaaaaccugugugguacc

SEQ ID NO: 2264454 - RNA, 20 nt, Yersinia pestis
caaaaacccauuaaaaacaa

SEQ ID NO: 2264455 - RNA, 20 nt, Yersinia pestis
caaaaacacagguucuccag

SEQ ID NO: 2264456 - RNA, 19 nt, Yersinia pestis
auuuuugcauauaaaacac

SEQ ID NO: 2264457 - RNA, 21 nt, Yersinia pestis
auuuuugcuuguuauuuuaau

SEQ ID NO: 2264458 - RNA, 18 nt, Yersinia pestis
auuuuuauaaucaucuac

SEQ ID NO: 2264459 - RNA, 13 nt, Yersinia pestis
auuuuuauauuuu

SEQ ID NO: 2264460 - RNA, 12 nt, Yersinia pestis
auuuuuaugguu

SEQ ID NO: 2264461 - RNA, 12 nt, Yersinia pestis
auuuuuuaaaac

SEQ ID NO: 2264462 - RNA, 13 nt, Yersinia pestis
caaaaacaaauaa

SEQ ID NO: 2264463 - RNA, 14 nt, Yersinia pestis
auuuuuuguagguu

SEQ ID NO: 2264464 - RNA, 15 nt, Yersinia pestis
auuuuuuguuuuuau

SEQ ID NO: 2264465 - RNA, 23 nt, Yersinia pestis
auuuuuuguucuuaauuuuauca

SEQ ID NO: 2264466 - RNA, 20 nt, Yersinia pestis
auuugcagcggaugauaaau

SEQ ID NO: 2264467 - RNA, 21 nt, Yersinia pestis
auuugcauaaucgcguucaga

SEQ ID NO: 2264468 - RNA, 19 nt, Yersinia pestis
auuugcccgaaucacuggu

SEQ ID NO: 2264469 - RNA, 19 nt, Yersinia pestis
auuugccucugcuagcaaa

SEQ ID NO: 2264470 - RNA, 18 nt, Yersinia pestis
auuucuuuuaaaucagaa

SEQ ID NO: 2264471 - RNA, 14 nt, Yersinia pestis
auuugacauuuccu

SEQ ID NO: 2264472 - RNA, 20 nt, Yersinia pestis
auuugaccuccguaggccaa

SEQ ID NO: 2264473 - RNA, 19 nt, Yersinia pestis
auuugacgcuguauacccg

SEQ ID NO: 2264474 - RNA, 15 nt, Yersinia pestis
auuuguaaauuuuuu

SEQ ID NO: 2264475 - RNA, 20 nt, Yersinia pestis
auuugggguauaacgaucag

SEQ ID NO: 2264476 - RNA, 16 nt, Yersinia pestis
auuugggguauauauu

SEQ ID NO: 2264477 - RNA, 20 nt, Yersinia pestis
auuuggcuaaugguuuuuau

SEQ ID NO: 2264478 - RNA, 19 nt, Yersinia pestis
auuugguuauaucccaaua

SEQ ID NO: 2264479 - RNA, 17 nt, Yersinia pestis
auuugguuggcuuuaac

SEQ ID NO: 2264480 - RNA, 21 nt, Yersinia pestis
auuuggucugcguauggggau

SEQ ID NO: 2264481 - RNA, 18 nt, Yersinia pestis
auuuggaaugaguuuaag

SEQ ID NO: 2264482 - RNA, 19 nt, Yersinia pestis
auuugucauguugaccaaa

SEQ ID NO: 2264483 - RNA, 14 nt, Yersinia pestis
auuugugucgggau

SEQ ID NO: 2264484 - RNA, 18 nt, Yersinia pestis
auuugugucgggauuuuu

SEQ ID NO: 2264485 - RNA, 19 nt, Yersinia pestis
auuuguggugguugcagug

SEQ ID NO: 2264486 - RNA, 20 nt, Yersinia pestis
auuuccuaugugauauuuua

SEQ ID NO: 2264487 - RNA, 21 nt, Yersinia pestis
auuuccuaugugauauuuuac

SEQ ID NO: 2264488 - RNA, 20 nt, Yersinia pestis
auuucauuuuaaaaucguau

SEQ ID NO: 2264489 - RNA, 12 nt, Yersinia pestis
auuuccacaauc

SEQ ID NO: 2264490 - RNA, 19 nt, Yersinia pestis
auuucuacgccgucaucau

SEQ ID NO: 2264491 - RNA, 20 nt, Yersinia pestis
auuucuacgccgucaucauc

SEQ ID NO: 2264492 - RNA, 13 nt, Yersinia pestis
auuucgcccugca

SEQ ID NO: 2264493 - RNA, 14 nt, Yersinia pestis
auuuauaaaaccac

SEQ ID NO: 2264494 - RNA, 16 nt, Yersinia pestis
auuuaggguauagcau

SEQ ID NO: 2264495 - RNA, 22 nt, Yersinia pestis
auuuaggauuagccgcuuucau

SEQ ID NO: 2264496 - RNA, 13 nt, Yersinia pestis
auuucacuggaaa

SEQ ID NO: 2264497 - RNA, 16 nt, Yersinia pestis
auuuauaaaaccacug

SEQ ID NO: 2264498 - RNA, 23 nt, Yersinia pestis
auuucaacaaaacgaacacugca

SEQ ID NO: 2264499 - RNA, 18 nt, Yersinia pestis
auuucagcaccauaaauu

SEQ ID NO: 2264500 - RNA, 19 nt, Yersinia pestis
auuucagcaccauaaauuu

SEQ ID NO: 2264501 - RNA, 21 nt, Yersinia pestis
auuucagaguaagucuuuccu

SEQ ID NO: 2264502 - RNA, 22 nt, Yersinia pestis
auuucagauaaaaauaaucaau

SEQ ID NO: 2264503 - RNA, 13 nt, Yersinia pestis
auuucagacugcu

SEQ ID NO: 2264504 - RNA, 19 nt, Yersinia pestis
auuucagacugcugacaac

SEQ ID NO: 2264505 - RNA, 14 nt, Yersinia pestis
auuucaguuuuucc

SEQ ID NO: 2264506 - RNA, 18 nt, Yersinia pestis
auuucacuggaaaaagug

SEQ ID NO: 2264507 - RNA, 17 nt, Yersinia pestis
auuucagcagcacguuc

SEQ ID NO: 2264508 - RNA, 23 nt, Yersinia pestis
auuucauagggcugaauaucauu

SEQ ID NO: 2264509 - RNA, 17 nt, Yersinia pestis
auuucaucucaauaacu

SEQ ID NO: 2264510 - RNA, 24 nt, Yersinia pestis
auuucaucggcaaaaacagucauu

SEQ ID NO: 2264511 - RNA, 14 nt, Yersinia pestis
auuucaucuugauu

SEQ ID NO: 2264512 - RNA, 17 nt, Yersinia pestis
auuucaugcgaauacuu

SEQ ID NO: 2264513 - RNA, 18 nt, Yersinia pestis
cacaaugccuaaaauggc

SEQ ID NO: 2264514 - RNA, 13 nt, Yersinia pestis
cacaauguugaua

SEQ ID NO: 2264515 - RNA, 11 nt, Yersinia pestis
cacaccaucag

SEQ ID NO: 2264516 - RNA, 22 nt, Yersinia pestis
cacacugacagcaacgacgccc

SEQ ID NO: 2264517 - RNA, 14 nt, Yersinia pestis
cacacugguugaaa

SEQ ID NO: 2264518 - RNA, 19 nt, Yersinia pestis
cacaccauuuggacugaau

SEQ ID NO: 2264519 - RNA, 17 nt, Yersinia pestis
cacacccucaacucaaa

SEQ ID NO: 2264520 - RNA, 13 nt, Yersinia pestis
cacaccggcugca

SEQ ID NO: 2264521 - RNA, 22 nt, Yersinia pestis
cacagucugucguacuuuccuu

SEQ ID NO: 2264522 - RNA, 19 nt, Yersinia pestis
cacagucgcacugauagca

SEQ ID NO: 2264523 - RNA, 14 nt, Yersinia pestis
cacaguacaaaaaa

SEQ ID NO: 2264524 - RNA, 20 nt, Yersinia pestis
cacaggggcgaugucaccau

SEQ ID NO: 2264525 - RNA, 17 nt, Yersinia pestis
cacaggcuuucaggacu

SEQ ID NO: 2264526 - RNA, 14 nt, Yersinia pestis
cacaggcugcaugg

SEQ ID NO: 2264527 - RNA, 12 nt, Yersinia pestis
cacagacaaaca

SEQ ID NO: 2264528 - RNA, 16 nt, Yersinia pestis
cacagcccugccuggc

SEQ ID NO: 2264529 - RNA, 16 nt, Yersinia pestis
cacagccuacgggguc

SEQ ID NO: 2264530 - RNA, 18 nt, Yersinia pestis
caauuuaccacuauccaa

SEQ ID NO: 2264531 - RNA, 20 nt, Yersinia pestis
caauugaguaacugauuaau

SEQ ID NO: 2264532 - RNA, 12 nt, Yersinia pestis
caauugcaccgc

SEQ ID NO: 2264533 - RNA, 22 nt, Yersinia pestis
caauuuagacaugggcagugca

SEQ ID NO: 2264534 - RNA, 22 nt, Yersinia pestis
caauuugucauguugaccaaac

SEQ ID NO: 2264535 - RNA, 20 nt, Yersinia pestis
caauuuuuugguguccccac

SEQ ID NO: 2264536 - RNA, 14 nt, Yersinia pestis
caauuuuugauacu

SEQ ID NO: 2264537 - RNA, 22 nt, Yersinia pestis
caauuuuugccuuucugggcug

SEQ ID NO: 2264538 - RNA, 15 nt, Yersinia pestis
caauucacucauaau

SEQ ID NO: 2264539 - RNA, 11 nt, Yersinia pestis
caauucaguuu

SEQ ID NO: 2264540 - RNA, 14 nt, Yersinia pestis
caauucacccauac

SEQ ID NO: 2264541 - RNA, 15 nt, Yersinia pestis
caauugauccugugc

SEQ ID NO: 2264542 - RNA, 16 nt, Yersinia pestis
caauuauuuagccugc

SEQ ID NO: 2264543 - RNA, 20 nt, Yersinia pestis
caauuauuuagccugccaau

SEQ ID NO: 2264544 - RNA, 12 nt, Yersinia pestis
caauucaaugcu

SEQ ID NO: 2264545 - RNA, 21 nt, Yersinia pestis
caauuagguugcagcuaaaca

SEQ ID NO: 2264546 - RNA, 21 nt, Yersinia pestis
caauuaggggaagguaaaaaa

SEQ ID NO: 2264547 - RNA, 22 nt, Yersinia pestis
caauuaggggaagguaaaaaag

SEQ ID NO: 2264548 - RNA, 23 nt, Yersinia pestis
caauuaggggaagguaaaaaaga

SEQ ID NO: 2264549 - RNA, 21 nt, Yersinia pestis
caauuagcugaucgggcuuua

SEQ ID NO: 2264550 - RNA, 18 nt, Yersinia pestis
caauuaaucaauuaaaua

SEQ ID NO: 2264551 - RNA, 22 nt, Yersinia pestis
caauuaaucaauuaaucaauua

SEQ ID NO: 2264552 - RNA, 15 nt, Yersinia pestis
caauguucucugggu

SEQ ID NO: 2264553 - RNA, 22 nt, Yersinia pestis
caaugcguuggcucagauaaua

SEQ ID NO: 2264554 - RNA, 15 nt, Yersinia pestis
caccauuaacaagcg

SEQ ID NO: 2264555 - RNA, 14 nt, Yersinia pestis
caccauguccaugu

SEQ ID NO: 2264556 - RNA, 15 nt, Yersinia pestis
caccauggaaaauau

SEQ ID NO: 2264557 - RNA, 17 nt, Yersinia pestis
caccaugaugaaucugu

SEQ ID NO: 2264558 - RNA, 16 nt, Yersinia pestis
caccaugaugaaucug

SEQ ID NO: 2264559 - RNA, 22 nt, Yersinia pestis
caccauccccugucuugccagc

SEQ ID NO: 2264560 - RNA, 22 nt, Yersinia pestis
caccaucgccccuguaguucau

SEQ ID NO: 2264561 - RNA, 20 nt, Yersinia pestis
caccaucgcgcugucuuuca

SEQ ID NO: 2264562 - RNA, 14 nt, Yersinia pestis
caccaucaacaugg

SEQ ID NO: 2264563 - RNA, 15 nt, Yersinia pestis
caccaguuuauuuuc

SEQ ID NO: 2264564 - RNA, 21 nt, Yersinia pestis
caccauaaaaacuucagagcc

SEQ ID NO: 2264565 - RNA, 16 nt, Yersinia pestis
caccaguucuaacccg

SEQ ID NO: 2264566 - RNA, 20 nt, Yersinia pestis
caccaguugaccauuuuuau

SEQ ID NO: 2264567 - RNA, 17 nt, Yersinia pestis
aaaaguuucagcgugga

SEQ ID NO: 2264568 - RNA, 21 nt, Yersinia pestis
aaaaguuaggguucaguaaaa

SEQ ID NO: 2264569 - RNA, 16 nt, Yersinia pestis
caccaccgacaccacg

SEQ ID NO: 2264570 - RNA, 15 nt, Yersinia pestis
caccaauaucaauau

SEQ ID NO: 2264571 - RNA, 16 nt, Yersinia pestis
caccaauuucaucgcu

SEQ ID NO: 2264572 - RNA, 23 nt, Yersinia pestis
caccaccaucacuuccagcgccc

SEQ ID NO: 2264573 - RNA, 14 nt, Yersinia pestis
caccaaugcaucca

SEQ ID NO: 2264574 - RNA, 17 nt, Yersinia pestis
caccaaugcauccaagc

SEQ ID NO: 2264575 - RNA, 20 nt, Yersinia pestis
caccaaugcauccaagccau

SEQ ID NO: 2264576 - RNA, 23 nt, Yersinia pestis
caccacggcuuucaauaaaacuc

SEQ ID NO: 2264577 - RNA, 12 nt, Yersinia pestis
caccacggucag

SEQ ID NO: 2264578 - RNA, 23 nt, Yersinia pestis
cacaucgggauccgccugcuggc

SEQ ID NO: 2264579 - RNA, 18 nt, Yersinia pestis
cacauaaauaaguucagg

SEQ ID NO: 2264580 - RNA, 19 nt, Yersinia pestis
cacaguuuucuuaaaauac

SEQ ID NO: 2264581 - RNA, 21 nt, Yersinia pestis
cacaucuugcgccgaaauaaa

SEQ ID NO: 2264582 - RNA, 18 nt, Yersinia pestis
cacaucucggcguaaaca

SEQ ID NO: 2264583 - RNA, 19 nt, Yersinia pestis
cacaugguuucaaugagca

SEQ ID NO: 2264584 - RNA, 21 nt, Yersinia pestis
cacaugguuucaaugagcaua

SEQ ID NO: 2264585 - RNA, 12 nt, Yersinia pestis
cacaugcucagu

SEQ ID NO: 2264586 - RNA, 16 nt, Yersinia pestis
cacccucaacucaaaa

SEQ ID NO: 2264587 - RNA, 21 nt, Yersinia pestis
cacccuaucugcucuugcuca

SEQ ID NO: 2264588 - RNA, 12 nt, Yersinia pestis
cacccguugcaa

SEQ ID NO: 2264589 - RNA, 15 nt, Yersinia pestis
cacccucugcagcuu

SEQ ID NO: 2264590 - RNA, 22 nt, Yersinia pestis
cacccuuuaaaucuagcccuuc

SEQ ID NO: 2264591 - RNA, 20 nt, Yersinia pestis
cacccuuuugaauucaccaa

SEQ ID NO: 2264592 - RNA, 15 nt, Yersinia pestis
cacccggcauaaagg

SEQ ID NO: 2264593 - RNA, 18 nt, Yersinia pestis
cacccggcauaaagguuu

SEQ ID NO: 2264594 - RNA, 22 nt, Yersinia pestis
cacccgcuucauucgcauaggg

SEQ ID NO: 2264595 - RNA, 20 nt, Yersinia pestis
caccauuggcgaucgcgcca

SEQ ID NO: 2264596 - RNA, 16 nt, Yersinia pestis
caccauuaauaauaac

SEQ ID NO: 2264597 - RNA, 15 nt, Yersinia pestis
caccauuaucuucca

SEQ ID NO: 2264598 - RNA, 13 nt, Yersinia pestis
caccauugaccag

SEQ ID NO: 2264599 - RNA, 13 nt, Yersinia pestis
cacccaacaauga

SEQ ID NO: 2264600 - RNA, 15 nt, Yersinia pestis
cacccaaacugucug

SEQ ID NO: 2264601 - RNA, 21 nt, Yersinia pestis
cacccaauaauaaaaaaaaau

SEQ ID NO: 2264602 - RNA, 14 nt, Yersinia pestis
caccauuuccaggc

SEQ ID NO: 2264603 - RNA, 15 nt, Yersinia pestis
caccauuuccaggcu

SEQ ID NO: 2264604 - RNA, 22 nt, Yersinia pestis
cacccaacuuuuuuaccacauu

SEQ ID NO: 2264605 - RNA, 20 nt, Yersinia pestis
cacccaccaagggucaucaa

SEQ ID NO: 2264606 - RNA, 21 nt, Yersinia pestis
cacccaccaagggucaucaac

SEQ ID NO: 2264607 - RNA, 16 nt, Yersinia pestis
caccgacaccacgauc

SEQ ID NO: 2264608 - RNA, 16 nt, Yersinia pestis
caccgauggcaccgac

SEQ ID NO: 2264609 - RNA, 22 nt, Yersinia pestis
caccgccgucaaaccaagcccu

SEQ ID NO: 2264610 - RNA, 22 nt, Yersinia pestis
aaaauaaguaacauuuguauuu

SEQ ID NO: 2264611 - RNA, 13 nt, Yersinia pestis
aaaauaacguagu

SEQ ID NO: 2264612 - RNA, 22 nt, Yersinia pestis
aaaauaacugggauauucugga

SEQ ID NO: 2264613 - RNA, 14 nt, Yersinia pestis
aaaauaauaauucu

SEQ ID NO: 2264614 - RNA, 18 nt, Yersinia pestis
caccguaacuucuucgcg

SEQ ID NO: 2264615 - RNA, 16 nt, Yersinia pestis
caccguaacuucuucg

SEQ ID NO: 2264616 - RNA, 18 nt, Yersinia pestis
caccgguuuacccugcgc

SEQ ID NO: 2264617 - RNA, 21 nt, Yersinia pestis
caccgguucacgugguuuugu

SEQ ID NO: 2264618 - RNA, 13 nt, Yersinia pestis
caccguuacucag

SEQ ID NO: 2264619 - RNA, 15 nt, Yersinia pestis
caccgugugauaaac

SEQ ID NO: 2264620 - RNA, 15 nt, Yersinia pestis
caccugaugagaggg

SEQ ID NO: 2264621 - RNA, 16 nt, Yersinia pestis
caccugagugcggcca

SEQ ID NO: 2264622 - RNA, 21 nt, Yersinia pestis
caccucuugcauacucaggcc

SEQ ID NO: 2264623 - RNA, 14 nt, Yersinia pestis
cacgauagccagug

SEQ ID NO: 2264624 - RNA, 22 nt, Yersinia pestis
cacgaucaucaacucgccaccc

SEQ ID NO: 2264625 - RNA, 21 nt, Yersinia pestis
cacgaucagugaagagauaac

SEQ ID NO: 2264626 - RNA, 17 nt, Yersinia pestis
cacgcagugcaucuucc

SEQ ID NO: 2264627 - RNA, 19 nt, Yersinia pestis
cacgcauuccaucagccaa

SEQ ID NO: 2264628 - RNA, 15 nt, Yersinia pestis
cacgcagcuuuuucu

SEQ ID NO: 2264629 - RNA, 23 nt, Yersinia pestis
cacgccccaacgguaacccgaua

SEQ ID NO: 2264630 - RNA, 15 nt, Yersinia pestis
cacgcccaacucuuu

SEQ ID NO: 2264631 - RNA, 18 nt, Yersinia pestis
cacgccaguaaacagcca

SEQ ID NO: 2264632 - RNA, 14 nt, Yersinia pestis
cacgccaguguuca

SEQ ID NO: 2264633 - RNA, 17 nt, Yersinia pestis
aaaauacugccaaucgc

SEQ ID NO: 2264634 - RNA, 14 nt, Yersinia pestis
cacgacgcgcuuga

SEQ ID NO: 2264635 - RNA, 19 nt, Yersinia pestis
cacgauaaauucgauaaaa

SEQ ID NO: 2264636 - RNA, 17 nt, Yersinia pestis
cacgauacgacuucuua

SEQ ID NO: 2264637 - RNA, 14 nt, Yersinia pestis
cacgauaccaccac

SEQ ID NO: 2264638 - RNA, 17 nt, Yersinia pestis
cacgauaccaccaccaa

SEQ ID NO: 2264639 - RNA, 22 nt, Yersinia pestis
caccuuuaccuuuacggccgcu

SEQ ID NO: 2264640 - RNA, 19 nt, Yersinia pestis
caccuuggaaaacagcaac

SEQ ID NO: 2264641 - RNA, 18 nt, Yersinia pestis
caccuucuugguuaguuc

SEQ ID NO: 2264642 - RNA, 22 nt, Yersinia pestis
caccugcgggauagcauaaaua

SEQ ID NO: 2264643 - RNA, 16 nt, Yersinia pestis
cacguaauaccuuaaa

SEQ ID NO: 2264644 - RNA, 17 nt, Yersinia pestis
cacgguuucuaaaaaau

SEQ ID NO: 2264645 - RNA, 13 nt, Yersinia pestis
cacgguaucugcu

SEQ ID NO: 2264646 - RNA, 17 nt, Yersinia pestis
cacgguaguaauaauuu

SEQ ID NO: 2264647 - RNA, 16 nt, Yersinia pestis
cacggcuuucaauaaa

SEQ ID NO: 2264648 - RNA, 22 nt, Yersinia pestis
aaaauauagcaaucauuuauau

SEQ ID NO: 2264649 - RNA, 17 nt, Yersinia pestis
cacggugaauaaacccu

SEQ ID NO: 2264650 - RNA, 17 nt, Yersinia pestis
cacggaaaguagccauu

SEQ ID NO: 2264651 - RNA, 20 nt, Yersinia pestis
cacggaaacguucaggcuuu

SEQ ID NO: 2264652 - RNA, 22 nt, Yersinia pestis
cacggcagugaucaaugacuuc

SEQ ID NO: 2264653 - RNA, 21 nt, Yersinia pestis
cacgcugaauaacaaaagccc

SEQ ID NO: 2264654 - RNA, 19 nt, Yersinia pestis
cacgcugggcgaucauuuu

SEQ ID NO: 2264655 - RNA, 16 nt, Yersinia pestis
caaacaguaacccagc

SEQ ID NO: 2264656 - RNA, 23 nt, Yersinia pestis
caaacaguaagauaggccaccuc

SEQ ID NO: 2264657 - RNA, 21 nt, Yersinia pestis
caaacagccgaucaacccgca

SEQ ID NO: 2264658 - RNA, 19 nt, Yersinia pestis
caaacaccgcacguuuaaa

SEQ ID NO: 2264659 - RNA, 17 nt, Yersinia pestis
caaacauugucaccuga

SEQ ID NO: 2264660 - RNA, 17 nt, Yersinia pestis
caaaccccgaugacuca

SEQ ID NO: 2264661 - RNA, 21 nt, Yersinia pestis
caaacccuaauaccaacagca

SEQ ID NO: 2264662 - RNA, 18 nt, Yersinia pestis
caaaccccgccucuucua

SEQ ID NO: 2264663 - RNA, 14 nt, Yersinia pestis
caaaaccauuggaa

SEQ ID NO: 2264664 - RNA, 19 nt, Yersinia pestis
caaaaguucacaugaugaa

SEQ ID NO: 2264665 - RNA, 12 nt, Yersinia pestis
caaaauaaaaau

SEQ ID NO: 2264666 - RNA, 23 nt, Yersinia pestis
caaaaguuaggguucaguaaaac

SEQ ID NO: 2264667 - RNA, 20 nt, Yersinia pestis
caaaaccguacugauaucuu

SEQ ID NO: 2264668 - RNA, 17 nt, Yersinia pestis
caaaaccggcauuaagc

SEQ ID NO: 2264669 - RNA, 20 nt, Yersinia pestis
caaaauaugauaguguaaaa

SEQ ID NO: 2264670 - RNA, 20 nt, Yersinia pestis
caaaauaaaaauucacaaca

SEQ ID NO: 2264671 - RNA, 14 nt, Yersinia pestis
caaaauaauauaau

SEQ ID NO: 2264672 - RNA, 19 nt, Yersinia pestis
caaaauaauaauucugcua

SEQ ID NO: 2264673 - RNA, 14 nt, Yersinia pestis
caaaaugagccugu

SEQ ID NO: 2264674 - RNA, 16 nt, Yersinia pestis
caaaaugccaacaacu

SEQ ID NO: 2264675 - RNA, 23 nt, Yersinia pestis
caaaaugcucuucaccaaaggaa

SEQ ID NO: 2264676 - RNA, 19 nt, Yersinia pestis
caaacucagcgaauaaaua

SEQ ID NO: 2264677 - RNA, 14 nt, Yersinia pestis
caaacucuggaugg

SEQ ID NO: 2264678 - RNA, 21 nt, Yersinia pestis
caaacucggccgggcugacau

SEQ ID NO: 2264679 - RNA, 20 nt, Yersinia pestis
caaagacuuuauucacagca

SEQ ID NO: 2264680 - RNA, 15 nt, Yersinia pestis
caaacuggcccagcu

SEQ ID NO: 2264681 - RNA, 18 nt, Yersinia pestis
caaacuggccauguugug

SEQ ID NO: 2264682 - RNA, 15 nt, Yersinia pestis
caaagauacagugga

SEQ ID NO: 2264683 - RNA, 19 nt, Yersinia pestis
caaagagucgcaaaacuuc

SEQ ID NO: 2264684 - RNA, 21 nt, Yersinia pestis
caaagcaaugaauacccaaaa

SEQ ID NO: 2264685 - RNA, 22 nt, Yersinia pestis
caaagauagacauauuguccaa

SEQ ID NO: 2264686 - RNA, 21 nt, Yersinia pestis
caaagcaccaacuaagcagau

SEQ ID NO: 2264687 - RNA, 17 nt, Yersinia pestis
caaagcuuacuguucac

SEQ ID NO: 2264688 - RNA, 17 nt, Yersinia pestis
caaagcuauuuuuagcc

SEQ ID NO: 2264689 - RNA, 22 nt, Yersinia pestis
caaauacggcgaaauauaaaac

SEQ ID NO: 2264690 - RNA, 17 nt, Yersinia pestis
caaauacuucaaaugac

SEQ ID NO: 2264691 - RNA, 22 nt, Yersinia pestis
caaauacgaccgucaccaaaua

SEQ ID NO: 2264692 - RNA, 22 nt, Yersinia pestis
caaauacccuaauucagauguu

SEQ ID NO: 2264693 - RNA, 15 nt, Yersinia pestis
caaauaauucagacg

SEQ ID NO: 2264694 - RNA, 22 nt, Yersinia pestis
caaauacaaaccguuugccguu

SEQ ID NO: 2264695 - RNA, 18 nt, Yersinia pestis
caaauaaguacuuccaau

SEQ ID NO: 2264696 - RNA, 21 nt, Yersinia pestis
caaauaaucagcucauuaaac

SEQ ID NO: 2264697 - RNA, 18 nt, Yersinia pestis
caaauaaguauuucaaau

SEQ ID NO: 2264698 - RNA, 20 nt, Yersinia pestis
caaagugccugcggcggaga

SEQ ID NO: 2264699 - RNA, 19 nt, Yersinia pestis
caaaguggcauaaccaauc

SEQ ID NO: 2264700 - RNA, 15 nt, Yersinia pestis
caaaguuaaaugaag

SEQ ID NO: 2264701 - RNA, 17 nt, Yersinia pestis
caaagguuucacaugug

SEQ ID NO: 2264702 - RNA, 13 nt, Yersinia pestis
caaaguaaaauaa

SEQ ID NO: 2264703 - RNA, 15 nt, Yersinia pestis
caaaguaaaauaaaa

SEQ ID NO: 2264704 - RNA, 18 nt, Yersinia pestis
caaaguaaggugccgcuu

SEQ ID NO: 2264705 - RNA, 20 nt, Yersinia pestis
caaaguaaggugccgcuugu

SEQ ID NO: 2264706 - RNA, 13 nt, Yersinia pestis
caaauaaacaaaa

SEQ ID NO: 2264707 - RNA, 17 nt, Yersinia pestis
caaaguugaguauuucu

SEQ ID NO: 2264708 - RNA, 16 nt, Yersinia pestis
caacgcaauugcaccg

SEQ ID NO: 2264709 - RNA, 17 nt, Yersinia pestis
caacgcaccauccagca

SEQ ID NO: 2264710 - RNA, 18 nt, Yersinia pestis
caacgauauagagcucag

SEQ ID NO: 2264711 - RNA, 14 nt, Yersinia pestis
caacgacagcaaca

SEQ ID NO: 2264712 - RNA, 17 nt, Yersinia pestis
caaccugcgccacccau

SEQ ID NO: 2264713 - RNA, 17 nt, Yersinia pestis
caaccugacugcuggca

SEQ ID NO: 2264714 - RNA, 18 nt, Yersinia pestis
caaccgcagugauauaac

SEQ ID NO: 2264715 - RNA, 21 nt, Yersinia pestis
caaccuuggugaagaucaaug

SEQ ID NO: 2264716 - RNA, 17 nt, Yersinia pestis
caacgaauaaaaaagcc

SEQ ID NO: 2264717 - RNA, 12 nt, Yersinia pestis
caacgaaaucac

SEQ ID NO: 2264718 - RNA, 18 nt, Yersinia pestis
caaccugguuaucggcca

SEQ ID NO: 2264719 - RNA, 15 nt, Yersinia pestis
caacauaaucaaucc

SEQ ID NO: 2264720 - RNA, 13 nt, Yersinia pestis
caacaguaaaggu

SEQ ID NO: 2264721 - RNA, 13 nt, Yersinia pestis
caaccaacaaaca

SEQ ID NO: 2264722 - RNA, 18 nt, Yersinia pestis
caaccaacaaacaauccu

SEQ ID NO: 2264723 - RNA, 20 nt, Yersinia pestis
caaccaaacggcccucauua

SEQ ID NO: 2264724 - RNA, 16 nt, Yersinia pestis
caacauuuuuagcuuc

SEQ ID NO: 2264725 - RNA, 16 nt, Yersinia pestis
caacauaguugaauaa

SEQ ID NO: 2264726 - RNA, 19 nt, Yersinia pestis
caacauagguuuuuucacu

SEQ ID NO: 2264727 - RNA, 23 nt, Yersinia pestis
caaccacuaaaccacauaacgca

SEQ ID NO: 2264728 - RNA, 14 nt, Yersinia pestis
caacccgcugaugc

SEQ ID NO: 2264729 - RNA, 16 nt, Yersinia pestis
caacccgcacguucag

SEQ ID NO: 2264730 - RNA, 17 nt, Yersinia pestis
caacccccgaacacucg

SEQ ID NO: 2264731 - RNA, 20 nt, Yersinia pestis
caaauagauagcaaucaaua

SEQ ID NO: 2264732 - RNA, 21 nt, Yersinia pestis
caaauagaucggguaaaccaa

SEQ ID NO: 2264733 - RNA, 22 nt, Yersinia pestis
caaauagaucggguaaaccaau

SEQ ID NO: 2264734 - RNA, 19 nt, Yersinia pestis
caaauuauauaagagauga

SEQ ID NO: 2264735 - RNA, 16 nt, Yersinia pestis
caaauuaccaccaccu

SEQ ID NO: 2264736 - RNA, 22 nt, Yersinia pestis
caaauuaccaccaccuccacag

SEQ ID NO: 2264737 - RNA, 15 nt, Yersinia pestis
caaauuaaucuugua

SEQ ID NO: 2264738 - RNA, 13 nt, Yersinia pestis
caaauuacuuuaa

SEQ ID NO: 2264739 - RNA, 23 nt, Yersinia pestis
caaaugggucgggaaucauuuga

SEQ ID NO: 2264740 - RNA, 13 nt, Yersinia pestis
caaauuaauaggu

SEQ ID NO: 2264741 - RNA, 15 nt, Yersinia pestis
caaauuugacauuuc

SEQ ID NO: 2264742 - RNA, 17 nt, Yersinia pestis
caaauugcggcaaccaa

SEQ ID NO: 2264743 - RNA, 21 nt, Yersinia pestis
caaauuuuuuauauuccacau

SEQ ID NO: 2264744 - RNA, 17 nt, Yersinia pestis
caaauuugacauuuccu

SEQ ID NO: 2264745 - RNA, 22 nt, Yersinia pestis
caacaauauucgcagccaaaau

SEQ ID NO: 2264746 - RNA, 23 nt, Yersinia pestis
caacaacgccgcaccggauuuau

SEQ ID NO: 2264747 - RNA, 18 nt, Yersinia pestis
caacaacgggucacagcc

SEQ ID NO: 2264748 - RNA, 21 nt, Yersinia pestis
caacaacgggucacagccacg

SEQ ID NO: 2264749 - RNA, 15 nt, Yersinia pestis
caacaacggugaaca

SEQ ID NO: 2264750 - RNA, 22 nt, Yersinia pestis
caacaagaucccaagcaggaaa

SEQ ID NO: 2264751 - RNA, 15 nt, Yersinia pestis
caacaauuuccauau

SEQ ID NO: 2264752 - RNA, 13 nt, Yersinia pestis
caacacaccugca

SEQ ID NO: 2264753 - RNA, 13 nt, Yersinia pestis
caacacaaaaacc

SEQ ID NO: 2264754 - RNA, 23 nt, Yersinia pestis
caacaauuuacgguccauaaaau

SEQ ID NO: 2264755 - RNA, 22 nt, Yersinia pestis
caacagauaugcauuauugaug

SEQ ID NO: 2264756 - RNA, 14 nt, Yersinia pestis
caacagauaaagcu

SEQ ID NO: 2264757 - RNA, 21 nt, Yersinia pestis
caacagauaauuggcaauaau

SEQ ID NO: 2264758 - RNA, 22 nt, Yersinia pestis
caacagauaauuggcaauaaug

SEQ ID NO: 2264759 - RNA, 21 nt, Yersinia pestis
caacagaugaugauuuuuaca

SEQ ID NO: 2264760 - RNA, 22 nt, Yersinia pestis
caacagaugaugauuuuuacag

SEQ ID NO: 2264761 - RNA, 23 nt, Yersinia pestis
caacagaugaugauuuuuacagc

SEQ ID NO: 2264762 - RNA, 20 nt, Yersinia pestis
caacacuuuuaaggaacggg

SEQ ID NO: 2264763 - RNA, 20 nt, Yersinia pestis
caacacuucuggccgcucuu

SEQ ID NO: 2264764 - RNA, 13 nt, Yersinia pestis
caacacugccuga

SEQ ID NO: 2264765 - RNA, 15 nt, Yersinia pestis
caacaccguaacgcc

SEQ ID NO: 2264766 - RNA, 15 nt, Yersinia pestis
caacacauaaaauca

SEQ ID NO: 2264767 - RNA, 19 nt, Yersinia pestis
caacacggugaauaaaccc

SEQ ID NO: 2264768 - RNA, 12 nt, Yersinia pestis
caaugcccccag

SEQ ID NO: 2264769 - RNA, 21 nt, Yersinia pestis
caaugccaagaauaauuacug

SEQ ID NO: 2264770 - RNA, 13 nt, Yersinia pestis
caaugcaaauauc

SEQ ID NO: 2264771 - RNA, 21 nt, Yersinia pestis
caaugcaccgacaaagauacu

SEQ ID NO: 2264772 - RNA, 17 nt, Yersinia pestis
caaugcauuguaaaaua

SEQ ID NO: 2264773 - RNA, 16 nt, Yersinia pestis
caaugcgaaaaaauau

SEQ ID NO: 2264774 - RNA, 17 nt, Yersinia pestis
caaugccucuucaauac

SEQ ID NO: 2264775 - RNA, 22 nt, Yersinia pestis
caaugccgcgaaggugugcuca

SEQ ID NO: 2264776 - RNA, 16 nt, Yersinia pestis
caaugaucaaacggau

SEQ ID NO: 2264777 - RNA, 16 nt, Yersinia pestis
caaugauaaaauccug

SEQ ID NO: 2264778 - RNA, 16 nt, Yersinia pestis
caaugaugucaucuuc

SEQ ID NO: 2264779 - RNA, 18 nt, Yersinia pestis
caaugauggcggcuaaau

SEQ ID NO: 2264780 - RNA, 19 nt, Yersinia pestis
caaugaugacuugauuaac

SEQ ID NO: 2264781 - RNA, 13 nt, Yersinia pestis
caaugauuuuuuu

SEQ ID NO: 2264782 - RNA, 22 nt, Yersinia pestis
caaucuugguuaauagcauuug

SEQ ID NO: 2264783 - RNA, 14 nt, Yersinia pestis
caaugaaaauuagc

SEQ ID NO: 2264784 - RNA, 15 nt, Yersinia pestis
caaugacuucuucca

SEQ ID NO: 2264785 - RNA, 15 nt, Yersinia pestis
caauccgaacaaaau

SEQ ID NO: 2264786 - RNA, 19 nt, Yersinia pestis
caaucaugggccaauccaa

SEQ ID NO: 2264787 - RNA, 22 nt, Yersinia pestis
caaucauuuauauaguaacuau

SEQ ID NO: 2264788 - RNA, 12 nt, Yersinia pestis
caaucauucugu

SEQ ID NO: 2264789 - RNA, 18 nt, Yersinia pestis
caaucauuacaucaucuu

SEQ ID NO: 2264790 - RNA, 15 nt, Yersinia pestis
caaucaucaucccag

SEQ ID NO: 2264791 - RNA, 18 nt, Yersinia pestis
caauauuggauaauaacc

SEQ ID NO: 2264792 - RNA, 16 nt, Yersinia pestis
caauauucgccagauu

SEQ ID NO: 2264793 - RNA, 14 nt, Yersinia pestis
caauauucgcagcc

SEQ ID NO: 2264794 - RNA, 15 nt, Yersinia pestis
caauauucgcagcca

SEQ ID NO: 2264795 - RNA, 18 nt, Yersinia pestis
caauauucagcguugaca

SEQ ID NO: 2264796 - RNA, 13 nt, Yersinia pestis
caaucuccaauga

SEQ ID NO: 2264797 - RNA, 21 nt, Yersinia pestis
caaucuccccguuuaggauug

SEQ ID NO: 2264798 - RNA, 22 nt, Yersinia pestis
caaucucugggugcugcucccg

SEQ ID NO: 2264799 - RNA, 14 nt, Yersinia pestis
caauccgcugacau

SEQ ID NO: 2264800 - RNA, 22 nt, Yersinia pestis
caaucggaaaucggugauauuc

SEQ ID NO: 2264801 - RNA, 17 nt, Yersinia pestis
caaucggcagauuggau

SEQ ID NO: 2264802 - RNA, 13 nt, Yersinia pestis
caauacauagaag

SEQ ID NO: 2264803 - RNA, 14 nt, Yersinia pestis
caauaaucucagca

SEQ ID NO: 2264804 - RNA, 23 nt, Yersinia pestis
caauaacuuuggguauaugacug

SEQ ID NO: 2264805 - RNA, 13 nt, Yersinia pestis
caauaacuauuuu

SEQ ID NO: 2264806 - RNA, 20 nt, Yersinia pestis
caauaacggaaaaucaucgc

SEQ ID NO: 2264807 - RNA, 19 nt, Yersinia pestis
caauaacguccugaugaug

SEQ ID NO: 2264808 - RNA, 17 nt, Yersinia pestis
caauaaccucagccuca

SEQ ID NO: 2264809 - RNA, 21 nt, Yersinia pestis
caauaaccucagccucauuca

SEQ ID NO: 2264810 - RNA, 22 nt, Yersinia pestis
caauaaccucagccucauucau

SEQ ID NO: 2264811 - RNA, 22 nt, Yersinia pestis
caauaaccucagggcgucucua

SEQ ID NO: 2264812 - RNA, 21 nt, Yersinia pestis
caauaaccucaggggccaaca

SEQ ID NO: 2264813 - RNA, 20 nt, Yersinia pestis
caauaaccucaaaaggaugg

SEQ ID NO: 2264814 - RNA, 18 nt, Yersinia pestis
caauaaccgcagcaggca

SEQ ID NO: 2264815 - RNA, 22 nt, Yersinia pestis
caauaaauucauuagcucaaau

SEQ ID NO: 2264816 - RNA, 16 nt, Yersinia pestis
caauaaauauccuccg

SEQ ID NO: 2264817 - RNA, 13 nt, Yersinia pestis
caaguacacugca

SEQ ID NO: 2264818 - RNA, 15 nt, Yersinia pestis
caaguacaaggggca

SEQ ID NO: 2264819 - RNA, 20 nt, Yersinia pestis
caauauguuagcagcacaag

SEQ ID NO: 2264820 - RNA, 16 nt, Yersinia pestis
caauauguugcacuga

SEQ ID NO: 2264821 - RNA, 20 nt, Yersinia pestis
caauauaaggcuuuauauug

SEQ ID NO: 2264822 - RNA, 14 nt, Yersinia pestis
caauaucuuugucu

SEQ ID NO: 2264823 - RNA, 14 nt, Yersinia pestis
caauaugaaauuuc

SEQ ID NO: 2264824 - RNA, 18 nt, Yersinia pestis
caauaugaaauuucacug

SEQ ID NO: 2264825 - RNA, 20 nt, Yersinia pestis
caauaugaacuuguucaucu

SEQ ID NO: 2264826 - RNA, 22 nt, Yersinia pestis
caauaugaauacgaauuuuuuc

SEQ ID NO: 2264827 - RNA, 23 nt, Yersinia pestis
caauagcuagccccaaucaagca

SEQ ID NO: 2264828 - RNA, 17 nt, Yersinia pestis
caauaggucagugguuu

SEQ ID NO: 2264829 - RNA, 23 nt, Yersinia pestis
caauagguguugccggcggcgcu

SEQ ID NO: 2264830 - RNA, 21 nt, Yersinia pestis
caauaccgccacacaauacau

SEQ ID NO: 2264831 - RNA, 15 nt, Yersinia pestis
caauaccgccacaca

SEQ ID NO: 2264832 - RNA, 15 nt, Yersinia pestis
caauaccaaaaaucu

SEQ ID NO: 2264833 - RNA, 16 nt, Yersinia pestis
caauaccaauucuuca

SEQ ID NO: 2264834 - RNA, 16 nt, Yersinia pestis
caauaccauauaccca

SEQ ID NO: 2264835 - RNA, 14 nt, Yersinia pestis
caauaccauuuugc

SEQ ID NO: 2264836 - RNA, 15 nt, Yersinia pestis
caauaccgccaauau

SEQ ID NO: 2264837 - RNA, 16 nt, Yersinia pestis
caauagcccaaauaac

SEQ ID NO: 2264838 - RNA, 17 nt, Yersinia pestis
caauagccauggcuuua

SEQ ID NO: 2264839 - RNA, 15 nt, Yersinia pestis
caauagacaaaagug

SEQ ID NO: 2264840 - RNA, 14 nt, Yersinia pestis
caagagugagucau

SEQ ID NO: 2264841 - RNA, 22 nt, Yersinia pestis
caagagugagucaucgggguuu

SEQ ID NO: 2264842 - RNA, 23 nt, Yersinia pestis
caagagugagucaucgggguuug

SEQ ID NO: 2264843 - RNA, 23 nt, Yersinia pestis
caagauugaugacucgauaguga

SEQ ID NO: 2264844 - RNA, 17 nt, Yersinia pestis
caagauugccaccuuca

SEQ ID NO: 2264845 - RNA, 18 nt, Yersinia pestis
caagauugccaccuucac

SEQ ID NO: 2264846 - RNA, 23 nt, Yersinia pestis
caagauugggaucaacgcccgcg

SEQ ID NO: 2264847 - RNA, 18 nt, Yersinia pestis
caagauuuuguagcccac

SEQ ID NO: 2264848 - RNA, 15 nt, Yersinia pestis
caagcaagcggcagc

SEQ ID NO: 2264849 - RNA, 15 nt, Yersinia pestis
caagccagugcggga

SEQ ID NO: 2264850 - RNA, 15 nt, Yersinia pestis
caaggucgcaaccag

SEQ ID NO: 2264851 - RNA, 16 nt, Yersinia pestis
caaggucgccucuggg

SEQ ID NO: 2264852 - RNA, 16 nt, Yersinia pestis
caaggcggcagagcca

SEQ ID NO: 2264853 - RNA, 20 nt, Yersinia pestis
caaggcgacuuugaugccaa

SEQ ID NO: 2264854 - RNA, 19 nt, Yersinia pestis
caagcuuuugccacauuuc

SEQ ID NO: 2264855 - RNA, 16 nt, Yersinia pestis
caaggacuucaucacc

SEQ ID NO: 2264856 - RNA, 21 nt, Yersinia pestis
caaggagaucgcucucacccu

SEQ ID NO: 2264857 - RNA, 22 nt, Yersinia pestis
caacuugugacgccggagaaau

SEQ ID NO: 2264858 - RNA, 23 nt, Yersinia pestis
caacuuuaauaugcaaaaaaaga

SEQ ID NO: 2264859 - RNA, 18 nt, Yersinia pestis
caacuuuuauuggcauua

SEQ ID NO: 2264860 - RNA, 13 nt, Yersinia pestis
caacuuuuacugu

SEQ ID NO: 2264861 - RNA, 21 nt, Yersinia pestis
caacuuucccagucauaaaua

SEQ ID NO: 2264862 - RNA, 22 nt, Yersinia pestis
caacuuuuuuaccacauuuccu

SEQ ID NO: 2264863 - RNA, 18 nt, Yersinia pestis
caacuuuuuucauccuaa

SEQ ID NO: 2264864 - RNA, 23 nt, Yersinia pestis
caagaaacgccccgauaaaccaa

SEQ ID NO: 2264865 - RNA, 20 nt, Yersinia pestis
caagacucaguaaauauaau

SEQ ID NO: 2264866 - RNA, 15 nt, Yersinia pestis
caagaccugccaauu

SEQ ID NO: 2264867 - RNA, 21 nt, Yersinia pestis
caagacgauaucgacgccugu

SEQ ID NO: 2264868 - RNA, 19 nt, Yersinia pestis
caagaagacuaaacgcuac

SEQ ID NO: 2264869 - RNA, 20 nt, Yersinia pestis
caagaacauuuccacaauca

SEQ ID NO: 2264870 - RNA, 15 nt, Yersinia pestis
caagaaagaaaaaua

SEQ ID NO: 2264871 - RNA, 18 nt, Yersinia pestis
caagaaagaaaaauagac

SEQ ID NO: 2264872 - RNA, 23 nt, Yersinia pestis
caagaaacuucauuucagguaaa

SEQ ID NO: 2264873 - RNA, 18 nt, Yersinia pestis
caacuccuuaccacugcu

SEQ ID NO: 2264874 - RNA, 21 nt, Yersinia pestis
caacuccuuaccacugcucac

SEQ ID NO: 2264875 - RNA, 21 nt, Yersinia pestis
caacucccaaauauauucuau

SEQ ID NO: 2264876 - RNA, 20 nt, Yersinia pestis
caacuaaacagggcagaaaa

SEQ ID NO: 2264877 - RNA, 16 nt, Yersinia pestis
caacgccucaucuuca

SEQ ID NO: 2264878 - RNA, 16 nt, Yersinia pestis
caacuaaacagaucac

SEQ ID NO: 2264879 - RNA, 20 nt, Yersinia pestis
caacuggguggccaguaacg

SEQ ID NO: 2264880 - RNA, 14 nt, Yersinia pestis
caacuguaaaaucu

SEQ ID NO: 2264881 - RNA, 19 nt, Yersinia pestis
caacugguuaucacugucc

SEQ ID NO: 2264882 - RNA, 17 nt, Yersinia pestis
caacuucuacauagaaa

SEQ ID NO: 2264883 - RNA, 17 nt, Yersinia pestis
caacuguuuuauuggca

SEQ ID NO: 2264884 - RNA, 17 nt, Yersinia pestis
caacucgccacccgcuu

SEQ ID NO: 2264885 - RNA, 17 nt, Yersinia pestis
caacucggccgcuaagu

SEQ ID NO: 2264886 - RNA, 15 nt, Yersinia pestis
caacugacugaaguu

SEQ ID NO: 2264887 - RNA, 13 nt, Yersinia pestis
caacugacugaag

SEQ ID NO: 2264888 - RNA, 17 nt, Yersinia pestis
caacugccaauauguua

SEQ ID NO: 2264889 - RNA, 20 nt, Yersinia pestis
cagcacugguagcaucaucg

SEQ ID NO: 2264890 - RNA, 15 nt, Yersinia pestis
cagcagaacaaaaca

SEQ ID NO: 2264891 - RNA, 13 nt, Yersinia pestis
cagcagaaacccg

SEQ ID NO: 2264892 - RNA, 14 nt, Yersinia pestis
cagcagaaacccgu

SEQ ID NO: 2264893 - RNA, 21 nt, Yersinia pestis
cagcacauaaagcgcauuauu

SEQ ID NO: 2264894 - RNA, 14 nt, Yersinia pestis
cagcacacgacagc

SEQ ID NO: 2264895 - RNA, 23 nt, Yersinia pestis
cagcaauuuuuagcgcuaaauca

SEQ ID NO: 2264896 - RNA, 22 nt, Yersinia pestis
cagcaauugaguaguaaaaccu

SEQ ID NO: 2264897 - RNA, 13 nt, Yersinia pestis
cagcacaaugacu

SEQ ID NO: 2264898 - RNA, 14 nt, Yersinia pestis
cagcacaagcgccu

SEQ ID NO: 2264899 - RNA, 18 nt, Yersinia pestis
cagcaaggcggcaagcaa

SEQ ID NO: 2264900 - RNA, 21 nt, Yersinia pestis
cagcaaggcggcaagcaagca

SEQ ID NO: 2264901 - RNA, 20 nt, Yersinia pestis
cagcaaggcgggcaaauuca

SEQ ID NO: 2264902 - RNA, 23 nt, Yersinia pestis
cagcaagauugggaucaacgccc

SEQ ID NO: 2264903 - RNA, 12 nt, Yersinia pestis
cagcaagagcag

SEQ ID NO: 2264904 - RNA, 12 nt, Yersinia pestis
aaaaugcucuuc

SEQ ID NO: 2264905 - RNA, 14 nt, Yersinia pestis
cagcaacgaauaaa

SEQ ID NO: 2264906 - RNA, 19 nt, Yersinia pestis
cagcaaccacgguaucaau

SEQ ID NO: 2264907 - RNA, 15 nt, Yersinia pestis
cagauaacucagggc

SEQ ID NO: 2264908 - RNA, 19 nt, Yersinia pestis
cagaucgcgaugcgccugu

SEQ ID NO: 2264909 - RNA, 21 nt, Yersinia pestis
cagaucgcgaugcgccuguua

SEQ ID NO: 2264910 - RNA, 19 nt, Yersinia pestis
cagaucguaaagacgccgu

SEQ ID NO: 2264911 - RNA, 21 nt, Yersinia pestis
cagaugaauauguuccaucag

SEQ ID NO: 2264912 - RNA, 15 nt, Yersinia pestis
cagaugaauauguuc

SEQ ID NO: 2264913 - RNA, 16 nt, Yersinia pestis
cagaugaaaaacugug

SEQ ID NO: 2264914 - RNA, 21 nt, Yersinia pestis
cagaugaaaaacugugcaaau

SEQ ID NO: 2264915 - RNA, 14 nt, Yersinia pestis
cagaucuauuugcu

SEQ ID NO: 2264916 - RNA, 20 nt, Yersinia pestis
cagaucugcccccccuuuca

SEQ ID NO: 2264917 - RNA, 19 nt, Yersinia pestis
cagaucuggguuagaaaua

SEQ ID NO: 2264918 - RNA, 23 nt, Yersinia pestis
cagaucuggguuagaaauauaac

SEQ ID NO: 2264919 - RNA, 14 nt, Yersinia pestis
cagaugacgggcga

SEQ ID NO: 2264920 - RNA, 21 nt, Yersinia pestis
cagaugacgggcgacccgcug

SEQ ID NO: 2264921 - RNA, 23 nt, Yersinia pestis
cagaugaucugaugaucaucugg

SEQ ID NO: 2264922 - RNA, 19 nt, Yersinia pestis
cagaugccgcuuuaguuuc

SEQ ID NO: 2264923 - RNA, 15 nt, Yersinia pestis
aaaaucuuucuguuc

SEQ ID NO: 2264924 - RNA, 20 nt, Yersinia pestis
aaaaucuuguuaauuuaaac

SEQ ID NO: 2264925 - RNA, 19 nt, Yersinia pestis
aaaaugaaauuuuauuacu

SEQ ID NO: 2264926 - RNA, 18 nt, Yersinia pestis
cagauuguuuauaaauua

SEQ ID NO: 2264927 - RNA, 18 nt, Yersinia pestis
cagauuugcccaaucuaa

SEQ ID NO: 2264928 - RNA, 13 nt, Yersinia pestis
cagauguuuaaau

SEQ ID NO: 2264929 - RNA, 22 nt, Yersinia pestis
cagauguuuaaauugcgcccgg

SEQ ID NO: 2264930 - RNA, 19 nt, Yersinia pestis
cagauguauuagcgcugcu

SEQ ID NO: 2264931 - RNA, 16 nt, Yersinia pestis
cagauguaaccaccca

SEQ ID NO: 2264932 - RNA, 18 nt, Yersinia pestis
cagaugucccagaaauau

SEQ ID NO: 2264933 - RNA, 20 nt, Yersinia pestis
cagaugucccagaaauauug

SEQ ID NO: 2264934 - RNA, 17 nt, Yersinia pestis
cagauggccccaauugu

SEQ ID NO: 2264935 - RNA, 20 nt, Yersinia pestis
cagauggccagauucaccag

SEQ ID NO: 2264936 - RNA, 21 nt, Yersinia pestis
cagacuuggguaaccaaucac

SEQ ID NO: 2264937 - RNA, 17 nt, Yersinia pestis
cagacuuggguaaccaa

SEQ ID NO: 2264938 - RNA, 16 nt, Yersinia pestis
cagacuucuuccaucu

SEQ ID NO: 2264939 - RNA, 21 nt, Yersinia pestis
cagacuaaaaaccgccacagc

SEQ ID NO: 2264940 - RNA, 13 nt, Yersinia pestis
aaaauauuuugcu

SEQ ID NO: 2264941 - RNA, 18 nt, Yersinia pestis
cagagaccacagauaaau

SEQ ID NO: 2264942 - RNA, 15 nt, Yersinia pestis
cagacuaaaaaccau

SEQ ID NO: 2264943 - RNA, 15 nt, Yersinia pestis
cagacguuuaaauaa

SEQ ID NO: 2264944 - RNA, 16 nt, Yersinia pestis
cagacguuuaaauaag

SEQ ID NO: 2264945 - RNA, 19 nt, Yersinia pestis
cagacguuggcucaucaaa

SEQ ID NO: 2264946 - RNA, 23 nt, Yersinia pestis
cagacgcgguuaacgacgcauua

SEQ ID NO: 2264947 - RNA, 14 nt, Yersinia pestis
cagaggaaucaaag

SEQ ID NO: 2264948 - RNA, 18 nt, Yersinia pestis
cagaggaaagagagccau

SEQ ID NO: 2264949 - RNA, 22 nt, Yersinia pestis
cagagccagaauaucguggaga

SEQ ID NO: 2264950 - RNA, 21 nt, Yersinia pestis
cagagccaauccccagaagcg

SEQ ID NO: 2264951 - RNA, 14 nt, Yersinia pestis
cagaguucggucau

SEQ ID NO: 2264952 - RNA, 16 nt, Yersinia pestis
cagaguucggucauaa

SEQ ID NO: 2264953 - RNA, 18 nt, Yersinia pestis
cagagucgcaaaaaauau

SEQ ID NO: 2264954 - RNA, 23 nt, Yersinia pestis
cagagucaguacggaaucauaaa

SEQ ID NO: 2264955 - RNA, 13 nt, Yersinia pestis
cagaggaguaaag

SEQ ID NO: 2264956 - RNA, 12 nt, Yersinia pestis
aaaaucauugac

SEQ ID NO: 2264957 - RNA, 18 nt, Yersinia pestis
cagagcacgcagagauga

SEQ ID NO: 2264958 - RNA, 14 nt, Yersinia pestis
cagagcagaaagca

SEQ ID NO: 2264959 - RNA, 21 nt, Yersinia pestis
cagagcacaacggaaggccca

SEQ ID NO: 2264960 - RNA, 20 nt, Yersinia pestis
cagagauaauagauaacaaa

SEQ ID NO: 2264961 - RNA, 24 nt, Yersinia pestis
cagagacagcaacaaacagccgau

SEQ ID NO: 2264962 - RNA, 14 nt, Yersinia pestis
cagacacaaugcug

SEQ ID NO: 2264963 - RNA, 21 nt, Yersinia pestis
cagacacagcaacaaccccau

SEQ ID NO: 2264964 - RNA, 15 nt, Yersinia pestis
cagacacaagauaaa

SEQ ID NO: 2264965 - RNA, 20 nt, Yersinia pestis
cagaauuucauuguggagga

SEQ ID NO: 2264966 - RNA, 15 nt, Yersinia pestis
cagaauuucauuuuc

SEQ ID NO: 2264967 - RNA, 15 nt, Yersinia pestis
cagacauaucugaac

SEQ ID NO: 2264968 - RNA, 21 nt, Yersinia pestis
cagacauauuggucauuuuuc

SEQ ID NO: 2264969 - RNA, 16 nt, Yersinia pestis
cagacacugacaucau

SEQ ID NO: 2264970 - RNA, 16 nt, Yersinia pestis
cagaagcguaaagcac

SEQ ID NO: 2264971 - RNA, 18 nt, Yersinia pestis
cagaagcguaaagcaccc

SEQ ID NO: 2264972 - RNA, 24 nt, Yersinia pestis
cagaacaccaacaccacacugagc

SEQ ID NO: 2264973 - RNA, 21 nt, Yersinia pestis
cagaacagagugugaaaucac

SEQ ID NO: 2264974 - RNA, 17 nt, Yersinia pestis
cagaaauaauaucaagu

SEQ ID NO: 2264975 - RNA, 22 nt, Yersinia pestis
cagaaauaaauauccuccggca

SEQ ID NO: 2264976 - RNA, 16 nt, Yersinia pestis
cagaaacgauuaccca

SEQ ID NO: 2264977 - RNA, 16 nt, Yersinia pestis
cagaaauagcaccauu

SEQ ID NO: 2264978 - RNA, 21 nt, Yersinia pestis
cagaaauagcaccauuaggcu

SEQ ID NO: 2264979 - RNA, 18 nt, Yersinia pestis
cagaaaaacaaugcuuuu

SEQ ID NO: 2264980 - RNA, 22 nt, Yersinia pestis
cacuuucagaauugugccccuu

SEQ ID NO: 2264981 - RNA, 15 nt, Yersinia pestis
cacgucuacuggcug

SEQ ID NO: 2264982 - RNA, 21 nt, Yersinia pestis
cacgucuacgcucuccucucc

SEQ ID NO: 2264983 - RNA, 20 nt, Yersinia pestis
cagcaguuacaguagugaag

SEQ ID NO: 2264984 - RNA, 12 nt, Yersinia pestis
cagcagucugau

SEQ ID NO: 2264985 - RNA, 15 nt, Yersinia pestis
cagcagucugacaga

SEQ ID NO: 2264986 - RNA, 22 nt, Yersinia pestis
cagcagucugaaacgccagccu

SEQ ID NO: 2264987 - RNA, 23 nt, Yersinia pestis
cagcagucugacaccggggaucc

SEQ ID NO: 2264988 - RNA, 20 nt, Yersinia pestis
cagcauaaauauucauuaaa

SEQ ID NO: 2264989 - RNA, 13 nt, Yersinia pestis
cagcauaaggcgu

SEQ ID NO: 2264990 - RNA, 20 nt, Yersinia pestis
cagcauaguaagcuggcccu

SEQ ID NO: 2264991 - RNA, 20 nt, Yersinia pestis
cagcaggugguuaaacugac

SEQ ID NO: 2264992 - RNA, 22 nt, Yersinia pestis
cagcagggccaaauugaacucg

SEQ ID NO: 2264993 - RNA, 17 nt, Yersinia pestis
cagcagaguaaagcagg

SEQ ID NO: 2264994 - RNA, 16 nt, Yersinia pestis
cagcaggcgugcugcu

SEQ ID NO: 2264995 - RNA, 13 nt, Yersinia pestis
cagcagcuuuugu

SEQ ID NO: 2264996 - RNA, 22 nt, Yersinia pestis
cagcauuuuuagggauaccuga

SEQ ID NO: 2264997 - RNA, 22 nt, Yersinia pestis
cagcauuucaggaucgaucugg

SEQ ID NO: 2264998 - RNA, 16 nt, Yersinia pestis
cagcauucugcuucca

SEQ ID NO: 2264999 - RNA, 21 nt, Yersinia pestis
cagcauucaggcuuuuuucua

SEQ ID NO: 2265000 - RNA, 17 nt, Yersinia pestis
cagccaccgcacacuga

SEQ ID NO: 2265001 - RNA, 13 nt, Yersinia pestis
cagccacaugauu

SEQ ID NO: 2265002 - RNA, 15 nt, Yersinia pestis
cagccaccaugggua

SEQ ID NO: 2265003 - RNA, 18 nt, Yersinia pestis
cagccagccuuaacugca

SEQ ID NO: 2265004 - RNA, 20 nt, Yersinia pestis
cagcauuaccaaggaaacca

SEQ ID NO: 2265005 - RNA, 15 nt, Yersinia pestis
cagcauguguuggcu

SEQ ID NO: 2265006 - RNA, 21 nt, Yersinia pestis
cagcauuaacccauauuacuc

SEQ ID NO: 2265007 - RNA, 13 nt, Yersinia pestis
cagcaugguagcc

SEQ ID NO: 2265008 - RNA, 16 nt, Yersinia pestis
cagcauccugcaaauu

SEQ ID NO: 2265009 - RNA, 23 nt, Yersinia pestis
cagcaucgcugaggucagugcug

SEQ ID NO: 2265010 - RNA, 14 nt, Yersinia pestis
cagcaucccagcca

SEQ ID NO: 2265011 - RNA, 14 nt, Yersinia pestis
cagcaucaccgccg

SEQ ID NO: 2265012 - RNA, 20 nt, Yersinia pestis
cagcauauuacccaguacug

SEQ ID NO: 2265013 - RNA, 22 nt, Yersinia pestis
cagcauauugagcauacuguug

SEQ ID NO: 2265014 - RNA, 14 nt, Yersinia pestis
cagcauauuguaaa

SEQ ID NO: 2265015 - RNA, 20 nt, Yersinia pestis
cagcauauuguaaacuucca

SEQ ID NO: 2265016 - RNA, 17 nt, Yersinia pestis
cagccucuaacauacuc

SEQ ID NO: 2265017 - RNA, 19 nt, Yersinia pestis
cagccucauucaugaggcu

SEQ ID NO: 2265018 - RNA, 20 nt, Yersinia pestis
cagccugguuuuuuaaaaaa

SEQ ID NO: 2265019 - RNA, 18 nt, Yersinia pestis
cagccuggagcgguuaau

SEQ ID NO: 2265020 - RNA, 14 nt, Yersinia pestis
cagcgaauaaauaa

SEQ ID NO: 2265021 - RNA, 14 nt, Yersinia pestis
cagccgagaaauag

SEQ ID NO: 2265022 - RNA, 17 nt, Yersinia pestis
cagccauugagcgaaga

SEQ ID NO: 2265023 - RNA, 14 nt, Yersinia pestis
cagcccugccuggc

SEQ ID NO: 2265024 - RNA, 23 nt, Yersinia pestis
cagcccuacuggcccgcccauaa

SEQ ID NO: 2265025 - RNA, 22 nt, Yersinia pestis
cagcgccaugauaaccacaacg

SEQ ID NO: 2265026 - RNA, 14 nt, Yersinia pestis
cagcgcccaagugc

SEQ ID NO: 2265027 - RNA, 13 nt, Yersinia pestis
cagcgcccccuuu

SEQ ID NO: 2265028 - RNA, 16 nt, Yersinia pestis
cagcgcaauaacguuu

SEQ ID NO: 2265029 - RNA, 23 nt, Yersinia pestis
cagcgcacugaauaacgcggcac

SEQ ID NO: 2265030 - RNA, 12 nt, Yersinia pestis
cagcgccacagu

SEQ ID NO: 2265031 - RNA, 20 nt, Yersinia pestis
cagcgccuccagucccccuc

SEQ ID NO: 2265032 - RNA, 14 nt, Yersinia pestis
cagcgcccuacugc

SEQ ID NO: 2265033 - RNA, 15 nt, Yersinia pestis
cagcgcgcagccaac

SEQ ID NO: 2265034 - RNA, 13 nt, Yersinia pestis
cagcgcgcagcca

SEQ ID NO: 2265035 - RNA, 19 nt, Yersinia pestis
cagcuguguuagcggcgcu

SEQ ID NO: 2265036 - RNA, 16 nt, Yersinia pestis
cagcucuucaauuucc

SEQ ID NO: 2265037 - RNA, 24 nt, Yersinia pestis
cagcuuauccgggugauguucccc

SEQ ID NO: 2265038 - RNA, 15 nt, Yersinia pestis
cagcuuccagcaccc

SEQ ID NO: 2265039 - RNA, 20 nt, Yersinia pestis
cagcuugauagggcugaaga

SEQ ID NO: 2265040 - RNA, 19 nt, Yersinia pestis
cagcuugcaacucggccgc

SEQ ID NO: 2265041 - RNA, 18 nt, Yersinia pestis
caggagcaaccauuuuau

SEQ ID NO: 2265042 - RNA, 16 nt, Yersinia pestis
caggauagagagaaug

SEQ ID NO: 2265043 - RNA, 19 nt, Yersinia pestis
aaaauuucucuuuuauucu

SEQ ID NO: 2265044 - RNA, 11 nt, Yersinia pestis
aaaauuuuaag

SEQ ID NO: 2265045 - RNA, 20 nt, Yersinia pestis
cagcuacugcacgcauucuu

SEQ ID NO: 2265046 - RNA, 13 nt, Yersinia pestis
cagcucaccguca

SEQ ID NO: 2265047 - RNA, 21 nt, Yersinia pestis
cagcucacucgguaaugagcc

SEQ ID NO: 2265048 - RNA, 17 nt, Yersinia pestis
cagcuaaucauugcaau

SEQ ID NO: 2265049 - RNA, 15 nt, Yersinia pestis
cagcuaauguuggca

SEQ ID NO: 2265050 - RNA, 15 nt, Yersinia pestis
cagcgcuuccacugc

SEQ ID NO: 2265051 - RNA, 12 nt, Yersinia pestis
cagcgcuggcuu

SEQ ID NO: 2265052 - RNA, 14 nt, Yersinia pestis
cagcucuacaguga

SEQ ID NO: 2265053 - RNA, 20 nt, Yersinia pestis
cagcucucugagccauccag

SEQ ID NO: 2265054 - RNA, 14 nt, Yersinia pestis
cagcucaucaccaa

SEQ ID NO: 2265055 - RNA, 21 nt, Yersinia pestis
caggcaucaucugcgguaacc

SEQ ID NO: 2265056 - RNA, 16 nt, Yersinia pestis
caggccaccuaacacu

SEQ ID NO: 2265057 - RNA, 13 nt, Yersinia pestis
caggcaucaucug

SEQ ID NO: 2265058 - RNA, 23 nt, Yersinia pestis
caggaugaugaauaccaccauca

SEQ ID NO: 2265059 - RNA, 23 nt, Yersinia pestis
caggaucaccagcaaaggccacc

SEQ ID NO: 2265060 - RNA, 15 nt, Yersinia pestis
caggaucugcuccuc

SEQ ID NO: 2265061 - RNA, 22 nt, Yersinia pestis
caggccauuggcaaaggccagc

SEQ ID NO: 2265062 - RNA, 15 nt, Yersinia pestis
caggccauuggcaaa

SEQ ID NO: 2265063 - RNA, 21 nt, Yersinia pestis
caggccauuggcaaaggccag

SEQ ID NO: 2265064 - RNA, 20 nt, Yersinia pestis
caggccacgcaauucaucac

SEQ ID NO: 2265065 - RNA, 18 nt, Yersinia pestis
caggccccaauccaccac

SEQ ID NO: 2265066 - RNA, 16 nt, Yersinia pestis
caggcccuuucaccgc

SEQ ID NO: 2265067 - RNA, 20 nt, Yersinia pestis
caggccgguauucagccaaa

SEQ ID NO: 2265068 - RNA, 13 nt, Yersinia pestis
caggccuucuuuu

SEQ ID NO: 2265069 - RNA, 14 nt, Yersinia pestis
caggccuuuacugu

SEQ ID NO: 2265070 - RNA, 16 nt, Yersinia pestis
caggcgaugcaaggaa

SEQ ID NO: 2265071 - RNA, 19 nt, Yersinia pestis
cagggccgauaaaaaaccc

SEQ ID NO: 2265072 - RNA, 21 nt, Yersinia pestis
cagggcgcuuucugggugacg

SEQ ID NO: 2265073 - RNA, 22 nt, Yersinia pestis
cagggcgguaacgcagauaaau

SEQ ID NO: 2265074 - RNA, 16 nt, Yersinia pestis
cagggcguauaaacag

SEQ ID NO: 2265075 - RNA, 13 nt, Yersinia pestis
cagggcagccaau

SEQ ID NO: 2265076 - RNA, 21 nt, Yersinia pestis
cagggcaaucaggaaaggccg

SEQ ID NO: 2265077 - RNA, 21 nt, Yersinia pestis
cagggcaucgaaaagcgccuu

SEQ ID NO: 2265078 - RNA, 13 nt, Yersinia pestis
cagggccacuucg

SEQ ID NO: 2265079 - RNA, 17 nt, Yersinia pestis
caggcugccugccugag

SEQ ID NO: 2265080 - RNA, 17 nt, Yersinia pestis
caggcuucgacaggcaa

SEQ ID NO: 2265081 - RNA, 15 nt, Yersinia pestis
caggcucccaagggu

SEQ ID NO: 2265082 - RNA, 13 nt, Yersinia pestis
cagucaaugacga

SEQ ID NO: 2265083 - RNA, 20 nt, Yersinia pestis
cagucacuuugggcugauca

SEQ ID NO: 2265084 - RNA, 22 nt, Yersinia pestis
cagucacuaccgcucagauaaa

SEQ ID NO: 2265085 - RNA, 12 nt, Yersinia pestis
cagucacuggcc

SEQ ID NO: 2265086 - RNA, 17 nt, Yersinia pestis
cagucacgcuaccagaa

SEQ ID NO: 2265087 - RNA, 18 nt, Yersinia pestis
cagucaccgcuguaaaug

SEQ ID NO: 2265088 - RNA, 17 nt, Yersinia pestis
caguaugcgaaacaccu

SEQ ID NO: 2265089 - RNA, 16 nt, Yersinia pestis
caguaucaauaccgaa

SEQ ID NO: 2265090 - RNA, 23 nt, Yersinia pestis
caguauuugcagcggaugauaaa

SEQ ID NO: 2265091 - RNA, 21 nt, Yersinia pestis
caguauugcagagcaaaacug

SEQ ID NO: 2265092 - RNA, 13 nt, Yersinia pestis
caguauucugcuu

SEQ ID NO: 2265093 - RNA, 16 nt, Yersinia pestis
caguauuagcuuuacu

SEQ ID NO: 2265094 - RNA, 14 nt, Yersinia pestis
caguccagccaccc

SEQ ID NO: 2265095 - RNA, 19 nt, Yersinia pestis
cagucauucaccugcccgu

SEQ ID NO: 2265096 - RNA, 22 nt, Yersinia pestis
cagucauucaccugcccgucac

SEQ ID NO: 2265097 - RNA, 18 nt, Yersinia pestis
cagucagccuuaauguuu

SEQ ID NO: 2265098 - RNA, 14 nt, Yersinia pestis
caguagugaagaua

SEQ ID NO: 2265099 - RNA, 17 nt, Yersinia pestis
caguaucgaagacaaac

SEQ ID NO: 2265100 - RNA, 20 nt, Yersinia pestis
caguaucgaagacaaacacg

SEQ ID NO: 2265101 - RNA, 20 nt, Yersinia pestis
caguaggcugaaggccugcu

SEQ ID NO: 2265102 - RNA, 23 nt, Yersinia pestis
caguagccacuuugggucugaau

SEQ ID NO: 2265103 - RNA, 17 nt, Yersinia pestis
caguagcagggccgccc

SEQ ID NO: 2265104 - RNA, 21 nt, Yersinia pestis
caguagacgacacaaaugcug

SEQ ID NO: 2265105 - RNA, 13 nt, Yersinia pestis
cagucccugugcg

SEQ ID NO: 2265106 - RNA, 17 nt, Yersinia pestis
cagucuagugcgcugug

SEQ ID NO: 2265107 - RNA, 17 nt, Yersinia pestis
cagucugaaaucuccuc

SEQ ID NO: 2265108 - RNA, 15 nt, Yersinia pestis
cagucugaagccuac

SEQ ID NO: 2265109 - RNA, 19 nt, Yersinia pestis
cagucugaaggguauugaa

SEQ ID NO: 2265110 - RNA, 23 nt, Yersinia pestis
cagucugaaggguauugaagaua

SEQ ID NO: 2265111 - RNA, 17 nt, Yersinia pestis
cagucugaauugauguc

SEQ ID NO: 2265112 - RNA, 22 nt, Yersinia pestis
cagucugagccucaugaaugag

SEQ ID NO: 2265113 - RNA, 13 nt, Yersinia pestis
cagucgcgaugcg

SEQ ID NO: 2265114 - RNA, 21 nt, Yersinia pestis
cagucgcuucauccgcgcuga

SEQ ID NO: 2265115 - RNA, 14 nt, Yersinia pestis
cagucgcugcuguu

SEQ ID NO: 2265116 - RNA, 22 nt, Yersinia pestis
cagugaaaagguuaacugcagu

SEQ ID NO: 2265117 - RNA, 19 nt, Yersinia pestis
cagucugucguacuuuccu

SEQ ID NO: 2265118 - RNA, 17 nt, Yersinia pestis
cagucugagggccacuu

SEQ ID NO: 2265119 - RNA, 21 nt, Yersinia pestis
cagucugaggcccgcuaguga

SEQ ID NO: 2265120 - RNA, 12 nt, Yersinia pestis
cagugaaggggg

SEQ ID NO: 2265121 - RNA, 21 nt, Yersinia pestis
cagugaauaacugguccaacu

SEQ ID NO: 2265122 - RNA, 13 nt, Yersinia pestis
cagugacgcagug

SEQ ID NO: 2265123 - RNA, 15 nt, Yersinia pestis
cagugacgcagugac

SEQ ID NO: 2265124 - RNA, 20 nt, Yersinia pestis
cagugacgcagugacgcagu

SEQ ID NO: 2265125 - RNA, 15 nt, Yersinia pestis
cagugacgcagugau

SEQ ID NO: 2265126 - RNA, 17 nt, Yersinia pestis
cagugauauaacccagu

SEQ ID NO: 2265127 - RNA, 16 nt, Yersinia pestis
cagugauauuauuuau

SEQ ID NO: 2265128 - RNA, 18 nt, Yersinia pestis
cagugauauuauuuauuu

SEQ ID NO: 2265129 - RNA, 18 nt, Yersinia pestis
cagugaugcugcacauca

SEQ ID NO: 2265130 - RNA, 14 nt, Yersinia pestis
cagugcaaauuuau

SEQ ID NO: 2265131 - RNA, 16 nt, Yersinia pestis
cagugcaacauuaaaa

SEQ ID NO: 2265132 - RNA, 18 nt, Yersinia pestis
cagugcaaaaugcucuuc

SEQ ID NO: 2265133 - RNA, 23 nt, Yersinia pestis
cagugcaaaaugcucuucaccaa

SEQ ID NO: 2265134 - RNA, 14 nt, Yersinia pestis
cagugcacagucac

SEQ ID NO: 2265135 - RNA, 16 nt, Yersinia pestis
cagugcacggcaguga

SEQ ID NO: 2265136 - RNA, 14 nt, Yersinia pestis
cagugcagccaaga

SEQ ID NO: 2265137 - RNA, 22 nt, Yersinia pestis
aaacaacgcugaaaaaucuuug

SEQ ID NO: 2265138 - RNA, 22 nt, Yersinia pestis
aaacaacgccgcucaauuaacc

SEQ ID NO: 2265139 - RNA, 20 nt, Yersinia pestis
cagguuuuuuccccauggcg

SEQ ID NO: 2265140 - RNA, 14 nt, Yersinia pestis
caguaaaaaaauag

SEQ ID NO: 2265141 - RNA, 11 nt, Yersinia pestis
caguaaaaacu

SEQ ID NO: 2265142 - RNA, 15 nt, Yersinia pestis
aaacaaaucuuaaau

SEQ ID NO: 2265143 - RNA, 22 nt, Yersinia pestis
aaacaaaucuuaaauugaagag

SEQ ID NO: 2265144 - RNA, 13 nt, Yersinia pestis
aaacaaccuaaaa

SEQ ID NO: 2265145 - RNA, 19 nt, Yersinia pestis
aaacaacccgaauuaauaa

SEQ ID NO: 2265146 - RNA, 15 nt, Yersinia pestis
aaacaaccuaaaaaa

SEQ ID NO: 2265147 - RNA, 20 nt, Yersinia pestis
aaacaaccuaaaaaaaacaa

SEQ ID NO: 2265148 - RNA, 20 nt, Yersinia pestis
cagguuguccgaagagaaag

SEQ ID NO: 2265149 - RNA, 11 nt, Yersinia pestis
caguaagcucu

SEQ ID NO: 2265150 - RNA, 12 nt, Yersinia pestis
caguaagcucua

SEQ ID NO: 2265151 - RNA, 18 nt, Yersinia pestis
caguaacggcuuauuugc

SEQ ID NO: 2265152 - RNA, 17 nt, Yersinia pestis
caguaacgggucucaau

SEQ ID NO: 2265153 - RNA, 18 nt, Yersinia pestis
caguaacgggucucaaug

SEQ ID NO: 2265154 - RNA, 17 nt, Yersinia pestis
caguaacguccaacuga

SEQ ID NO: 2265155 - RNA, 21 nt, Yersinia pestis
caguaacgccugauucaucgc

SEQ ID NO: 2265156 - RNA, 21 nt, Yersinia pestis
caguaaccccuucgagcaccg

SEQ ID NO: 2265157 - RNA, 22 nt, Yersinia pestis
caguaaagauuauguagauccc

SEQ ID NO: 2265158 - RNA, 18 nt, Yersinia pestis
caguaaacgcuaaaccau

SEQ ID NO: 2265159 - RNA, 18 nt, Yersinia pestis
caguaaacgguugcugua

SEQ ID NO: 2265160 - RNA, 15 nt, Yersinia pestis
caguaaacagccagc

SEQ ID NO: 2265161 - RNA, 19 nt, Yersinia pestis
caguaaacagccagcauca

SEQ ID NO: 2265162 - RNA, 16 nt, Yersinia pestis
caguaaacauuuugac

SEQ ID NO: 2265163 - RNA, 18 nt, Yersinia pestis
caguaaacauuuugacuu

SEQ ID NO: 2265164 - RNA, 15 nt, Yersinia pestis
caguaaaccaauuuu

SEQ ID NO: 2265165 - RNA, 12 nt, Yersinia pestis
caguaaaaacug

SEQ ID NO: 2265166 - RNA, 14 nt, Yersinia pestis
caguacagaauuuc

SEQ ID NO: 2265167 - RNA, 23 nt, Yersinia pestis
caguacagcgcaucggaucaauu

SEQ ID NO: 2265168 - RNA, 15 nt, Yersinia pestis
caguacauaaaccgu

SEQ ID NO: 2265169 - RNA, 13 nt, Yersinia pestis
caguacaaaaaac

SEQ ID NO: 2265170 - RNA, 14 nt, Yersinia pestis
caguaauauuuuca

SEQ ID NO: 2265171 - RNA, 18 nt, Yersinia pestis
caguaaucaaacauaaaa

SEQ ID NO: 2265172 - RNA, 20 nt, Yersinia pestis
cagggguaagauccaccaca

SEQ ID NO: 2265173 - RNA, 20 nt, Yersinia pestis
cagggggaugccuuguuucu

SEQ ID NO: 2265174 - RNA, 23 nt, Yersinia pestis
caggggcguuauucucaauugac

SEQ ID NO: 2265175 - RNA, 16 nt, Yersinia pestis
caggggcgaugucacc

SEQ ID NO: 2265176 - RNA, 13 nt, Yersinia pestis
caggucaaucaau

SEQ ID NO: 2265177 - RNA, 20 nt, Yersinia pestis
caggucaaucaauucuucaa

SEQ ID NO: 2265178 - RNA, 14 nt, Yersinia pestis
cagguauucuccag

SEQ ID NO: 2265179 - RNA, 19 nt, Yersinia pestis
cagguauucuccaguuggc

SEQ ID NO: 2265180 - RNA, 13 nt, Yersinia pestis
cagguauuucucc

SEQ ID NO: 2265181 - RNA, 22 nt, Yersinia pestis
caggucaggaagagaaaagcag

SEQ ID NO: 2265182 - RNA, 15 nt, Yersinia pestis
caggucgauuacaua

SEQ ID NO: 2265183 - RNA, 18 nt, Yersinia pestis
caggugcuuauuuauuuu

SEQ ID NO: 2265184 - RNA, 20 nt, Yersinia pestis
caggucucgcacucaucuuu

SEQ ID NO: 2265185 - RNA, 12 nt, Yersinia pestis
caggucugcaug

SEQ ID NO: 2265186 - RNA, 14 nt, Yersinia pestis
caggucugcauggu

SEQ ID NO: 2265187 - RNA, 20 nt, Yersinia pestis
caggugaacguuggcuucac

SEQ ID NO: 2265188 - RNA, 22 nt, Yersinia pestis
caggugaacguuggcuucaccu

SEQ ID NO: 2265189 - RNA, 13 nt, Yersinia pestis
cagguucauuaca

SEQ ID NO: 2265190 - RNA, 20 nt, Yersinia pestis
cagguuaugcagcucaauca

SEQ ID NO: 2265191 - RNA, 20 nt, Yersinia pestis
cagguguuaguguucuuacg

SEQ ID NO: 2265192 - RNA, 17 nt, Yersinia pestis
cagguggauccgucauc

SEQ ID NO: 2265193 - RNA, 21 nt, Yersinia pestis
cauuuugugcucuggcuauau

SEQ ID NO: 2265194 - RNA, 21 nt, Yersinia pestis
cauuuuguauuuuguuuuuuu

SEQ ID NO: 2265195 - RNA, 13 nt, Yersinia pestis
cauugauggccuu

SEQ ID NO: 2265196 - RNA, 16 nt, Yersinia pestis
cauugauaaucuccau

SEQ ID NO: 2265197 - RNA, 17 nt, Yersinia pestis
cauugauaaucuccauu

SEQ ID NO: 2265198 - RNA, 19 nt, Yersinia pestis
cauugauaaucuccauuga

SEQ ID NO: 2265199 - RNA, 14 nt, Yersinia pestis
cauugauaauaaua

SEQ ID NO: 2265200 - RNA, 13 nt, Yersinia pestis
cauuuuuaacauc

SEQ ID NO: 2265201 - RNA, 14 nt, Yersinia pestis
cauuuuuauuuuau

SEQ ID NO: 2265202 - RNA, 19 nt, Yersinia pestis
cauuuuuuaucuuguaaau

SEQ ID NO: 2265203 - RNA, 23 nt, Yersinia pestis
cauuuuuuaucuuguaaauaguc

SEQ ID NO: 2265204 - RNA, 14 nt, Yersinia pestis
cauuuuuuguagug

SEQ ID NO: 2265205 - RNA, 15 nt, Yersinia pestis
cauuuuuuguaguga

SEQ ID NO: 2265206 - RNA, 17 nt, Yersinia pestis
cauuuuuuuauuaaguu

SEQ ID NO: 2265207 - RNA, 14 nt, Yersinia pestis
cauuuuucuauuuc

SEQ ID NO: 2265208 - RNA, 20 nt, Yersinia pestis
cauuuuuuaaaaccaaauua

SEQ ID NO: 2265209 - RNA, 18 nt, Yersinia pestis
ccaaacugcucauaaagc

SEQ ID NO: 2265210 - RNA, 14 nt, Yersinia pestis
ccaaacgugcuacu

SEQ ID NO: 2265211 - RNA, 18 nt, Yersinia pestis
ccaaacauuuucaucuga

SEQ ID NO: 2265212 - RNA, 12 nt, Yersinia pestis
ccaaacaaacac

SEQ ID NO: 2265213 - RNA, 14 nt, Yersinia pestis
ccaaacaaaugaac

SEQ ID NO: 2265214 - RNA, 17 nt, Yersinia pestis
ccaaaauuuagaagccc

SEQ ID NO: 2265215 - RNA, 22 nt, Yersinia pestis
ccaaacaacaacacaauuaaua

SEQ ID NO: 2265216 - RNA, 11 nt, Yersinia pestis
ccaaacagaau

SEQ ID NO: 2265217 - RNA, 14 nt, Yersinia pestis
ccaaaauagccagc

SEQ ID NO: 2265218 - RNA, 13 nt, Yersinia pestis
ccaaaauaauaua

SEQ ID NO: 2265219 - RNA, 24 nt, Yersinia pestis
ccaaaauaauucgaguagauucau

SEQ ID NO: 2265220 - RNA, 11 nt, Yersinia pestis
ccaaaaucaaa

SEQ ID NO: 2265221 - RNA, 16 nt, Yersinia pestis
ccaaaauccaccagcg

SEQ ID NO: 2265222 - RNA, 15 nt, Yersinia pestis
ccaaaacucaugucc

SEQ ID NO: 2265223 - RNA, 18 nt, Yersinia pestis
ccaaaacucccuguuacg

SEQ ID NO: 2265224 - RNA, 18 nt, Yersinia pestis
ccaaaacgaacaaaaugg

SEQ ID NO: 2265225 - RNA, 15 nt, Yersinia pestis
ccaaaaccauuggaa

SEQ ID NO: 2265226 - RNA, 16 nt, Yersinia pestis
ccaaaacgccaccagc

SEQ ID NO: 2265227 - RNA, 12 nt, Yersinia pestis
ccaaaacagccu

SEQ ID NO: 2265228 - RNA, 15 nt, Yersinia pestis
ccaaaacaucggcca

SEQ ID NO: 2265229 - RNA, 12 nt, Yersinia pestis
ccaaaaaucuug

SEQ ID NO: 2265230 - RNA, 19 nt, Yersinia pestis
ccaaggggagccacacacu

SEQ ID NO: 2265231 - RNA, 18 nt, Yersinia pestis
ccaagcggcaggggcgcg

SEQ ID NO: 2265232 - RNA, 17 nt, Yersinia pestis
ccaagcccgcugcaacu

SEQ ID NO: 2265233 - RNA, 18 nt, Yersinia pestis
ccaagaagauaacuuuuu

SEQ ID NO: 2265234 - RNA, 19 nt, Yersinia pestis
ccaagaagauaacuuuuua

SEQ ID NO: 2265235 - RNA, 13 nt, Yersinia pestis
ccaagaaacgccc

SEQ ID NO: 2265236 - RNA, 19 nt, Yersinia pestis
ccaacuugcuggcaggaaa

SEQ ID NO: 2265237 - RNA, 17 nt, Yersinia pestis
ccaagaacgccaaauga

SEQ ID NO: 2265238 - RNA, 20 nt, Yersinia pestis
ccaaccggauaaaacaauag

SEQ ID NO: 2265239 - RNA, 14 nt, Yersinia pestis
ccaacuugcuggca

SEQ ID NO: 2265240 - RNA, 14 nt, Yersinia pestis
ccaagaaaagcacc

SEQ ID NO: 2265241 - RNA, 17 nt, Yersinia pestis
ccaagaaaagcaccgca

SEQ ID NO: 2265242 - RNA, 22 nt, Yersinia pestis
ccaacuaaacagggcagaaaau

SEQ ID NO: 2265243 - RNA, 20 nt, Yersinia pestis
ccaacuaaacagggcagaaa

SEQ ID NO: 2265244 - RNA, 21 nt, Yersinia pestis
ccaacucaccuuuaucgcgga

SEQ ID NO: 2265245 - RNA, 13 nt, Yersinia pestis
ccaaaugaaaaau

SEQ ID NO: 2265246 - RNA, 13 nt, Yersinia pestis
ccaaaugagaugg

SEQ ID NO: 2265247 - RNA, 13 nt, Yersinia pestis
ccaaaugguuagu

SEQ ID NO: 2265248 - RNA, 13 nt, Yersinia pestis
ccaaaugcugacu

SEQ ID NO: 2265249 - RNA, 23 nt, Yersinia pestis
ccaaauagcaagccaaaacagcc

SEQ ID NO: 2265250 - RNA, 18 nt, Yersinia pestis
ccaaauacauauaaccau

SEQ ID NO: 2265251 - RNA, 21 nt, Yersinia pestis
ccaaagcaguaaacauuuuga

SEQ ID NO: 2265252 - RNA, 13 nt, Yersinia pestis
ccaacaauuugcg

SEQ ID NO: 2265253 - RNA, 23 nt, Yersinia pestis
ccaaauguuggauaacccccuga

SEQ ID NO: 2265254 - RNA, 20 nt, Yersinia pestis
ccaaauuacuuuaaagccaa

SEQ ID NO: 2265255 - RNA, 21 nt, Yersinia pestis
ccaacacucaugacaaaaugc

SEQ ID NO: 2265256 - RNA, 21 nt, Yersinia pestis
ccaacacuccucuuucuuaau

SEQ ID NO: 2265257 - RNA, 18 nt, Yersinia pestis
ccaacaauuugcgcccgc

SEQ ID NO: 2265258 - RNA, 13 nt, Yersinia pestis
ccaacaccaccau

SEQ ID NO: 2265259 - RNA, 16 nt, Yersinia pestis
ccaaccccaucagcau

SEQ ID NO: 2265260 - RNA, 21 nt, Yersinia pestis
ccaaccaggccgccaucauca

SEQ ID NO: 2265261 - RNA, 18 nt, Yersinia pestis
ccaacaugagccacacau

SEQ ID NO: 2265262 - RNA, 16 nt, Yersinia pestis
ccaacagacucacucu

SEQ ID NO: 2265263 - RNA, 15 nt, Yersinia pestis
ccaacauguugaaau

SEQ ID NO: 2265264 - RNA, 20 nt, Yersinia pestis
ccaacauguugaaaucuauu

SEQ ID NO: 2265265 - RNA, 21 nt, Yersinia pestis
ccaauucacgccuaucucgac

SEQ ID NO: 2265266 - RNA, 19 nt, Yersinia pestis
ccaauucaaggccagcacg

SEQ ID NO: 2265267 - RNA, 22 nt, Yersinia pestis
ccaauuaggggaagguaaaaaa

SEQ ID NO: 2265268 - RNA, 11 nt, Yersinia pestis
ccacaauccgg

SEQ ID NO: 2265269 - RNA, 12 nt, Yersinia pestis
ccacaacugaau

SEQ ID NO: 2265270 - RNA, 14 nt, Yersinia pestis
ccacaacagauggc

SEQ ID NO: 2265271 - RNA, 20 nt, Yersinia pestis
ccacaaaggucagcaugguc

SEQ ID NO: 2265272 - RNA, 13 nt, Yersinia pestis
ccacaaauuuuua

SEQ ID NO: 2265273 - RNA, 14 nt, Yersinia pestis
ccacaaauuuuuac

SEQ ID NO: 2265274 - RNA, 13 nt, Yersinia pestis
ccaaugauuaacg

SEQ ID NO: 2265275 - RNA, 18 nt, Yersinia pestis
ccaauuacgcugcccuga

SEQ ID NO: 2265276 - RNA, 16 nt, Yersinia pestis
ccaaugccucuucaau

SEQ ID NO: 2265277 - RNA, 15 nt, Yersinia pestis
ccaauguuucaaauc

SEQ ID NO: 2265278 - RNA, 18 nt, Yersinia pestis
ccaaugccaagaauaauu

SEQ ID NO: 2265279 - RNA, 10 nt, Yersinia pestis
ccaauaaugc

SEQ ID NO: 2265280 - RNA, 15 nt, Yersinia pestis
ccaauaagauaaaca

SEQ ID NO: 2265281 - RNA, 20 nt, Yersinia pestis
ccaauaagugaaacaaauac

SEQ ID NO: 2265282 - RNA, 14 nt, Yersinia pestis
ccaauaauaaaaaa

SEQ ID NO: 2265283 - RNA, 19 nt, Yersinia pestis
ccaauaauaaaaaaaaaua

SEQ ID NO: 2265284 - RNA, 19 nt, Yersinia pestis
ccaaguaugauaaugccuu

SEQ ID NO: 2265285 - RNA, 21 nt, Yersinia pestis
ccacaccuccgcccucuugcu

SEQ ID NO: 2265286 - RNA, 24 nt, Yersinia pestis
ccacaccggcugcaauaagccaga

SEQ ID NO: 2265287 - RNA, 20 nt, Yersinia pestis
ccacaauggcagagcuuuuc

SEQ ID NO: 2265288 - RNA, 17 nt, Yersinia pestis
ccacacugucaucacug

SEQ ID NO: 2265289 - RNA, 21 nt, Yersinia pestis
ccacauauauagagaaaucua

SEQ ID NO: 2265290 - RNA, 19 nt, Yersinia pestis
ccacaucaaaccggcuaau

SEQ ID NO: 2265291 - RNA, 17 nt, Yersinia pestis
ccacauaaaauagccca

SEQ ID NO: 2265292 - RNA, 22 nt, Yersinia pestis
ccacauaaaauagcccagugcg

SEQ ID NO: 2265293 - RNA, 22 nt, Yersinia pestis
ccacauaaaaagaaaaaaacag

SEQ ID NO: 2265294 - RNA, 18 nt, Yersinia pestis
ccacagguggggcaguua

SEQ ID NO: 2265295 - RNA, 19 nt, Yersinia pestis
ccacagucgccgucaauuu

SEQ ID NO: 2265296 - RNA, 17 nt, Yersinia pestis
ccacaucacgcagcgcu

SEQ ID NO: 2265297 - RNA, 11 nt, Yersinia pestis
ccacaucauua

SEQ ID NO: 2265298 - RNA, 14 nt, Yersinia pestis
ccacauucaggccg

SEQ ID NO: 2265299 - RNA, 22 nt, Yersinia pestis
ccacaugguuucaaugagcaua

SEQ ID NO: 2265300 - RNA, 16 nt, Yersinia pestis
ccaccaacuccugccu

SEQ ID NO: 2265301 - RNA, 16 nt, Yersinia pestis
ccaccaacccgccccc

SEQ ID NO: 2265302 - RNA, 16 nt, Yersinia pestis
ccaccacaucauccag

SEQ ID NO: 2265303 - RNA, 17 nt, Yersinia pestis
ccaccacaucauccagu

SEQ ID NO: 2265304 - RNA, 14 nt, Yersinia pestis
ccaccuuaaaauaa

SEQ ID NO: 2265305 - RNA, 22 nt, Yersinia pestis
ccaccuaauacagcaccaccga

SEQ ID NO: 2265306 - RNA, 14 nt, Yersinia pestis
ccaccuacaaccua

SEQ ID NO: 2265307 - RNA, 20 nt, Yersinia pestis
ccaccuacaaccuaccaccu

SEQ ID NO: 2265308 - RNA, 21 nt, Yersinia pestis
ccaccuacaaccuaccaccua

SEQ ID NO: 2265309 - RNA, 13 nt, Yersinia pestis
ccaccuaccaccu

SEQ ID NO: 2265310 - RNA, 14 nt, Yersinia pestis
ccaccuaccaccua

SEQ ID NO: 2265311 - RNA, 19 nt, Yersinia pestis
ccaccuaccaccuaccacc

SEQ ID NO: 2265312 - RNA, 14 nt, Yersinia pestis
ccacgcaucaauaa

SEQ ID NO: 2265313 - RNA, 16 nt, Yersinia pestis
ccaccggcaguucauu

SEQ ID NO: 2265314 - RNA, 19 nt, Yersinia pestis
ccaccggcaguucauuccc

SEQ ID NO: 2265315 - RNA, 21 nt, Yersinia pestis
ccaccguguccggguuuaccc

SEQ ID NO: 2265316 - RNA, 15 nt, Yersinia pestis
ccaccgucuguggug

SEQ ID NO: 2265317 - RNA, 22 nt, Yersinia pestis
ccaccguggcgcgccacuucuu

SEQ ID NO: 2265318 - RNA, 17 nt, Yersinia pestis
ccagcagaaguuguugc

SEQ ID NO: 2265319 - RNA, 12 nt, Yersinia pestis
ccagcaaaucau

SEQ ID NO: 2265320 - RNA, 15 nt, Yersinia pestis
ccagcaaaggccacc

SEQ ID NO: 2265321 - RNA, 17 nt, Yersinia pestis
ccagcaacugaaaccga

SEQ ID NO: 2265322 - RNA, 18 nt, Yersinia pestis
ccagcaacguaacaugca

SEQ ID NO: 2265323 - RNA, 18 nt, Yersinia pestis
ccagcaacucaagccacu

SEQ ID NO: 2265324 - RNA, 13 nt, Yersinia pestis
ccagcaagagcag

SEQ ID NO: 2265325 - RNA, 17 nt, Yersinia pestis
ccagcacacagaugcug

SEQ ID NO: 2265326 - RNA, 22 nt, Yersinia pestis
ccagcaagagcagccaacacac

SEQ ID NO: 2265327 - RNA, 14 nt, Yersinia pestis
ccagcaagccgugg

SEQ ID NO: 2265328 - RNA, 12 nt, Yersinia pestis
ccagcacagccu

SEQ ID NO: 2265329 - RNA, 13 nt, Yersinia pestis
ccagcaucaguag

SEQ ID NO: 2265330 - RNA, 20 nt, Yersinia pestis
ccagcaggcgugcugcuucc

SEQ ID NO: 2265331 - RNA, 22 nt, Yersinia pestis
ccagcaggcgugcugcuuccug

SEQ ID NO: 2265332 - RNA, 23 nt, Yersinia pestis
ccagccaagacuuuccacaacag

SEQ ID NO: 2265333 - RNA, 20 nt, Yersinia pestis
ccagccaugcgacaccaaga

SEQ ID NO: 2265334 - RNA, 18 nt, Yersinia pestis
ccagccccaaacacuuag

SEQ ID NO: 2265335 - RNA, 14 nt, Yersinia pestis
ccagcccaucacca

SEQ ID NO: 2265336 - RNA, 12 nt, Yersinia pestis
ccacuuauaucu

SEQ ID NO: 2265337 - RNA, 17 nt, Yersinia pestis
ccacuuguaccugugcc

SEQ ID NO: 2265338 - RNA, 20 nt, Yersinia pestis
ccacuuguaccugugccagu

SEQ ID NO: 2265339 - RNA, 17 nt, Yersinia pestis
ccacgccaauuaccguc

SEQ ID NO: 2265340 - RNA, 23 nt, Yersinia pestis
ccacgccagccuguuaauaauuc

SEQ ID NO: 2265341 - RNA, 22 nt, Yersinia pestis
ccacgccaacccucuuccgguu

SEQ ID NO: 2265342 - RNA, 18 nt, Yersinia pestis
ccacgccaacccucuucc

SEQ ID NO: 2265343 - RNA, 23 nt, Yersinia pestis
ccacuguaucuuugcuaucucuu

SEQ ID NO: 2265344 - RNA, 19 nt, Yersinia pestis
ccacuggccugagaaccca

SEQ ID NO: 2265345 - RNA, 17 nt, Yersinia pestis
ccacugcggucaaagaa

SEQ ID NO: 2265346 - RNA, 18 nt, Yersinia pestis
ccacugcguacucacccc

SEQ ID NO: 2265347 - RNA, 15 nt, Yersinia pestis
ccagaauaauaagcc

SEQ ID NO: 2265348 - RNA, 21 nt, Yersinia pestis
ccagaauuucauuguggagga

SEQ ID NO: 2265349 - RNA, 19 nt, Yersinia pestis
ccagaaucacugucaaaaa

SEQ ID NO: 2265350 - RNA, 14 nt, Yersinia pestis
ccagacaacaguca

SEQ ID NO: 2265351 - RNA, 23 nt, Yersinia pestis
ccagacacugacaucaucaccua

SEQ ID NO: 2265352 - RNA, 21 nt, Yersinia pestis
ccagaacaauaccgccaauau

SEQ ID NO: 2265353 - RNA, 15 nt, Yersinia pestis
ccacuuugcugugag

SEQ ID NO: 2265354 - RNA, 15 nt, Yersinia pestis
ccagaaaggcaaaaa

SEQ ID NO: 2265355 - RNA, 19 nt, Yersinia pestis
ccagaaaaccuucagcaaa

SEQ ID NO: 2265356 - RNA, 20 nt, Yersinia pestis
ccagaugccaaauaucuuuc

SEQ ID NO: 2265357 - RNA, 19 nt, Yersinia pestis
ccagaucuuuuucauucug

SEQ ID NO: 2265358 - RNA, 20 nt, Yersinia pestis
ccagaucuuuuucauucuga

SEQ ID NO: 2265359 - RNA, 17 nt, Yersinia pestis
ccagauggcaaucugca

SEQ ID NO: 2265360 - RNA, 15 nt, Yersinia pestis
ccagauaacaacaaa

SEQ ID NO: 2265361 - RNA, 19 nt, Yersinia pestis
ccagauaacauacaccauc

SEQ ID NO: 2265362 - RNA, 18 nt, Yersinia pestis
ccagauagcgaaucacau

SEQ ID NO: 2265363 - RNA, 23 nt, Yersinia pestis
ccagaucagcacggaaccccugc

SEQ ID NO: 2265364 - RNA, 19 nt, Yersinia pestis
ccagaucacggaaguaagg

SEQ ID NO: 2265365 - RNA, 17 nt, Yersinia pestis
ccagaucauuuuuuucc

SEQ ID NO: 2265366 - RNA, 14 nt, Yersinia pestis
ccagacccugcacc

SEQ ID NO: 2265367 - RNA, 15 nt, Yersinia pestis
ccagacccugcacca

SEQ ID NO: 2265368 - RNA, 19 nt, Yersinia pestis
ccagacccugcaccacgcc

SEQ ID NO: 2265369 - RNA, 20 nt, Yersinia pestis
ccagaccgcguaagccgugc

SEQ ID NO: 2265370 - RNA, 15 nt, Yersinia pestis
ccagagcgacuuaau

SEQ ID NO: 2265371 - RNA, 18 nt, Yersinia pestis
ccagagcggagccucagu

SEQ ID NO: 2265372 - RNA, 23 nt, Yersinia pestis
ccagagcguuucaguauuguaua

SEQ ID NO: 2265373 - RNA, 13 nt, Yersinia pestis
ccagagcccgggu

SEQ ID NO: 2265374 - RNA, 23 nt, Yersinia pestis
ccagaggguuaacggauccugcc

SEQ ID NO: 2265375 - RNA, 15 nt, Yersinia pestis
ccagagaugauagca

SEQ ID NO: 2265376 - RNA, 20 nt, Yersinia pestis
ccagagacauaaagcccgcu

SEQ ID NO: 2265377 - RNA, 23 nt, Yersinia pestis
ccagacucugcuaccaggaagcg

SEQ ID NO: 2265378 - RNA, 14 nt, Yersinia pestis
ccagacugacaacc

SEQ ID NO: 2265379 - RNA, 20 nt, Yersinia pestis
ccagacuguucacaagccaa

SEQ ID NO: 2265380 - RNA, 20 nt, Yersinia pestis
ccagacguuaugaauaaacc

SEQ ID NO: 2265381 - RNA, 13 nt, Yersinia pestis
cauacuuugccuu

SEQ ID NO: 2265382 - RNA, 21 nt, Yersinia pestis
cauacucucgcccucuggugc

SEQ ID NO: 2265383 - RNA, 23 nt, Yersinia pestis
cagugcauucaucaugcugucau

SEQ ID NO: 2265384 - RNA, 17 nt, Yersinia pestis
cagugcauugcagaaag

SEQ ID NO: 2265385 - RNA, 16 nt, Yersinia pestis
cagugccaacagcgag

SEQ ID NO: 2265386 - RNA, 17 nt, Yersinia pestis
cagugccaagguucgaa

SEQ ID NO: 2265387 - RNA, 19 nt, Yersinia pestis
cauagaugcaaaugucaga

SEQ ID NO: 2265388 - RNA, 19 nt, Yersinia pestis
cauagauuauuuuuauaca

SEQ ID NO: 2265389 - RNA, 12 nt, Yersinia pestis
cauagaauuuaa

SEQ ID NO: 2265390 - RNA, 15 nt, Yersinia pestis
cauagacgaaggcac

SEQ ID NO: 2265391 - RNA, 17 nt, Yersinia pestis
cauagcuggcuucaaaa

SEQ ID NO: 2265392 - RNA, 20 nt, Yersinia pestis
cauagcuggcuuucgcuuua

SEQ ID NO: 2265393 - RNA, 16 nt, Yersinia pestis
cauagcuggcuucaaa

SEQ ID NO: 2265394 - RNA, 17 nt, Yersinia pestis
cauagcgugauuuuuau

SEQ ID NO: 2265395 - RNA, 15 nt, Yersinia pestis
cauagcgugauuuuu

SEQ ID NO: 2265396 - RNA, 18 nt, Yersinia pestis
cauagcgguuuuguuguc

SEQ ID NO: 2265397 - RNA, 11 nt, Yersinia pestis
cauagccaugg

SEQ ID NO: 2265398 - RNA, 16 nt, Yersinia pestis
cauagccauggcuucu

SEQ ID NO: 2265399 - RNA, 13 nt, Yersinia pestis
cauagccauccca

SEQ ID NO: 2265400 - RNA, 20 nt, Yersinia pestis
cauauaaaaaacuaauguuu

SEQ ID NO: 2265401 - RNA, 12 nt, Yersinia pestis
cauauaaaccag

SEQ ID NO: 2265402 - RNA, 13 nt, Yersinia pestis
cauauaaccaugc

SEQ ID NO: 2265403 - RNA, 22 nt, Yersinia pestis
cauauaucacuauuucaggcau

SEQ ID NO: 2265404 - RNA, 13 nt, Yersinia pestis
cauauaucacuau

SEQ ID NO: 2265405 - RNA, 24 nt, Yersinia pestis
cauauagcggcguucagcaauaug

SEQ ID NO: 2265406 - RNA, 15 nt, Yersinia pestis
cauauaucacuauuu

SEQ ID NO: 2265407 - RNA, 22 nt, Yersinia pestis
cauauagcggcguucagcaaua

SEQ ID NO: 2265408 - RNA, 17 nt, Yersinia pestis
cauauccucgagaugua

SEQ ID NO: 2265409 - RNA, 16 nt, Yersinia pestis
cauauccgaugauaua

SEQ ID NO: 2265410 - RNA, 23 nt, Yersinia pestis
cauaucgaucaaccauucauacu

SEQ ID NO: 2265411 - RNA, 14 nt, Yersinia pestis
cauaucaaccguuu

SEQ ID NO: 2265412 - RNA, 16 nt, Yersinia pestis
cauaucaaaauaaaaa

SEQ ID NO: 2265413 - RNA, 21 nt, Yersinia pestis
cauaucaaaauaaaaauucac

SEQ ID NO: 2265414 - RNA, 19 nt, Yersinia pestis
cauauauuuuucuuucucg

SEQ ID NO: 2265415 - RNA, 15 nt, Yersinia pestis
cauaucaaaauaaaa

SEQ ID NO: 2265416 - RNA, 15 nt, Yersinia pestis
cauauauugcauuua

SEQ ID NO: 2265417 - RNA, 11 nt, Yersinia pestis
cauauauuuca

SEQ ID NO: 2265418 - RNA, 19 nt, Yersinia pestis
cauauucaugguuucaaaa

SEQ ID NO: 2265419 - RNA, 12 nt, Yersinia pestis
cauauucaucaa

SEQ ID NO: 2265420 - RNA, 16 nt, Yersinia pestis
cauaucgcuaaaacac

SEQ ID NO: 2265421 - RNA, 17 nt, Yersinia pestis
cauauuuuuuagaucuc

SEQ ID NO: 2265422 - RNA, 13 nt, Yersinia pestis
cauauuuuaaaua

SEQ ID NO: 2265423 - RNA, 16 nt, Yersinia pestis
cauauuucucuuuccg

SEQ ID NO: 2265424 - RNA, 19 nt, Yersinia pestis
cauauugcucugccgcagu

SEQ ID NO: 2265425 - RNA, 20 nt, Yersinia pestis
caucaaaggagugcccggca

SEQ ID NO: 2265426 - RNA, 21 nt, Yersinia pestis
caucaaauacacauaaccauc

SEQ ID NO: 2265427 - RNA, 14 nt, Yersinia pestis
caucaacauacuga

SEQ ID NO: 2265428 - RNA, 16 nt, Yersinia pestis
caucaagugaaccauc

SEQ ID NO: 2265429 - RNA, 14 nt, Yersinia pestis
caucaauaaaauua

SEQ ID NO: 2265430 - RNA, 19 nt, Yersinia pestis
caucaauaaaauuacccag

SEQ ID NO: 2265431 - RNA, 22 nt, Yersinia pestis
caucaauaauaacgaauuucau

SEQ ID NO: 2265432 - RNA, 17 nt, Yersinia pestis
caucaauagguguugcc

SEQ ID NO: 2265433 - RNA, 18 nt, Yersinia pestis
caucacacuuguuugccc

SEQ ID NO: 2265434 - RNA, 20 nt, Yersinia pestis
caucacauccgaucagccag

SEQ ID NO: 2265435 - RNA, 22 nt, Yersinia pestis
caucacagaacaucugccaggc

SEQ ID NO: 2265436 - RNA, 12 nt, Yersinia pestis
caucaccacccu

SEQ ID NO: 2265437 - RNA, 19 nt, Yersinia pestis
caucaccuugcgcccuugu

SEQ ID NO: 2265438 - RNA, 18 nt, Yersinia pestis
caucaccgcuaucacuga

SEQ ID NO: 2265439 - RNA, 11 nt, Yersinia pestis
caucagcaauu

SEQ ID NO: 2265440 - RNA, 18 nt, Yersinia pestis
caucagcaaaguauuuau

SEQ ID NO: 2265441 - RNA, 22 nt, Yersinia pestis
caucacuggcgggccguuuacu

SEQ ID NO: 2265442 - RNA, 18 nt, Yersinia pestis
caucacugcuauuuaccc

SEQ ID NO: 2265443 - RNA, 20 nt, Yersinia pestis
caucgaguccguuaaaaaau

SEQ ID NO: 2265444 - RNA, 21 nt, Yersinia pestis
caucgaguccguuaaaaaauu

SEQ ID NO: 2265445 - RNA, 19 nt, Yersinia pestis
caucgagcgggcuucacca

SEQ ID NO: 2265446 - RNA, 20 nt, Yersinia pestis
caucgacuaauuaaacaagu

SEQ ID NO: 2265447 - RNA, 16 nt, Yersinia pestis
caucgccccaaagaua

SEQ ID NO: 2265448 - RNA, 16 nt, Yersinia pestis
caucgccauccgugcg

SEQ ID NO: 2265449 - RNA, 22 nt, Yersinia pestis
cauccgcgaugacacaauuccc

SEQ ID NO: 2265450 - RNA, 15 nt, Yersinia pestis
caucgaaaaaaauac

SEQ ID NO: 2265451 - RNA, 23 nt, Yersinia pestis
caucgaagagugcauugaaggua

SEQ ID NO: 2265452 - RNA, 20 nt, Yersinia pestis
caucgaacgcgucacuggcc

SEQ ID NO: 2265453 - RNA, 15 nt, Yersinia pestis
caucggcaaaaacag

SEQ ID NO: 2265454 - RNA, 14 nt, Yersinia pestis
caucgcccugcucu

SEQ ID NO: 2265455 - RNA, 22 nt, Yersinia pestis
caucggcgaggcguuggcuucu

SEQ ID NO: 2265456 - RNA, 18 nt, Yersinia pestis
caucgggaugcgcucgcu

SEQ ID NO: 2265457 - RNA, 20 nt, Yersinia pestis
caucgggauccgccugcugg

SEQ ID NO: 2265458 - RNA, 23 nt, Yersinia pestis
caucgggaacaggaucugcuccu

SEQ ID NO: 2265459 - RNA, 14 nt, Yersinia pestis
caucgggaacagga

SEQ ID NO: 2265460 - RNA, 22 nt, Yersinia pestis
caucgggaacaggaucugcucc

SEQ ID NO: 2265461 - RNA, 19 nt, Yersinia pestis
caucgggguuugucagcag

SEQ ID NO: 2265462 - RNA, 17 nt, Yersinia pestis
caucgggcuugucuugu

SEQ ID NO: 2265463 - RNA, 22 nt, Yersinia pestis
caucggucauuuuacgccuggc

SEQ ID NO: 2265464 - RNA, 17 nt, Yersinia pestis
caucagcaucaauaaaa

SEQ ID NO: 2265465 - RNA, 19 nt, Yersinia pestis
caucagcauauuacccagu

SEQ ID NO: 2265466 - RNA, 12 nt, Yersinia pestis
caucaugacgau

SEQ ID NO: 2265467 - RNA, 14 nt, Yersinia pestis
caucaugaguaaaa

SEQ ID NO: 2265468 - RNA, 14 nt, Yersinia pestis
caucauuugagcug

SEQ ID NO: 2265469 - RNA, 17 nt, Yersinia pestis
cauccaaauagccuugc

SEQ ID NO: 2265470 - RNA, 15 nt, Yersinia pestis
cauccaaauagccuu

SEQ ID NO: 2265471 - RNA, 22 nt, Yersinia pestis
caucauuuuuuaucuuguaaau

SEQ ID NO: 2265472 - RNA, 17 nt, Yersinia pestis
cauccagcucauauaau

SEQ ID NO: 2265473 - RNA, 15 nt, Yersinia pestis
cauccgcauaaguua

SEQ ID NO: 2265474 - RNA, 16 nt, Yersinia pestis
cauccccaucgccaau

SEQ ID NO: 2265475 - RNA, 22 nt, Yersinia pestis
cauccccaaacgcugaccaugg

SEQ ID NO: 2265476 - RNA, 11 nt, Yersinia pestis
cauccccagaa

SEQ ID NO: 2265477 - RNA, 18 nt, Yersinia pestis
caucccauugcaggauaa

SEQ ID NO: 2265478 - RNA, 19 nt, Yersinia pestis
cauccccacugacaucauu

SEQ ID NO: 2265479 - RNA, 19 nt, Yersinia pestis
caucccagccaccaugggu

SEQ ID NO: 2265480 - RNA, 16 nt, Yersinia pestis
caucccaggcauccuu

SEQ ID NO: 2265481 - RNA, 14 nt, Yersinia pestis
cauccauuguauug

SEQ ID NO: 2265482 - RNA, 22 nt, Yersinia pestis
cauccauuguauugcucagggc

SEQ ID NO: 2265483 - RNA, 20 nt, Yersinia pestis
cauccauguaggcucgagcc

SEQ ID NO: 2265484 - RNA, 13 nt, Yersinia pestis
caucccaaaauag

SEQ ID NO: 2265485 - RNA, 22 nt, Yersinia pestis
caucccaaaauagccagcccca

SEQ ID NO: 2265486 - RNA, 23 nt, Yersinia pestis
caucccaagagaacggagagaac

SEQ ID NO: 2265487 - RNA, 14 nt, Yersinia pestis
caucccacucugua

SEQ ID NO: 2265488 - RNA, 16 nt, Yersinia pestis
cauccauuacauccuu

SEQ ID NO: 2265489 - RNA, 15 nt, Yersinia pestis
cauccaugccauggc

SEQ ID NO: 2265490 - RNA, 15 nt, Yersinia pestis
cauccaguaagcugu

SEQ ID NO: 2265491 - RNA, 18 nt, Yersinia pestis
cauccaguaagcuguuga

SEQ ID NO: 2265492 - RNA, 14 nt, Yersinia pestis
cauccagugccaac

SEQ ID NO: 2265493 - RNA, 20 nt, Yersinia pestis
cauccauaaguauuuauucc

SEQ ID NO: 2265494 - RNA, 21 nt, Yersinia pestis
caugaugucgcgacucaagcc

SEQ ID NO: 2265495 - RNA, 15 nt, Yersinia pestis
caugauucucuauuc

SEQ ID NO: 2265496 - RNA, 16 nt, Yersinia pestis
caugaugauaucaccu

SEQ ID NO: 2265497 - RNA, 20 nt, Yersinia pestis
caugaugaauacgauaaaga

SEQ ID NO: 2265498 - RNA, 21 nt, Yersinia pestis
caugauggucguggcauugag

SEQ ID NO: 2265499 - RNA, 21 nt, Yersinia pestis
caugauagcuugggcgauagu

SEQ ID NO: 2265500 - RNA, 16 nt, Yersinia pestis
caugaugacaaugcgu

SEQ ID NO: 2265501 - RNA, 15 nt, Yersinia pestis
caugauuuguugaug

SEQ ID NO: 2265502 - RNA, 12 nt, Yersinia pestis
caugcacaguug

SEQ ID NO: 2265503 - RNA, 21 nt, Yersinia pestis
caugcagcauuuucagcaacu

SEQ ID NO: 2265504 - RNA, 17 nt, Yersinia pestis
caugccuaauuugguac

SEQ ID NO: 2265505 - RNA, 16 nt, Yersinia pestis
caugccuugaaacuca

SEQ ID NO: 2265506 - RNA, 20 nt, Yersinia pestis
caugccuugaaacucaacga

SEQ ID NO: 2265507 - RNA, 19 nt, Yersinia pestis
caugcgauacgcccgcccc

SEQ ID NO: 2265508 - RNA, 18 nt, Yersinia pestis
caugccccaauguagaca

SEQ ID NO: 2265509 - RNA, 15 nt, Yersinia pestis
caugccacuucgcua

SEQ ID NO: 2265510 - RNA, 12 nt, Yersinia pestis
caugccauggcg

SEQ ID NO: 2265511 - RNA, 18 nt, Yersinia pestis
caugcccagccucuggau

SEQ ID NO: 2265512 - RNA, 22 nt, Yersinia pestis
caucuuuuuuuuuauuaucauc

SEQ ID NO: 2265513 - RNA, 12 nt, Yersinia pestis
caucuuuuucug

SEQ ID NO: 2265514 - RNA, 13 nt, Yersinia pestis
caucuugaaaaua

SEQ ID NO: 2265515 - RNA, 19 nt, Yersinia pestis
caucuuguucuaauaauaa

SEQ ID NO: 2265516 - RNA, 23 nt, Yersinia pestis
caucuugcgccgaaauaaaacca

SEQ ID NO: 2265517 - RNA, 19 nt, Yersinia pestis
caucuugggccgacucugc

SEQ ID NO: 2265518 - RNA, 12 nt, Yersinia pestis
caucuuuaacaa

SEQ ID NO: 2265519 - RNA, 15 nt, Yersinia pestis
caucuuuaacaacaa

SEQ ID NO: 2265520 - RNA, 16 nt, Yersinia pestis
caucuuuaauuaaugg

SEQ ID NO: 2265521 - RNA, 16 nt, Yersinia pestis
caucuuuaccccauug

SEQ ID NO: 2265522 - RNA, 21 nt, Yersinia pestis
caucuuucucauuagcgucuu

SEQ ID NO: 2265523 - RNA, 12 nt, Yersinia pestis
caucguggcuuu

SEQ ID NO: 2265524 - RNA, 23 nt, Yersinia pestis
caucguggucaccgccaaaugaa

SEQ ID NO: 2265525 - RNA, 15 nt, Yersinia pestis
caucuucuucuuuaa

SEQ ID NO: 2265526 - RNA, 15 nt, Yersinia pestis
caugagugaaaauau

SEQ ID NO: 2265527 - RNA, 17 nt, Yersinia pestis
caugagugaaaauaugu

SEQ ID NO: 2265528 - RNA, 21 nt, Yersinia pestis
caugauaaaacuauucugcuu

SEQ ID NO: 2265529 - RNA, 16 nt, Yersinia pestis
caugauaaccacaacg

SEQ ID NO: 2265530 - RNA, 20 nt, Yersinia pestis
caugauaaccacaacgacag

SEQ ID NO: 2265531 - RNA, 23 nt, Yersinia pestis
caugagaauacuucaggccaaua

SEQ ID NO: 2265532 - RNA, 20 nt, Yersinia pestis
caugagaaguuuuuggcgaa

SEQ ID NO: 2265533 - RNA, 15 nt, Yersinia pestis
caugaaguuuaacca

SEQ ID NO: 2265534 - RNA, 15 nt, Yersinia pestis
caugaauauucacca

SEQ ID NO: 2265535 - RNA, 17 nt, Yersinia pestis
caugguuggcccaaucg

SEQ ID NO: 2265536 - RNA, 22 nt, Yersinia pestis
caugggcuugcauaucagcaau

SEQ ID NO: 2265537 - RNA, 21 nt, Yersinia pestis
cauggcggcagcacagagcac

SEQ ID NO: 2265538 - RNA, 23 nt, Yersinia pestis
caugcucagaaaccugugugacc

SEQ ID NO: 2265539 - RNA, 19 nt, Yersinia pestis
cauggcgaaaauccuucau

SEQ ID NO: 2265540 - RNA, 16 nt, Yersinia pestis
cauggcgaaaauccuu

SEQ ID NO: 2265541 - RNA, 16 nt, Yersinia pestis
caugcggauugaacug

SEQ ID NO: 2265542 - RNA, 16 nt, Yersinia pestis
caugcguaaaugaaau

SEQ ID NO: 2265543 - RNA, 16 nt, Yersinia pestis
caugcgccauauaccc

SEQ ID NO: 2265544 - RNA, 15 nt, Yersinia pestis
cauguuuaucaaaca

SEQ ID NO: 2265545 - RNA, 14 nt, Yersinia pestis
cauguucucuccua

SEQ ID NO: 2265546 - RNA, 21 nt, Yersinia pestis
cauguaguacuuaccuuccca

SEQ ID NO: 2265547 - RNA, 17 nt, Yersinia pestis
cauguucgcacugcucu

SEQ ID NO: 2265548 - RNA, 20 nt, Yersinia pestis
caugucagacagcacgggcu

SEQ ID NO: 2265549 - RNA, 23 nt, Yersinia pestis
caugucagacagcacgggcuauc

SEQ ID NO: 2265550 - RNA, 13 nt, Yersinia pestis
cauuaaaaacaaa

SEQ ID NO: 2265551 - RNA, 12 nt, Yersinia pestis
cauuaaaauaac

SEQ ID NO: 2265552 - RNA, 13 nt, Yersinia pestis
cauuaaaauaaca

SEQ ID NO: 2265553 - RNA, 15 nt, Yersinia pestis
cauuaaaauaacaau

SEQ ID NO: 2265554 - RNA, 18 nt, Yersinia pestis
cauuaaaauaacaauuca

SEQ ID NO: 2265555 - RNA, 14 nt, Yersinia pestis
cauuaaaaauacaa

SEQ ID NO: 2265556 - RNA, 11 nt, Yersinia pestis
cauuaaacaga

SEQ ID NO: 2265557 - RNA, 13 nt, Yersinia pestis
cauuaacaauguu

SEQ ID NO: 2265558 - RNA, 20 nt, Yersinia pestis
cauuaacaauguuauauuuc

SEQ ID NO: 2265559 - RNA, 16 nt, Yersinia pestis
cauuaacaauuacuuu

SEQ ID NO: 2265560 - RNA, 16 nt, Yersinia pestis
cauuaaccuaaaaacg

SEQ ID NO: 2265561 - RNA, 19 nt, Yersinia pestis
cauucuuuuuguuaaaaua

SEQ ID NO: 2265562 - RNA, 12 nt, Yersinia pestis
cauucuugauuu

SEQ ID NO: 2265563 - RNA, 22 nt, Yersinia pestis
cauugagcauaucaaucagcau

SEQ ID NO: 2265564 - RNA, 22 nt, Yersinia pestis
cauugacgauaucaauaaagaa

SEQ ID NO: 2265565 - RNA, 13 nt, Yersinia pestis
cauugacguuaca

SEQ ID NO: 2265566 - RNA, 13 nt, Yersinia pestis
cauugaccgccaa

SEQ ID NO: 2265567 - RNA, 21 nt, Yersinia pestis
cauucuggggcgguuuuccuc

SEQ ID NO: 2265568 - RNA, 20 nt, Yersinia pestis
cauucugauagugauuuuuu

SEQ ID NO: 2265569 - RNA, 16 nt, Yersinia pestis
cauucugauagugauu

SEQ ID NO: 2265570 - RNA, 22 nt, Yersinia pestis
cauucucuacucgcucaccacu

SEQ ID NO: 2265571 - RNA, 23 nt, Yersinia pestis
cauucucuacucgcucaccacug

SEQ ID NO: 2265572 - RNA, 12 nt, Yersinia pestis
cauucuagccuu

SEQ ID NO: 2265573 - RNA, 16 nt, Yersinia pestis
cauucuaucauccuug

SEQ ID NO: 2265574 - RNA, 15 nt, Yersinia pestis
cauucccugcgguua

SEQ ID NO: 2265575 - RNA, 15 nt, Yersinia pestis
cauuauauuauuuau

SEQ ID NO: 2265576 - RNA, 17 nt, Yersinia pestis
cauuacaagugccaaau

SEQ ID NO: 2265577 - RNA, 14 nt, Yersinia pestis
cauuauauuauuua

SEQ ID NO: 2265578 - RNA, 17 nt, Yersinia pestis
cauuaauuaaucagaca

SEQ ID NO: 2265579 - RNA, 18 nt, Yersinia pestis
cauuaauuaaucagacac

SEQ ID NO: 2265580 - RNA, 22 nt, Yersinia pestis
cauuaaugcagguucauuacac

SEQ ID NO: 2265581 - RNA, 22 nt, Yersinia pestis
cauuaauggcagcauacauauc

SEQ ID NO: 2265582 - RNA, 19 nt, Yersinia pestis
cauuauccggccauuuuuu

SEQ ID NO: 2265583 - RNA, 14 nt, Yersinia pestis
cauuaucuuuaauu

SEQ ID NO: 2265584 - RNA, 23 nt, Yersinia pestis
cauuaucuaaacaauugccuuug

SEQ ID NO: 2265585 - RNA, 15 nt, Yersinia pestis
cauuaucugaaagca

SEQ ID NO: 2265586 - RNA, 12 nt, Yersinia pestis
cauuauguguca

SEQ ID NO: 2265587 - RNA, 12 nt, Yersinia pestis
cauuauuauuua

SEQ ID NO: 2265588 - RNA, 21 nt, Yersinia pestis
cauucacaccgcuacccgccc

SEQ ID NO: 2265589 - RNA, 13 nt, Yersinia pestis
cauucaauguaaa

SEQ ID NO: 2265590 - RNA, 20 nt, Yersinia pestis
cauuauucaugaugccgagu

SEQ ID NO: 2265591 - RNA, 23 nt, Yersinia pestis
cauucaccugcccgucacucaga

SEQ ID NO: 2265592 - RNA, 16 nt, Yersinia pestis
cauucaccaccaccag

SEQ ID NO: 2265593 - RNA, 18 nt, Yersinia pestis
cauucagcacccaacuua

SEQ ID NO: 2265594 - RNA, 14 nt, Yersinia pestis
cauucagcaauauu

SEQ ID NO: 2265595 - RNA, 18 nt, Yersinia pestis
cauucauuuuaaaaaaau

SEQ ID NO: 2265596 - RNA, 17 nt, Yersinia pestis
cauucauuuuaaaaaaa

SEQ ID NO: 2265597 - RNA, 22 nt, Yersinia pestis
cauucaugaggcuucuuaauuc

SEQ ID NO: 2265598 - RNA, 16 nt, Yersinia pestis
ccugcuauuuaacaaa

SEQ ID NO: 2265599 - RNA, 15 nt, Yersinia pestis
ccugcucaacugcuc

SEQ ID NO: 2265600 - RNA, 16 nt, Yersinia pestis
ccugcucaacugcuca

SEQ ID NO: 2265601 - RNA, 14 nt, Yersinia pestis
ccugcucacgcaaa

SEQ ID NO: 2265602 - RNA, 19 nt, Yersinia pestis
ccugcuacucgaauuauuu

SEQ ID NO: 2265603 - RNA, 20 nt, Yersinia pestis
ccugcggccaucaccaugcc

SEQ ID NO: 2265604 - RNA, 15 nt, Yersinia pestis
ccugccugcugcucc

SEQ ID NO: 2265605 - RNA, 16 nt, Yersinia pestis
ccugccugcugcucca

SEQ ID NO: 2265606 - RNA, 19 nt, Yersinia pestis
ccugccugggccgcugggc

SEQ ID NO: 2265607 - RNA, 12 nt, Yersinia pestis
ccugcugcucca

SEQ ID NO: 2265608 - RNA, 16 nt, Yersinia pestis
ccugcugcuccaauga

SEQ ID NO: 2265609 - RNA, 17 nt, Yersinia pestis
ccugcugcuccaccaau

SEQ ID NO: 2265610 - RNA, 23 nt, Yersinia pestis
ccugcuuaaccgauuucagcacc

SEQ ID NO: 2265611 - RNA, 13 nt, Yersinia pestis
ccugcuguuagua

SEQ ID NO: 2265612 - RNA, 12 nt, Yersinia pestis
ccugcuggcgca

SEQ ID NO: 2265613 - RNA, 23 nt, Yersinia pestis
ccugcaccagugccaauccccac

SEQ ID NO: 2265614 - RNA, 22 nt, Yersinia pestis
ccugcagguaagaaggcaauau

SEQ ID NO: 2265615 - RNA, 22 nt, Yersinia pestis
ccugcccguuaucuuauggcua

SEQ ID NO: 2265616 - RNA, 15 nt, Yersinia pestis
ccugcauaucauucg

SEQ ID NO: 2265617 - RNA, 18 nt, Yersinia pestis
ccugccagaaucagcccc

SEQ ID NO: 2265618 - RNA, 13 nt, Yersinia pestis
ccuguaagacuca

SEQ ID NO: 2265619 - RNA, 20 nt, Yersinia pestis
ccuggcugcgcaccacuguc

SEQ ID NO: 2265620 - RNA, 13 nt, Yersinia pestis
ccuggcucaaauu

SEQ ID NO: 2265621 - RNA, 20 nt, Yersinia pestis
ccuggcguaauauugccccc

SEQ ID NO: 2265622 - RNA, 22 nt, Yersinia pestis
ccuggcguaauauugcccccuc

SEQ ID NO: 2265623 - RNA, 15 nt, Yersinia pestis
ccuggcuaauuuuau

SEQ ID NO: 2265624 - RNA, 14 nt, Yersinia pestis
ccuggcaggccagc

SEQ ID NO: 2265625 - RNA, 13 nt, Yersinia pestis
ccuggauauucau

SEQ ID NO: 2265626 - RNA, 19 nt, Yersinia pestis
ccuucaaagccgcuuuaau

SEQ ID NO: 2265627 - RNA, 17 nt, Yersinia pestis
ccuucaacuaauauuaa

SEQ ID NO: 2265628 - RNA, 13 nt, Yersinia pestis
ccuucaacucuac

SEQ ID NO: 2265629 - RNA, 14 nt, Yersinia pestis
ccuucaccaauaca

SEQ ID NO: 2265630 - RNA, 13 nt, Yersinia pestis
ccuucaccaauac

SEQ ID NO: 2265631 - RNA, 15 nt, Yersinia pestis
ccuucacccaggcug

SEQ ID NO: 2265632 - RNA, 11 nt, Yersinia pestis
ccuucacccag

SEQ ID NO: 2265633 - RNA, 23 nt, Yersinia pestis
ccuucacgcaucacaucuugcaa

SEQ ID NO: 2265634 - RNA, 20 nt, Yersinia pestis
ccuucacggaaaauaaagcu

SEQ ID NO: 2265635 - RNA, 19 nt, Yersinia pestis
ccuguacuuugauucaaaa

SEQ ID NO: 2265636 - RNA, 22 nt, Yersinia pestis
ccuguacuuugauucaaaaugc

SEQ ID NO: 2265637 - RNA, 19 nt, Yersinia pestis
ccuuaauguuuuacgauca

SEQ ID NO: 2265638 - RNA, 14 nt, Yersinia pestis
ccuguaccaccacc

SEQ ID NO: 2265639 - RNA, 20 nt, Yersinia pestis
ccuguaccaccaccaacagc

SEQ ID NO: 2265640 - RNA, 18 nt, Yersinia pestis
ccuuauucaaagaauaac

SEQ ID NO: 2265641 - RNA, 12 nt, Yersinia pestis
ccuuacagugau

SEQ ID NO: 2265642 - RNA, 21 nt, Yersinia pestis
ccuucuuauuuaucacauuuc

SEQ ID NO: 2265643 - RNA, 18 nt, Yersinia pestis
ccuucuuucaaagugaca

SEQ ID NO: 2265644 - RNA, 17 nt, Yersinia pestis
ccuugaaacagcagggg

SEQ ID NO: 2265645 - RNA, 21 nt, Yersinia pestis
ccuucgaaacugaucacuggc

SEQ ID NO: 2265646 - RNA, 23 nt, Yersinia pestis
ccuucgccgucaaacucuucagc

SEQ ID NO: 2265647 - RNA, 16 nt, Yersinia pestis
ccuucagccaccagau

SEQ ID NO: 2265648 - RNA, 19 nt, Yersinia pestis
ccuucaggccuuuacuguu

SEQ ID NO: 2265649 - RNA, 16 nt, Yersinia pestis
ccuucagcgauacaac

SEQ ID NO: 2265650 - RNA, 23 nt, Yersinia pestis
ccuuguaagaccaauugguaaga

SEQ ID NO: 2265651 - RNA, 20 nt, Yersinia pestis
ccuuguaagauaccaaccca

SEQ ID NO: 2265652 - RNA, 11 nt, Yersinia pestis
ccuuguuucug

SEQ ID NO: 2265653 - RNA, 22 nt, Yersinia pestis
ccuuguggauauuuaaugcagc

SEQ ID NO: 2265654 - RNA, 19 nt, Yersinia pestis
ccuuggcauugucugcugg

SEQ ID NO: 2265655 - RNA, 15 nt, Yersinia pestis
ccuuucgaguugaac

SEQ ID NO: 2265656 - RNA, 22 nt, Yersinia pestis
ccuuucgcuugcaggucugcau

SEQ ID NO: 2265657 - RNA, 13 nt, Yersinia pestis
ccuuuugacuggu

SEQ ID NO: 2265658 - RNA, 15 nt, Yersinia pestis
ccuuuugaauucacc

SEQ ID NO: 2265659 - RNA, 15 nt, Yersinia pestis
ccuuugcuuucagga

SEQ ID NO: 2265660 - RNA, 16 nt, Yersinia pestis
ccuuugcuuucaggau

SEQ ID NO: 2265661 - RNA, 18 nt, Yersinia pestis
ccuuugcuuuucugccua

SEQ ID NO: 2265662 - RNA, 16 nt, Yersinia pestis
ccuuuaggaaagccca

SEQ ID NO: 2265663 - RNA, 17 nt, Yersinia pestis
ccuuuauguaguucagu

SEQ ID NO: 2265664 - RNA, 13 nt, Yersinia pestis
ccuuuacuccccu

SEQ ID NO: 2265665 - RNA, 22 nt, Yersinia pestis
cgaccaaauggacgaacagccc

SEQ ID NO: 2265666 - RNA, 22 nt, Yersinia pestis
cgacauuaagcauauccaacgc

SEQ ID NO: 2265667 - RNA, 17 nt, Yersinia pestis
cgaccaauucacgcagg

SEQ ID NO: 2265668 - RNA, 16 nt, Yersinia pestis
cgaccaauucaucagc

SEQ ID NO: 2265669 - RNA, 12 nt, Yersinia pestis
cgacccaaagcu

SEQ ID NO: 2265670 - RNA, 18 nt, Yersinia pestis
cgacccaaagcucuacac

SEQ ID NO: 2265671 - RNA, 14 nt, Yersinia pestis
cgacccacgccccu

SEQ ID NO: 2265672 - RNA, 16 nt, Yersinia pestis
cgaccaucacggucau

SEQ ID NO: 2265673 - RNA, 23 nt, Yersinia pestis
cgaccaucacggucaugcggccu

SEQ ID NO: 2265674 - RNA, 12 nt, Yersinia pestis
cgaccagcagaa

SEQ ID NO: 2265675 - RNA, 15 nt, Yersinia pestis
cgaccgcucuucaca

SEQ ID NO: 2265676 - RNA, 17 nt, Yersinia pestis
cgaccggcugauguucu

SEQ ID NO: 2265677 - RNA, 18 nt, Yersinia pestis
cgaccggggaucaauaaa

SEQ ID NO: 2265678 - RNA, 19 nt, Yersinia pestis
cgacccggcugcacgccau

SEQ ID NO: 2265679 - RNA, 13 nt, Yersinia pestis
cgacggagagaac

SEQ ID NO: 2265680 - RNA, 16 nt, Yersinia pestis
cgacgcgucacuucuc

SEQ ID NO: 2265681 - RNA, 13 nt, Yersinia pestis
cgacgccccacua

SEQ ID NO: 2265682 - RNA, 14 nt, Yersinia pestis
cgaauugaucugau

SEQ ID NO: 2265683 - RNA, 17 nt, Yersinia pestis
cgacaaauuuuuccuuu

SEQ ID NO: 2265684 - RNA, 20 nt, Yersinia pestis
cgacaauaccgccacacaau

SEQ ID NO: 2265685 - RNA, 17 nt, Yersinia pestis
cgacaccguugauugau

SEQ ID NO: 2265686 - RNA, 14 nt, Yersinia pestis
cgacaccaagaggc

SEQ ID NO: 2265687 - RNA, 14 nt, Yersinia pestis
cgacagccaaauca

SEQ ID NO: 2265688 - RNA, 23 nt, Yersinia pestis
cgacauagccggagguuuuucau

SEQ ID NO: 2265689 - RNA, 13 nt, Yersinia pestis
cgacagggacucc

SEQ ID NO: 2265690 - RNA, 17 nt, Yersinia pestis
cgaagaaaaacacuuua

SEQ ID NO: 2265691 - RNA, 17 nt, Yersinia pestis
ccuuuugcugcacugcu

SEQ ID NO: 2265692 - RNA, 21 nt, Yersinia pestis
cgaacguaaaaaguagauccc

SEQ ID NO: 2265693 - RNA, 20 nt, Yersinia pestis
cgaauauugcguuaccuaaa

SEQ ID NO: 2265694 - RNA, 17 nt, Yersinia pestis
cgaauauaguugaucua

SEQ ID NO: 2265695 - RNA, 18 nt, Yersinia pestis
cgaauaacucucaucuau

SEQ ID NO: 2265696 - RNA, 20 nt, Yersinia pestis
cgaauaaaaccuugcgccaa

SEQ ID NO: 2265697 - RNA, 12 nt, Yersinia pestis
cgaauaaaaccu

SEQ ID NO: 2265698 - RNA, 15 nt, Yersinia pestis
cgaauaaauaauugg

SEQ ID NO: 2265699 - RNA, 16 nt, Yersinia pestis
cgaaugagcaguaaua

SEQ ID NO: 2265700 - RNA, 22 nt, Yersinia pestis
cgaaugagcaguaauagcaaaa

SEQ ID NO: 2265701 - RNA, 12 nt, Yersinia pestis
cgaaugggucag

SEQ ID NO: 2265702 - RNA, 17 nt, Yersinia pestis
cgaauggccgcugcagg

SEQ ID NO: 2265703 - RNA, 23 nt, Yersinia pestis
cgaauuauuugggguauauauuu

SEQ ID NO: 2265704 - RNA, 19 nt, Yersinia pestis
cgaauuauuuuggaguaua

SEQ ID NO: 2265705 - RNA, 14 nt, Yersinia pestis
cgaauuauuuagag

SEQ ID NO: 2265706 - RNA, 16 nt, Yersinia pestis
cgaauuaauaaaaccu

SEQ ID NO: 2265707 - RNA, 20 nt, Yersinia pestis
ccuacaaccuaccaccuacc

SEQ ID NO: 2265708 - RNA, 22 nt, Yersinia pestis
ccuaaugaacacuuaauuccau

SEQ ID NO: 2265709 - RNA, 17 nt, Yersinia pestis
ccuaccaccuacaaccu

SEQ ID NO: 2265710 - RNA, 18 nt, Yersinia pestis
ccuaccaccuacaaccua

SEQ ID NO: 2265711 - RNA, 21 nt, Yersinia pestis
ccuaccaccuacaaccuacca

SEQ ID NO: 2265712 - RNA, 14 nt, Yersinia pestis
ccuaccaccuacca

SEQ ID NO: 2265713 - RNA, 23 nt, Yersinia pestis
ccuacauaaaaauagcuucccug

SEQ ID NO: 2265714 - RNA, 15 nt, Yersinia pestis
ccuacagaaaaauaa

SEQ ID NO: 2265715 - RNA, 12 nt, Yersinia pestis
ccuacugucaac

SEQ ID NO: 2265716 - RNA, 16 nt, Yersinia pestis
ccuacugacauuucuu

SEQ ID NO: 2265717 - RNA, 21 nt, Yersinia pestis
ccuacugauuggauaaaauau

SEQ ID NO: 2265718 - RNA, 15 nt, Yersinia pestis
ccuagcaaugagaca

SEQ ID NO: 2265719 - RNA, 15 nt, Yersinia pestis
ccuagccagccaccg

SEQ ID NO: 2265720 - RNA, 20 nt, Yersinia pestis
ccuaccugccugcugcugug

SEQ ID NO: 2265721 - RNA, 17 nt, Yersinia pestis
ccuaccgcaccaaugcc

SEQ ID NO: 2265722 - RNA, 15 nt, Yersinia pestis
ccuaccguucucugc

SEQ ID NO: 2265723 - RNA, 16 nt, Yersinia pestis
ccuaccguucucugcu

SEQ ID NO: 2265724 - RNA, 20 nt, Yersinia pestis
ccuacgguaccgcaggucag

SEQ ID NO: 2265725 - RNA, 21 nt, Yersinia pestis
ccuacgggaaauaacugguga

SEQ ID NO: 2265726 - RNA, 22 nt, Yersinia pestis
ccuaggcggugagggagucagg

SEQ ID NO: 2265727 - RNA, 15 nt, Yersinia pestis
ccuauccucaccguu

SEQ ID NO: 2265728 - RNA, 16 nt, Yersinia pestis
ccuauccacugugauu

SEQ ID NO: 2265729 - RNA, 14 nt, Yersinia pestis
ccuauacgcucuau

SEQ ID NO: 2265730 - RNA, 19 nt, Yersinia pestis
ccuauagcucagaaaauaa

SEQ ID NO: 2265731 - RNA, 23 nt, Yersinia pestis
ccuauuuucgcccuuaucuacug

SEQ ID NO: 2265732 - RNA, 23 nt, Yersinia pestis
ccuauuucagggcguauaaacag

SEQ ID NO: 2265733 - RNA, 14 nt, Yersinia pestis
ccuauuucaccgcu

SEQ ID NO: 2265734 - RNA, 14 nt, Yersinia pestis
ccucaauuuugccu

SEQ ID NO: 2265735 - RNA, 13 nt, Yersinia pestis
ccucacaagccac

SEQ ID NO: 2265736 - RNA, 13 nt, Yersinia pestis
ccucaaaaaccug

SEQ ID NO: 2265737 - RNA, 12 nt, Yersinia pestis
ccucaccauuua

SEQ ID NO: 2265738 - RNA, 20 nt, Yersinia pestis
ccuccuuggggccucacucu

SEQ ID NO: 2265739 - RNA, 18 nt, Yersinia pestis
ccuccuugagauccucca

SEQ ID NO: 2265740 - RNA, 18 nt, Yersinia pestis
ccuccugcggcggagcaa

SEQ ID NO: 2265741 - RNA, 16 nt, Yersinia pestis
ccuccagucccccuca

SEQ ID NO: 2265742 - RNA, 16 nt, Yersinia pestis
ccuccauucugcagau

SEQ ID NO: 2265743 - RNA, 16 nt, Yersinia pestis
ccuccggcgcccuucc

SEQ ID NO: 2265744 - RNA, 19 nt, Yersinia pestis
ccuccggcgcccuucccau

SEQ ID NO: 2265745 - RNA, 20 nt, Yersinia pestis
ccuccaacugagugagcgca

SEQ ID NO: 2265746 - RNA, 13 nt, Yersinia pestis
ccuccaagaugau

SEQ ID NO: 2265747 - RNA, 17 nt, Yersinia pestis
ccuccaagaugauaaau

SEQ ID NO: 2265748 - RNA, 13 nt, Yersinia pestis
aaacgcaacacag

SEQ ID NO: 2265749 - RNA, 21 nt, Yersinia pestis
ccucaucucaugacaaagaau

SEQ ID NO: 2265750 - RNA, 20 nt, Yersinia pestis
ccucagccucauucaugagg

SEQ ID NO: 2265751 - RNA, 20 nt, Yersinia pestis
ccucgaaaucauccgcggca

SEQ ID NO: 2265752 - RNA, 23 nt, Yersinia pestis
ccucgacaccaaaacucccuguu

SEQ ID NO: 2265753 - RNA, 23 nt, Yersinia pestis
ccuaaaaucauugacguuacaga

SEQ ID NO: 2265754 - RNA, 14 nt, Yersinia pestis
ccuaaaaaaaacaa

SEQ ID NO: 2265755 - RNA, 21 nt, Yersinia pestis
ccuaaagauaauuaauucaau

SEQ ID NO: 2265756 - RNA, 18 nt, Yersinia pestis
ccuaaagcgccuuccuuu

SEQ ID NO: 2265757 - RNA, 22 nt, Yersinia pestis
ccuaaacagcaacacaaaagcg

SEQ ID NO: 2265758 - RNA, 14 nt, Yersinia pestis
ccuaaaauuaucgc

SEQ ID NO: 2265759 - RNA, 23 nt, Yersinia pestis
ccuaaaauuaucgcaauuucaga

SEQ ID NO: 2265760 - RNA, 16 nt, Yersinia pestis
ccuaaaccccacagcg

SEQ ID NO: 2265761 - RNA, 23 nt, Yersinia pestis
ccguuuguaaccgacuugcccaa

SEQ ID NO: 2265762 - RNA, 20 nt, Yersinia pestis
ccuaauaaccgacagugcau

SEQ ID NO: 2265763 - RNA, 15 nt, Yersinia pestis
ccuaauaccaauacc

SEQ ID NO: 2265764 - RNA, 19 nt, Yersinia pestis
ccuaauaucauguucuuug

SEQ ID NO: 2265765 - RNA, 20 nt, Yersinia pestis
ccuaauauccucaaaauucg

SEQ ID NO: 2265766 - RNA, 18 nt, Yersinia pestis
ccuaacuggcgguuauug

SEQ ID NO: 2265767 - RNA, 20 nt, Yersinia pestis
ccuaacgccaaaauguagua

SEQ ID NO: 2265768 - RNA, 23 nt, Yersinia pestis
ccuaacgccguggugaaaaauga

SEQ ID NO: 2265769 - RNA, 12 nt, Yersinia pestis
ccuaaccgcugu

SEQ ID NO: 2265770 - RNA, 18 nt, Yersinia pestis
ccuaacaacugccgccau

SEQ ID NO: 2265771 - RNA, 20 nt, Yersinia pestis
ccuaacacguuaaauuucuu

SEQ ID NO: 2265772 - RNA, 22 nt, Yersinia pestis
ccuaaauccugcaaugcauaag

SEQ ID NO: 2265773 - RNA, 15 nt, Yersinia pestis
ccuaacaaacugaau

SEQ ID NO: 2265774 - RNA, 15 nt, Yersinia pestis
ccuaaauaauuccag

SEQ ID NO: 2265775 - RNA, 18 nt, Yersinia pestis
ccguucuaguagugggca

SEQ ID NO: 2265776 - RNA, 19 nt, Yersinia pestis
ccguuguguaucagcaacu

SEQ ID NO: 2265777 - RNA, 14 nt, Yersinia pestis
ccguugccugugcg

SEQ ID NO: 2265778 - RNA, 14 nt, Yersinia pestis
ccguuacugcaucu

SEQ ID NO: 2265779 - RNA, 21 nt, Yersinia pestis
ccguuauagaucuccugcaac

SEQ ID NO: 2265780 - RNA, 17 nt, Yersinia pestis
ccguuaauggcaccauc

SEQ ID NO: 2265781 - RNA, 13 nt, Yersinia pestis
ccguucacccuuu

SEQ ID NO: 2265782 - RNA, 14 nt, Yersinia pestis
ccguucaauaauag

SEQ ID NO: 2265783 - RNA, 13 nt, Yersinia pestis
ccguuccaaccgg

SEQ ID NO: 2265784 - RNA, 15 nt, Yersinia pestis
ccgguugagugagac

SEQ ID NO: 2265785 - RNA, 17 nt, Yersinia pestis
ccgguucggauucuguu

SEQ ID NO: 2265786 - RNA, 20 nt, Yersinia pestis
ccgguucauuuagcagcgca

SEQ ID NO: 2265787 - RNA, 15 nt, Yersinia pestis
ccgucgacuguaaca

SEQ ID NO: 2265788 - RNA, 23 nt, Yersinia pestis
aaacgaguuuccaguucaagaua

SEQ ID NO: 2265789 - RNA, 16 nt, Yersinia pestis
aaacgacgggcugcug

SEQ ID NO: 2265790 - RNA, 16 nt, Yersinia pestis
ccgucgucacuuugac

SEQ ID NO: 2265791 - RNA, 23 nt, Yersinia pestis
ccgugccaggugugcccaacaac

SEQ ID NO: 2265792 - RNA, 14 nt, Yersinia pestis
ccgugcacccggcc

SEQ ID NO: 2265793 - RNA, 17 nt, Yersinia pestis
ccguggauaaacaaaua

SEQ ID NO: 2265794 - RNA, 18 nt, Yersinia pestis
ccguggauauccacauca

SEQ ID NO: 2265795 - RNA, 22 nt, Yersinia pestis
ccguggcgcggaugcuuuauuc

SEQ ID NO: 2265796 - RNA, 16 nt, Yersinia pestis
ccgugguuauugcgcc

SEQ ID NO: 2265797 - RNA, 23 nt, Yersinia pestis
ccguguccggguuuacccagcca

SEQ ID NO: 2265798 - RNA, 17 nt, Yersinia pestis
ccggcaucaaccaagac

SEQ ID NO: 2265799 - RNA, 15 nt, Yersinia pestis
ccggcacuaaaaucu

SEQ ID NO: 2265800 - RNA, 15 nt, Yersinia pestis
ccggcaccuucaacg

SEQ ID NO: 2265801 - RNA, 16 nt, Yersinia pestis
ccggcaaucgcuucca

SEQ ID NO: 2265802 - RNA, 20 nt, Yersinia pestis
ccggcgaagggcgcagcccc

SEQ ID NO: 2265803 - RNA, 17 nt, Yersinia pestis
ccgcuuaucccuccauc

SEQ ID NO: 2265804 - RNA, 19 nt, Yersinia pestis
ccgcuucgcgcccgcccca

SEQ ID NO: 2265805 - RNA, 17 nt, Yersinia pestis
ccgcuucgcgcccgccc

SEQ ID NO: 2265806 - RNA, 17 nt, Yersinia pestis
ccgcuguaggugucacc

SEQ ID NO: 2265807 - RNA, 21 nt, Yersinia pestis
ccgccucuuuuuccacacccu

SEQ ID NO: 2265808 - RNA, 21 nt, Yersinia pestis
ccggacauaaugcauccacuu

SEQ ID NO: 2265809 - RNA, 18 nt, Yersinia pestis
ccggcaacacgaugccag

SEQ ID NO: 2265810 - RNA, 14 nt, Yersinia pestis
ccggauuccaccug

SEQ ID NO: 2265811 - RNA, 17 nt, Yersinia pestis
ccggauggucacccuuu

SEQ ID NO: 2265812 - RNA, 16 nt, Yersinia pestis
ccggaugcaucgggca

SEQ ID NO: 2265813 - RNA, 21 nt, Yersinia pestis
ccggauagggggcaaccauau

SEQ ID NO: 2265814 - RNA, 20 nt, Yersinia pestis
ccggaucgcgacgaaaaccu

SEQ ID NO: 2265815 - RNA, 19 nt, Yersinia pestis
ccggcgugaguuccagccc

SEQ ID NO: 2265816 - RNA, 23 nt, Yersinia pestis
aaaccgcuauaucaucagcagag

SEQ ID NO: 2265817 - RNA, 17 nt, Yersinia pestis
ccggcuaacgaggcaua

SEQ ID NO: 2265818 - RNA, 16 nt, Yersinia pestis
ccggcgguuaucacau

SEQ ID NO: 2265819 - RNA, 20 nt, Yersinia pestis
ccggcgguuaucacaucauc

SEQ ID NO: 2265820 - RNA, 13 nt, Yersinia pestis
aaaccuaaaccuu

SEQ ID NO: 2265821 - RNA, 19 nt, Yersinia pestis
ccggcugcaauaagccaga

SEQ ID NO: 2265822 - RNA, 14 nt, Yersinia pestis
aaaccuaaugccag

SEQ ID NO: 2265823 - RNA, 15 nt, Yersinia pestis
ccgggcgaacagaaa

SEQ ID NO: 2265824 - RNA, 21 nt, Yersinia pestis
ccggucguauucagcacugcc

SEQ ID NO: 2265825 - RNA, 17 nt, Yersinia pestis
ccggucgcguaccuuca

SEQ ID NO: 2265826 - RNA, 22 nt, Yersinia pestis
ccgguauucagccaaaucauca

SEQ ID NO: 2265827 - RNA, 22 nt, Yersinia pestis
aaacauuguuaccuaaccaaac

SEQ ID NO: 2265828 - RNA, 13 nt, Yersinia pestis
aaacauuggcuuu

SEQ ID NO: 2265829 - RNA, 12 nt, Yersinia pestis
aaaccacgcggu

SEQ ID NO: 2265830 - RNA, 15 nt, Yersinia pestis
aaaccacgcgguugg

SEQ ID NO: 2265831 - RNA, 19 nt, Yersinia pestis
aaaccaccugaccuagcaa

SEQ ID NO: 2265832 - RNA, 22 nt, Yersinia pestis
aaacauuucauuccagauaaaa

SEQ ID NO: 2265833 - RNA, 15 nt, Yersinia pestis
aaaccacugcgguca

SEQ ID NO: 2265834 - RNA, 15 nt, Yersinia pestis
aaaccacuguuuuuc

SEQ ID NO: 2265835 - RNA, 14 nt, Yersinia pestis
ccgagcaaucaaaa

SEQ ID NO: 2265836 - RNA, 16 nt, Yersinia pestis
ccgagcaaucaaaagg

SEQ ID NO: 2265837 - RNA, 22 nt, Yersinia pestis
cccuuuuugaaucaagcauuca

SEQ ID NO: 2265838 - RNA, 19 nt, Yersinia pestis
cccuuuuugguuuucuauu

SEQ ID NO: 2265839 - RNA, 20 nt, Yersinia pestis
cccuuaugaguacuauuuuu

SEQ ID NO: 2265840 - RNA, 19 nt, Yersinia pestis
cccuuauccguuaacccaa

SEQ ID NO: 2265841 - RNA, 12 nt, Yersinia pestis
cccuuacccugg

SEQ ID NO: 2265842 - RNA, 17 nt, Yersinia pestis
aaacagcacuaucccca

SEQ ID NO: 2265843 - RNA, 17 nt, Yersinia pestis
cccuucagucaguaggc

SEQ ID NO: 2265844 - RNA, 23 nt, Yersinia pestis
aaacagaucacccgcaaaacuga

SEQ ID NO: 2265845 - RNA, 11 nt, Yersinia pestis
cccuucaguca

SEQ ID NO: 2265846 - RNA, 23 nt, Yersinia pestis
aaacagauacaucgccaguguug

SEQ ID NO: 2265847 - RNA, 22 nt, Yersinia pestis
aaacagauauuuucggguaucu

SEQ ID NO: 2265848 - RNA, 22 nt, Yersinia pestis
ccgaaagcgccugugggcggcu

SEQ ID NO: 2265849 - RNA, 18 nt, Yersinia pestis
aaacaucaugacaaaaau

SEQ ID NO: 2265850 - RNA, 23 nt, Yersinia pestis
aaacaucaucccuauagacaaua

SEQ ID NO: 2265851 - RNA, 14 nt, Yersinia pestis
aaacaucaugacaa

SEQ ID NO: 2265852 - RNA, 16 nt, Yersinia pestis
ccgaacucgucauuca

SEQ ID NO: 2265853 - RNA, 16 nt, Yersinia pestis
ccgaacugauacccac

SEQ ID NO: 2265854 - RNA, 19 nt, Yersinia pestis
ccgaacugauacccacucg

SEQ ID NO: 2265855 - RNA, 21 nt, Yersinia pestis
ccgaauaauaaauauccuccg

SEQ ID NO: 2265856 - RNA, 13 nt, Yersinia pestis
ccgaauaaaaccu

SEQ ID NO: 2265857 - RNA, 21 nt, Yersinia pestis
ccgaaucacuuaccugaguaa

SEQ ID NO: 2265858 - RNA, 17 nt, Yersinia pestis
aaacaucgacaccaaga

SEQ ID NO: 2265859 - RNA, 16 nt, Yersinia pestis
cccguucuaguagugg

SEQ ID NO: 2265860 - RNA, 12 nt, Yersinia pestis
cccguuccuuca

SEQ ID NO: 2265861 - RNA, 15 nt, Yersinia pestis
cccguuacugcaucu

SEQ ID NO: 2265862 - RNA, 13 nt, Yersinia pestis
cccgugucacuua

SEQ ID NO: 2265863 - RNA, 18 nt, Yersinia pestis
cccguguuagcaucugau

SEQ ID NO: 2265864 - RNA, 15 nt, Yersinia pestis
cccgugcuuugccuu

SEQ ID NO: 2265865 - RNA, 18 nt, Yersinia pestis
cccuauaggcucaaugcg

SEQ ID NO: 2265866 - RNA, 15 nt, Yersinia pestis
cccuagccagccacc

SEQ ID NO: 2265867 - RNA, 22 nt, Yersinia pestis
cccuagccagccaccgcacacu

SEQ ID NO: 2265868 - RNA, 18 nt, Yersinia pestis
cccuaaauaauaucuguc

SEQ ID NO: 2265869 - RNA, 18 nt, Yersinia pestis
cccuaaacagcaacacaa

SEQ ID NO: 2265870 - RNA, 16 nt, Yersinia pestis
cccuaauaucauguuc

SEQ ID NO: 2265871 - RNA, 16 nt, Yersinia pestis
cccggcucauccgcca

SEQ ID NO: 2265872 - RNA, 23 nt, Yersinia pestis
cccgguaagcgguauccaccuuc

SEQ ID NO: 2265873 - RNA, 13 nt, Yersinia pestis
cccggugcggcua

SEQ ID NO: 2265874 - RNA, 20 nt, Yersinia pestis
cccggugaucaucgcaccau

SEQ ID NO: 2265875 - RNA, 20 nt, Yersinia pestis
cccugauccacuacuuauuu

SEQ ID NO: 2265876 - RNA, 20 nt, Yersinia pestis
cccugaguuaucuguuucaa

SEQ ID NO: 2265877 - RNA, 14 nt, Yersinia pestis
cccugacucccuca

SEQ ID NO: 2265878 - RNA, 14 nt, Yersinia pestis
cccugacucccuga

SEQ ID NO: 2265879 - RNA, 21 nt, Yersinia pestis
cccugacgaaauuuaagaaau

SEQ ID NO: 2265880 - RNA, 16 nt, Yersinia pestis
cccugaacucaucagc

SEQ ID NO: 2265881 - RNA, 18 nt, Yersinia pestis
cccugcugauaauuuauu

SEQ ID NO: 2265882 - RNA, 21 nt, Yersinia pestis
cccugcgguauccuuagccaa

SEQ ID NO: 2265883 - RNA, 22 nt, Yersinia pestis
cccugccagaaucagccccaag

SEQ ID NO: 2265884 - RNA, 14 nt, Yersinia pestis
cccucagccaaagc

SEQ ID NO: 2265885 - RNA, 12 nt, Yersinia pestis
cccucaauaccg

SEQ ID NO: 2265886 - RNA, 14 nt, Yersinia pestis
cccucaaugacgcg

SEQ ID NO: 2265887 - RNA, 15 nt, Yersinia pestis
cccucacaagccacg

SEQ ID NO: 2265888 - RNA, 16 nt, Yersinia pestis
cccucauuuuacccga

SEQ ID NO: 2265889 - RNA, 22 nt, Yersinia pestis
cccucauuuucgaacuuaacua

SEQ ID NO: 2265890 - RNA, 17 nt, Yersinia pestis
cccuccaauaacuaaca

SEQ ID NO: 2265891 - RNA, 14 nt, Yersinia pestis
cccucgacaccaaa

SEQ ID NO: 2265892 - RNA, 15 nt, Yersinia pestis
cccucucauccugcu

SEQ ID NO: 2265893 - RNA, 20 nt, Yersinia pestis
aaacccauaaguccuuaaaa

SEQ ID NO: 2265894 - RNA, 17 nt, Yersinia pestis
aaacccauagcaaagau

SEQ ID NO: 2265895 - RNA, 21 nt, Yersinia pestis
aaaccauuuuacuaaaccagu

SEQ ID NO: 2265896 - RNA, 14 nt, Yersinia pestis
aaacccaaccccau

SEQ ID NO: 2265897 - RNA, 20 nt, Yersinia pestis
aaaccccacccugugaaaua

SEQ ID NO: 2265898 - RNA, 17 nt, Yersinia pestis
aaacccauuaaaaacaa

SEQ ID NO: 2265899 - RNA, 19 nt, Yersinia pestis
aaacccgcgcagccuaaaa

SEQ ID NO: 2265900 - RNA, 13 nt, Yersinia pestis
ccgcccguagaaa

SEQ ID NO: 2265901 - RNA, 21 nt, Yersinia pestis
ccgcccccaauaagggccacc

SEQ ID NO: 2265902 - RNA, 14 nt, Yersinia pestis
ccgccccccauccc

SEQ ID NO: 2265903 - RNA, 19 nt, Yersinia pestis
ccgccgucaaaccaagccc

SEQ ID NO: 2265904 - RNA, 23 nt, Yersinia pestis
ccgccgccaacagugaauaacug

SEQ ID NO: 2265905 - RNA, 20 nt, Yersinia pestis
ccgccgcaggccauuacccu

SEQ ID NO: 2265906 - RNA, 14 nt, Yersinia pestis
ccgccgccagcccc

SEQ ID NO: 2265907 - RNA, 22 nt, Yersinia pestis
aaaccagaugaucugaugauca

SEQ ID NO: 2265908 - RNA, 19 nt, Yersinia pestis
aaaccaucgcucuccugcc

SEQ ID NO: 2265909 - RNA, 19 nt, Yersinia pestis
ccgccagguuuacuggcgg

SEQ ID NO: 2265910 - RNA, 15 nt, Yersinia pestis
ccgccaguaaaccug

SEQ ID NO: 2265911 - RNA, 17 nt, Yersinia pestis
ccgccaguaaaccuggc

SEQ ID NO: 2265912 - RNA, 15 nt, Yersinia pestis
ccgccaguaacuggc

SEQ ID NO: 2265913 - RNA, 16 nt, Yersinia pestis
ccgccaguaacuggcc

SEQ ID NO: 2265914 - RNA, 21 nt, Yersinia pestis
ccgccacacaauacauagaag

SEQ ID NO: 2265915 - RNA, 14 nt, Yersinia pestis
ccgccagccccgcu

SEQ ID NO: 2265916 - RNA, 20 nt, Yersinia pestis
ccgccagccuugugcuucau

SEQ ID NO: 2265917 - RNA, 12 nt, Yersinia pestis
ccgccagcaagu

SEQ ID NO: 2265918 - RNA, 15 nt, Yersinia pestis
ccgccagcagaacca

SEQ ID NO: 2265919 - RNA, 19 nt, Yersinia pestis
ccgccacuuuaacugcacc

SEQ ID NO: 2265920 - RNA, 19 nt, Yersinia pestis
ccgccagauuauccagccc

SEQ ID NO: 2265921 - RNA, 16 nt, Yersinia pestis
ccgcaugcaacagaua

SEQ ID NO: 2265922 - RNA, 16 nt, Yersinia pestis
ccgcaucgugcuccgc

SEQ ID NO: 2265923 - RNA, 22 nt, Yersinia pestis
ccgcagacugaaauaaugguuu

SEQ ID NO: 2265924 - RNA, 22 nt, Yersinia pestis
ccgcagcggcuagcagcagguu

SEQ ID NO: 2265925 - RNA, 13 nt, Yersinia pestis
ccgcaggaagcaa

SEQ ID NO: 2265926 - RNA, 11 nt, Yersinia pestis
ccgcaguccaa

SEQ ID NO: 2265927 - RNA, 18 nt, Yersinia pestis
ccgauuucagcaccauaa

SEQ ID NO: 2265928 - RNA, 16 nt, Yersinia pestis
ccgauuuaaacccucu

SEQ ID NO: 2265929 - RNA, 16 nt, Yersinia pestis
ccgcaauaucaaugaa

SEQ ID NO: 2265930 - RNA, 22 nt, Yersinia pestis
ccgcaauaucaaugaaaaaaag

SEQ ID NO: 2265931 - RNA, 16 nt, Yersinia pestis
ccauauuacucacaca

SEQ ID NO: 2265932 - RNA, 17 nt, Yersinia pestis
ccaucaggucaguaaug

SEQ ID NO: 2265933 - RNA, 18 nt, Yersinia pestis
ccauccgguuuuaaauua

SEQ ID NO: 2265934 - RNA, 21 nt, Yersinia pestis
ccaucgccccuguaguucauc

SEQ ID NO: 2265935 - RNA, 15 nt, Yersinia pestis
ccaucgcgccuaccu

SEQ ID NO: 2265936 - RNA, 19 nt, Yersinia pestis
ccauccauauuuggcaugu

SEQ ID NO: 2265937 - RNA, 17 nt, Yersinia pestis
ccaugccagcccaucac

SEQ ID NO: 2265938 - RNA, 21 nt, Yersinia pestis
ccaugagaauacuucaggcca

SEQ ID NO: 2265939 - RNA, 18 nt, Yersinia pestis
ccaugagaaccaguucug

SEQ ID NO: 2265940 - RNA, 13 nt, Yersinia pestis
ccauggccgccag

SEQ ID NO: 2265941 - RNA, 22 nt, Yersinia pestis
ccaucuugggccgacucugcau

SEQ ID NO: 2265942 - RNA, 20 nt, Yersinia pestis
ccaucuuguucuaauaauaa

SEQ ID NO: 2265943 - RNA, 20 nt, Yersinia pestis
ccaucuugucgucacccauu

SEQ ID NO: 2265944 - RNA, 20 nt, Yersinia pestis
ccaucguauauccaccgauu

SEQ ID NO: 2265945 - RNA, 16 nt, Yersinia pestis
ccaucgucagccccug

SEQ ID NO: 2265946 - RNA, 12 nt, Yersinia pestis
ccauugccagaa

SEQ ID NO: 2265947 - RNA, 19 nt, Yersinia pestis
ccauuucuuauaucuguuu

SEQ ID NO: 2265948 - RNA, 17 nt, Yersinia pestis
ccauuuuauccucuucc

SEQ ID NO: 2265949 - RNA, 19 nt, Yersinia pestis
ccauuuuauuuaacguguu

SEQ ID NO: 2265950 - RNA, 18 nt, Yersinia pestis
ccauuuucaauaccauau

SEQ ID NO: 2265951 - RNA, 18 nt, Yersinia pestis
ccauuuuuauaucagauu

SEQ ID NO: 2265952 - RNA, 20 nt, Yersinia pestis
ccauuuuuauaucagauuca

SEQ ID NO: 2265953 - RNA, 20 nt, Yersinia pestis
cccaaccgaccaaaggccaa

SEQ ID NO: 2265954 - RNA, 16 nt, Yersinia pestis
cccaagauacuggaag

SEQ ID NO: 2265955 - RNA, 13 nt, Yersinia pestis
ccauuaacaauau

SEQ ID NO: 2265956 - RNA, 23 nt, Yersinia pestis
ccauuaacaauguuauauuucuu

SEQ ID NO: 2265957 - RNA, 17 nt, Yersinia pestis
ccauuaaccuaaaaacg

SEQ ID NO: 2265958 - RNA, 24 nt, Yersinia pestis
ccauguuggguaaaccaaucaagc

SEQ ID NO: 2265959 - RNA, 23 nt, Yersinia pestis
ccauuacgcaacguaauaucugc

SEQ ID NO: 2265960 - RNA, 17 nt, Yersinia pestis
ccauuacuguccuuuaa

SEQ ID NO: 2265961 - RNA, 22 nt, Yersinia pestis
ccauucgcaggccagacccauu

SEQ ID NO: 2265962 - RNA, 21 nt, Yersinia pestis
ccauucggcacugcaucugac

SEQ ID NO: 2265963 - RNA, 17 nt, Yersinia pestis
ccaugucgaucauggca

SEQ ID NO: 2265964 - RNA, 23 nt, Yersinia pestis
ccauguugaguuuacgcagugcu

SEQ ID NO: 2265965 - RNA, 13 nt, Yersinia pestis
ccauguucuucaa

SEQ ID NO: 2265966 - RNA, 21 nt, Yersinia pestis
ccaugguuacgccagcagcau

SEQ ID NO: 2265967 - RNA, 15 nt, Yersinia pestis
ccauggcuucugcuu

SEQ ID NO: 2265968 - RNA, 17 nt, Yersinia pestis
ccauggcucaccauaaa

SEQ ID NO: 2265969 - RNA, 14 nt, Yersinia pestis
ccauggcuaacaua

SEQ ID NO: 2265970 - RNA, 14 nt, Yersinia pestis
ccagguaagaaaga

SEQ ID NO: 2265971 - RNA, 19 nt, Yersinia pestis
ccagguucuaccgcuagau

SEQ ID NO: 2265972 - RNA, 21 nt, Yersinia pestis
ccaggugcuuauuuauuuuua

SEQ ID NO: 2265973 - RNA, 17 nt, Yersinia pestis
ccaguaagcuguugacc

SEQ ID NO: 2265974 - RNA, 13 nt, Yersinia pestis
ccaguacagugaa

SEQ ID NO: 2265975 - RNA, 22 nt, Yersinia pestis
ccaguaauaccuuaauggcuuu

SEQ ID NO: 2265976 - RNA, 15 nt, Yersinia pestis
ccaguaggggccacc

SEQ ID NO: 2265977 - RNA, 22 nt, Yersinia pestis
ccaguaggggccaccaaauaaa

SEQ ID NO: 2265978 - RNA, 15 nt, Yersinia pestis
ccaguagcccagccg

SEQ ID NO: 2265979 - RNA, 13 nt, Yersinia pestis
ccagucauucacc

SEQ ID NO: 2265980 - RNA, 13 nt, Yersinia pestis
ccaguaugguuuc

SEQ ID NO: 2265981 - RNA, 21 nt, Yersinia pestis
ccagucacuaccgcucagaua

SEQ ID NO: 2265982 - RNA, 18 nt, Yersinia pestis
ccagucgucuucagcuuc

SEQ ID NO: 2265983 - RNA, 17 nt, Yersinia pestis
ccagucucuuugccaag

SEQ ID NO: 2265984 - RNA, 16 nt, Yersinia pestis
ccagugauaaaugcua

SEQ ID NO: 2265985 - RNA, 20 nt, Yersinia pestis
ccagugcaaaaugcucuuca

SEQ ID NO: 2265986 - RNA, 14 nt, Yersinia pestis
ccagugcaaauuua

SEQ ID NO: 2265987 - RNA, 12 nt, Yersinia pestis
ccagugccaauc

SEQ ID NO: 2265988 - RNA, 19 nt, Yersinia pestis
ccagugccaauccccacca

SEQ ID NO: 2265989 - RNA, 16 nt, Yersinia pestis
ccaguucaacaccaag

SEQ ID NO: 2265990 - RNA, 14 nt, Yersinia pestis
ccaguucaguccag

SEQ ID NO: 2265991 - RNA, 12 nt, Yersinia pestis
ccauacaaauag

SEQ ID NO: 2265992 - RNA, 14 nt, Yersinia pestis
ccauacaguuaauu

SEQ ID NO: 2265993 - RNA, 18 nt, Yersinia pestis
ccauacaguuaauuucaa

SEQ ID NO: 2265994 - RNA, 12 nt, Yersinia pestis
ccauaaaaggau

SEQ ID NO: 2265995 - RNA, 17 nt, Yersinia pestis
ccauaaaauaaauaauu

SEQ ID NO: 2265996 - RNA, 16 nt, Yersinia pestis
ccaguuuuuuccugcu

SEQ ID NO: 2265997 - RNA, 20 nt, Yersinia pestis
ccauaaaaacuucagagcca

SEQ ID NO: 2265998 - RNA, 18 nt, Yersinia pestis
ccauaauuaauuauucaa

SEQ ID NO: 2265999 - RNA, 20 nt, Yersinia pestis
cccauaagcgggguauuuua

SEQ ID NO: 2266000 - RNA, 21 nt, Yersinia pestis
cccaguuuuuaauuuaaacuc

SEQ ID NO: 2266001 - RNA, 23 nt, Yersinia pestis
aaacaauuuugguacagguguug

SEQ ID NO: 2266002 - RNA, 11 nt, Yersinia pestis
aaacaauguga

SEQ ID NO: 2266003 - RNA, 23 nt, Yersinia pestis
aaacaaugugauaccuaaaccuu

SEQ ID NO: 2266004 - RNA, 11 nt, Yersinia pestis
cccauaacaau

SEQ ID NO: 2266005 - RNA, 12 nt, Yersinia pestis
cccaucaccauu

SEQ ID NO: 2266006 - RNA, 15 nt, Yersinia pestis
cccaucagcacuccc

SEQ ID NO: 2266007 - RNA, 15 nt, Yersinia pestis
cccaucagcaucaau

SEQ ID NO: 2266008 - RNA, 16 nt, Yersinia pestis
cccauccgcaggaagc

SEQ ID NO: 2266009 - RNA, 14 nt, Yersinia pestis
cccauccuguucaa

SEQ ID NO: 2266010 - RNA, 21 nt, Yersinia pestis
cccaucgaacgcgucacuggc

SEQ ID NO: 2266011 - RNA, 18 nt, Yersinia pestis
cccagguuacugcccugg

SEQ ID NO: 2266012 - RNA, 20 nt, Yersinia pestis
cccagucgucuucagcuucc

SEQ ID NO: 2266013 - RNA, 18 nt, Yersinia pestis
cccagugcguacgccaac

SEQ ID NO: 2266014 - RNA, 19 nt, Yersinia pestis
cccaggugcuuauuuauuu

SEQ ID NO: 2266015 - RNA, 13 nt, Yersinia pestis
cccaggccuccgc

SEQ ID NO: 2266016 - RNA, 21 nt, Yersinia pestis
cccagccgggguaucauagaa

SEQ ID NO: 2266017 - RNA, 18 nt, Yersinia pestis
cccacuuguaccugugcc

SEQ ID NO: 2266018 - RNA, 19 nt, Yersinia pestis
cccacuuguaccugugcca

SEQ ID NO: 2266019 - RNA, 22 nt, Yersinia pestis
cccaaggguauaacucaucagu

SEQ ID NO: 2266020 - RNA, 23 nt, Yersinia pestis
cccaaggguauaacucaucagua

SEQ ID NO: 2266021 - RNA, 14 nt, Yersinia pestis
cccaggcaaucucu

SEQ ID NO: 2266022 - RNA, 14 nt, Yersinia pestis
ccccuuuuuucuau

SEQ ID NO: 2266023 - RNA, 21 nt, Yersinia pestis
cccgacagaacugauuucagg

SEQ ID NO: 2266024 - RNA, 14 nt, Yersinia pestis
ccccguauaacgca

SEQ ID NO: 2266025 - RNA, 18 nt, Yersinia pestis
ccccguccagcccaccau

SEQ ID NO: 2266026 - RNA, 13 nt, Yersinia pestis
cccgcaaagccug

SEQ ID NO: 2266027 - RNA, 15 nt, Yersinia pestis
cccgaguaagcgcug

SEQ ID NO: 2266028 - RNA, 14 nt, Yersinia pestis
cccgcacgcccaua

SEQ ID NO: 2266029 - RNA, 16 nt, Yersinia pestis
cccgccaguaaaccug

SEQ ID NO: 2266030 - RNA, 20 nt, Yersinia pestis
cccgccaguaaaccuggcgg

SEQ ID NO: 2266031 - RNA, 17 nt, Yersinia pestis
ccccagccggugucacu

SEQ ID NO: 2266032 - RNA, 18 nt, Yersinia pestis
ccccaucaauuuccccaa

SEQ ID NO: 2266033 - RNA, 14 nt, Yersinia pestis
ccccauccguccaa

SEQ ID NO: 2266034 - RNA, 22 nt, Yersinia pestis
cccccagcggugaucgcugcca

SEQ ID NO: 2266035 - RNA, 24 nt, Yersinia pestis
cccccagcguuguucuaauacuga

SEQ ID NO: 2266036 - RNA, 11 nt, Yersinia pestis
cccccagugcu

SEQ ID NO: 2266037 - RNA, 12 nt, Yersinia pestis
cccccaucccca

SEQ ID NO: 2266038 - RNA, 17 nt, Yersinia pestis
ccccgccucaaugcaac

SEQ ID NO: 2266039 - RNA, 18 nt, Yersinia pestis
ccccgcgauguaaauauc

SEQ ID NO: 2266040 - RNA, 23 nt, Yersinia pestis
cccauggugauaaagguguagug

SEQ ID NO: 2266041 - RNA, 15 nt, Yersinia pestis
ccccacaucaggccg

SEQ ID NO: 2266042 - RNA, 19 nt, Yersinia pestis
cgcuugcaggucugcaugg

SEQ ID NO: 2266043 - RNA, 18 nt, Yersinia pestis
cgcuuggugaugcugcug

SEQ ID NO: 2266044 - RNA, 21 nt, Yersinia pestis
cggcacgcguugguuguccug

SEQ ID NO: 2266045 - RNA, 19 nt, Yersinia pestis
cggcagcgagcacugcccc

SEQ ID NO: 2266046 - RNA, 17 nt, Yersinia pestis
cggcagauaugccaggc

SEQ ID NO: 2266047 - RNA, 22 nt, Yersinia pestis
cggcagguuaaaguugauaaag

SEQ ID NO: 2266048 - RNA, 18 nt, Yersinia pestis
cggcauacuccauuuuuu

SEQ ID NO: 2266049 - RNA, 17 nt, Yersinia pestis
cggcauacuccauuuuu

SEQ ID NO: 2266050 - RNA, 20 nt, Yersinia pestis
cggcagugaucgcacuucaa

SEQ ID NO: 2266051 - RNA, 20 nt, Yersinia pestis
cggcagcgagcacugccccg

SEQ ID NO: 2266052 - RNA, 15 nt, Yersinia pestis
cggcaucuuuugcua

SEQ ID NO: 2266053 - RNA, 17 nt, Yersinia pestis
cggcauccucagggcga

SEQ ID NO: 2266054 - RNA, 20 nt, Yersinia pestis
cggccaacugcuggccaacu

SEQ ID NO: 2266055 - RNA, 14 nt, Yersinia pestis
cggcauuagugaau

SEQ ID NO: 2266056 - RNA, 12 nt, Yersinia pestis
cggccaucccag

SEQ ID NO: 2266057 - RNA, 18 nt, Yersinia pestis
cggccaucuaacugcaca

SEQ ID NO: 2266058 - RNA, 16 nt, Yersinia pestis
cggccagcauucaggc

SEQ ID NO: 2266059 - RNA, 16 nt, Yersinia pestis
cggccacccgccauca

SEQ ID NO: 2266060 - RNA, 23 nt, Yersinia pestis
cggccaugucaggccaccaauca

SEQ ID NO: 2266061 - RNA, 12 nt, Yersinia pestis
cggccccagccc

SEQ ID NO: 2266062 - RNA, 15 nt, Yersinia pestis
cggcgagcacugccc

SEQ ID NO: 2266063 - RNA, 16 nt, Yersinia pestis
cggcgaaauauaaaac

SEQ ID NO: 2266064 - RNA, 21 nt, Yersinia pestis
cggcgcgcuugccacgccagu

SEQ ID NO: 2266065 - RNA, 20 nt, Yersinia pestis
cggcgguaaccccggcggcu

SEQ ID NO: 2266066 - RNA, 14 nt, Yersinia pestis
cggcgguauacaga

SEQ ID NO: 2266067 - RNA, 20 nt, Yersinia pestis
cggcgcugacuggcaggaaa

SEQ ID NO: 2266068 - RNA, 22 nt, Yersinia pestis
cggcggcgcuggcguaaaauau

SEQ ID NO: 2266069 - RNA, 17 nt, Yersinia pestis
cggcggcgagcacugcc

SEQ ID NO: 2266070 - RNA, 19 nt, Yersinia pestis
cggcggcgagcacugcccc

SEQ ID NO: 2266071 - RNA, 20 nt, Yersinia pestis
cgauuaaaauaaagcgaguu

SEQ ID NO: 2266072 - RNA, 16 nt, Yersinia pestis
cgauuaggacaaauag

SEQ ID NO: 2266073 - RNA, 18 nt, Yersinia pestis
cgauuaccugcauauccu

SEQ ID NO: 2266074 - RNA, 14 nt, Yersinia pestis
cgauuuaugaaccg

SEQ ID NO: 2266075 - RNA, 13 nt, Yersinia pestis
cgaugucaauaaa

SEQ ID NO: 2266076 - RNA, 18 nt, Yersinia pestis
cgaucugauaucucuuua

SEQ ID NO: 2266077 - RNA, 20 nt, Yersinia pestis
cgaugaccgugacauuuuca

SEQ ID NO: 2266078 - RNA, 19 nt, Yersinia pestis
cgaugaccauuuauuucca

SEQ ID NO: 2266079 - RNA, 14 nt, Yersinia pestis
cgaugaaaaacaga

SEQ ID NO: 2266080 - RNA, 16 nt, Yersinia pestis
cgaucuugaacgguga

SEQ ID NO: 2266081 - RNA, 12 nt, Yersinia pestis
cgaucaacagug

SEQ ID NO: 2266082 - RNA, 18 nt, Yersinia pestis
cgaucaacccgcagacug

SEQ ID NO: 2266083 - RNA, 16 nt, Yersinia pestis
cgaucacaugcucagu

SEQ ID NO: 2266084 - RNA, 16 nt, Yersinia pestis
cgaucagcaauaugcu

SEQ ID NO: 2266085 - RNA, 19 nt, Yersinia pestis
cgaucagcaauaugcugaa

SEQ ID NO: 2266086 - RNA, 20 nt, Yersinia pestis
cgaucacuuucccgcgucgu

SEQ ID NO: 2266087 - RNA, 18 nt, Yersinia pestis
cgaucacuuucccgcguc

SEQ ID NO: 2266088 - RNA, 16 nt, Yersinia pestis
cgaucacggaaaucug

SEQ ID NO: 2266089 - RNA, 22 nt, Yersinia pestis
cgaucaacaggccaccuaacac

SEQ ID NO: 2266090 - RNA, 13 nt, Yersinia pestis
cgauaucaauaaa

SEQ ID NO: 2266091 - RNA, 14 nt, Yersinia pestis
cgauauacacccca

SEQ ID NO: 2266092 - RNA, 18 nt, Yersinia pestis
cgauacucgauaccagcg

SEQ ID NO: 2266093 - RNA, 18 nt, Yersinia pestis
cgauaguauaaauaccug

SEQ ID NO: 2266094 - RNA, 21 nt, Yersinia pestis
cgauaguauaaauaccugugu

SEQ ID NO: 2266095 - RNA, 18 nt, Yersinia pestis
cgauacccauuuuaaucu

SEQ ID NO: 2266096 - RNA, 17 nt, Yersinia pestis
cgauacguugcagguca

SEQ ID NO: 2266097 - RNA, 22 nt, Yersinia pestis
cgauaacuuuuggcagcaccag

SEQ ID NO: 2266098 - RNA, 17 nt, Yersinia pestis
cgauaacguuguuucug

SEQ ID NO: 2266099 - RNA, 15 nt, Yersinia pestis
cgauaacgccccggc

SEQ ID NO: 2266100 - RNA, 16 nt, Yersinia pestis
cgauaacguuguuucu

SEQ ID NO: 2266101 - RNA, 21 nt, Yersinia pestis
cgauccuaggcggugagggag

SEQ ID NO: 2266102 - RNA, 14 nt, Yersinia pestis
cgauccgucacaac

SEQ ID NO: 2266103 - RNA, 21 nt, Yersinia pestis
cgauccgggaaaaaauacgcu

SEQ ID NO: 2266104 - RNA, 17 nt, Yersinia pestis
cgauccgggaaaaaaua

SEQ ID NO: 2266105 - RNA, 15 nt, Yersinia pestis
cgauccgcuuuuuag

SEQ ID NO: 2266106 - RNA, 12 nt, Yersinia pestis
cgaucauuuucu

SEQ ID NO: 2266107 - RNA, 21 nt, Yersinia pestis
cgauccaaaacaucggccagc

SEQ ID NO: 2266108 - RNA, 22 nt, Yersinia pestis
cgauccaaaacaucggccagcg

SEQ ID NO: 2266109 - RNA, 15 nt, Yersinia pestis
cgcagguuggcggca

SEQ ID NO: 2266110 - RNA, 16 nt, Yersinia pestis
cgcagguuggcggcaa

SEQ ID NO: 2266111 - RNA, 15 nt, Yersinia pestis
cgcagguucaucaga

SEQ ID NO: 2266112 - RNA, 22 nt, Yersinia pestis
aaacggucauuguagauggcca

SEQ ID NO: 2266113 - RNA, 21 nt, Yersinia pestis
aaacggucuguuaauccuaau

SEQ ID NO: 2266114 - RNA, 21 nt, Yersinia pestis
aaacggucauuguagauggcc

SEQ ID NO: 2266115 - RNA, 16 nt, Yersinia pestis
cgcaguugccaaacaa

SEQ ID NO: 2266116 - RNA, 13 nt, Yersinia pestis
cgcaguaaauuca

SEQ ID NO: 2266117 - RNA, 18 nt, Yersinia pestis
cgauuucagcaccauaaa

SEQ ID NO: 2266118 - RNA, 19 nt, Yersinia pestis
cgcaauaaauggcauuuuu

SEQ ID NO: 2266119 - RNA, 17 nt, Yersinia pestis
cgcaauaucaaaacucc

SEQ ID NO: 2266120 - RNA, 14 nt, Yersinia pestis
cgcaaucagauggu

SEQ ID NO: 2266121 - RNA, 12 nt, Yersinia pestis
cgcaauugcacc

SEQ ID NO: 2266122 - RNA, 14 nt, Yersinia pestis
cgcaccauaaccaa

SEQ ID NO: 2266123 - RNA, 18 nt, Yersinia pestis
cgcaccauaaccaaucca

SEQ ID NO: 2266124 - RNA, 23 nt, Yersinia pestis
cgcacuuacccgaaucacugacu

SEQ ID NO: 2266125 - RNA, 17 nt, Yersinia pestis
cgcacugguuggcggcu

SEQ ID NO: 2266126 - RNA, 16 nt, Yersinia pestis
cgcacccuuacccugg

SEQ ID NO: 2266127 - RNA, 16 nt, Yersinia pestis
cgcacccuccaauaau

SEQ ID NO: 2266128 - RNA, 16 nt, Yersinia pestis
cgcacgggucauuaac

SEQ ID NO: 2266129 - RNA, 22 nt, Yersinia pestis
cgcacgggucauuaacgcacau

SEQ ID NO: 2266130 - RNA, 16 nt, Yersinia pestis
cgcacguaccacggcg

SEQ ID NO: 2266131 - RNA, 23 nt, Yersinia pestis
cgccauuuuuauguuuaucaccc

SEQ ID NO: 2266132 - RNA, 14 nt, Yersinia pestis
cgccauucauuuuu

SEQ ID NO: 2266133 - RNA, 19 nt, Yersinia pestis
cgccauugagucguuauaa

SEQ ID NO: 2266134 - RNA, 17 nt, Yersinia pestis
cgccauugcauauugcu

SEQ ID NO: 2266135 - RNA, 13 nt, Yersinia pestis
cgccauccuuggc

SEQ ID NO: 2266136 - RNA, 15 nt, Yersinia pestis
cgccaucaauaauuu

SEQ ID NO: 2266137 - RNA, 23 nt, Yersinia pestis
cgccauauauugauccaaauggc

SEQ ID NO: 2266138 - RNA, 13 nt, Yersinia pestis
cgcccccgccagg

SEQ ID NO: 2266139 - RNA, 20 nt, Yersinia pestis
cgccccguuaauccuucacu

SEQ ID NO: 2266140 - RNA, 20 nt, Yersinia pestis
cgccccugcgaucugccuua

SEQ ID NO: 2266141 - RNA, 13 nt, Yersinia pestis
cgcccgcggccaa

SEQ ID NO: 2266142 - RNA, 11 nt, Yersinia pestis
cgcccaggcca

SEQ ID NO: 2266143 - RNA, 17 nt, Yersinia pestis
cgcccguuggccggcca

SEQ ID NO: 2266144 - RNA, 14 nt, Yersinia pestis
cgcccuugucuggg

SEQ ID NO: 2266145 - RNA, 17 nt, Yersinia pestis
cgcccuugucugggcug

SEQ ID NO: 2266146 - RNA, 22 nt, Yersinia pestis
cgccagucagcuagccugcccc

SEQ ID NO: 2266147 - RNA, 19 nt, Yersinia pestis
cgccaguaaaccuggcggg

SEQ ID NO: 2266148 - RNA, 18 nt, Yersinia pestis
cgccagugccgcggcggc

SEQ ID NO: 2266149 - RNA, 19 nt, Yersinia pestis
cgccagugccgcggcggcc

SEQ ID NO: 2266150 - RNA, 22 nt, Yersinia pestis
cgccauauccaacuucuuccau

SEQ ID NO: 2266151 - RNA, 15 nt, Yersinia pestis
cgccauauauugauc

SEQ ID NO: 2266152 - RNA, 21 nt, Yersinia pestis
cgccauauacccaaagccagu

SEQ ID NO: 2266153 - RNA, 22 nt, Yersinia pestis
cgcauccccaucgccaauacaa

SEQ ID NO: 2266154 - RNA, 14 nt, Yersinia pestis
cgccaccuggaacc

SEQ ID NO: 2266155 - RNA, 20 nt, Yersinia pestis
cgccacgcagugccgaugag

SEQ ID NO: 2266156 - RNA, 18 nt, Yersinia pestis
cgccagauggucacccuc

SEQ ID NO: 2266157 - RNA, 14 nt, Yersinia pestis
cgccagauuaucca

SEQ ID NO: 2266158 - RNA, 16 nt, Yersinia pestis
cgccagauuauccagc

SEQ ID NO: 2266159 - RNA, 19 nt, Yersinia pestis
cgccagauuauccagcccu

SEQ ID NO: 2266160 - RNA, 22 nt, Yersinia pestis
cgccagcaacuaucuccggccu

SEQ ID NO: 2266161 - RNA, 14 nt, Yersinia pestis
cgccagcacgguua

SEQ ID NO: 2266162 - RNA, 17 nt, Yersinia pestis
cgcuaccuccggggccu

SEQ ID NO: 2266163 - RNA, 20 nt, Yersinia pestis
cgcguugucagccaugccug

SEQ ID NO: 2266164 - RNA, 14 nt, Yersinia pestis
cgcguugcccuucu

SEQ ID NO: 2266165 - RNA, 14 nt, Yersinia pestis
cgcuagauuuucuu

SEQ ID NO: 2266166 - RNA, 22 nt, Yersinia pestis
cgcuauaaaacagcuugauagg

SEQ ID NO: 2266167 - RNA, 15 nt, Yersinia pestis
cgcuauaucaucagc

SEQ ID NO: 2266168 - RNA, 12 nt, Yersinia pestis
cgcuaugcuaaa

SEQ ID NO: 2266169 - RNA, 15 nt, Yersinia pestis
cgcucaaucacgaca

SEQ ID NO: 2266170 - RNA, 22 nt, Yersinia pestis
cgcucacuuuuauauccgccau

SEQ ID NO: 2266171 - RNA, 15 nt, Yersinia pestis
cgcucacuuuuauau

SEQ ID NO: 2266172 - RNA, 21 nt, Yersinia pestis
cgcucacuuuuauauccgcca

SEQ ID NO: 2266173 - RNA, 16 nt, Yersinia pestis
cgcucuacaacgucca

SEQ ID NO: 2266174 - RNA, 13 nt, Yersinia pestis
cgcucuacauuug

SEQ ID NO: 2266175 - RNA, 12 nt, Yersinia pestis
cgcucggcgcuc

SEQ ID NO: 2266176 - RNA, 14 nt, Yersinia pestis
cgcucgcuugcugc

SEQ ID NO: 2266177 - RNA, 14 nt, Yersinia pestis
cgcugacagaguac

SEQ ID NO: 2266178 - RNA, 21 nt, Yersinia pestis
cgcucuguugacucgcggcag

SEQ ID NO: 2266179 - RNA, 15 nt, Yersinia pestis
cgcucuucagcauca

SEQ ID NO: 2266180 - RNA, 16 nt, Yersinia pestis
cgcucuggguuaaauu

SEQ ID NO: 2266181 - RNA, 12 nt, Yersinia pestis
cgcuccucagcc

SEQ ID NO: 2266182 - RNA, 18 nt, Yersinia pestis
cgcuccggcaaccagcgu

SEQ ID NO: 2266183 - RNA, 16 nt, Yersinia pestis
cgcucccuccgccagc

SEQ ID NO: 2266184 - RNA, 20 nt, Yersinia pestis
cgcucccuccgccagcaagu

SEQ ID NO: 2266185 - RNA, 22 nt, Yersinia pestis
cgcucaucaaccgggauaucaa

SEQ ID NO: 2266186 - RNA, 16 nt, Yersinia pestis
cgcucaucacggcggc

SEQ ID NO: 2266187 - RNA, 20 nt, Yersinia pestis
cgcuccacacaaaaacgcuc

SEQ ID NO: 2266188 - RNA, 17 nt, Yersinia pestis
cgcuccagauugucaau

SEQ ID NO: 2266189 - RNA, 13 nt, Yersinia pestis
cgcuccagguuca

SEQ ID NO: 2266190 - RNA, 15 nt, Yersinia pestis
cgcuguauacccgcc

SEQ ID NO: 2266191 - RNA, 24 nt, Yersinia pestis
cgcugucauuccaaccuuguaacu

SEQ ID NO: 2266192 - RNA, 16 nt, Yersinia pestis
cgcugucugaauagug

SEQ ID NO: 2266193 - RNA, 21 nt, Yersinia pestis
cgcuggugcggaacagcgccc

SEQ ID NO: 2266194 - RNA, 20 nt, Yersinia pestis
cgcuggcgcgcauaguaucc

SEQ ID NO: 2266195 - RNA, 17 nt, Yersinia pestis
cgcuggcuuucucccau

SEQ ID NO: 2266196 - RNA, 22 nt, Yersinia pestis
cgcuuccagcgcuuccacugcg

SEQ ID NO: 2266197 - RNA, 18 nt, Yersinia pestis
cgcuucgcacuucaagca

SEQ ID NO: 2266198 - RNA, 15 nt, Yersinia pestis
cgcuucguccagaug

SEQ ID NO: 2266199 - RNA, 20 nt, Yersinia pestis
cgcuucuuguugagugacca

SEQ ID NO: 2266200 - RNA, 20 nt, Yersinia pestis
cgcuucacauuugaaaugca

SEQ ID NO: 2266201 - RNA, 12 nt, Yersinia pestis
cgcuuaccaaaa

SEQ ID NO: 2266202 - RNA, 18 nt, Yersinia pestis
cgcuuaaauaaaacaccc

SEQ ID NO: 2266203 - RNA, 19 nt, Yersinia pestis
cgcuguuugauuaaaaccc

SEQ ID NO: 2266204 - RNA, 14 nt, Yersinia pestis
cgcuggcauacuga

SEQ ID NO: 2266205 - RNA, 23 nt, Yersinia pestis
cgcugauguaggcaauacaccgc

SEQ ID NO: 2266206 - RNA, 16 nt, Yersinia pestis
cgcugauuaaccugua

SEQ ID NO: 2266207 - RNA, 20 nt, Yersinia pestis
cgcugauguaggcaauacac

SEQ ID NO: 2266208 - RNA, 20 nt, Yersinia pestis
cgcugagguucuccaacaac

SEQ ID NO: 2266209 - RNA, 16 nt, Yersinia pestis
cgcugauaacuuccuu

SEQ ID NO: 2266210 - RNA, 18 nt, Yersinia pestis
cgcugauaacuuccuuug

SEQ ID NO: 2266211 - RNA, 16 nt, Yersinia pestis
cgcugauaaccagcag

SEQ ID NO: 2266212 - RNA, 19 nt, Yersinia pestis
cgcugacguaauaccggca

SEQ ID NO: 2266213 - RNA, 18 nt, Yersinia pestis
cgcugacuuguggaacaa

SEQ ID NO: 2266214 - RNA, 22 nt, Yersinia pestis
cgcgagugaaccgcgcucugcu

SEQ ID NO: 2266215 - RNA, 15 nt, Yersinia pestis
cgcgccacuucuuuc

SEQ ID NO: 2266216 - RNA, 16 nt, Yersinia pestis
cgcgccagauucuagc

SEQ ID NO: 2266217 - RNA, 23 nt, Yersinia pestis
cgcgcauauaggcgaaaggcgca

SEQ ID NO: 2266218 - RNA, 14 nt, Yersinia pestis
cgcgccagggaggg

SEQ ID NO: 2266219 - RNA, 22 nt, Yersinia pestis
cgcgcgcccagacgccggccgg

SEQ ID NO: 2266220 - RNA, 18 nt, Yersinia pestis
cgcgcgugguuuccugga

SEQ ID NO: 2266221 - RNA, 11 nt, Yersinia pestis
cgcgcuaacca

SEQ ID NO: 2266222 - RNA, 16 nt, Yersinia pestis
cgcggaaaucagcuuc

SEQ ID NO: 2266223 - RNA, 13 nt, Yersinia pestis
cgcgcugcugcuc

SEQ ID NO: 2266224 - RNA, 19 nt, Yersinia pestis
cgccuaaaaaugauuucag

SEQ ID NO: 2266225 - RNA, 15 nt, Yersinia pestis
cgccuaguuaaacuc

SEQ ID NO: 2266226 - RNA, 23 nt, Yersinia pestis
cgccguggcgacagcuauuuauu

SEQ ID NO: 2266227 - RNA, 23 nt, Yersinia pestis
cgccgugucggaugccgcuccag

SEQ ID NO: 2266228 - RNA, 20 nt, Yersinia pestis
cgccuccagucccccucaca

SEQ ID NO: 2266229 - RNA, 13 nt, Yersinia pestis
cgccgccgccagc

SEQ ID NO: 2266230 - RNA, 15 nt, Yersinia pestis
cgccgccgcaccgcu

SEQ ID NO: 2266231 - RNA, 17 nt, Yersinia pestis
cgccgguuaucaccuga

SEQ ID NO: 2266232 - RNA, 14 nt, Yersinia pestis
cgccgucagcucuu

SEQ ID NO: 2266233 - RNA, 21 nt, Yersinia pestis
cgccgucaugcugaaucugua

SEQ ID NO: 2266234 - RNA, 13 nt, Yersinia pestis
cgccgugccagaa

SEQ ID NO: 2266235 - RNA, 17 nt, Yersinia pestis
cgcgacgguacugauca

SEQ ID NO: 2266236 - RNA, 17 nt, Yersinia pestis
cgcgacucaagccucua

SEQ ID NO: 2266237 - RNA, 12 nt, Yersinia pestis
cgcgaccagcag

SEQ ID NO: 2266238 - RNA, 19 nt, Yersinia pestis
cgccuucagguaauuuaua

SEQ ID NO: 2266239 - RNA, 19 nt, Yersinia pestis
cgccuucccacaaacucca

SEQ ID NO: 2266240 - RNA, 19 nt, Yersinia pestis
cgccuucaucgcgauugaa

SEQ ID NO: 2266241 - RNA, 16 nt, Yersinia pestis
cgccuucauguugcaa

SEQ ID NO: 2266242 - RNA, 13 nt, Yersinia pestis
cgccucugcuccg

SEQ ID NO: 2266243 - RNA, 15 nt, Yersinia pestis
cgccugauccaacau

SEQ ID NO: 2266244 - RNA, 15 nt, Yersinia pestis
cgccugaucgauaac

SEQ ID NO: 2266245 - RNA, 20 nt, Yersinia pestis
cgccugacugcccgccugcu

SEQ ID NO: 2266246 - RNA, 19 nt, Yersinia pestis
cgccucgcuuacugguacc

SEQ ID NO: 2266247 - RNA, 12 nt, Yersinia pestis
uuuuuuaaaaaa

SEQ ID NO: 2266248 - RNA, 16 nt, Yersinia pestis
uuuuugugcuucauau

SEQ ID NO: 2266249 - RNA, 15 nt, Yersinia pestis
uuuuucucaaucuca

SEQ ID NO: 2266250 - RNA, 22 nt, Yersinia pestis
uuuuucuguucagauuuaccau

SEQ ID NO: 2266251 - RNA, 15 nt, Yersinia pestis
uuuuucgacaaaaaa

SEQ ID NO: 2266252 - RNA, 15 nt, Yersinia pestis
uuuugaugcuaauuu

SEQ ID NO: 2266253 - RNA, 15 nt, Yersinia pestis
uuuuucccuucaacu

SEQ ID NO: 2266254 - RNA, 20 nt, Yersinia pestis
uuuuuggggucugaauauaa

SEQ ID NO: 2266255 - RNA, 21 nt, Yersinia pestis
uuuuugcccggcugauauaac

SEQ ID NO: 2266256 - RNA, 14 nt, Yersinia pestis
uuuuugcuggaacu

SEQ ID NO: 2266257 - RNA, 15 nt, Yersinia pestis
uuuuugcuuuuugcu

SEQ ID NO: 2266258 - RNA, 14 nt, Yersinia pestis
uuuuugaauaaucc

SEQ ID NO: 2266259 - RNA, 17 nt, Yersinia pestis
uuuuucuuuuuaacuua

SEQ ID NO: 2266260 - RNA, 16 nt, Yersinia pestis
uuugucgcucaagccu

SEQ ID NO: 2266261 - RNA, 20 nt, Yersinia pestis
uuugucauguugaccaaaca

SEQ ID NO: 2266262 - RNA, 22 nt, Yersinia pestis
uuugucauguugaccaaacaga

SEQ ID NO: 2266263 - RNA, 23 nt, Yersinia pestis
uuugucagcagucugagggccac

SEQ ID NO: 2266264 - RNA, 22 nt, Yersinia pestis
uuuguccggagagagacuuugu

SEQ ID NO: 2266265 - RNA, 23 nt, Yersinia pestis
uuugugucgggauuuuuuuuccu

SEQ ID NO: 2266266 - RNA, 21 nt, Yersinia pestis
uuuguuaaaauaguggcacaa

SEQ ID NO: 2266267 - RNA, 22 nt, Yersinia pestis
uuuguguugaacuuuauuuaau

SEQ ID NO: 2266268 - RNA, 12 nt, Yersinia pestis
uuuguuauuucu

SEQ ID NO: 2266269 - RNA, 13 nt, Yersinia pestis
uuuguugauguaa

SEQ ID NO: 2266270 - RNA, 13 nt, Yersinia pestis
uuuguuuuuauau

SEQ ID NO: 2266271 - RNA, 15 nt, Yersinia pestis
uuuguuuuucugaca

SEQ ID NO: 2266272 - RNA, 20 nt, Yersinia pestis
uuuguuuggauaaaaacauu

SEQ ID NO: 2266273 - RNA, 13 nt, Yersinia pestis
uuuuaacaucauu

SEQ ID NO: 2266274 - RNA, 21 nt, Yersinia pestis
uuuuaauauuguugguuuaaa

SEQ ID NO: 2266275 - RNA, 16 nt, Yersinia pestis
uuuuaauaaaaaacug

SEQ ID NO: 2266276 - RNA, 14 nt, Yersinia pestis
uuuuaaaaaaaaag

SEQ ID NO: 2266277 - RNA, 16 nt, Yersinia pestis
uuuuaaagaaugcaac

SEQ ID NO: 2266278 - RNA, 16 nt, Yersinia pestis
uuuuaaacgucagauu

SEQ ID NO: 2266279 - RNA, 18 nt, Yersinia pestis
uuuuaaacuuguaucaaa

SEQ ID NO: 2266280 - RNA, 21 nt, Yersinia pestis
uuuuaaagcacggccauuucu

SEQ ID NO: 2266281 - RNA, 15 nt, Yersinia pestis
uuugggcuugagcag

SEQ ID NO: 2266282 - RNA, 13 nt, Yersinia pestis
uuugggaacaaca

SEQ ID NO: 2266283 - RNA, 21 nt, Yersinia pestis
uuuggugaucaugauuucucg

SEQ ID NO: 2266284 - RNA, 23 nt, Yersinia pestis
uuuggucaguugaauauuccauu

SEQ ID NO: 2266285 - RNA, 14 nt, Yersinia pestis
uuugguuaaagaag

SEQ ID NO: 2266286 - RNA, 18 nt, Yersinia pestis
uuugguuauaucccaaua

SEQ ID NO: 2266287 - RNA, 16 nt, Yersinia pestis
uuugguuauuaugauu

SEQ ID NO: 2266288 - RNA, 18 nt, Yersinia pestis
uuuguagugacguaaaaa

SEQ ID NO: 2266289 - RNA, 20 nt, Yersinia pestis
uuugucaauaaccucagccu

SEQ ID NO: 2266290 - RNA, 22 nt, Yersinia pestis
uuuguauuuacucguuuuacau

SEQ ID NO: 2266291 - RNA, 14 nt, Yersinia pestis
uuugguuuucuauu

SEQ ID NO: 2266292 - RNA, 15 nt, Yersinia pestis
uuuguacaacuucuu

SEQ ID NO: 2266293 - RNA, 23 nt, Yersinia pestis
uuuguaauaacucagccauugcu

SEQ ID NO: 2266294 - RNA, 13 nt, Yersinia pestis
uuugcugaugcac

SEQ ID NO: 2266295 - RNA, 14 nt, Yersinia pestis
uuugcugccaucag

SEQ ID NO: 2266296 - RNA, 17 nt, Yersinia pestis
uuugcugccauuuccaa

SEQ ID NO: 2266297 - RNA, 20 nt, Yersinia pestis
uuugcucgggcucucuucag

SEQ ID NO: 2266298 - RNA, 17 nt, Yersinia pestis
uuuggauuggucagguu

SEQ ID NO: 2266299 - RNA, 18 nt, Yersinia pestis
uuuggaucaggaucacca

SEQ ID NO: 2266300 - RNA, 13 nt, Yersinia pestis
uuugcuuuuugcu

SEQ ID NO: 2266301 - RNA, 15 nt, Yersinia pestis
uuugcuugcugccug

SEQ ID NO: 2266302 - RNA, 18 nt, Yersinia pestis
uuugcuuuuugcuuuuug

SEQ ID NO: 2266303 - RNA, 22 nt, Yersinia pestis
uuugcuucgccauuuccaucau

SEQ ID NO: 2266304 - RNA, 18 nt, Yersinia pestis
uuuuccaggguccaacau

SEQ ID NO: 2266305 - RNA, 17 nt, Yersinia pestis
uuuuauuaccugcuauu

SEQ ID NO: 2266306 - RNA, 21 nt, Yersinia pestis
uuuuauuaccugcuauuuuau

SEQ ID NO: 2266307 - RNA, 22 nt, Yersinia pestis
uuuuauggcauaaacugaaguu

SEQ ID NO: 2266308 - RNA, 15 nt, Yersinia pestis
uuuuauguuaaauca

SEQ ID NO: 2266309 - RNA, 21 nt, Yersinia pestis
uuuuauggcauaaacugaagu

SEQ ID NO: 2266310 - RNA, 16 nt, Yersinia pestis
uuuuauugucuuuaau

SEQ ID NO: 2266311 - RNA, 18 nt, Yersinia pestis
uuuuauucgcguuucauu

SEQ ID NO: 2266312 - RNA, 14 nt, Yersinia pestis
uuuuauuauuuuuu

SEQ ID NO: 2266313 - RNA, 20 nt, Yersinia pestis
uuuugauaauuucaguucag

SEQ ID NO: 2266314 - RNA, 22 nt, Yersinia pestis
uuuucccaguaagcucuacuaa

SEQ ID NO: 2266315 - RNA, 14 nt, Yersinia pestis
uuuucgggaaaaaa

SEQ ID NO: 2266316 - RNA, 18 nt, Yersinia pestis
uuuucccuguagaacacc

SEQ ID NO: 2266317 - RNA, 14 nt, Yersinia pestis
uuuucccucagcca

SEQ ID NO: 2266318 - RNA, 20 nt, Yersinia pestis
uuuucuagcuguagcaauau

SEQ ID NO: 2266319 - RNA, 12 nt, Yersinia pestis
uuuuaugccuuu

SEQ ID NO: 2266320 - RNA, 15 nt, Yersinia pestis
uuuuaucaucauaaa

SEQ ID NO: 2266321 - RNA, 23 nt, Yersinia pestis
uuuuaucaggcgaaugcccugcu

SEQ ID NO: 2266322 - RNA, 16 nt, Yersinia pestis
uuuuauauaauugaag

SEQ ID NO: 2266323 - RNA, 14 nt, Yersinia pestis
uuuuauaucagauu

SEQ ID NO: 2266324 - RNA, 18 nt, Yersinia pestis
uuuuauauccgccauccu

SEQ ID NO: 2266325 - RNA, 14 nt, Yersinia pestis
uuuuauauuccaca

SEQ ID NO: 2266326 - RNA, 20 nt, Yersinia pestis
uuuuauauugauaaaaauca

SEQ ID NO: 2266327 - RNA, 15 nt, Yersinia pestis
uuuuauaaugagaau

SEQ ID NO: 2266328 - RNA, 20 nt, Yersinia pestis
uuuuauaccggggccaucau

SEQ ID NO: 2266329 - RNA, 15 nt, Yersinia pestis
uuuuagcgcuuuuac

SEQ ID NO: 2266330 - RNA, 17 nt, Yersinia pestis
uuuuagugauuaauuaa

SEQ ID NO: 2266331 - RNA, 18 nt, Yersinia pestis
uuuuaguaacaaaaugcg

SEQ ID NO: 2266332 - RNA, 20 nt, Yersinia pestis
uuuuaaucuccuggugguuu

SEQ ID NO: 2266333 - RNA, 19 nt, Yersinia pestis
uuuuaaucgacacuuaaau

SEQ ID NO: 2266334 - RNA, 23 nt, Yersinia pestis
uuuuaauuauaauccacugaaau

SEQ ID NO: 2266335 - RNA, 13 nt, Yersinia pestis
uuuuagacgucag

SEQ ID NO: 2266336 - RNA, 19 nt, Yersinia pestis
uuuuacgccuauccucaug

SEQ ID NO: 2266337 - RNA, 23 nt, Yersinia pestis
uuuuaccuuuaacuguuuuauau

SEQ ID NO: 2266338 - RNA, 13 nt, Yersinia pestis
uuuuaccuaguag

SEQ ID NO: 2266339 - RNA, 19 nt, Yersinia pestis
uuuuacgggccuuuuaauu

SEQ ID NO: 2266340 - RNA, 13 nt, Yersinia pestis
uugaauaucacca

SEQ ID NO: 2266341 - RNA, 16 nt, Yersinia pestis
uugaauauuuuuaauc

SEQ ID NO: 2266342 - RNA, 17 nt, Yersinia pestis
uugaauauuuuuaaucu

SEQ ID NO: 2266343 - RNA, 16 nt, Yersinia pestis
uugacauaaacacgca

SEQ ID NO: 2266344 - RNA, 17 nt, Yersinia pestis
uugacacgagagauaau

SEQ ID NO: 2266345 - RNA, 14 nt, Yersinia pestis
uugacauuuccuug

SEQ ID NO: 2266346 - RNA, 14 nt, Yersinia pestis
uugaccaacugucg

SEQ ID NO: 2266347 - RNA, 18 nt, Yersinia pestis
uugaagauucaaccaauu

SEQ ID NO: 2266348 - RNA, 22 nt, Yersinia pestis
uugaaguacggugccagcagca

SEQ ID NO: 2266349 - RNA, 14 nt, Yersinia pestis
uugaacaaacccca

SEQ ID NO: 2266350 - RNA, 21 nt, Yersinia pestis
uucuuuucucccuuucacuuu

SEQ ID NO: 2266351 - RNA, 15 nt, Yersinia pestis
uugaaaaguuuuuug

SEQ ID NO: 2266352 - RNA, 16 nt, Yersinia pestis
uugaaaugauaacaau

SEQ ID NO: 2266353 - RNA, 14 nt, Yersinia pestis
uugaaaucagauca

SEQ ID NO: 2266354 - RNA, 17 nt, Yersinia pestis
uucuugaaaaaauaaau

SEQ ID NO: 2266355 - RNA, 18 nt, Yersinia pestis
uucuuuacgguuaaaaca

SEQ ID NO: 2266356 - RNA, 14 nt, Yersinia pestis
uucuuucaccagug

SEQ ID NO: 2266357 - RNA, 13 nt, Yersinia pestis
uucuuucucgaua

SEQ ID NO: 2266358 - RNA, 20 nt, Yersinia pestis
uugauacggccuauuucuug

SEQ ID NO: 2266359 - RNA, 19 nt, Yersinia pestis
uugauacggcuuacuuuua

SEQ ID NO: 2266360 - RNA, 15 nt, Yersinia pestis
uugauauauagaaau

SEQ ID NO: 2266361 - RNA, 19 nt, Yersinia pestis
uugagggcgucucuacgac

SEQ ID NO: 2266362 - RNA, 19 nt, Yersinia pestis
uugaggagcgauaacauuu

SEQ ID NO: 2266363 - RNA, 18 nt, Yersinia pestis
uugaguaacaagaacacc

SEQ ID NO: 2266364 - RNA, 22 nt, Yersinia pestis
uugagacacaaaaaagaaauuu

SEQ ID NO: 2266365 - RNA, 22 nt, Yersinia pestis
uugagauagucauuuuauuuag

SEQ ID NO: 2266366 - RNA, 17 nt, Yersinia pestis
uugagauuuucccagug

SEQ ID NO: 2266367 - RNA, 19 nt, Yersinia pestis
uugaccgacgcugaacuga

SEQ ID NO: 2266368 - RNA, 17 nt, Yersinia pestis
uugacgguuuucugaau

SEQ ID NO: 2266369 - RNA, 20 nt, Yersinia pestis
uugacguccccggucaugag

SEQ ID NO: 2266370 - RNA, 19 nt, Yersinia pestis
uugauaucaauauccgcau

SEQ ID NO: 2266371 - RNA, 22 nt, Yersinia pestis
uugauccaaauggcugcguucu

SEQ ID NO: 2266372 - RNA, 23 nt, Yersinia pestis
uugauccaccguuuuacucagga

SEQ ID NO: 2266373 - RNA, 19 nt, Yersinia pestis
uugaucaucaaacuauuca

SEQ ID NO: 2266374 - RNA, 20 nt, Yersinia pestis
uugaugugaaacauaauuaa

SEQ ID NO: 2266375 - RNA, 22 nt, Yersinia pestis
uugauguaagcugggaaggcgu

SEQ ID NO: 2266376 - RNA, 20 nt, Yersinia pestis
uugaugguuauguguauuug

SEQ ID NO: 2266377 - RNA, 20 nt, Yersinia pestis
uugauggccuugaaucaaaa

SEQ ID NO: 2266378 - RNA, 17 nt, Yersinia pestis
uugcacacgauuaccug

SEQ ID NO: 2266379 - RNA, 23 nt, Yersinia pestis
uugcaacugggcgacaaucaaug

SEQ ID NO: 2266380 - RNA, 20 nt, Yersinia pestis
uugauuaggcaugauaagca

SEQ ID NO: 2266381 - RNA, 16 nt, Yersinia pestis
uugauuauaugcguuu

SEQ ID NO: 2266382 - RNA, 18 nt, Yersinia pestis
uugauuaccaauaauuaa

SEQ ID NO: 2266383 - RNA, 19 nt, Yersinia pestis
uugauucaaaaugccaguc

SEQ ID NO: 2266384 - RNA, 14 nt, Yersinia pestis
uucuuauuaaucaa

SEQ ID NO: 2266385 - RNA, 14 nt, Yersinia pestis
uucuuagugcuaca

SEQ ID NO: 2266386 - RNA, 15 nt, Yersinia pestis
uucuucucucacuuu

SEQ ID NO: 2266387 - RNA, 14 nt, Yersinia pestis
uucuguagugccgc

SEQ ID NO: 2266388 - RNA, 17 nt, Yersinia pestis
uucuguagugccgccag

SEQ ID NO: 2266389 - RNA, 20 nt, Yersinia pestis
uucugcucccaugucagaca

SEQ ID NO: 2266390 - RNA, 14 nt, Yersinia pestis
uucugcgacuuuau

SEQ ID NO: 2266391 - RNA, 13 nt, Yersinia pestis
uucuguucagauu

SEQ ID NO: 2266392 - RNA, 21 nt, Yersinia pestis
uucucuuuccgcucagcaucu

SEQ ID NO: 2266393 - RNA, 15 nt, Yersinia pestis
uucucuuucagcucu

SEQ ID NO: 2266394 - RNA, 22 nt, Yersinia pestis
uucucugaugaacggagaugau

SEQ ID NO: 2266395 - RNA, 21 nt, Yersinia pestis
uucucuggaguuauacccaua

SEQ ID NO: 2266396 - RNA, 15 nt, Yersinia pestis
uucugccuauccuca

SEQ ID NO: 2266397 - RNA, 16 nt, Yersinia pestis
uucugccuauccucac

SEQ ID NO: 2266398 - RNA, 21 nt, Yersinia pestis
uucucugaacgcacuucaauc

SEQ ID NO: 2266399 - RNA, 13 nt, Yersinia pestis
uucucuccuaaaa

SEQ ID NO: 2266400 - RNA, 24 nt, Yersinia pestis
uucucuacugaauggaucacauca

SEQ ID NO: 2266401 - RNA, 15 nt, Yersinia pestis
uucucaaucucaaaa

SEQ ID NO: 2266402 - RNA, 17 nt, Yersinia pestis
uucucaaugauaaaauc

SEQ ID NO: 2266403 - RNA, 17 nt, Yersinia pestis
uucucaauggcuuuuuu

SEQ ID NO: 2266404 - RNA, 11 nt, Yersinia pestis
uucucaccaag

SEQ ID NO: 2266405 - RNA, 12 nt, Yersinia pestis
uucucacucuau

SEQ ID NO: 2266406 - RNA, 21 nt, Yersinia pestis
uucguauguuuuuaacaaaau

SEQ ID NO: 2266407 - RNA, 16 nt, Yersinia pestis
uucggugacuaaaauc

SEQ ID NO: 2266408 - RNA, 15 nt, Yersinia pestis
uucuaaaaaaugaac

SEQ ID NO: 2266409 - RNA, 21 nt, Yersinia pestis
uucguuucccccuguaaaaca

SEQ ID NO: 2266410 - RNA, 21 nt, Yersinia pestis
uucgguaaugccagcccugau

SEQ ID NO: 2266411 - RNA, 22 nt, Yersinia pestis
uucgggugagugagcgcaggua

SEQ ID NO: 2266412 - RNA, 23 nt, Yersinia pestis
uucgggugagugagcgcggguaa

SEQ ID NO: 2266413 - RNA, 17 nt, Yersinia pestis
uucuauccgaaaaauau

SEQ ID NO: 2266414 - RNA, 18 nt, Yersinia pestis
uucuaucgggcagguaaa

SEQ ID NO: 2266415 - RNA, 23 nt, Yersinia pestis
uucuaucgggcagguaaauccuu

SEQ ID NO: 2266416 - RNA, 16 nt, Yersinia pestis
uucuacuccauucaga

SEQ ID NO: 2266417 - RNA, 18 nt, Yersinia pestis
uucucaacagcaucauca

SEQ ID NO: 2266418 - RNA, 17 nt, Yersinia pestis
uucuaauugauauuauu

SEQ ID NO: 2266419 - RNA, 20 nt, Yersinia pestis
uucuacaaauuuuuuauauu

SEQ ID NO: 2266420 - RNA, 22 nt, Yersinia pestis
uucuacaaauuuuuuauauucc

SEQ ID NO: 2266421 - RNA, 21 nt, Yersinia pestis
uucuacccuggcggcaaacgc

SEQ ID NO: 2266422 - RNA, 17 nt, Yersinia pestis
uucuaccguaucagccc

SEQ ID NO: 2266423 - RNA, 15 nt, Yersinia pestis
uucuaccuggcucaa

SEQ ID NO: 2266424 - RNA, 22 nt, Yersinia pestis
uucuaccuggcucaaauuuggg

SEQ ID NO: 2266425 - RNA, 17 nt, Yersinia pestis
uuguggcuaccaauuau

SEQ ID NO: 2266426 - RNA, 20 nt, Yersinia pestis
uuguguuucaucgacucuuu

SEQ ID NO: 2266427 - RNA, 23 nt, Yersinia pestis
uuguuaccuaaccaaacauuguc

SEQ ID NO: 2266428 - RNA, 15 nt, Yersinia pestis
uuguucuaauaauaa

SEQ ID NO: 2266429 - RNA, 17 nt, Yersinia pestis
uugucguuauuuucuau

SEQ ID NO: 2266430 - RNA, 17 nt, Yersinia pestis
uugucucuacucucugu

SEQ ID NO: 2266431 - RNA, 20 nt, Yersinia pestis
uugugcaaaaucagcauaac

SEQ ID NO: 2266432 - RNA, 20 nt, Yersinia pestis
uugugcgccaaccgcuugca

SEQ ID NO: 2266433 - RNA, 18 nt, Yersinia pestis
uugugcguaaagaaaaaa

SEQ ID NO: 2266434 - RNA, 23 nt, Yersinia pestis
uugguuagcgccuuuuuuauaau

SEQ ID NO: 2266435 - RNA, 15 nt, Yersinia pestis
uugguguugcaaaac

SEQ ID NO: 2266436 - RNA, 14 nt, Yersinia pestis
uuguaccuguuuuu

SEQ ID NO: 2266437 - RNA, 20 nt, Yersinia pestis
uuguaccaccaaaccccucg

SEQ ID NO: 2266438 - RNA, 14 nt, Yersinia pestis
uuguauagucucca

SEQ ID NO: 2266439 - RNA, 20 nt, Yersinia pestis
uuguauacaauugccugauu

SEQ ID NO: 2266440 - RNA, 23 nt, Yersinia pestis
uugucacggcggccgucacugag

SEQ ID NO: 2266441 - RNA, 18 nt, Yersinia pestis
uugucaccuaaccaaaca

SEQ ID NO: 2266442 - RNA, 14 nt, Yersinia pestis
uugucaccuaacca

SEQ ID NO: 2266443 - RNA, 16 nt, Yersinia pestis
uugucaugaaaaucuu

SEQ ID NO: 2266444 - RNA, 13 nt, Yersinia pestis
uuuaacucaaaua

SEQ ID NO: 2266445 - RNA, 15 nt, Yersinia pestis
uuuaacucaaauaaa

SEQ ID NO: 2266446 - RNA, 19 nt, Yersinia pestis
uuuaacucaauuuuggcug

SEQ ID NO: 2266447 - RNA, 19 nt, Yersinia pestis
uuuaacuuccaauuucuca

SEQ ID NO: 2266448 - RNA, 17 nt, Yersinia pestis
uuuaacccgguuggcua

SEQ ID NO: 2266449 - RNA, 14 nt, Yersinia pestis
uuuaacgucgcuga

SEQ ID NO: 2266450 - RNA, 21 nt, Yersinia pestis
uuuaacgccgcugaccuugcu

SEQ ID NO: 2266451 - RNA, 20 nt, Yersinia pestis
uuuaauuaaauguauaaaaa

SEQ ID NO: 2266452 - RNA, 21 nt, Yersinia pestis
uuuaauuaaauguauaaaaaa

SEQ ID NO: 2266453 - RNA, 17 nt, Yersinia pestis
uuuaauaacuuaucuga

SEQ ID NO: 2266454 - RNA, 17 nt, Yersinia pestis
uuuaauuaguuuaucag

SEQ ID NO: 2266455 - RNA, 15 nt, Yersinia pestis
uuuaauuuaaauaaa

SEQ ID NO: 2266456 - RNA, 16 nt, Yersinia pestis
uuuaauuuaugauuaa

SEQ ID NO: 2266457 - RNA, 13 nt, Yersinia pestis
uuuaaaaucccuc

SEQ ID NO: 2266458 - RNA, 17 nt, Yersinia pestis
uuuaaaacuguggcuga

SEQ ID NO: 2266459 - RNA, 22 nt, Yersinia pestis
uuuaacacauuccaguaaaaaa

SEQ ID NO: 2266460 - RNA, 17 nt, Yersinia pestis
uuuaacaacccauuucc

SEQ ID NO: 2266461 - RNA, 22 nt, Yersinia pestis
uuguuuuuucccagaacauaug

SEQ ID NO: 2266462 - RNA, 13 nt, Yersinia pestis
uuuaaaaccaaau

SEQ ID NO: 2266463 - RNA, 17 nt, Yersinia pestis
uuguuuucaugaugacu

SEQ ID NO: 2266464 - RNA, 19 nt, Yersinia pestis
uuguuuucaugaugacuuu

SEQ ID NO: 2266465 - RNA, 18 nt, Yersinia pestis
uuguuuugacuaaaauuc

SEQ ID NO: 2266466 - RNA, 14 nt, Yersinia pestis
uuggacucuggaau

SEQ ID NO: 2266467 - RNA, 15 nt, Yersinia pestis
uuggauaaaauauua

SEQ ID NO: 2266468 - RNA, 23 nt, Yersinia pestis
uugcuuugggcuaucgccuucau

SEQ ID NO: 2266469 - RNA, 22 nt, Yersinia pestis
uugcuuuuaacuccuugaaacu

SEQ ID NO: 2266470 - RNA, 14 nt, Yersinia pestis
uugcuuuuugcuuu

SEQ ID NO: 2266471 - RNA, 14 nt, Yersinia pestis
uuggaaaacagcaa

SEQ ID NO: 2266472 - RNA, 22 nt, Yersinia pestis
uuggaaaaaucaguauuauaaa

SEQ ID NO: 2266473 - RNA, 15 nt, Yersinia pestis
uugcuuucaggggcu

SEQ ID NO: 2266474 - RNA, 22 nt, Yersinia pestis
uugcuuaucgucaaguucauau

SEQ ID NO: 2266475 - RNA, 14 nt, Yersinia pestis
uugcuuaucacccc

SEQ ID NO: 2266476 - RNA, 17 nt, Yersinia pestis
uugcuuauccagccgcu

SEQ ID NO: 2266477 - RNA, 19 nt, Yersinia pestis
uugcuguuguaggacaaag

SEQ ID NO: 2266478 - RNA, 21 nt, Yersinia pestis
uugcuguuguuauuacuguca

SEQ ID NO: 2266479 - RNA, 19 nt, Yersinia pestis
uugcuccaguugauacagg

SEQ ID NO: 2266480 - RNA, 11 nt, Yersinia pestis
uugcugaauca

SEQ ID NO: 2266481 - RNA, 15 nt, Yersinia pestis
uugcugccaacggcu

SEQ ID NO: 2266482 - RNA, 12 nt, Yersinia pestis
uugcugcaaccg

SEQ ID NO: 2266483 - RNA, 18 nt, Yersinia pestis
uugcugaugucauucuau

SEQ ID NO: 2266484 - RNA, 16 nt, Yersinia pestis
uuggcuaacuggcgcu

SEQ ID NO: 2266485 - RNA, 20 nt, Yersinia pestis
uuggcaugaaguuuaaccaa

SEQ ID NO: 2266486 - RNA, 15 nt, Yersinia pestis
uuggcauguucacau

SEQ ID NO: 2266487 - RNA, 14 nt, Yersinia pestis
uuggccacuggccu

SEQ ID NO: 2266488 - RNA, 13 nt, Yersinia pestis
uuggcggcaccuu

SEQ ID NO: 2266489 - RNA, 14 nt, Yersinia pestis
uugguguugcaaaa

SEQ ID NO: 2266490 - RNA, 20 nt, Yersinia pestis
uugguguguaauuuuuacau

SEQ ID NO: 2266491 - RNA, 18 nt, Yersinia pestis
uuggugucccaaacucug

SEQ ID NO: 2266492 - RNA, 22 nt, Yersinia pestis
uuggugucccaaacucuggaug

SEQ ID NO: 2266493 - RNA, 15 nt, Yersinia pestis
uuggucaauaaaauu

SEQ ID NO: 2266494 - RNA, 16 nt, Yersinia pestis
uugggcuugagcagug

SEQ ID NO: 2266495 - RNA, 23 nt, Yersinia pestis
uugggcuugagcagugcgcggcg

SEQ ID NO: 2266496 - RNA, 21 nt, Yersinia pestis
uugggcaauguugagaaauau

SEQ ID NO: 2266497 - RNA, 14 nt, Yersinia pestis
uugccuuucugggc

SEQ ID NO: 2266498 - RNA, 21 nt, Yersinia pestis
uugcgccgaaauaaaaccauc

SEQ ID NO: 2266499 - RNA, 16 nt, Yersinia pestis
uugcgccggaauaaag

SEQ ID NO: 2266500 - RNA, 16 nt, Yersinia pestis
uugccgccuuccugcu

SEQ ID NO: 2266501 - RNA, 17 nt, Yersinia pestis
uugccggaagagaagca

SEQ ID NO: 2266502 - RNA, 15 nt, Yersinia pestis
uugccgccgggcagc

SEQ ID NO: 2266503 - RNA, 18 nt, Yersinia pestis
uugcgcuucuuguugagu

SEQ ID NO: 2266504 - RNA, 14 nt, Yersinia pestis
uugcgcuccacgcc

SEQ ID NO: 2266505 - RNA, 23 nt, Yersinia pestis
uugcguuaacugcgcuguucauc

SEQ ID NO: 2266506 - RNA, 19 nt, Yersinia pestis
uugcguuaccuaaaacuga

SEQ ID NO: 2266507 - RNA, 13 nt, Yersinia pestis
uugcgugcaauaa

SEQ ID NO: 2266508 - RNA, 21 nt, Yersinia pestis
uugcgcucugacuacugaaac

SEQ ID NO: 2266509 - RNA, 19 nt, Yersinia pestis
uugccaaaauccaccagcg

SEQ ID NO: 2266510 - RNA, 20 nt, Yersinia pestis
uugccaaaugcaaaccaggc

SEQ ID NO: 2266511 - RNA, 21 nt, Yersinia pestis
uugccaaccggauaaaacaau

SEQ ID NO: 2266512 - RNA, 13 nt, Yersinia pestis
uugccacauuucc

SEQ ID NO: 2266513 - RNA, 15 nt, Yersinia pestis
uugcccccugcucca

SEQ ID NO: 2266514 - RNA, 21 nt, Yersinia pestis
uugccacccuaucugcucuug

SEQ ID NO: 2266515 - RNA, 13 nt, Yersinia pestis
uugcccuucagau

SEQ ID NO: 2266516 - RNA, 14 nt, Yersinia pestis
uugcccuucuucag

SEQ ID NO: 2266517 - RNA, 20 nt, Yersinia pestis
uugcccuggagcaagauuuu

SEQ ID NO: 2266518 - RNA, 18 nt, Yersinia pestis
uugcccguuagccaugca

SEQ ID NO: 2266519 - RNA, 15 nt, Yersinia pestis
uugcaucuuuaauua

SEQ ID NO: 2266520 - RNA, 14 nt, Yersinia pestis
uugcauauuucucu

SEQ ID NO: 2266521 - RNA, 14 nt, Yersinia pestis
uugcagacugcuga

SEQ ID NO: 2266522 - RNA, 15 nt, Yersinia pestis
uuuccuacacuggcc

SEQ ID NO: 2266523 - RNA, 14 nt, Yersinia pestis
uuuccguuaaccca

SEQ ID NO: 2266524 - RNA, 16 nt, Yersinia pestis
uuuccucaaacgugau

SEQ ID NO: 2266525 - RNA, 13 nt, Yersinia pestis
uuuccucuucauc

SEQ ID NO: 2266526 - RNA, 15 nt, Yersinia pestis
uuuccucuucaucua

SEQ ID NO: 2266527 - RNA, 17 nt, Yersinia pestis
uuuccugacccggugac

SEQ ID NO: 2266528 - RNA, 11 nt, Yersinia pestis
uuuccucuuua

SEQ ID NO: 2266529 - RNA, 22 nt, Yersinia pestis
uuuccugcacaucaaguacuuc

SEQ ID NO: 2266530 - RNA, 15 nt, Yersinia pestis
uuuccuguauuuccu

SEQ ID NO: 2266531 - RNA, 17 nt, Yersinia pestis
uuuccuguauuuccugu

SEQ ID NO: 2266532 - RNA, 13 nt, Yersinia pestis
uuucgcaguugcc

SEQ ID NO: 2266533 - RNA, 21 nt, Yersinia pestis
uuucgcccaagccgaccauua

SEQ ID NO: 2266534 - RNA, 17 nt, Yersinia pestis
uuuccagaaucaauggg

SEQ ID NO: 2266535 - RNA, 14 nt, Yersinia pestis
uuuccagcaaaagc

SEQ ID NO: 2266536 - RNA, 14 nt, Yersinia pestis
uuuccaggcuacca

SEQ ID NO: 2266537 - RNA, 19 nt, Yersinia pestis
uuuccagcggcguaucaaa

SEQ ID NO: 2266538 - RNA, 20 nt, Yersinia pestis
uuuccagcggcguaucaaac

SEQ ID NO: 2266539 - RNA, 13 nt, Yersinia pestis
uuuccaucacugc

SEQ ID NO: 2266540 - RNA, 15 nt, Yersinia pestis
uuuccaguuucauca

SEQ ID NO: 2266541 - RNA, 15 nt, Yersinia pestis
uuucccuuucucagu

SEQ ID NO: 2266542 - RNA, 13 nt, Yersinia pestis
uuucccguugaua

SEQ ID NO: 2266543 - RNA, 16 nt, Yersinia pestis
uuucccgacagaacug

SEQ ID NO: 2266544 - RNA, 17 nt, Yersinia pestis
uuucccgcuccaaauua

SEQ ID NO: 2266545 - RNA, 15 nt, Yersinia pestis
uuuccccuucauuug

SEQ ID NO: 2266546 - RNA, 15 nt, Yersinia pestis
uuucuaucucaucca

SEQ ID NO: 2266547 - RNA, 17 nt, Yersinia pestis
uuucuauccgaaaaaua

SEQ ID NO: 2266548 - RNA, 16 nt, Yersinia pestis
uuucuauuuucagcau

SEQ ID NO: 2266549 - RNA, 12 nt, Yersinia pestis
uuucuauuucug

SEQ ID NO: 2266550 - RNA, 20 nt, Yersinia pestis
uuucucagguguuacacagu

SEQ ID NO: 2266551 - RNA, 17 nt, Yersinia pestis
uuucucgcucaggaucg

SEQ ID NO: 2266552 - RNA, 21 nt, Yersinia pestis
uuucugaagaugccaaucaaa

SEQ ID NO: 2266553 - RNA, 16 nt, Yersinia pestis
uuucucuaaaauuuua

SEQ ID NO: 2266554 - RNA, 17 nt, Yersinia pestis
uuucucugaugaacgga

SEQ ID NO: 2266555 - RNA, 17 nt, Yersinia pestis
uuucuggcaauuucugu

SEQ ID NO: 2266556 - RNA, 21 nt, Yersinia pestis
uuucugcggcaagcugugccu

SEQ ID NO: 2266557 - RNA, 21 nt, Yersinia pestis
uuucguuuaaaaaauaucuau

SEQ ID NO: 2266558 - RNA, 17 nt, Yersinia pestis
uuucuaacaaaccuaaa

SEQ ID NO: 2266559 - RNA, 19 nt, Yersinia pestis
uuucuacgccgucaucauc

SEQ ID NO: 2266560 - RNA, 15 nt, Yersinia pestis
uuucguuucugucug

SEQ ID NO: 2266561 - RNA, 17 nt, Yersinia pestis
uuucgcuuuacauugcu

SEQ ID NO: 2266562 - RNA, 21 nt, Yersinia pestis
uuucggaucagcgccugcugu

SEQ ID NO: 2266563 - RNA, 15 nt, Yersinia pestis
uuucgcuacugagau

SEQ ID NO: 2266564 - RNA, 14 nt, Yersinia pestis
uuugauuuaaauau

SEQ ID NO: 2266565 - RNA, 16 nt, Yersinia pestis
uuugauuuaaauauua

SEQ ID NO: 2266566 - RNA, 13 nt, Yersinia pestis
uuugaugcuaauu

SEQ ID NO: 2266567 - RNA, 10 nt, Yersinia pestis
uuugagaaag

SEQ ID NO: 2266568 - RNA, 21 nt, Yersinia pestis
uuugagccaccgcauuccagc

SEQ ID NO: 2266569 - RNA, 14 nt, Yersinia pestis
uuugaguaacaaga

SEQ ID NO: 2266570 - RNA, 21 nt, Yersinia pestis
uuugauaaggccaugucacua

SEQ ID NO: 2266571 - RNA, 21 nt, Yersinia pestis
uuugccaccuccgcauccggc

SEQ ID NO: 2266572 - RNA, 20 nt, Yersinia pestis
uuugccagugguuggcagcc

SEQ ID NO: 2266573 - RNA, 22 nt, Yersinia pestis
uuugcauugaccgccaaaucca

SEQ ID NO: 2266574 - RNA, 18 nt, Yersinia pestis
uuugcauugaccgccaaa

SEQ ID NO: 2266575 - RNA, 20 nt, Yersinia pestis
uuugcccgcgcuuccaggcu

SEQ ID NO: 2266576 - RNA, 19 nt, Yersinia pestis
uuugccguuguuaguguau

SEQ ID NO: 2266577 - RNA, 22 nt, Yersinia pestis
uuugccuucauccaacucacca

SEQ ID NO: 2266578 - RNA, 19 nt, Yersinia pestis
uuugcgcagcaaauaaaca

SEQ ID NO: 2266579 - RNA, 23 nt, Yersinia pestis
uuugcgcagcaaauaaacaaaau

SEQ ID NO: 2266580 - RNA, 19 nt, Yersinia pestis
uuugcaauuaauuggccca

SEQ ID NO: 2266581 - RNA, 23 nt, Yersinia pestis
uuugcaacgcaggcacugcagaa

SEQ ID NO: 2266582 - RNA, 20 nt, Yersinia pestis
uuugcacgaucagugaagag

SEQ ID NO: 2266583 - RNA, 18 nt, Yersinia pestis
uuugcagucgcuucaucc

SEQ ID NO: 2266584 - RNA, 19 nt, Yersinia pestis
uuugcagcggaugauaaau

SEQ ID NO: 2266585 - RNA, 21 nt, Yersinia pestis
uuugcauaauuaugaaaguaa

SEQ ID NO: 2266586 - RNA, 13 nt, Yersinia pestis
uuugcauccgcaa

SEQ ID NO: 2266587 - RNA, 15 nt, Yersinia pestis
uuugcaucuggugac

SEQ ID NO: 2266588 - RNA, 15 nt, Yersinia pestis
uuugacauuuccuug

SEQ ID NO: 2266589 - RNA, 19 nt, Yersinia pestis
uuugacacgggaucaacau

SEQ ID NO: 2266590 - RNA, 13 nt, Yersinia pestis
uuugacuuuaauu

SEQ ID NO: 2266591 - RNA, 20 nt, Yersinia pestis
uuugaaccgcuaucugcuga

SEQ ID NO: 2266592 - RNA, 23 nt, Yersinia pestis
uuucuuacuaaaauaucacuaua

SEQ ID NO: 2266593 - RNA, 15 nt, Yersinia pestis
uuucuuaauaauauc

SEQ ID NO: 2266594 - RNA, 11 nt, Yersinia pestis
uuucuugccag

SEQ ID NO: 2266595 - RNA, 19 nt, Yersinia pestis
uuucuuucaggcugguugg

SEQ ID NO: 2266596 - RNA, 15 nt, Yersinia pestis
uuucuucguuugcua

SEQ ID NO: 2266597 - RNA, 15 nt, Yersinia pestis
uuucuucugagauau

SEQ ID NO: 2266598 - RNA, 22 nt, Yersinia pestis
uuucuuccgccagcagaaccau

SEQ ID NO: 2266599 - RNA, 15 nt, Yersinia pestis
uuuauuuauuuccgc

SEQ ID NO: 2266600 - RNA, 16 nt, Yersinia pestis
uuuauuuauuuccgcu

SEQ ID NO: 2266601 - RNA, 12 nt, Yersinia pestis
uuuauuguauaa

SEQ ID NO: 2266602 - RNA, 19 nt, Yersinia pestis
uuuauugucuuuaauaaaa

SEQ ID NO: 2266603 - RNA, 16 nt, Yersinia pestis
uuuauugacuguaaau

SEQ ID NO: 2266604 - RNA, 12 nt, Yersinia pestis
uuuauuaucaau

SEQ ID NO: 2266605 - RNA, 14 nt, Yersinia pestis
uuuauuagacauag

SEQ ID NO: 2266606 - RNA, 16 nt, Yersinia pestis
uuucaaaguaaaauaa

SEQ ID NO: 2266607 - RNA, 19 nt, Yersinia pestis
uuucaaauaguagaucuau

SEQ ID NO: 2266608 - RNA, 13 nt, Yersinia pestis
uuucaaaauugag

SEQ ID NO: 2266609 - RNA, 20 nt, Yersinia pestis
uuucaaaccacuguuuuuca

SEQ ID NO: 2266610 - RNA, 22 nt, Yersinia pestis
uuucaaaccacuguuuuucauu

SEQ ID NO: 2266611 - RNA, 14 nt, Yersinia pestis
uuucaaucacugcg

SEQ ID NO: 2266612 - RNA, 15 nt, Yersinia pestis
uuucaaucacuucug

SEQ ID NO: 2266613 - RNA, 14 nt, Yersinia pestis
uuucacccucugcg

SEQ ID NO: 2266614 - RNA, 22 nt, Yersinia pestis
uuucacuggccuauuaagauaa

SEQ ID NO: 2266615 - RNA, 17 nt, Yersinia pestis
uuucaaugggaugccca

SEQ ID NO: 2266616 - RNA, 18 nt, Yersinia pestis
uuucaauucucccauuua

SEQ ID NO: 2266617 - RNA, 19 nt, Yersinia pestis
uuucacacgcccaggccau

SEQ ID NO: 2266618 - RNA, 20 nt, Yersinia pestis
uuucaggacugucuucaacu

SEQ ID NO: 2266619 - RNA, 22 nt, Yersinia pestis
uuucagacugcugacaacccuc

SEQ ID NO: 2266620 - RNA, 18 nt, Yersinia pestis
uuucagcuugcaacaaaa

SEQ ID NO: 2266621 - RNA, 19 nt, Yersinia pestis
uuucagcuucaagguacug

SEQ ID NO: 2266622 - RNA, 15 nt, Yersinia pestis
uuucagcauaucccu

SEQ ID NO: 2266623 - RNA, 13 nt, Yersinia pestis
uuucaugauucuc

SEQ ID NO: 2266624 - RNA, 19 nt, Yersinia pestis
uuucaugauccacaaugau

SEQ ID NO: 2266625 - RNA, 16 nt, Yersinia pestis
uuucauggguuucuau

SEQ ID NO: 2266626 - RNA, 16 nt, Yersinia pestis
uuucaucgcugaauuu

SEQ ID NO: 2266627 - RNA, 18 nt, Yersinia pestis
uuucaucggcaaaaacag

SEQ ID NO: 2266628 - RNA, 22 nt, Yersinia pestis
uuucaucucaauaacuauuuuu

SEQ ID NO: 2266629 - RNA, 22 nt, Yersinia pestis
uuucauccuaaagauaauuaau

SEQ ID NO: 2266630 - RNA, 17 nt, Yersinia pestis
uuucaucgaaaaaaaua

SEQ ID NO: 2266631 - RNA, 19 nt, Yersinia pestis
uuucaucgaaaaaaauacu

SEQ ID NO: 2266632 - RNA, 17 nt, Yersinia pestis
uuucauuagucaauguu

SEQ ID NO: 2266633 - RNA, 14 nt, Yersinia pestis
uuucauuauuuuca

SEQ ID NO: 2266634 - RNA, 21 nt, Yersinia pestis
uuucauucggcacagccagug

SEQ ID NO: 2266635 - RNA, 21 nt, Yersinia pestis
uuucauuccagauaaaauacu

SEQ ID NO: 2266636 - RNA, 11 nt, Yersinia pestis
uuuccacaaca

SEQ ID NO: 2266637 - RNA, 14 nt, Yersinia pestis
uuuccaagcuaguc

SEQ ID NO: 2266638 - RNA, 20 nt, Yersinia pestis
uuuauagaauacaggguaaa

SEQ ID NO: 2266639 - RNA, 19 nt, Yersinia pestis
uuuauagggucgaauguuc

SEQ ID NO: 2266640 - RNA, 20 nt, Yersinia pestis
uuuauaccggggccaucauc

SEQ ID NO: 2266641 - RNA, 23 nt, Yersinia pestis
uuuauaaauuacucguauaaaaa

SEQ ID NO: 2266642 - RNA, 18 nt, Yersinia pestis
uuuauaaccgucaccaaa

SEQ ID NO: 2266643 - RNA, 19 nt, Yersinia pestis
uuuaucacuuagcucaauc

SEQ ID NO: 2266644 - RNA, 22 nt, Yersinia pestis
uuuaucaguagucaauacaauu

SEQ ID NO: 2266645 - RNA, 19 nt, Yersinia pestis
uuuaucaaucagcugauau

SEQ ID NO: 2266646 - RNA, 15 nt, Yersinia pestis
uuuauauaacagcca

SEQ ID NO: 2266647 - RNA, 13 nt, Yersinia pestis
uuuauauccccua

SEQ ID NO: 2266648 - RNA, 13 nt, Yersinia pestis
uuuauauccccug

SEQ ID NO: 2266649 - RNA, 19 nt, Yersinia pestis
uuuauauuccacauacaaa

SEQ ID NO: 2266650 - RNA, 16 nt, Yersinia pestis
uuuauauugauaaaaa

SEQ ID NO: 2266651 - RNA, 23 nt, Yersinia pestis
uuuauauugaugacugaauuguc

SEQ ID NO: 2266652 - RNA, 13 nt, Yersinia pestis
uuuauauuuuugg

SEQ ID NO: 2266653 - RNA, 13 nt, Yersinia pestis
uuuaugcugccca

SEQ ID NO: 2266654 - RNA, 22 nt, Yersinia pestis
uuuauggaaauuauuuagaaac

SEQ ID NO: 2266655 - RNA, 21 nt, Yersinia pestis
uuuauguacauccaauuuuuu

SEQ ID NO: 2266656 - RNA, 15 nt, Yersinia pestis
uuuauggcuuauccc

SEQ ID NO: 2266657 - RNA, 20 nt, Yersinia pestis
uuuauggcagaaaucagcca

SEQ ID NO: 2266658 - RNA, 21 nt, Yersinia pestis
uuuauggcgaugaugauuauu

SEQ ID NO: 2266659 - RNA, 13 nt, Yersinia pestis
uuuauuaaguuuu

SEQ ID NO: 2266660 - RNA, 21 nt, Yersinia pestis
uuuaucugcauuaaaauaaca

SEQ ID NO: 2266661 - RNA, 19 nt, Yersinia pestis
uuuaucgugaauaaaaaua

SEQ ID NO: 2266662 - RNA, 13 nt, Yersinia pestis
uuuaucggcauuu

SEQ ID NO: 2266663 - RNA, 15 nt, Yersinia pestis
uuuaucaucauaaau

SEQ ID NO: 2266664 - RNA, 13 nt, Yersinia pestis
uuuauccccuucg

SEQ ID NO: 2266665 - RNA, 15 nt, Yersinia pestis
uuuauccuguacaua

SEQ ID NO: 2266666 - RNA, 11 nt, Yersinia pestis
uuuagcaaagc

SEQ ID NO: 2266667 - RNA, 15 nt, Yersinia pestis
uuuagaugucagauu

SEQ ID NO: 2266668 - RNA, 14 nt, Yersinia pestis
uuuagaucucagaa

SEQ ID NO: 2266669 - RNA, 12 nt, Yersinia pestis
uuuagcauugca

SEQ ID NO: 2266670 - RNA, 17 nt, Yersinia pestis
uuuagccccuucacgga

SEQ ID NO: 2266671 - RNA, 14 nt, Yersinia pestis
uuuagcgcuaaauc

SEQ ID NO: 2266672 - RNA, 18 nt, Yersinia pestis
uuuagucaaaacaauauc

SEQ ID NO: 2266673 - RNA, 21 nt, Yersinia pestis
uuuagugcugccagacaauga

SEQ ID NO: 2266674 - RNA, 19 nt, Yersinia pestis
uuuauaaaaaauggaguuu

SEQ ID NO: 2266675 - RNA, 14 nt, Yersinia pestis
uuuauaaaaccacu

SEQ ID NO: 2266676 - RNA, 19 nt, Yersinia pestis
uuuaggccaauuuggccaa

SEQ ID NO: 2266677 - RNA, 21 nt, Yersinia pestis
uuuacuuuaucguccaugcuu

SEQ ID NO: 2266678 - RNA, 12 nt, Yersinia pestis
uuuagaaaacau

SEQ ID NO: 2266679 - RNA, 15 nt, Yersinia pestis
uuuacugcuuuucua

SEQ ID NO: 2266680 - RNA, 14 nt, Yersinia pestis
uuuacuccucugcc

SEQ ID NO: 2266681 - RNA, 19 nt, Yersinia pestis
uuuacuccccaaagccuac

SEQ ID NO: 2266682 - RNA, 20 nt, Yersinia pestis
uuuacuccccugccuauccu

SEQ ID NO: 2266683 - RNA, 18 nt, Yersinia pestis
uuuacuccccugccuauu

SEQ ID NO: 2266684 - RNA, 21 nt, Yersinia pestis
uuuacugcggcuuucugccug

SEQ ID NO: 2266685 - RNA, 18 nt, Yersinia pestis
uuuacugcguaaccccaa

SEQ ID NO: 2266686 - RNA, 14 nt, Yersinia pestis
uuuacgaucggccu

SEQ ID NO: 2266687 - RNA, 22 nt, Yersinia pestis
uuuacguacgccgaacuucauc

SEQ ID NO: 2266688 - RNA, 21 nt, Yersinia pestis
uuuacguagggcggccuuugg

SEQ ID NO: 2266689 - RNA, 17 nt, Yersinia pestis
uuuacuaaauuagaaaa

SEQ ID NO: 2266690 - RNA, 21 nt, Yersinia pestis
uuuacgccuauccucaugauu

SEQ ID NO: 2266691 - RNA, 18 nt, Yersinia pestis
ucagucgcgauaaaauuc

SEQ ID NO: 2266692 - RNA, 21 nt, Yersinia pestis
ucagugaaagggaaguuucuu

SEQ ID NO: 2266693 - RNA, 15 nt, Yersinia pestis
ucaguauuggucuua

SEQ ID NO: 2266694 - RNA, 21 nt, Yersinia pestis
ucagucaguguuucuauuuuc

SEQ ID NO: 2266695 - RNA, 17 nt, Yersinia pestis
ucagucagggugaaagc

SEQ ID NO: 2266696 - RNA, 19 nt, Yersinia pestis
ucagugguuuuauaaauaa

SEQ ID NO: 2266697 - RNA, 20 nt, Yersinia pestis
ucagugucaguucgacaccu

SEQ ID NO: 2266698 - RNA, 16 nt, Yersinia pestis
ucagugggcuauuuau

SEQ ID NO: 2266699 - RNA, 13 nt, Yersinia pestis
ucaguggcuggaa

SEQ ID NO: 2266700 - RNA, 15 nt, Yersinia pestis
ucagugaagagauaa

SEQ ID NO: 2266701 - RNA, 20 nt, Yersinia pestis
ucagugaaggaugaauaaau

SEQ ID NO: 2266702 - RNA, 19 nt, Yersinia pestis
ucagugcacggcagugauc

SEQ ID NO: 2266703 - RNA, 13 nt, Yersinia pestis
ucagugcuauuca

SEQ ID NO: 2266704 - RNA, 15 nt, Yersinia pestis
ucagugcuauucaua

SEQ ID NO: 2266705 - RNA, 18 nt, Yersinia pestis
ucagugauaacaacccua

SEQ ID NO: 2266706 - RNA, 22 nt, Yersinia pestis
ucagugauucgggugagugagc

SEQ ID NO: 2266707 - RNA, 17 nt, Yersinia pestis
ucaguaauucacccuuu

SEQ ID NO: 2266708 - RNA, 22 nt, Yersinia pestis
ucaguaaagcgcaggaaagcau

SEQ ID NO: 2266709 - RNA, 20 nt, Yersinia pestis
ucaguaaauauaauuucaaa

SEQ ID NO: 2266710 - RNA, 13 nt, Yersinia pestis
ucagguuguuccg

SEQ ID NO: 2266711 - RNA, 22 nt, Yersinia pestis
ucagguugaaauaaauaaguuc

SEQ ID NO: 2266712 - RNA, 12 nt, Yersinia pestis
ucaguauaaauu

SEQ ID NO: 2266713 - RNA, 14 nt, Yersinia pestis
ucaguaucaccaga

SEQ ID NO: 2266714 - RNA, 19 nt, Yersinia pestis
ucaguacagucccugugcg

SEQ ID NO: 2266715 - RNA, 15 nt, Yersinia pestis
ucaguaccaccacca

SEQ ID NO: 2266716 - RNA, 15 nt, Yersinia pestis
ucauaaauaaagaua

SEQ ID NO: 2266717 - RNA, 16 nt, Yersinia pestis
ucauaaauaaaagaua

SEQ ID NO: 2266718 - RNA, 12 nt, Yersinia pestis
ucauaaauuaaa

SEQ ID NO: 2266719 - RNA, 17 nt, Yersinia pestis
ucauaaauuaaaacuga

SEQ ID NO: 2266720 - RNA, 20 nt, Yersinia pestis
ucauaaauauuuuaugcccc

SEQ ID NO: 2266721 - RNA, 21 nt, Yersinia pestis
ucauaaauauuuuaugccccc

SEQ ID NO: 2266722 - RNA, 14 nt, Yersinia pestis
ucauaaaaauacau

SEQ ID NO: 2266723 - RNA, 19 nt, Yersinia pestis
ucauaaaaauacauaucaa

SEQ ID NO: 2266724 - RNA, 21 nt, Yersinia pestis
ucaguuuagcuaaauuuaaga

SEQ ID NO: 2266725 - RNA, 17 nt, Yersinia pestis
ucaguuuuaauuuauga

SEQ ID NO: 2266726 - RNA, 15 nt, Yersinia pestis
ucaguuaaucaagcc

SEQ ID NO: 2266727 - RNA, 16 nt, Yersinia pestis
ucaguuaaucaagcca

SEQ ID NO: 2266728 - RNA, 20 nt, Yersinia pestis
ucaguguguuauuuuucucu

SEQ ID NO: 2266729 - RNA, 16 nt, Yersinia pestis
ucaguguuagccccuc

SEQ ID NO: 2266730 - RNA, 15 nt, Yersinia pestis
ucaguucagaaagga

SEQ ID NO: 2266731 - RNA, 12 nt, Yersinia pestis
ucaguucgcguu

SEQ ID NO: 2266732 - RNA, 20 nt, Yersinia pestis
ucaguucgguugccaaaauu

SEQ ID NO: 2266733 - RNA, 13 nt, Yersinia pestis
ucaguugauuuua

SEQ ID NO: 2266734 - RNA, 20 nt, Yersinia pestis
ucaguuuacaugauugaaaa

SEQ ID NO: 2266735 - RNA, 23 nt, Yersinia pestis
ucaucaagauggucauaaauagg

SEQ ID NO: 2266736 - RNA, 22 nt, Yersinia pestis
ucaucaauggauucuugcugca

SEQ ID NO: 2266737 - RNA, 20 nt, Yersinia pestis
ucaucaauggauucuugcug

SEQ ID NO: 2266738 - RNA, 15 nt, Yersinia pestis
ucaucaaauucaggu

SEQ ID NO: 2266739 - RNA, 21 nt, Yersinia pestis
ucaucaaccgggauaucaaau

SEQ ID NO: 2266740 - RNA, 15 nt, Yersinia pestis
ucaucaaacuauuca

SEQ ID NO: 2266741 - RNA, 22 nt, Yersinia pestis
ucaucaaaacugaugguuuccu

SEQ ID NO: 2266742 - RNA, 13 nt, Yersinia pestis
ucauauuggccag

SEQ ID NO: 2266743 - RNA, 13 nt, Yersinia pestis
ucauauauuaaau

SEQ ID NO: 2266744 - RNA, 15 nt, Yersinia pestis
ucauaucaaaauaaa

SEQ ID NO: 2266745 - RNA, 14 nt, Yersinia pestis
ucauaucaaaauaa

SEQ ID NO: 2266746 - RNA, 16 nt, Yersinia pestis
ucauaucgcuaaaaca

SEQ ID NO: 2266747 - RNA, 20 nt, Yersinia pestis
ucauauccuaucuuuaccca

SEQ ID NO: 2266748 - RNA, 22 nt, Yersinia pestis
ucauaucccccccaagagaaac

SEQ ID NO: 2266749 - RNA, 19 nt, Yersinia pestis
ucauaucuuuaccuguuuc

SEQ ID NO: 2266750 - RNA, 18 nt, Yersinia pestis
ucauaugacaaauaaggc

SEQ ID NO: 2266751 - RNA, 16 nt, Yersinia pestis
ucauaugcgcgucaau

SEQ ID NO: 2266752 - RNA, 21 nt, Yersinia pestis
ucauauucagccgauguguuu

SEQ ID NO: 2266753 - RNA, 22 nt, Yersinia pestis
ucauauguucgaucaaaacaau

SEQ ID NO: 2266754 - RNA, 18 nt, Yersinia pestis
ucauacacggucuggcaa

SEQ ID NO: 2266755 - RNA, 21 nt, Yersinia pestis
ucauaauucagcaaacucagc

SEQ ID NO: 2266756 - RNA, 13 nt, Yersinia pestis
ucauacaucauuu

SEQ ID NO: 2266757 - RNA, 22 nt, Yersinia pestis
ucauaccggcggcacacuggau

SEQ ID NO: 2266758 - RNA, 19 nt, Yersinia pestis
ucauaccauucucugucuu

SEQ ID NO: 2266759 - RNA, 18 nt, Yersinia pestis
ucauaacuaagagucaca

SEQ ID NO: 2266760 - RNA, 13 nt, Yersinia pestis
ucauaauaaugau

SEQ ID NO: 2266761 - RNA, 15 nt, Yersinia pestis
ucauaauaaugauua

SEQ ID NO: 2266762 - RNA, 16 nt, Yersinia pestis
ucauaccggcuucacg

SEQ ID NO: 2266763 - RNA, 22 nt, Yersinia pestis
ucauaccuuacuuccaauaagu

SEQ ID NO: 2266764 - RNA, 21 nt, Yersinia pestis
ucauacucccccauuuccugu

SEQ ID NO: 2266765 - RNA, 12 nt, Yersinia pestis
ucauacucaguc

SEQ ID NO: 2266766 - RNA, 16 nt, Yersinia pestis
ucauacucccccauuu

SEQ ID NO: 2266767 - RNA, 23 nt, Yersinia pestis
ucauagaaggcggagaauguuaa

SEQ ID NO: 2266768 - RNA, 20 nt, Yersinia pestis
ucauagccaucccaauaauu

SEQ ID NO: 2266769 - RNA, 18 nt, Yersinia pestis
ucauagcgaauaauggca

SEQ ID NO: 2266770 - RNA, 15 nt, Yersinia pestis
ucaggaucaccagca

SEQ ID NO: 2266771 - RNA, 22 nt, Yersinia pestis
ucagguaucgcuuucagcaggg

SEQ ID NO: 2266772 - RNA, 15 nt, Yersinia pestis
ucagguucaauuccc

SEQ ID NO: 2266773 - RNA, 23 nt, Yersinia pestis
ucaggugaguaaacaccuucaga

SEQ ID NO: 2266774 - RNA, 16 nt, Yersinia pestis
ucaggucgauuacaua

SEQ ID NO: 2266775 - RNA, 15 nt, Yersinia pestis
ucaggcucaucaccu

SEQ ID NO: 2266776 - RNA, 21 nt, Yersinia pestis
ucaggcucaucaccuuccaaa

SEQ ID NO: 2266777 - RNA, 21 nt, Yersinia pestis
ucagggcguauaaacagagcc

SEQ ID NO: 2266778 - RNA, 18 nt, Yersinia pestis
ucagggcgucucuacgac

SEQ ID NO: 2266779 - RNA, 22 nt, Yersinia pestis
ucagggccacuucgguggcccu

SEQ ID NO: 2266780 - RNA, 18 nt, Yersinia pestis
ucagggccagcauaguaa

SEQ ID NO: 2266781 - RNA, 13 nt, Yersinia pestis
ucagggcaauaac

SEQ ID NO: 2266782 - RNA, 21 nt, Yersinia pestis
ucagggcaauaacaaacacau

SEQ ID NO: 2266783 - RNA, 16 nt, Yersinia pestis
ucagggagucagggag

SEQ ID NO: 2266784 - RNA, 15 nt, Yersinia pestis
ucagcucaccaccuc

SEQ ID NO: 2266785 - RNA, 15 nt, Yersinia pestis
ucagcucauuaaacu

SEQ ID NO: 2266786 - RNA, 21 nt, Yersinia pestis
ucagcguuuuaaucacaucuc

SEQ ID NO: 2266787 - RNA, 17 nt, Yersinia pestis
ucagcucuucaauuucc

SEQ ID NO: 2266788 - RNA, 15 nt, Yersinia pestis
ucagcugacgcagca

SEQ ID NO: 2266789 - RNA, 21 nt, Yersinia pestis
ucagcuuaccgguaaguaauu

SEQ ID NO: 2266790 - RNA, 17 nt, Yersinia pestis
ucagcuuucucugcgcu

SEQ ID NO: 2266791 - RNA, 18 nt, Yersinia pestis
ucaggaaaugcagacucu

SEQ ID NO: 2266792 - RNA, 14 nt, Yersinia pestis
ucaggaaauuacca

SEQ ID NO: 2266793 - RNA, 19 nt, Yersinia pestis
ucaggaagagaaaagcaga

SEQ ID NO: 2266794 - RNA, 20 nt, Yersinia pestis
uaucuucccuguccagccca

SEQ ID NO: 2266795 - RNA, 14 nt, Yersinia pestis
uaucuucaacuguc

SEQ ID NO: 2266796 - RNA, 17 nt, Yersinia pestis
ucagcguauggggaaaa

SEQ ID NO: 2266797 - RNA, 21 nt, Yersinia pestis
ucagcguagccguuaaauauc

SEQ ID NO: 2266798 - RNA, 15 nt, Yersinia pestis
ucagcguauagccuu

SEQ ID NO: 2266799 - RNA, 17 nt, Yersinia pestis
ucagcguggaauuaaua

SEQ ID NO: 2266800 - RNA, 23 nt, Yersinia pestis
ucagcggagcugacgucagaucg

SEQ ID NO: 2266801 - RNA, 21 nt, Yersinia pestis
ucagcgcuuggcucuggagcu

SEQ ID NO: 2266802 - RNA, 20 nt, Yersinia pestis
ucagcgcuuggcucuggagc

SEQ ID NO: 2266803 - RNA, 15 nt, Yersinia pestis
ucaucacugaaagug

SEQ ID NO: 2266804 - RNA, 21 nt, Yersinia pestis
ucaucacugccgucaaugccu

SEQ ID NO: 2266805 - RNA, 12 nt, Yersinia pestis
ucaucagcagag

SEQ ID NO: 2266806 - RNA, 16 nt, Yersinia pestis
ucaucagagucuguca

SEQ ID NO: 2266807 - RNA, 13 nt, Yersinia pestis
ucaucagcgccuu

SEQ ID NO: 2266808 - RNA, 14 nt, Yersinia pestis
ucaucagcgcuggc

SEQ ID NO: 2266809 - RNA, 20 nt, Yersinia pestis
ucaucacuaacgacagauua

SEQ ID NO: 2266810 - RNA, 17 nt, Yersinia pestis
ucaucaccuuccaaacu

SEQ ID NO: 2266811 - RNA, 20 nt, Yersinia pestis
ucaucaccguugaaaugucc

SEQ ID NO: 2266812 - RNA, 19 nt, Yersinia pestis
ucaucaccagucagccuua

SEQ ID NO: 2266813 - RNA, 13 nt, Yersinia pestis
ucaucaccauuca

SEQ ID NO: 2266814 - RNA, 14 nt, Yersinia pestis
ucaucauaaaaaua

SEQ ID NO: 2266815 - RNA, 14 nt, Yersinia pestis
ucaucaucaaugga

SEQ ID NO: 2266816 - RNA, 13 nt, Yersinia pestis
ucaucaucauauu

SEQ ID NO: 2266817 - RNA, 14 nt, Yersinia pestis
ucaucaucuucuuc

SEQ ID NO: 2266818 - RNA, 19 nt, Yersinia pestis
ucaucaucuuuaauaauag

SEQ ID NO: 2266819 - RNA, 15 nt, Yersinia pestis
ucauccaacuuaccu

SEQ ID NO: 2266820 - RNA, 21 nt, Yersinia pestis
ucauccaacuuaccuugaucc

SEQ ID NO: 2266821 - RNA, 13 nt, Yersinia pestis
ucaucauuuuuua

SEQ ID NO: 2266822 - RNA, 18 nt, Yersinia pestis
ucaucauggauaaagccu

SEQ ID NO: 2266823 - RNA, 22 nt, Yersinia pestis
ucaucauucauuuuaaaaaaau

SEQ ID NO: 2266824 - RNA, 19 nt, Yersinia pestis
ucauccaguuuggcugcca

SEQ ID NO: 2266825 - RNA, 21 nt, Yersinia pestis
ucauccaggguuuugaaauca

SEQ ID NO: 2266826 - RNA, 13 nt, Yersinia pestis
ucauccagcucaa

SEQ ID NO: 2266827 - RNA, 14 nt, Yersinia pestis
ucaucccaagagaa

SEQ ID NO: 2266828 - RNA, 18 nt, Yersinia pestis
ucaucccaagagaacgga

SEQ ID NO: 2266829 - RNA, 14 nt, Yersinia pestis
ucauccauaaguau

SEQ ID NO: 2266830 - RNA, 18 nt, Yersinia pestis
ucaucccaaucaucaucc

SEQ ID NO: 2266831 - RNA, 20 nt, Yersinia pestis
ucaucccuuuagcgucuaac

SEQ ID NO: 2266832 - RNA, 16 nt, Yersinia pestis
ucauccgcucagcaaa

SEQ ID NO: 2266833 - RNA, 15 nt, Yersinia pestis
ucauccgcuccagcc

SEQ ID NO: 2266834 - RNA, 14 nt, Yersinia pestis
ucauccuaaagaua

SEQ ID NO: 2266835 - RNA, 14 nt, Yersinia pestis
ucauccguaaaaaa

SEQ ID NO: 2266836 - RNA, 17 nt, Yersinia pestis
ucauccguaaaaaaccu

SEQ ID NO: 2266837 - RNA, 20 nt, Yersinia pestis
ucaucgcugagggccaugcc

SEQ ID NO: 2266838 - RNA, 20 nt, Yersinia pestis
ucaucgcggguuuuuaacuu

SEQ ID NO: 2266839 - RNA, 18 nt, Yersinia pestis
ucaucgcuaaauacugcu

SEQ ID NO: 2266840 - RNA, 20 nt, Yersinia pestis
ucaucgcuaacccucaguaa

SEQ ID NO: 2266841 - RNA, 16 nt, Yersinia pestis
ucaucgcggaugccuu

SEQ ID NO: 2266842 - RNA, 17 nt, Yersinia pestis
ucaucgcggaugccuuu

SEQ ID NO: 2266843 - RNA, 21 nt, Yersinia pestis
ucaucgccgcaaauuaacaca

SEQ ID NO: 2266844 - RNA, 22 nt, Yersinia pestis
ucaucgcaccauaaccaaucca

SEQ ID NO: 2266845 - RNA, 14 nt, Yersinia pestis
ucaucgaaauuccc

SEQ ID NO: 2266846 - RNA, 15 nt, Yersinia pestis
ucaucgaaaaaaaua

SEQ ID NO: 2266847 - RNA, 17 nt, Yersinia pestis
ucauccugcuauuuaac

SEQ ID NO: 2266848 - RNA, 22 nt, Yersinia pestis
ucaucuacaacaucaucgucaa

SEQ ID NO: 2266849 - RNA, 16 nt, Yersinia pestis
ucaucucaauaacuau

SEQ ID NO: 2266850 - RNA, 21 nt, Yersinia pestis
ucaucucaauaacuauuuuug

SEQ ID NO: 2266851 - RNA, 21 nt, Yersinia pestis
ucaucgucggcccggccaggc

SEQ ID NO: 2266852 - RNA, 17 nt, Yersinia pestis
ucaucgcuugaucacga

SEQ ID NO: 2266853 - RNA, 17 nt, Yersinia pestis
ucaucggcaaaaacagu

SEQ ID NO: 2266854 - RNA, 20 nt, Yersinia pestis
ucaucgggguuugucagcag

SEQ ID NO: 2266855 - RNA, 20 nt, Yersinia pestis
ucaucuugggcgggaucucc

SEQ ID NO: 2266856 - RNA, 16 nt, Yersinia pestis
ucaucuuuaauaauag

SEQ ID NO: 2266857 - RNA, 17 nt, Yersinia pestis
ucaucuuuaauaauaga

SEQ ID NO: 2266858 - RNA, 12 nt, Yersinia pestis
ucaucuucuuca

SEQ ID NO: 2266859 - RNA, 13 nt, Yersinia pestis
ucaucuucuucau

SEQ ID NO: 2266860 - RNA, 14 nt, Yersinia pestis
ucaucuucaucagg

SEQ ID NO: 2266861 - RNA, 17 nt, Yersinia pestis
ucaucuucaucagggaa

SEQ ID NO: 2266862 - RNA, 16 nt, Yersinia pestis
ucaucugaccaaacau

SEQ ID NO: 2266863 - RNA, 20 nt, Yersinia pestis
ucaucuggugaaugcgggcc

SEQ ID NO: 2266864 - RNA, 18 nt, Yersinia pestis
ucaucuggugagaacacg

SEQ ID NO: 2266865 - RNA, 23 nt, Yersinia pestis
ucaucugguuuuuuuauaaauua

SEQ ID NO: 2266866 - RNA, 21 nt, Yersinia pestis
ucaugauaaaacuauucugcu

SEQ ID NO: 2266867 - RNA, 16 nt, Yersinia pestis
ucaugacaucccagca

SEQ ID NO: 2266868 - RNA, 13 nt, Yersinia pestis
ucaugagaaguuu

SEQ ID NO: 2266869 - RNA, 15 nt, Yersinia pestis
ucaugaaugaggcug

SEQ ID NO: 2266870 - RNA, 17 nt, Yersinia pestis
ucaucuuuugcuauuaa

SEQ ID NO: 2266871 - RNA, 15 nt, Yersinia pestis
ucaucuuuugcuauu

SEQ ID NO: 2266872 - RNA, 13 nt, Yersinia pestis
ucaucuuuuucug

SEQ ID NO: 2266873 - RNA, 13 nt, Yersinia pestis
ucaucuuucucau

SEQ ID NO: 2266874 - RNA, 18 nt, Yersinia pestis
ucaucuuucucauuagcg

SEQ ID NO: 2266875 - RNA, 15 nt, Yersinia pestis
ucaucuuuuucugcc

SEQ ID NO: 2266876 - RNA, 13 nt, Yersinia pestis
ucaugcucacaau

SEQ ID NO: 2266877 - RNA, 18 nt, Yersinia pestis
ucaugcuaauaccacaac

SEQ ID NO: 2266878 - RNA, 14 nt, Yersinia pestis
ucauuacucagcuu

SEQ ID NO: 2266879 - RNA, 22 nt, Yersinia pestis
ucauuacccucauguaagccaa

SEQ ID NO: 2266880 - RNA, 16 nt, Yersinia pestis
ucauuaccaauaccau

SEQ ID NO: 2266881 - RNA, 15 nt, Yersinia pestis
ucauuacaucaucuu

SEQ ID NO: 2266882 - RNA, 23 nt, Yersinia pestis
ucauuaauccccggucacuuaaa

SEQ ID NO: 2266883 - RNA, 19 nt, Yersinia pestis
ucauuaacacaucuauuuu

SEQ ID NO: 2266884 - RNA, 19 nt, Yersinia pestis
ucauuaaaugcuuuuugcg

SEQ ID NO: 2266885 - RNA, 17 nt, Yersinia pestis
ucauguuuaaacacuua

SEQ ID NO: 2266886 - RNA, 13 nt, Yersinia pestis
ucauguugaccaa

SEQ ID NO: 2266887 - RNA, 13 nt, Yersinia pestis
ucauguugcaaca

SEQ ID NO: 2266888 - RNA, 17 nt, Yersinia pestis
ucauguucgcacugcuc

SEQ ID NO: 2266889 - RNA, 15 nt, Yersinia pestis
ucauguaaggcaaua

SEQ ID NO: 2266890 - RNA, 21 nt, Yersinia pestis
ucauguaaggcaauaccaaua

SEQ ID NO: 2266891 - RNA, 15 nt, Yersinia pestis
ucaugucaugagguu

SEQ ID NO: 2266892 - RNA, 22 nt, Yersinia pestis
ucaugucaugagguugugcguu

SEQ ID NO: 2266893 - RNA, 18 nt, Yersinia pestis
ucauggccugaugcaccu

SEQ ID NO: 2266894 - RNA, 16 nt, Yersinia pestis
ucaugguacaacugcg

SEQ ID NO: 2266895 - RNA, 21 nt, Yersinia pestis
ucauuagccagccaauggcca

SEQ ID NO: 2266896 - RNA, 20 nt, Yersinia pestis
ucauuagccguuguucaccc

SEQ ID NO: 2266897 - RNA, 19 nt, Yersinia pestis
ucauuagugcccaacggca

SEQ ID NO: 2266898 - RNA, 14 nt, Yersinia pestis
ucauuauggauaau

SEQ ID NO: 2266899 - RNA, 13 nt, Yersinia pestis
ucauuauuuucac

SEQ ID NO: 2266900 - RNA, 19 nt, Yersinia pestis
ucauucaauuguuccauau

SEQ ID NO: 2266901 - RNA, 16 nt, Yersinia pestis
ucauuauuugauauag

SEQ ID NO: 2266902 - RNA, 23 nt, Yersinia pestis
ucauuauuaaacuugcucuuuca

SEQ ID NO: 2266903 - RNA, 18 nt, Yersinia pestis
ucauugagcauaucaauc

SEQ ID NO: 2266904 - RNA, 22 nt, Yersinia pestis
ucauugagaucaguucaguauu

SEQ ID NO: 2266905 - RNA, 21 nt, Yersinia pestis
ucauugaggguugucagcagu

SEQ ID NO: 2266906 - RNA, 22 nt, Yersinia pestis
ucauugccacgacgcagcucca

SEQ ID NO: 2266907 - RNA, 21 nt, Yersinia pestis
ucauucugaucgaguucagug

SEQ ID NO: 2266908 - RNA, 22 nt, Yersinia pestis
ucauucccgauaauuauaaauu

SEQ ID NO: 2266909 - RNA, 15 nt, Yersinia pestis
ucauucaugaggcuu

SEQ ID NO: 2266910 - RNA, 16 nt, Yersinia pestis
ucauucauuuuaaaaa

SEQ ID NO: 2266911 - RNA, 17 nt, Yersinia pestis
ucauucauuuuaaaaaa

SEQ ID NO: 2266912 - RNA, 17 nt, Yersinia pestis
ucauuccccaucgccaa

SEQ ID NO: 2266913 - RNA, 22 nt, Yersinia pestis
uccaaaauaauauaauucaaua

SEQ ID NO: 2266914 - RNA, 20 nt, Yersinia pestis
uccaaaacaucggccagcgu

SEQ ID NO: 2266915 - RNA, 15 nt, Yersinia pestis
uccaaaaaacugcgg

SEQ ID NO: 2266916 - RNA, 22 nt, Yersinia pestis
ucauuuuuugggaugaaaaaua

SEQ ID NO: 2266917 - RNA, 14 nt, Yersinia pestis
uccaaaugaaaaau

SEQ ID NO: 2266918 - RNA, 18 nt, Yersinia pestis
uccaaaugaacuaucgcc

SEQ ID NO: 2266919 - RNA, 20 nt, Yersinia pestis
uccaaaugacagcaucaaua

SEQ ID NO: 2266920 - RNA, 13 nt, Yersinia pestis
uccaacucaccuu

SEQ ID NO: 2266921 - RNA, 18 nt, Yersinia pestis
uccaacauguugaaaucu

SEQ ID NO: 2266922 - RNA, 12 nt, Yersinia pestis
uccaaccaaccu

SEQ ID NO: 2266923 - RNA, 14 nt, Yersinia pestis
ucauuuucuguuga

SEQ ID NO: 2266924 - RNA, 16 nt, Yersinia pestis
ucauuuuguuuucucu

SEQ ID NO: 2266925 - RNA, 17 nt, Yersinia pestis
ucauuuuguuuucucuu

SEQ ID NO: 2266926 - RNA, 13 nt, Yersinia pestis
ucauuuuucccuu

SEQ ID NO: 2266927 - RNA, 16 nt, Yersinia pestis
ucauuuuaacaauuuu

SEQ ID NO: 2266928 - RNA, 13 nt, Yersinia pestis
ucauuuuaaaaaa

SEQ ID NO: 2266929 - RNA, 18 nt, Yersinia pestis
ucauuucccgugcacugc

SEQ ID NO: 2266930 - RNA, 21 nt, Yersinia pestis
ucauuucccgugcacugcgau

SEQ ID NO: 2266931 - RNA, 18 nt, Yersinia pestis
ucauugcuguuguuauua

SEQ ID NO: 2266932 - RNA, 18 nt, Yersinia pestis
ucauugcucuggauagca

SEQ ID NO: 2266933 - RNA, 18 nt, Yersinia pestis
ucauugcugcuguuauua

SEQ ID NO: 2266934 - RNA, 19 nt, Yersinia pestis
ucauuucaacuauuuggug

SEQ ID NO: 2266935 - RNA, 12 nt, Yersinia pestis
ucauuuaaauac

SEQ ID NO: 2266936 - RNA, 12 nt, Yersinia pestis
ucauuuaaaaua

SEQ ID NO: 2266937 - RNA, 11 nt, Yersinia pestis
ucauuuaacug

SEQ ID NO: 2266938 - RNA, 19 nt, Yersinia pestis
ucauuuaauuuauccaacu

SEQ ID NO: 2266939 - RNA, 15 nt, Yersinia pestis
uccauacgaauuuuu

SEQ ID NO: 2266940 - RNA, 18 nt, Yersinia pestis
uccauagauacacuccau

SEQ ID NO: 2266941 - RNA, 22 nt, Yersinia pestis
uccauagugauuauuuaaacaa

SEQ ID NO: 2266942 - RNA, 16 nt, Yersinia pestis
uccauaaguauuuauu

SEQ ID NO: 2266943 - RNA, 21 nt, Yersinia pestis
uccauaaacggaacucaucuu

SEQ ID NO: 2266944 - RNA, 20 nt, Yersinia pestis
uccauauagccccaacacug

SEQ ID NO: 2266945 - RNA, 15 nt, Yersinia pestis
uccaucaaaggagaa

SEQ ID NO: 2266946 - RNA, 19 nt, Yersinia pestis
uccauauuuuagcggccuc

SEQ ID NO: 2266947 - RNA, 15 nt, Yersinia pestis
uccaucagacauauu

SEQ ID NO: 2266948 - RNA, 23 nt, Yersinia pestis
uccaucggccagugcgccggccu

SEQ ID NO: 2266949 - RNA, 16 nt, Yersinia pestis
uccaguucaacaccaa

SEQ ID NO: 2266950 - RNA, 15 nt, Yersinia pestis
uccaguuaucaucgu

SEQ ID NO: 2266951 - RNA, 17 nt, Yersinia pestis
uccagugaaaucaucac

SEQ ID NO: 2266952 - RNA, 18 nt, Yersinia pestis
uccagugcgcgauaaacg

SEQ ID NO: 2266953 - RNA, 18 nt, Yersinia pestis
uccaguaaaagaauaaau

SEQ ID NO: 2266954 - RNA, 18 nt, Yersinia pestis
uccaguaagcuguugacc

SEQ ID NO: 2266955 - RNA, 16 nt, Yersinia pestis
uccaggguaauaagug

SEQ ID NO: 2266956 - RNA, 15 nt, Yersinia pestis
uccagcaucgcugag

SEQ ID NO: 2266957 - RNA, 20 nt, Yersinia pestis
uccagcagccucuaacauac

SEQ ID NO: 2266958 - RNA, 13 nt, Yersinia pestis
uccagcguaaaca

SEQ ID NO: 2266959 - RNA, 17 nt, Yersinia pestis
uccagcucauauaauca

SEQ ID NO: 2266960 - RNA, 19 nt, Yersinia pestis
uccaggacauccagcggug

SEQ ID NO: 2266961 - RNA, 22 nt, Yersinia pestis
uccaggauauucacguuuuucc

SEQ ID NO: 2266962 - RNA, 21 nt, Yersinia pestis
uccaggcuaugcuuaauuugg

SEQ ID NO: 2266963 - RNA, 14 nt, Yersinia pestis
uccaggcuggccac

SEQ ID NO: 2266964 - RNA, 16 nt, Yersinia pestis
uccaggcuaccaaggc

SEQ ID NO: 2266965 - RNA, 21 nt, Yersinia pestis
uccacuuuaccgauuucaggu

SEQ ID NO: 2266966 - RNA, 20 nt, Yersinia pestis
uccacugcguacucacccca

SEQ ID NO: 2266967 - RNA, 11 nt, Yersinia pestis
uccacuuauau

SEQ ID NO: 2266968 - RNA, 22 nt, Yersinia pestis
uccacuacuuauuuccgcgccg

SEQ ID NO: 2266969 - RNA, 18 nt, Yersinia pestis
uccacuacucaguugcag

SEQ ID NO: 2266970 - RNA, 12 nt, Yersinia pestis
uccacuaacccc

SEQ ID NO: 2266971 - RNA, 14 nt, Yersinia pestis
uccacucucugcuu

SEQ ID NO: 2266972 - RNA, 21 nt, Yersinia pestis
uccacgggcgcaauggaagaa

SEQ ID NO: 2266973 - RNA, 14 nt, Yersinia pestis
uccacgguauuagu

SEQ ID NO: 2266974 - RNA, 15 nt, Yersinia pestis
uccaccugaucaugc

SEQ ID NO: 2266975 - RNA, 16 nt, Yersinia pestis
uccacgcccaacucuu

SEQ ID NO: 2266976 - RNA, 15 nt, Yersinia pestis
uccagcaaaagccuc

SEQ ID NO: 2266977 - RNA, 14 nt, Yersinia pestis
uccagaugccaaau

SEQ ID NO: 2266978 - RNA, 14 nt, Yersinia pestis
uccagcaacucaag

SEQ ID NO: 2266979 - RNA, 22 nt, Yersinia pestis
uccagcaaauuagacacgccgg

SEQ ID NO: 2266980 - RNA, 15 nt, Yersinia pestis
uccagcaccccuuca

SEQ ID NO: 2266981 - RNA, 20 nt, Yersinia pestis
uccagaacaauaccgccaau

SEQ ID NO: 2266982 - RNA, 14 nt, Yersinia pestis
uccagaacaauacc

SEQ ID NO: 2266983 - RNA, 17 nt, Yersinia pestis
uccagaauaucuucaac

SEQ ID NO: 2266984 - RNA, 16 nt, Yersinia pestis
uccagaauauaaaagc

SEQ ID NO: 2266985 - RNA, 23 nt, Yersinia pestis
uccagaauauaaaagcacagaca

SEQ ID NO: 2266986 - RNA, 22 nt, Yersinia pestis
uccagauagcgaaucacaucau

SEQ ID NO: 2266987 - RNA, 20 nt, Yersinia pestis
uccagauaacauacaccauc

SEQ ID NO: 2266988 - RNA, 18 nt, Yersinia pestis
uccaacuucuuccauuaa

SEQ ID NO: 2266989 - RNA, 18 nt, Yersinia pestis
uccaagacggacgugaau

SEQ ID NO: 2266990 - RNA, 21 nt, Yersinia pestis
uccaacuaaacagggcagaaa

SEQ ID NO: 2266991 - RNA, 23 nt, Yersinia pestis
uccaacuaaacagggcagaaaau

SEQ ID NO: 2266992 - RNA, 15 nt, Yersinia pestis
uccaacugagugagc

SEQ ID NO: 2266993 - RNA, 18 nt, Yersinia pestis
uccaagcacacugguuga

SEQ ID NO: 2266994 - RNA, 14 nt, Yersinia pestis
uccaauaacuaaca

SEQ ID NO: 2266995 - RNA, 19 nt, Yersinia pestis
uccaauaagucacuuuccu

SEQ ID NO: 2266996 - RNA, 20 nt, Yersinia pestis
uccaaucauucugucaucaa

SEQ ID NO: 2266997 - RNA, 15 nt, Yersinia pestis
uccacaaacucaugc

SEQ ID NO: 2266998 - RNA, 20 nt, Yersinia pestis
uccacaaauuuuuaccuucu

SEQ ID NO: 2266999 - RNA, 15 nt, Yersinia pestis
uccacaaucagcccg

SEQ ID NO: 2267000 - RNA, 17 nt, Yersinia pestis
uccaauucauaauagcg

SEQ ID NO: 2267001 - RNA, 15 nt, Yersinia pestis
uccaauuuaccacua

SEQ ID NO: 2267002 - RNA, 14 nt, Yersinia pestis
uccaauuucucaaa

SEQ ID NO: 2267003 - RNA, 22 nt, Yersinia pestis
uccacccggcauuguuggcccg

SEQ ID NO: 2267004 - RNA, 15 nt, Yersinia pestis
uccacaccaacagac

SEQ ID NO: 2267005 - RNA, 21 nt, Yersinia pestis
uccacacccucucuuuccagc

SEQ ID NO: 2267006 - RNA, 11 nt, Yersinia pestis
uccacacaaaa

SEQ ID NO: 2267007 - RNA, 20 nt, Yersinia pestis
uccacacagcauucugcuuc

SEQ ID NO: 2267008 - RNA, 16 nt, Yersinia pestis
uccacacaguauucug

SEQ ID NO: 2267009 - RNA, 20 nt, Yersinia pestis
uccacacaguauucugcuuc

SEQ ID NO: 2267010 - RNA, 21 nt, Yersinia pestis
uccacauaaaaagaaaaaaac

SEQ ID NO: 2267011 - RNA, 20 nt, Yersinia pestis
uccacauaaaauagcccagu

SEQ ID NO: 2267012 - RNA, 23 nt, Yersinia pestis
uccacauaaaauagcccagugcg

SEQ ID NO: 2267013 - RNA, 17 nt, Yersinia pestis
uccacagucaguucauu

SEQ ID NO: 2267014 - RNA, 19 nt, Yersinia pestis
uccacauauauagagaaau

SEQ ID NO: 2267015 - RNA, 23 nt, Yersinia pestis
uccaccaacggcccaauauugau

SEQ ID NO: 2267016 - RNA, 20 nt, Yersinia pestis
ucccaugcuggcccaguaga

SEQ ID NO: 2267017 - RNA, 16 nt, Yersinia pestis
ucccauacccacuaau

SEQ ID NO: 2267018 - RNA, 18 nt, Yersinia pestis
ucccauacccacuaauac

SEQ ID NO: 2267019 - RNA, 23 nt, Yersinia pestis
ucccaucgaacgcgucacuggcc

SEQ ID NO: 2267020 - RNA, 13 nt, Yersinia pestis
ucccauuuauuac

SEQ ID NO: 2267021 - RNA, 21 nt, Yersinia pestis
uccccaacucuuucaacuucc

SEQ ID NO: 2267022 - RNA, 23 nt, Yersinia pestis
uccccaaaucccgcuggaagucu

SEQ ID NO: 2267023 - RNA, 17 nt, Yersinia pestis
uccccaauucacgcaag

SEQ ID NO: 2267024 - RNA, 12 nt, Yersinia pestis
ucccagccacca

SEQ ID NO: 2267025 - RNA, 15 nt, Yersinia pestis
ucccaguuuuuaauu

SEQ ID NO: 2267026 - RNA, 16 nt, Yersinia pestis
ucccaguuuuuaauuu

SEQ ID NO: 2267027 - RNA, 14 nt, Yersinia pestis
ucccagucgucuuc

SEQ ID NO: 2267028 - RNA, 14 nt, Yersinia pestis
ucccaguaagcucu

SEQ ID NO: 2267029 - RNA, 17 nt, Yersinia pestis
ucccagucauaaauauc

SEQ ID NO: 2267030 - RNA, 15 nt, Yersinia pestis
uccccccuuuuucaa

SEQ ID NO: 2267031 - RNA, 19 nt, Yersinia pestis
ucccccggaucacuggcua

SEQ ID NO: 2267032 - RNA, 17 nt, Yersinia pestis
ucccccgguuaaugcca

SEQ ID NO: 2267033 - RNA, 17 nt, Yersinia pestis
ucccccuuuggccgcuc

SEQ ID NO: 2267034 - RNA, 20 nt, Yersinia pestis
ucccccuugauucacugauu

SEQ ID NO: 2267035 - RNA, 20 nt, Yersinia pestis
uccccccccacuugaccuuc

SEQ ID NO: 2267036 - RNA, 15 nt, Yersinia pestis
uccccccuucaucga

SEQ ID NO: 2267037 - RNA, 18 nt, Yersinia pestis
ucccccgcgccgacugcu

SEQ ID NO: 2267038 - RNA, 18 nt, Yersinia pestis
uccccgcuugggugagga

SEQ ID NO: 2267039 - RNA, 15 nt, Yersinia pestis
uccccgcuaacugcu

SEQ ID NO: 2267040 - RNA, 20 nt, Yersinia pestis
uccccaggugcuuauuuauu

SEQ ID NO: 2267041 - RNA, 16 nt, Yersinia pestis
uccccagaugaauggu

SEQ ID NO: 2267042 - RNA, 21 nt, Yersinia pestis
uccccaccauugcaaacauca

SEQ ID NO: 2267043 - RNA, 12 nt, Yersinia pestis
uccccaccaaca

SEQ ID NO: 2267044 - RNA, 12 nt, Yersinia pestis
ucccccaccuga

SEQ ID NO: 2267045 - RNA, 20 nt, Yersinia pestis
ucccccaccaguaaacgcca

SEQ ID NO: 2267046 - RNA, 13 nt, Yersinia pestis
uccauuucugguu

SEQ ID NO: 2267047 - RNA, 17 nt, Yersinia pestis
ucccaagaaaagcaccg

SEQ ID NO: 2267048 - RNA, 21 nt, Yersinia pestis
ucccaagaaaagcaccgcagu

SEQ ID NO: 2267049 - RNA, 23 nt, Yersinia pestis
ucccaaggguauaacucaucagu

SEQ ID NO: 2267050 - RNA, 21 nt, Yersinia pestis
ucccaaucaaugcuuuuguac

SEQ ID NO: 2267051 - RNA, 22 nt, Yersinia pestis
ucccaaugaauauuauucaguu

SEQ ID NO: 2267052 - RNA, 19 nt, Yersinia pestis
ucccaaaauagccagcccc

SEQ ID NO: 2267053 - RNA, 12 nt, Yersinia pestis
ucccaaaauaug

SEQ ID NO: 2267054 - RNA, 18 nt, Yersinia pestis
ucccagaacauaugccca

SEQ ID NO: 2267055 - RNA, 19 nt, Yersinia pestis
ucccagaauaauaagccgu

SEQ ID NO: 2267056 - RNA, 17 nt, Yersinia pestis
uccaugaaaacccgccu

SEQ ID NO: 2267057 - RNA, 23 nt, Yersinia pestis
uccaugcccagcguuggcagaaa

SEQ ID NO: 2267058 - RNA, 13 nt, Yersinia pestis
uccaugccauucu

SEQ ID NO: 2267059 - RNA, 14 nt, Yersinia pestis
uccaugaugcuguc

SEQ ID NO: 2267060 - RNA, 19 nt, Yersinia pestis
uccaugagcgcuauuuauc

SEQ ID NO: 2267061 - RNA, 19 nt, Yersinia pestis
uccaugggccucgcuucug

SEQ ID NO: 2267062 - RNA, 20 nt, Yersinia pestis
uccauuacuguccuuuaacu

SEQ ID NO: 2267063 - RNA, 20 nt, Yersinia pestis
uccauguuaggauaggguuu

SEQ ID NO: 2267064 - RNA, 14 nt, Yersinia pestis
uccauucugcagau

SEQ ID NO: 2267065 - RNA, 13 nt, Yersinia pestis
uccauucugcaga

SEQ ID NO: 2267066 - RNA, 20 nt, Yersinia pestis
uccauuagcguauuaaacca

SEQ ID NO: 2267067 - RNA, 13 nt, Yersinia pestis
uccauucagagcg

SEQ ID NO: 2267068 - RNA, 18 nt, Yersinia pestis
ucccuagcgaaguauuaa

SEQ ID NO: 2267069 - RNA, 14 nt, Yersinia pestis
ucccuaaaaucauu

SEQ ID NO: 2267070 - RNA, 14 nt, Yersinia pestis
ucccguauagauua

SEQ ID NO: 2267071 - RNA, 17 nt, Yersinia pestis
ucccguagcaaauaacc

SEQ ID NO: 2267072 - RNA, 18 nt, Yersinia pestis
ucccgugccagauccucu

SEQ ID NO: 2267073 - RNA, 17 nt, Yersinia pestis
ucccgugugauuuccau

SEQ ID NO: 2267074 - RNA, 22 nt, Yersinia pestis
uccccuucgauauuacaguuua

SEQ ID NO: 2267075 - RNA, 18 nt, Yersinia pestis
uccccuuugacagcaucu

SEQ ID NO: 2267076 - RNA, 14 nt, Yersinia pestis
uccccuggcggcua

SEQ ID NO: 2267077 - RNA, 21 nt, Yersinia pestis
ucccgauacucauugcaccuc

SEQ ID NO: 2267078 - RNA, 16 nt, Yersinia pestis
ucccgagcuaacgcuu

SEQ ID NO: 2267079 - RNA, 16 nt, Yersinia pestis
ucccgcaaagccugcc

SEQ ID NO: 2267080 - RNA, 14 nt, Yersinia pestis
ucccgcaaagccug

SEQ ID NO: 2267081 - RNA, 19 nt, Yersinia pestis
ucccgaugauugcaucauc

SEQ ID NO: 2267082 - RNA, 18 nt, Yersinia pestis
ucccgauauaaauaaaau

SEQ ID NO: 2267083 - RNA, 19 nt, Yersinia pestis
ucccgauauaaauaaaaua

SEQ ID NO: 2267084 - RNA, 19 nt, Yersinia pestis
ucccgauacccauuuuaau

SEQ ID NO: 2267085 - RNA, 13 nt, Yersinia pestis
ucccuucugaaac

SEQ ID NO: 2267086 - RNA, 14 nt, Yersinia pestis
ucccuucugaaacu

SEQ ID NO: 2267087 - RNA, 19 nt, Yersinia pestis
ucccuucaaucaaugaacc

SEQ ID NO: 2267088 - RNA, 15 nt, Yersinia pestis
ucccuuuuaccgaaa

SEQ ID NO: 2267089 - RNA, 15 nt, Yersinia pestis
ucccuuucucaguga

SEQ ID NO: 2267090 - RNA, 14 nt, Yersinia pestis
ucccuuguugccuu

SEQ ID NO: 2267091 - RNA, 16 nt, Yersinia pestis
ucccuuguugccuuuc

SEQ ID NO: 2267092 - RNA, 15 nt, Yersinia pestis
ucccugcauaaaaau

SEQ ID NO: 2267093 - RNA, 18 nt, Yersinia pestis
ucccugauggggcaauca

SEQ ID NO: 2267094 - RNA, 17 nt, Yersinia pestis
ucccuccgccagcaagu

SEQ ID NO: 2267095 - RNA, 15 nt, Yersinia pestis
uccgcaacauagccc

SEQ ID NO: 2267096 - RNA, 17 nt, Yersinia pestis
uccgauaauaauuccau

SEQ ID NO: 2267097 - RNA, 18 nt, Yersinia pestis
uccgauaaacuucacaau

SEQ ID NO: 2267098 - RNA, 17 nt, Yersinia pestis
uccgacgaccacuuugu

SEQ ID NO: 2267099 - RNA, 21 nt, Yersinia pestis
ucgccuaaguuugacuggaau

SEQ ID NO: 2267100 - RNA, 22 nt, Yersinia pestis
ucgccuuucacgcguucaaucu

SEQ ID NO: 2267101 - RNA, 13 nt, Yersinia pestis
ucgccuugccgcu

SEQ ID NO: 2267102 - RNA, 17 nt, Yersinia pestis
ucgccuugccgcuguug

SEQ ID NO: 2267103 - RNA, 22 nt, Yersinia pestis
ucgcgaccaauucaucagcgcu

SEQ ID NO: 2267104 - RNA, 15 nt, Yersinia pestis
ucgcgacgaaaaccu

SEQ ID NO: 2267105 - RNA, 21 nt, Yersinia pestis
ucgcgauaaaauucagccacu

SEQ ID NO: 2267106 - RNA, 16 nt, Yersinia pestis
ucgccgggucaggaag

SEQ ID NO: 2267107 - RNA, 18 nt, Yersinia pestis
ucgcgccuaccugccugc

SEQ ID NO: 2267108 - RNA, 18 nt, Yersinia pestis
ucgcuaaaaccuaauaac

SEQ ID NO: 2267109 - RNA, 15 nt, Yersinia pestis
ucgcuaauuucuccc

SEQ ID NO: 2267110 - RNA, 22 nt, Yersinia pestis
ucgcuaucugugucaguaccug

SEQ ID NO: 2267111 - RNA, 17 nt, Yersinia pestis
ucgcggguuuuuaacuu

SEQ ID NO: 2267112 - RNA, 21 nt, Yersinia pestis
ucgcgguauuuggcauucaua

SEQ ID NO: 2267113 - RNA, 21 nt, Yersinia pestis
ucgcugaacaauugccaggcc

SEQ ID NO: 2267114 - RNA, 12 nt, Yersinia pestis
ucgcucugcguu

SEQ ID NO: 2267115 - RNA, 15 nt, Yersinia pestis
ucgcugaaaugcuau

SEQ ID NO: 2267116 - RNA, 12 nt, Yersinia pestis
ucgcuauuuccg

SEQ ID NO: 2267117 - RNA, 19 nt, Yersinia pestis
ucgcuauuucucucuacuu

SEQ ID NO: 2267118 - RNA, 18 nt, Yersinia pestis
ucgcucggcucgaaccug

SEQ ID NO: 2267119 - RNA, 15 nt, Yersinia pestis
ucgcuccucagccuu

SEQ ID NO: 2267120 - RNA, 22 nt, Yersinia pestis
ucgcucgcauaaauguuaccca

SEQ ID NO: 2267121 - RNA, 21 nt, Yersinia pestis
ucggaaaucugaugauuggag

SEQ ID NO: 2267122 - RNA, 15 nt, Yersinia pestis
ucgcuucgcucggcu

SEQ ID NO: 2267123 - RNA, 22 nt, Yersinia pestis
ucggcaauauuggcgcacaacu

SEQ ID NO: 2267124 - RNA, 20 nt, Yersinia pestis
ucggcacugcccugccuggu

SEQ ID NO: 2267125 - RNA, 21 nt, Yersinia pestis
ucgacucaauaaauccaucaa

SEQ ID NO: 2267126 - RNA, 14 nt, Yersinia pestis
ucgacgauauugau

SEQ ID NO: 2267127 - RNA, 18 nt, Yersinia pestis
ucgaccuuaaccgcacaa

SEQ ID NO: 2267128 - RNA, 13 nt, Yersinia pestis
ucgagccuacaua

SEQ ID NO: 2267129 - RNA, 17 nt, Yersinia pestis
ucgagccgcgcccuccc

SEQ ID NO: 2267130 - RNA, 17 nt, Yersinia pestis
ucgagcaacuuuuacug

SEQ ID NO: 2267131 - RNA, 16 nt, Yersinia pestis
ucgagcaacuuuuacu

SEQ ID NO: 2267132 - RNA, 18 nt, Yersinia pestis
ucgagauguauccaaggc

SEQ ID NO: 2267133 - RNA, 16 nt, Yersinia pestis
ucgagaugcugacccu

SEQ ID NO: 2267134 - RNA, 19 nt, Yersinia pestis
ucgacauaaagaugcaagc

SEQ ID NO: 2267135 - RNA, 11 nt, Yersinia pestis
uccuuaaaaac

SEQ ID NO: 2267136 - RNA, 20 nt, Yersinia pestis
uccuguuuuugaauagguaa

SEQ ID NO: 2267137 - RNA, 19 nt, Yersinia pestis
ucgaauguucugcggaagu

SEQ ID NO: 2267138 - RNA, 17 nt, Yersinia pestis
ucgcagccaaaauaauc

SEQ ID NO: 2267139 - RNA, 19 nt, Yersinia pestis
ucgcagccaaaauaaucac

SEQ ID NO: 2267140 - RNA, 16 nt, Yersinia pestis
ucgcaaagcgggccag

SEQ ID NO: 2267141 - RNA, 22 nt, Yersinia pestis
ucgcaaagcgggccagcaacca

SEQ ID NO: 2267142 - RNA, 14 nt, Yersinia pestis
ucgcaaaacuucac

SEQ ID NO: 2267143 - RNA, 14 nt, Yersinia pestis
ucgcauugucaccc

SEQ ID NO: 2267144 - RNA, 22 nt, Yersinia pestis
ucgcaucuuccaaaggaaggga

SEQ ID NO: 2267145 - RNA, 15 nt, Yersinia pestis
ucgcaucuuccaaag

SEQ ID NO: 2267146 - RNA, 15 nt, Yersinia pestis
ucgcaggcuucaacu

SEQ ID NO: 2267147 - RNA, 18 nt, Yersinia pestis
ucgccaaacaaauguuua

SEQ ID NO: 2267148 - RNA, 17 nt, Yersinia pestis
ucgauccgauaauaauu

SEQ ID NO: 2267149 - RNA, 20 nt, Yersinia pestis
ucgaugccggguuggcuccc

SEQ ID NO: 2267150 - RNA, 18 nt, Yersinia pestis
ucgauugauauauagaaa

SEQ ID NO: 2267151 - RNA, 17 nt, Yersinia pestis
ucgauccgaauauguca

SEQ ID NO: 2267152 - RNA, 15 nt, Yersinia pestis
ucgauagcaacaucg

SEQ ID NO: 2267153 - RNA, 12 nt, Yersinia pestis
ucgaucagauac

SEQ ID NO: 2267154 - RNA, 16 nt, Yersinia pestis
ucgauagcuuucuccu

SEQ ID NO: 2267155 - RNA, 19 nt, Yersinia pestis
ucgaucagcgucagcagau

SEQ ID NO: 2267156 - RNA, 22 nt, Yersinia pestis
ucgauaagcacuccacuggugg

SEQ ID NO: 2267157 - RNA, 15 nt, Yersinia pestis
ucgagcuaccggcau

SEQ ID NO: 2267158 - RNA, 16 nt, Yersinia pestis
ucgagcgcuaauauua

SEQ ID NO: 2267159 - RNA, 21 nt, Yersinia pestis
uccucugccuauccucaccgu

SEQ ID NO: 2267160 - RNA, 14 nt, Yersinia pestis
uccucugccuauuc

SEQ ID NO: 2267161 - RNA, 20 nt, Yersinia pestis
uccucuccccuaccucaucc

SEQ ID NO: 2267162 - RNA, 12 nt, Yersinia pestis
uccucuucuucu

SEQ ID NO: 2267163 - RNA, 12 nt, Yersinia pestis
uccucuucuucg

SEQ ID NO: 2267164 - RNA, 12 nt, Yersinia pestis
uccucuuccaau

SEQ ID NO: 2267165 - RNA, 16 nt, Yersinia pestis
uccugacgaugauaaa

SEQ ID NO: 2267166 - RNA, 11 nt, Yersinia pestis
uccugaauaau

SEQ ID NO: 2267167 - RNA, 22 nt, Yersinia pestis
uccugaacgaggacuuccugcc

SEQ ID NO: 2267168 - RNA, 21 nt, Yersinia pestis
uccucucaccaagauaccgag

SEQ ID NO: 2267169 - RNA, 16 nt, Yersinia pestis
uccuggcguaauauug

SEQ ID NO: 2267170 - RNA, 21 nt, Yersinia pestis
uccuggccguguuuuucccua

SEQ ID NO: 2267171 - RNA, 23 nt, Yersinia pestis
uccugccgccucugcuccgguaa

SEQ ID NO: 2267172 - RNA, 18 nt, Yersinia pestis
uccuggccguguuuuucc

SEQ ID NO: 2267173 - RNA, 20 nt, Yersinia pestis
uccuggccguguuuuucccu

SEQ ID NO: 2267174 - RNA, 19 nt, Yersinia pestis
uccugcccaagaauaauaa

SEQ ID NO: 2267175 - RNA, 16 nt, Yersinia pestis
uccugccgccucugcu

SEQ ID NO: 2267176 - RNA, 17 nt, Yersinia pestis
uccugccgccucugcuc

SEQ ID NO: 2267177 - RNA, 15 nt, Yersinia pestis
uccugauuuaguuua

SEQ ID NO: 2267178 - RNA, 21 nt, Yersinia pestis
uccugaucuucauugccuucu

SEQ ID NO: 2267179 - RNA, 15 nt, Yersinia pestis
uccugaucaacugcu

SEQ ID NO: 2267180 - RNA, 21 nt, Yersinia pestis
uccugaucaacugcuguuggc

SEQ ID NO: 2267181 - RNA, 19 nt, Yersinia pestis
uccuauagcucagaaaaua

SEQ ID NO: 2267182 - RNA, 16 nt, Yersinia pestis
uccuaugugauauuuu

SEQ ID NO: 2267183 - RNA, 20 nt, Yersinia pestis
uccuaugugauauuuuacug

SEQ ID NO: 2267184 - RNA, 19 nt, Yersinia pestis
uccucaccauuuauugcca

SEQ ID NO: 2267185 - RNA, 22 nt, Yersinia pestis
uccucaagaccgauuuguaagc

SEQ ID NO: 2267186 - RNA, 23 nt, Yersinia pestis
uccuccggcauagccggagguuu

SEQ ID NO: 2267187 - RNA, 23 nt, Yersinia pestis
uccuccgacauagccggagguuu

SEQ ID NO: 2267188 - RNA, 12 nt, Yersinia pestis
uccucaugauuu

SEQ ID NO: 2267189 - RNA, 14 nt, Yersinia pestis
uccuaaagauaauu

SEQ ID NO: 2267190 - RNA, 17 nt, Yersinia pestis
uccuaaagauaauuaau

SEQ ID NO: 2267191 - RNA, 12 nt, Yersinia pestis
uccuacaccauu

SEQ ID NO: 2267192 - RNA, 20 nt, Yersinia pestis
uccuacgccggagucuaucu

SEQ ID NO: 2267193 - RNA, 17 nt, Yersinia pestis
uccguguaguuauugau

SEQ ID NO: 2267194 - RNA, 19 nt, Yersinia pestis
uccguuaacccaaagccau

SEQ ID NO: 2267195 - RNA, 12 nt, Yersinia pestis
uccguuaaaaaa

SEQ ID NO: 2267196 - RNA, 13 nt, Yersinia pestis
uccguuaucuuug

SEQ ID NO: 2267197 - RNA, 21 nt, Yersinia pestis
uccgucccaagaaaagcaccg

SEQ ID NO: 2267198 - RNA, 20 nt, Yersinia pestis
uccgcgaugacacaauuccc

SEQ ID NO: 2267199 - RNA, 16 nt, Yersinia pestis
uccgccucaucucaug

SEQ ID NO: 2267200 - RNA, 17 nt, Yersinia pestis
uccgccugagauuaacc

SEQ ID NO: 2267201 - RNA, 14 nt, Yersinia pestis
uccgcgccaaggca

SEQ ID NO: 2267202 - RNA, 14 nt, Yersinia pestis
uccgcgccagggag

SEQ ID NO: 2267203 - RNA, 16 nt, Yersinia pestis
uccggaaucagcguuu

SEQ ID NO: 2267204 - RNA, 22 nt, Yersinia pestis
uccgcuucucagucgcgaugcg

SEQ ID NO: 2267205 - RNA, 14 nt, Yersinia pestis
uccgcuuccaucac

SEQ ID NO: 2267206 - RNA, 19 nt, Yersinia pestis
uccgcuuagcaggcccuuu

SEQ ID NO: 2267207 - RNA, 22 nt, Yersinia pestis
uccgcuuagcaggcccuuucac

SEQ ID NO: 2267208 - RNA, 17 nt, Yersinia pestis
uccgcuggcauacugac

SEQ ID NO: 2267209 - RNA, 13 nt, Yersinia pestis
uccgcaccauucg

SEQ ID NO: 2267210 - RNA, 17 nt, Yersinia pestis
uccgcaccuuugucauu

SEQ ID NO: 2267211 - RNA, 17 nt, Yersinia pestis
uccgcauucgccaucgg

SEQ ID NO: 2267212 - RNA, 20 nt, Yersinia pestis
uccgccaguugcucacggug

SEQ ID NO: 2267213 - RNA, 15 nt, Yersinia pestis
uccgccauccuucaa

SEQ ID NO: 2267214 - RNA, 17 nt, Yersinia pestis
uccgccgccaacaguga

SEQ ID NO: 2267215 - RNA, 19 nt, Yersinia pestis
uccguaacccgccucgcuu

SEQ ID NO: 2267216 - RNA, 21 nt, Yersinia pestis
uccguacccgcucuaaguuaa

SEQ ID NO: 2267217 - RNA, 11 nt, Yersinia pestis
uccguagaaau

SEQ ID NO: 2267218 - RNA, 13 nt, Yersinia pestis
uccgguguauuug

SEQ ID NO: 2267219 - RNA, 15 nt, Yersinia pestis
uccgguguuuuugac

SEQ ID NO: 2267220 - RNA, 17 nt, Yersinia pestis
uccgguugccagccagg

SEQ ID NO: 2267221 - RNA, 16 nt, Yersinia pestis
uccgguuguucuacua

SEQ ID NO: 2267222 - RNA, 19 nt, Yersinia pestis
uccgggugauguuccccca

SEQ ID NO: 2267223 - RNA, 20 nt, Yersinia pestis
uccggguuuacccagccaag

SEQ ID NO: 2267224 - RNA, 22 nt, Yersinia pestis
uccggguuuacccagccaagac

SEQ ID NO: 2267225 - RNA, 22 nt, Yersinia pestis
uccggcgauaaaauacgcggcg

SEQ ID NO: 2267226 - RNA, 15 nt, Yersinia pestis
uccggacuucauaaa

SEQ ID NO: 2267227 - RNA, 12 nt, Yersinia pestis
ucuccaagcaca

SEQ ID NO: 2267228 - RNA, 15 nt, Yersinia pestis
ucuccaagcacacug

SEQ ID NO: 2267229 - RNA, 20 nt, Yersinia pestis
ucuccaauggaaauccguuu

SEQ ID NO: 2267230 - RNA, 23 nt, Yersinia pestis
ucucaucggcauacuccuuaauc

SEQ ID NO: 2267231 - RNA, 14 nt, Yersinia pestis
ucucauccugcuau

SEQ ID NO: 2267232 - RNA, 23 nt, Yersinia pestis
ucucauccugcuauuuaacaaaa

SEQ ID NO: 2267233 - RNA, 13 nt, Yersinia pestis
ucucaguugaugg

SEQ ID NO: 2267234 - RNA, 15 nt, Yersinia pestis
ucucaguugaaaccc

SEQ ID NO: 2267235 - RNA, 17 nt, Yersinia pestis
ucuccaucucuaauugu

SEQ ID NO: 2267236 - RNA, 21 nt, Yersinia pestis
ucuccaugauauaucagucuu

SEQ ID NO: 2267237 - RNA, 19 nt, Yersinia pestis
ucuccuauccacugugauu

SEQ ID NO: 2267238 - RNA, 17 nt, Yersinia pestis
ucuccuaaaaucuaucg

SEQ ID NO: 2267239 - RNA, 15 nt, Yersinia pestis
ucuccguugaaaccu

SEQ ID NO: 2267240 - RNA, 18 nt, Yersinia pestis
ucuauuguuacuuuuaau

SEQ ID NO: 2267241 - RNA, 18 nt, Yersinia pestis
ucuauuuauuuauaaaac

SEQ ID NO: 2267242 - RNA, 21 nt, Yersinia pestis
ucuauuuauuuauaaaaccac

SEQ ID NO: 2267243 - RNA, 13 nt, Yersinia pestis
ucuauuuuuauuu

SEQ ID NO: 2267244 - RNA, 23 nt, Yersinia pestis
ucuauuuuuauuucuccuuacua

SEQ ID NO: 2267245 - RNA, 15 nt, Yersinia pestis
ucucagaauuuuuuu

SEQ ID NO: 2267246 - RNA, 12 nt, Yersinia pestis
ucucacccuucu

SEQ ID NO: 2267247 - RNA, 20 nt, Yersinia pestis
ucucacgcugaauaacaaaa

SEQ ID NO: 2267248 - RNA, 19 nt, Yersinia pestis
ucucaauauuaauaaugcc

SEQ ID NO: 2267249 - RNA, 17 nt, Yersinia pestis
ucucaauauuaauaaug

SEQ ID NO: 2267250 - RNA, 17 nt, Yersinia pestis
ucucaauggcuuuuuua

SEQ ID NO: 2267251 - RNA, 16 nt, Yersinia pestis
ucucaauauuaauaau

SEQ ID NO: 2267252 - RNA, 17 nt, Yersinia pestis
ucucacaaaauaauaau

SEQ ID NO: 2267253 - RNA, 20 nt, Yersinia pestis
ucucacaaaauaauaauucu

SEQ ID NO: 2267254 - RNA, 16 nt, Yersinia pestis
ucuauuaccucaauac

SEQ ID NO: 2267255 - RNA, 21 nt, Yersinia pestis
ucuauucccugcaauugcaga

SEQ ID NO: 2267256 - RNA, 13 nt, Yersinia pestis
ucuauuauuaaag

SEQ ID NO: 2267257 - RNA, 17 nt, Yersinia pestis
ucuauuaggcaguuccc

SEQ ID NO: 2267258 - RNA, 13 nt, Yersinia pestis
ucuaucucaggcu

SEQ ID NO: 2267259 - RNA, 21 nt, Yersinia pestis
ucuaucugguuuaaauucuau

SEQ ID NO: 2267260 - RNA, 21 nt, Yersinia pestis
ucuaucucggcccgacuaaau

SEQ ID NO: 2267261 - RNA, 20 nt, Yersinia pestis
ucuaucagaccuuuaggaaa

SEQ ID NO: 2267262 - RNA, 23 nt, Yersinia pestis
ucuaucauuuacggcuuuucgcu

SEQ ID NO: 2267263 - RNA, 13 nt, Yersinia pestis
ucuaucauccuug

SEQ ID NO: 2267264 - RNA, 14 nt, Yersinia pestis
ucuaucccuauuuu

SEQ ID NO: 2267265 - RNA, 14 nt, Yersinia pestis
ucuauccgaaaaau

SEQ ID NO: 2267266 - RNA, 16 nt, Yersinia pestis
ucuaucgauaaaguca

SEQ ID NO: 2267267 - RNA, 18 nt, Yersinia pestis
ucuauagagugcaauuuu

SEQ ID NO: 2267268 - RNA, 21 nt, Yersinia pestis
ucuauagagugcaauuuuauu

SEQ ID NO: 2267269 - RNA, 18 nt, Yersinia pestis
ucuagaauucgcccccgu

SEQ ID NO: 2267270 - RNA, 14 nt, Yersinia pestis
ucuacuuucuacuc

SEQ ID NO: 2267271 - RNA, 23 nt, Yersinia pestis
ucuagaccugaggauaaaaacua

SEQ ID NO: 2267272 - RNA, 20 nt, Yersinia pestis
ucuagcagugauuucagugu

SEQ ID NO: 2267273 - RNA, 16 nt, Yersinia pestis
ucuagcuguagcaaua

SEQ ID NO: 2267274 - RNA, 14 nt, Yersinia pestis
ucuagcucuuccag

SEQ ID NO: 2267275 - RNA, 22 nt, Yersinia pestis
ucuaguuugugcugcuaauauu

SEQ ID NO: 2267276 - RNA, 19 nt, Yersinia pestis
ucuagcuguagcaauauau

SEQ ID NO: 2267277 - RNA, 14 nt, Yersinia pestis
ucuaggguuauuuu

SEQ ID NO: 2267278 - RNA, 12 nt, Yersinia pestis
ucuauaauucag

SEQ ID NO: 2267279 - RNA, 23 nt, Yersinia pestis
ucuauaaaacgcacacugcagau

SEQ ID NO: 2267280 - RNA, 13 nt, Yersinia pestis
ucuauaaaaccgu

SEQ ID NO: 2267281 - RNA, 15 nt, Yersinia pestis
ucuaauugcugccca

SEQ ID NO: 2267282 - RNA, 20 nt, Yersinia pestis
ucuaaucgcgcauuucuucu

SEQ ID NO: 2267283 - RNA, 15 nt, Yersinia pestis
ucuaaucuccucucc

SEQ ID NO: 2267284 - RNA, 21 nt, Yersinia pestis
ucuaaucggcuggcaagauaa

SEQ ID NO: 2267285 - RNA, 21 nt, Yersinia pestis
ucuaauagggccuccaacugc

SEQ ID NO: 2267286 - RNA, 20 nt, Yersinia pestis
ucuaccuucaggccuuuacu

SEQ ID NO: 2267287 - RNA, 20 nt, Yersinia pestis
ucuaccgaucaaacagguaa

SEQ ID NO: 2267288 - RNA, 17 nt, Yersinia pestis
ucuacccuggcggcaaa

SEQ ID NO: 2267289 - RNA, 17 nt, Yersinia pestis
ucuaaaccgaguucaga

SEQ ID NO: 2267290 - RNA, 15 nt, Yersinia pestis
ucuaaaaucgcacug

SEQ ID NO: 2267291 - RNA, 16 nt, Yersinia pestis
ucuaaaauuuuaaguu

SEQ ID NO: 2267292 - RNA, 16 nt, Yersinia pestis
ucuaaaauaucuuuca

SEQ ID NO: 2267293 - RNA, 19 nt, Yersinia pestis
ucuaaccaggugcagauaa

SEQ ID NO: 2267294 - RNA, 17 nt, Yersinia pestis
ucguuuuaauuugccuu

SEQ ID NO: 2267295 - RNA, 12 nt, Yersinia pestis
ucguguucggua

SEQ ID NO: 2267296 - RNA, 24 nt, Yersinia pestis
ucgugaaaacuuucuuucaguaau

SEQ ID NO: 2267297 - RNA, 17 nt, Yersinia pestis
ucgucuucgcauucuuu

SEQ ID NO: 2267298 - RNA, 18 nt, Yersinia pestis
ucguguauaucacuauuu

SEQ ID NO: 2267299 - RNA, 19 nt, Yersinia pestis
ucguguauaucacuauuuc

SEQ ID NO: 2267300 - RNA, 18 nt, Yersinia pestis
ucguguaacacgaggcgc

SEQ ID NO: 2267301 - RNA, 20 nt, Yersinia pestis
ucgugcgggauucgaaccug

SEQ ID NO: 2267302 - RNA, 18 nt, Yersinia pestis
ucggcauacuccauuuuu

SEQ ID NO: 2267303 - RNA, 16 nt, Yersinia pestis
ucggcaggcaacugag

SEQ ID NO: 2267304 - RNA, 16 nt, Yersinia pestis
ucguacuuuccuuccu

SEQ ID NO: 2267305 - RNA, 18 nt, Yersinia pestis
ucguacuuuccuuccucu

SEQ ID NO: 2267306 - RNA, 21 nt, Yersinia pestis
ucgucacugucagacaguucu

SEQ ID NO: 2267307 - RNA, 16 nt, Yersinia pestis
ucgucaaacucggccg

SEQ ID NO: 2267308 - RNA, 21 nt, Yersinia pestis
ucguagcauggacgcuuuacu

SEQ ID NO: 2267309 - RNA, 15 nt, Yersinia pestis
ucuucagucaguguu

SEQ ID NO: 2267310 - RNA, 20 nt, Yersinia pestis
ucuucauaagccagugcuau

SEQ ID NO: 2267311 - RNA, 20 nt, Yersinia pestis
ucuucauaacgcuuuuucau

SEQ ID NO: 2267312 - RNA, 19 nt, Yersinia pestis
ucuucagguaagccuuucu

SEQ ID NO: 2267313 - RNA, 20 nt, Yersinia pestis
ucuuacaagaaugcagauau

SEQ ID NO: 2267314 - RNA, 18 nt, Yersinia pestis
ucuuaauuuggcuuaaaa

SEQ ID NO: 2267315 - RNA, 18 nt, Yersinia pestis
ucuuaaucuuuaauucau

SEQ ID NO: 2267316 - RNA, 19 nt, Yersinia pestis
ucuuaaucuuuaauucauc

SEQ ID NO: 2267317 - RNA, 22 nt, Yersinia pestis
ucuuaagcguacacuuucuacu

SEQ ID NO: 2267318 - RNA, 18 nt, Yersinia pestis
ucuuaauaccuaaaauua

SEQ ID NO: 2267319 - RNA, 20 nt, Yersinia pestis
ucuuccaauagcaguggcca

SEQ ID NO: 2267320 - RNA, 14 nt, Yersinia pestis
ucuucccuguccag

SEQ ID NO: 2267321 - RNA, 16 nt, Yersinia pestis
ucuucgggaggaggua

SEQ ID NO: 2267322 - RNA, 22 nt, Yersinia pestis
ucuucggcggcuaaagcugcuu

SEQ ID NO: 2267323 - RNA, 14 nt, Yersinia pestis
ucuucuagcucuuc

SEQ ID NO: 2267324 - RNA, 12 nt, Yersinia pestis
ucuucucacccc

SEQ ID NO: 2267325 - RNA, 21 nt, Yersinia pestis
ucuucgaucaacgccucacaa

SEQ ID NO: 2267326 - RNA, 21 nt, Yersinia pestis
ucuucgauuugcucuuuuuug

SEQ ID NO: 2267327 - RNA, 23 nt, Yersinia pestis
ucuucgcgagucacauuuuuaau

SEQ ID NO: 2267328 - RNA, 17 nt, Yersinia pestis
ucuugcauacucaggcc

SEQ ID NO: 2267329 - RNA, 21 nt, Yersinia pestis
ucuugcaaggggcgagccacg

SEQ ID NO: 2267330 - RNA, 12 nt, Yersinia pestis
ucuugccagcgg

SEQ ID NO: 2267331 - RNA, 22 nt, Yersinia pestis
ucuugugaugcauauuauuaau

SEQ ID NO: 2267332 - RNA, 17 nt, Yersinia pestis
ucuugugacaucaccuu

SEQ ID NO: 2267333 - RNA, 15 nt, Yersinia pestis
ucuuguaguaaccac

SEQ ID NO: 2267334 - RNA, 23 nt, Yersinia pestis
ucuuguaaauagucauauauuuu

SEQ ID NO: 2267335 - RNA, 16 nt, Yersinia pestis
ucuuuacgaucugccu

SEQ ID NO: 2267336 - RNA, 19 nt, Yersinia pestis
ucuuuacgaucugccuguu

SEQ ID NO: 2267337 - RNA, 14 nt, Yersinia pestis
ucuuuacgaucugc

SEQ ID NO: 2267338 - RNA, 13 nt, Yersinia pestis
ucuuuaaagacuu

SEQ ID NO: 2267339 - RNA, 16 nt, Yersinia pestis
ucuuuaacaacaacca

SEQ ID NO: 2267340 - RNA, 14 nt, Yersinia pestis
ucuuuaaaaucuug

SEQ ID NO: 2267341 - RNA, 14 nt, Yersinia pestis
ucuuuagauuucac

SEQ ID NO: 2267342 - RNA, 19 nt, Yersinia pestis
ucuuuacuaaauuagaaaa

SEQ ID NO: 2267343 - RNA, 16 nt, Yersinia pestis
ucuugaaaauaugccc

SEQ ID NO: 2267344 - RNA, 11 nt, Yersinia pestis
ucuugaaaaaa

SEQ ID NO: 2267345 - RNA, 15 nt, Yersinia pestis
ucuugaauaauauuc

SEQ ID NO: 2267346 - RNA, 23 nt, Yersinia pestis
ucuugacgguucgaaaauaauga

SEQ ID NO: 2267347 - RNA, 19 nt, Yersinia pestis
ucuugauuaccaauaauua

SEQ ID NO: 2267348 - RNA, 22 nt, Yersinia pestis
ucuucuugugagcgauauuuau

SEQ ID NO: 2267349 - RNA, 10 nt, Yersinia pestis
ucuucuggaa

SEQ ID NO: 2267350 - RNA, 18 nt, Yersinia pestis
ucuucuggaauggggaug

SEQ ID NO: 2267351 - RNA, 23 nt, Yersinia pestis
ucugaaugaauucuauaaugaug

SEQ ID NO: 2267352 - RNA, 17 nt, Yersinia pestis
ucugauguguauauuuu

SEQ ID NO: 2267353 - RNA, 14 nt, Yersinia pestis
ucugauuaccuucu

SEQ ID NO: 2267354 - RNA, 19 nt, Yersinia pestis
ucugaggauguaguccccc

SEQ ID NO: 2267355 - RNA, 13 nt, Yersinia pestis
ucugaggccaaca

SEQ ID NO: 2267356 - RNA, 14 nt, Yersinia pestis
ucugaguaccagca

SEQ ID NO: 2267357 - RNA, 15 nt, Yersinia pestis
ucugagucagucagg

SEQ ID NO: 2267358 - RNA, 19 nt, Yersinia pestis
ucugagucgauagcuuucu

SEQ ID NO: 2267359 - RNA, 21 nt, Yersinia pestis
ucugagucgauagcuuucucc

SEQ ID NO: 2267360 - RNA, 20 nt, Yersinia pestis
ucugauaaccguuuuuucaa

SEQ ID NO: 2267361 - RNA, 12 nt, Yersinia pestis
ucugaacuauug

SEQ ID NO: 2267362 - RNA, 18 nt, Yersinia pestis
ucugaaacgccagccucu

SEQ ID NO: 2267363 - RNA, 21 nt, Yersinia pestis
ucugccaauaaaguccaccuc

SEQ ID NO: 2267364 - RNA, 19 nt, Yersinia pestis
ucugccaaauauugcacaa

SEQ ID NO: 2267365 - RNA, 18 nt, Yersinia pestis
ucugccaccgcuccuuuc

SEQ ID NO: 2267366 - RNA, 16 nt, Yersinia pestis
ucugccagauagucau

SEQ ID NO: 2267367 - RNA, 17 nt, Yersinia pestis
ucugccaauucaaggcc

SEQ ID NO: 2267368 - RNA, 14 nt, Yersinia pestis
ucugccaugguugg

SEQ ID NO: 2267369 - RNA, 15 nt, Yersinia pestis
ucugccaugguuggg

SEQ ID NO: 2267370 - RNA, 12 nt, Yersinia pestis
ucugcauaccug

SEQ ID NO: 2267371 - RNA, 22 nt, Yersinia pestis
ucugcauacagaucgagcauca

SEQ ID NO: 2267372 - RNA, 18 nt, Yersinia pestis
ucugcccacucaccuaaa

SEQ ID NO: 2267373 - RNA, 17 nt, Yersinia pestis
ucugcccuuucucgccu

SEQ ID NO: 2267374 - RNA, 18 nt, Yersinia pestis
ucugcccuuucucgccua

SEQ ID NO: 2267375 - RNA, 15 nt, Yersinia pestis
ucugccgauuuaaac

SEQ ID NO: 2267376 - RNA, 19 nt, Yersinia pestis
ucugccuauucucaccguu

SEQ ID NO: 2267377 - RNA, 19 nt, Yersinia pestis
ucugccuauccucaccguu

SEQ ID NO: 2267378 - RNA, 17 nt, Yersinia pestis
ucugccuaucuuaaaaa

SEQ ID NO: 2267379 - RNA, 20 nt, Yersinia pestis
ucugccugugggcuauaggg

SEQ ID NO: 2267380 - RNA, 13 nt, Yersinia pestis
ucugccuuaucaa

SEQ ID NO: 2267381 - RNA, 23 nt, Yersinia pestis
ucugcuuaacucaaucuuugccu

SEQ ID NO: 2267382 - RNA, 16 nt, Yersinia pestis
ucugcgccuauaccug

SEQ ID NO: 2267383 - RNA, 16 nt, Yersinia pestis
ucugcuuaguuggugc

SEQ ID NO: 2267384 - RNA, 20 nt, Yersinia pestis
ucugcgagcguuuaaauacc

SEQ ID NO: 2267385 - RNA, 22 nt, Yersinia pestis
ucuggcaaacgcugcacaucau

SEQ ID NO: 2267386 - RNA, 19 nt, Yersinia pestis
ucugggacgugcauaaaac

SEQ ID NO: 2267387 - RNA, 15 nt, Yersinia pestis
ucuggggcaaucaau

SEQ ID NO: 2267388 - RNA, 14 nt, Yersinia pestis
ucuggguaagaaca

SEQ ID NO: 2267389 - RNA, 15 nt, Yersinia pestis
ucuggguaagaacag

SEQ ID NO: 2267390 - RNA, 18 nt, Yersinia pestis
ucuggguaagaacagaga

SEQ ID NO: 2267391 - RNA, 20 nt, Yersinia pestis
ucuggccagcgucuucagug

SEQ ID NO: 2267392 - RNA, 22 nt, Yersinia pestis
ucuggccagcgucuucaguggc

SEQ ID NO: 2267393 - RNA, 19 nt, Yersinia pestis
ucuggcaauccagcgccug

SEQ ID NO: 2267394 - RNA, 11 nt, Yersinia pestis
ucuuaaaaaua

SEQ ID NO: 2267395 - RNA, 22 nt, Yersinia pestis
ucuguuuuguuuccccuaauuc

SEQ ID NO: 2267396 - RNA, 16 nt, Yersinia pestis
ucuguuuuugccaccu

SEQ ID NO: 2267397 - RNA, 14 nt, Yersinia pestis
ucuguuuuugccac

SEQ ID NO: 2267398 - RNA, 18 nt, Yersinia pestis
ucuguuucaaauaaguau

SEQ ID NO: 2267399 - RNA, 18 nt, Yersinia pestis
ucuguuggugguggccug

SEQ ID NO: 2267400 - RNA, 21 nt, Yersinia pestis
ucuguggauuaacuucuuccg

SEQ ID NO: 2267401 - RNA, 13 nt, Yersinia pestis
ucugucugagucg

SEQ ID NO: 2267402 - RNA, 21 nt, Yersinia pestis
ucugucucugguaguuuugca

SEQ ID NO: 2267403 - RNA, 15 nt, Yersinia pestis
ucuguaucauauguu

SEQ ID NO: 2267404 - RNA, 15 nt, Yersinia pestis
ucuggucuugcaccu

SEQ ID NO: 2267405 - RNA, 23 nt, Yersinia pestis
ucuggucacuaaaacugaagcau

SEQ ID NO: 2267406 - RNA, 15 nt, Yersinia pestis
ucugguagcugcuca

SEQ ID NO: 2267407 - RNA, 15 nt, Yersinia pestis
ucugguaguuuugca

SEQ ID NO: 2267408 - RNA, 14 nt, Yersinia pestis
uggucucagaacaa

SEQ ID NO: 2267409 - RNA, 13 nt, Yersinia pestis
uggucgcacccaa

SEQ ID NO: 2267410 - RNA, 17 nt, Yersinia pestis
uggucgguuuccgccug

SEQ ID NO: 2267411 - RNA, 20 nt, Yersinia pestis
uggugucacaaucucuggca

SEQ ID NO: 2267412 - RNA, 12 nt, Yersinia pestis
uggugucuuuac

SEQ ID NO: 2267413 - RNA, 23 nt, Yersinia pestis
ugguggauaaaaaacgggcuugg

SEQ ID NO: 2267414 - RNA, 20 nt, Yersinia pestis
uggguuucuaucaggagcau

SEQ ID NO: 2267415 - RNA, 22 nt, Yersinia pestis
uggguuugguuauuaugauugg

SEQ ID NO: 2267416 - RNA, 14 nt, Yersinia pestis
uggguuugagcagu

SEQ ID NO: 2267417 - RNA, 18 nt, Yersinia pestis
ugguaccaaacaacaaca

SEQ ID NO: 2267418 - RNA, 19 nt, Yersinia pestis
ugguaccaaucuccaauga

SEQ ID NO: 2267419 - RNA, 17 nt, Yersinia pestis
ugguaccgauaaaagua

SEQ ID NO: 2267420 - RNA, 18 nt, Yersinia pestis
ugggugucaggaagcaag

SEQ ID NO: 2267421 - RNA, 12 nt, Yersinia pestis
uggguggccagu

SEQ ID NO: 2267422 - RNA, 17 nt, Yersinia pestis
ugggugcugcucccgua

SEQ ID NO: 2267423 - RNA, 13 nt, Yersinia pestis
ugggugcugcucc

SEQ ID NO: 2267424 - RNA, 13 nt, Yersinia pestis
uggguucuucaaa

SEQ ID NO: 2267425 - RNA, 13 nt, Yersinia pestis
uggguuaaugcug

SEQ ID NO: 2267426 - RNA, 21 nt, Yersinia pestis
uggucagcaauaaccaacggg

SEQ ID NO: 2267427 - RNA, 18 nt, Yersinia pestis
uggucagcacuuccaacu

SEQ ID NO: 2267428 - RNA, 14 nt, Yersinia pestis
ugguauaaauggca

SEQ ID NO: 2267429 - RNA, 20 nt, Yersinia pestis
ugguauagacuguuuuauua

SEQ ID NO: 2267430 - RNA, 22 nt, Yersinia pestis
ugguauagacuguuuuauuaua

SEQ ID NO: 2267431 - RNA, 17 nt, Yersinia pestis
ugguaccggcaccaaga

SEQ ID NO: 2267432 - RNA, 21 nt, Yersinia pestis
uggguaucuuugcuucaggca

SEQ ID NO: 2267433 - RNA, 22 nt, Yersinia pestis
uggguauggucagcaauaacca

SEQ ID NO: 2267434 - RNA, 23 nt, Yersinia pestis
uggguauauaguuuauuuuauuu

SEQ ID NO: 2267435 - RNA, 15 nt, Yersinia pestis
uggguauaugacugu

SEQ ID NO: 2267436 - RNA, 17 nt, Yersinia pestis
uggguagcagcccaaca

SEQ ID NO: 2267437 - RNA, 15 nt, Yersinia pestis
uggguagacauggca

SEQ ID NO: 2267438 - RNA, 20 nt, Yersinia pestis
uggggcugccaguaaaauca

SEQ ID NO: 2267439 - RNA, 15 nt, Yersinia pestis
ugggucaucacccag

SEQ ID NO: 2267440 - RNA, 15 nt, Yersinia pestis
ugggugaaagcuaau

SEQ ID NO: 2267441 - RNA, 14 nt, Yersinia pestis
ugggugaacacaga

SEQ ID NO: 2267442 - RNA, 17 nt, Yersinia pestis
ugggugaugugacguca

SEQ ID NO: 2267443 - RNA, 22 nt, Yersinia pestis
ugggugccucaacgcaccccac

SEQ ID NO: 2267444 - RNA, 17 nt, Yersinia pestis
ugggcugaagucuuuag

SEQ ID NO: 2267445 - RNA, 18 nt, Yersinia pestis
ugggcuaucgccuucauc

SEQ ID NO: 2267446 - RNA, 20 nt, Yersinia pestis
ugggcuucacauccaauggc

SEQ ID NO: 2267447 - RNA, 14 nt, Yersinia pestis
uggggcaguuaacc

SEQ ID NO: 2267448 - RNA, 20 nt, Yersinia pestis
ugggcuaaaacucaaauaga

SEQ ID NO: 2267449 - RNA, 14 nt, Yersinia pestis
ugggccugaguggg

SEQ ID NO: 2267450 - RNA, 19 nt, Yersinia pestis
uggcuuuuuuguuuuuaua

SEQ ID NO: 2267451 - RNA, 23 nt, Yersinia pestis
uggcuuuuuuguuuuuauaucaa

SEQ ID NO: 2267452 - RNA, 17 nt, Yersinia pestis
uggcuuuuucuuccagc

SEQ ID NO: 2267453 - RNA, 13 nt, Yersinia pestis
uggcuuuuuuaau

SEQ ID NO: 2267454 - RNA, 13 nt, Yersinia pestis
ugggauccauagg

SEQ ID NO: 2267455 - RNA, 18 nt, Yersinia pestis
ugggauauagaagguuuc

SEQ ID NO: 2267456 - RNA, 23 nt, Yersinia pestis
uggcuuuuuuaauaaaaaacuga

SEQ ID NO: 2267457 - RNA, 13 nt, Yersinia pestis
uggcuuucuccca

SEQ ID NO: 2267458 - RNA, 18 nt, Yersinia pestis
uggcuuucucccauucac

SEQ ID NO: 2267459 - RNA, 13 nt, Yersinia pestis
uggcuuucgcuuu

SEQ ID NO: 2267460 - RNA, 21 nt, Yersinia pestis
uggcggcacgcguugguuguc

SEQ ID NO: 2267461 - RNA, 18 nt, Yersinia pestis
uggcggcagcacagagca

SEQ ID NO: 2267462 - RNA, 16 nt, Yersinia pestis
ugggcagggcgcaaug

SEQ ID NO: 2267463 - RNA, 19 nt, Yersinia pestis
ugggcagggcgcaauggcg

SEQ ID NO: 2267464 - RNA, 20 nt, Yersinia pestis
ugggcagaagaguaaagcgu

SEQ ID NO: 2267465 - RNA, 21 nt, Yersinia pestis
ugggaucucacuaaaccaggu

SEQ ID NO: 2267466 - RNA, 16 nt, Yersinia pestis
ugggcaagcucugggc

SEQ ID NO: 2267467 - RNA, 14 nt, Yersinia pestis
ugggcaaucuccag

SEQ ID NO: 2267468 - RNA, 18 nt, Yersinia pestis
uguauuugguuauauccc

SEQ ID NO: 2267469 - RNA, 14 nt, Yersinia pestis
uguauuuccuguau

SEQ ID NO: 2267470 - RNA, 19 nt, Yersinia pestis
uguauucgcaucuuccaaa

SEQ ID NO: 2267471 - RNA, 18 nt, Yersinia pestis
uguauuuucaaucgcuuu

SEQ ID NO: 2267472 - RNA, 21 nt, Yersinia pestis
uguauuugguuauaucccaau

SEQ ID NO: 2267473 - RNA, 13 nt, Yersinia pestis
ugucaaaaaccca

SEQ ID NO: 2267474 - RNA, 22 nt, Yersinia pestis
uguauguggcuguauucacgua

SEQ ID NO: 2267475 - RNA, 15 nt, Yersinia pestis
uguauuaguuucaaa

SEQ ID NO: 2267476 - RNA, 18 nt, Yersinia pestis
uguauucgcaucuuccaa

SEQ ID NO: 2267477 - RNA, 13 nt, Yersinia pestis
uguaucauauguu

SEQ ID NO: 2267478 - RNA, 20 nt, Yersinia pestis
uguauccguagacauuaucc

SEQ ID NO: 2267479 - RNA, 16 nt, Yersinia pestis
uguauccgaauuauca

SEQ ID NO: 2267480 - RNA, 13 nt, Yersinia pestis
uguauccaaggca

SEQ ID NO: 2267481 - RNA, 12 nt, Yersinia pestis
uguauccagcag

SEQ ID NO: 2267482 - RNA, 14 nt, Yersinia pestis
uguauccagcagcg

SEQ ID NO: 2267483 - RNA, 13 nt, Yersinia pestis
uguauacaauugc

SEQ ID NO: 2267484 - RNA, 19 nt, Yersinia pestis
uguauacaauugccugauu

SEQ ID NO: 2267485 - RNA, 21 nt, Yersinia pestis
uguauaaccccccugcugaua

SEQ ID NO: 2267486 - RNA, 19 nt, Yersinia pestis
uguauaucacuauuucaga

SEQ ID NO: 2267487 - RNA, 15 nt, Yersinia pestis
uguagcgccagguaa

SEQ ID NO: 2267488 - RNA, 13 nt, Yersinia pestis
uguagccaaagug

SEQ ID NO: 2267489 - RNA, 19 nt, Yersinia pestis
uguaggcaauacaccgcca

SEQ ID NO: 2267490 - RNA, 19 nt, Yersinia pestis
uguagcugaacaaacuuau

SEQ ID NO: 2267491 - RNA, 12 nt, Yersinia pestis
uguagcaaaccc

SEQ ID NO: 2267492 - RNA, 17 nt, Yersinia pestis
uguagaauguugauaua

SEQ ID NO: 2267493 - RNA, 24 nt, Yersinia pestis
uguagacuuggcuuuuucuuccag

SEQ ID NO: 2267494 - RNA, 15 nt, Yersinia pestis
uguagagaaauucau

SEQ ID NO: 2267495 - RNA, 18 nt, Yersinia pestis
uguaguuauugauuaauu

SEQ ID NO: 2267496 - RNA, 14 nt, Yersinia pestis
uguaguuagaugac

SEQ ID NO: 2267497 - RNA, 22 nt, Yersinia pestis
uguaguucagucgcgauaaaau

SEQ ID NO: 2267498 - RNA, 15 nt, Yersinia pestis
uguauaaaaaagaua

SEQ ID NO: 2267499 - RNA, 21 nt, Yersinia pestis
uguauaaaaaagauaauaaaa

SEQ ID NO: 2267500 - RNA, 15 nt, Yersinia pestis
uguaaacuccuugga

SEQ ID NO: 2267501 - RNA, 16 nt, Yersinia pestis
ugguuaguucuucuga

SEQ ID NO: 2267502 - RNA, 23 nt, Yersinia pestis
ugguuaucaagaucaaaagcaga

SEQ ID NO: 2267503 - RNA, 20 nt, Yersinia pestis
uguaaaacgaguaaauacaa

SEQ ID NO: 2267504 - RNA, 16 nt, Yersinia pestis
uguaaauauaaaauaa

SEQ ID NO: 2267505 - RNA, 15 nt, Yersinia pestis
uguaaauauaaaaua

SEQ ID NO: 2267506 - RNA, 22 nt, Yersinia pestis
uguaacgaugaauuaucaaccg

SEQ ID NO: 2267507 - RNA, 17 nt, Yersinia pestis
uguacauuucguagccu

SEQ ID NO: 2267508 - RNA, 20 nt, Yersinia pestis
uguaccaaaacgaacaaaau

SEQ ID NO: 2267509 - RNA, 15 nt, Yersinia pestis
uguaauuguauuaua

SEQ ID NO: 2267510 - RNA, 21 nt, Yersinia pestis
uguaauuuuuacauuccacaa

SEQ ID NO: 2267511 - RNA, 19 nt, Yersinia pestis
uguaccgccauaguacaua

SEQ ID NO: 2267512 - RNA, 14 nt, Yersinia pestis
uguaccugugccag

SEQ ID NO: 2267513 - RNA, 14 nt, Yersinia pestis
uguacguauggcau

SEQ ID NO: 2267514 - RNA, 21 nt, Yersinia pestis
uguacugcugcaacucauuaa

SEQ ID NO: 2267515 - RNA, 22 nt, Yersinia pestis
uguacuuugauucaaaaugcca

SEQ ID NO: 2267516 - RNA, 24 nt, Yersinia pestis
uguacuuugauucaaaaugccagu

SEQ ID NO: 2267517 - RNA, 13 nt, Yersinia pestis
uggccugaugcac

SEQ ID NO: 2267518 - RNA, 18 nt, Yersinia pestis
uggccuggcauuuuacug

SEQ ID NO: 2267519 - RNA, 23 nt, Yersinia pestis
uggccgcuuugguugccagauaa

SEQ ID NO: 2267520 - RNA, 16 nt, Yersinia pestis
uggcgaucaagguuuc

SEQ ID NO: 2267521 - RNA, 20 nt, Yersinia pestis
uggcgacgugaugccaguaa

SEQ ID NO: 2267522 - RNA, 19 nt, Yersinia pestis
uggcgcaaagacuuuucca

SEQ ID NO: 2267523 - RNA, 14 nt, Yersinia pestis
uggcgcacauuaca

SEQ ID NO: 2267524 - RNA, 12 nt, Yersinia pestis
uggcgauuucag

SEQ ID NO: 2267525 - RNA, 20 nt, Yersinia pestis
uggcauuuuuuacgguucca

SEQ ID NO: 2267526 - RNA, 15 nt, Yersinia pestis
uggccaacugcgccu

SEQ ID NO: 2267527 - RNA, 15 nt, Yersinia pestis
uggcauuuucaguau

SEQ ID NO: 2267528 - RNA, 16 nt, Yersinia pestis
uggcauggauaucagc

SEQ ID NO: 2267529 - RNA, 18 nt, Yersinia pestis
uggcauuaauuucaccga

SEQ ID NO: 2267530 - RNA, 15 nt, Yersinia pestis
uggcaugccaugcac

SEQ ID NO: 2267531 - RNA, 17 nt, Yersinia pestis
uggcaugacuuagcacg

SEQ ID NO: 2267532 - RNA, 20 nt, Yersinia pestis
uggccacugcgggcaguaac

SEQ ID NO: 2267533 - RNA, 20 nt, Yersinia pestis
uggccacccaacgcaauugc

SEQ ID NO: 2267534 - RNA, 17 nt, Yersinia pestis
uggccaguaaaaccuga

SEQ ID NO: 2267535 - RNA, 18 nt, Yersinia pestis
uggccaguugccacucau

SEQ ID NO: 2267536 - RNA, 14 nt, Yersinia pestis
uggccaugaaucaa

SEQ ID NO: 2267537 - RNA, 16 nt, Yersinia pestis
uggcccggaagguuuc

SEQ ID NO: 2267538 - RNA, 13 nt, Yersinia pestis
uggccauguugug

SEQ ID NO: 2267539 - RNA, 18 nt, Yersinia pestis
uggccaugaaucaaauua

SEQ ID NO: 2267540 - RNA, 13 nt, Yersinia pestis
uggcccaagccau

SEQ ID NO: 2267541 - RNA, 15 nt, Yersinia pestis
uggcccaagccaucc

SEQ ID NO: 2267542 - RNA, 17 nt, Yersinia pestis
uggcccaagccauccuu

SEQ ID NO: 2267543 - RNA, 18 nt, Yersinia pestis
uggcccaagccauccuuc

SEQ ID NO: 2267544 - RNA, 19 nt, Yersinia pestis
uggcccaagccauccuuuu

SEQ ID NO: 2267545 - RNA, 21 nt, Yersinia pestis
uggcccaguagagcacuucau

SEQ ID NO: 2267546 - RNA, 20 nt, Yersinia pestis
uggccccaauuguuucuucc

SEQ ID NO: 2267547 - RNA, 16 nt, Yersinia pestis
uggcccacuguuaccc

SEQ ID NO: 2267548 - RNA, 17 nt, Yersinia pestis
uggccgccgcggugaag

SEQ ID NO: 2267549 - RNA, 13 nt, Yersinia pestis
uggcccucugccg

SEQ ID NO: 2267550 - RNA, 19 nt, Yersinia pestis
uggcccugagguuauugac

SEQ ID NO: 2267551 - RNA, 14 nt, Yersinia pestis
uggccgaaauggaa

SEQ ID NO: 2267552 - RNA, 18 nt, Yersinia pestis
uggccgaaauggaaaggc

SEQ ID NO: 2267553 - RNA, 14 nt, Yersinia pestis
uggccgacugacac

SEQ ID NO: 2267554 - RNA, 19 nt, Yersinia pestis
uggagguguauuuuuaugg

SEQ ID NO: 2267555 - RNA, 14 nt, Yersinia pestis
uggaggcuggcagg

SEQ ID NO: 2267556 - RNA, 20 nt, Yersinia pestis
uggaggaaggcgguuaucug

SEQ ID NO: 2267557 - RNA, 16 nt, Yersinia pestis
uggagcuauggaagaa

SEQ ID NO: 2267558 - RNA, 22 nt, Yersinia pestis
uggagccuguacauaaauuugu

SEQ ID NO: 2267559 - RNA, 18 nt, Yersinia pestis
uggagcaaaugaacgcga

SEQ ID NO: 2267560 - RNA, 12 nt, Yersinia pestis
uggagagcaggg

SEQ ID NO: 2267561 - RNA, 19 nt, Yersinia pestis
uggacuacacagacuggug

SEQ ID NO: 2267562 - RNA, 14 nt, Yersinia pestis
uggauauauuuaca

SEQ ID NO: 2267563 - RNA, 16 nt, Yersinia pestis
uggauauccacaucac

SEQ ID NO: 2267564 - RNA, 14 nt, Yersinia pestis
uggauaauuucagc

SEQ ID NO: 2267565 - RNA, 15 nt, Yersinia pestis
uggauaauuuaauua

SEQ ID NO: 2267566 - RNA, 14 nt, Yersinia pestis
uggauaaaauauua

SEQ ID NO: 2267567 - RNA, 24 nt, Yersinia pestis
uggaugguauuugacauggauugu

SEQ ID NO: 2267568 - RNA, 12 nt, Yersinia pestis
uggaucagcaga

SEQ ID NO: 2267569 - RNA, 19 nt, Yersinia pestis
uggaucacaaugcaaauau

SEQ ID NO: 2267570 - RNA, 13 nt, Yersinia pestis
uggaucacaucac

SEQ ID NO: 2267571 - RNA, 18 nt, Yersinia pestis
uggcaaccccuaauccag

SEQ ID NO: 2267572 - RNA, 17 nt, Yersinia pestis
uggcaacuaucguccgc

SEQ ID NO: 2267573 - RNA, 15 nt, Yersinia pestis
uggcaacucagcacg

SEQ ID NO: 2267574 - RNA, 19 nt, Yersinia pestis
uggcaacucuagcgccagc

SEQ ID NO: 2267575 - RNA, 14 nt, Yersinia pestis
uggcaauaaaggca

SEQ ID NO: 2267576 - RNA, 18 nt, Yersinia pestis
uggcaauaauucagauga

SEQ ID NO: 2267577 - RNA, 14 nt, Yersinia pestis
uggcaagguaaacg

SEQ ID NO: 2267578 - RNA, 23 nt, Yersinia pestis
uggcaagguaaacggguuuuugu

SEQ ID NO: 2267579 - RNA, 23 nt, Yersinia pestis
uggcaaucacaacccccccgacc

SEQ ID NO: 2267580 - RNA, 17 nt, Yersinia pestis
uggcaauccagcgccug

SEQ ID NO: 2267581 - RNA, 15 nt, Yersinia pestis
uggauugagccaccg

SEQ ID NO: 2267582 - RNA, 17 nt, Yersinia pestis
uggauugaaaucagauc

SEQ ID NO: 2267583 - RNA, 16 nt, Yersinia pestis
uggauuaacuucuucc

SEQ ID NO: 2267584 - RNA, 13 nt, Yersinia pestis
uggauuuuccaga

SEQ ID NO: 2267585 - RNA, 14 nt, Yersinia pestis
uggcaaaaagaauu

SEQ ID NO: 2267586 - RNA, 18 nt, Yersinia pestis
uggcaaaacucaggugag

SEQ ID NO: 2267587 - RNA, 22 nt, Yersinia pestis
uggcaaaacucaggugaguaaa

SEQ ID NO: 2267588 - RNA, 18 nt, Yersinia pestis
uggcaaaccggacauaau

SEQ ID NO: 2267589 - RNA, 19 nt, Yersinia pestis
uggcaccguggauaaacaa

SEQ ID NO: 2267590 - RNA, 10 nt, Yersinia pestis
uggcagagac

SEQ ID NO: 2267591 - RNA, 16 nt, Yersinia pestis
uggcagauuggcuugc

SEQ ID NO: 2267592 - RNA, 18 nt, Yersinia pestis
uggcacugccaucaauca

SEQ ID NO: 2267593 - RNA, 13 nt, Yersinia pestis
uggcagaaaucag

SEQ ID NO: 2267594 - RNA, 14 nt, Yersinia pestis
uggcagaaguugaa

SEQ ID NO: 2267595 - RNA, 12 nt, Yersinia pestis
uggcaggccagc

SEQ ID NO: 2267596 - RNA, 16 nt, Yersinia pestis
uggcauaaccaaucau

SEQ ID NO: 2267597 - RNA, 14 nt, Yersinia pestis
uggcauaaucaacg

SEQ ID NO: 2267598 - RNA, 19 nt, Yersinia pestis
uguuuugcugccauuucca

SEQ ID NO: 2267599 - RNA, 17 nt, Yersinia pestis
uguuuucggcuugcaaa

SEQ ID NO: 2267600 - RNA, 19 nt, Yersinia pestis
uguuuguugauguaagcug

SEQ ID NO: 2267601 - RNA, 14 nt, Yersinia pestis
uguuuguuuggaua

SEQ ID NO: 2267602 - RNA, 16 nt, Yersinia pestis
uguuucuauuuucagc

SEQ ID NO: 2267603 - RNA, 15 nt, Yersinia pestis
uguuucuauccgaaa

SEQ ID NO: 2267604 - RNA, 16 nt, Yersinia pestis
uguuuggauaaaaaca

SEQ ID NO: 2267605 - RNA, 17 nt, Yersinia pestis
uguuuauucucccgaua

SEQ ID NO: 2267606 - RNA, 13 nt, Yersinia pestis
uguuuaucuucua

SEQ ID NO: 2267607 - RNA, 14 nt, Yersinia pestis
uguuucagacccua

SEQ ID NO: 2267608 - RNA, 12 nt, Yersinia pestis
uguuucagcauc

SEQ ID NO: 2267609 - RNA, 18 nt, Yersinia pestis
uguuuccccuaauucucc

SEQ ID NO: 2267610 - RNA, 18 nt, Yersinia pestis
uguuucgacgguuuuuug

SEQ ID NO: 2267611 - RNA, 19 nt, Yersinia pestis
uguuuaaaaaggcguuauc

SEQ ID NO: 2267612 - RNA, 12 nt, Yersinia pestis
uguuuaaaucuu

SEQ ID NO: 2267613 - RNA, 22 nt, Yersinia pestis
uguuuaacuuucgucaauuuuu

SEQ ID NO: 2267614 - RNA, 16 nt, Yersinia pestis
uguuuauaaauuaaaa

SEQ ID NO: 2267615 - RNA, 14 nt, Yersinia pestis
uguuuauaaauuaa

SEQ ID NO: 2267616 - RNA, 13 nt, Yersinia pestis
uuaaaaguaggcu

SEQ ID NO: 2267617 - RNA, 21 nt, Yersinia pestis
uuaaaaucguauaacauaaua

SEQ ID NO: 2267618 - RNA, 18 nt, Yersinia pestis
uuaaagcccgcuuaaaua

SEQ ID NO: 2267619 - RNA, 19 nt, Yersinia pestis
uuaaagccuuucagcgcug

SEQ ID NO: 2267620 - RNA, 17 nt, Yersinia pestis
uuaaagauuaagacuuu

SEQ ID NO: 2267621 - RNA, 22 nt, Yersinia pestis
uuaaagauuucaucauucaaua

SEQ ID NO: 2267622 - RNA, 19 nt, Yersinia pestis
uuaaacuugcucuuucacg

SEQ ID NO: 2267623 - RNA, 18 nt, Yersinia pestis
uuaaacuuguaucaaaac

SEQ ID NO: 2267624 - RNA, 12 nt, Yersinia pestis
uguuuuuuugau

SEQ ID NO: 2267625 - RNA, 14 nt, Yersinia pestis
uguuuuuuuuauuc

SEQ ID NO: 2267626 - RNA, 17 nt, Yersinia pestis
uuaaaaaaauuaucauc

SEQ ID NO: 2267627 - RNA, 17 nt, Yersinia pestis
uuaaaaaaauuaaaaua

SEQ ID NO: 2267628 - RNA, 15 nt, Yersinia pestis
uuaaaaauacaacca

SEQ ID NO: 2267629 - RNA, 18 nt, Yersinia pestis
uuaaaaauacaaccaaca

SEQ ID NO: 2267630 - RNA, 15 nt, Yersinia pestis
uuaaaaagccugaau

SEQ ID NO: 2267631 - RNA, 17 nt, Yersinia pestis
uuaaaaagccugaauuc

SEQ ID NO: 2267632 - RNA, 19 nt, Yersinia pestis
uuaaaaacugugccugaau

SEQ ID NO: 2267633 - RNA, 13 nt, Yersinia pestis
uuaaaaacccaua

SEQ ID NO: 2267634 - RNA, 18 nt, Yersinia pestis
uuaaaaaauaauuuuaug

SEQ ID NO: 2267635 - RNA, 15 nt, Yersinia pestis
uuaaaacauauuaag

SEQ ID NO: 2267636 - RNA, 22 nt, Yersinia pestis
uuaaaaauagauuaaaagucua

SEQ ID NO: 2267637 - RNA, 14 nt, Yersinia pestis
uuaaaaaucagaga

SEQ ID NO: 2267638 - RNA, 14 nt, Yersinia pestis
uuaaaaaucaaaag

SEQ ID NO: 2267639 - RNA, 20 nt, Yersinia pestis
uguuccagugcguuuuauuc

SEQ ID NO: 2267640 - RNA, 21 nt, Yersinia pestis
uguuccagugcguuuuauuca

SEQ ID NO: 2267641 - RNA, 22 nt, Yersinia pestis
uguuccagugcguuuuauucaa

SEQ ID NO: 2267642 - RNA, 23 nt, Yersinia pestis
uguuccacuguaucuuugcuauc

SEQ ID NO: 2267643 - RNA, 22 nt, Yersinia pestis
uguuccggcgcgauguccacaa

SEQ ID NO: 2267644 - RNA, 20 nt, Yersinia pestis
uguuauugcuccgacaauaa

SEQ ID NO: 2267645 - RNA, 20 nt, Yersinia pestis
uguucacccacuugccauaa

SEQ ID NO: 2267646 - RNA, 19 nt, Yersinia pestis
uguucagcauaaauauuca

SEQ ID NO: 2267647 - RNA, 17 nt, Yersinia pestis
uguucagcauuguuggc

SEQ ID NO: 2267648 - RNA, 14 nt, Yersinia pestis
uguuaucaccuguc

SEQ ID NO: 2267649 - RNA, 16 nt, Yersinia pestis
uguuauuaaugauaac

SEQ ID NO: 2267650 - RNA, 16 nt, Yersinia pestis
uguuauuauuaaauuu

SEQ ID NO: 2267651 - RNA, 18 nt, Yersinia pestis
uguuaugaggggaggcug

SEQ ID NO: 2267652 - RNA, 16 nt, Yersinia pestis
uguuauggauuuuuaa

SEQ ID NO: 2267653 - RNA, 21 nt, Yersinia pestis
uguugauuacgggucagcuca

SEQ ID NO: 2267654 - RNA, 22 nt, Yersinia pestis
uguugcaacggucauuggcccg

SEQ ID NO: 2267655 - RNA, 20 nt, Yersinia pestis
uguugcagucuccaucacuc

SEQ ID NO: 2267656 - RNA, 21 nt, Yersinia pestis
uguugccaaugggccaagguc

SEQ ID NO: 2267657 - RNA, 15 nt, Yersinia pestis
uguugccacccuauc

SEQ ID NO: 2267658 - RNA, 16 nt, Yersinia pestis
uguugccaccugcugg

SEQ ID NO: 2267659 - RNA, 22 nt, Yersinia pestis
uguugcauuuuuucauuccaga

SEQ ID NO: 2267660 - RNA, 16 nt, Yersinia pestis
uguuggcaaauaaucc

SEQ ID NO: 2267661 - RNA, 15 nt, Yersinia pestis
uguuggcaauuucac

SEQ ID NO: 2267662 - RNA, 19 nt, Yersinia pestis
uguuguuauuacugucacu

SEQ ID NO: 2267663 - RNA, 20 nt, Yersinia pestis
uguugugguggcuauuagcc

SEQ ID NO: 2267664 - RNA, 21 nt, Yersinia pestis
uguugugauguuuuugaccau

SEQ ID NO: 2267665 - RNA, 22 nt, Yersinia pestis
uguuguuggcuaaugcgagugc

SEQ ID NO: 2267666 - RNA, 15 nt, Yersinia pestis
uguuguuauugacca

SEQ ID NO: 2267667 - RNA, 14 nt, Yersinia pestis
uguuguagcgccag

SEQ ID NO: 2267668 - RNA, 19 nt, Yersinia pestis
uguuguagcgccagguaag

SEQ ID NO: 2267669 - RNA, 13 nt, Yersinia pestis
uguuggcccgcau

SEQ ID NO: 2267670 - RNA, 13 nt, Yersinia pestis
uguuggggcacaa

SEQ ID NO: 2267671 - RNA, 21 nt, Yersinia pestis
uguuggguaaucaucagggaa

SEQ ID NO: 2267672 - RNA, 16 nt, Yersinia pestis
uguuggguugugguau

SEQ ID NO: 2267673 - RNA, 16 nt, Yersinia pestis
ugugacgcuugaauau

SEQ ID NO: 2267674 - RNA, 17 nt, Yersinia pestis
ugucagcagucugaggg

SEQ ID NO: 2267675 - RNA, 14 nt, Yersinia pestis
ugucagcagucuga

SEQ ID NO: 2267676 - RNA, 16 nt, Yersinia pestis
ugucagcagucugaaa

SEQ ID NO: 2267677 - RNA, 21 nt, Yersinia pestis
ugucagcagucugaagccuac

SEQ ID NO: 2267678 - RNA, 23 nt, Yersinia pestis
ugucagauaucugcucauuacca

SEQ ID NO: 2267679 - RNA, 14 nt, Yersinia pestis
ugucagacaguucu

SEQ ID NO: 2267680 - RNA, 16 nt, Yersinia pestis
ugucagacaguucugu

SEQ ID NO: 2267681 - RNA, 16 nt, Yersinia pestis
ugucacugcacuccug

SEQ ID NO: 2267682 - RNA, 17 nt, Yersinia pestis
ugucacuugcccugagu

SEQ ID NO: 2267683 - RNA, 14 nt, Yersinia pestis
ugucaccuaccacc

SEQ ID NO: 2267684 - RNA, 18 nt, Yersinia pestis
ugucaccugucaccuguc

SEQ ID NO: 2267685 - RNA, 19 nt, Yersinia pestis
ugucaccugucaccuguca

SEQ ID NO: 2267686 - RNA, 15 nt, Yersinia pestis
ugugcaaucaagggc

SEQ ID NO: 2267687 - RNA, 13 nt, Yersinia pestis
ugugcaaugcaga

SEQ ID NO: 2267688 - RNA, 12 nt, Yersinia pestis
ugugcagcauca

SEQ ID NO: 2267689 - RNA, 18 nt, Yersinia pestis
ugugcauguagcugcagc

SEQ ID NO: 2267690 - RNA, 21 nt, Yersinia pestis
ugugccucgucgaggaucacc

SEQ ID NO: 2267691 - RNA, 15 nt, Yersinia pestis
ugugcggauggcugc

SEQ ID NO: 2267692 - RNA, 16 nt, Yersinia pestis
ugugucgcuauuuccg

SEQ ID NO: 2267693 - RNA, 14 nt, Yersinia pestis
ugugguauagguau

SEQ ID NO: 2267694 - RNA, 24 nt, Yersinia pestis
ugugucagaccaaauagcaagcca

SEQ ID NO: 2267695 - RNA, 13 nt, Yersinia pestis
uguguuuuucuua

SEQ ID NO: 2267696 - RNA, 21 nt, Yersinia pestis
uguguuuuugucauuuaauua

SEQ ID NO: 2267697 - RNA, 16 nt, Yersinia pestis
uguguuuguuuggaua

SEQ ID NO: 2267698 - RNA, 22 nt, Yersinia pestis
uguuaacgccauaaggauuugg

SEQ ID NO: 2267699 - RNA, 20 nt, Yersinia pestis
uguuaacauccagaccuuca

SEQ ID NO: 2267700 - RNA, 18 nt, Yersinia pestis
uguggcgauuuaauccaa

SEQ ID NO: 2267701 - RNA, 15 nt, Yersinia pestis
ugugcguaaagaaaa

SEQ ID NO: 2267702 - RNA, 19 nt, Yersinia pestis
uguggguucaucgaggaau

SEQ ID NO: 2267703 - RNA, 17 nt, Yersinia pestis
uuaauuuuucauaauaa

SEQ ID NO: 2267704 - RNA, 23 nt, Yersinia pestis
uuaauuggcucauaacacuuaau

SEQ ID NO: 2267705 - RNA, 15 nt, Yersinia pestis
uuaauccuucacuua

SEQ ID NO: 2267706 - RNA, 23 nt, Yersinia pestis
uuaauccucucuugaaaugauaa

SEQ ID NO: 2267707 - RNA, 21 nt, Yersinia pestis
uuaauccccggucacuuaaau

SEQ ID NO: 2267708 - RNA, 16 nt, Yersinia pestis
uuaaucgcugaacaga

SEQ ID NO: 2267709 - RNA, 17 nt, Yersinia pestis
uuaaucgucuuguuggu

SEQ ID NO: 2267710 - RNA, 17 nt, Yersinia pestis
uuaaucguuauaauauu

SEQ ID NO: 2267711 - RNA, 13 nt, Yersinia pestis
uuaauuaaaaaua

SEQ ID NO: 2267712 - RNA, 16 nt, Yersinia pestis
uuaauuaaauguauaa

SEQ ID NO: 2267713 - RNA, 13 nt, Yersinia pestis
uuacaguuuaauu

SEQ ID NO: 2267714 - RNA, 22 nt, Yersinia pestis
uuacauaacaccaauugcaggc

SEQ ID NO: 2267715 - RNA, 18 nt, Yersinia pestis
uuaccacuauccaacugg

SEQ ID NO: 2267716 - RNA, 17 nt, Yersinia pestis
uuaccacauuuccuaug

SEQ ID NO: 2267717 - RNA, 21 nt, Yersinia pestis
uuaccaccgucaagacaacaa

SEQ ID NO: 2267718 - RNA, 22 nt, Yersinia pestis
uuacacacccucaacucaaaac

SEQ ID NO: 2267719 - RNA, 16 nt, Yersinia pestis
uuacaauucggcuggc

SEQ ID NO: 2267720 - RNA, 12 nt, Yersinia pestis
uuaccugcauau

SEQ ID NO: 2267721 - RNA, 20 nt, Yersinia pestis
uuaccuauaaacuugauuca

SEQ ID NO: 2267722 - RNA, 15 nt, Yersinia pestis
uuaccggccucuuuc

SEQ ID NO: 2267723 - RNA, 16 nt, Yersinia pestis
uuaccgggcgaacaga

SEQ ID NO: 2267724 - RNA, 23 nt, Yersinia pestis
uuaccgucgaacauaaaaaugca

SEQ ID NO: 2267725 - RNA, 18 nt, Yersinia pestis
uuaccagcgucaaaccau

SEQ ID NO: 2267726 - RNA, 22 nt, Yersinia pestis
uuaccauccacuagguccauaa

SEQ ID NO: 2267727 - RNA, 21 nt, Yersinia pestis
uuacccguuacacaaucagua

SEQ ID NO: 2267728 - RNA, 11 nt, Yersinia pestis
uuacccuucgu

SEQ ID NO: 2267729 - RNA, 22 nt, Yersinia pestis
uuaccgagcgucaagccaaccc

SEQ ID NO: 2267730 - RNA, 23 nt, Yersinia pestis
uuaccgauaaaggccgcagauaa

SEQ ID NO: 2267731 - RNA, 17 nt, Yersinia pestis
uuaauaucuuuaaauua

SEQ ID NO: 2267732 - RNA, 16 nt, Yersinia pestis
uuaauaugcaaaaaaa

SEQ ID NO: 2267733 - RNA, 11 nt, Yersinia pestis
uuaauauuaau

SEQ ID NO: 2267734 - RNA, 23 nt, Yersinia pestis
uuaauauuuaucugcauuaaaau

SEQ ID NO: 2267735 - RNA, 18 nt, Yersinia pestis
uuaaucaguucuuuaauc

SEQ ID NO: 2267736 - RNA, 19 nt, Yersinia pestis
uuaaucauauuuuccugca

SEQ ID NO: 2267737 - RNA, 17 nt, Yersinia pestis
uuaaucagugacaagaa

SEQ ID NO: 2267738 - RNA, 22 nt, Yersinia pestis
uuaaucccaccggggagcacua

SEQ ID NO: 2267739 - RNA, 22 nt, Yersinia pestis
uuaauccccaggugcuuauuua

SEQ ID NO: 2267740 - RNA, 20 nt, Yersinia pestis
uuaauaaucgauaaaaagaa

SEQ ID NO: 2267741 - RNA, 23 nt, Yersinia pestis
uuaauaauaguuucuggcaaggu

SEQ ID NO: 2267742 - RNA, 19 nt, Yersinia pestis
uuaauacacgcuuccagua

SEQ ID NO: 2267743 - RNA, 16 nt, Yersinia pestis
uuaauacaucaucaaa

SEQ ID NO: 2267744 - RNA, 18 nt, Yersinia pestis
uuaauacaucaucaaaac

SEQ ID NO: 2267745 - RNA, 18 nt, Yersinia pestis
uuaauacaauagagaaua

SEQ ID NO: 2267746 - RNA, 16 nt, Yersinia pestis
uuaauauauaaaauaa

SEQ ID NO: 2267747 - RNA, 20 nt, Yersinia pestis
uuaauauauaaaauaaauuu

SEQ ID NO: 2267748 - RNA, 11 nt, Yersinia pestis
uuaacugcagu

SEQ ID NO: 2267749 - RNA, 11 nt, Yersinia pestis
uuaacugcacg

SEQ ID NO: 2267750 - RNA, 16 nt, Yersinia pestis
uuaacugcaguaaaaa

SEQ ID NO: 2267751 - RNA, 18 nt, Yersinia pestis
uuaacugcaguaaaaaua

SEQ ID NO: 2267752 - RNA, 20 nt, Yersinia pestis
uuaacugcaguaaaaauauu

SEQ ID NO: 2267753 - RNA, 13 nt, Yersinia pestis
uuaagaagccuca

SEQ ID NO: 2267754 - RNA, 12 nt, Yersinia pestis
uuaacuguuuua

SEQ ID NO: 2267755 - RNA, 20 nt, Yersinia pestis
uuaaauaacagcuaaaauga

SEQ ID NO: 2267756 - RNA, 12 nt, Yersinia pestis
uuaaaugaaaca

SEQ ID NO: 2267757 - RNA, 13 nt, Yersinia pestis
uuaaaugaagcag

SEQ ID NO: 2267758 - RNA, 19 nt, Yersinia pestis
uuaaaugaccacccacguu

SEQ ID NO: 2267759 - RNA, 12 nt, Yersinia pestis
uuaagacguauc

SEQ ID NO: 2267760 - RNA, 21 nt, Yersinia pestis
uuaagaauccucugaauaaaa

SEQ ID NO: 2267761 - RNA, 13 nt, Yersinia pestis
uuaaggcgcgacu

SEQ ID NO: 2267762 - RNA, 16 nt, Yersinia pestis
uuaaggcgcgacugau

SEQ ID NO: 2267763 - RNA, 20 nt, Yersinia pestis
uuaagggggggaagcucccc

SEQ ID NO: 2267764 - RNA, 19 nt, Yersinia pestis
uuaaggauggucaacauug

SEQ ID NO: 2267765 - RNA, 16 nt, Yersinia pestis
uuaaggacucuuaguu

SEQ ID NO: 2267766 - RNA, 14 nt, Yersinia pestis
uuaagagagaugca

SEQ ID NO: 2267767 - RNA, 23 nt, Yersinia pestis
uuaaguaaguuuaaacuguuauu

SEQ ID NO: 2267768 - RNA, 16 nt, Yersinia pestis
uuaaggucaacaacua

SEQ ID NO: 2267769 - RNA, 19 nt, Yersinia pestis
uuaagguuagcuaugcagu

SEQ ID NO: 2267770 - RNA, 14 nt, Yersinia pestis
uuaaguagucagca

SEQ ID NO: 2267771 - RNA, 15 nt, Yersinia pestis
uuaagucaaauuuaa

SEQ ID NO: 2267772 - RNA, 18 nt, Yersinia pestis
uuagcgcacggggaaaca

SEQ ID NO: 2267773 - RNA, 15 nt, Yersinia pestis
uuagcgcuaagcccg

SEQ ID NO: 2267774 - RNA, 14 nt, Yersinia pestis
uuagcgauuucuag

SEQ ID NO: 2267775 - RNA, 21 nt, Yersinia pestis
uuagcucaaauauuugcacaa

SEQ ID NO: 2267776 - RNA, 23 nt, Yersinia pestis
uuagcugauuugauauuagccaa

SEQ ID NO: 2267777 - RNA, 15 nt, Yersinia pestis
uuagcuuacaccaug

SEQ ID NO: 2267778 - RNA, 15 nt, Yersinia pestis
uuagcgaugacugag

SEQ ID NO: 2267779 - RNA, 16 nt, Yersinia pestis
uuaggcaugauaagca

SEQ ID NO: 2267780 - RNA, 17 nt, Yersinia pestis
uuaggauaaccaauucu

SEQ ID NO: 2267781 - RNA, 19 nt, Yersinia pestis
uuagcacguuuuucagcuu

SEQ ID NO: 2267782 - RNA, 16 nt, Yersinia pestis
uuagcacauaugcagc

SEQ ID NO: 2267783 - RNA, 12 nt, Yersinia pestis
uuagcagggcau

SEQ ID NO: 2267784 - RNA, 14 nt, Yersinia pestis
uuagcaauaauaga

SEQ ID NO: 2267785 - RNA, 21 nt, Yersinia pestis
uuagcaacgguaucccgguga

SEQ ID NO: 2267786 - RNA, 17 nt, Yersinia pestis
uuagccgaauaucccac

SEQ ID NO: 2267787 - RNA, 15 nt, Yersinia pestis
uuagccauaagauaa

SEQ ID NO: 2267788 - RNA, 20 nt, Yersinia pestis
uuagccauucaaaaauuaaa

SEQ ID NO: 2267789 - RNA, 15 nt, Yersinia pestis
uuagccccaaaugcc

SEQ ID NO: 2267790 - RNA, 16 nt, Yersinia pestis
uuagccaaauacccua

SEQ ID NO: 2267791 - RNA, 20 nt, Yersinia pestis
uuagccacugguugaaaguu

SEQ ID NO: 2267792 - RNA, 21 nt, Yersinia pestis
uuagccaacgggguauuuaac

SEQ ID NO: 2267793 - RNA, 23 nt, Yersinia pestis
uuagccaagcaaccuuguuuuau

SEQ ID NO: 2267794 - RNA, 20 nt, Yersinia pestis
uuagcauuaccgguaauauu

SEQ ID NO: 2267795 - RNA, 19 nt, Yersinia pestis
uuagcauugcagauuucuu

SEQ ID NO: 2267796 - RNA, 20 nt, Yersinia pestis
uuagcauugcagauuucuuc

SEQ ID NO: 2267797 - RNA, 19 nt, Yersinia pestis
uuagacagaauuauuuaua

SEQ ID NO: 2267798 - RNA, 11 nt, Yersinia pestis
uuagacgucag

SEQ ID NO: 2267799 - RNA, 17 nt, Yersinia pestis
uuagacgucagauuagu

SEQ ID NO: 2267800 - RNA, 22 nt, Yersinia pestis
uuagacaugggcagugcacagu

SEQ ID NO: 2267801 - RNA, 20 nt, Yersinia pestis
uuagauaggcuuuccccccu

SEQ ID NO: 2267802 - RNA, 13 nt, Yersinia pestis
uuagaugcuaucu

SEQ ID NO: 2267803 - RNA, 20 nt, Yersinia pestis
uuacuuacuguauuaccuca

SEQ ID NO: 2267804 - RNA, 18 nt, Yersinia pestis
uuacuuacccgaaucacu

SEQ ID NO: 2267805 - RNA, 22 nt, Yersinia pestis
uuaccuguuucgauccagcuac

SEQ ID NO: 2267806 - RNA, 21 nt, Yersinia pestis
uuaccuuguuuguuacugcuu

SEQ ID NO: 2267807 - RNA, 14 nt, Yersinia pestis
uuauauuauuuauc

SEQ ID NO: 2267808 - RNA, 13 nt, Yersinia pestis
uuauauaacagcc

SEQ ID NO: 2267809 - RNA, 17 nt, Yersinia pestis
uuauauaacagccauuu

SEQ ID NO: 2267810 - RNA, 21 nt, Yersinia pestis
uuauauaacgacuauuuaucg

SEQ ID NO: 2267811 - RNA, 12 nt, Yersinia pestis
uuauauaacuag

SEQ ID NO: 2267812 - RNA, 18 nt, Yersinia pestis
uuauaugaucaguggggu

SEQ ID NO: 2267813 - RNA, 13 nt, Yersinia pestis
uuaucacauuucg

SEQ ID NO: 2267814 - RNA, 20 nt, Yersinia pestis
uuaucaccaguauuauuggc

SEQ ID NO: 2267815 - RNA, 22 nt, Yersinia pestis
uuauaguccuuccaugacacau

SEQ ID NO: 2267816 - RNA, 13 nt, Yersinia pestis
uuauaguuaaaac

SEQ ID NO: 2267817 - RNA, 20 nt, Yersinia pestis
uuauaguuaaacugauuggu

SEQ ID NO: 2267818 - RNA, 15 nt, Yersinia pestis
uuauagguauacacc

SEQ ID NO: 2267819 - RNA, 12 nt, Yersinia pestis
uuauacugugcg

SEQ ID NO: 2267820 - RNA, 14 nt, Yersinia pestis
uuauacuauuuaug

SEQ ID NO: 2267821 - RNA, 15 nt, Yersinia pestis
uuauaacuauauucu

SEQ ID NO: 2267822 - RNA, 16 nt, Yersinia pestis
uuauaccuacccuuua

SEQ ID NO: 2267823 - RNA, 16 nt, Yersinia pestis
uuauacccauacaaau

SEQ ID NO: 2267824 - RNA, 17 nt, Yersinia pestis
uuauacccguuauauuu

SEQ ID NO: 2267825 - RNA, 15 nt, Yersinia pestis
uuauacuaaagaaau

SEQ ID NO: 2267826 - RNA, 21 nt, Yersinia pestis
uuaguggcuuuaagauccagu

SEQ ID NO: 2267827 - RNA, 19 nt, Yersinia pestis
uuaguuacaauaaaucaau

SEQ ID NO: 2267828 - RNA, 18 nt, Yersinia pestis
uuagugcuacagcagcag

SEQ ID NO: 2267829 - RNA, 20 nt, Yersinia pestis
uuagugaaucaucaauaccc

SEQ ID NO: 2267830 - RNA, 23 nt, Yersinia pestis
uuagucacucaagccaguaacua

SEQ ID NO: 2267831 - RNA, 20 nt, Yersinia pestis
uuaguugguaauaaggucac

SEQ ID NO: 2267832 - RNA, 23 nt, Yersinia pestis
uuaguugaccuugguaaauacca

SEQ ID NO: 2267833 - RNA, 23 nt, Yersinia pestis
uuagguaaugccacgucaucgaa

SEQ ID NO: 2267834 - RNA, 16 nt, Yersinia pestis
uuaggugaaaauaaua

SEQ ID NO: 2267835 - RNA, 14 nt, Yersinia pestis
uuaggugacaggca

SEQ ID NO: 2267836 - RNA, 14 nt, Yersinia pestis
uuagguugaaauac

SEQ ID NO: 2267837 - RNA, 20 nt, Yersinia pestis
uuagggcgcggcugguaaca

SEQ ID NO: 2267838 - RNA, 17 nt, Yersinia pestis
uuaggcgggcaguauaa

SEQ ID NO: 2267839 - RNA, 16 nt, Yersinia pestis
ugcugugcgauuucac

SEQ ID NO: 2267840 - RNA, 23 nt, Yersinia pestis
ugcugugagccagagacauaaag

SEQ ID NO: 2267841 - RNA, 22 nt, Yersinia pestis
ugcugucauuggugcugaugau

SEQ ID NO: 2267842 - RNA, 14 nt, Yersinia pestis
ugcuguauuuuucg

SEQ ID NO: 2267843 - RNA, 14 nt, Yersinia pestis
ugcuggugucacaa

SEQ ID NO: 2267844 - RNA, 17 nt, Yersinia pestis
ugcuggugggccugcug

SEQ ID NO: 2267845 - RNA, 15 nt, Yersinia pestis
ugcuggguugcuucg

SEQ ID NO: 2267846 - RNA, 15 nt, Yersinia pestis
ugcuggccugauagu

SEQ ID NO: 2267847 - RNA, 14 nt, Yersinia pestis
ugcugacaacccuc

SEQ ID NO: 2267848 - RNA, 13 nt, Yersinia pestis
ugcugacaaaccc

SEQ ID NO: 2267849 - RNA, 21 nt, Yersinia pestis
ugcugacaaaguuaaaugaag

SEQ ID NO: 2267850 - RNA, 22 nt, Yersinia pestis
ugcugacaaaguuaaaugaagg

SEQ ID NO: 2267851 - RNA, 16 nt, Yersinia pestis
ugcuggccaacugcgc

SEQ ID NO: 2267852 - RNA, 20 nt, Yersinia pestis
ugcuggcaguggcggcaaaa

SEQ ID NO: 2267853 - RNA, 21 nt, Yersinia pestis
ugcuggauuuuuaucuuucug

SEQ ID NO: 2267854 - RNA, 12 nt, Yersinia pestis
ugcuuaaaacag

SEQ ID NO: 2267855 - RNA, 19 nt, Yersinia pestis
ugcuuaagaggaucuuccu

SEQ ID NO: 2267856 - RNA, 20 nt, Yersinia pestis
ugcuuaccacuggccuccca

SEQ ID NO: 2267857 - RNA, 14 nt, Yersinia pestis
ugcuuccaacucac

SEQ ID NO: 2267858 - RNA, 18 nt, Yersinia pestis
ugcuuccaacucaccuaa

SEQ ID NO: 2267859 - RNA, 11 nt, Yersinia pestis
ugcuugcugcc

SEQ ID NO: 2267860 - RNA, 22 nt, Yersinia pestis
ugcuugcgcguuaaucugcugc

SEQ ID NO: 2267861 - RNA, 13 nt, Yersinia pestis
ugcuuguuauuuu

SEQ ID NO: 2267862 - RNA, 18 nt, Yersinia pestis
ugcuuguuguugauaguu

SEQ ID NO: 2267863 - RNA, 23 nt, Yersinia pestis
ugcuugguuacgggcuugcugca

SEQ ID NO: 2267864 - RNA, 15 nt, Yersinia pestis
ugcuuugcuucaucc

SEQ ID NO: 2267865 - RNA, 19 nt, Yersinia pestis
ugcuuuccacgcccaacuc

SEQ ID NO: 2267866 - RNA, 16 nt, Yersinia pestis
ugcuuucuaacaaacc

SEQ ID NO: 2267867 - RNA, 18 nt, Yersinia pestis
uggaaacucuaaggguaa

SEQ ID NO: 2267868 - RNA, 21 nt, Yersinia pestis
ugcuuuuuauugucucuacuc

SEQ ID NO: 2267869 - RNA, 19 nt, Yersinia pestis
ugcuuuuugcaucgcuucu

SEQ ID NO: 2267870 - RNA, 18 nt, Yersinia pestis
ugcuuuuugccagugguu

SEQ ID NO: 2267871 - RNA, 15 nt, Yersinia pestis
ugcuuuuugcuuuuu

SEQ ID NO: 2267872 - RNA, 18 nt, Yersinia pestis
ugcuuuuugcuuuuugcu

SEQ ID NO: 2267873 - RNA, 15 nt, Yersinia pestis
uggaaguacuuauuu

SEQ ID NO: 2267874 - RNA, 20 nt, Yersinia pestis
uggaagccgacgaucuugcc

SEQ ID NO: 2267875 - RNA, 14 nt, Yersinia pestis
uggaagaccagaua

SEQ ID NO: 2267876 - RNA, 20 nt, Yersinia pestis
uggaacgaagccgcagagau

SEQ ID NO: 2267877 - RNA, 17 nt, Yersinia pestis
uggacaaauaaaacaga

SEQ ID NO: 2267878 - RNA, 23 nt, Yersinia pestis
uggacagaaaacaaucuggcagc

SEQ ID NO: 2267879 - RNA, 14 nt, Yersinia pestis
uggacaucugcuuu

SEQ ID NO: 2267880 - RNA, 23 nt, Yersinia pestis
uggacgaacagccccaaccaucu

SEQ ID NO: 2267881 - RNA, 14 nt, Yersinia pestis
uggacgcaucagau

SEQ ID NO: 2267882 - RNA, 15 nt, Yersinia pestis
uggaauuaaaguauc

SEQ ID NO: 2267883 - RNA, 13 nt, Yersinia pestis
uggaauuaauauc

SEQ ID NO: 2267884 - RNA, 14 nt, Yersinia pestis
uggaaugaguuuaa

SEQ ID NO: 2267885 - RNA, 17 nt, Yersinia pestis
uggaaugaguuuaaguc

SEQ ID NO: 2267886 - RNA, 21 nt, Yersinia pestis
uggaauaguguguguauuuaa

SEQ ID NO: 2267887 - RNA, 21 nt, Yersinia pestis
uggaaucggccuucaauaccu

SEQ ID NO: 2267888 - RNA, 19 nt, Yersinia pestis
uggaaguggccagccugga

SEQ ID NO: 2267889 - RNA, 16 nt, Yersinia pestis
ugcguguggucagcac

SEQ ID NO: 2267890 - RNA, 18 nt, Yersinia pestis
ugcguuaauuacacccaa

SEQ ID NO: 2267891 - RNA, 13 nt, Yersinia pestis
ugcguaucauuau

SEQ ID NO: 2267892 - RNA, 19 nt, Yersinia pestis
ugcggguucaagucccgcc

SEQ ID NO: 2267893 - RNA, 14 nt, Yersinia pestis
ugcgggaguuuguc

SEQ ID NO: 2267894 - RNA, 17 nt, Yersinia pestis
ugcgggauucgaaccug

SEQ ID NO: 2267895 - RNA, 16 nt, Yersinia pestis
ugcggcuuucugccug

SEQ ID NO: 2267896 - RNA, 19 nt, Yersinia pestis
ugcggcuuucugccugugg

SEQ ID NO: 2267897 - RNA, 23 nt, Yersinia pestis
ugcggauuuuuuugcaauuaauu

SEQ ID NO: 2267898 - RNA, 16 nt, Yersinia pestis
ugcgcuucaucaauau

SEQ ID NO: 2267899 - RNA, 24 nt, Yersinia pestis
ugcgcuucaucaauauaguaagca

SEQ ID NO: 2267900 - RNA, 12 nt, Yersinia pestis
ugcgcuggcucu

SEQ ID NO: 2267901 - RNA, 18 nt, Yersinia pestis
ugcgcauuucacccucug

SEQ ID NO: 2267902 - RNA, 23 nt, Yersinia pestis
ugcgcauuucacccucugcagcu

SEQ ID NO: 2267903 - RNA, 18 nt, Yersinia pestis
ugcuauccacaaacucau

SEQ ID NO: 2267904 - RNA, 20 nt, Yersinia pestis
ugcuagcagaggcaaauucc

SEQ ID NO: 2267905 - RNA, 14 nt, Yersinia pestis
ugcuacuuaauauc

SEQ ID NO: 2267906 - RNA, 13 nt, Yersinia pestis
ugcuagugauaaa

SEQ ID NO: 2267907 - RNA, 11 nt, Yersinia pestis
ugcucaacaua

SEQ ID NO: 2267908 - RNA, 13 nt, Yersinia pestis
ugcuauugaacau

SEQ ID NO: 2267909 - RNA, 16 nt, Yersinia pestis
ugcuauugaacauuca

SEQ ID NO: 2267910 - RNA, 18 nt, Yersinia pestis
ugcuauucauaaaucagu

SEQ ID NO: 2267911 - RNA, 23 nt, Yersinia pestis
ugcuauucauaaaucaguacuau

SEQ ID NO: 2267912 - RNA, 22 nt, Yersinia pestis
ugcuacggauugcaaauccguc

SEQ ID NO: 2267913 - RNA, 14 nt, Yersinia pestis
ugcuacagcagcag

SEQ ID NO: 2267914 - RNA, 18 nt, Yersinia pestis
ugcuaauaccacaacauu

SEQ ID NO: 2267915 - RNA, 20 nt, Yersinia pestis
ugcuaauuucaucucaauaa

SEQ ID NO: 2267916 - RNA, 18 nt, Yersinia pestis
ugcucucgcuccagcucg

SEQ ID NO: 2267917 - RNA, 13 nt, Yersinia pestis
ugcucuucauaag

SEQ ID NO: 2267918 - RNA, 17 nt, Yersinia pestis
ugcucuucauaagccag

SEQ ID NO: 2267919 - RNA, 23 nt, Yersinia pestis
ugcucuucauaagccagugcuau

SEQ ID NO: 2267920 - RNA, 21 nt, Yersinia pestis
ugcucucgagaaauaaauacu

SEQ ID NO: 2267921 - RNA, 16 nt, Yersinia pestis
ugcucggcuaaacggu

SEQ ID NO: 2267922 - RNA, 21 nt, Yersinia pestis
ugcuccaucuuuuacaaauuu

SEQ ID NO: 2267923 - RNA, 16 nt, Yersinia pestis
ugcucgcuaaucaagc

SEQ ID NO: 2267924 - RNA, 16 nt, Yersinia pestis
ugcucagcuaaagaac

SEQ ID NO: 2267925 - RNA, 17 nt, Yersinia pestis
ugcucacgguagguuuc

SEQ ID NO: 2267926 - RNA, 21 nt, Yersinia pestis
ugcucacgguagguuucuggg

SEQ ID NO: 2267927 - RNA, 21 nt, Yersinia pestis
ugcucacuggaguuaaauccc

SEQ ID NO: 2267928 - RNA, 15 nt, Yersinia pestis
ugcucagggccacuu

SEQ ID NO: 2267929 - RNA, 18 nt, Yersinia pestis
ugccagcaaagacaauaa

SEQ ID NO: 2267930 - RNA, 14 nt, Yersinia pestis
ugccagcagcaagu

SEQ ID NO: 2267931 - RNA, 17 nt, Yersinia pestis
ugccaguagccguuaca

SEQ ID NO: 2267932 - RNA, 16 nt, Yersinia pestis
ugccaucaaucaguac

SEQ ID NO: 2267933 - RNA, 16 nt, Yersinia pestis
ugcccaauggcaaaac

SEQ ID NO: 2267934 - RNA, 11 nt, Yersinia pestis
ugccagugaau

SEQ ID NO: 2267935 - RNA, 14 nt, Yersinia pestis
ugccauaccaggcc

SEQ ID NO: 2267936 - RNA, 16 nt, Yersinia pestis
ugccauaaaugggaag

SEQ ID NO: 2267937 - RNA, 22 nt, Yersinia pestis
ugccauaagcggacauggcaac

SEQ ID NO: 2267938 - RNA, 22 nt, Yersinia pestis
ugccaauauguuagcagcacaa

SEQ ID NO: 2267939 - RNA, 18 nt, Yersinia pestis
ugccaauaugguauucaa

SEQ ID NO: 2267940 - RNA, 12 nt, Yersinia pestis
ugccaagucuua

SEQ ID NO: 2267941 - RNA, 22 nt, Yersinia pestis
ugccaagguucgaaaaaacauc

SEQ ID NO: 2267942 - RNA, 19 nt, Yersinia pestis
ugccaauccccaccaaaag

SEQ ID NO: 2267943 - RNA, 20 nt, Yersinia pestis
ugccaccaaaugcucagcca

SEQ ID NO: 2267944 - RNA, 17 nt, Yersinia pestis
ugcaguaaaaauauuaa

SEQ ID NO: 2267945 - RNA, 20 nt, Yersinia pestis
ugcaggugugcggauggcug

SEQ ID NO: 2267946 - RNA, 23 nt, Yersinia pestis
ugcaguaaccccuucgagcaccg

SEQ ID NO: 2267947 - RNA, 14 nt, Yersinia pestis
ugcaguaaauaguc

SEQ ID NO: 2267948 - RNA, 15 nt, Yersinia pestis
ugcaguaacauaauc

SEQ ID NO: 2267949 - RNA, 20 nt, Yersinia pestis
ugccaacgcaauucaauaua

SEQ ID NO: 2267950 - RNA, 17 nt, Yersinia pestis
ugccaacgucucuucca

SEQ ID NO: 2267951 - RNA, 17 nt, Yersinia pestis
ugcaguaucccuggcuc

SEQ ID NO: 2267952 - RNA, 15 nt, Yersinia pestis
ugcagucuccaucac

SEQ ID NO: 2267953 - RNA, 18 nt, Yersinia pestis
ugcccaucuuuuaguaac

SEQ ID NO: 2267954 - RNA, 19 nt, Yersinia pestis
ugcccaguuuaccauccac

SEQ ID NO: 2267955 - RNA, 20 nt, Yersinia pestis
ugcccaguuuaccauccacu

SEQ ID NO: 2267956 - RNA, 14 nt, Yersinia pestis
ugcccagagcgcgg

SEQ ID NO: 2267957 - RNA, 14 nt, Yersinia pestis
ugcccagccucugg

SEQ ID NO: 2267958 - RNA, 16 nt, Yersinia pestis
ugcccagccucuggau

SEQ ID NO: 2267959 - RNA, 17 nt, Yersinia pestis
ugcccagccugguuuuu

SEQ ID NO: 2267960 - RNA, 18 nt, Yersinia pestis
ugccccuucaaagccgcu

SEQ ID NO: 2267961 - RNA, 20 nt, Yersinia pestis
ugccccuuuuuucuauuuau

SEQ ID NO: 2267962 - RNA, 20 nt, Yersinia pestis
ugcccuuucucgccuaaguu

SEQ ID NO: 2267963 - RNA, 13 nt, Yersinia pestis
ugcccuucuucag

SEQ ID NO: 2267964 - RNA, 22 nt, Yersinia pestis
ugcccuucagaugaauccagcc

SEQ ID NO: 2267965 - RNA, 17 nt, Yersinia pestis
ugcccgucaauaucauc

SEQ ID NO: 2267966 - RNA, 18 nt, Yersinia pestis
ugcccuuacuauuuuucu

SEQ ID NO: 2267967 - RNA, 14 nt, Yersinia pestis
ugccgacaaccaac

SEQ ID NO: 2267968 - RNA, 16 nt, Yersinia pestis
ugccgaugucaauaaa

SEQ ID NO: 2267969 - RNA, 21 nt, Yersinia pestis
ugccgcaaacgcucaguuaaa

SEQ ID NO: 2267970 - RNA, 18 nt, Yersinia pestis
ugccgaugagcuucuuca

SEQ ID NO: 2267971 - RNA, 23 nt, Yersinia pestis
ugccucacggcuaccagcagcau

SEQ ID NO: 2267972 - RNA, 15 nt, Yersinia pestis
ugccugcaccagugc

SEQ ID NO: 2267973 - RNA, 14 nt, Yersinia pestis
ugccuauccucacc

SEQ ID NO: 2267974 - RNA, 16 nt, Yersinia pestis
ugccuaucuuaaaaau

SEQ ID NO: 2267975 - RNA, 23 nt, Yersinia pestis
ugccuauccucaccguucaagau

SEQ ID NO: 2267976 - RNA, 14 nt, Yersinia pestis
ugccuuuaauggca

SEQ ID NO: 2267977 - RNA, 23 nt, Yersinia pestis
ugccuuucuguaacucaaauuau

SEQ ID NO: 2267978 - RNA, 19 nt, Yersinia pestis
ugccuuagguaagucagcg

SEQ ID NO: 2267979 - RNA, 12 nt, Yersinia pestis
ugccuguucucu

SEQ ID NO: 2267980 - RNA, 15 nt, Yersinia pestis
ugccugugggcuaua

SEQ ID NO: 2267981 - RNA, 21 nt, Yersinia pestis
ugccgucaaugccuguuauaa

SEQ ID NO: 2267982 - RNA, 20 nt, Yersinia pestis
ugccguauucagcaguguga

SEQ ID NO: 2267983 - RNA, 21 nt, Yersinia pestis
ugccggcguuaaugccacccc

SEQ ID NO: 2267984 - RNA, 15 nt, Yersinia pestis
ugccggcggcgcugg

SEQ ID NO: 2267985 - RNA, 20 nt, Yersinia pestis
ugccggcguuaaugccaccc

SEQ ID NO: 2267986 - RNA, 18 nt, Yersinia pestis
ugcgauccuggcguaaua

SEQ ID NO: 2267987 - RNA, 21 nt, Yersinia pestis
ugcgauacaccauuuccaggc

SEQ ID NO: 2267988 - RNA, 23 nt, Yersinia pestis
ugcgauacaccauuuccaggcua

SEQ ID NO: 2267989 - RNA, 20 nt, Yersinia pestis
ugcgauuucacggauaucaa

SEQ ID NO: 2267990 - RNA, 14 nt, Yersinia pestis
ugcgcaucagccag

SEQ ID NO: 2267991 - RNA, 23 nt, Yersinia pestis
ugcgcaguaaauucaucacuuag

SEQ ID NO: 2267992 - RNA, 22 nt, Yersinia pestis
ugcgaaagacggccaacugcug

SEQ ID NO: 2267993 - RNA, 16 nt, Yersinia pestis
ugcgaagcuuuuauug

SEQ ID NO: 2267994 - RNA, 15 nt, Yersinia pestis
ugcgacaaugccccc

SEQ ID NO: 2267995 - RNA, 16 nt, Yersinia pestis
ugcgacaaugccccca

SEQ ID NO: 2267996 - RNA, 13 nt, Yersinia pestis
ugcgacaauuucc

SEQ ID NO: 2267997 - RNA, 21 nt, Yersinia pestis
ugcgacaggcucagcacaaac

SEQ ID NO: 2267998 - RNA, 14 nt, Yersinia pestis
ugcgagcaaggcau

SEQ ID NO: 2267999 - RNA, 16 nt, Yersinia pestis
ugcgagauauaaacua

SEQ ID NO: 2268000 - RNA, 17 nt, Yersinia pestis
ugcgacgacgacaauga

SEQ ID NO: 2268001 - RNA, 18 nt, Yersinia pestis
ugcgaccaaaagccaccg

SEQ ID NO: 2268002 - RNA, 20 nt, Yersinia pestis
ugacacaucccaacgcaggc

SEQ ID NO: 2268003 - RNA, 20 nt, Yersinia pestis
ugacaccauugauaauaaua

SEQ ID NO: 2268004 - RNA, 21 nt, Yersinia pestis
ugacaccauugauaauaauau

SEQ ID NO: 2268005 - RNA, 21 nt, Yersinia pestis
ugacaacguguccgcaccauu

SEQ ID NO: 2268006 - RNA, 19 nt, Yersinia pestis
ugacaacgucacuuccauc

SEQ ID NO: 2268007 - RNA, 14 nt, Yersinia pestis
ugacaaccacuaaa

SEQ ID NO: 2268008 - RNA, 17 nt, Yersinia pestis
ugacaaccacuaaacca

SEQ ID NO: 2268009 - RNA, 12 nt, Yersinia pestis
ugacaacaccgu

SEQ ID NO: 2268010 - RNA, 19 nt, Yersinia pestis
ugacaacaccguaacgccc

SEQ ID NO: 2268011 - RNA, 16 nt, Yersinia pestis
ugacaacaucaaauga

SEQ ID NO: 2268012 - RNA, 19 nt, Yersinia pestis
ugacaaaggguaauuaauu

SEQ ID NO: 2268013 - RNA, 15 nt, Yersinia pestis
ugacaaagugcccgc

SEQ ID NO: 2268014 - RNA, 14 nt, Yersinia pestis
ugaauucaagaagg

SEQ ID NO: 2268015 - RNA, 12 nt, Yersinia pestis
ugaauucaccaa

SEQ ID NO: 2268016 - RNA, 16 nt, Yersinia pestis
ugaauuauuucaguag

SEQ ID NO: 2268017 - RNA, 15 nt, Yersinia pestis
ugaauuauuagauga

SEQ ID NO: 2268018 - RNA, 12 nt, Yersinia pestis
ugaauugccccc

SEQ ID NO: 2268019 - RNA, 17 nt, Yersinia pestis
ucuuuauuauuauuuau

SEQ ID NO: 2268020 - RNA, 15 nt, Yersinia pestis
ugaauaccauaacaa

SEQ ID NO: 2268021 - RNA, 16 nt, Yersinia pestis
ugaauaccaccaucac

SEQ ID NO: 2268022 - RNA, 13 nt, Yersinia pestis
ugaauaucaucuu

SEQ ID NO: 2268023 - RNA, 18 nt, Yersinia pestis
ugaauaucaccauauuca

SEQ ID NO: 2268024 - RNA, 20 nt, Yersinia pestis
ugaauaucaccauauucauc

SEQ ID NO: 2268025 - RNA, 18 nt, Yersinia pestis
ugaauaucacccauaaau

SEQ ID NO: 2268026 - RNA, 16 nt, Yersinia pestis
ugaaucgccguuaccc

SEQ ID NO: 2268027 - RNA, 21 nt, Yersinia pestis
ugaaucuguaagucauucuug

SEQ ID NO: 2268028 - RNA, 20 nt, Yersinia pestis
ugaaugaccaagguuauaca

SEQ ID NO: 2268029 - RNA, 22 nt, Yersinia pestis
ugacagacccuguucguuagca

SEQ ID NO: 2268030 - RNA, 22 nt, Yersinia pestis
ugacacggguauuggcugcuug

SEQ ID NO: 2268031 - RNA, 19 nt, Yersinia pestis
ugacaccggggauccauag

SEQ ID NO: 2268032 - RNA, 18 nt, Yersinia pestis
ugacacgggaucaacaug

SEQ ID NO: 2268033 - RNA, 16 nt, Yersinia pestis
ugacacggguauuggc

SEQ ID NO: 2268034 - RNA, 16 nt, Yersinia pestis
ugacacgagaaggguu

SEQ ID NO: 2268035 - RNA, 18 nt, Yersinia pestis
ugacacgagagauaauag

SEQ ID NO: 2268036 - RNA, 14 nt, Yersinia pestis
ugacauaaacacgc

SEQ ID NO: 2268037 - RNA, 17 nt, Yersinia pestis
ugacaguagugaguuaa

SEQ ID NO: 2268038 - RNA, 16 nt, Yersinia pestis
ugacaguauuuguagu

SEQ ID NO: 2268039 - RNA, 19 nt, Yersinia pestis
ugacaguauuuguagugga

SEQ ID NO: 2268040 - RNA, 14 nt, Yersinia pestis
ugaccaauagucac

SEQ ID NO: 2268041 - RNA, 18 nt, Yersinia pestis
ugaccacaaaaacagugu

SEQ ID NO: 2268042 - RNA, 19 nt, Yersinia pestis
ugaccacgcaucaauaaua

SEQ ID NO: 2268043 - RNA, 18 nt, Yersinia pestis
ugaccacgcaucaauaau

SEQ ID NO: 2268044 - RNA, 19 nt, Yersinia pestis
ugaccacugcuucugucag

SEQ ID NO: 2268045 - RNA, 21 nt, Yersinia pestis
ugaccacuugcugaugcccau

SEQ ID NO: 2268046 - RNA, 17 nt, Yersinia pestis
ugaccagugaauaaguu

SEQ ID NO: 2268047 - RNA, 16 nt, Yersinia pestis
ugaccagugaauaagu

SEQ ID NO: 2268048 - RNA, 22 nt, Yersinia pestis
ugaccaucgaucugggcuaugc

SEQ ID NO: 2268049 - RNA, 21 nt, Yersinia pestis
ugaccauucacgccgcuccug

SEQ ID NO: 2268050 - RNA, 21 nt, Yersinia pestis
ugaccaugcuuauugccaugc

SEQ ID NO: 2268051 - RNA, 19 nt, Yersinia pestis
ugaccggugacguuggauc

SEQ ID NO: 2268052 - RNA, 13 nt, Yersinia pestis
ugaccgguauaga

SEQ ID NO: 2268053 - RNA, 15 nt, Yersinia pestis
ugaccgcuguuugau

SEQ ID NO: 2268054 - RNA, 13 nt, Yersinia pestis
ugaccccaaauuu

SEQ ID NO: 2268055 - RNA, 21 nt, Yersinia pestis
ugaccuauugauaaaaccacu

SEQ ID NO: 2268056 - RNA, 20 nt, Yersinia pestis
ugaccuauugauaaaaccgc

SEQ ID NO: 2268057 - RNA, 15 nt, Yersinia pestis
ugaccguuguaugug

SEQ ID NO: 2268058 - RNA, 21 nt, Yersinia pestis
ugacuuuaaaaaaauuaucau

SEQ ID NO: 2268059 - RNA, 12 nt, Yersinia pestis
ugacuugauuaa

SEQ ID NO: 2268060 - RNA, 18 nt, Yersinia pestis
ugacuuugucagcagucu

SEQ ID NO: 2268061 - RNA, 19 nt, Yersinia pestis
ugagaagaaaucauuuagg

SEQ ID NO: 2268062 - RNA, 16 nt, Yersinia pestis
ugacuuuuuuuaacca

SEQ ID NO: 2268063 - RNA, 13 nt, Yersinia pestis
ugacuguaaauau

SEQ ID NO: 2268064 - RNA, 20 nt, Yersinia pestis
ugacuggggugaacgaaagc

SEQ ID NO: 2268065 - RNA, 16 nt, Yersinia pestis
ugacuggaauauucca

SEQ ID NO: 2268066 - RNA, 15 nt, Yersinia pestis
ugacuggcuauuaga

SEQ ID NO: 2268067 - RNA, 21 nt, Yersinia pestis
ugacugccgggaucaauuaca

SEQ ID NO: 2268068 - RNA, 20 nt, Yersinia pestis
ugacucccuguucguuuccc

SEQ ID NO: 2268069 - RNA, 21 nt, Yersinia pestis
ugacucccugacucccugacu

SEQ ID NO: 2268070 - RNA, 16 nt, Yersinia pestis
ugacucaucaaaacaa

SEQ ID NO: 2268071 - RNA, 15 nt, Yersinia pestis
ugacucacguauuuu

SEQ ID NO: 2268072 - RNA, 14 nt, Yersinia pestis
ugacggcagcgagc

SEQ ID NO: 2268073 - RNA, 12 nt, Yersinia pestis
ugagccauuauc

SEQ ID NO: 2268074 - RNA, 14 nt, Yersinia pestis
ugagccgcauacau

SEQ ID NO: 2268075 - RNA, 13 nt, Yersinia pestis
ugagccugcggca

SEQ ID NO: 2268076 - RNA, 20 nt, Yersinia pestis
ugagccucaugaaugaggcu

SEQ ID NO: 2268077 - RNA, 22 nt, Yersinia pestis
ugagcacgauuaccauuacuuc

SEQ ID NO: 2268078 - RNA, 22 nt, Yersinia pestis
ugagccaucaaucguacuggcg

SEQ ID NO: 2268079 - RNA, 12 nt, Yersinia pestis
ugagcagcucua

SEQ ID NO: 2268080 - RNA, 12 nt, Yersinia pestis
ugagauuaucag

SEQ ID NO: 2268081 - RNA, 15 nt, Yersinia pestis
ugagaucuaaaaaau

SEQ ID NO: 2268082 - RNA, 15 nt, Yersinia pestis
ugagauccuccauau

SEQ ID NO: 2268083 - RNA, 15 nt, Yersinia pestis
ugagaugaacacaga

SEQ ID NO: 2268084 - RNA, 15 nt, Yersinia pestis
ugagauggcgcaaug

SEQ ID NO: 2268085 - RNA, 14 nt, Yersinia pestis
ugagaagacgaaua

SEQ ID NO: 2268086 - RNA, 18 nt, Yersinia pestis
ugagaaguaaaacgugaa

SEQ ID NO: 2268087 - RNA, 18 nt, Yersinia pestis
ugagaauacuucaggcca

SEQ ID NO: 2268088 - RNA, 21 nt, Yersinia pestis
ugagaaggguauugaagauac

SEQ ID NO: 2268089 - RNA, 14 nt, Yersinia pestis
ugagaagugaaaaa

SEQ ID NO: 2268090 - RNA, 12 nt, Yersinia pestis
ugagaauaaaac

SEQ ID NO: 2268091 - RNA, 15 nt, Yersinia pestis
ugagaauaaaaccua

SEQ ID NO: 2268092 - RNA, 14 nt, Yersinia pestis
ugagguaaaccaag

SEQ ID NO: 2268093 - RNA, 21 nt, Yersinia pestis
ugaggguugucagcagucuga

SEQ ID NO: 2268094 - RNA, 12 nt, Yersinia pestis
ugagggccacuu

SEQ ID NO: 2268095 - RNA, 22 nt, Yersinia pestis
ugagggccacuucgguggcccu

SEQ ID NO: 2268096 - RNA, 15 nt, Yersinia pestis
ugaggauucaagaac

SEQ ID NO: 2268097 - RNA, 21 nt, Yersinia pestis
ugaggcagugaauagggaaua

SEQ ID NO: 2268098 - RNA, 16 nt, Yersinia pestis
ugaggcucuucugggc

SEQ ID NO: 2268099 - RNA, 18 nt, Yersinia pestis
ugaggcuaccugcaccaa

SEQ ID NO: 2268100 - RNA, 17 nt, Yersinia pestis
ugagugaaaauauguag

SEQ ID NO: 2268101 - RNA, 21 nt, Yersinia pestis
ugagugaaaucuccuguggca

SEQ ID NO: 2268102 - RNA, 15 nt, Yersinia pestis
ugagugaauagauaa

SEQ ID NO: 2268103 - RNA, 18 nt, Yersinia pestis
ugaguauuucuuucacuu

SEQ ID NO: 2268104 - RNA, 21 nt, Yersinia pestis
ugaguauguuugauuaagccg

SEQ ID NO: 2268105 - RNA, 23 nt, Yersinia pestis
ugaguauccaauaagcguauuuu

SEQ ID NO: 2268106 - RNA, 17 nt, Yersinia pestis
ugaguaauuucagauaa

SEQ ID NO: 2268107 - RNA, 19 nt, Yersinia pestis
ugaguaauuucagauaaaa

SEQ ID NO: 2268108 - RNA, 13 nt, Yersinia pestis
ugaguaguggagc

SEQ ID NO: 2268109 - RNA, 11 nt, Yersinia pestis
ugaggucagcg

SEQ ID NO: 2268110 - RNA, 13 nt, Yersinia pestis
ugagguucccaac

SEQ ID NO: 2268111 - RNA, 18 nt, Yersinia pestis
ugagguuagaaaacaguu

SEQ ID NO: 2268112 - RNA, 15 nt, Yersinia pestis
ugaguaaaagauuca

SEQ ID NO: 2268113 - RNA, 20 nt, Yersinia pestis
ugaguaaaccguacauuaaa

SEQ ID NO: 2268114 - RNA, 22 nt, Yersinia pestis
ugaguaaacaccuucagacuga

SEQ ID NO: 2268115 - RNA, 12 nt, Yersinia pestis
ugaguaacauua

SEQ ID NO: 2268116 - RNA, 15 nt, Yersinia pestis
ugaguaaauuaaauu

SEQ ID NO: 2268117 - RNA, 15 nt, Yersinia pestis
ugaguaauuucagau

SEQ ID NO: 2268118 - RNA, 22 nt, Yersinia pestis
ugagcuguaaauauaaaauaau

SEQ ID NO: 2268119 - RNA, 20 nt, Yersinia pestis
ugagcuuauggaaguaaucc

SEQ ID NO: 2268120 - RNA, 17 nt, Yersinia pestis
ugaggauaggcagaaga

SEQ ID NO: 2268121 - RNA, 14 nt, Yersinia pestis
ugagcuauuccagu

SEQ ID NO: 2268122 - RNA, 22 nt, Yersinia pestis
ugagcucaccguuacucaggga

SEQ ID NO: 2268123 - RNA, 21 nt, Yersinia pestis
ugagcguagcugucaccuaac

SEQ ID NO: 2268124 - RNA, 17 nt, Yersinia pestis
ugagcgcacgauaaauc

SEQ ID NO: 2268125 - RNA, 23 nt, Yersinia pestis
ugagcgccaugcgcuuucagcac

SEQ ID NO: 2268126 - RNA, 14 nt, Yersinia pestis
ugagcgcuauuuau

SEQ ID NO: 2268127 - RNA, 14 nt, Yersinia pestis
ugcagacucuuaua

SEQ ID NO: 2268128 - RNA, 17 nt, Yersinia pestis
ugcagauaccacaucaa

SEQ ID NO: 2268129 - RNA, 17 nt, Yersinia pestis
ugcagaaucacuggcag

SEQ ID NO: 2268130 - RNA, 19 nt, Yersinia pestis
ugcagaaucacuggcagaa

SEQ ID NO: 2268131 - RNA, 23 nt, Yersinia pestis
ugcagaaucacuggcagaaguug

SEQ ID NO: 2268132 - RNA, 20 nt, Yersinia pestis
ugcagcaacaauaacuuugg

SEQ ID NO: 2268133 - RNA, 17 nt, Yersinia pestis
ugcagaucggcauuauu

SEQ ID NO: 2268134 - RNA, 17 nt, Yersinia pestis
ugcagccaauguuucaa

SEQ ID NO: 2268135 - RNA, 21 nt, Yersinia pestis
ugcagcauuuucagcaacuga

SEQ ID NO: 2268136 - RNA, 23 nt, Yersinia pestis
ugcagcauuuucagcaacugacc

SEQ ID NO: 2268137 - RNA, 14 nt, Yersinia pestis
ugcagcauuucagg

SEQ ID NO: 2268138 - RNA, 17 nt, Yersinia pestis
ugcaggcugucaggaac

SEQ ID NO: 2268139 - RNA, 23 nt, Yersinia pestis
ugcagggcgacauuaaucaucgc

SEQ ID NO: 2268140 - RNA, 19 nt, Yersinia pestis
ugcaggauagccaaccccu

SEQ ID NO: 2268141 - RNA, 21 nt, Yersinia pestis
ugcagcucaaagaccacauca

SEQ ID NO: 2268142 - RNA, 16 nt, Yersinia pestis
ugcagcucaaucacau

SEQ ID NO: 2268143 - RNA, 20 nt, Yersinia pestis
ugcagcggaugauaaauauc

SEQ ID NO: 2268144 - RNA, 19 nt, Yersinia pestis
ugcaaggggcgagccacga

SEQ ID NO: 2268145 - RNA, 17 nt, Yersinia pestis
ugcaauaaauucaaaau

SEQ ID NO: 2268146 - RNA, 18 nt, Yersinia pestis
ugcaauaacaccagcagg

SEQ ID NO: 2268147 - RNA, 22 nt, Yersinia pestis
ugcaaguguaugaguaucaaua

SEQ ID NO: 2268148 - RNA, 21 nt, Yersinia pestis
ugcaauaaauucaaaauagag

SEQ ID NO: 2268149 - RNA, 20 nt, Yersinia pestis
ugcaagcccccaaaguagaa

SEQ ID NO: 2268150 - RNA, 21 nt, Yersinia pestis
ugcacaaucucguuaucagcc

SEQ ID NO: 2268151 - RNA, 22 nt, Yersinia pestis
ugcacacgggcgguaaucugcg

SEQ ID NO: 2268152 - RNA, 13 nt, Yersinia pestis
ugcaauccgcuga

SEQ ID NO: 2268153 - RNA, 15 nt, Yersinia pestis
ugcaaugcuuauuuc

SEQ ID NO: 2268154 - RNA, 23 nt, Yersinia pestis
ugcaaugcuuauuucacacuguu

SEQ ID NO: 2268155 - RNA, 21 nt, Yersinia pestis
ugcaauggcuggcaaggcacg

SEQ ID NO: 2268156 - RNA, 13 nt, Yersinia pestis
ugcaauuuuauug

SEQ ID NO: 2268157 - RNA, 19 nt, Yersinia pestis
ugcaauuuuauugauuggc

SEQ ID NO: 2268158 - RNA, 21 nt, Yersinia pestis
ugcacagguccaucagcaaau

SEQ ID NO: 2268159 - RNA, 22 nt, Yersinia pestis
ugcacaguaggcugaaggccug

SEQ ID NO: 2268160 - RNA, 17 nt, Yersinia pestis
ugcacagguaguaagca

SEQ ID NO: 2268161 - RNA, 15 nt, Yersinia pestis
ugcacaucauuuauu

SEQ ID NO: 2268162 - RNA, 17 nt, Yersinia pestis
ugcaccaauaacugccc

SEQ ID NO: 2268163 - RNA, 22 nt, Yersinia pestis
ugcaccaaugacuaauugugca

SEQ ID NO: 2268164 - RNA, 12 nt, Yersinia pestis
ugcaccaaucaa

SEQ ID NO: 2268165 - RNA, 18 nt, Yersinia pestis
ugcacgacaacaaagccg

SEQ ID NO: 2268166 - RNA, 21 nt, Yersinia pestis
ugcagaaauaaauauccuccg

SEQ ID NO: 2268167 - RNA, 23 nt, Yersinia pestis
ugcacuuuuacugguucauuuuc

SEQ ID NO: 2268168 - RNA, 16 nt, Yersinia pestis
ugauauuccucgcagg

SEQ ID NO: 2268169 - RNA, 15 nt, Yersinia pestis
ugauauauagaaaua

SEQ ID NO: 2268170 - RNA, 19 nt, Yersinia pestis
ugaguguccacauagcugc

SEQ ID NO: 2268171 - RNA, 17 nt, Yersinia pestis
ugagugaccaagcccaa

SEQ ID NO: 2268172 - RNA, 16 nt, Yersinia pestis
ugagugagacaauuaa

SEQ ID NO: 2268173 - RNA, 19 nt, Yersinia pestis
ugagugaucauauuaggca

SEQ ID NO: 2268174 - RNA, 16 nt, Yersinia pestis
ugaucacuggcauugc

SEQ ID NO: 2268175 - RNA, 11 nt, Yersinia pestis
ugaucagcagu

SEQ ID NO: 2268176 - RNA, 20 nt, Yersinia pestis
ugaucagcauuucggcuauu

SEQ ID NO: 2268177 - RNA, 20 nt, Yersinia pestis
ugaucagccgauguuugagc

SEQ ID NO: 2268178 - RNA, 21 nt, Yersinia pestis
ugauccgauaaacuucacaau

SEQ ID NO: 2268179 - RNA, 16 nt, Yersinia pestis
ugauccgguuuccuua

SEQ ID NO: 2268180 - RNA, 20 nt, Yersinia pestis
ugauccccgcuaacugcuga

SEQ ID NO: 2268181 - RNA, 13 nt, Yersinia pestis
ugaugaaugcgaa

SEQ ID NO: 2268182 - RNA, 20 nt, Yersinia pestis
ugaugaaguuauuuuuauua

SEQ ID NO: 2268183 - RNA, 19 nt, Yersinia pestis
ugaugaauaccaccaucac

SEQ ID NO: 2268184 - RNA, 13 nt, Yersinia pestis
ugaucgggcuuua

SEQ ID NO: 2268185 - RNA, 13 nt, Yersinia pestis
ugaucggcauaaa

SEQ ID NO: 2268186 - RNA, 15 nt, Yersinia pestis
ugaucggcauaaaug

SEQ ID NO: 2268187 - RNA, 16 nt, Yersinia pestis
ugaugacaaugcguua

SEQ ID NO: 2268188 - RNA, 19 nt, Yersinia pestis
ugaugacgccguacaaaua

SEQ ID NO: 2268189 - RNA, 18 nt, Yersinia pestis
ugaugacaaccucucagu

SEQ ID NO: 2268190 - RNA, 14 nt, Yersinia pestis
ugaugacaaugcgu

SEQ ID NO: 2268191 - RNA, 22 nt, Yersinia pestis
ugaugacacccguuccuucagc

SEQ ID NO: 2268192 - RNA, 17 nt, Yersinia pestis
ugaugacggugaugucc

SEQ ID NO: 2268193 - RNA, 17 nt, Yersinia pestis
ugaucgccguacuuggu

SEQ ID NO: 2268194 - RNA, 19 nt, Yersinia pestis
ugaucgccgcuaauuuucc

SEQ ID NO: 2268195 - RNA, 15 nt, Yersinia pestis
ugaugagaaguaaaa

SEQ ID NO: 2268196 - RNA, 20 nt, Yersinia pestis
ugaugauuuggcugaauacc

SEQ ID NO: 2268197 - RNA, 14 nt, Yersinia pestis
ugaugccaaauuaa

SEQ ID NO: 2268198 - RNA, 16 nt, Yersinia pestis
ugaugcauauuauuaa

SEQ ID NO: 2268199 - RNA, 23 nt, Yersinia pestis
ugaugcauauuauuaaugaaauu

SEQ ID NO: 2268200 - RNA, 18 nt, Yersinia pestis
ugaugcaguaaauagucu

SEQ ID NO: 2268201 - RNA, 15 nt, Yersinia pestis
ugaugcuuuucuuuc

SEQ ID NO: 2268202 - RNA, 16 nt, Yersinia pestis
ugaugcuuuucuuucc

SEQ ID NO: 2268203 - RNA, 21 nt, Yersinia pestis
ugaugcucauuuaaaauacuc

SEQ ID NO: 2268204 - RNA, 16 nt, Yersinia pestis
ugcaaaaaaagacacu

SEQ ID NO: 2268205 - RNA, 11 nt, Yersinia pestis
ugcaaaaaaag

SEQ ID NO: 2268206 - RNA, 20 nt, Yersinia pestis
ugcaaacccuaauaccaaca

SEQ ID NO: 2268207 - RNA, 22 nt, Yersinia pestis
ugcaaaccaugggggcaacggu

SEQ ID NO: 2268208 - RNA, 24 nt, Yersinia pestis
ugcaaaccaugggggcaacgguaa

SEQ ID NO: 2268209 - RNA, 15 nt, Yersinia pestis
ugcaaacgagaguau

SEQ ID NO: 2268210 - RNA, 13 nt, Yersinia pestis
ugauuuccaucua

SEQ ID NO: 2268211 - RNA, 14 nt, Yersinia pestis
ugauuuaaauauua

SEQ ID NO: 2268212 - RNA, 20 nt, Yersinia pestis
ugauuuaaauauuauuuaau

SEQ ID NO: 2268213 - RNA, 15 nt, Yersinia pestis
ugauucgucugccau

SEQ ID NO: 2268214 - RNA, 19 nt, Yersinia pestis
ugauucgggugagugagcg

SEQ ID NO: 2268215 - RNA, 16 nt, Yersinia pestis
ugauucgcgaccagca

SEQ ID NO: 2268216 - RNA, 17 nt, Yersinia pestis
ugauucucuauucugcu

SEQ ID NO: 2268217 - RNA, 13 nt, Yersinia pestis
ugauuauucugcu

SEQ ID NO: 2268218 - RNA, 17 nt, Yersinia pestis
ugauuauuuaaacaaug

SEQ ID NO: 2268219 - RNA, 13 nt, Yersinia pestis
ugauuaaaacccc

SEQ ID NO: 2268220 - RNA, 20 nt, Yersinia pestis
ugauuaaaagucaacugcuc

SEQ ID NO: 2268221 - RNA, 18 nt, Yersinia pestis
ugauuaucaaguuaaaua

SEQ ID NO: 2268222 - RNA, 14 nt, Yersinia pestis
ugauucaaaaugcc

SEQ ID NO: 2268223 - RNA, 13 nt, Yersinia pestis
ugauucaauuucg

SEQ ID NO: 2268224 - RNA, 17 nt, Yersinia pestis
ugauucaacugccgcaa

SEQ ID NO: 2268225 - RNA, 18 nt, Yersinia pestis
ugauuccgguacugugcu

SEQ ID NO: 2268226 - RNA, 13 nt, Yersinia pestis
ugauguuauuaau

SEQ ID NO: 2268227 - RNA, 20 nt, Yersinia pestis
ugaugugacgucacugaugc

SEQ ID NO: 2268228 - RNA, 21 nt, Yersinia pestis
ugaugugacgucacugaugcu

SEQ ID NO: 2268229 - RNA, 15 nt, Yersinia pestis
ugaugugaaacauaa

SEQ ID NO: 2268230 - RNA, 21 nt, Yersinia pestis
ugaugugaacgcccuguaaug

SEQ ID NO: 2268231 - RNA, 18 nt, Yersinia pestis
ugaugggaggaaacugcc

SEQ ID NO: 2268232 - RNA, 19 nt, Yersinia pestis
ugauggcgcagacccguga

SEQ ID NO: 2268233 - RNA, 17 nt, Yersinia pestis
ugauggccuugaaucaa

SEQ ID NO: 2268234 - RNA, 14 nt, Yersinia pestis
ugauggccuugaau

SEQ ID NO: 2268235 - RNA, 22 nt, Yersinia pestis
ugauggcaccgugggcaaagaa

SEQ ID NO: 2268236 - RNA, 15 nt, Yersinia pestis
ugauggccguaucau

SEQ ID NO: 2268237 - RNA, 19 nt, Yersinia pestis
ugaugggauuaauaauggu

SEQ ID NO: 2268238 - RNA, 19 nt, Yersinia pestis
gaccuguagcuuuuuaaau

SEQ ID NO: 2268239 - RNA, 18 nt, Yersinia pestis
gaccuauugauaaaaccg

SEQ ID NO: 2268240 - RNA, 14 nt, Yersinia pestis
gaccuagcaaugag

SEQ ID NO: 2268241 - RNA, 13 nt, Yersinia pestis
gaccuccguaggc

SEQ ID NO: 2268242 - RNA, 16 nt, Yersinia pestis
gaccuccguaggccaa

SEQ ID NO: 2268243 - RNA, 22 nt, Yersinia pestis
gaccggguaacucccggcaggc

SEQ ID NO: 2268244 - RNA, 23 nt, Yersinia pestis
gaccgcuguuugauuaaaacccc

SEQ ID NO: 2268245 - RNA, 15 nt, Yersinia pestis
gaccgcucuucacau

SEQ ID NO: 2268246 - RNA, 21 nt, Yersinia pestis
gaccgcgacacaagccauuuc

SEQ ID NO: 2268247 - RNA, 14 nt, Yersinia pestis
gacccguuuauaaa

SEQ ID NO: 2268248 - RNA, 16 nt, Yersinia pestis
gacccggcugcacgcc

SEQ ID NO: 2268249 - RNA, 23 nt, Yersinia pestis
gaccgccaaauccaagccaccac

SEQ ID NO: 2268250 - RNA, 20 nt, Yersinia pestis
gaccccuucuuccagcauca

SEQ ID NO: 2268251 - RNA, 14 nt, Yersinia pestis
gaccccugcugaaa

SEQ ID NO: 2268252 - RNA, 12 nt, Yersinia pestis
gaccauuucucu

SEQ ID NO: 2268253 - RNA, 15 nt, Yersinia pestis
gacccaagggcuauu

SEQ ID NO: 2268254 - RNA, 14 nt, Yersinia pestis
gacccacaucggcc

SEQ ID NO: 2268255 - RNA, 22 nt, Yersinia pestis
gaccaugccaucagaauaggug

SEQ ID NO: 2268256 - RNA, 20 nt, Yersinia pestis
gaccauaaaaggauggccca

SEQ ID NO: 2268257 - RNA, 16 nt, Yersinia pestis
gaccaucgaucugggc

SEQ ID NO: 2268258 - RNA, 15 nt, Yersinia pestis
gaccuuccauaacuc

SEQ ID NO: 2268259 - RNA, 13 nt, Yersinia pestis
gaccuugguaucu

SEQ ID NO: 2268260 - RNA, 19 nt, Yersinia pestis
gacgaaauagcgccugccc

SEQ ID NO: 2268261 - RNA, 13 nt, Yersinia pestis
gacgaacagcccc

SEQ ID NO: 2268262 - RNA, 19 nt, Yersinia pestis
gacgacggaaccgaauaau

SEQ ID NO: 2268263 - RNA, 16 nt, Yersinia pestis
gacgacacaaaugcug

SEQ ID NO: 2268264 - RNA, 23 nt, Yersinia pestis
gacgacacaaaugcugugccaug

SEQ ID NO: 2268265 - RNA, 23 nt, Yersinia pestis
gacgauaacuuuuggcagcacca

SEQ ID NO: 2268266 - RNA, 15 nt, Yersinia pestis
gacgagcggcauuga

SEQ ID NO: 2268267 - RNA, 19 nt, Yersinia pestis
gacgcaaacggguggccgc

SEQ ID NO: 2268268 - RNA, 22 nt, Yersinia pestis
gacgauugcacuggcuaauacc

SEQ ID NO: 2268269 - RNA, 19 nt, Yersinia pestis
gacggaugaaaagugaucc

SEQ ID NO: 2268270 - RNA, 18 nt, Yersinia pestis
gacgcguuugcuugcugc

SEQ ID NO: 2268271 - RNA, 22 nt, Yersinia pestis
gacgcuaaccaccgucaccaaa

SEQ ID NO: 2268272 - RNA, 15 nt, Yersinia pestis
gacgcggugacaaug

SEQ ID NO: 2268273 - RNA, 16 nt, Yersinia pestis
gacgcuggcagccuuu

SEQ ID NO: 2268274 - RNA, 20 nt, Yersinia pestis
gacgcuguauacggacaaug

SEQ ID NO: 2268275 - RNA, 22 nt, Yersinia pestis
gacgcuuuacuccucugccuau

SEQ ID NO: 2268276 - RNA, 22 nt, Yersinia pestis
gacgcuguugacguguuagcug

SEQ ID NO: 2268277 - RNA, 13 nt, Yersinia pestis
gacgcuuauccug

SEQ ID NO: 2268278 - RNA, 23 nt, Yersinia pestis
gacgccccgaaccauuuaccauc

SEQ ID NO: 2268279 - RNA, 18 nt, Yersinia pestis
gacgccguaaauacaucc

SEQ ID NO: 2268280 - RNA, 18 nt, Yersinia pestis
gacaaauaaaacagaacc

SEQ ID NO: 2268281 - RNA, 21 nt, Yersinia pestis
gacaaauaaaacagaaccccc

SEQ ID NO: 2268282 - RNA, 13 nt, Yersinia pestis
gacaaacagauac

SEQ ID NO: 2268283 - RNA, 13 nt, Yersinia pestis
gaauuuuagucaa

SEQ ID NO: 2268284 - RNA, 15 nt, Yersinia pestis
cuuuggugaucauga

SEQ ID NO: 2268285 - RNA, 23 nt, Yersinia pestis
gaauuuucuaacgcgccggauuc

SEQ ID NO: 2268286 - RNA, 21 nt, Yersinia pestis
gaauuuucucauuaauaauga

SEQ ID NO: 2268287 - RNA, 14 nt, Yersinia pestis
gacaauuaacacuu

SEQ ID NO: 2268288 - RNA, 18 nt, Yersinia pestis
gacaaugccaucccccuu

SEQ ID NO: 2268289 - RNA, 21 nt, Yersinia pestis
gacaauaccgccacacaauac

SEQ ID NO: 2268290 - RNA, 15 nt, Yersinia pestis
gacaauaguguugcu

SEQ ID NO: 2268291 - RNA, 18 nt, Yersinia pestis
gacaauagagucacagag

SEQ ID NO: 2268292 - RNA, 22 nt, Yersinia pestis
gacaagucaugguacaacugcg

SEQ ID NO: 2268293 - RNA, 23 nt, Yersinia pestis
gacaauaacggaaaaucaucgcu

SEQ ID NO: 2268294 - RNA, 17 nt, Yersinia pestis
gacaacauugccaaauu

SEQ ID NO: 2268295 - RNA, 17 nt, Yersinia pestis
gacaacgcuuggcauca

SEQ ID NO: 2268296 - RNA, 20 nt, Yersinia pestis
gacaagagcaauggcgauga

SEQ ID NO: 2268297 - RNA, 16 nt, Yersinia pestis
gacaagauugccaccu

SEQ ID NO: 2268298 - RNA, 21 nt, Yersinia pestis
gacaagauugccaccuucacc

SEQ ID NO: 2268299 - RNA, 23 nt, Yersinia pestis
gacaagauugccaccuucaccgu

SEQ ID NO: 2268300 - RNA, 16 nt, Yersinia pestis
gacaacucuucuaucu

SEQ ID NO: 2268301 - RNA, 17 nt, Yersinia pestis
gacaacgucacuuccau

SEQ ID NO: 2268302 - RNA, 16 nt, Yersinia pestis
gacaaggaaaaggcag

SEQ ID NO: 2268303 - RNA, 15 nt, Yersinia pestis
gacagaauauccagc

SEQ ID NO: 2268304 - RNA, 13 nt, Yersinia pestis
gacagacccuguu

SEQ ID NO: 2268305 - RNA, 15 nt, Yersinia pestis
gacacuuuugucgcu

SEQ ID NO: 2268306 - RNA, 20 nt, Yersinia pestis
gacacuuugguuugcagcga

SEQ ID NO: 2268307 - RNA, 22 nt, Yersinia pestis
gacagcaucugcaauggcuggc

SEQ ID NO: 2268308 - RNA, 22 nt, Yersinia pestis
gacagcauacauccuaaauaau

SEQ ID NO: 2268309 - RNA, 14 nt, Yersinia pestis
gacaggcaaagacu

SEQ ID NO: 2268310 - RNA, 17 nt, Yersinia pestis
gacaggcaaagacuaca

SEQ ID NO: 2268311 - RNA, 14 nt, Yersinia pestis
gacacaucccaacg

SEQ ID NO: 2268312 - RNA, 17 nt, Yersinia pestis
gacacaaauuacucugc

SEQ ID NO: 2268313 - RNA, 14 nt, Yersinia pestis
gacacaacacauua

SEQ ID NO: 2268314 - RNA, 13 nt, Yersinia pestis
gacacaauucccg

SEQ ID NO: 2268315 - RNA, 18 nt, Yersinia pestis
gacacaauagaugcagua

SEQ ID NO: 2268316 - RNA, 17 nt, Yersinia pestis
gacaccaagaggcugcg

SEQ ID NO: 2268317 - RNA, 17 nt, Yersinia pestis
gacacccguacgaauuu

SEQ ID NO: 2268318 - RNA, 18 nt, Yersinia pestis
gacacccguuccuucagc

SEQ ID NO: 2268319 - RNA, 18 nt, Yersinia pestis
gacaccaaucuuuuucag

SEQ ID NO: 2268320 - RNA, 17 nt, Yersinia pestis
gacaccaagacugaagu

SEQ ID NO: 2268321 - RNA, 14 nt, Yersinia pestis
gacacuaaccagac

SEQ ID NO: 2268322 - RNA, 23 nt, Yersinia pestis
gacacucggcgguuugagccacc

SEQ ID NO: 2268323 - RNA, 17 nt, Yersinia pestis
gacacugacaucaucac

SEQ ID NO: 2268324 - RNA, 16 nt, Yersinia pestis
gacaccggggauccau

SEQ ID NO: 2268325 - RNA, 19 nt, Yersinia pestis
gacauuaucgccagcaacu

SEQ ID NO: 2268326 - RNA, 22 nt, Yersinia pestis
gacaugucucgguuaaagacau

SEQ ID NO: 2268327 - RNA, 20 nt, Yersinia pestis
gacaugugagugguguaaga

SEQ ID NO: 2268328 - RNA, 12 nt, Yersinia pestis
gacauuaagcau

SEQ ID NO: 2268329 - RNA, 21 nt, Yersinia pestis
gacauggggguguuuuuccaa

SEQ ID NO: 2268330 - RNA, 19 nt, Yersinia pestis
gacaugggcagugcacagu

SEQ ID NO: 2268331 - RNA, 15 nt, Yersinia pestis
gacauuuugugcucu

SEQ ID NO: 2268332 - RNA, 14 nt, Yersinia pestis
gacaucgccagauu

SEQ ID NO: 2268333 - RNA, 19 nt, Yersinia pestis
gacaucagguuguauuuug

SEQ ID NO: 2268334 - RNA, 12 nt, Yersinia pestis
gacauccaauuc

SEQ ID NO: 2268335 - RNA, 21 nt, Yersinia pestis
gacaugcaccguaacuucuuc

SEQ ID NO: 2268336 - RNA, 23 nt, Yersinia pestis
gacaugauuaaaucaagcugcuc

SEQ ID NO: 2268337 - RNA, 22 nt, Yersinia pestis
gacauaagaugaccaccaauuu

SEQ ID NO: 2268338 - RNA, 16 nt, Yersinia pestis
gacauauucaaccgcc

SEQ ID NO: 2268339 - RNA, 18 nt, Yersinia pestis
gacauaaugccggcggcc

SEQ ID NO: 2268340 - RNA, 18 nt, Yersinia pestis
gacaggcucagcacaaac

SEQ ID NO: 2268341 - RNA, 14 nt, Yersinia pestis
gacaggcuccuccu

SEQ ID NO: 2268342 - RNA, 18 nt, Yersinia pestis
gacaggcaauuauccauc

SEQ ID NO: 2268343 - RNA, 14 nt, Yersinia pestis
gacaguaacuaaag

SEQ ID NO: 2268344 - RNA, 20 nt, Yersinia pestis
gacagugagguuauugacaa

SEQ ID NO: 2268345 - RNA, 21 nt, Yersinia pestis
gaccacuuuuuguguuuuggc

SEQ ID NO: 2268346 - RNA, 21 nt, Yersinia pestis
gaccagacaacagucacacca

SEQ ID NO: 2268347 - RNA, 20 nt, Yersinia pestis
gaccacgauuuaaugguuuc

SEQ ID NO: 2268348 - RNA, 13 nt, Yersinia pestis
gaccaccgccauu

SEQ ID NO: 2268349 - RNA, 19 nt, Yersinia pestis
gaccaauugguaagaaugg

SEQ ID NO: 2268350 - RNA, 16 nt, Yersinia pestis
gaccaauuucaauaau

SEQ ID NO: 2268351 - RNA, 16 nt, Yersinia pestis
gaccaauucaucagcg

SEQ ID NO: 2268352 - RNA, 16 nt, Yersinia pestis
gaccaacgcuguaauc

SEQ ID NO: 2268353 - RNA, 12 nt, Yersinia pestis
gacauuuuucua

SEQ ID NO: 2268354 - RNA, 21 nt, Yersinia pestis
gaccaaauggacgaacagccc

SEQ ID NO: 2268355 - RNA, 23 nt, Yersinia pestis
gaccaaauagcaagccaaaacag

SEQ ID NO: 2268356 - RNA, 18 nt, Yersinia pestis
gaccagcgccgauauaca

SEQ ID NO: 2268357 - RNA, 17 nt, Yersinia pestis
gaccagauaaucgccaa

SEQ ID NO: 2268358 - RNA, 13 nt, Yersinia pestis
gaccagugagcca

SEQ ID NO: 2268359 - RNA, 23 nt, Yersinia pestis
gaccagugcacccagcucgguga

SEQ ID NO: 2268360 - RNA, 14 nt, Yersinia pestis
gaccagggcuaaaa

SEQ ID NO: 2268361 - RNA, 15 nt, Yersinia pestis
gacugucuucaacuu

SEQ ID NO: 2268362 - RNA, 12 nt, Yersinia pestis
gacuguggcugc

SEQ ID NO: 2268363 - RNA, 23 nt, Yersinia pestis
gacugugguugccccaaaugcug

SEQ ID NO: 2268364 - RNA, 15 nt, Yersinia pestis
gacuguugaaguaca

SEQ ID NO: 2268365 - RNA, 22 nt, Yersinia pestis
gacuguuuugcuaacugugcca

SEQ ID NO: 2268366 - RNA, 15 nt, Yersinia pestis
gacugguugcugguu

SEQ ID NO: 2268367 - RNA, 14 nt, Yersinia pestis
gacugguugcuggu

SEQ ID NO: 2268368 - RNA, 19 nt, Yersinia pestis
gacuguaaauauucugacg

SEQ ID NO: 2268369 - RNA, 23 nt, Yersinia pestis
gacuggcgauauggcacaggcaa

SEQ ID NO: 2268370 - RNA, 17 nt, Yersinia pestis
gacuucuuauuaaucaa

SEQ ID NO: 2268371 - RNA, 17 nt, Yersinia pestis
gacuuguggaacaacag

SEQ ID NO: 2268372 - RNA, 13 nt, Yersinia pestis
gacuuuccccaga

SEQ ID NO: 2268373 - RNA, 15 nt, Yersinia pestis
gacuuuaauuaaaaa

SEQ ID NO: 2268374 - RNA, 20 nt, Yersinia pestis
gacuuuaauuaaaaauagau

SEQ ID NO: 2268375 - RNA, 21 nt, Yersinia pestis
gagaaaaaguauugcacugag

SEQ ID NO: 2268376 - RNA, 15 nt, Yersinia pestis
gacuuuccacaacag

SEQ ID NO: 2268377 - RNA, 15 nt, Yersinia pestis
gacuuugauauuucu

SEQ ID NO: 2268378 - RNA, 16 nt, Yersinia pestis
gagaaacccauagcaa

SEQ ID NO: 2268379 - RNA, 23 nt, Yersinia pestis
gagaaaauuucucuuuuauucuc

SEQ ID NO: 2268380 - RNA, 15 nt, Yersinia pestis
gagaaacaaaaccaa

SEQ ID NO: 2268381 - RNA, 13 nt, Yersinia pestis
gagaacaggcaga

SEQ ID NO: 2268382 - RNA, 16 nt, Yersinia pestis
gagacuccucuucuuc

SEQ ID NO: 2268383 - RNA, 15 nt, Yersinia pestis
gagagaaccauuauu

SEQ ID NO: 2268384 - RNA, 17 nt, Yersinia pestis
gagacuucgguauggcg

SEQ ID NO: 2268385 - RNA, 15 nt, Yersinia pestis
gagacccgauuucac

SEQ ID NO: 2268386 - RNA, 13 nt, Yersinia pestis
gagagcaauagaa

SEQ ID NO: 2268387 - RNA, 15 nt, Yersinia pestis
gagacaagagcaaug

SEQ ID NO: 2268388 - RNA, 20 nt, Yersinia pestis
gagaccagguauuucuccau

SEQ ID NO: 2268389 - RNA, 20 nt, Yersinia pestis
gagaaucucuccagugcaaa

SEQ ID NO: 2268390 - RNA, 23 nt, Yersinia pestis
gagaaugguacuugacgcugcag

SEQ ID NO: 2268391 - RNA, 15 nt, Yersinia pestis
gagaauaaaaccuaa

SEQ ID NO: 2268392 - RNA, 15 nt, Yersinia pestis
gagaauaaaaaugau

SEQ ID NO: 2268393 - RNA, 22 nt, Yersinia pestis
gagaaccggggcgauacaccaa

SEQ ID NO: 2268394 - RNA, 19 nt, Yersinia pestis
gacucugcuaccaggaagc

SEQ ID NO: 2268395 - RNA, 21 nt, Yersinia pestis
gacugaacgggguuagcagac

SEQ ID NO: 2268396 - RNA, 18 nt, Yersinia pestis
gacugaaaguagaaauaa

SEQ ID NO: 2268397 - RNA, 17 nt, Yersinia pestis
gacugaaauaaugguuu

SEQ ID NO: 2268398 - RNA, 15 nt, Yersinia pestis
gacugagauuauuau

SEQ ID NO: 2268399 - RNA, 17 nt, Yersinia pestis
gacugauguaagcucau

SEQ ID NO: 2268400 - RNA, 19 nt, Yersinia pestis
gacugcuaauaccaccacc

SEQ ID NO: 2268401 - RNA, 15 nt, Yersinia pestis
gacugcuuuucacau

SEQ ID NO: 2268402 - RNA, 15 nt, Yersinia pestis
gacuggacaaauaaa

SEQ ID NO: 2268403 - RNA, 22 nt, Yersinia pestis
gacuggacaaauaaaacagaac

SEQ ID NO: 2268404 - RNA, 22 nt, Yersinia pestis
gacuggcauuuuuauuuuaucu

SEQ ID NO: 2268405 - RNA, 14 nt, Yersinia pestis
gacuggcaggaaau

SEQ ID NO: 2268406 - RNA, 14 nt, Yersinia pestis
gacucaagccucua

SEQ ID NO: 2268407 - RNA, 23 nt, Yersinia pestis
gacuauucugccuauccucaccg

SEQ ID NO: 2268408 - RNA, 21 nt, Yersinia pestis
gacuaauugugcagcaucacc

SEQ ID NO: 2268409 - RNA, 14 nt, Yersinia pestis
gacuaauuaaacaa

SEQ ID NO: 2268410 - RNA, 16 nt, Yersinia pestis
gacuaccaaaauuuaa

SEQ ID NO: 2268411 - RNA, 15 nt, Yersinia pestis
gacucaguaaauaua

SEQ ID NO: 2268412 - RNA, 15 nt, Yersinia pestis
gacucaucaaaacaa

SEQ ID NO: 2268413 - RNA, 16 nt, Yersinia pestis
gacucacgucaguaau

SEQ ID NO: 2268414 - RNA, 15 nt, Yersinia pestis
gacuccugccccccc

SEQ ID NO: 2268415 - RNA, 16 nt, Yersinia pestis
gacgguacugaaaucc

SEQ ID NO: 2268416 - RNA, 19 nt, Yersinia pestis
gacguaauuuuaagccgca

SEQ ID NO: 2268417 - RNA, 14 nt, Yersinia pestis
gacguaaauggcua

SEQ ID NO: 2268418 - RNA, 20 nt, Yersinia pestis
gacguaaaaaggcagugaca

SEQ ID NO: 2268419 - RNA, 21 nt, Yersinia pestis
gacguaaaaaggcagugacag

SEQ ID NO: 2268420 - RNA, 17 nt, Yersinia pestis
gacggcgggguuuucag

SEQ ID NO: 2268421 - RNA, 19 nt, Yersinia pestis
gacggcgguauacagaagc

SEQ ID NO: 2268422 - RNA, 12 nt, Yersinia pestis
gacggcggcgga

SEQ ID NO: 2268423 - RNA, 10 nt, Yersinia pestis
gacuaacucu

SEQ ID NO: 2268424 - RNA, 17 nt, Yersinia pestis
gacuaaggcaaccugag

SEQ ID NO: 2268425 - RNA, 14 nt, Yersinia pestis
gacuaaccucugca

SEQ ID NO: 2268426 - RNA, 17 nt, Yersinia pestis
gacuaaacugaucauca

SEQ ID NO: 2268427 - RNA, 17 nt, Yersinia pestis
gacuaaaucgcuuaucu

SEQ ID NO: 2268428 - RNA, 20 nt, Yersinia pestis
gacuaacagaauauugacac

SEQ ID NO: 2268429 - RNA, 18 nt, Yersinia pestis
gacuaaaaaccgccacag

SEQ ID NO: 2268430 - RNA, 16 nt, Yersinia pestis
gacuaaaauucaaaca

SEQ ID NO: 2268431 - RNA, 21 nt, Yersinia pestis
gacgugugcuguaagaaaaag

SEQ ID NO: 2268432 - RNA, 16 nt, Yersinia pestis
gacguuauuauugauu

SEQ ID NO: 2268433 - RNA, 16 nt, Yersinia pestis
gacguuuaucugauga

SEQ ID NO: 2268434 - RNA, 23 nt, Yersinia pestis
gacguuuaucugaugaaaaaguc

SEQ ID NO: 2268435 - RNA, 13 nt, Yersinia pestis
gacgucauagaau

SEQ ID NO: 2268436 - RNA, 18 nt, Yersinia pestis
gacgugagcguucaaaau

SEQ ID NO: 2268437 - RNA, 17 nt, Yersinia pestis
gacgugaggguucaagu

SEQ ID NO: 2268438 - RNA, 21 nt, Yersinia pestis
gacgugaggguucaagucccu

SEQ ID NO: 2268439 - RNA, 17 nt, Yersinia pestis
gacgugaugccaguaau

SEQ ID NO: 2268440 - RNA, 21 nt, Yersinia pestis
gagcgacuuaauggucuucuu

SEQ ID NO: 2268441 - RNA, 20 nt, Yersinia pestis
gagcgauaacauuuuuucuu

SEQ ID NO: 2268442 - RNA, 22 nt, Yersinia pestis
gagccuuauaggcgcauaugaa

SEQ ID NO: 2268443 - RNA, 18 nt, Yersinia pestis
gagccuacuacauggaug

SEQ ID NO: 2268444 - RNA, 21 nt, Yersinia pestis
gagccucaugaaugaggcuga

SEQ ID NO: 2268445 - RNA, 17 nt, Yersinia pestis
gagcgcuauucugacgc

SEQ ID NO: 2268446 - RNA, 13 nt, Yersinia pestis
gagcgcagacguu

SEQ ID NO: 2268447 - RNA, 15 nt, Yersinia pestis
gagcugacgucagau

SEQ ID NO: 2268448 - RNA, 17 nt, Yersinia pestis
gagcugaucugccagua

SEQ ID NO: 2268449 - RNA, 16 nt, Yersinia pestis
gagcugcgauaaucug

SEQ ID NO: 2268450 - RNA, 14 nt, Yersinia pestis
gagcuaaugcuauc

SEQ ID NO: 2268451 - RNA, 17 nt, Yersinia pestis
gagcuauggaagaacug

SEQ ID NO: 2268452 - RNA, 19 nt, Yersinia pestis
gagcucgcuagucaucacu

SEQ ID NO: 2268453 - RNA, 18 nt, Yersinia pestis
gagcgguuuauauuuuug

SEQ ID NO: 2268454 - RNA, 14 nt, Yersinia pestis
gagcguagacuaaa

SEQ ID NO: 2268455 - RNA, 14 nt, Yersinia pestis
gagcgucaagccaa

SEQ ID NO: 2268456 - RNA, 20 nt, Yersinia pestis
gagcgucaagccaaccccca

SEQ ID NO: 2268457 - RNA, 23 nt, Yersinia pestis
gagcuaacgcgucaaucggguua

SEQ ID NO: 2268458 - RNA, 17 nt, Yersinia pestis
gagcggaugauucgcca

SEQ ID NO: 2268459 - RNA, 13 nt, Yersinia pestis
gagcggcaacugu

SEQ ID NO: 2268460 - RNA, 15 nt, Yersinia pestis
gagcggggcaaaaau

SEQ ID NO: 2268461 - RNA, 14 nt, Yersinia pestis
gaggauagggugcc

SEQ ID NO: 2268462 - RNA, 19 nt, Yersinia pestis
gaggauagggugccccaug

SEQ ID NO: 2268463 - RNA, 22 nt, Yersinia pestis
gaggauauuuauuaaaacacau

SEQ ID NO: 2268464 - RNA, 12 nt, Yersinia pestis
gaggaucaccac

SEQ ID NO: 2268465 - RNA, 19 nt, Yersinia pestis
gaggauauuagggcugaca

SEQ ID NO: 2268466 - RNA, 14 nt, Yersinia pestis
gaggcacccgagca

SEQ ID NO: 2268467 - RNA, 14 nt, Yersinia pestis
gaggauucaagaac

SEQ ID NO: 2268468 - RNA, 18 nt, Yersinia pestis
gaggauuuuccgcagcuc

SEQ ID NO: 2268469 - RNA, 14 nt, Yersinia pestis
gaggcgaucugcuu

SEQ ID NO: 2268470 - RNA, 17 nt, Yersinia pestis
gagcuucuucaaaagca

SEQ ID NO: 2268471 - RNA, 11 nt, Yersinia pestis
gagcuugcugc

SEQ ID NO: 2268472 - RNA, 15 nt, Yersinia pestis
gagcuguauguuuuc

SEQ ID NO: 2268473 - RNA, 22 nt, Yersinia pestis
gagcuguagaacuuguucauau

SEQ ID NO: 2268474 - RNA, 14 nt, Yersinia pestis
gaggacggcggccu

SEQ ID NO: 2268475 - RNA, 19 nt, Yersinia pestis
gaggacuuccugcccagcg

SEQ ID NO: 2268476 - RNA, 21 nt, Yersinia pestis
gaggaauagccagcguggugu

SEQ ID NO: 2268477 - RNA, 21 nt, Yersinia pestis
gaggaaggcgguuaucuggaa

SEQ ID NO: 2268478 - RNA, 18 nt, Yersinia pestis
gagccggcugagaagagg

SEQ ID NO: 2268479 - RNA, 17 nt, Yersinia pestis
gagccauccaggcaagc

SEQ ID NO: 2268480 - RNA, 16 nt, Yersinia pestis
gagccauccaggcaag

SEQ ID NO: 2268481 - RNA, 15 nt, Yersinia pestis
gagccauccaggcaa

SEQ ID NO: 2268482 - RNA, 19 nt, Yersinia pestis
gagccauugauuggcuccu

SEQ ID NO: 2268483 - RNA, 16 nt, Yersinia pestis
gagcagugcgcggcgc

SEQ ID NO: 2268484 - RNA, 20 nt, Yersinia pestis
gagcagccaacacaccugca

SEQ ID NO: 2268485 - RNA, 22 nt, Yersinia pestis
gagcauaccgguuugggcauca

SEQ ID NO: 2268486 - RNA, 21 nt, Yersinia pestis
gagcauaacugguggcaggcc

SEQ ID NO: 2268487 - RNA, 22 nt, Yersinia pestis
gagcauaacugguggcaggccc

SEQ ID NO: 2268488 - RNA, 21 nt, Yersinia pestis
gagccaaacgugcuacuuaau

SEQ ID NO: 2268489 - RNA, 12 nt, Yersinia pestis
gagcacugcccc

SEQ ID NO: 2268490 - RNA, 22 nt, Yersinia pestis
gagcagaaagcagcagcuuuug

SEQ ID NO: 2268491 - RNA, 13 nt, Yersinia pestis
gagcaccgcagga

SEQ ID NO: 2268492 - RNA, 15 nt, Yersinia pestis
gagcaccgcaggaac

SEQ ID NO: 2268493 - RNA, 11 nt, Yersinia pestis
gagcaccagaa

SEQ ID NO: 2268494 - RNA, 17 nt, Yersinia pestis
gagauuucagacugcug

SEQ ID NO: 2268495 - RNA, 16 nt, Yersinia pestis
gagcaacucacugaau

SEQ ID NO: 2268496 - RNA, 18 nt, Yersinia pestis
gagcaaaacugggcuuga

SEQ ID NO: 2268497 - RNA, 14 nt, Yersinia pestis
gagcaauaacgugu

SEQ ID NO: 2268498 - RNA, 17 nt, Yersinia pestis
gagcaagggcagcuaac

SEQ ID NO: 2268499 - RNA, 15 nt, Yersinia pestis
gagaugcaaucuaac

SEQ ID NO: 2268500 - RNA, 13 nt, Yersinia pestis
gagaugcaguaag

SEQ ID NO: 2268501 - RNA, 18 nt, Yersinia pestis
gagaugcaguaaguauau

SEQ ID NO: 2268502 - RNA, 16 nt, Yersinia pestis
gagauguauccaaggc

SEQ ID NO: 2268503 - RNA, 14 nt, Yersinia pestis
gagauucaggagau

SEQ ID NO: 2268504 - RNA, 12 nt, Yersinia pestis
gagauucugggg

SEQ ID NO: 2268505 - RNA, 16 nt, Yersinia pestis
gagagugauuccagcu

SEQ ID NO: 2268506 - RNA, 19 nt, Yersinia pestis
gagauaacgcugauguagg

SEQ ID NO: 2268507 - RNA, 16 nt, Yersinia pestis
gagauauaaacuaaua

SEQ ID NO: 2268508 - RNA, 20 nt, Yersinia pestis
gagauauuugucgcauuuau

SEQ ID NO: 2268509 - RNA, 16 nt, Yersinia pestis
gagaucagugccagua

SEQ ID NO: 2268510 - RNA, 12 nt, Yersinia pestis
gagaucaguuca

SEQ ID NO: 2268511 - RNA, 17 nt, Yersinia pestis
gagauccuccauauccu

SEQ ID NO: 2268512 - RNA, 19 nt, Yersinia pestis
gauuucaucggcaaaaaca

SEQ ID NO: 2268513 - RNA, 15 nt, Yersinia pestis
gauuuguugaugaau

SEQ ID NO: 2268514 - RNA, 19 nt, Yersinia pestis
gauuugcgggcuaaaacug

SEQ ID NO: 2268515 - RNA, 17 nt, Yersinia pestis
gcaaaacacucagauca

SEQ ID NO: 2268516 - RNA, 21 nt, Yersinia pestis
gcaaaacagauauuugcugcc

SEQ ID NO: 2268517 - RNA, 17 nt, Yersinia pestis
gcaaaaaaagacacuaa

SEQ ID NO: 2268518 - RNA, 13 nt, Yersinia pestis
gauuuuuuguucu

SEQ ID NO: 2268519 - RNA, 14 nt, Yersinia pestis
gauugguuauccua

SEQ ID NO: 2268520 - RNA, 18 nt, Yersinia pestis
gauuucaucauucaauac

SEQ ID NO: 2268521 - RNA, 15 nt, Yersinia pestis
gauugcaaauccguc

SEQ ID NO: 2268522 - RNA, 22 nt, Yersinia pestis
gauugcaucaucaguauugacg

SEQ ID NO: 2268523 - RNA, 14 nt, Yersinia pestis
gauucuagcaucgc

SEQ ID NO: 2268524 - RNA, 15 nt, Yersinia pestis
gauucuagcaucgcc

SEQ ID NO: 2268525 - RNA, 23 nt, Yersinia pestis
gauucggcuucgguuugagcuug

SEQ ID NO: 2268526 - RNA, 16 nt, Yersinia pestis
gauucgcgaccagcag

SEQ ID NO: 2268527 - RNA, 21 nt, Yersinia pestis
gauucgcggcagagaucaugu

SEQ ID NO: 2268528 - RNA, 14 nt, Yersinia pestis
gauucgucugccau

SEQ ID NO: 2268529 - RNA, 16 nt, Yersinia pestis
gauucgggugagugag

SEQ ID NO: 2268530 - RNA, 14 nt, Yersinia pestis
gauucguagaaaca

SEQ ID NO: 2268531 - RNA, 22 nt, Yersinia pestis
gauuccuguugaccaauccggu

SEQ ID NO: 2268532 - RNA, 15 nt, Yersinia pestis
gauucaagaaccgca

SEQ ID NO: 2268533 - RNA, 15 nt, Yersinia pestis
gauuagguuuuauuc

SEQ ID NO: 2268534 - RNA, 16 nt, Yersinia pestis
gauuagcgagguuuug

SEQ ID NO: 2268535 - RNA, 20 nt, Yersinia pestis
gauuagucuuagacgucaga

SEQ ID NO: 2268536 - RNA, 20 nt, Yersinia pestis
gauuaguuuuagacgucaga

SEQ ID NO: 2268537 - RNA, 15 nt, Yersinia pestis
gauucaccuugauua

SEQ ID NO: 2268538 - RNA, 16 nt, Yersinia pestis
gauucacgaauagcgg

SEQ ID NO: 2268539 - RNA, 13 nt, Yersinia pestis
gauuaccaauaau

SEQ ID NO: 2268540 - RNA, 18 nt, Yersinia pestis
gauuaauuauugggggga

SEQ ID NO: 2268541 - RNA, 13 nt, Yersinia pestis
gauguuccuggcc

SEQ ID NO: 2268542 - RNA, 15 nt, Yersinia pestis
gauguucgcuccccc

SEQ ID NO: 2268543 - RNA, 15 nt, Yersinia pestis
gauguuuaacccaau

SEQ ID NO: 2268544 - RNA, 20 nt, Yersinia pestis
gauguuacgcuaucgcuaaa

SEQ ID NO: 2268545 - RNA, 15 nt, Yersinia pestis
gaugugaaacauaau

SEQ ID NO: 2268546 - RNA, 17 nt, Yersinia pestis
gaugugauccacacagu

SEQ ID NO: 2268547 - RNA, 20 nt, Yersinia pestis
gaugugcucugcuccgccuu

SEQ ID NO: 2268548 - RNA, 22 nt, Yersinia pestis
gauguggauaauuucagcagca

SEQ ID NO: 2268549 - RNA, 21 nt, Yersinia pestis
gauggcuaauuaauuuaaaca

SEQ ID NO: 2268550 - RNA, 16 nt, Yersinia pestis
gaugauaaguuugaug

SEQ ID NO: 2268551 - RNA, 13 nt, Yersinia pestis
gaugauaaauaca

SEQ ID NO: 2268552 - RNA, 19 nt, Yersinia pestis
gaugaccauuuauuuccac

SEQ ID NO: 2268553 - RNA, 18 nt, Yersinia pestis
gaugaagcauuaaacaga

SEQ ID NO: 2268554 - RNA, 19 nt, Yersinia pestis
gaugaagcauuaaacagau

SEQ ID NO: 2268555 - RNA, 17 nt, Yersinia pestis
gaugauuugucaauggg

SEQ ID NO: 2268556 - RNA, 18 nt, Yersinia pestis
gaugauaaugccgcccau

SEQ ID NO: 2268557 - RNA, 14 nt, Yersinia pestis
gaugauauacccac

SEQ ID NO: 2268558 - RNA, 18 nt, Yersinia pestis
gaugcacaguaggcugaa

SEQ ID NO: 2268559 - RNA, 21 nt, Yersinia pestis
gaugcacaguaggcugaaggc

SEQ ID NO: 2268560 - RNA, 13 nt, Yersinia pestis
gaugccauuuacc

SEQ ID NO: 2268561 - RNA, 13 nt, Yersinia pestis
gaugccgcuuuag

SEQ ID NO: 2268562 - RNA, 14 nt, Yersinia pestis
gaugcgcuccgcca

SEQ ID NO: 2268563 - RNA, 18 nt, Yersinia pestis
gaugcgcgcgucacuaaa

SEQ ID NO: 2268564 - RNA, 14 nt, Yersinia pestis
gaugccuaauaauu

SEQ ID NO: 2268565 - RNA, 13 nt, Yersinia pestis
gaugccuauuugc

SEQ ID NO: 2268566 - RNA, 18 nt, Yersinia pestis
gaugccuauuugcagaaa

SEQ ID NO: 2268567 - RNA, 17 nt, Yersinia pestis
gaugcgccuguuagggc

SEQ ID NO: 2268568 - RNA, 21 nt, Yersinia pestis
gaugcugacagaacgcaauca

SEQ ID NO: 2268569 - RNA, 16 nt, Yersinia pestis
gaugcuagugauaaac

SEQ ID NO: 2268570 - RNA, 14 nt, Yersinia pestis
gauggcccaagcca

SEQ ID NO: 2268571 - RNA, 21 nt, Yersinia pestis
gauggccuugaaucaaaauac

SEQ ID NO: 2268572 - RNA, 14 nt, Yersinia pestis
gaucucauuuagca

SEQ ID NO: 2268573 - RNA, 19 nt, Yersinia pestis
gaucuaacguccccugagc

SEQ ID NO: 2268574 - RNA, 22 nt, Yersinia pestis
gaucugauaucucuuuaucauu

SEQ ID NO: 2268575 - RNA, 12 nt, Yersinia pestis
gaucugccuuau

SEQ ID NO: 2268576 - RNA, 18 nt, Yersinia pestis
gaucugccuguucucucc

SEQ ID NO: 2268577 - RNA, 17 nt, Yersinia pestis
gaucucuuuauauucaa

SEQ ID NO: 2268578 - RNA, 20 nt, Yersinia pestis
gaucugacauuugcaucuau

SEQ ID NO: 2268579 - RNA, 19 nt, Yersinia pestis
gaucugaaacggugaggau

SEQ ID NO: 2268580 - RNA, 15 nt, Yersinia pestis
gaucucuccagccug

SEQ ID NO: 2268581 - RNA, 14 nt, Yersinia pestis
gaugaacacagaaa

SEQ ID NO: 2268582 - RNA, 16 nt, Yersinia pestis
gaugaaacacaacaac

SEQ ID NO: 2268583 - RNA, 13 nt, Yersinia pestis
gaugaaaaacugu

SEQ ID NO: 2268584 - RNA, 22 nt, Yersinia pestis
gaucuuuggccccgcgcuaacc

SEQ ID NO: 2268585 - RNA, 21 nt, Yersinia pestis
gaucuguuguugugacaggcu

SEQ ID NO: 2268586 - RNA, 21 nt, Yersinia pestis
gaucuggcuuucucaacagca

SEQ ID NO: 2268587 - RNA, 13 nt, Yersinia pestis
gaucuggcaaaau

SEQ ID NO: 2268588 - RNA, 16 nt, Yersinia pestis
gaucuucauugccuuc

SEQ ID NO: 2268589 - RNA, 19 nt, Yersinia pestis
gaucuugaacggugaggau

SEQ ID NO: 2268590 - RNA, 14 nt, Yersinia pestis
gauauagagcucag

SEQ ID NO: 2268591 - RNA, 19 nt, Yersinia pestis
gauauagaagguuucaccc

SEQ ID NO: 2268592 - RNA, 17 nt, Yersinia pestis
gauauacccaccagaga

SEQ ID NO: 2268593 - RNA, 12 nt, Yersinia pestis
gauauaaauaaa

SEQ ID NO: 2268594 - RNA, 15 nt, Yersinia pestis
gauauaaauaaaaua

SEQ ID NO: 2268595 - RNA, 18 nt, Yersinia pestis
gauagugucacucugguu

SEQ ID NO: 2268596 - RNA, 22 nt, Yersinia pestis
gauaguggucauuuuguuuucu

SEQ ID NO: 2268597 - RNA, 16 nt, Yersinia pestis
gauagugaguauguau

SEQ ID NO: 2268598 - RNA, 21 nt, Yersinia pestis
gauagucauuuuauuuaggcu

SEQ ID NO: 2268599 - RNA, 13 nt, Yersinia pestis
gauaguuaucugg

SEQ ID NO: 2268600 - RNA, 17 nt, Yersinia pestis
gauaguuaaauuauccc

SEQ ID NO: 2268601 - RNA, 14 nt, Yersinia pestis
gauagguuuuuccc

SEQ ID NO: 2268602 - RNA, 18 nt, Yersinia pestis
gauaggccaccucuuccu

SEQ ID NO: 2268603 - RNA, 15 nt, Yersinia pestis
gauaggcgaaauuga

SEQ ID NO: 2268604 - RNA, 11 nt, Yersinia pestis
gauagcugcuu

SEQ ID NO: 2268605 - RNA, 18 nt, Yersinia pestis
gauagccuauuucaccgc

SEQ ID NO: 2268606 - RNA, 18 nt, Yersinia pestis
gauacuacaaucaucggc

SEQ ID NO: 2268607 - RNA, 23 nt, Yersinia pestis
gauagccaaccccucugguguga

SEQ ID NO: 2268608 - RNA, 19 nt, Yersinia pestis
gauagagauaaaaaaaccg

SEQ ID NO: 2268609 - RNA, 17 nt, Yersinia pestis
gauagaccguagaaacc

SEQ ID NO: 2268610 - RNA, 17 nt, Yersinia pestis
gauaagugaauaaauca

SEQ ID NO: 2268611 - RNA, 19 nt, Yersinia pestis
gauaaguuuuaauaucugc

SEQ ID NO: 2268612 - RNA, 14 nt, Yersinia pestis
gauaccuaaaccuu

SEQ ID NO: 2268613 - RNA, 18 nt, Yersinia pestis
gauaaggugcgggaugca

SEQ ID NO: 2268614 - RNA, 22 nt, Yersinia pestis
gaucaaaacaaauuauuagaau

SEQ ID NO: 2268615 - RNA, 15 nt, Yersinia pestis
gaucaaaagcagaga

SEQ ID NO: 2268616 - RNA, 23 nt, Yersinia pestis
gauauuugggucgguaaccugaa

SEQ ID NO: 2268617 - RNA, 18 nt, Yersinia pestis
gauauuucacguucauca

SEQ ID NO: 2268618 - RNA, 18 nt, Yersinia pestis
gauauucucaccugcuua

SEQ ID NO: 2268619 - RNA, 23 nt, Yersinia pestis
gauauuccggugaucuugaccga

SEQ ID NO: 2268620 - RNA, 18 nt, Yersinia pestis
gauauauagaaauaagga

SEQ ID NO: 2268621 - RNA, 15 nt, Yersinia pestis
gauauagcgcaccac

SEQ ID NO: 2268622 - RNA, 17 nt, Yersinia pestis
gauauagcgcaccaccg

SEQ ID NO: 2268623 - RNA, 20 nt, Yersinia pestis
gauauucacguuuuuccauu

SEQ ID NO: 2268624 - RNA, 14 nt, Yersinia pestis
gauauucagugcaa

SEQ ID NO: 2268625 - RNA, 10 nt, Yersinia pestis
gauauucaua

SEQ ID NO: 2268626 - RNA, 17 nt, Yersinia pestis
gauauuauuagccaaau

SEQ ID NO: 2268627 - RNA, 15 nt, Yersinia pestis
gauauuauucucuac

SEQ ID NO: 2268628 - RNA, 20 nt, Yersinia pestis
gauauuauuuauuuuauaau

SEQ ID NO: 2268629 - RNA, 18 nt, Yersinia pestis
gaucaauguuaucgccaa

SEQ ID NO: 2268630 - RNA, 19 nt, Yersinia pestis
gaucacagcucucugagcc

SEQ ID NO: 2268631 - RNA, 22 nt, Yersinia pestis
gaucacaucacagugccaaaag

SEQ ID NO: 2268632 - RNA, 23 nt, Yersinia pestis
gaucaccaaucggaucgagcugu

SEQ ID NO: 2268633 - RNA, 22 nt, Yersinia pestis
gaucaaguugcugagauaucaa

SEQ ID NO: 2268634 - RNA, 15 nt, Yersinia pestis
gaucaaucucaucaa

SEQ ID NO: 2268635 - RNA, 21 nt, Yersinia pestis
gaucaauaucccgagaaacaa

SEQ ID NO: 2268636 - RNA, 19 nt, Yersinia pestis
gaucaaaggcgaccaaugg

SEQ ID NO: 2268637 - RNA, 22 nt, Yersinia pestis
gaucaccacgucaccuuucuug

SEQ ID NO: 2268638 - RNA, 19 nt, Yersinia pestis
gaucaccaccgcauuuuca

SEQ ID NO: 2268639 - RNA, 19 nt, Yersinia pestis
gaucaccaggcucucauau

SEQ ID NO: 2268640 - RNA, 16 nt, Yersinia pestis
gaucacuggcauugca

SEQ ID NO: 2268641 - RNA, 13 nt, Yersinia pestis
gaucaguggggua

SEQ ID NO: 2268642 - RNA, 22 nt, Yersinia pestis
gaucaguggcuuaauugaagca

SEQ ID NO: 2268643 - RNA, 17 nt, Yersinia pestis
gaucaucaacgcgccuu

SEQ ID NO: 2268644 - RNA, 16 nt, Yersinia pestis
gaucaguuugccuugu

SEQ ID NO: 2268645 - RNA, 16 nt, Yersinia pestis
gaucccaagcaggaaa

SEQ ID NO: 2268646 - RNA, 14 nt, Yersinia pestis
gauccagugaaauc

SEQ ID NO: 2268647 - RNA, 15 nt, Yersinia pestis
gauccagugaaauca

SEQ ID NO: 2268648 - RNA, 13 nt, Yersinia pestis
gaucaucugguga

SEQ ID NO: 2268649 - RNA, 16 nt, Yersinia pestis
gaucaucaggcaggua

SEQ ID NO: 2268650 - RNA, 19 nt, Yersinia pestis
gaucaucgauacaaaccgu

SEQ ID NO: 2268651 - RNA, 17 nt, Yersinia pestis
gaucaucgcaccauaac

SEQ ID NO: 2268652 - RNA, 21 nt, Yersinia pestis
gaucauccgcucagcaaaaau

SEQ ID NO: 2268653 - RNA, 20 nt, Yersinia pestis
gaguaacacuucagacugaa

SEQ ID NO: 2268654 - RNA, 14 nt, Yersinia pestis
gaguaaugaaaucu

SEQ ID NO: 2268655 - RNA, 22 nt, Yersinia pestis
gaguaauuucagauaaaaauaa

SEQ ID NO: 2268656 - RNA, 15 nt, Yersinia pestis
gaguacgaacagaga

SEQ ID NO: 2268657 - RNA, 14 nt, Yersinia pestis
gagguuaucagccu

SEQ ID NO: 2268658 - RNA, 21 nt, Yersinia pestis
gagguuauugacaaagagccc

SEQ ID NO: 2268659 - RNA, 15 nt, Yersinia pestis
gaguaaagcguccgc

SEQ ID NO: 2268660 - RNA, 20 nt, Yersinia pestis
gaguaaauagcaaaacugag

SEQ ID NO: 2268661 - RNA, 15 nt, Yersinia pestis
gaguaaauuaaauuu

SEQ ID NO: 2268662 - RNA, 20 nt, Yersinia pestis
gaguaaauucgggcuuuaau

SEQ ID NO: 2268663 - RNA, 23 nt, Yersinia pestis
gagguuuugggcuaaaagggagu

SEQ ID NO: 2268664 - RNA, 21 nt, Yersinia pestis
gaggugguaaaaucccccacg

SEQ ID NO: 2268665 - RNA, 17 nt, Yersinia pestis
gagggcucaaucucugc

SEQ ID NO: 2268666 - RNA, 22 nt, Yersinia pestis
gagggcgguuaaauacagcacc

SEQ ID NO: 2268667 - RNA, 17 nt, Yersinia pestis
gagggcgguuaaauaca

SEQ ID NO: 2268668 - RNA, 13 nt, Yersinia pestis
gagggcuucuggc

SEQ ID NO: 2268669 - RNA, 15 nt, Yersinia pestis
gagggugaugacaau

SEQ ID NO: 2268670 - RNA, 16 nt, Yersinia pestis
gagggugaugacaaug

SEQ ID NO: 2268671 - RNA, 15 nt, Yersinia pestis
gaggguugucagcag

SEQ ID NO: 2268672 - RNA, 16 nt, Yersinia pestis
gagguacggccagcaa

SEQ ID NO: 2268673 - RNA, 16 nt, Yersinia pestis
gagggagacgcgcggu

SEQ ID NO: 2268674 - RNA, 19 nt, Yersinia pestis
gagggacgcgaaucccccc

SEQ ID NO: 2268675 - RNA, 14 nt, Yersinia pestis
gaggcuuuaaucug

SEQ ID NO: 2268676 - RNA, 16 nt, Yersinia pestis
gaggcucuucugggcu

SEQ ID NO: 2268677 - RNA, 22 nt, Yersinia pestis
gaggcucauuaauccccaggug

SEQ ID NO: 2268678 - RNA, 15 nt, Yersinia pestis
gaggcucuucugggc

SEQ ID NO: 2268679 - RNA, 18 nt, Yersinia pestis
gauaacuuuuuauuucuu

SEQ ID NO: 2268680 - RNA, 21 nt, Yersinia pestis
gauaacuuccuuugcccuuac

SEQ ID NO: 2268681 - RNA, 16 nt, Yersinia pestis
gauaacuccaggguaa

SEQ ID NO: 2268682 - RNA, 15 nt, Yersinia pestis
gauaagaucucagca

SEQ ID NO: 2268683 - RNA, 20 nt, Yersinia pestis
gauaagagcgacucaauaau

SEQ ID NO: 2268684 - RNA, 12 nt, Yersinia pestis
gauaaccagcag

SEQ ID NO: 2268685 - RNA, 13 nt, Yersinia pestis
gauaaccagcagc

SEQ ID NO: 2268686 - RNA, 22 nt, Yersinia pestis
gauaacccuaucgucagugcgg

SEQ ID NO: 2268687 - RNA, 15 nt, Yersinia pestis
gauaacauacaccau

SEQ ID NO: 2268688 - RNA, 17 nt, Yersinia pestis
gauaacacgaguaauga

SEQ ID NO: 2268689 - RNA, 20 nt, Yersinia pestis
gauaaagacgucauaaauau

SEQ ID NO: 2268690 - RNA, 22 nt, Yersinia pestis
gauaaacuguuuaagcuuuuua

SEQ ID NO: 2268691 - RNA, 18 nt, Yersinia pestis
gauaaauucgauaaaagg

SEQ ID NO: 2268692 - RNA, 13 nt, Yersinia pestis
gauaaaucgccca

SEQ ID NO: 2268693 - RNA, 18 nt, Yersinia pestis
gaguuuuuugcgccacaa

SEQ ID NO: 2268694 - RNA, 20 nt, Yersinia pestis
gaguuugucgcucuggguua

SEQ ID NO: 2268695 - RNA, 20 nt, Yersinia pestis
gagugacaacauugccaaau

SEQ ID NO: 2268696 - RNA, 14 nt, Yersinia pestis
gagugagcgcgggu

SEQ ID NO: 2268697 - RNA, 13 nt, Yersinia pestis
gagugagacaauu

SEQ ID NO: 2268698 - RNA, 23 nt, Yersinia pestis
gaguguucggggguugucagcag

SEQ ID NO: 2268699 - RNA, 19 nt, Yersinia pestis
gaguguucauaaauuaaaa

SEQ ID NO: 2268700 - RNA, 22 nt, Yersinia pestis
gaguugauaaacaauaaacaga

SEQ ID NO: 2268701 - RNA, 17 nt, Yersinia pestis
gaguugaugcaauggca

SEQ ID NO: 2268702 - RNA, 23 nt, Yersinia pestis
gagugaaaucuccuguggcacau

SEQ ID NO: 2268703 - RNA, 19 nt, Yersinia pestis
gagugaaggguugaccgca

SEQ ID NO: 2268704 - RNA, 17 nt, Yersinia pestis
gagugaaucgccguuac

SEQ ID NO: 2268705 - RNA, 15 nt, Yersinia pestis
gagucgcaaaacuuc

SEQ ID NO: 2268706 - RNA, 20 nt, Yersinia pestis
gagucgauagcuuucuccuu

SEQ ID NO: 2268707 - RNA, 14 nt, Yersinia pestis
gagucgaugaaaca

SEQ ID NO: 2268708 - RNA, 15 nt, Yersinia pestis
gaguaguaaaaccua

SEQ ID NO: 2268709 - RNA, 19 nt, Yersinia pestis
gaguagcugugaacguacu

SEQ ID NO: 2268710 - RNA, 14 nt, Yersinia pestis
gaguaggaaauaca

SEQ ID NO: 2268711 - RNA, 23 nt, Yersinia pestis
gcagaucugcccccccuuucacc

SEQ ID NO: 2268712 - RNA, 21 nt, Yersinia pestis
gcagauacuggaagccgacga

SEQ ID NO: 2268713 - RNA, 14 nt, Yersinia pestis
gcagcaagaacaau

SEQ ID NO: 2268714 - RNA, 15 nt, Yersinia pestis
gcagccugcggcggc

SEQ ID NO: 2268715 - RNA, 19 nt, Yersinia pestis
gcagccuuuauccaaccac

SEQ ID NO: 2268716 - RNA, 16 nt, Yersinia pestis
gcagcgacaaccugua

SEQ ID NO: 2268717 - RNA, 10 nt, Yersinia pestis
gcagccgccg

SEQ ID NO: 2268718 - RNA, 20 nt, Yersinia pestis
gcagaaguccugauucgcga

SEQ ID NO: 2268719 - RNA, 22 nt, Yersinia pestis
gcagaaucacuggcagaaguug

SEQ ID NO: 2268720 - RNA, 12 nt, Yersinia pestis
gcagaagagguu

SEQ ID NO: 2268721 - RNA, 16 nt, Yersinia pestis
gcagaaccauggcacu

SEQ ID NO: 2268722 - RNA, 12 nt, Yersinia pestis
gcagaacccagg

SEQ ID NO: 2268723 - RNA, 18 nt, Yersinia pestis
gcagaacaaaacaagccc

SEQ ID NO: 2268724 - RNA, 22 nt, Yersinia pestis
gcagaaaucagccauaucaaaa

SEQ ID NO: 2268725 - RNA, 13 nt, Yersinia pestis
gcagaaagugacc

SEQ ID NO: 2268726 - RNA, 16 nt, Yersinia pestis
gcagaaauaauaucaa

SEQ ID NO: 2268727 - RNA, 14 nt, Yersinia pestis
gcacuucauuggcu

SEQ ID NO: 2268728 - RNA, 16 nt, Yersinia pestis
gcacuuuaaucgccag

SEQ ID NO: 2268729 - RNA, 15 nt, Yersinia pestis
gcacuuuaaauaccc

SEQ ID NO: 2268730 - RNA, 17 nt, Yersinia pestis
gcacuuuaaauacccag

SEQ ID NO: 2268731 - RNA, 22 nt, Yersinia pestis
gcacuuuuacugguucauuuuc

SEQ ID NO: 2268732 - RNA, 22 nt, Yersinia pestis
gcacuuuuauacauucgagcua

SEQ ID NO: 2268733 - RNA, 18 nt, Yersinia pestis
gcagaguccucucaccaa

SEQ ID NO: 2268734 - RNA, 19 nt, Yersinia pestis
gcagaguccucucaccaag

SEQ ID NO: 2268735 - RNA, 19 nt, Yersinia pestis
gcagagucgcaaaaaauau

SEQ ID NO: 2268736 - RNA, 23 nt, Yersinia pestis
gcagagccaauccccagaagcgc

SEQ ID NO: 2268737 - RNA, 21 nt, Yersinia pestis
gcagacucuuauauaaaucca

SEQ ID NO: 2268738 - RNA, 19 nt, Yersinia pestis
gcagacugcugacaaaccc

SEQ ID NO: 2268739 - RNA, 16 nt, Yersinia pestis
gcagacucuuauauaa

SEQ ID NO: 2268740 - RNA, 21 nt, Yersinia pestis
gcagagaucauguaguacuua

SEQ ID NO: 2268741 - RNA, 14 nt, Yersinia pestis
gcagagaggagaau

SEQ ID NO: 2268742 - RNA, 15 nt, Yersinia pestis
gcagagcaaaacugg

SEQ ID NO: 2268743 - RNA, 13 nt, Yersinia pestis
gcagacagcgagc

SEQ ID NO: 2268744 - RNA, 16 nt, Yersinia pestis
gcagcucaaaaucuuc

SEQ ID NO: 2268745 - RNA, 15 nt, Yersinia pestis
gcagcgagcacugcc

SEQ ID NO: 2268746 - RNA, 14 nt, Yersinia pestis
gcaggaagcaauga

SEQ ID NO: 2268747 - RNA, 16 nt, Yersinia pestis
gcaggaagcaaugaaa

SEQ ID NO: 2268748 - RNA, 22 nt, Yersinia pestis
gcaggaaguuauggaugaccaa

SEQ ID NO: 2268749 - RNA, 22 nt, Yersinia pestis
gcaggaaauugccgcaucagcc

SEQ ID NO: 2268750 - RNA, 22 nt, Yersinia pestis
gcaggaacgaaguuagacccaa

SEQ ID NO: 2268751 - RNA, 19 nt, Yersinia pestis
gcagggccgguuaauugaa

SEQ ID NO: 2268752 - RNA, 15 nt, Yersinia pestis
gcaggcuucaacuac

SEQ ID NO: 2268753 - RNA, 18 nt, Yersinia pestis
gcagggccgauaaaaaac

SEQ ID NO: 2268754 - RNA, 21 nt, Yersinia pestis
gcagggccgcccagauaaaga

SEQ ID NO: 2268755 - RNA, 14 nt, Yersinia pestis
gcaggcggccaaug

SEQ ID NO: 2268756 - RNA, 17 nt, Yersinia pestis
gcaggaguugguggcac

SEQ ID NO: 2268757 - RNA, 20 nt, Yersinia pestis
gcaggaucuggauuuuccag

SEQ ID NO: 2268758 - RNA, 21 nt, Yersinia pestis
gcaggggaggcgguccuccug

SEQ ID NO: 2268759 - RNA, 20 nt, Yersinia pestis
gcaggguggagagaaaggcu

SEQ ID NO: 2268760 - RNA, 20 nt, Yersinia pestis
gcagguucggcgcaaucaua

SEQ ID NO: 2268761 - RNA, 16 nt, Yersinia pestis
gcaguaacguccaacu

SEQ ID NO: 2268762 - RNA, 15 nt, Yersinia pestis
gcaguaacgccauaa

SEQ ID NO: 2268763 - RNA, 22 nt, Yersinia pestis
gcaggugguuaaacugacauua

SEQ ID NO: 2268764 - RNA, 15 nt, Yersinia pestis
gcagguguaaauuuc

SEQ ID NO: 2268765 - RNA, 20 nt, Yersinia pestis
gcauaaauauucauuaaaaa

SEQ ID NO: 2268766 - RNA, 17 nt, Yersinia pestis
gcauaaccaaucaucac

SEQ ID NO: 2268767 - RNA, 18 nt, Yersinia pestis
gcauaaacugaaguuaaa

SEQ ID NO: 2268768 - RNA, 20 nt, Yersinia pestis
gcauaaacugaaguuaaaaa

SEQ ID NO: 2268769 - RNA, 18 nt, Yersinia pestis
gcauaaagcuauucaucu

SEQ ID NO: 2268770 - RNA, 17 nt, Yersinia pestis
gcauaaagguuugccag

SEQ ID NO: 2268771 - RNA, 19 nt, Yersinia pestis
gcaguguaaaaccugacug

SEQ ID NO: 2268772 - RNA, 17 nt, Yersinia pestis
gcagugaucaaugacuu

SEQ ID NO: 2268773 - RNA, 21 nt, Yersinia pestis
gcagugaucaguccuuagcau

SEQ ID NO: 2268774 - RNA, 16 nt, Yersinia pestis
gcagugacgcagugac

SEQ ID NO: 2268775 - RNA, 17 nt, Yersinia pestis
gcagugacgcagugacg

SEQ ID NO: 2268776 - RNA, 16 nt, Yersinia pestis
gcagugacgcagugau

SEQ ID NO: 2268777 - RNA, 17 nt, Yersinia pestis
gcagugacgcagugauu

SEQ ID NO: 2268778 - RNA, 20 nt, Yersinia pestis
gcagucugagggccacuucg

SEQ ID NO: 2268779 - RNA, 23 nt, Yersinia pestis
gcagucugaggggcguuuaaugc

SEQ ID NO: 2268780 - RNA, 12 nt, Yersinia pestis
gcagucugaggc

SEQ ID NO: 2268781 - RNA, 18 nt, Yersinia pestis
gcagucugaggcccgcua

SEQ ID NO: 2268782 - RNA, 23 nt, Yersinia pestis
gcagucugacagauacuuucggg

SEQ ID NO: 2268783 - RNA, 15 nt, Yersinia pestis
gcaguaauagcaaaa

SEQ ID NO: 2268784 - RNA, 21 nt, Yersinia pestis
gcaccgcugauaaccagcagc

SEQ ID NO: 2268785 - RNA, 13 nt, Yersinia pestis
gcaccgcgcuaua

SEQ ID NO: 2268786 - RNA, 22 nt, Yersinia pestis
gcaccgccgucaaaccaagccc

SEQ ID NO: 2268787 - RNA, 19 nt, Yersinia pestis
gcacccacgguaucugcuu

SEQ ID NO: 2268788 - RNA, 16 nt, Yersinia pestis
gcacccaauguauaug

SEQ ID NO: 2268789 - RNA, 13 nt, Yersinia pestis
gcaccucaggguu

SEQ ID NO: 2268790 - RNA, 18 nt, Yersinia pestis
gcaccguggauaaacaaa

SEQ ID NO: 2268791 - RNA, 20 nt, Yersinia pestis
gcaccggauuuauugcucuc

SEQ ID NO: 2268792 - RNA, 22 nt, Yersinia pestis
gcacgaaccugagcgaucaaua

SEQ ID NO: 2268793 - RNA, 16 nt, Yersinia pestis
gcacgacaacaaagcc

SEQ ID NO: 2268794 - RNA, 23 nt, Yersinia pestis
gcaccaauuuucccaagccuaac

SEQ ID NO: 2268795 - RNA, 16 nt, Yersinia pestis
gcaccacaauggcaga

SEQ ID NO: 2268796 - RNA, 12 nt, Yersinia pestis
gcaccagcacca

SEQ ID NO: 2268797 - RNA, 14 nt, Yersinia pestis
gcaccagcaccaac

SEQ ID NO: 2268798 - RNA, 21 nt, Yersinia pestis
gcaccaaucauuacaucaucu

SEQ ID NO: 2268799 - RNA, 18 nt, Yersinia pestis
gcacaucgccauuagacg

SEQ ID NO: 2268800 - RNA, 15 nt, Yersinia pestis
gcaccauggaaaaua

SEQ ID NO: 2268801 - RNA, 14 nt, Yersinia pestis
gcaccauccagcaa

SEQ ID NO: 2268802 - RNA, 18 nt, Yersinia pestis
gcaccauccagcaaauca

SEQ ID NO: 2268803 - RNA, 14 nt, Yersinia pestis
gcaccagugccaau

SEQ ID NO: 2268804 - RNA, 21 nt, Yersinia pestis
gcaccauaaccaauccaugcc

SEQ ID NO: 2268805 - RNA, 22 nt, Yersinia pestis
gcaccaguugaccauuuuuauc

SEQ ID NO: 2268806 - RNA, 22 nt, Yersinia pestis
gcaaugagacaagagcaauggc

SEQ ID NO: 2268807 - RNA, 18 nt, Yersinia pestis
gcacaaagcuuacuguuc

SEQ ID NO: 2268808 - RNA, 12 nt, Yersinia pestis
gcacacccccau

SEQ ID NO: 2268809 - RNA, 19 nt, Yersinia pestis
gcacaccgcuacaggcgca

SEQ ID NO: 2268810 - RNA, 13 nt, Yersinia pestis
gcacaucccaaua

SEQ ID NO: 2268811 - RNA, 21 nt, Yersinia pestis
gcacaggcaaaaagagucagu

SEQ ID NO: 2268812 - RNA, 18 nt, Yersinia pestis
gcaauaacaccagcaggu

SEQ ID NO: 2268813 - RNA, 15 nt, Yersinia pestis
gcaauaacaccagca

SEQ ID NO: 2268814 - RNA, 19 nt, Yersinia pestis
gcaauaaacucauaccgaa

SEQ ID NO: 2268815 - RNA, 23 nt, Yersinia pestis
gcaauaaaggcaagauuucucuu

SEQ ID NO: 2268816 - RNA, 18 nt, Yersinia pestis
gcaauaacguuuaccgcu

SEQ ID NO: 2268817 - RNA, 16 nt, Yersinia pestis
gcaaggcggcaagcaa

SEQ ID NO: 2268818 - RNA, 17 nt, Yersinia pestis
gcaaggcguacaucucu

SEQ ID NO: 2268819 - RNA, 22 nt, Yersinia pestis
gcaaucaugggccaauccaaua

SEQ ID NO: 2268820 - RNA, 16 nt, Yersinia pestis
gcaaucagaggccauc

SEQ ID NO: 2268821 - RNA, 14 nt, Yersinia pestis
gcaaucauuuauau

SEQ ID NO: 2268822 - RNA, 22 nt, Yersinia pestis
gcaaucgcauugcguucaauac

SEQ ID NO: 2268823 - RNA, 24 nt, Yersinia pestis
gcaacucacugaauauccguucag

SEQ ID NO: 2268824 - RNA, 22 nt, Yersinia pestis
gcaacguuuuaccugcacaggu

SEQ ID NO: 2268825 - RNA, 21 nt, Yersinia pestis
gcaacguaauaucugccaccg

SEQ ID NO: 2268826 - RNA, 22 nt, Yersinia pestis
gcaacugaguaguggagccacu

SEQ ID NO: 2268827 - RNA, 16 nt, Yersinia pestis
gcaacucuagcgccag

SEQ ID NO: 2268828 - RNA, 18 nt, Yersinia pestis
gcaacuccuuaccacugc

SEQ ID NO: 2268829 - RNA, 13 nt, Yersinia pestis
gcaaggaagucca

SEQ ID NO: 2268830 - RNA, 12 nt, Yersinia pestis
gcaagaguccag

SEQ ID NO: 2268831 - RNA, 20 nt, Yersinia pestis
gcaagcguuuuacugcuucu

SEQ ID NO: 2268832 - RNA, 17 nt, Yersinia pestis
gcaagcguaggggacau

SEQ ID NO: 2268833 - RNA, 14 nt, Yersinia pestis
gcaagcugugccug

SEQ ID NO: 2268834 - RNA, 19 nt, Yersinia pestis
gcaacuguaaugccccacu

SEQ ID NO: 2268835 - RNA, 23 nt, Yersinia pestis
gcaacuguaaugccccacuucac

SEQ ID NO: 2268836 - RNA, 21 nt, Yersinia pestis
gcaacgaaaugucgaaagaua

SEQ ID NO: 2268837 - RNA, 15 nt, Yersinia pestis
gcaaccgagaagucg

SEQ ID NO: 2268838 - RNA, 15 nt, Yersinia pestis
gcaaccauauuaaac

SEQ ID NO: 2268839 - RNA, 18 nt, Yersinia pestis
gcaaccccuaauccagca

SEQ ID NO: 2268840 - RNA, 23 nt, Yersinia pestis
gcaacgcacgauccgcccauugc

SEQ ID NO: 2268841 - RNA, 22 nt, Yersinia pestis
gcaacaucaggccuucuuuucu

SEQ ID NO: 2268842 - RNA, 20 nt, Yersinia pestis
gcaacagcguaauaccacua

SEQ ID NO: 2268843 - RNA, 18 nt, Yersinia pestis
gcaaccacuuauccagcu

SEQ ID NO: 2268844 - RNA, 21 nt, Yersinia pestis
gcaaccaguuauagcgguggc

SEQ ID NO: 2268845 - RNA, 13 nt, Yersinia pestis
gcaacaacacccg

SEQ ID NO: 2268846 - RNA, 20 nt, Yersinia pestis
gcaaaacugggcuugagagu

SEQ ID NO: 2268847 - RNA, 23 nt, Yersinia pestis
gcaaaacggccaguaaucaaaca

SEQ ID NO: 2268848 - RNA, 15 nt, Yersinia pestis
gcaacacccaacuca

SEQ ID NO: 2268849 - RNA, 15 nt, Yersinia pestis
gcaacaauaaagcgg

SEQ ID NO: 2268850 - RNA, 23 nt, Yersinia pestis
gcaacacagucgcacugauagca

SEQ ID NO: 2268851 - RNA, 17 nt, Yersinia pestis
gcaacacaucuuccagu

SEQ ID NO: 2268852 - RNA, 16 nt, Yersinia pestis
gcauacaccuucuuaa

SEQ ID NO: 2268853 - RNA, 15 nt, Yersinia pestis
gcauaggccaauaga

SEQ ID NO: 2268854 - RNA, 14 nt, Yersinia pestis
gcauaggccaauag

SEQ ID NO: 2268855 - RNA, 17 nt, Yersinia pestis
gcauagcuaaccuuaac

SEQ ID NO: 2268856 - RNA, 19 nt, Yersinia pestis
gcauagccggagguuuuuc

SEQ ID NO: 2268857 - RNA, 16 nt, Yersinia pestis
gccacagucgccguca

SEQ ID NO: 2268858 - RNA, 20 nt, Yersinia pestis
gccacaggcugcauggguaa

SEQ ID NO: 2268859 - RNA, 17 nt, Yersinia pestis
gccacgaugugaagcaa

SEQ ID NO: 2268860 - RNA, 18 nt, Yersinia pestis
gccaccuucuuauuuauc

SEQ ID NO: 2268861 - RNA, 17 nt, Yersinia pestis
gccaccgcauuccagcg

SEQ ID NO: 2268862 - RNA, 18 nt, Yersinia pestis
gccaccgcauuccagcgu

SEQ ID NO: 2268863 - RNA, 21 nt, Yersinia pestis
gccacugacgguaauuguucc

SEQ ID NO: 2268864 - RNA, 20 nt, Yersinia pestis
gccacggccgccuucaacug

SEQ ID NO: 2268865 - RNA, 15 nt, Yersinia pestis
gccagaaucagcccc

SEQ ID NO: 2268866 - RNA, 18 nt, Yersinia pestis
gccagaauaucguggaga

SEQ ID NO: 2268867 - RNA, 13 nt, Yersinia pestis
gccagacacaaug

SEQ ID NO: 2268868 - RNA, 15 nt, Yersinia pestis
gccagaauuuugcag

SEQ ID NO: 2268869 - RNA, 19 nt, Yersinia pestis
gccagaauuuugcagcgcu

SEQ ID NO: 2268870 - RNA, 17 nt, Yersinia pestis
gccagaugucccagaaa

SEQ ID NO: 2268871 - RNA, 16 nt, Yersinia pestis
gccagauugugcggcu

SEQ ID NO: 2268872 - RNA, 13 nt, Yersinia pestis
gccagcagaaacc

SEQ ID NO: 2268873 - RNA, 17 nt, Yersinia pestis
gccagauagagguggcc

SEQ ID NO: 2268874 - RNA, 21 nt, Yersinia pestis
gccagauaacgauaacuccag

SEQ ID NO: 2268875 - RNA, 19 nt, Yersinia pestis
gccagauaugaucaaaaau

SEQ ID NO: 2268876 - RNA, 14 nt, Yersinia pestis
gccagccucugcgc

SEQ ID NO: 2268877 - RNA, 17 nt, Yersinia pestis
gccagcggguacacugu

SEQ ID NO: 2268878 - RNA, 21 nt, Yersinia pestis
gccagcuuuuuaucauuuaaa

SEQ ID NO: 2268879 - RNA, 21 nt, Yersinia pestis
gccagguaagaaagagaugac

SEQ ID NO: 2268880 - RNA, 17 nt, Yersinia pestis
gccagguaagaaagaga

SEQ ID NO: 2268881 - RNA, 23 nt, Yersinia pestis
gccaguaacgcuucaucauggau

SEQ ID NO: 2268882 - RNA, 13 nt, Yersinia pestis
gccaggucaggaa

SEQ ID NO: 2268883 - RNA, 16 nt, Yersinia pestis
gccagggagggcgcgc

SEQ ID NO: 2268884 - RNA, 15 nt, Yersinia pestis
gccaguuaauaccag

SEQ ID NO: 2268885 - RNA, 17 nt, Yersinia pestis
gccaguguuuucuccac

SEQ ID NO: 2268886 - RNA, 22 nt, Yersinia pestis
gccauaaaugggaagggcgccg

SEQ ID NO: 2268887 - RNA, 23 nt, Yersinia pestis
gccaguuuuagucucgcagccgc

SEQ ID NO: 2268888 - RNA, 19 nt, Yersinia pestis
gccaguuugcgaccaauac

SEQ ID NO: 2268889 - RNA, 13 nt, Yersinia pestis
gccaguugcucac

SEQ ID NO: 2268890 - RNA, 17 nt, Yersinia pestis
gccagugccgcggcggc

SEQ ID NO: 2268891 - RNA, 15 nt, Yersinia pestis
gccagugcuggcaac

SEQ ID NO: 2268892 - RNA, 15 nt, Yersinia pestis
gccagugacugagca

SEQ ID NO: 2268893 - RNA, 22 nt, Yersinia pestis
gccagugaaucagccagagaau

SEQ ID NO: 2268894 - RNA, 19 nt, Yersinia pestis
gccagugacaacuuagguu

SEQ ID NO: 2268895 - RNA, 21 nt, Yersinia pestis
gccaguagcaauaaggugcca

SEQ ID NO: 2268896 - RNA, 21 nt, Yersinia pestis
gccaguaaacagccagcauca

SEQ ID NO: 2268897 - RNA, 17 nt, Yersinia pestis
gccaguaauuaaugcca

SEQ ID NO: 2268898 - RNA, 15 nt, Yersinia pestis
gccauauucaccaca

SEQ ID NO: 2268899 - RNA, 19 nt, Yersinia pestis
gccauauacgcauaaugcg

SEQ ID NO: 2268900 - RNA, 20 nt, Yersinia pestis
gccaucccccuuuggccgcu

SEQ ID NO: 2268901 - RNA, 13 nt, Yersinia pestis
gccauagcugcug

SEQ ID NO: 2268902 - RNA, 14 nt, Yersinia pestis
gccauacaguuaau

SEQ ID NO: 2268903 - RNA, 18 nt, Yersinia pestis
gccauaauccagaagcca

SEQ ID NO: 2268904 - RNA, 22 nt, Yersinia pestis
gccauaagugcacugaacccca

SEQ ID NO: 2268905 - RNA, 14 nt, Yersinia pestis
gccauaaccagagc

SEQ ID NO: 2268906 - RNA, 20 nt, Yersinia pestis
gccauaagcccccguaucau

SEQ ID NO: 2268907 - RNA, 20 nt, Yersinia pestis
gccauaagcgacgacauuaa

SEQ ID NO: 2268908 - RNA, 18 nt, Yersinia pestis
gccaugcauuaaggcgcg

SEQ ID NO: 2268909 - RNA, 20 nt, Yersinia pestis
gccaucgccgacaaaauccc

SEQ ID NO: 2268910 - RNA, 15 nt, Yersinia pestis
gcccccuccaacuga

SEQ ID NO: 2268911 - RNA, 14 nt, Yersinia pestis
gccccgauaaacca

SEQ ID NO: 2268912 - RNA, 17 nt, Yersinia pestis
gcccccccuuucaccaa

SEQ ID NO: 2268913 - RNA, 19 nt, Yersinia pestis
gcccccaauaagggccacc

SEQ ID NO: 2268914 - RNA, 12 nt, Yersinia pestis
gccccaucagca

SEQ ID NO: 2268915 - RNA, 22 nt, Yersinia pestis
gccccauccugacgaaugacuc

SEQ ID NO: 2268916 - RNA, 15 nt, Yersinia pestis
gccccaaccaucucc

SEQ ID NO: 2268917 - RNA, 19 nt, Yersinia pestis
gcccaucuauggaccucac

SEQ ID NO: 2268918 - RNA, 17 nt, Yersinia pestis
gccccagcccagcaggc

SEQ ID NO: 2268919 - RNA, 14 nt, Yersinia pestis
gcccauagaccugc

SEQ ID NO: 2268920 - RNA, 14 nt, Yersinia pestis
gcccauagccaugg

SEQ ID NO: 2268921 - RNA, 11 nt, Yersinia pestis
gcccaucagca

SEQ ID NO: 2268922 - RNA, 14 nt, Yersinia pestis
gcccauccgcagga

SEQ ID NO: 2268923 - RNA, 19 nt, Yersinia pestis
gcccauccuguucaaaagg

SEQ ID NO: 2268924 - RNA, 18 nt, Yersinia pestis
gcccauccgcaggaagca

SEQ ID NO: 2268925 - RNA, 16 nt, Yersinia pestis
gcccaucaugccagca

SEQ ID NO: 2268926 - RNA, 16 nt, Yersinia pestis
gcccagcguucucugg

SEQ ID NO: 2268927 - RNA, 18 nt, Yersinia pestis
gcccagccugguuuuuua

SEQ ID NO: 2268928 - RNA, 20 nt, Yersinia pestis
gcccagccgggguaucauag

SEQ ID NO: 2268929 - RNA, 14 nt, Yersinia pestis
gcccagccucugga

SEQ ID NO: 2268930 - RNA, 18 nt, Yersinia pestis
gcccagcaaggcgggcaa

SEQ ID NO: 2268931 - RNA, 16 nt, Yersinia pestis
gcccagaaaggcaaaa

SEQ ID NO: 2268932 - RNA, 22 nt, Yersinia pestis
gcccgcuagugauagcgggccu

SEQ ID NO: 2268933 - RNA, 14 nt, Yersinia pestis
gcccuaacauugag

SEQ ID NO: 2268934 - RNA, 23 nt, Yersinia pestis
gcccugcuaauuugacgccgccg

SEQ ID NO: 2268935 - RNA, 15 nt, Yersinia pestis
gcccugcucuucugg

SEQ ID NO: 2268936 - RNA, 16 nt, Yersinia pestis
gcccugaauuucaaua

SEQ ID NO: 2268937 - RNA, 22 nt, Yersinia pestis
gccccuucacggaaaauaaagc

SEQ ID NO: 2268938 - RNA, 15 nt, Yersinia pestis
gccccuguaaauaaa

SEQ ID NO: 2268939 - RNA, 18 nt, Yersinia pestis
gccccgcgcuaaccaacg

SEQ ID NO: 2268940 - RNA, 16 nt, Yersinia pestis
gccccgcuaccaagcc

SEQ ID NO: 2268941 - RNA, 22 nt, Yersinia pestis
gcccgcgacggagagaacaggc

SEQ ID NO: 2268942 - RNA, 21 nt, Yersinia pestis
gcccgcagcggcuagcagcag

SEQ ID NO: 2268943 - RNA, 21 nt, Yersinia pestis
gccuccaacuuaucacuggag

SEQ ID NO: 2268944 - RNA, 13 nt, Yersinia pestis
gccuccagugaua

SEQ ID NO: 2268945 - RNA, 23 nt, Yersinia pestis
gccuaauuucgguagcucggccc

SEQ ID NO: 2268946 - RNA, 23 nt, Yersinia pestis
gccuaauuugguacgacgccaga

SEQ ID NO: 2268947 - RNA, 19 nt, Yersinia pestis
gccuaaggccaucaauaaa

SEQ ID NO: 2268948 - RNA, 15 nt, Yersinia pestis
gccuaacaaacugaa

SEQ ID NO: 2268949 - RNA, 23 nt, Yersinia pestis
gccuauuaagauaauuauccauu

SEQ ID NO: 2268950 - RNA, 17 nt, Yersinia pestis
gccuaucugaaugaauu

SEQ ID NO: 2268951 - RNA, 17 nt, Yersinia pestis
gccuauuugcagaaagu

SEQ ID NO: 2268952 - RNA, 19 nt, Yersinia pestis
gccuauugaauaacagcua

SEQ ID NO: 2268953 - RNA, 22 nt, Yersinia pestis
gccuauuguuuaugaguucugc

SEQ ID NO: 2268954 - RNA, 13 nt, Yersinia pestis
gccucaaaaaccu

SEQ ID NO: 2268955 - RNA, 19 nt, Yersinia pestis
gccuauuugcagaaaguaa

SEQ ID NO: 2268956 - RNA, 20 nt, Yersinia pestis
gccucaauuuugccuucugc

SEQ ID NO: 2268957 - RNA, 19 nt, Yersinia pestis
gccucacaacuuucccagu

SEQ ID NO: 2268958 - RNA, 21 nt, Yersinia pestis
gccucacaacuuucccaguca

SEQ ID NO: 2268959 - RNA, 13 nt, Yersinia pestis
gccucaccgccag

SEQ ID NO: 2268960 - RNA, 14 nt, Yersinia pestis
gccuaccugccugc

SEQ ID NO: 2268961 - RNA, 16 nt, Yersinia pestis
gccuacguucaggccc

SEQ ID NO: 2268962 - RNA, 15 nt, Yersinia pestis
gccuagcaucauaaa

SEQ ID NO: 2268963 - RNA, 13 nt, Yersinia pestis
gccuauccucacc

SEQ ID NO: 2268964 - RNA, 14 nt, Yersinia pestis
gccuauccucauga

SEQ ID NO: 2268965 - RNA, 15 nt, Yersinia pestis
gccuauccucaugau

SEQ ID NO: 2268966 - RNA, 20 nt, Yersinia pestis
gccuaggaucgaaugaucag

SEQ ID NO: 2268967 - RNA, 23 nt, Yersinia pestis
gccuauaaggcucuguuaccagc

SEQ ID NO: 2268968 - RNA, 22 nt, Yersinia pestis
gccuaguuaaacucaccgagca

SEQ ID NO: 2268969 - RNA, 18 nt, Yersinia pestis
gccgggucaggaagagaa

SEQ ID NO: 2268970 - RNA, 14 nt, Yersinia pestis
gccgggucaggaag

SEQ ID NO: 2268971 - RNA, 18 nt, Yersinia pestis
gccgugucgggccaauaa

SEQ ID NO: 2268972 - RNA, 15 nt, Yersinia pestis
gccguuaaaaugagc

SEQ ID NO: 2268973 - RNA, 19 nt, Yersinia pestis
gccugagguucccaacggc

SEQ ID NO: 2268974 - RNA, 21 nt, Yersinia pestis
gccugagguucccaacggcag

SEQ ID NO: 2268975 - RNA, 17 nt, Yersinia pestis
gccugacugcccgccug

SEQ ID NO: 2268976 - RNA, 15 nt, Yersinia pestis
gccugauccaacauc

SEQ ID NO: 2268977 - RNA, 20 nt, Yersinia pestis
gccugaaucugaauggcccg

SEQ ID NO: 2268978 - RNA, 15 nt, Yersinia pestis
gccucuagcuaacag

SEQ ID NO: 2268979 - RNA, 16 nt, Yersinia pestis
gccucuguagccgcag

SEQ ID NO: 2268980 - RNA, 13 nt, Yersinia pestis
gccucuucugucg

SEQ ID NO: 2268981 - RNA, 17 nt, Yersinia pestis
gccugcaccagugccaa

SEQ ID NO: 2268982 - RNA, 18 nt, Yersinia pestis
gccugcaccagugccaau

SEQ ID NO: 2268983 - RNA, 16 nt, Yersinia pestis
gccugcaccagugcca

SEQ ID NO: 2268984 - RNA, 17 nt, Yersinia pestis
gccugcccagucuggcu

SEQ ID NO: 2268985 - RNA, 13 nt, Yersinia pestis
gccugcggcggcu

SEQ ID NO: 2268986 - RNA, 14 nt, Yersinia pestis
gccugcggcggcua

SEQ ID NO: 2268987 - RNA, 23 nt, Yersinia pestis
gccugcgcuaauacggcuugcaa

SEQ ID NO: 2268988 - RNA, 15 nt, Yersinia pestis
gccuggaaacgaccu

SEQ ID NO: 2268989 - RNA, 15 nt, Yersinia pestis
gccuggaagcaaaag

SEQ ID NO: 2268990 - RNA, 19 nt, Yersinia pestis
gccugggcauacuguuugc

SEQ ID NO: 2268991 - RNA, 21 nt, Yersinia pestis
gccuggcgcauaguuucaaua

SEQ ID NO: 2268992 - RNA, 16 nt, Yersinia pestis
gccuguaccaccacca

SEQ ID NO: 2268993 - RNA, 22 nt, Yersinia pestis
gccuguaccaccaccaacagca

SEQ ID NO: 2268994 - RNA, 19 nt, Yersinia pestis
gccuguauuauuaauguac

SEQ ID NO: 2268995 - RNA, 20 nt, Yersinia pestis
gccugugacgcuugaauaua

SEQ ID NO: 2268996 - RNA, 14 nt, Yersinia pestis
gccugugcgcuggu

SEQ ID NO: 2268997 - RNA, 17 nt, Yersinia pestis
gccggaggauauuuauu

SEQ ID NO: 2268998 - RNA, 21 nt, Yersinia pestis
gccgcuuucaucgauugcugg

SEQ ID NO: 2268999 - RNA, 19 nt, Yersinia pestis
gccgcuuguugccacccua

SEQ ID NO: 2269000 - RNA, 22 nt, Yersinia pestis
gccgcuuugguugccagauaau

SEQ ID NO: 2269001 - RNA, 13 nt, Yersinia pestis
gccgcggcuggga

SEQ ID NO: 2269002 - RNA, 16 nt, Yersinia pestis
gccgcgccauccuugg

SEQ ID NO: 2269003 - RNA, 14 nt, Yersinia pestis
gccggcggcccaua

SEQ ID NO: 2269004 - RNA, 10 nt, Yersinia pestis
gccggcggcc

SEQ ID NO: 2269005 - RNA, 14 nt, Yersinia pestis
gccgcagagaugaa

SEQ ID NO: 2269006 - RNA, 15 nt, Yersinia pestis
gccgaugcgacaauu

SEQ ID NO: 2269007 - RNA, 19 nt, Yersinia pestis
gccgauacgcgccgcagca

SEQ ID NO: 2269008 - RNA, 17 nt, Yersinia pestis
gccgaucaacaggccac

SEQ ID NO: 2269009 - RNA, 18 nt, Yersinia pestis
gccgaucaacaggccacc

SEQ ID NO: 2269010 - RNA, 22 nt, Yersinia pestis
gccgaugagcuucuucaaaagc

SEQ ID NO: 2269011 - RNA, 19 nt, Yersinia pestis
gccgaugaauaugcuucau

SEQ ID NO: 2269012 - RNA, 16 nt, Yersinia pestis
gccgcaucaaagcgcg

SEQ ID NO: 2269013 - RNA, 14 nt, Yersinia pestis
gccgccacaggcga

SEQ ID NO: 2269014 - RNA, 18 nt, Yersinia pestis
gccgcauugauccucguu

SEQ ID NO: 2269015 - RNA, 19 nt, Yersinia pestis
gccgcaugcaacagauaau

SEQ ID NO: 2269016 - RNA, 17 nt, Yersinia pestis
gccgcauucaccaccau

SEQ ID NO: 2269017 - RNA, 21 nt, Yersinia pestis
gccgccagauuauccagcccu

SEQ ID NO: 2269018 - RNA, 17 nt, Yersinia pestis
gccgccgccagccccgc

SEQ ID NO: 2269019 - RNA, 13 nt, Yersinia pestis
gccgccgccagcc

SEQ ID NO: 2269020 - RNA, 15 nt, Yersinia pestis
gccgcgaauaacaga

SEQ ID NO: 2269021 - RNA, 13 nt, Yersinia pestis
gccgcccagcgac

SEQ ID NO: 2269022 - RNA, 22 nt, Yersinia pestis
gccgccagucauucaccugccc

SEQ ID NO: 2269023 - RNA, 19 nt, Yersinia pestis
gcucaaugugcggaaauaa

SEQ ID NO: 2269024 - RNA, 15 nt, Yersinia pestis
gcucaauuaaccuga

SEQ ID NO: 2269025 - RNA, 19 nt, Yersinia pestis
gcucaaugccgcugucuga

SEQ ID NO: 2269026 - RNA, 20 nt, Yersinia pestis
gcucaaugcguuggcucaga

SEQ ID NO: 2269027 - RNA, 20 nt, Yersinia pestis
gcuagucuguuaugcccaac

SEQ ID NO: 2269028 - RNA, 17 nt, Yersinia pestis
gcuaggaggccaggacu

SEQ ID NO: 2269029 - RNA, 18 nt, Yersinia pestis
gcuaggaggccaggacuu

SEQ ID NO: 2269030 - RNA, 13 nt, Yersinia pestis
gcuagcuucaggu

SEQ ID NO: 2269031 - RNA, 14 nt, Yersinia pestis
gcuacuuuuuucac

SEQ ID NO: 2269032 - RNA, 15 nt, Yersinia pestis
gcuacuuuuuucaca

SEQ ID NO: 2269033 - RNA, 21 nt, Yersinia pestis
gcuacuuaauaucuaacugau

SEQ ID NO: 2269034 - RNA, 17 nt, Yersinia pestis
gcuacugcgagucuugg

SEQ ID NO: 2269035 - RNA, 18 nt, Yersinia pestis
gcuacugguaauaaugcu

SEQ ID NO: 2269036 - RNA, 14 nt, Yersinia pestis
gcuacugggcuacc

SEQ ID NO: 2269037 - RNA, 14 nt, Yersinia pestis
gcucagccaucucu

SEQ ID NO: 2269038 - RNA, 14 nt, Yersinia pestis
gcucaggccuugcg

SEQ ID NO: 2269039 - RNA, 16 nt, Yersinia pestis
gcucacuuuuauccag

SEQ ID NO: 2269040 - RNA, 17 nt, Yersinia pestis
gcucacuuuuauccagc

SEQ ID NO: 2269041 - RNA, 18 nt, Yersinia pestis
gcucacuuuuauauccgc

SEQ ID NO: 2269042 - RNA, 12 nt, Yersinia pestis
gcucaccacuga

SEQ ID NO: 2269043 - RNA, 19 nt, Yersinia pestis
gcucacccauuuuauccuc

SEQ ID NO: 2269044 - RNA, 20 nt, Yersinia pestis
gcucacucgguacaaucucu

SEQ ID NO: 2269045 - RNA, 23 nt, Yersinia pestis
gcucauaugcagcauccagcuca

SEQ ID NO: 2269046 - RNA, 22 nt, Yersinia pestis
gcucaucaaaggagugcccggc

SEQ ID NO: 2269047 - RNA, 19 nt, Yersinia pestis
gcucauaaagcaucagacu

SEQ ID NO: 2269048 - RNA, 16 nt, Yersinia pestis
gcucauaaagcaucag

SEQ ID NO: 2269049 - RNA, 21 nt, Yersinia pestis
gcucauaccaugccaucaaug

SEQ ID NO: 2269050 - RNA, 15 nt, Yersinia pestis
gcucaucauaaaaau

SEQ ID NO: 2269051 - RNA, 20 nt, Yersinia pestis
gcucauccaucauugcuaaa

SEQ ID NO: 2269052 - RNA, 15 nt, Yersinia pestis
gcucaguugaugcaa

SEQ ID NO: 2269053 - RNA, 22 nt, Yersinia pestis
gcucagggccacuucgguggcc

SEQ ID NO: 2269054 - RNA, 15 nt, Yersinia pestis
gcuccagccuggaag

SEQ ID NO: 2269055 - RNA, 19 nt, Yersinia pestis
gcuccagugcaucgcugag

SEQ ID NO: 2269056 - RNA, 11 nt, Yersinia pestis
gcuccagauug

SEQ ID NO: 2269057 - RNA, 19 nt, Yersinia pestis
gcuccaaagcuuccaauau

SEQ ID NO: 2269058 - RNA, 15 nt, Yersinia pestis
gcucauuuuuugggu

SEQ ID NO: 2269059 - RNA, 14 nt, Yersinia pestis
gcuccaauaaaaaa

SEQ ID NO: 2269060 - RNA, 14 nt, Yersinia pestis
gcucauuuuguaug

SEQ ID NO: 2269061 - RNA, 19 nt, Yersinia pestis
gcucauuggcaaauugcug

SEQ ID NO: 2269062 - RNA, 17 nt, Yersinia pestis
gcucgcugguggcuuga

SEQ ID NO: 2269063 - RNA, 20 nt, Yersinia pestis
gcucgcuaauuucucccggg

SEQ ID NO: 2269064 - RNA, 22 nt, Yersinia pestis
gcucggcgcucaauguuccuca

SEQ ID NO: 2269065 - RNA, 19 nt, Yersinia pestis
gcucgcacccuuacccugg

SEQ ID NO: 2269066 - RNA, 15 nt, Yersinia pestis
gcuccaucagguuua

SEQ ID NO: 2269067 - RNA, 15 nt, Yersinia pestis
gcuccaguucgacua

SEQ ID NO: 2269068 - RNA, 20 nt, Yersinia pestis
gcuccgguuuucacccccac

SEQ ID NO: 2269069 - RNA, 14 nt, Yersinia pestis
gcuccucagccuuu

SEQ ID NO: 2269070 - RNA, 18 nt, Yersinia pestis
gcuccuccuuggggccuc

SEQ ID NO: 2269071 - RNA, 20 nt, Yersinia pestis
gcucgaaccugaacgcagga

SEQ ID NO: 2269072 - RNA, 13 nt, Yersinia pestis
gcuaauuucuccc

SEQ ID NO: 2269073 - RNA, 14 nt, Yersinia pestis
gcuaauugucacag

SEQ ID NO: 2269074 - RNA, 21 nt, Yersinia pestis
gcuaauuauuuuauuuaaaau

SEQ ID NO: 2269075 - RNA, 23 nt, Yersinia pestis
gcuaauucuggguacaacacaaa

SEQ ID NO: 2269076 - RNA, 19 nt, Yersinia pestis
gcuaauucugcgccuauac

SEQ ID NO: 2269077 - RNA, 23 nt, Yersinia pestis
gcuaauucugcgccuauaccugc

SEQ ID NO: 2269078 - RNA, 22 nt, Yersinia pestis
gcuaaugcccgacgugagcguu

SEQ ID NO: 2269079 - RNA, 15 nt, Yersinia pestis
gcuaaugcuauccac

SEQ ID NO: 2269080 - RNA, 18 nt, Yersinia pestis
gcuaaugcucgcucauca

SEQ ID NO: 2269081 - RNA, 21 nt, Yersinia pestis
gcuaccaaggcugguggcuga

SEQ ID NO: 2269082 - RNA, 17 nt, Yersinia pestis
gcuaccaauuauucggg

SEQ ID NO: 2269083 - RNA, 19 nt, Yersinia pestis
gcuaccagagaaccgacag

SEQ ID NO: 2269084 - RNA, 22 nt, Yersinia pestis
gcuacccaauaaccccgugcca

SEQ ID NO: 2269085 - RNA, 14 nt, Yersinia pestis
gcuaccaugaguga

SEQ ID NO: 2269086 - RNA, 21 nt, Yersinia pestis
gcuaccaggaagcggccaggu

SEQ ID NO: 2269087 - RNA, 21 nt, Yersinia pestis
gcuacaggcgcaacugccaug

SEQ ID NO: 2269088 - RNA, 13 nt, Yersinia pestis
gcuacagcgucag

SEQ ID NO: 2269089 - RNA, 17 nt, Yersinia pestis
gcuacagguagcgguga

SEQ ID NO: 2269090 - RNA, 16 nt, Yersinia pestis
gcuacgcaaaaucagu

SEQ ID NO: 2269091 - RNA, 13 nt, Yersinia pestis
gcuaccugcacca

SEQ ID NO: 2269092 - RNA, 14 nt, Yersinia pestis
gcuaccggaaccaa

SEQ ID NO: 2269093 - RNA, 23 nt, Yersinia pestis
gcuacguuuaucgugcaguaaug

SEQ ID NO: 2269094 - RNA, 14 nt, Yersinia pestis
gcuacguacuaucu

SEQ ID NO: 2269095 - RNA, 18 nt, Yersinia pestis
gcuacggcaccuuuuuug

SEQ ID NO: 2269096 - RNA, 14 nt, Yersinia pestis
gcuaaguacuaucu

SEQ ID NO: 2269097 - RNA, 24 nt, Yersinia pestis
gcuaacugcugauuuuguagaaug

SEQ ID NO: 2269098 - RNA, 21 nt, Yersinia pestis
gcuaacuggcggggcaaauag

SEQ ID NO: 2269099 - RNA, 14 nt, Yersinia pestis
gcuaaucaguuccc

SEQ ID NO: 2269100 - RNA, 21 nt, Yersinia pestis
gcuaaugaguagcuaauaaaa

SEQ ID NO: 2269101 - RNA, 16 nt, Yersinia pestis
gcuaauauuuauaaaa

SEQ ID NO: 2269102 - RNA, 17 nt, Yersinia pestis
gcuaauacuggcuaaau

SEQ ID NO: 2269103 - RNA, 15 nt, Yersinia pestis
gcuaaguaugugcug

SEQ ID NO: 2269104 - RNA, 14 nt, Yersinia pestis
gcuaaaaugaucuu

SEQ ID NO: 2269105 - RNA, 21 nt, Yersinia pestis
gcuaaaccauguucuggcaga

SEQ ID NO: 2269106 - RNA, 20 nt, Yersinia pestis
gcuaaaccaagguuuacgua

SEQ ID NO: 2269107 - RNA, 18 nt, Yersinia pestis
gcuaacaucaauguauua

SEQ ID NO: 2269108 - RNA, 17 nt, Yersinia pestis
gcuaaccaccgucacca

SEQ ID NO: 2269109 - RNA, 21 nt, Yersinia pestis
gcuaaccaccgucaccaaaua

SEQ ID NO: 2269110 - RNA, 17 nt, Yersinia pestis
gcuaaccccugcaucuu

SEQ ID NO: 2269111 - RNA, 13 nt, Yersinia pestis
gcuaaccuuaacu

SEQ ID NO: 2269112 - RNA, 15 nt, Yersinia pestis
gcuaaauacugcugg

SEQ ID NO: 2269113 - RNA, 16 nt, Yersinia pestis
gcuaaauaaccagaga

SEQ ID NO: 2269114 - RNA, 13 nt, Yersinia pestis
gcuaaaucaucaa

SEQ ID NO: 2269115 - RNA, 20 nt, Yersinia pestis
gcguucuucugauucaauuu

SEQ ID NO: 2269116 - RNA, 18 nt, Yersinia pestis
gcguuagcgauuucuagu

SEQ ID NO: 2269117 - RNA, 16 nt, Yersinia pestis
gcguuaaugccacccc

SEQ ID NO: 2269118 - RNA, 20 nt, Yersinia pestis
gcguuaucacgguugccgcg

SEQ ID NO: 2269119 - RNA, 21 nt, Yersinia pestis
gcguuauugcgacauaaagca

SEQ ID NO: 2269120 - RNA, 22 nt, Yersinia pestis
gcguucaauacaugguaccugu

SEQ ID NO: 2269121 - RNA, 15 nt, Yersinia pestis
gcguucaaaaucaaa

SEQ ID NO: 2269122 - RNA, 18 nt, Yersinia pestis
gcguaucguccagcagca

SEQ ID NO: 2269123 - RNA, 19 nt, Yersinia pestis
gcguaucguccagcagcag

SEQ ID NO: 2269124 - RNA, 22 nt, Yersinia pestis
gcgucucuacgacgcccgcaga

SEQ ID NO: 2269125 - RNA, 12 nt, Yersinia pestis
gcgucuucagug

SEQ ID NO: 2269126 - RNA, 22 nt, Yersinia pestis
gcgugaaacgauaugcuccaga

SEQ ID NO: 2269127 - RNA, 21 nt, Yersinia pestis
gcgucuuuagauuucaccuau

SEQ ID NO: 2269128 - RNA, 18 nt, Yersinia pestis
gcgucuuuaucgccagcu

SEQ ID NO: 2269129 - RNA, 14 nt, Yersinia pestis
gcguggaauuaaua

SEQ ID NO: 2269130 - RNA, 15 nt, Yersinia pestis
gcguggaugaccagu

SEQ ID NO: 2269131 - RNA, 22 nt, Yersinia pestis
gcgugauuuuuauauuuugaga

SEQ ID NO: 2269132 - RNA, 18 nt, Yersinia pestis
gcguagagccuuuacggg

SEQ ID NO: 2269133 - RNA, 13 nt, Yersinia pestis
gcguacuguuagu

SEQ ID NO: 2269134 - RNA, 21 nt, Yersinia pestis
gcguacaucucuugggcgcag

SEQ ID NO: 2269135 - RNA, 22 nt, Yersinia pestis
gcguaccauauggaugaugcac

SEQ ID NO: 2269136 - RNA, 16 nt, Yersinia pestis
gcguaaucagccgcgg

SEQ ID NO: 2269137 - RNA, 16 nt, Yersinia pestis
gcguaauaggcugcgc

SEQ ID NO: 2269138 - RNA, 17 nt, Yersinia pestis
gcguaagccuucaaccu

SEQ ID NO: 2269139 - RNA, 21 nt, Yersinia pestis
gcguaacugcugggcugguag

SEQ ID NO: 2269140 - RNA, 12 nt, Yersinia pestis
gcguaaauaaaa

SEQ ID NO: 2269141 - RNA, 18 nt, Yersinia pestis
gcguaaaauuagagcaaa

SEQ ID NO: 2269142 - RNA, 23 nt, Yersinia pestis
gcgguuucaaccccuucuucacc

SEQ ID NO: 2269143 - RNA, 20 nt, Yersinia pestis
gcgguugucggcauaacagg

SEQ ID NO: 2269144 - RNA, 22 nt, Yersinia pestis
gcgguuuuuccgccgucuggug

SEQ ID NO: 2269145 - RNA, 18 nt, Yersinia pestis
gcgguuggcccuuuucaa

SEQ ID NO: 2269146 - RNA, 15 nt, Yersinia pestis
gcgguugcgcuguug

SEQ ID NO: 2269147 - RNA, 15 nt, Yersinia pestis
gcgguuaucuggaau

SEQ ID NO: 2269148 - RNA, 18 nt, Yersinia pestis
gcgguuacguucaccuaa

SEQ ID NO: 2269149 - RNA, 18 nt, Yersinia pestis
gcggucacgcugauucaa

SEQ ID NO: 2269150 - RNA, 20 nt, Yersinia pestis
gcgggugucuuuaaaaucuu

SEQ ID NO: 2269151 - RNA, 21 nt, Yersinia pestis
gcgguggucaauaucaccagu

SEQ ID NO: 2269152 - RNA, 14 nt, Yersinia pestis
gcgguggccgccuu

SEQ ID NO: 2269153 - RNA, 19 nt, Yersinia pestis
gcgggggaacguggguggu

SEQ ID NO: 2269154 - RNA, 17 nt, Yersinia pestis
gcgggugguccccagag

SEQ ID NO: 2269155 - RNA, 13 nt, Yersinia pestis
gcgggccugaggu

SEQ ID NO: 2269156 - RNA, 22 nt, Yersinia pestis
gcgggccuuugcuuuucugccu

SEQ ID NO: 2269157 - RNA, 22 nt, Yersinia pestis
gcgggcaaaacgacgggcugcu

SEQ ID NO: 2269158 - RNA, 13 nt, Yersinia pestis
gcggcuucagcac

SEQ ID NO: 2269159 - RNA, 18 nt, Yersinia pestis
gcgggaucuccagaagca

SEQ ID NO: 2269160 - RNA, 18 nt, Yersinia pestis
gcggcucucuuucuccaa

SEQ ID NO: 2269161 - RNA, 13 nt, Yersinia pestis
gcgcuuaaauaaa

SEQ ID NO: 2269162 - RNA, 16 nt, Yersinia pestis
gcgcuguugaucgccg

SEQ ID NO: 2269163 - RNA, 13 nt, Yersinia pestis
gcggcagagccaa

SEQ ID NO: 2269164 - RNA, 22 nt, Yersinia pestis
gcgcugucuuucauucggcaca

SEQ ID NO: 2269165 - RNA, 14 nt, Yersinia pestis
gcggcaucaccaaa

SEQ ID NO: 2269166 - RNA, 22 nt, Yersinia pestis
gcggcagcgaagaacaacgggc

SEQ ID NO: 2269167 - RNA, 18 nt, Yersinia pestis
gcggccagcaagagcagc

SEQ ID NO: 2269168 - RNA, 16 nt, Yersinia pestis
gcggccaugucaggcc

SEQ ID NO: 2269169 - RNA, 13 nt, Yersinia pestis
gcggccagugaug

SEQ ID NO: 2269170 - RNA, 16 nt, Yersinia pestis
gcggccuuccaaggcu

SEQ ID NO: 2269171 - RNA, 16 nt, Yersinia pestis
gcgauagauuuucagc

SEQ ID NO: 2269172 - RNA, 18 nt, Yersinia pestis
gcgauaccuuuugcugca

SEQ ID NO: 2269173 - RNA, 15 nt, Yersinia pestis
gcgaggcuucucagc

SEQ ID NO: 2269174 - RNA, 22 nt, Yersinia pestis
gcgagggccuuucugaacaaaa

SEQ ID NO: 2269175 - RNA, 21 nt, Yersinia pestis
gcgagggucgcgcccugcgca

SEQ ID NO: 2269176 - RNA, 20 nt, Yersinia pestis
gcgaugaaaaacagauauac

SEQ ID NO: 2269177 - RNA, 12 nt, Yersinia pestis
gcgaugacugag

SEQ ID NO: 2269178 - RNA, 21 nt, Yersinia pestis
gcgacuucagcucccgccgca

SEQ ID NO: 2269179 - RNA, 19 nt, Yersinia pestis
gcgacugcgcgcugaacgu

SEQ ID NO: 2269180 - RNA, 20 nt, Yersinia pestis
gcgagauauaaacuaauauc

SEQ ID NO: 2269181 - RNA, 14 nt, Yersinia pestis
gcgagcaaggcauc

SEQ ID NO: 2269182 - RNA, 17 nt, Yersinia pestis
gcgauugugcagagugu

SEQ ID NO: 2269183 - RNA, 19 nt, Yersinia pestis
gcgcaaaugcguagcgggg

SEQ ID NO: 2269184 - RNA, 16 nt, Yersinia pestis
gcgauuaggacaaaua

SEQ ID NO: 2269185 - RNA, 13 nt, Yersinia pestis
gcgauuaaaauaa

SEQ ID NO: 2269186 - RNA, 20 nt, Yersinia pestis
gcgcacguaccacggcggga

SEQ ID NO: 2269187 - RNA, 17 nt, Yersinia pestis
gccuucguuugucaaug

SEQ ID NO: 2269188 - RNA, 15 nt, Yersinia pestis
gccuugaaacucaac

SEQ ID NO: 2269189 - RNA, 15 nt, Yersinia pestis
gccuuggucucagaa

SEQ ID NO: 2269190 - RNA, 17 nt, Yersinia pestis
gccuugugcuucauggc

SEQ ID NO: 2269191 - RNA, 23 nt, Yersinia pestis
gccuuaacugcauagcuaaccuu

SEQ ID NO: 2269192 - RNA, 22 nt, Yersinia pestis
gccuuaaaugcguagagucagu

SEQ ID NO: 2269193 - RNA, 19 nt, Yersinia pestis
gccuuauaggcgcauauga

SEQ ID NO: 2269194 - RNA, 23 nt, Yersinia pestis
gccuuauaggcgcauaugaaaaa

SEQ ID NO: 2269195 - RNA, 22 nt, Yersinia pestis
gccuuaucagcgaaaaauuuca

SEQ ID NO: 2269196 - RNA, 19 nt, Yersinia pestis
gccuguuagggcgcggcug

SEQ ID NO: 2269197 - RNA, 13 nt, Yersinia pestis
gccuucauccagg

SEQ ID NO: 2269198 - RNA, 15 nt, Yersinia pestis
gccuucauccagggu

SEQ ID NO: 2269199 - RNA, 17 nt, Yersinia pestis
gccuucccgcuugguua

SEQ ID NO: 2269200 - RNA, 13 nt, Yersinia pestis
gccuuuauucauu

SEQ ID NO: 2269201 - RNA, 14 nt, Yersinia pestis
gccuuuauucauuc

SEQ ID NO: 2269202 - RNA, 17 nt, Yersinia pestis
gccuuucguuucugucu

SEQ ID NO: 2269203 - RNA, 12 nt, Yersinia pestis
gccuuucugggc

SEQ ID NO: 2269204 - RNA, 16 nt, Yersinia pestis
gccuuuguuguuacca

SEQ ID NO: 2269205 - RNA, 13 nt, Yersinia pestis
gcgaaauugacuu

SEQ ID NO: 2269206 - RNA, 18 nt, Yersinia pestis
gccuuuuugcaucaccau

SEQ ID NO: 2269207 - RNA, 18 nt, Yersinia pestis
gccuuuuuuauaauaaug

SEQ ID NO: 2269208 - RNA, 19 nt, Yersinia pestis
gcgacaccaagaggcugcg

SEQ ID NO: 2269209 - RNA, 18 nt, Yersinia pestis
gcgccuaccugccugcug

SEQ ID NO: 2269210 - RNA, 20 nt, Yersinia pestis
gcgccuaccugccugcugcu

SEQ ID NO: 2269211 - RNA, 14 nt, Yersinia pestis
gcgcgcugcugcuc

SEQ ID NO: 2269212 - RNA, 13 nt, Yersinia pestis
gcgcgcuguggcu

SEQ ID NO: 2269213 - RNA, 19 nt, Yersinia pestis
gcgcgucgccauaaccaga

SEQ ID NO: 2269214 - RNA, 20 nt, Yersinia pestis
gcgcuaagcccgugauaaau

SEQ ID NO: 2269215 - RNA, 19 nt, Yersinia pestis
gcgcuaaaggcaucgccug

SEQ ID NO: 2269216 - RNA, 14 nt, Yersinia pestis
gcgcucauuucccg

SEQ ID NO: 2269217 - RNA, 15 nt, Yersinia pestis
gcgcugcaucagcag

SEQ ID NO: 2269218 - RNA, 15 nt, Yersinia pestis
gcgccagacuggccg

SEQ ID NO: 2269219 - RNA, 22 nt, Yersinia pestis
gcgccagguaagaaagagauga

SEQ ID NO: 2269220 - RNA, 16 nt, Yersinia pestis
gcgcccuucccauuua

SEQ ID NO: 2269221 - RNA, 17 nt, Yersinia pestis
gcgccgcggcccugagg

SEQ ID NO: 2269222 - RNA, 19 nt, Yersinia pestis
gcgccguaaaaagcagcaa

SEQ ID NO: 2269223 - RNA, 13 nt, Yersinia pestis
gcgccgacugcug

SEQ ID NO: 2269224 - RNA, 14 nt, Yersinia pestis
gugcuagugcuggu

SEQ ID NO: 2269225 - RNA, 14 nt, Yersinia pestis
gugcuacagcagca

SEQ ID NO: 2269226 - RNA, 14 nt, Yersinia pestis
gugcucauuaaaac

SEQ ID NO: 2269227 - RNA, 16 nt, Yersinia pestis
gugcucauuaucgcag

SEQ ID NO: 2269228 - RNA, 24 nt, Yersinia pestis
gugcguuuuauucaagugcucacu

SEQ ID NO: 2269229 - RNA, 13 nt, Yersinia pestis
gugcguaaagaaa

SEQ ID NO: 2269230 - RNA, 16 nt, Yersinia pestis
gugcguaaagaaaaaa

SEQ ID NO: 2269231 - RNA, 12 nt, Yersinia pestis
gugcguaggcaa

SEQ ID NO: 2269232 - RNA, 23 nt, Yersinia pestis
gugcugaauuggaagagccugaa

SEQ ID NO: 2269233 - RNA, 21 nt, Yersinia pestis
gugcucgggugccucacguau

SEQ ID NO: 2269234 - RNA, 19 nt, Yersinia pestis
gugcugcuaauauuuauaa

SEQ ID NO: 2269235 - RNA, 17 nt, Yersinia pestis
gugcugccauauauucu

SEQ ID NO: 2269236 - RNA, 15 nt, Yersinia pestis
gugcugcccaaaauc

SEQ ID NO: 2269237 - RNA, 14 nt, Yersinia pestis
gugcgccggccugc

SEQ ID NO: 2269238 - RNA, 18 nt, Yersinia pestis
gugccgccgauugcgcuu

SEQ ID NO: 2269239 - RNA, 20 nt, Yersinia pestis
gugauguggcuugcaaucag

SEQ ID NO: 2269240 - RNA, 19 nt, Yersinia pestis
gugauucgcucgcauaaau

SEQ ID NO: 2269241 - RNA, 16 nt, Yersinia pestis
gugauuauuuaaacaa

SEQ ID NO: 2269242 - RNA, 22 nt, Yersinia pestis
gugauuaccugagagagguuga

SEQ ID NO: 2269243 - RNA, 22 nt, Yersinia pestis
gugauuaauacacgcuuccagu

SEQ ID NO: 2269244 - RNA, 15 nt, Yersinia pestis
gugauuagcaguaau

SEQ ID NO: 2269245 - RNA, 14 nt, Yersinia pestis
gugauuguuuuacg

SEQ ID NO: 2269246 - RNA, 18 nt, Yersinia pestis
gugcaauaaauucaaaau

SEQ ID NO: 2269247 - RNA, 21 nt, Yersinia pestis
gugaugaagguagucccucaa

SEQ ID NO: 2269248 - RNA, 16 nt, Yersinia pestis
gugaugaugcuaguga

SEQ ID NO: 2269249 - RNA, 12 nt, Yersinia pestis
gucgcuguuacu

SEQ ID NO: 2269250 - RNA, 17 nt, Yersinia pestis
gugccaaaauaucuucc

SEQ ID NO: 2269251 - RNA, 15 nt, Yersinia pestis
gugccagauccucuu

SEQ ID NO: 2269252 - RNA, 13 nt, Yersinia pestis
gugccagcagcaa

SEQ ID NO: 2269253 - RNA, 12 nt, Yersinia pestis
gugccagcagca

SEQ ID NO: 2269254 - RNA, 23 nt, Yersinia pestis
gugccaaauggaauaaaaaguca

SEQ ID NO: 2269255 - RNA, 15 nt, Yersinia pestis
gugccaauccccacc

SEQ ID NO: 2269256 - RNA, 14 nt, Yersinia pestis
gugccacaacaagc

SEQ ID NO: 2269257 - RNA, 19 nt, Yersinia pestis
gugccaacucagcggccug

SEQ ID NO: 2269258 - RNA, 21 nt, Yersinia pestis
gugcccuuuuugguuuucuau

SEQ ID NO: 2269259 - RNA, 13 nt, Yersinia pestis
gugccccauggcu

SEQ ID NO: 2269260 - RNA, 17 nt, Yersinia pestis
guguuguuuucaugaug

SEQ ID NO: 2269261 - RNA, 14 nt, Yersinia pestis
guguuucaaauaag

SEQ ID NO: 2269262 - RNA, 17 nt, Yersinia pestis
guguuuuggcuaaacca

SEQ ID NO: 2269263 - RNA, 22 nt, Yersinia pestis
guuaaaaugagcacggacagca

SEQ ID NO: 2269264 - RNA, 19 nt, Yersinia pestis
guguuacacaguuauuccc

SEQ ID NO: 2269265 - RNA, 17 nt, Yersinia pestis
guguugcaacggucauu

SEQ ID NO: 2269266 - RNA, 12 nt, Yersinia pestis
guguuggcaaaa

SEQ ID NO: 2269267 - RNA, 12 nt, Yersinia pestis
guguugggcagu

SEQ ID NO: 2269268 - RNA, 14 nt, Yersinia pestis
guguaacccgccuu

SEQ ID NO: 2269269 - RNA, 16 nt, Yersinia pestis
guguguucaaaaaaua

SEQ ID NO: 2269270 - RNA, 21 nt, Yersinia pestis
gugugucuucagaaugaaagg

SEQ ID NO: 2269271 - RNA, 14 nt, Yersinia pestis
gugugauuuccauc

SEQ ID NO: 2269272 - RNA, 15 nt, Yersinia pestis
gugugauuuccaucu

SEQ ID NO: 2269273 - RNA, 13 nt, Yersinia pestis
guuaauauuuauc

SEQ ID NO: 2269274 - RNA, 23 nt, Yersinia pestis
guuaauaccagaugcauauacug

SEQ ID NO: 2269275 - RNA, 23 nt, Yersinia pestis
guuacaacgagggcucaaucucu

SEQ ID NO: 2269276 - RNA, 12 nt, Yersinia pestis
guuaaguuucau

SEQ ID NO: 2269277 - RNA, 17 nt, Yersinia pestis
guuaaauaugcugacca

SEQ ID NO: 2269278 - RNA, 19 nt, Yersinia pestis
guuaaauagugggcuaaaa

SEQ ID NO: 2269279 - RNA, 14 nt, Yersinia pestis
guuaaagacauauc

SEQ ID NO: 2269280 - RNA, 17 nt, Yersinia pestis
guuaccuugugucacca

SEQ ID NO: 2269281 - RNA, 21 nt, Yersinia pestis
guuacgauacguugcagguca

SEQ ID NO: 2269282 - RNA, 19 nt, Yersinia pestis
guuacaccgaaauuagaag

SEQ ID NO: 2269283 - RNA, 15 nt, Yersinia pestis
guuacacaucaggcu

SEQ ID NO: 2269284 - RNA, 18 nt, Yersinia pestis
guuaccuaaccaaacauu

SEQ ID NO: 2269285 - RNA, 14 nt, Yersinia pestis
guuacucagcaucc

SEQ ID NO: 2269286 - RNA, 16 nt, Yersinia pestis
guuacgggcuugcugc

SEQ ID NO: 2269287 - RNA, 20 nt, Yersinia pestis
guuacgggcuugcugcaacc

SEQ ID NO: 2269288 - RNA, 23 nt, Yersinia pestis
guggguucuucaaagugguggca

SEQ ID NO: 2269289 - RNA, 17 nt, Yersinia pestis
guggggggagugugccg

SEQ ID NO: 2269290 - RNA, 23 nt, Yersinia pestis
guggcuaucugaaacugagauuu

SEQ ID NO: 2269291 - RNA, 20 nt, Yersinia pestis
gugguuagcagauaauaaau

SEQ ID NO: 2269292 - RNA, 10 nt, Yersinia pestis
gugguuuggu

SEQ ID NO: 2269293 - RNA, 16 nt, Yersinia pestis
gugguauggauauuuu

SEQ ID NO: 2269294 - RNA, 14 nt, Yersinia pestis
guggugaugaugac

SEQ ID NO: 2269295 - RNA, 22 nt, Yersinia pestis
guggcaacucuagcgccagcaa

SEQ ID NO: 2269296 - RNA, 15 nt, Yersinia pestis
guggccacucaccuc

SEQ ID NO: 2269297 - RNA, 17 nt, Yersinia pestis
guggcgaaaaccccacc

SEQ ID NO: 2269298 - RNA, 17 nt, Yersinia pestis
guucauuuuguauuuug

SEQ ID NO: 2269299 - RNA, 17 nt, Yersinia pestis
guucauuccccaucgcc

SEQ ID NO: 2269300 - RNA, 18 nt, Yersinia pestis
guucauaaauuaaaacug

SEQ ID NO: 2269301 - RNA, 19 nt, Yersinia pestis
guucaucaauaccgugacu

SEQ ID NO: 2269302 - RNA, 15 nt, Yersinia pestis
guucauauuggccag

SEQ ID NO: 2269303 - RNA, 16 nt, Yersinia pestis
guucauauuggccagu

SEQ ID NO: 2269304 - RNA, 18 nt, Yersinia pestis
guucagcaucccagccac

SEQ ID NO: 2269305 - RNA, 15 nt, Yersinia pestis
guucaggauccgccu

SEQ ID NO: 2269306 - RNA, 21 nt, Yersinia pestis
guucagugcucccugaacgcc

SEQ ID NO: 2269307 - RNA, 15 nt, Yersinia pestis
guucauaaauuaaaa

SEQ ID NO: 2269308 - RNA, 19 nt, Yersinia pestis
guuagacgacuagccuaac

SEQ ID NO: 2269309 - RNA, 13 nt, Yersinia pestis
guuagaaauauaa

SEQ ID NO: 2269310 - RNA, 15 nt, Yersinia pestis
guucagcaauaugaa

SEQ ID NO: 2269311 - RNA, 14 nt, Yersinia pestis
guucagcagcgaca

SEQ ID NO: 2269312 - RNA, 23 nt, Yersinia pestis
guucagcgacgauaauuugcagc

SEQ ID NO: 2269313 - RNA, 18 nt, Yersinia pestis
guuccaacgcacaccccc

SEQ ID NO: 2269314 - RNA, 21 nt, Yersinia pestis
guuccaacgcacacccccauu

SEQ ID NO: 2269315 - RNA, 14 nt, Yersinia pestis
guucccaugacgau

SEQ ID NO: 2269316 - RNA, 19 nt, Yersinia pestis
guuccuggaaccagugaau

SEQ ID NO: 2269317 - RNA, 15 nt, Yersinia pestis
guucgcaaugaaccc

SEQ ID NO: 2269318 - RNA, 14 nt, Yersinia pestis
guugaugcaaaacc

SEQ ID NO: 2269319 - RNA, 18 nt, Yersinia pestis
guugauggcgcaguaacu

SEQ ID NO: 2269320 - RNA, 20 nt, Yersinia pestis
guugaugcucauuuaaaaua

SEQ ID NO: 2269321 - RNA, 18 nt, Yersinia pestis
guugcaugcgccauauac

SEQ ID NO: 2269322 - RNA, 15 nt, Yersinia pestis
guugauacggccuau

SEQ ID NO: 2269323 - RNA, 22 nt, Yersinia pestis
guugauacuccauuugaacugu

SEQ ID NO: 2269324 - RNA, 15 nt, Yersinia pestis
guugauaaagcugga

SEQ ID NO: 2269325 - RNA, 20 nt, Yersinia pestis
guugauaaaacacucuuuuu

SEQ ID NO: 2269326 - RNA, 20 nt, Yersinia pestis
guugauaaacaauaaacaga

SEQ ID NO: 2269327 - RNA, 21 nt, Yersinia pestis
guugagaauuaaggaaacuca

SEQ ID NO: 2269328 - RNA, 15 nt, Yersinia pestis
guugagauuaucagc

SEQ ID NO: 2269329 - RNA, 15 nt, Yersinia pestis
guugaccaaacagaa

SEQ ID NO: 2269330 - RNA, 17 nt, Yersinia pestis
guugaaucaauugcugu

SEQ ID NO: 2269331 - RNA, 21 nt, Yersinia pestis
guugaauaccaagccaaauua

SEQ ID NO: 2269332 - RNA, 17 nt, Yersinia pestis
guugaauuugacgugaa

SEQ ID NO: 2269333 - RNA, 16 nt, Yersinia pestis
guugaauuaaaaaccc

SEQ ID NO: 2269334 - RNA, 17 nt, Yersinia pestis
guugaaaccucaucauc

SEQ ID NO: 2269335 - RNA, 13 nt, Yersinia pestis
guucgugaaagca

SEQ ID NO: 2269336 - RNA, 18 nt, Yersinia pestis
guucuucugauaaaacag

SEQ ID NO: 2269337 - RNA, 20 nt, Yersinia pestis
guugucagauaucugcucau

SEQ ID NO: 2269338 - RNA, 16 nt, Yersinia pestis
guuguucgugaaagca

SEQ ID NO: 2269339 - RNA, 20 nt, Yersinia pestis
guugucagcagucugaaauc

SEQ ID NO: 2269340 - RNA, 18 nt, Yersinia pestis
guuguaccuguuuuuguu

SEQ ID NO: 2269341 - RNA, 13 nt, Yersinia pestis
guuuaaaaaauau

SEQ ID NO: 2269342 - RNA, 21 nt, Yersinia pestis
guuuaaaaaggcguuauccuu

SEQ ID NO: 2269343 - RNA, 20 nt, Yersinia pestis
guuguuggguaugauuuuua

SEQ ID NO: 2269344 - RNA, 14 nt, Yersinia pestis
guuuagcucucaga

SEQ ID NO: 2269345 - RNA, 17 nt, Yersinia pestis
guuuagcuuccaacuga

SEQ ID NO: 2269346 - RNA, 20 nt, Yersinia pestis
guuuacgcacguugagugau

SEQ ID NO: 2269347 - RNA, 13 nt, Yersinia pestis
guuuaccuauugc

SEQ ID NO: 2269348 - RNA, 19 nt, Yersinia pestis
guuuaccgcugcagggccu

SEQ ID NO: 2269349 - RNA, 16 nt, Yersinia pestis
guuuaucuucuacuua

SEQ ID NO: 2269350 - RNA, 22 nt, Yersinia pestis
guuuauccuuuuuauuuaagca

SEQ ID NO: 2269351 - RNA, 11 nt, Yersinia pestis
guuuaucccau

SEQ ID NO: 2269352 - RNA, 14 nt, Yersinia pestis
guuuccuucaccaa

SEQ ID NO: 2269353 - RNA, 21 nt, Yersinia pestis
guuucccuucgcgcaguaaac

SEQ ID NO: 2269354 - RNA, 19 nt, Yersinia pestis
guuucccguaccagugcca

SEQ ID NO: 2269355 - RNA, 18 nt, Yersinia pestis
guuucuccgguaauaguu

SEQ ID NO: 2269356 - RNA, 12 nt, Yersinia pestis
guuggcagagac

SEQ ID NO: 2269357 - RNA, 14 nt, Yersinia pestis
guuggcauauggcc

SEQ ID NO: 2269358 - RNA, 21 nt, Yersinia pestis
guuggcaauaaauauccuccg

SEQ ID NO: 2269359 - RNA, 22 nt, Yersinia pestis
guuggaguaucagaaacagcag

SEQ ID NO: 2269360 - RNA, 15 nt, Yersinia pestis
guugcuuuuaacucc

SEQ ID NO: 2269361 - RNA, 15 nt, Yersinia pestis
guugcuguucucucc

SEQ ID NO: 2269362 - RNA, 15 nt, Yersinia pestis
guugcugucucgcuu

SEQ ID NO: 2269363 - RNA, 22 nt, Yersinia pestis
guuggugaucuggcuuucucaa

SEQ ID NO: 2269364 - RNA, 14 nt, Yersinia pestis
guuggucaccacuu

SEQ ID NO: 2269365 - RNA, 12 nt, Yersinia pestis
guuggggaugcc

SEQ ID NO: 2269366 - RNA, 17 nt, Yersinia pestis
guugggccuugcuucug

SEQ ID NO: 2269367 - RNA, 16 nt, Yersinia pestis
guuggcuuuaucucac

SEQ ID NO: 2269368 - RNA, 14 nt, Yersinia pestis
guuggcugccuucc

SEQ ID NO: 2269369 - RNA, 15 nt, Yersinia pestis
guugggaaaaguggc

SEQ ID NO: 2269370 - RNA, 21 nt, Yersinia pestis
guugggaaaaguggcuaucug

SEQ ID NO: 2269371 - RNA, 16 nt, Yersinia pestis
guugcucacccauuuu

SEQ ID NO: 2269372 - RNA, 19 nt, Yersinia pestis
guugcucacccauuuuauc

SEQ ID NO: 2269373 - RNA, 21 nt, Yersinia pestis
guugcgcaggguuuccaagcu

SEQ ID NO: 2269374 - RNA, 13 nt, Yersinia pestis
guugccaaccgga

SEQ ID NO: 2269375 - RNA, 22 nt, Yersinia pestis
guugccaccagcguugacacuc

SEQ ID NO: 2269376 - RNA, 18 nt, Yersinia pestis
guugccaccugcuggggg

SEQ ID NO: 2269377 - RNA, 19 nt, Yersinia pestis
guugccauguugaguuuac

SEQ ID NO: 2269378 - RNA, 23 nt, Yersinia pestis
guugcccccugcuccaaagcuuc

SEQ ID NO: 2269379 - RNA, 14 nt, Yersinia pestis
uaaaaacccucuca

SEQ ID NO: 2269380 - RNA, 22 nt, Yersinia pestis
uaaaaacccucucauccugcua

SEQ ID NO: 2269381 - RNA, 20 nt, Yersinia pestis
uaaaaacuaccguauaauca

SEQ ID NO: 2269382 - RNA, 12 nt, Yersinia pestis
uaaaaacugugc

SEQ ID NO: 2269383 - RNA, 21 nt, Yersinia pestis
uaaaaacuuaucuaaaaaacc

SEQ ID NO: 2269384 - RNA, 17 nt, Yersinia pestis
uaaaaacccauaagucc

SEQ ID NO: 2269385 - RNA, 20 nt, Yersinia pestis
uaaaaacccauaaguccuua

SEQ ID NO: 2269386 - RNA, 18 nt, Yersinia pestis
guuugaugcgcugagcaa

SEQ ID NO: 2269387 - RNA, 13 nt, Yersinia pestis
guuugaugguuau

SEQ ID NO: 2269388 - RNA, 14 nt, Yersinia pestis
uaaaaauaaucaau

SEQ ID NO: 2269389 - RNA, 16 nt, Yersinia pestis
uaaaaauacauaucaa

SEQ ID NO: 2269390 - RNA, 14 nt, Yersinia pestis
uaaaaauacaacca

SEQ ID NO: 2269391 - RNA, 16 nt, Yersinia pestis
uaaaaauagauuaaaa

SEQ ID NO: 2269392 - RNA, 19 nt, Yersinia pestis
uaaaaauagauuaaaaguc

SEQ ID NO: 2269393 - RNA, 18 nt, Yersinia pestis
uaaaaagcagcaaacgaa

SEQ ID NO: 2269394 - RNA, 20 nt, Yersinia pestis
uaaaaagaucugcauugauu

SEQ ID NO: 2269395 - RNA, 23 nt, Yersinia pestis
uaaaaagaucugcauugauuaaa

SEQ ID NO: 2269396 - RNA, 13 nt, Yersinia pestis
uaaaaagucagcu

SEQ ID NO: 2269397 - RNA, 14 nt, Yersinia pestis
uaaaacucaaacug

SEQ ID NO: 2269398 - RNA, 22 nt, Yersinia pestis
uaaaacucucgaaaauguguga

SEQ ID NO: 2269399 - RNA, 18 nt, Yersinia pestis
uaaaacugaagcaucaau

SEQ ID NO: 2269400 - RNA, 17 nt, Yersinia pestis
uaaaagauucauaaaaa

SEQ ID NO: 2269401 - RNA, 19 nt, Yersinia pestis
uaaaagauucauaaaaaaa

SEQ ID NO: 2269402 - RNA, 19 nt, Yersinia pestis
uaaaagaauaaaugucacu

SEQ ID NO: 2269403 - RNA, 14 nt, Yersinia pestis
uaaaaccaccugac

SEQ ID NO: 2269404 - RNA, 16 nt, Yersinia pestis
uaaaaccacugaccua

SEQ ID NO: 2269405 - RNA, 10 nt, Yersinia pestis
uaaaaccaau

SEQ ID NO: 2269406 - RNA, 18 nt, Yersinia pestis
uaaaaccaagaagacuaa

SEQ ID NO: 2269407 - RNA, 12 nt, Yersinia pestis
uaaaacauuuca

SEQ ID NO: 2269408 - RNA, 15 nt, Yersinia pestis
uaaaaauucacaaca

SEQ ID NO: 2269409 - RNA, 19 nt, Yersinia pestis
uaaaaaugcacugaacaau

SEQ ID NO: 2269410 - RNA, 12 nt, Yersinia pestis
uaaaauuuuaag

SEQ ID NO: 2269411 - RNA, 17 nt, Yersinia pestis
uaaaauuuaaaguaaac

SEQ ID NO: 2269412 - RNA, 18 nt, Yersinia pestis
uaaacacucaauaaguag

SEQ ID NO: 2269413 - RNA, 19 nt, Yersinia pestis
uaaacagacacagcaacaa

SEQ ID NO: 2269414 - RNA, 14 nt, Yersinia pestis
uaaacagacacagc

SEQ ID NO: 2269415 - RNA, 15 nt, Yersinia pestis
uaaacagacuaaaaa

SEQ ID NO: 2269416 - RNA, 18 nt, Yersinia pestis
uaaacagacuaaaaaccg

SEQ ID NO: 2269417 - RNA, 17 nt, Yersinia pestis
uaaacaauguuaaacuu

SEQ ID NO: 2269418 - RNA, 16 nt, Yersinia pestis
uaaacaaguugaacca

SEQ ID NO: 2269419 - RNA, 13 nt, Yersinia pestis
uaaacaacgcuga

SEQ ID NO: 2269420 - RNA, 15 nt, Yersinia pestis
uaaaaucgauaguca

SEQ ID NO: 2269421 - RNA, 18 nt, Yersinia pestis
uaaaauuacccagcaucu

SEQ ID NO: 2269422 - RNA, 20 nt, Yersinia pestis
uaaaaugggccugagugggg

SEQ ID NO: 2269423 - RNA, 18 nt, Yersinia pestis
uaaaauauccccugcaag

SEQ ID NO: 2269424 - RNA, 19 nt, Yersinia pestis
uaaaauaucuuucaagucc

SEQ ID NO: 2269425 - RNA, 13 nt, Yersinia pestis
uaaaauaaugagu

SEQ ID NO: 2269426 - RNA, 21 nt, Yersinia pestis
uaaaauaaugaguuaaugaga

SEQ ID NO: 2269427 - RNA, 14 nt, Yersinia pestis
uaaaauaaauuuau

SEQ ID NO: 2269428 - RNA, 15 nt, Yersinia pestis
uaaaaggcuauuuaa

SEQ ID NO: 2269429 - RNA, 19 nt, Yersinia pestis
uaaaaggcuauuuaaauuu

SEQ ID NO: 2269430 - RNA, 19 nt, Yersinia pestis
uaaaaggauggcccaagcc

SEQ ID NO: 2269431 - RNA, 18 nt, Yersinia pestis
uaaaaggauggcccaagc

SEQ ID NO: 2269432 - RNA, 11 nt, Yersinia pestis
uaaaauaauga

SEQ ID NO: 2269433 - RNA, 13 nt, Yersinia pestis
uaaaauaauaaug

SEQ ID NO: 2269434 - RNA, 21 nt, Yersinia pestis
uaaaugcaauuuuugcagugc

SEQ ID NO: 2269435 - RNA, 16 nt, Yersinia pestis
uaaaucuacuuuauuc

SEQ ID NO: 2269436 - RNA, 17 nt, Yersinia pestis
uaaaucuacuuuauuca

SEQ ID NO: 2269437 - RNA, 16 nt, Yersinia pestis
uaaaugagaucgcugu

SEQ ID NO: 2269438 - RNA, 22 nt, Yersinia pestis
uaaaugagggauauacccuaua

SEQ ID NO: 2269439 - RNA, 19 nt, Yersinia pestis
uaaauccuuguaaggugcu

SEQ ID NO: 2269440 - RNA, 20 nt, Yersinia pestis
uaaauccuuguaaggugcua

SEQ ID NO: 2269441 - RNA, 14 nt, Yersinia pestis
uaaauccaaggcgg

SEQ ID NO: 2269442 - RNA, 17 nt, Yersinia pestis
uaaaucccgcuugucgc

SEQ ID NO: 2269443 - RNA, 13 nt, Yersinia pestis
uaaauauaaaaua

SEQ ID NO: 2269444 - RNA, 14 nt, Yersinia pestis
uaaauauaauuuca

SEQ ID NO: 2269445 - RNA, 13 nt, Yersinia pestis
uaaauauuaacau

SEQ ID NO: 2269446 - RNA, 14 nt, Yersinia pestis
uaaauauuaacauu

SEQ ID NO: 2269447 - RNA, 17 nt, Yersinia pestis
uaaauauuaacauuaau

SEQ ID NO: 2269448 - RNA, 18 nt, Yersinia pestis
uaaauauuaucuucacca

SEQ ID NO: 2269449 - RNA, 16 nt, Yersinia pestis
uaaauauaaaauaaua

SEQ ID NO: 2269450 - RNA, 21 nt, Yersinia pestis
uaaauauugguacauaggucu

SEQ ID NO: 2269451 - RNA, 22 nt, Yersinia pestis
uaaaucagugaaggaugaauaa

SEQ ID NO: 2269452 - RNA, 12 nt, Yersinia pestis
uaaaucagugua

SEQ ID NO: 2269453 - RNA, 18 nt, Yersinia pestis
uaaaucaguacuauucac

SEQ ID NO: 2269454 - RNA, 18 nt, Yersinia pestis
uaaaggcgagucagcaca

SEQ ID NO: 2269455 - RNA, 22 nt, Yersinia pestis
uaaaggcuaaaccggcacaggc

SEQ ID NO: 2269456 - RNA, 16 nt, Yersinia pestis
uaaagucggccuauga

SEQ ID NO: 2269457 - RNA, 15 nt, Yersinia pestis
uaaagucaucccgca

SEQ ID NO: 2269458 - RNA, 15 nt, Yersinia pestis
uaaaguuaucaccaa

SEQ ID NO: 2269459 - RNA, 18 nt, Yersinia pestis
uaaaguuauguuuuuccu

SEQ ID NO: 2269460 - RNA, 22 nt, Yersinia pestis
uaaauaaccgagcgugaagagc

SEQ ID NO: 2269461 - RNA, 21 nt, Yersinia pestis
uaaaguguacuguuaacucau

SEQ ID NO: 2269462 - RNA, 19 nt, Yersinia pestis
uaaauaccgccaaauacaa

SEQ ID NO: 2269463 - RNA, 18 nt, Yersinia pestis
uaaauacccgguuuccag

SEQ ID NO: 2269464 - RNA, 16 nt, Yersinia pestis
uaaauagucauauauu

SEQ ID NO: 2269465 - RNA, 13 nt, Yersinia pestis
uaaauagugggcu

SEQ ID NO: 2269466 - RNA, 13 nt, Yersinia pestis
uaaauacagauca

SEQ ID NO: 2269467 - RNA, 15 nt, Yersinia pestis
uaaauaccagagacg

SEQ ID NO: 2269468 - RNA, 22 nt, Yersinia pestis
uaaauaccaauuucauacaggc

SEQ ID NO: 2269469 - RNA, 14 nt, Yersinia pestis
uaaauacauccaug

SEQ ID NO: 2269470 - RNA, 16 nt, Yersinia pestis
uaaauacagcaccauu

SEQ ID NO: 2269471 - RNA, 20 nt, Yersinia pestis
uaaauaaguaggcaucugcc

SEQ ID NO: 2269472 - RNA, 18 nt, Yersinia pestis
uaaacagucuuauuacuc

SEQ ID NO: 2269473 - RNA, 20 nt, Yersinia pestis
uaaacauaaaaaaugccagc

SEQ ID NO: 2269474 - RNA, 19 nt, Yersinia pestis
uaaacagccguauaucuua

SEQ ID NO: 2269475 - RNA, 15 nt, Yersinia pestis
uaaacccaaccccau

SEQ ID NO: 2269476 - RNA, 17 nt, Yersinia pestis
uaaacgccaaucaccuu

SEQ ID NO: 2269477 - RNA, 21 nt, Yersinia pestis
uaaaccgagccugcuuuaaug

SEQ ID NO: 2269478 - RNA, 15 nt, Yersinia pestis
uaaacucuuuaaguu

SEQ ID NO: 2269479 - RNA, 13 nt, Yersinia pestis
uaaacucuuucau

SEQ ID NO: 2269480 - RNA, 23 nt, Yersinia pestis
uaaacuaccgaucaucaggcagg

SEQ ID NO: 2269481 - RNA, 14 nt, Yersinia pestis
uaaacgggcuucca

SEQ ID NO: 2269482 - RNA, 18 nt, Yersinia pestis
uaaacgggcuuccaucag

SEQ ID NO: 2269483 - RNA, 21 nt, Yersinia pestis
uaaacgggcuuccaucaggaa

SEQ ID NO: 2269484 - RNA, 21 nt, Yersinia pestis
uaaacgccgcgucaauaacau

SEQ ID NO: 2269485 - RNA, 22 nt, Yersinia pestis
uaaacgccgaucauaaaucaca

SEQ ID NO: 2269486 - RNA, 21 nt, Yersinia pestis
uaaagauuucaucauucaaua

SEQ ID NO: 2269487 - RNA, 16 nt, Yersinia pestis
uaaagauuucaucauu

SEQ ID NO: 2269488 - RNA, 14 nt, Yersinia pestis
uaaaggcaucucac

SEQ ID NO: 2269489 - RNA, 22 nt, Yersinia pestis
uaaaggcaacgaaggcaacaac

SEQ ID NO: 2269490 - RNA, 17 nt, Yersinia pestis
uaaagauagccacuaac

SEQ ID NO: 2269491 - RNA, 12 nt, Yersinia pestis
uaaagaaaaaac

SEQ ID NO: 2269492 - RNA, 14 nt, Yersinia pestis
uaaagaaaaacccg

SEQ ID NO: 2269493 - RNA, 15 nt, Yersinia pestis
uaaagaaaaaacguu

SEQ ID NO: 2269494 - RNA, 23 nt, Yersinia pestis
uaaagaaaaacccguugaagccu

SEQ ID NO: 2269495 - RNA, 14 nt, Yersinia pestis
uaacacuuauuaac

SEQ ID NO: 2269496 - RNA, 17 nt, Yersinia pestis
uaacacuugaccaaccu

SEQ ID NO: 2269497 - RNA, 21 nt, Yersinia pestis
uaacacguuaaauuucuucaa

SEQ ID NO: 2269498 - RNA, 20 nt, Yersinia pestis
uaacacggccuauugaauaa

SEQ ID NO: 2269499 - RNA, 20 nt, Yersinia pestis
uaacacgaaaagcagcaguu

SEQ ID NO: 2269500 - RNA, 14 nt, Yersinia pestis
uaacaaucagugca

SEQ ID NO: 2269501 - RNA, 16 nt, Yersinia pestis
uaacaauccgaacaaa

SEQ ID NO: 2269502 - RNA, 15 nt, Yersinia pestis
uaacaauccgaacaa

SEQ ID NO: 2269503 - RNA, 17 nt, Yersinia pestis
uaacaauccgaacaaaa

SEQ ID NO: 2269504 - RNA, 21 nt, Yersinia pestis
uaacaacugguuaucacuguc

SEQ ID NO: 2269505 - RNA, 11 nt, Yersinia pestis
uaacaacugcc

SEQ ID NO: 2269506 - RNA, 16 nt, Yersinia pestis
uaacaacuuccacaca

SEQ ID NO: 2269507 - RNA, 15 nt, Yersinia pestis
uaacaauauuauauu

SEQ ID NO: 2269508 - RNA, 14 nt, Yersinia pestis
uaacaauauucauu

SEQ ID NO: 2269509 - RNA, 14 nt, Yersinia pestis
uaacaauaaaaucu

SEQ ID NO: 2269510 - RNA, 19 nt, Yersinia pestis
uaacaacaucgagcgggcu

SEQ ID NO: 2269511 - RNA, 16 nt, Yersinia pestis
uaacaacccuaacacc

SEQ ID NO: 2269512 - RNA, 12 nt, Yersinia pestis
uaacaaaaccgg

SEQ ID NO: 2269513 - RNA, 19 nt, Yersinia pestis
uaaauuuuguacaacuucu

SEQ ID NO: 2269514 - RNA, 17 nt, Yersinia pestis
uaaaugucgcuaauagg

SEQ ID NO: 2269515 - RNA, 15 nt, Yersinia pestis
uaaauguacuacuuc

SEQ ID NO: 2269516 - RNA, 19 nt, Yersinia pestis
uaacagcgugcgcuccauu

SEQ ID NO: 2269517 - RNA, 15 nt, Yersinia pestis
uaacauauaaaccag

SEQ ID NO: 2269518 - RNA, 19 nt, Yersinia pestis
uaacauauaaaccagccag

SEQ ID NO: 2269519 - RNA, 17 nt, Yersinia pestis
uaacaucaauguauuaa

SEQ ID NO: 2269520 - RNA, 24 nt, Yersinia pestis
uaaccacaacgacagccaaaucag

SEQ ID NO: 2269521 - RNA, 17 nt, Yersinia pestis
uaaccacacuuggugcu

SEQ ID NO: 2269522 - RNA, 23 nt, Yersinia pestis
uaaccagagcggagccucaguuc

SEQ ID NO: 2269523 - RNA, 16 nt, Yersinia pestis
uaaccagcaucaguag

SEQ ID NO: 2269524 - RNA, 21 nt, Yersinia pestis
uaaccagcaguugcugcucug

SEQ ID NO: 2269525 - RNA, 16 nt, Yersinia pestis
uaaccaccucggaagg

SEQ ID NO: 2269526 - RNA, 21 nt, Yersinia pestis
uaaccaacaguuauuuuaauu

SEQ ID NO: 2269527 - RNA, 16 nt, Yersinia pestis
uaaccaaaagccccau

SEQ ID NO: 2269528 - RNA, 18 nt, Yersinia pestis
uaacaucagcgauucauu

SEQ ID NO: 2269529 - RNA, 20 nt, Yersinia pestis
uaacaucagcgauucauuga

SEQ ID NO: 2269530 - RNA, 22 nt, Yersinia pestis
uaacaucauugguuuuaauauu

SEQ ID NO: 2269531 - RNA, 20 nt, Yersinia pestis
uaaccauuuauauaacagcc

SEQ ID NO: 2269532 - RNA, 13 nt, Yersinia pestis
uaacccaaagcca

SEQ ID NO: 2269533 - RNA, 12 nt, Yersinia pestis
uaacccaaagug

SEQ ID NO: 2269534 - RNA, 15 nt, Yersinia pestis
uaacccaaugccaua

SEQ ID NO: 2269535 - RNA, 15 nt, Yersinia pestis
uaacccccaagcuuu

SEQ ID NO: 2269536 - RNA, 15 nt, Yersinia pestis
uaaccccguagcaca

SEQ ID NO: 2269537 - RNA, 14 nt, Yersinia pestis
uaaccuucuucauu

SEQ ID NO: 2269538 - RNA, 14 nt, Yersinia pestis
uaaccuuaacugca

SEQ ID NO: 2269539 - RNA, 15 nt, Yersinia pestis
uaaccugcacuuuca

SEQ ID NO: 2269540 - RNA, 22 nt, Yersinia pestis
uaaccuguucccguucagccuc

SEQ ID NO: 2269541 - RNA, 23 nt, Yersinia pestis
uaacuaacaucagcgauucauug

SEQ ID NO: 2269542 - RNA, 16 nt, Yersinia pestis
uaacuaacguuuugua

SEQ ID NO: 2269543 - RNA, 15 nt, Yersinia pestis
uaacggcucugccaa

SEQ ID NO: 2269544 - RNA, 20 nt, Yersinia pestis
uaacgccgaguaagucaaua

SEQ ID NO: 2269545 - RNA, 14 nt, Yersinia pestis
uaacuaauaauaau

SEQ ID NO: 2269546 - RNA, 21 nt, Yersinia pestis
uaacuauuuuugacuuuaauu

SEQ ID NO: 2269547 - RNA, 22 nt, Yersinia pestis
uaacuauuuuugacuuuaauua

SEQ ID NO: 2269548 - RNA, 18 nt, Yersinia pestis
uaacucaaccccagccgg

SEQ ID NO: 2269549 - RNA, 16 nt, Yersinia pestis
uaacuccaucaggcua

SEQ ID NO: 2269550 - RNA, 13 nt, Yersinia pestis
uaacucaucagua

SEQ ID NO: 2269551 - RNA, 13 nt, Yersinia pestis
uaacucaugugua

SEQ ID NO: 2269552 - RNA, 15 nt, Yersinia pestis
uaacucaauaaauuc

SEQ ID NO: 2269553 - RNA, 16 nt, Yersinia pestis
uaacucaauaaauuca

SEQ ID NO: 2269554 - RNA, 18 nt, Yersinia pestis
uaacuggcgguuauugaa

SEQ ID NO: 2269555 - RNA, 18 nt, Yersinia pestis
uaacuggcuggcuuugga

SEQ ID NO: 2269556 - RNA, 15 nt, Yersinia pestis
uaacuggccaauuaa

SEQ ID NO: 2269557 - RNA, 16 nt, Yersinia pestis
uaacugguggcaggcc

SEQ ID NO: 2269558 - RNA, 16 nt, Yersinia pestis
uaacugcugcuuuaau

SEQ ID NO: 2269559 - RNA, 13 nt, Yersinia pestis
uaacugcauagcu

SEQ ID NO: 2269560 - RNA, 15 nt, Yersinia pestis
uaacugcauagcuaa

SEQ ID NO: 2269561 - RNA, 12 nt, Yersinia pestis
uaacugaaagcc

SEQ ID NO: 2269562 - RNA, 16 nt, Yersinia pestis
uaacucuucuggcaaa

SEQ ID NO: 2269563 - RNA, 15 nt, Yersinia pestis
uaacucuuuuuaaac

SEQ ID NO: 2269564 - RNA, 19 nt, Yersinia pestis
uaagcaggggaucgggcug

SEQ ID NO: 2269565 - RNA, 17 nt, Yersinia pestis
uaagcaggaagauaucg

SEQ ID NO: 2269566 - RNA, 18 nt, Yersinia pestis
uaagcagcaccaauauca

SEQ ID NO: 2269567 - RNA, 16 nt, Yersinia pestis
uaagcacgaauuuuau

SEQ ID NO: 2269568 - RNA, 18 nt, Yersinia pestis
uaagccgcaauaaauggc

SEQ ID NO: 2269569 - RNA, 13 nt, Yersinia pestis
uaagaucucagca

SEQ ID NO: 2269570 - RNA, 17 nt, Yersinia pestis
uaagauccauguauauu

SEQ ID NO: 2269571 - RNA, 20 nt, Yersinia pestis
uaagauccagaacaccaaca

SEQ ID NO: 2269572 - RNA, 20 nt, Yersinia pestis
uaagauccaguucaguccag

SEQ ID NO: 2269573 - RNA, 19 nt, Yersinia pestis
uaagauucgccgcaaggca

SEQ ID NO: 2269574 - RNA, 13 nt, Yersinia pestis
uaaggaaacucau

SEQ ID NO: 2269575 - RNA, 14 nt, Yersinia pestis
uaagcugcagaggu

SEQ ID NO: 2269576 - RNA, 16 nt, Yersinia pestis
uaagcuaucauuaaau

SEQ ID NO: 2269577 - RNA, 19 nt, Yersinia pestis
uaagccgugcggcacugcg

SEQ ID NO: 2269578 - RNA, 22 nt, Yersinia pestis
uaagccgcaggcaaacaaugug

SEQ ID NO: 2269579 - RNA, 17 nt, Yersinia pestis
uaagcgacgacauuaau

SEQ ID NO: 2269580 - RNA, 20 nt, Yersinia pestis
uaagcguagggauaaaucgc

SEQ ID NO: 2269581 - RNA, 14 nt, Yersinia pestis
uaagcguauuuugu

SEQ ID NO: 2269582 - RNA, 21 nt, Yersinia pestis
uaagcguauuuugucaugaaa

SEQ ID NO: 2269583 - RNA, 18 nt, Yersinia pestis
uaagcgguauccaccuuc

SEQ ID NO: 2269584 - RNA, 20 nt, Yersinia pestis
uaagcgguauccaccuucca

SEQ ID NO: 2269585 - RNA, 18 nt, Yersinia pestis
uaagcggcguauuaucag

SEQ ID NO: 2269586 - RNA, 16 nt, Yersinia pestis
uaacuuuaguuucuuu

SEQ ID NO: 2269587 - RNA, 15 nt, Yersinia pestis
uaacuucuuccgcaa

SEQ ID NO: 2269588 - RNA, 21 nt, Yersinia pestis
uaacuuaaaauauggcaggua

SEQ ID NO: 2269589 - RNA, 21 nt, Yersinia pestis
uaacuuacugcucuaucucuu

SEQ ID NO: 2269590 - RNA, 15 nt, Yersinia pestis
uaacuuaauggcacc

SEQ ID NO: 2269591 - RNA, 19 nt, Yersinia pestis
uaacuuauugauuauaugc

SEQ ID NO: 2269592 - RNA, 21 nt, Yersinia pestis
uaacuuaucgaccaacuggca

SEQ ID NO: 2269593 - RNA, 18 nt, Yersinia pestis
uaacuucagguucaccuu

SEQ ID NO: 2269594 - RNA, 16 nt, Yersinia pestis
uaacuuuaucagucug

SEQ ID NO: 2269595 - RNA, 21 nt, Yersinia pestis
uaacuuuggguauaugacugu

SEQ ID NO: 2269596 - RNA, 19 nt, Yersinia pestis
uaacuuuuggcagcaccag

SEQ ID NO: 2269597 - RNA, 21 nt, Yersinia pestis
uaacuuuucuucauugcugcu

SEQ ID NO: 2269598 - RNA, 15 nt, Yersinia pestis
uaacuuuuggcagca

SEQ ID NO: 2269599 - RNA, 16 nt, Yersinia pestis
uaagaacaacgcugca

SEQ ID NO: 2269600 - RNA, 19 nt, Yersinia pestis
uaagaaagagaugacccaa

SEQ ID NO: 2269601 - RNA, 15 nt, Yersinia pestis
uaagaagccucauga

SEQ ID NO: 2269602 - RNA, 16 nt, Yersinia pestis
uaagaagccucaugaa

SEQ ID NO: 2269603 - RNA, 18 nt, Yersinia pestis
uaagacguuauuauugau

SEQ ID NO: 2269604 - RNA, 17 nt, Yersinia pestis
uaagaaguagaaugaga

SEQ ID NO: 2269605 - RNA, 14 nt, Yersinia pestis
uaagaauaaauaau

SEQ ID NO: 2269606 - RNA, 19 nt, Yersinia pestis
uaagagcgacucaauaaua

SEQ ID NO: 2269607 - RNA, 21 nt, Yersinia pestis
uaagaguccuuaaaaacccau

SEQ ID NO: 2269608 - RNA, 18 nt, Yersinia pestis
uaagauaggccaccucuu

SEQ ID NO: 2269609 - RNA, 17 nt, Yersinia pestis
uaagauccaccacauca

SEQ ID NO: 2269610 - RNA, 23 nt, Yersinia pestis
uaagauaacccaaugccauagcu

SEQ ID NO: 2269611 - RNA, 19 nt, Yersinia pestis
uauacuaaaacagcucacu

SEQ ID NO: 2269612 - RNA, 17 nt, Yersinia pestis
uauacuaaaacagcuca

SEQ ID NO: 2269613 - RNA, 15 nt, Yersinia pestis
uauacuaaagaaaua

SEQ ID NO: 2269614 - RNA, 14 nt, Yersinia pestis
uauacggcuauuuu

SEQ ID NO: 2269615 - RNA, 19 nt, Yersinia pestis
uauacggcggcuacuggua

SEQ ID NO: 2269616 - RNA, 16 nt, Yersinia pestis
uauacggacaaugcca

SEQ ID NO: 2269617 - RNA, 15 nt, Yersinia pestis
uauacauuauuauuu

SEQ ID NO: 2269618 - RNA, 15 nt, Yersinia pestis
uauacccgucauaaa

SEQ ID NO: 2269619 - RNA, 16 nt, Yersinia pestis
uauacccaccagagac

SEQ ID NO: 2269620 - RNA, 18 nt, Yersinia pestis
uauagaaagugacacauu

SEQ ID NO: 2269621 - RNA, 13 nt, Yersinia pestis
uauagagaaaucu

SEQ ID NO: 2269622 - RNA, 14 nt, Yersinia pestis
uauagagaaaucua

SEQ ID NO: 2269623 - RNA, 14 nt, Yersinia pestis
uauagagugcaauu

SEQ ID NO: 2269624 - RNA, 14 nt, Yersinia pestis
uauacauaccacuu

SEQ ID NO: 2269625 - RNA, 19 nt, Yersinia pestis
uauacauacgucuccauuu

SEQ ID NO: 2269626 - RNA, 22 nt, Yersinia pestis
uauacagcccgguaucaccuuu

SEQ ID NO: 2269627 - RNA, 22 nt, Yersinia pestis
uauaaauuacucguauaaaaaa

SEQ ID NO: 2269628 - RNA, 13 nt, Yersinia pestis
uauaaauuaaaaa

SEQ ID NO: 2269629 - RNA, 12 nt, Yersinia pestis
uauaaauuuaau

SEQ ID NO: 2269630 - RNA, 13 nt, Yersinia pestis
uauaaauuuaaua

SEQ ID NO: 2269631 - RNA, 16 nt, Yersinia pestis
uauaaauuuaauaaaa

SEQ ID NO: 2269632 - RNA, 17 nt, Yersinia pestis
uauaaauuuaauaaaaa

SEQ ID NO: 2269633 - RNA, 15 nt, Yersinia pestis
uauaauuaacagcau

SEQ ID NO: 2269634 - RNA, 13 nt, Yersinia pestis
uauaauucauuuu

SEQ ID NO: 2269635 - RNA, 13 nt, Yersinia pestis
uauaauucaauau

SEQ ID NO: 2269636 - RNA, 21 nt, Yersinia pestis
uaguguaaaaaccaucugaug

SEQ ID NO: 2269637 - RNA, 15 nt, Yersinia pestis
uagugacguaaaaag

SEQ ID NO: 2269638 - RNA, 21 nt, Yersinia pestis
uagugacuaauuguuugcuuu

SEQ ID NO: 2269639 - RNA, 19 nt, Yersinia pestis
uagugaaguaauaaaaauc

SEQ ID NO: 2269640 - RNA, 22 nt, Yersinia pestis
uagugcuuccaacucaccuaaa

SEQ ID NO: 2269641 - RNA, 14 nt, Yersinia pestis
uagugacucaucaa

SEQ ID NO: 2269642 - RNA, 19 nt, Yersinia pestis
uaguuaagguuagcuaugc

SEQ ID NO: 2269643 - RNA, 21 nt, Yersinia pestis
uaguuaacacgaaaagcagca

SEQ ID NO: 2269644 - RNA, 16 nt, Yersinia pestis
uagucucuugggcagc

SEQ ID NO: 2269645 - RNA, 17 nt, Yersinia pestis
uaguuuauuuuauuuaa

SEQ ID NO: 2269646 - RNA, 20 nt, Yersinia pestis
uaguuaucucccauuaauua

SEQ ID NO: 2269647 - RNA, 19 nt, Yersinia pestis
uaguucacgauggaaaaaa

SEQ ID NO: 2269648 - RNA, 20 nt, Yersinia pestis
uaguucacgauggaaaaaau

SEQ ID NO: 2269649 - RNA, 14 nt, Yersinia pestis
uaguucaaugguca

SEQ ID NO: 2269650 - RNA, 19 nt, Yersinia pestis
uauaaaccggucauacauu

SEQ ID NO: 2269651 - RNA, 14 nt, Yersinia pestis
uauaaacauaaaaa

SEQ ID NO: 2269652 - RNA, 13 nt, Yersinia pestis
uauaaauaaaaua

SEQ ID NO: 2269653 - RNA, 14 nt, Yersinia pestis
uauaaauaaaauag

SEQ ID NO: 2269654 - RNA, 12 nt, Yersinia pestis
uaucaccagguu

SEQ ID NO: 2269655 - RNA, 13 nt, Yersinia pestis
uaucacaucaucc

SEQ ID NO: 2269656 - RNA, 20 nt, Yersinia pestis
uaucaggcuaauacaugcug

SEQ ID NO: 2269657 - RNA, 15 nt, Yersinia pestis
uaucauauucaucaa

SEQ ID NO: 2269658 - RNA, 23 nt, Yersinia pestis
uaucauaucgaccaugaauaauu

SEQ ID NO: 2269659 - RNA, 17 nt, Yersinia pestis
uaucauaaauaaaagau

SEQ ID NO: 2269660 - RNA, 15 nt, Yersinia pestis
uaucagucuuuucaa

SEQ ID NO: 2269661 - RNA, 14 nt, Yersinia pestis
uaucaguugguuua

SEQ ID NO: 2269662 - RNA, 12 nt, Yersinia pestis
uauauuuaauuu

SEQ ID NO: 2269663 - RNA, 15 nt, Yersinia pestis
uauauuuaauuuaaa

SEQ ID NO: 2269664 - RNA, 22 nt, Yersinia pestis
uauauugaugacugaauuguca

SEQ ID NO: 2269665 - RNA, 18 nt, Yersinia pestis
uauauugaugugaaacau

SEQ ID NO: 2269666 - RNA, 23 nt, Yersinia pestis
uauauugccaucgggcaauugaa

SEQ ID NO: 2269667 - RNA, 17 nt, Yersinia pestis
uauauugcauuuaugau

SEQ ID NO: 2269668 - RNA, 20 nt, Yersinia pestis
uaucaauaggauuuucauga

SEQ ID NO: 2269669 - RNA, 21 nt, Yersinia pestis
uaucaaucagcugauaugaaa

SEQ ID NO: 2269670 - RNA, 15 nt, Yersinia pestis
uaucaaucaaaaaau

SEQ ID NO: 2269671 - RNA, 16 nt, Yersinia pestis
uaucaaucaaaaaaua

SEQ ID NO: 2269672 - RNA, 19 nt, Yersinia pestis
uaucaauuguuugcuauca

SEQ ID NO: 2269673 - RNA, 15 nt, Yersinia pestis
uauauucaauaucac

SEQ ID NO: 2269674 - RNA, 18 nt, Yersinia pestis
uauauucaauaucacuga

SEQ ID NO: 2269675 - RNA, 20 nt, Yersinia pestis
uauauuccacauacaaagca

SEQ ID NO: 2269676 - RNA, 15 nt, Yersinia pestis
uauauugauaaaaau

SEQ ID NO: 2269677 - RNA, 14 nt, Yersinia pestis
uauauugauaaaag

SEQ ID NO: 2269678 - RNA, 23 nt, Yersinia pestis
uauauucuacaaugucacgcuuu

SEQ ID NO: 2269679 - RNA, 16 nt, Yersinia pestis
uauauguugggaaaua

SEQ ID NO: 2269680 - RNA, 17 nt, Yersinia pestis
uauagcgcaccaccgac

SEQ ID NO: 2269681 - RNA, 17 nt, Yersinia pestis
uauaggguuguguggua

SEQ ID NO: 2269682 - RNA, 18 nt, Yersinia pestis
uauauacccguaauauuu

SEQ ID NO: 2269683 - RNA, 18 nt, Yersinia pestis
uauaggcuauuuuacuug

SEQ ID NO: 2269684 - RNA, 21 nt, Yersinia pestis
uauaggcgcauaugaaaaacc

SEQ ID NO: 2269685 - RNA, 17 nt, Yersinia pestis
uauauauccaaaauaau

SEQ ID NO: 2269686 - RNA, 17 nt, Yersinia pestis
uaucaucuuuuucugcc

SEQ ID NO: 2269687 - RNA, 19 nt, Yersinia pestis
uaucaucuuuuucugccug

SEQ ID NO: 2269688 - RNA, 16 nt, Yersinia pestis
uaucauccccuauaua

SEQ ID NO: 2269689 - RNA, 13 nt, Yersinia pestis
uaucaucagcaga

SEQ ID NO: 2269690 - RNA, 11 nt, Yersinia pestis
uauccagcccu

SEQ ID NO: 2269691 - RNA, 13 nt, Yersinia pestis
uauccagccgcuc

SEQ ID NO: 2269692 - RNA, 12 nt, Yersinia pestis
uauccaggcacu

SEQ ID NO: 2269693 - RNA, 17 nt, Yersinia pestis
uauccaggcacugccau

SEQ ID NO: 2269694 - RNA, 12 nt, Yersinia pestis
uauccagcagcg

SEQ ID NO: 2269695 - RNA, 22 nt, Yersinia pestis
uaucccuauuuuuuccgaaaaa

SEQ ID NO: 2269696 - RNA, 15 nt, Yersinia pestis
uaucccuguuuucua

SEQ ID NO: 2269697 - RNA, 17 nt, Yersinia pestis
uaucgaaacacauacaa

SEQ ID NO: 2269698 - RNA, 13 nt, Yersinia pestis
uaucgaauugauc

SEQ ID NO: 2269699 - RNA, 14 nt, Yersinia pestis
uaucgacaaucaca

SEQ ID NO: 2269700 - RNA, 15 nt, Yersinia pestis
uauccgccaaagauu

SEQ ID NO: 2269701 - RNA, 16 nt, Yersinia pestis
uauccuuuuuauuuaa

SEQ ID NO: 2269702 - RNA, 22 nt, Yersinia pestis
uauccuugauggaaauacgcuu

SEQ ID NO: 2269703 - RNA, 13 nt, Yersinia pestis
uaucuaucuguuc

SEQ ID NO: 2269704 - RNA, 16 nt, Yersinia pestis
uaucuguaaucaccag

SEQ ID NO: 2269705 - RNA, 20 nt, Yersinia pestis
uaucuguuucaaauaaguau

SEQ ID NO: 2269706 - RNA, 18 nt, Yersinia pestis
uaucuuaugagcagccca

SEQ ID NO: 2269707 - RNA, 12 nt, Yersinia pestis
uaucuacuucua

SEQ ID NO: 2269708 - RNA, 21 nt, Yersinia pestis
uaucuacuucuauuacccuaa

SEQ ID NO: 2269709 - RNA, 16 nt, Yersinia pestis
uaucgaugguuggcua

SEQ ID NO: 2269710 - RNA, 17 nt, Yersinia pestis
uaucgaucaaaccagag

SEQ ID NO: 2269711 - RNA, 15 nt, Yersinia pestis
uagccagauaaaacu

SEQ ID NO: 2269712 - RNA, 23 nt, Yersinia pestis
uagccaccaguuuauuuucccuu

SEQ ID NO: 2269713 - RNA, 22 nt, Yersinia pestis
uagccaccaguuuauuuucccu

SEQ ID NO: 2269714 - RNA, 21 nt, Yersinia pestis
uagccagccaccgcacacuga

SEQ ID NO: 2269715 - RNA, 19 nt, Yersinia pestis
uagccagccaccgcacacu

SEQ ID NO: 2269716 - RNA, 19 nt, Yersinia pestis
uagccgaugcuacaccauc

SEQ ID NO: 2269717 - RNA, 20 nt, Yersinia pestis
uagccgcaggcgaugcaagg

SEQ ID NO: 2269718 - RNA, 23 nt, Yersinia pestis
uagccaugagguuuauuccuugu

SEQ ID NO: 2269719 - RNA, 21 nt, Yersinia pestis
uagcgaaauaucaggaugaac

SEQ ID NO: 2269720 - RNA, 20 nt, Yersinia pestis
uagccuuuuugcaucaccau

SEQ ID NO: 2269721 - RNA, 19 nt, Yersinia pestis
uagccugcaccucaucaac

SEQ ID NO: 2269722 - RNA, 18 nt, Yersinia pestis
uagccgucacuuaaaaau

SEQ ID NO: 2269723 - RNA, 15 nt, Yersinia pestis
uagcagugauuucag

SEQ ID NO: 2269724 - RNA, 21 nt, Yersinia pestis
uagccaaauacccuaauucag

SEQ ID NO: 2269725 - RNA, 18 nt, Yersinia pestis
uagcaaggcguacaucuc

SEQ ID NO: 2269726 - RNA, 14 nt, Yersinia pestis
uagcaauagaacug

SEQ ID NO: 2269727 - RNA, 15 nt, Yersinia pestis
uagcaauauaauaau

SEQ ID NO: 2269728 - RNA, 22 nt, Yersinia pestis
uagcaaugagacaagagcaaug

SEQ ID NO: 2269729 - RNA, 13 nt, Yersinia pestis
uagcaauuugagg

SEQ ID NO: 2269730 - RNA, 21 nt, Yersinia pestis
uagaucacagacguuuaaaua

SEQ ID NO: 2269731 - RNA, 20 nt, Yersinia pestis
uagaucccauacccacuaau

SEQ ID NO: 2269732 - RNA, 21 nt, Yersinia pestis
uagaucuccugcaacgccuuc

SEQ ID NO: 2269733 - RNA, 19 nt, Yersinia pestis
uagaucgagucaucggguu

SEQ ID NO: 2269734 - RNA, 22 nt, Yersinia pestis
uagauauuguuuugacuaaaau

SEQ ID NO: 2269735 - RNA, 17 nt, Yersinia pestis
uagcuuucuccuuugau

SEQ ID NO: 2269736 - RNA, 15 nt, Yersinia pestis
uagcucgcucaacau

SEQ ID NO: 2269737 - RNA, 16 nt, Yersinia pestis
uagcucgcuguggcua

SEQ ID NO: 2269738 - RNA, 14 nt, Yersinia pestis
uagcuaaccuuaac

SEQ ID NO: 2269739 - RNA, 13 nt, Yersinia pestis
uagcucaagggca

SEQ ID NO: 2269740 - RNA, 15 nt, Yersinia pestis
uagcucagaaaauaa

SEQ ID NO: 2269741 - RNA, 13 nt, Yersinia pestis
uagcgugccgcag

SEQ ID NO: 2269742 - RNA, 17 nt, Yersinia pestis
uagcgugauuuuuauau

SEQ ID NO: 2269743 - RNA, 22 nt, Yersinia pestis
uagcguugccgccgggcagcaa

SEQ ID NO: 2269744 - RNA, 14 nt, Yersinia pestis
uagcgauagaguug

SEQ ID NO: 2269745 - RNA, 15 nt, Yersinia pestis
uagcgaugacugagu

SEQ ID NO: 2269746 - RNA, 19 nt, Yersinia pestis
uagcgaugacugaguauga

SEQ ID NO: 2269747 - RNA, 23 nt, Yersinia pestis
uagggcugucagccaccgugucc

SEQ ID NO: 2269748 - RNA, 22 nt, Yersinia pestis
uaggggccaccaaauaaaacaa

SEQ ID NO: 2269749 - RNA, 20 nt, Yersinia pestis
uaggguuguuggucagcaga

SEQ ID NO: 2269750 - RNA, 16 nt, Yersinia pestis
uaggcgcauaugaaaa

SEQ ID NO: 2269751 - RNA, 14 nt, Yersinia pestis
uagggaugaguguu

SEQ ID NO: 2269752 - RNA, 18 nt, Yersinia pestis
uagggauuuuaagcagcc

SEQ ID NO: 2269753 - RNA, 23 nt, Yersinia pestis
uaggaucgaaugaucagaggcug

SEQ ID NO: 2269754 - RNA, 23 nt, Yersinia pestis
uaggaggguguuuuuuugucuuu

SEQ ID NO: 2269755 - RNA, 22 nt, Yersinia pestis
uagagagaaaaaguauugcacu

SEQ ID NO: 2269756 - RNA, 21 nt, Yersinia pestis
uagacuuggcuuuuucuucca

SEQ ID NO: 2269757 - RNA, 17 nt, Yersinia pestis
uagacuguuuuauuaua

SEQ ID NO: 2269758 - RNA, 21 nt, Yersinia pestis
uagacuguuuuauuauauauu

SEQ ID NO: 2269759 - RNA, 20 nt, Yersinia pestis
uagacgucagauuagcuuua

SEQ ID NO: 2269760 - RNA, 20 nt, Yersinia pestis
uagacgucagauuaguuuua

SEQ ID NO: 2269761 - RNA, 13 nt, Yersinia pestis
uagacuaaaugua

SEQ ID NO: 2269762 - RNA, 20 nt, Yersinia pestis
uagacgacacaaaugcugug

SEQ ID NO: 2269763 - RNA, 21 nt, Yersinia pestis
uagacgcaucgaccacccgua

SEQ ID NO: 2269764 - RNA, 14 nt, Yersinia pestis
uagaccguagaaac

SEQ ID NO: 2269765 - RNA, 12 nt, Yersinia pestis
uagacgaaggca

SEQ ID NO: 2269766 - RNA, 17 nt, Yersinia pestis
uagacgacacaaaugcu

SEQ ID NO: 2269767 - RNA, 16 nt, Yersinia pestis
uagaccaaugaauuac

SEQ ID NO: 2269768 - RNA, 22 nt, Yersinia pestis
uagacagaagcguaaagcaccc

SEQ ID NO: 2269769 - RNA, 14 nt, Yersinia pestis
uagacaagcgcagu

SEQ ID NO: 2269770 - RNA, 16 nt, Yersinia pestis
uagacaguaacuaaag

SEQ ID NO: 2269771 - RNA, 22 nt, Yersinia pestis
uagacagcaguuaaugcuuaag

SEQ ID NO: 2269772 - RNA, 18 nt, Yersinia pestis
uagagauacuuccuucaa

SEQ ID NO: 2269773 - RNA, 14 nt, Yersinia pestis
uagagcacagcacu

SEQ ID NO: 2269774 - RNA, 15 nt, Yersinia pestis
uagagcagugcagca

SEQ ID NO: 2269775 - RNA, 17 nt, Yersinia pestis
uagagccuuuacgggcu

SEQ ID NO: 2269776 - RNA, 19 nt, Yersinia pestis
uagagcuuccagugcauua

SEQ ID NO: 2269777 - RNA, 16 nt, Yersinia pestis
uagauacugaaauaua

SEQ ID NO: 2269778 - RNA, 14 nt, Yersinia pestis
uagauacaauucac

SEQ ID NO: 2269779 - RNA, 17 nt, Yersinia pestis
uagauagccauaauaau

SEQ ID NO: 2269780 - RNA, 16 nt, Yersinia pestis
uagauagcaaucaaua

SEQ ID NO: 2269781 - RNA, 14 nt, Yersinia pestis
uagaguugauaaac

SEQ ID NO: 2269782 - RNA, 15 nt, Yersinia pestis
uagaguugauaaaca

SEQ ID NO: 2269783 - RNA, 13 nt, Yersinia pestis
uagagugagaaua

SEQ ID NO: 2269784 - RNA, 16 nt, Yersinia pestis
uagagugcauccagcg

SEQ ID NO: 2269785 - RNA, 23 nt, Yersinia pestis
uagaaauauaacugcgaccaaaa

SEQ ID NO: 2269786 - RNA, 23 nt, Yersinia pestis
uagaaauagcugcuucugaacca

SEQ ID NO: 2269787 - RNA, 23 nt, Yersinia pestis
uagaaaguauugcuaucaggcuc

SEQ ID NO: 2269788 - RNA, 22 nt, Yersinia pestis
uagaaauucaacuugccugaaa

SEQ ID NO: 2269789 - RNA, 19 nt, Yersinia pestis
uagaaccggaauaaaucag

SEQ ID NO: 2269790 - RNA, 21 nt, Yersinia pestis
uagaaaccaucaccgaggaua

SEQ ID NO: 2269791 - RNA, 13 nt, Yersinia pestis
uacuaucaucauc

SEQ ID NO: 2269792 - RNA, 14 nt, Yersinia pestis
uacuaucuauuauu

SEQ ID NO: 2269793 - RNA, 13 nt, Yersinia pestis
uagaaucugcugc

SEQ ID NO: 2269794 - RNA, 16 nt, Yersinia pestis
uagaauuuaagauacc

SEQ ID NO: 2269795 - RNA, 19 nt, Yersinia pestis
uagaauuuaagauaccagc

SEQ ID NO: 2269796 - RNA, 20 nt, Yersinia pestis
uagaauaaguugaugcagua

SEQ ID NO: 2269797 - RNA, 19 nt, Yersinia pestis
uagaauacaggguaaauua

SEQ ID NO: 2269798 - RNA, 20 nt, Yersinia pestis
uagaauacaggguaaauuau

SEQ ID NO: 2269799 - RNA, 14 nt, Yersinia pestis
uagaagcucauaug

SEQ ID NO: 2269800 - RNA, 21 nt, Yersinia pestis
uagaagguaaucagacugcug

SEQ ID NO: 2269801 - RNA, 21 nt, Yersinia pestis
uagaacuauuggucaaucuag

SEQ ID NO: 2269802 - RNA, 20 nt, Yersinia pestis
uacacuuucuuugaugcaua

SEQ ID NO: 2269803 - RNA, 22 nt, Yersinia pestis
uacacuuucuuugaugcauaug

SEQ ID NO: 2269804 - RNA, 23 nt, Yersinia pestis
uacacacccucaacucaaaacaa

SEQ ID NO: 2269805 - RNA, 17 nt, Yersinia pestis
uacacaaucaguaaaua

SEQ ID NO: 2269806 - RNA, 23 nt, Yersinia pestis
uacaauuuuuggucguauucaua

SEQ ID NO: 2269807 - RNA, 15 nt, Yersinia pestis
uacagcccaagagaa

SEQ ID NO: 2269808 - RNA, 17 nt, Yersinia pestis
uacagcccaagagaaau

SEQ ID NO: 2269809 - RNA, 17 nt, Yersinia pestis
uacagccggauaggcuu

SEQ ID NO: 2269810 - RNA, 22 nt, Yersinia pestis
uacagccggauaggcuuaauau

SEQ ID NO: 2269811 - RNA, 23 nt, Yersinia pestis
uacagcgcuuggugaugcugcug

SEQ ID NO: 2269812 - RNA, 18 nt, Yersinia pestis
uacagcaaacaucgguaa

SEQ ID NO: 2269813 - RNA, 13 nt, Yersinia pestis
uacagaucauuag

SEQ ID NO: 2269814 - RNA, 20 nt, Yersinia pestis
uacagauauauccaggcacu

SEQ ID NO: 2269815 - RNA, 17 nt, Yersinia pestis
uacaauagagaauagac

SEQ ID NO: 2269816 - RNA, 16 nt, Yersinia pestis
uacaaccuaccaccua

SEQ ID NO: 2269817 - RNA, 21 nt, Yersinia pestis
uacaaucucugggugcugcuc

SEQ ID NO: 2269818 - RNA, 18 nt, Yersinia pestis
uacaauccaaccuauaua

SEQ ID NO: 2269819 - RNA, 21 nt, Yersinia pestis
uacaaauaguaauaauuaauc

SEQ ID NO: 2269820 - RNA, 19 nt, Yersinia pestis
uacaaaguccacgugcuua

SEQ ID NO: 2269821 - RNA, 13 nt, Yersinia pestis
uacaacaauaaua

SEQ ID NO: 2269822 - RNA, 20 nt, Yersinia pestis
uacaacaacgggucacagcc

SEQ ID NO: 2269823 - RNA, 11 nt, Yersinia pestis
uacaaauauua

SEQ ID NO: 2269824 - RNA, 23 nt, Yersinia pestis
uacauuuagucuacgcucuacau

SEQ ID NO: 2269825 - RNA, 13 nt, Yersinia pestis
uacauuuaaacac

SEQ ID NO: 2269826 - RNA, 18 nt, Yersinia pestis
uacauuuaaacacucaau

SEQ ID NO: 2269827 - RNA, 22 nt, Yersinia pestis
uacauuuaaacacucaauaagu

SEQ ID NO: 2269828 - RNA, 22 nt, Yersinia pestis
uacauucgagcaacuuuuacug

SEQ ID NO: 2269829 - RNA, 12 nt, Yersinia pestis
uacauuccacaa

SEQ ID NO: 2269830 - RNA, 22 nt, Yersinia pestis
uacauuauuauuuacaaaccau

SEQ ID NO: 2269831 - RNA, 19 nt, Yersinia pestis
uaccaacucugaaguaaau

SEQ ID NO: 2269832 - RNA, 18 nt, Yersinia pestis
uaccaaaacgaacaaaau

SEQ ID NO: 2269833 - RNA, 16 nt, Yersinia pestis
uaccaaaacgccacca

SEQ ID NO: 2269834 - RNA, 15 nt, Yersinia pestis
uaccaaaauuuaaau

SEQ ID NO: 2269835 - RNA, 12 nt, Yersinia pestis
uaccaaacauuu

SEQ ID NO: 2269836 - RNA, 24 nt, Yersinia pestis
uaccaaggcaugauaggcacggca

SEQ ID NO: 2269837 - RNA, 14 nt, Yersinia pestis
uaccaauaaaaccu

SEQ ID NO: 2269838 - RNA, 15 nt, Yersinia pestis
uaccaagccaaauua

SEQ ID NO: 2269839 - RNA, 15 nt, Yersinia pestis
uaccaauaauuaauu

SEQ ID NO: 2269840 - RNA, 16 nt, Yersinia pestis
uaccaauggugcccau

SEQ ID NO: 2269841 - RNA, 16 nt, Yersinia pestis
uacaugauugaaaaac

SEQ ID NO: 2269842 - RNA, 17 nt, Yersinia pestis
uacaugauugaaaaaca

SEQ ID NO: 2269843 - RNA, 21 nt, Yersinia pestis
uacaucuccgcuauuuuccac

SEQ ID NO: 2269844 - RNA, 13 nt, Yersinia pestis
uacauccuaaaua

SEQ ID NO: 2269845 - RNA, 19 nt, Yersinia pestis
uacaucgccaguguugcca

SEQ ID NO: 2269846 - RNA, 13 nt, Yersinia pestis
uacauccaacuuc

SEQ ID NO: 2269847 - RNA, 22 nt, Yersinia pestis
uacauccaauuuuuucaucaua

SEQ ID NO: 2269848 - RNA, 22 nt, Yersinia pestis
uacaucagggugaccgcacugc

SEQ ID NO: 2269849 - RNA, 13 nt, Yersinia pestis
uacaucaggguga

SEQ ID NO: 2269850 - RNA, 13 nt, Yersinia pestis
uacaucacaccca

SEQ ID NO: 2269851 - RNA, 12 nt, Yersinia pestis
uacauauaucac

SEQ ID NO: 2269852 - RNA, 22 nt, Yersinia pestis
uacauauaauccaaaauaauau

SEQ ID NO: 2269853 - RNA, 14 nt, Yersinia pestis
uacaggccccuucu

SEQ ID NO: 2269854 - RNA, 18 nt, Yersinia pestis
uacaggggcguuauucuc

SEQ ID NO: 2269855 - RNA, 15 nt, Yersinia pestis
uacagggaagccggc

SEQ ID NO: 2269856 - RNA, 19 nt, Yersinia pestis
uacagggcgaauggaagau

SEQ ID NO: 2269857 - RNA, 13 nt, Yersinia pestis
uacccauuuuaau

SEQ ID NO: 2269858 - RNA, 22 nt, Yersinia pestis
uacccgucguacuuuaagcugc

SEQ ID NO: 2269859 - RNA, 17 nt, Yersinia pestis
uacccguaauauuucaa

SEQ ID NO: 2269860 - RNA, 17 nt, Yersinia pestis
uacccagccaagacuuu

SEQ ID NO: 2269861 - RNA, 22 nt, Yersinia pestis
uacccagcuucuuuuaaagaag

SEQ ID NO: 2269862 - RNA, 20 nt, Yersinia pestis
uaccaguuuuuuccugcugc

SEQ ID NO: 2269863 - RNA, 22 nt, Yersinia pestis
uaccaguuuuuuccugcugcug

SEQ ID NO: 2269864 - RNA, 19 nt, Yersinia pestis
uaccauauggaugaugcac

SEQ ID NO: 2269865 - RNA, 24 nt, Yersinia pestis
uaccauauccacgguauuaguauu

SEQ ID NO: 2269866 - RNA, 15 nt, Yersinia pestis
uaccacauuuccuau

SEQ ID NO: 2269867 - RNA, 15 nt, Yersinia pestis
uaccaauugauguca

SEQ ID NO: 2269868 - RNA, 12 nt, Yersinia pestis
uaccaauugaug

SEQ ID NO: 2269869 - RNA, 18 nt, Yersinia pestis
uaccaccaccaacagcau

SEQ ID NO: 2269870 - RNA, 16 nt, Yersinia pestis
uaccaccaccaacccg

SEQ ID NO: 2269871 - RNA, 16 nt, Yersinia pestis
uaccaccaccacaccg

SEQ ID NO: 2269872 - RNA, 20 nt, Yersinia pestis
uaccucaguuaucagggccu

SEQ ID NO: 2269873 - RNA, 16 nt, Yersinia pestis
uaccuccauauccugg

SEQ ID NO: 2269874 - RNA, 14 nt, Yersinia pestis
uaccguugggcuuu

SEQ ID NO: 2269875 - RNA, 20 nt, Yersinia pestis
uaccucacuggcuuuauuau

SEQ ID NO: 2269876 - RNA, 13 nt, Yersinia pestis
uaccugcucaacu

SEQ ID NO: 2269877 - RNA, 18 nt, Yersinia pestis
uaccugcgacaccguuga

SEQ ID NO: 2269878 - RNA, 14 nt, Yersinia pestis
uaccugccugcugc

SEQ ID NO: 2269879 - RNA, 16 nt, Yersinia pestis
uaccugccugcugcug

SEQ ID NO: 2269880 - RNA, 19 nt, Yersinia pestis
uaccugccugcugcugugg

SEQ ID NO: 2269881 - RNA, 20 nt, Yersinia pestis
uaccugcaccaaugacuaau

SEQ ID NO: 2269882 - RNA, 15 nt, Yersinia pestis
uaccugcaucaucac

SEQ ID NO: 2269883 - RNA, 15 nt, Yersinia pestis
uaccgucauccagca

SEQ ID NO: 2269884 - RNA, 21 nt, Yersinia pestis
uaccggcgguuaucacaucau

SEQ ID NO: 2269885 - RNA, 16 nt, Yersinia pestis
uaccggcauuggcugg

SEQ ID NO: 2269886 - RNA, 16 nt, Yersinia pestis
uaccgacaccaauacc

SEQ ID NO: 2269887 - RNA, 20 nt, Yersinia pestis
uaccgacaucaacagaggca

SEQ ID NO: 2269888 - RNA, 16 nt, Yersinia pestis
uaccggagcuggcauu

SEQ ID NO: 2269889 - RNA, 20 nt, Yersinia pestis
uaccgaucaaacagguaaaa

SEQ ID NO: 2269890 - RNA, 18 nt, Yersinia pestis
uaccgaguucucaccaag

SEQ ID NO: 2269891 - RNA, 18 nt, Yersinia pestis
uacgggugugcugggugu

SEQ ID NO: 2269892 - RNA, 19 nt, Yersinia pestis
uacgcucuccucuccccua

SEQ ID NO: 2269893 - RNA, 23 nt, Yersinia pestis
uacgcucgguuguucagcaccag

SEQ ID NO: 2269894 - RNA, 16 nt, Yersinia pestis
uacgguccauaaaauc

SEQ ID NO: 2269895 - RNA, 18 nt, Yersinia pestis
uacgguagcgauauccuu

SEQ ID NO: 2269896 - RNA, 17 nt, Yersinia pestis
uacggugccagcagcaa

SEQ ID NO: 2269897 - RNA, 15 nt, Yersinia pestis
uacgguguuugguga

SEQ ID NO: 2269898 - RNA, 20 nt, Yersinia pestis
uacguaaacgaguuuccagu

SEQ ID NO: 2269899 - RNA, 17 nt, Yersinia pestis
uacguaaauagguuuua

SEQ ID NO: 2269900 - RNA, 18 nt, Yersinia pestis
uacuaaauuagaaaacaa

SEQ ID NO: 2269901 - RNA, 17 nt, Yersinia pestis
uacuaaauuagaaaaca

SEQ ID NO: 2269902 - RNA, 17 nt, Yersinia pestis
uacguucaccuaaauuu

SEQ ID NO: 2269903 - RNA, 14 nt, Yersinia pestis
uacguugcagguca

SEQ ID NO: 2269904 - RNA, 14 nt, Yersinia pestis
uaccuuacuguauc

SEQ ID NO: 2269905 - RNA, 13 nt, Yersinia pestis
uaccuuaggcuug

SEQ ID NO: 2269906 - RNA, 21 nt, Yersinia pestis
uaccugucccguuccaaccgg

SEQ ID NO: 2269907 - RNA, 20 nt, Yersinia pestis
uacgagagaucguaggcuuu

SEQ ID NO: 2269908 - RNA, 19 nt, Yersinia pestis
uacgccugggcauacuguu

SEQ ID NO: 2269909 - RNA, 23 nt, Yersinia pestis
uacgcaacguaauaucugccacc

SEQ ID NO: 2269910 - RNA, 13 nt, Yersinia pestis
uacgcaaguaaaa

SEQ ID NO: 2269911 - RNA, 13 nt, Yersinia pestis
uacgccaagaggg

SEQ ID NO: 2269912 - RNA, 22 nt, Yersinia pestis
uacgccaccugagguuauugac

SEQ ID NO: 2269913 - RNA, 13 nt, Yersinia pestis
uacgccaccuucu

SEQ ID NO: 2269914 - RNA, 20 nt, Yersinia pestis
uacgccaccuucuuauuuau

SEQ ID NO: 2269915 - RNA, 13 nt, Yersinia pestis
uaauacucuguua

SEQ ID NO: 2269916 - RNA, 16 nt, Yersinia pestis
uaauacugucaaaauc

SEQ ID NO: 2269917 - RNA, 22 nt, Yersinia pestis
uaauacugcgguccuacccuuu

SEQ ID NO: 2269918 - RNA, 14 nt, Yersinia pestis
uaauacgaaauacu

SEQ ID NO: 2269919 - RNA, 18 nt, Yersinia pestis
uaauaccguuuucuuuca

SEQ ID NO: 2269920 - RNA, 20 nt, Yersinia pestis
uaauaccauuucuuauaucu

SEQ ID NO: 2269921 - RNA, 14 nt, Yersinia pestis
uaauaccacaacau

SEQ ID NO: 2269922 - RNA, 15 nt, Yersinia pestis
uaauaccacaccuua

SEQ ID NO: 2269923 - RNA, 14 nt, Yersinia pestis
uaauaauuccauga

SEQ ID NO: 2269924 - RNA, 20 nt, Yersinia pestis
uaauaauucugcuauuaauu

SEQ ID NO: 2269925 - RNA, 21 nt, Yersinia pestis
uaauaaugaacguugucaggc

SEQ ID NO: 2269926 - RNA, 20 nt, Yersinia pestis
uaauacaggcugacauuucu

SEQ ID NO: 2269927 - RNA, 13 nt, Yersinia pestis
uaauacaucauca

SEQ ID NO: 2269928 - RNA, 22 nt, Yersinia pestis
uaauaagugaucagcuaacaaa

SEQ ID NO: 2269929 - RNA, 14 nt, Yersinia pestis
uaauaagggcgcau

SEQ ID NO: 2269930 - RNA, 14 nt, Yersinia pestis
uaauaaguuaauaa

SEQ ID NO: 2269931 - RNA, 16 nt, Yersinia pestis
uaauaaguuaauaaug

SEQ ID NO: 2269932 - RNA, 22 nt, Yersinia pestis
uaauaaucuaaauuaauaucuu

SEQ ID NO: 2269933 - RNA, 15 nt, Yersinia pestis
uaauaacgaauuuca

SEQ ID NO: 2269934 - RNA, 13 nt, Yersinia pestis
uaauaaauuaaua

SEQ ID NO: 2269935 - RNA, 18 nt, Yersinia pestis
uaauaaacaugaauaaca

SEQ ID NO: 2269936 - RNA, 13 nt, Yersinia pestis
uaauaaaaucaaa

SEQ ID NO: 2269937 - RNA, 20 nt, Yersinia pestis
uaauaaaaccuuuacaauua

SEQ ID NO: 2269938 - RNA, 22 nt, Yersinia pestis
uaaggcccgcaguaauauguaa

SEQ ID NO: 2269939 - RNA, 14 nt, Yersinia pestis
uaaggagugccauc

SEQ ID NO: 2269940 - RNA, 20 nt, Yersinia pestis
uaaggcguuacccacauuaa

SEQ ID NO: 2269941 - RNA, 16 nt, Yersinia pestis
uaaggguaaaaucccc

SEQ ID NO: 2269942 - RNA, 15 nt, Yersinia pestis
uaaguaauaacucag

SEQ ID NO: 2269943 - RNA, 16 nt, Yersinia pestis
uaagguuagcuaugca

SEQ ID NO: 2269944 - RNA, 19 nt, Yersinia pestis
uaaggugaugaaugacugg

SEQ ID NO: 2269945 - RNA, 20 nt, Yersinia pestis
uaagguguuacaacaugaaa

SEQ ID NO: 2269946 - RNA, 20 nt, Yersinia pestis
uaaggucacuguuucgccuu

SEQ ID NO: 2269947 - RNA, 24 nt, Yersinia pestis
uaauaaaaaccaauggaaaauaca

SEQ ID NO: 2269948 - RNA, 20 nt, Yersinia pestis
uaauaaaaaaaaauaaaauu

SEQ ID NO: 2269949 - RNA, 14 nt, Yersinia pestis
uaauaaaaaacuga

SEQ ID NO: 2269950 - RNA, 16 nt, Yersinia pestis
uaauaaaaaacugacu

SEQ ID NO: 2269951 - RNA, 23 nt, Yersinia pestis
uaaguucagguugaaauaaauaa

SEQ ID NO: 2269952 - RNA, 22 nt, Yersinia pestis
uaaguuaucgucacuggcacca

SEQ ID NO: 2269953 - RNA, 15 nt, Yersinia pestis
uaaguccaagacaga

SEQ ID NO: 2269954 - RNA, 16 nt, Yersinia pestis
uaaguauuucaaauaa

SEQ ID NO: 2269955 - RNA, 14 nt, Yersinia pestis
uaagucaaauuuaa

SEQ ID NO: 2269956 - RNA, 18 nt, Yersinia pestis
uaagucaaauuuaaaguu

SEQ ID NO: 2269957 - RNA, 20 nt, Yersinia pestis
uaagucaaauuuaaaguuuu

SEQ ID NO: 2269958 - RNA, 15 nt, Yersinia pestis
uaaguauuucaaaua

SEQ ID NO: 2269959 - RNA, 14 nt, Yersinia pestis
uaagugcuaaucau

SEQ ID NO: 2269960 - RNA, 16 nt, Yersinia pestis
uaagugcgggaaagua

SEQ ID NO: 2269961 - RNA, 22 nt, Yersinia pestis
uaagugauucgggugagugagc

SEQ ID NO: 2269962 - RNA, 16 nt, Yersinia pestis
uaagugccaguuaaua

SEQ ID NO: 2269963 - RNA, 14 nt, Yersinia pestis
uaauagauaguacu

SEQ ID NO: 2269964 - RNA, 22 nt, Yersinia pestis
uaauaugcaaaaaaagacacua

SEQ ID NO: 2269965 - RNA, 15 nt, Yersinia pestis
uaauaugccaaaucu

SEQ ID NO: 2269966 - RNA, 12 nt, Yersinia pestis
uaaucaaacgau

SEQ ID NO: 2269967 - RNA, 13 nt, Yersinia pestis
uaauauuuucauc

SEQ ID NO: 2269968 - RNA, 15 nt, Yersinia pestis
uaaucauaucaaaau

SEQ ID NO: 2269969 - RNA, 17 nt, Yersinia pestis
uaaucauaucaaaauaa

SEQ ID NO: 2269970 - RNA, 17 nt, Yersinia pestis
uaaucauauuuuccugc

SEQ ID NO: 2269971 - RNA, 13 nt, Yersinia pestis
uaauccacccggc

SEQ ID NO: 2269972 - RNA, 15 nt, Yersinia pestis
uaaucaguuucaggc

SEQ ID NO: 2269973 - RNA, 21 nt, Yersinia pestis
uaaucaauccuacauucagua

SEQ ID NO: 2269974 - RNA, 16 nt, Yersinia pestis
uaaucaagccuucauu

SEQ ID NO: 2269975 - RNA, 14 nt, Yersinia pestis
uaaucaauuaaaua

SEQ ID NO: 2269976 - RNA, 22 nt, Yersinia pestis
uaaucgucccacaugaacucaa

SEQ ID NO: 2269977 - RNA, 21 nt, Yersinia pestis
uaaucuaauuucaaaugaacu

SEQ ID NO: 2269978 - RNA, 14 nt, Yersinia pestis
uaaucuauuaauau

SEQ ID NO: 2269979 - RNA, 18 nt, Yersinia pestis
uaaucgcgcauuucuucu

SEQ ID NO: 2269980 - RNA, 23 nt, Yersinia pestis
uaaucgccugcugagccaaauaa

SEQ ID NO: 2269981 - RNA, 21 nt, Yersinia pestis
uaaucgccagcaaaucacauu

SEQ ID NO: 2269982 - RNA, 21 nt, Yersinia pestis
uaaucgccugaugcuuuucuu

SEQ ID NO: 2269983 - RNA, 22 nt, Yersinia pestis
uaaucgccgccuccgauucaua

SEQ ID NO: 2269984 - RNA, 20 nt, Yersinia pestis
uaauccccggucacuuaaau

SEQ ID NO: 2269985 - RNA, 16 nt, Yersinia pestis
uaaucgauaaaaagaa

SEQ ID NO: 2269986 - RNA, 17 nt, Yersinia pestis
uaaucgauaaaaagaau

SEQ ID NO: 2269987 - RNA, 14 nt, Yersinia pestis
uaaucgauaaugga

SEQ ID NO: 2269988 - RNA, 15 nt, Yersinia pestis
uaaucgcagcagaga

SEQ ID NO: 2269989 - RNA, 23 nt, Yersinia pestis
uaauccccaggugcuuauuuauu

SEQ ID NO: 2269990 - RNA, 22 nt, Yersinia pestis
uaaucccaccggggagcacuau

SEQ ID NO: 2269991 - RNA, 21 nt, Yersinia pestis
uaauguguuuuugucauuuaa

SEQ ID NO: 2269992 - RNA, 15 nt, Yersinia pestis
uaauguuuauauuga

SEQ ID NO: 2269993 - RNA, 12 nt, Yersinia pestis
uaauguugaucu

SEQ ID NO: 2269994 - RNA, 14 nt, Yersinia pestis
uaaugucuuuacua

SEQ ID NO: 2269995 - RNA, 17 nt, Yersinia pestis
uaaugucuuuacuaaau

SEQ ID NO: 2269996 - RNA, 23 nt, Yersinia pestis
uaauuacuuuauuuaaaauuaau

SEQ ID NO: 2269997 - RNA, 18 nt, Yersinia pestis
uaauuaacagcaucacug

SEQ ID NO: 2269998 - RNA, 20 nt, Yersinia pestis
uaauuaacacccaauaauaa

SEQ ID NO: 2269999 - RNA, 15 nt, Yersinia pestis
uaauuaaauauuaac

SEQ ID NO: 2270000 - RNA, 17 nt, Yersinia pestis
uaauuaaauguauaaaa

SEQ ID NO: 2270001 - RNA, 20 nt, Yersinia pestis
uaauuaaauguauaaaaaag

SEQ ID NO: 2270002 - RNA, 13 nt, Yersinia pestis
uaauuaaaugacu

SEQ ID NO: 2270003 - RNA, 17 nt, Yersinia pestis
uaauuaaacgcucauca

SEQ ID NO: 2270004 - RNA, 20 nt, Yersinia pestis
uaauuaaacgcucaucaacc

SEQ ID NO: 2270005 - RNA, 21 nt, Yersinia pestis
uaauguacaccuaaaacauac

SEQ ID NO: 2270006 - RNA, 14 nt, Yersinia pestis
uaauguaauaaucu

SEQ ID NO: 2270007 - RNA, 21 nt, Yersinia pestis
uaauggauugaucauucucug

SEQ ID NO: 2270008 - RNA, 19 nt, Yersinia pestis
uaaugguuuccauaauggu

SEQ ID NO: 2270009 - RNA, 20 nt, Yersinia pestis
uaaugguuuccauaaugguu

SEQ ID NO: 2270010 - RNA, 12 nt, Yersinia pestis
uaauggauagcu

SEQ ID NO: 2270011 - RNA, 20 nt, Yersinia pestis
uaauggcaccaucggcucua

SEQ ID NO: 2270012 - RNA, 23 nt, Yersinia pestis
uaaugcuguuguagcgccaggua

SEQ ID NO: 2270013 - RNA, 19 nt, Yersinia pestis
uaauucuggguacaacaca

SEQ ID NO: 2270014 - RNA, 16 nt, Yersinia pestis
uaauucugcuauuaau

SEQ ID NO: 2270015 - RNA, 19 nt, Yersinia pestis
uaauucaugcuaauaccac

SEQ ID NO: 2270016 - RNA, 13 nt, Yersinia pestis
uaauucauuauua

SEQ ID NO: 2270017 - RNA, 17 nt, Yersinia pestis
uaauuccaugcaaaaua

SEQ ID NO: 2270018 - RNA, 21 nt, Yersinia pestis
uaauuauaauccacugaaaua

SEQ ID NO: 2270019 - RNA, 17 nt, Yersinia pestis
uaauuauaccuacccuu

SEQ ID NO: 2270020 - RNA, 22 nt, Yersinia pestis
uaauugaauugccccccaauau

SEQ ID NO: 2270021 - RNA, 21 nt, Yersinia pestis
uaauugaagauuuaaauaaca

SEQ ID NO: 2270022 - RNA, 17 nt, Yersinia pestis
uaauugaagauuuaaau

SEQ ID NO: 2270023 - RNA, 20 nt, Yersinia pestis
uaauugaagauuuaaauaac

SEQ ID NO: 2270024 - RNA, 18 nt, Yersinia pestis
uaauugauauuauuuaua

SEQ ID NO: 2270025 - RNA, 15 nt, Yersinia pestis
uaauuggcaauaaug

SEQ ID NO: 2270026 - RNA, 23 nt, Yersinia pestis
gggauauacccuauaggcucaau

SEQ ID NO: 2270027 - RNA, 12 nt, Yersinia pestis
gggauaucucac

SEQ ID NO: 2270028 - RNA, 15 nt, Yersinia pestis
gggauauuaauucca

SEQ ID NO: 2270029 - RNA, 11 nt, Yersinia pestis
gggaugcccac

SEQ ID NO: 2270030 - RNA, 23 nt, Yersinia pestis
gggaugauagcuucucgcaccag

SEQ ID NO: 2270031 - RNA, 21 nt, Yersinia pestis
gggcacaacaagcggccagcu

SEQ ID NO: 2270032 - RNA, 21 nt, Yersinia pestis
gggaaaucaaagacuaaccuc

SEQ ID NO: 2270033 - RNA, 22 nt, Yersinia pestis
gggaaauagcaacuaaacacga

SEQ ID NO: 2270034 - RNA, 15 nt, Yersinia pestis
gggagccgcccugca

SEQ ID NO: 2270035 - RNA, 21 nt, Yersinia pestis
gggaguauacggucaaaagcu

SEQ ID NO: 2270036 - RNA, 14 nt, Yersinia pestis
gggaguuacucagc

SEQ ID NO: 2270037 - RNA, 11 nt, Yersinia pestis
gggcaguaacg

SEQ ID NO: 2270038 - RNA, 18 nt, Yersinia pestis
gggcaucgaaaagcgccu

SEQ ID NO: 2270039 - RNA, 16 nt, Yersinia pestis
gggcauugcagacugc

SEQ ID NO: 2270040 - RNA, 17 nt, Yersinia pestis
gggccuguuugcagcga

SEQ ID NO: 2270041 - RNA, 18 nt, Yersinia pestis
gggccuuuauucauucag

SEQ ID NO: 2270042 - RNA, 10 nt, Yersinia pestis
gggcgccccg

SEQ ID NO: 2270043 - RNA, 15 nt, Yersinia pestis
gggcugccaguaaaa

SEQ ID NO: 2270044 - RNA, 16 nt, Yersinia pestis
gggcuuuuggggcgcu

SEQ ID NO: 2270045 - RNA, 18 nt, Yersinia pestis
ggggaaagcaauacgcca

SEQ ID NO: 2270046 - RNA, 13 nt, Yersinia pestis
gggcguucuguca

SEQ ID NO: 2270047 - RNA, 16 nt, Yersinia pestis
gggcgguaguauuugu

SEQ ID NO: 2270048 - RNA, 20 nt, Yersinia pestis
gggcgcugagguucuccaac

SEQ ID NO: 2270049 - RNA, 19 nt, Yersinia pestis
gggcgcggguaauggcggu

SEQ ID NO: 2270050 - RNA, 12 nt, Yersinia pestis
ggcugaugguca

SEQ ID NO: 2270051 - RNA, 19 nt, Yersinia pestis
ggcugauucacuggcaaaa

SEQ ID NO: 2270052 - RNA, 17 nt, Yersinia pestis
ggcugauuaccugcauc

SEQ ID NO: 2270053 - RNA, 14 nt, Yersinia pestis
ggcugauuaauauc

SEQ ID NO: 2270054 - RNA, 23 nt, Yersinia pestis
ggcucugcgaccaaggcucuggc

SEQ ID NO: 2270055 - RNA, 14 nt, Yersinia pestis
ggcucugaaacgcu

SEQ ID NO: 2270056 - RNA, 22 nt, Yersinia pestis
ggcucuggccagcgucuucagu

SEQ ID NO: 2270057 - RNA, 17 nt, Yersinia pestis
ggcucgcugguggcuug

SEQ ID NO: 2270058 - RNA, 18 nt, Yersinia pestis
ggcucgcugguggcuuga

SEQ ID NO: 2270059 - RNA, 14 nt, Yersinia pestis
ggcucgagccgcgc

SEQ ID NO: 2270060 - RNA, 20 nt, Yersinia pestis
ggcucgagccuacauggaug

SEQ ID NO: 2270061 - RNA, 12 nt, Yersinia pestis
ggcucgaaccug

SEQ ID NO: 2270062 - RNA, 14 nt, Yersinia pestis
ggcucgaagcgcgc

SEQ ID NO: 2270063 - RNA, 18 nt, Yersinia pestis
ggcucccccuugauucac

SEQ ID NO: 2270064 - RNA, 13 nt, Yersinia pestis
ggcucauuuuuug

SEQ ID NO: 2270065 - RNA, 13 nt, Yersinia pestis
ggcucaaauagca

SEQ ID NO: 2270066 - RNA, 20 nt, Yersinia pestis
ggcucacacacuaauaauaa

SEQ ID NO: 2270067 - RNA, 21 nt, Yersinia pestis
ggcucaauccaaaugacacuu

SEQ ID NO: 2270068 - RNA, 21 nt, Yersinia pestis
ggcucagauaauaacgauccg

SEQ ID NO: 2270069 - RNA, 19 nt, Yersinia pestis
ggcucagcacaaacauggc

SEQ ID NO: 2270070 - RNA, 14 nt, Yersinia pestis
ggcucagcauggaa

SEQ ID NO: 2270071 - RNA, 16 nt, Yersinia pestis
ggcuuuuuuaauaaaa

SEQ ID NO: 2270072 - RNA, 19 nt, Yersinia pestis
ggcuuuuuuacgcgccugc

SEQ ID NO: 2270073 - RNA, 15 nt, Yersinia pestis
gggaaacaguaaauu

SEQ ID NO: 2270074 - RNA, 12 nt, Yersinia pestis
ggcuuuaauauc

SEQ ID NO: 2270075 - RNA, 17 nt, Yersinia pestis
ggcuuuaagauccaguu

SEQ ID NO: 2270076 - RNA, 19 nt, Yersinia pestis
ggcuuuaccuuacguaaac

SEQ ID NO: 2270077 - RNA, 16 nt, Yersinia pestis
ggcuuggcaugacauc

SEQ ID NO: 2270078 - RNA, 15 nt, Yersinia pestis
ggcuugguuguuucu

SEQ ID NO: 2270079 - RNA, 15 nt, Yersinia pestis
ggcuugggagucaga

SEQ ID NO: 2270080 - RNA, 15 nt, Yersinia pestis
ggcuucgcuguagga

SEQ ID NO: 2270081 - RNA, 21 nt, Yersinia pestis
ggcuguuguaguuagaugaca

SEQ ID NO: 2270082 - RNA, 16 nt, Yersinia pestis
ggcuguauucacguau

SEQ ID NO: 2270083 - RNA, 14 nt, Yersinia pestis
ggcuggggcaagcu

SEQ ID NO: 2270084 - RNA, 13 nt, Yersinia pestis
ggcugccugccug

SEQ ID NO: 2270085 - RNA, 16 nt, Yersinia pestis
ggcugcugcagccggg

SEQ ID NO: 2270086 - RNA, 18 nt, Yersinia pestis
ggcuggcauuuuuuaugu

SEQ ID NO: 2270087 - RNA, 16 nt, Yersinia pestis
ggcuggaucagcagac

SEQ ID NO: 2270088 - RNA, 18 nt, Yersinia pestis
ggcuggaaaaaauaaugg

SEQ ID NO: 2270089 - RNA, 22 nt, Yersinia pestis
ggcuggaaaaaauaauggccaa

SEQ ID NO: 2270090 - RNA, 21 nt, Yersinia pestis
ggcuggcccaaugcugucacu

SEQ ID NO: 2270091 - RNA, 20 nt, Yersinia pestis
gguacaauucgcaagaagcg

SEQ ID NO: 2270092 - RNA, 13 nt, Yersinia pestis
gguaaucaugggg

SEQ ID NO: 2270093 - RNA, 20 nt, Yersinia pestis
gguaaucgacggaaacagca

SEQ ID NO: 2270094 - RNA, 17 nt, Yersinia pestis
gguaauuaauauauaaa

SEQ ID NO: 2270095 - RNA, 21 nt, Yersinia pestis
gguaauuaauauauaaaauaa

SEQ ID NO: 2270096 - RNA, 17 nt, Yersinia pestis
gguaaugacauauucaa

SEQ ID NO: 2270097 - RNA, 15 nt, Yersinia pestis
gguaauaccaaugcu

SEQ ID NO: 2270098 - RNA, 14 nt, Yersinia pestis
gguaagucagcggg

SEQ ID NO: 2270099 - RNA, 16 nt, Yersinia pestis
gguaauaaugcucggc

SEQ ID NO: 2270100 - RNA, 21 nt, Yersinia pestis
gguaauaucgguaaaaaauca

SEQ ID NO: 2270101 - RNA, 17 nt, Yersinia pestis
gguaaucagacugcuga

SEQ ID NO: 2270102 - RNA, 15 nt, Yersinia pestis
gguaaucagacugcu

SEQ ID NO: 2270103 - RNA, 14 nt, Yersinia pestis
gguagaacugcggc

SEQ ID NO: 2270104 - RNA, 16 nt, Yersinia pestis
gguagaccaccaacuc

SEQ ID NO: 2270105 - RNA, 17 nt, Yersinia pestis
gguacugaucauuauua

SEQ ID NO: 2270106 - RNA, 20 nt, Yersinia pestis
gguaccgggccauagcccau

SEQ ID NO: 2270107 - RNA, 17 nt, Yersinia pestis
gguaccugaucagcauu

SEQ ID NO: 2270108 - RNA, 19 nt, Yersinia pestis
gguacgaugggccgugucg

SEQ ID NO: 2270109 - RNA, 15 nt, Yersinia pestis
gguacggccagcaau

SEQ ID NO: 2270110 - RNA, 13 nt, Yersinia pestis
gguaguaauaauu

SEQ ID NO: 2270111 - RNA, 19 nt, Yersinia pestis
gguagguuucugggcuggc

SEQ ID NO: 2270112 - RNA, 21 nt, Yersinia pestis
gguagucauauucaggcuggg

SEQ ID NO: 2270113 - RNA, 17 nt, Yersinia pestis
gguagugacucaucaaa

SEQ ID NO: 2270114 - RNA, 15 nt, Yersinia pestis
gguaucgauaugaac

SEQ ID NO: 2270115 - RNA, 19 nt, Yersinia pestis
ggucagccaacgacaggua

SEQ ID NO: 2270116 - RNA, 18 nt, Yersinia pestis
gguauucagccaaaucau

SEQ ID NO: 2270117 - RNA, 17 nt, Yersinia pestis
gguauuccgagcaauca

SEQ ID NO: 2270118 - RNA, 18 nt, Yersinia pestis
ggucacccucaagagcga

SEQ ID NO: 2270119 - RNA, 12 nt, Yersinia pestis
gguaucuuugcu

SEQ ID NO: 2270120 - RNA, 20 nt, Yersinia pestis
gguaucucccgcaaagccug

SEQ ID NO: 2270121 - RNA, 19 nt, Yersinia pestis
gguauggcgcuuaacugca

SEQ ID NO: 2270122 - RNA, 13 nt, Yersinia pestis
gggucgugcggga

SEQ ID NO: 2270123 - RNA, 12 nt, Yersinia pestis
ggggaccagcac

SEQ ID NO: 2270124 - RNA, 20 nt, Yersinia pestis
gggucagugaaaaaugagaa

SEQ ID NO: 2270125 - RNA, 11 nt, Yersinia pestis
ggguaucuguu

SEQ ID NO: 2270126 - RNA, 16 nt, Yersinia pestis
ggguauuccacccgca

SEQ ID NO: 2270127 - RNA, 16 nt, Yersinia pestis
ggguaucagcgaccaa

SEQ ID NO: 2270128 - RNA, 20 nt, Yersinia pestis
gguaaaaggcccgcuaguga

SEQ ID NO: 2270129 - RNA, 14 nt, Yersinia pestis
gguaaaauccccau

SEQ ID NO: 2270130 - RNA, 17 nt, Yersinia pestis
gguaaaugauggcggcu

SEQ ID NO: 2270131 - RNA, 19 nt, Yersinia pestis
gguaaagaagcauagaaau

SEQ ID NO: 2270132 - RNA, 12 nt, Yersinia pestis
gguaagaaagag

SEQ ID NO: 2270133 - RNA, 18 nt, Yersinia pestis
gguaaguaauugaagugg

SEQ ID NO: 2270134 - RNA, 11 nt, Yersinia pestis
gguaaggcaaa

SEQ ID NO: 2270135 - RNA, 22 nt, Yersinia pestis
gguaaggccgcgauaaaaaaua

SEQ ID NO: 2270136 - RNA, 18 nt, Yersinia pestis
gguaacuuacaggcugcc

SEQ ID NO: 2270137 - RNA, 21 nt, Yersinia pestis
gguaaccugaaagucaggauu

SEQ ID NO: 2270138 - RNA, 16 nt, Yersinia pestis
gguaaccccggcggcu

SEQ ID NO: 2270139 - RNA, 12 nt, Yersinia pestis
gguaacccuuug

SEQ ID NO: 2270140 - RNA, 22 nt, Yersinia pestis
gguaacagagccuuauaggcgc

SEQ ID NO: 2270141 - RNA, 19 nt, Yersinia pestis
ggguucuaaauccugcaaa

SEQ ID NO: 2270142 - RNA, 15 nt, Yersinia pestis
ggguuugagcagugc

SEQ ID NO: 2270143 - RNA, 15 nt, Yersinia pestis
ggguuccaacugaua

SEQ ID NO: 2270144 - RNA, 12 nt, Yersinia pestis
ggguuaaauagu

SEQ ID NO: 2270145 - RNA, 24 nt, Yersinia pestis
ggguggccgccgcggugaagaaca

SEQ ID NO: 2270146 - RNA, 20 nt, Yersinia pestis
gguggcgucaaagcgguggu

SEQ ID NO: 2270147 - RNA, 14 nt, Yersinia pestis
gguggcucaaucca

SEQ ID NO: 2270148 - RNA, 23 nt, Yersinia pestis
gguggcgauaaagagugaaauau

SEQ ID NO: 2270149 - RNA, 14 nt, Yersinia pestis
ggugccucaacgca

SEQ ID NO: 2270150 - RNA, 21 nt, Yersinia pestis
ggugaguuacgugagcaucug

SEQ ID NO: 2270151 - RNA, 19 nt, Yersinia pestis
ggugaaccaucaacaauuc

SEQ ID NO: 2270152 - RNA, 15 nt, Yersinia pestis
ggugaagaaaccuaa

SEQ ID NO: 2270153 - RNA, 22 nt, Yersinia pestis
ggucuuucgcccacaaccaggc

SEQ ID NO: 2270154 - RNA, 16 nt, Yersinia pestis
ggucgugaaagcagaa

SEQ ID NO: 2270155 - RNA, 13 nt, Yersinia pestis
ggucgcugggccu

SEQ ID NO: 2270156 - RNA, 16 nt, Yersinia pestis
ggucgauuacauacuu

SEQ ID NO: 2270157 - RNA, 18 nt, Yersinia pestis
ggucgcacugugagcggc

SEQ ID NO: 2270158 - RNA, 21 nt, Yersinia pestis
ggucgaacccauucaucaaac

SEQ ID NO: 2270159 - RNA, 18 nt, Yersinia pestis
guaagcucuacuaauauu

SEQ ID NO: 2270160 - RNA, 14 nt, Yersinia pestis
guaaguaaaaagga

SEQ ID NO: 2270161 - RNA, 18 nt, Yersinia pestis
guaagggaaauugucugg

SEQ ID NO: 2270162 - RNA, 14 nt, Yersinia pestis
guaagcaugccauc

SEQ ID NO: 2270163 - RNA, 21 nt, Yersinia pestis
guaagccgugccugcuggcaa

SEQ ID NO: 2270164 - RNA, 21 nt, Yersinia pestis
guaagcgcuggcuuaauuggc

SEQ ID NO: 2270165 - RNA, 23 nt, Yersinia pestis
guaauaguuaaucgcagcagaga

SEQ ID NO: 2270166 - RNA, 22 nt, Yersinia pestis
guaaucaacacauaaaaucagc

SEQ ID NO: 2270167 - RNA, 22 nt, Yersinia pestis
guaaucgacggaaacagcacgg

SEQ ID NO: 2270168 - RNA, 14 nt, Yersinia pestis
guaagugauucggg

SEQ ID NO: 2270169 - RNA, 17 nt, Yersinia pestis
guaacauuacuuugaau

SEQ ID NO: 2270170 - RNA, 17 nt, Yersinia pestis
guaacauuuguauuuuu

SEQ ID NO: 2270171 - RNA, 21 nt, Yersinia pestis
guaacgaacgcucuuuaacaa

SEQ ID NO: 2270172 - RNA, 17 nt, Yersinia pestis
guaaccugaaagucagg

SEQ ID NO: 2270173 - RNA, 22 nt, Yersinia pestis
guaacgaaucugcacuguaauu

SEQ ID NO: 2270174 - RNA, 18 nt, Yersinia pestis
guaacgaauucagcagcg

SEQ ID NO: 2270175 - RNA, 18 nt, Yersinia pestis
guaacgccgcuaaaucau

SEQ ID NO: 2270176 - RNA, 16 nt, Yersinia pestis
guaagaauaaauaaua

SEQ ID NO: 2270177 - RNA, 21 nt, Yersinia pestis
guaagaauaaauaauaucaau

SEQ ID NO: 2270178 - RNA, 17 nt, Yersinia pestis
guaagaccaauugguaa

SEQ ID NO: 2270179 - RNA, 19 nt, Yersinia pestis
guaacuuuuuguugcacca

SEQ ID NO: 2270180 - RNA, 22 nt, Yersinia pestis
guaacuuuuuguugcaccaacg

SEQ ID NO: 2270181 - RNA, 19 nt, Yersinia pestis
guaagauccaccacaucau

SEQ ID NO: 2270182 - RNA, 21 nt, Yersinia pestis
guaagauaccaacccacucuu

SEQ ID NO: 2270183 - RNA, 15 nt, Yersinia pestis
guaacucaaugccaa

SEQ ID NO: 2270184 - RNA, 18 nt, Yersinia pestis
guaacuauuuacauaaua

SEQ ID NO: 2270185 - RNA, 20 nt, Yersinia pestis
guaacguccaacugacgcca

SEQ ID NO: 2270186 - RNA, 18 nt, Yersinia pestis
guaacuguguuugauuaa

SEQ ID NO: 2270187 - RNA, 17 nt, Yersinia pestis
guaacuuacaggcugcc

SEQ ID NO: 2270188 - RNA, 16 nt, Yersinia pestis
guaacuguaaggccaa

SEQ ID NO: 2270189 - RNA, 17 nt, Yersinia pestis
guaaagguauagcgaua

SEQ ID NO: 2270190 - RNA, 15 nt, Yersinia pestis
guaaauacauggcga

SEQ ID NO: 2270191 - RNA, 12 nt, Yersinia pestis
guaaauccuucu

SEQ ID NO: 2270192 - RNA, 13 nt, Yersinia pestis
guaaauauaaaau

SEQ ID NO: 2270193 - RNA, 18 nt, Yersinia pestis
guaaauagucauauauuu

SEQ ID NO: 2270194 - RNA, 23 nt, Yersinia pestis
guaaauguacagucauuuacuga

SEQ ID NO: 2270195 - RNA, 15 nt, Yersinia pestis
guaaauggcuaaacu

SEQ ID NO: 2270196 - RNA, 18 nt, Yersinia pestis
guaaaugcuguaagaauu

SEQ ID NO: 2270197 - RNA, 14 nt, Yersinia pestis
guaaauuagccacu

SEQ ID NO: 2270198 - RNA, 21 nt, Yersinia pestis
guaaauguacagucauuuacu

SEQ ID NO: 2270199 - RNA, 19 nt, Yersinia pestis
guaacacuugaccaaccug

SEQ ID NO: 2270200 - RNA, 21 nt, Yersinia pestis
guaacacuucagacugaaagu

SEQ ID NO: 2270201 - RNA, 11 nt, Yersinia pestis
guaacagagcc

SEQ ID NO: 2270202 - RNA, 14 nt, Yersinia pestis
guaacagagccuua

SEQ ID NO: 2270203 - RNA, 15 nt, Yersinia pestis
guaacagagccuuau

SEQ ID NO: 2270204 - RNA, 13 nt, Yersinia pestis
guaacagagcaga

SEQ ID NO: 2270205 - RNA, 22 nt, Yersinia pestis
guaacagagcagaaagcagcag

SEQ ID NO: 2270206 - RNA, 12 nt, Yersinia pestis
guaacaggccau

SEQ ID NO: 2270207 - RNA, 20 nt, Yersinia pestis
guaacaauaauaucguguug

SEQ ID NO: 2270208 - RNA, 13 nt, Yersinia pestis
guaacacacagca

SEQ ID NO: 2270209 - RNA, 17 nt, Yersinia pestis
guaacacacagcagaca

SEQ ID NO: 2270210 - RNA, 16 nt, Yersinia pestis
guaaagcacccacacc

SEQ ID NO: 2270211 - RNA, 15 nt, Yersinia pestis
guaaagaacccccca

SEQ ID NO: 2270212 - RNA, 16 nt, Yersinia pestis
guaaacagacacagca

SEQ ID NO: 2270213 - RNA, 21 nt, Yersinia pestis
guaaaccuaacacguuaaauu

SEQ ID NO: 2270214 - RNA, 16 nt, Yersinia pestis
guaaacgcaucccagg

SEQ ID NO: 2270215 - RNA, 16 nt, Yersinia pestis
guaaaccguacauuaa

SEQ ID NO: 2270216 - RNA, 13 nt, Yersinia pestis
gguuaaacugacc

SEQ ID NO: 2270217 - RNA, 12 nt, Yersinia pestis
gguuaaagacau

SEQ ID NO: 2270218 - RNA, 22 nt, Yersinia pestis
gguuaacggucucuuucgggca

SEQ ID NO: 2270219 - RNA, 19 nt, Yersinia pestis
guaaaauuauugccgcaga

SEQ ID NO: 2270220 - RNA, 13 nt, Yersinia pestis
guaaaauuuaaag

SEQ ID NO: 2270221 - RNA, 14 nt, Yersinia pestis
guaaaauuuaaagu

SEQ ID NO: 2270222 - RNA, 16 nt, Yersinia pestis
guaaaauuuaaaguaa

SEQ ID NO: 2270223 - RNA, 20 nt, Yersinia pestis
guaguauuaacgaaauacuc

SEQ ID NO: 2270224 - RNA, 12 nt, Yersinia pestis
guaguaaaaccu

SEQ ID NO: 2270225 - RNA, 22 nt, Yersinia pestis
guaguaaaaccuagcugcugca

SEQ ID NO: 2270226 - RNA, 14 nt, Yersinia pestis
guagguuucugggc

SEQ ID NO: 2270227 - RNA, 22 nt, Yersinia pestis
guagugacguaaaaaggcagug

SEQ ID NO: 2270228 - RNA, 21 nt, Yersinia pestis
guagugccgccagugcuuccg

SEQ ID NO: 2270229 - RNA, 18 nt, Yersinia pestis
guaguuaagguuagcuau

SEQ ID NO: 2270230 - RNA, 17 nt, Yersinia pestis
guaguuacagcaaauac

SEQ ID NO: 2270231 - RNA, 22 nt, Yersinia pestis
guaguucagucgcgauaaaauu

SEQ ID NO: 2270232 - RNA, 12 nt, Yersinia pestis
guauaacucauc

SEQ ID NO: 2270233 - RNA, 12 nt, Yersinia pestis
guauaaauaccu

SEQ ID NO: 2270234 - RNA, 16 nt, Yersinia pestis
guauaaauagccugua

SEQ ID NO: 2270235 - RNA, 20 nt, Yersinia pestis
guauaaaaaagauaauaaaa

SEQ ID NO: 2270236 - RNA, 12 nt, Yersinia pestis
guauaaaaauag

SEQ ID NO: 2270237 - RNA, 14 nt, Yersinia pestis
guauaaaaauagcc

SEQ ID NO: 2270238 - RNA, 16 nt, Yersinia pestis
guagccugcacggcuc

SEQ ID NO: 2270239 - RNA, 14 nt, Yersinia pestis
guagcucagcuggu

SEQ ID NO: 2270240 - RNA, 12 nt, Yersinia pestis
guagcuaauaaa

SEQ ID NO: 2270241 - RNA, 14 nt, Yersinia pestis
guagcucagccugu

SEQ ID NO: 2270242 - RNA, 21 nt, Yersinia pestis
guaggcaauacaccgccagua

SEQ ID NO: 2270243 - RNA, 19 nt, Yersinia pestis
guaggcaucucugaagccu

SEQ ID NO: 2270244 - RNA, 13 nt, Yersinia pestis
guaggcaucugcc

SEQ ID NO: 2270245 - RNA, 20 nt, Yersinia pestis
guagcucggccccuaacuga

SEQ ID NO: 2270246 - RNA, 22 nt, Yersinia pestis
guaggcuuauuaugacaacuga

SEQ ID NO: 2270247 - RNA, 21 nt, Yersinia pestis
guagggauaaaucgcccaacc

SEQ ID NO: 2270248 - RNA, 20 nt, Yersinia pestis
guacguagcgauaacagaua

SEQ ID NO: 2270249 - RNA, 23 nt, Yersinia pestis
guacucauauuguccaaaggaag

SEQ ID NO: 2270250 - RNA, 13 nt, Yersinia pestis
guacuaucuauua

SEQ ID NO: 2270251 - RNA, 17 nt, Yersinia pestis
guaccggcuccugccgc

SEQ ID NO: 2270252 - RNA, 12 nt, Yersinia pestis
guacuguugaug

SEQ ID NO: 2270253 - RNA, 20 nt, Yersinia pestis
guacuguugaugcagaugac

SEQ ID NO: 2270254 - RNA, 22 nt, Yersinia pestis
guacuuccaauaagugauucga

SEQ ID NO: 2270255 - RNA, 18 nt, Yersinia pestis
guacuucagguaauaacg

SEQ ID NO: 2270256 - RNA, 18 nt, Yersinia pestis
guacugggaugaagaaau

SEQ ID NO: 2270257 - RNA, 21 nt, Yersinia pestis
guacuggaucacaaugcaaau

SEQ ID NO: 2270258 - RNA, 19 nt, Yersinia pestis
guagacuuuguacuucgaa

SEQ ID NO: 2270259 - RNA, 19 nt, Yersinia pestis
guagagcacuucauuuucu

SEQ ID NO: 2270260 - RNA, 21 nt, Yersinia pestis
guaaugguuaccaaaaagcaa

SEQ ID NO: 2270261 - RNA, 15 nt, Yersinia pestis
guacauuaaaugaau

SEQ ID NO: 2270262 - RNA, 20 nt, Yersinia pestis
guaccaaaucagcaagcugc

SEQ ID NO: 2270263 - RNA, 22 nt, Yersinia pestis
guaccaaaucagcaagcugcuc

SEQ ID NO: 2270264 - RNA, 16 nt, Yersinia pestis
guaaucguauucucaa

SEQ ID NO: 2270265 - RNA, 13 nt, Yersinia pestis
guaccgcagguca

SEQ ID NO: 2270266 - RNA, 13 nt, Yersinia pestis
guacccucauugg

SEQ ID NO: 2270267 - RNA, 19 nt, Yersinia pestis
guaccaaucuccaaugacc

SEQ ID NO: 2270268 - RNA, 14 nt, Yersinia pestis
guacccauuauucu

SEQ ID NO: 2270269 - RNA, 17 nt, Yersinia pestis
guacccgaucugagcca

SEQ ID NO: 2270270 - RNA, 16 nt, Yersinia pestis
gucgcacugauagcaa

SEQ ID NO: 2270271 - RNA, 13 nt, Yersinia pestis
gucgcacccaaac

SEQ ID NO: 2270272 - RNA, 15 nt, Yersinia pestis
guccuguuguggugg

SEQ ID NO: 2270273 - RNA, 20 nt, Yersinia pestis
gucgccaacauuuauuuauc

SEQ ID NO: 2270274 - RNA, 22 nt, Yersinia pestis
gucgcccugaauuucaauaaca

SEQ ID NO: 2270275 - RNA, 20 nt, Yersinia pestis
gucgcgggcacuuugucaau

SEQ ID NO: 2270276 - RNA, 14 nt, Yersinia pestis
gucgccucuggggc

SEQ ID NO: 2270277 - RNA, 23 nt, Yersinia pestis
guccugauucgcgaccagcagaa

SEQ ID NO: 2270278 - RNA, 15 nt, Yersinia pestis
guccuggccaaagcc

SEQ ID NO: 2270279 - RNA, 18 nt, Yersinia pestis
gucccgacuuuggcgcgc

SEQ ID NO: 2270280 - RNA, 17 nt, Yersinia pestis
guccauaaugagguuau

SEQ ID NO: 2270281 - RNA, 21 nt, Yersinia pestis
gucauuuccguuaacccaaag

SEQ ID NO: 2270282 - RNA, 12 nt, Yersinia pestis
gucauuuccugu

SEQ ID NO: 2270283 - RNA, 14 nt, Yersinia pestis
gucauuuccuguau

SEQ ID NO: 2270284 - RNA, 21 nt, Yersinia pestis
gucauuuccuguauuuccugu

SEQ ID NO: 2270285 - RNA, 14 nt, Yersinia pestis
gucauuuacugaug

SEQ ID NO: 2270286 - RNA, 13 nt, Yersinia pestis
gucauucacugug

SEQ ID NO: 2270287 - RNA, 22 nt, Yersinia pestis
gucauuccaaccuuguaacuuu

SEQ ID NO: 2270288 - RNA, 20 nt, Yersinia pestis
gucauucuugguggagccug

SEQ ID NO: 2270289 - RNA, 17 nt, Yersinia pestis
guauaucacuauuucag

SEQ ID NO: 2270290 - RNA, 16 nt, Yersinia pestis
guauauaccugucaua

SEQ ID NO: 2270291 - RNA, 21 nt, Yersinia pestis
guauauguugggaaauaacca

SEQ ID NO: 2270292 - RNA, 17 nt, Yersinia pestis
guauaugcugauaaaau

SEQ ID NO: 2270293 - RNA, 20 nt, Yersinia pestis
guauacaugccucugcuaac

SEQ ID NO: 2270294 - RNA, 23 nt, Yersinia pestis
guauacauuauuauuuacaaacc

SEQ ID NO: 2270295 - RNA, 20 nt, Yersinia pestis
guauaccccugcucacgcaa

SEQ ID NO: 2270296 - RNA, 20 nt, Yersinia pestis
guauacccgccgcaucuaaa

SEQ ID NO: 2270297 - RNA, 23 nt, Yersinia pestis
gucaaaaacccauuaaaaacaaa

SEQ ID NO: 2270298 - RNA, 23 nt, Yersinia pestis
guaucaaaacgccagauaugauc

SEQ ID NO: 2270299 - RNA, 17 nt, Yersinia pestis
guauauuggccugcaca

SEQ ID NO: 2270300 - RNA, 14 nt, Yersinia pestis
gucaacgauuguua

SEQ ID NO: 2270301 - RNA, 14 nt, Yersinia pestis
gucaacuaaacaga

SEQ ID NO: 2270302 - RNA, 14 nt, Yersinia pestis
gucaagacaacaaa

SEQ ID NO: 2270303 - RNA, 16 nt, Yersinia pestis
gucaaucgcucuucac

SEQ ID NO: 2270304 - RNA, 20 nt, Yersinia pestis
gucaaucuagaacuauuggu

SEQ ID NO: 2270305 - RNA, 12 nt, Yersinia pestis
gucaauuaaaaa

SEQ ID NO: 2270306 - RNA, 20 nt, Yersinia pestis
gucaccgauacuuccagugg

SEQ ID NO: 2270307 - RNA, 13 nt, Yersinia pestis
gucaccgcaggcc

SEQ ID NO: 2270308 - RNA, 19 nt, Yersinia pestis
gucaccgaacucgauaaua

SEQ ID NO: 2270309 - RNA, 13 nt, Yersinia pestis
gucacgucuucac

SEQ ID NO: 2270310 - RNA, 16 nt, Yersinia pestis
gucacugccaucucau

SEQ ID NO: 2270311 - RNA, 19 nt, Yersinia pestis
gucacugaugcuuggcccg

SEQ ID NO: 2270312 - RNA, 15 nt, Yersinia pestis
gucacucagaaaaca

SEQ ID NO: 2270313 - RNA, 17 nt, Yersinia pestis
gucacucagaaaacagc

SEQ ID NO: 2270314 - RNA, 20 nt, Yersinia pestis
gucacuaaauccaaaugccc

SEQ ID NO: 2270315 - RNA, 17 nt, Yersinia pestis
gucacuaaaacugaagc

SEQ ID NO: 2270316 - RNA, 16 nt, Yersinia pestis
gucacuaaaacugaag

SEQ ID NO: 2270317 - RNA, 17 nt, Yersinia pestis
gucacuuugggcugauc

SEQ ID NO: 2270318 - RNA, 22 nt, Yersinia pestis
gucacuucucugacacacaaau

SEQ ID NO: 2270319 - RNA, 20 nt, Yersinia pestis
gucacuuacugaucaauaaa

SEQ ID NO: 2270320 - RNA, 13 nt, Yersinia pestis
gucacugucagac

SEQ ID NO: 2270321 - RNA, 18 nt, Yersinia pestis
gucacugucagacaguuc

SEQ ID NO: 2270322 - RNA, 22 nt, Yersinia pestis
gucacuggcaccauuugcccug

SEQ ID NO: 2270323 - RNA, 13 nt, Yersinia pestis
gucagaaauaaau

SEQ ID NO: 2270324 - RNA, 13 nt, Yersinia pestis
gucagaaccuguu

SEQ ID NO: 2270325 - RNA, 16 nt, Yersinia pestis
gucagaaccuguuaca

SEQ ID NO: 2270326 - RNA, 15 nt, Yersinia pestis
gucagacugcugaca

SEQ ID NO: 2270327 - RNA, 19 nt, Yersinia pestis
gucagauuaguuuuagaug

SEQ ID NO: 2270328 - RNA, 20 nt, Yersinia pestis
gucagauuagucuuagacgu

SEQ ID NO: 2270329 - RNA, 21 nt, Yersinia pestis
gucagaugcugacgggcgcgg

SEQ ID NO: 2270330 - RNA, 15 nt, Yersinia pestis
gucagauaucugcuc

SEQ ID NO: 2270331 - RNA, 20 nt, Yersinia pestis
gucauguugaccaaacagaa

SEQ ID NO: 2270332 - RNA, 20 nt, Yersinia pestis
gucaugauagacagcaaacg

SEQ ID NO: 2270333 - RNA, 13 nt, Yersinia pestis
gucauuaacacau

SEQ ID NO: 2270334 - RNA, 22 nt, Yersinia pestis
gucauuaacguuguuauuucug

SEQ ID NO: 2270335 - RNA, 18 nt, Yersinia pestis
gucaugaugaauacgaua

SEQ ID NO: 2270336 - RNA, 16 nt, Yersinia pestis
gucaugcaauuacugc

SEQ ID NO: 2270337 - RNA, 19 nt, Yersinia pestis
gucaugauagacagcaaac

SEQ ID NO: 2270338 - RNA, 20 nt, Yersinia pestis
gucauaccggcggcacacug

SEQ ID NO: 2270339 - RNA, 13 nt, Yersinia pestis
gucaugaaaaucu

SEQ ID NO: 2270340 - RNA, 19 nt, Yersinia pestis
gucauaaauaaagauaccc

SEQ ID NO: 2270341 - RNA, 15 nt, Yersinia pestis
gucaggguaagcuga

SEQ ID NO: 2270342 - RNA, 18 nt, Yersinia pestis
gucagucaaugagccugc

SEQ ID NO: 2270343 - RNA, 18 nt, Yersinia pestis
gucagguuaauaccugca

SEQ ID NO: 2270344 - RNA, 23 nt, Yersinia pestis
gucaguugaauauuccauuuguc

SEQ ID NO: 2270345 - RNA, 20 nt, Yersinia pestis
gucaguuuuggcuugaaagc

SEQ ID NO: 2270346 - RNA, 23 nt, Yersinia pestis
gucaguguuucggcauugagcac

SEQ ID NO: 2270347 - RNA, 19 nt, Yersinia pestis
gucagugguuuuaucaaua

SEQ ID NO: 2270348 - RNA, 23 nt, Yersinia pestis
gucagugauucgggugagugagc

SEQ ID NO: 2270349 - RNA, 15 nt, Yersinia pestis
gucagugcuccaucu

SEQ ID NO: 2270350 - RNA, 18 nt, Yersinia pestis
gucagugcggccaccuau

SEQ ID NO: 2270351 - RNA, 12 nt, Yersinia pestis
gucagugguggu

SEQ ID NO: 2270352 - RNA, 16 nt, Yersinia pestis
gucagugguuuuauca

SEQ ID NO: 2270353 - RNA, 15 nt, Yersinia pestis
gucagucagggugaa

SEQ ID NO: 2270354 - RNA, 18 nt, Yersinia pestis
gucagccgcgaaaaacca

SEQ ID NO: 2270355 - RNA, 15 nt, Yersinia pestis
gucagccccugccag

SEQ ID NO: 2270356 - RNA, 13 nt, Yersinia pestis
gucagcacuucca

SEQ ID NO: 2270357 - RNA, 22 nt, Yersinia pestis
gucagcacaaacagcuuuuuaa

SEQ ID NO: 2270358 - RNA, 20 nt, Yersinia pestis
gucagcuggaacaagagauc

SEQ ID NO: 2270359 - RNA, 16 nt, Yersinia pestis
gucaggaaacuggcca

SEQ ID NO: 2270360 - RNA, 22 nt, Yersinia pestis
ggccuguuugcagcgaauugac

SEQ ID NO: 2270361 - RNA, 16 nt, Yersinia pestis
ggccuugaaacagcag

SEQ ID NO: 2270362 - RNA, 20 nt, Yersinia pestis
ggccuggguagacauggcaa

SEQ ID NO: 2270363 - RNA, 18 nt, Yersinia pestis
ggccugcaaacggcucau

SEQ ID NO: 2270364 - RNA, 21 nt, Yersinia pestis
ggccuaaugccgcgcccccag

SEQ ID NO: 2270365 - RNA, 20 nt, Yersinia pestis
ggccguuugcccuuuuugcg

SEQ ID NO: 2270366 - RNA, 22 nt, Yersinia pestis
ggccuaagccggucuuuuuaca

SEQ ID NO: 2270367 - RNA, 22 nt, Yersinia pestis
ggccuaucaucaccauucaaga

SEQ ID NO: 2270368 - RNA, 20 nt, Yersinia pestis
ggccuacuggugccugacug

SEQ ID NO: 2270369 - RNA, 17 nt, Yersinia pestis
ggccguguuuuucccua

SEQ ID NO: 2270370 - RNA, 12 nt, Yersinia pestis
ggccugagaacc

SEQ ID NO: 2270371 - RNA, 21 nt, Yersinia pestis
ggccuuucguuucugucugag

SEQ ID NO: 2270372 - RNA, 23 nt, Yersinia pestis
ggcgaaauugacuuuaaaaaaau

SEQ ID NO: 2270373 - RNA, 15 nt, Yersinia pestis
ggcgaaugcccugcu

SEQ ID NO: 2270374 - RNA, 19 nt, Yersinia pestis
ggcgaagggcgcagccccc

SEQ ID NO: 2270375 - RNA, 23 nt, Yersinia pestis
ggcgacguugcucccaucccuca

SEQ ID NO: 2270376 - RNA, 19 nt, Yersinia pestis
ggcgcaucgcgaucugaca

SEQ ID NO: 2270377 - RNA, 17 nt, Yersinia pestis
ggcgcacguucccaggc

SEQ ID NO: 2270378 - RNA, 14 nt, Yersinia pestis
ggcgcaauggaaga

SEQ ID NO: 2270379 - RNA, 14 nt, Yersinia pestis
ggcgcacaacugcg

SEQ ID NO: 2270380 - RNA, 12 nt, Yersinia pestis
ggcgauuucagc

SEQ ID NO: 2270381 - RNA, 17 nt, Yersinia pestis
ggcgauuucagcugcuu

SEQ ID NO: 2270382 - RNA, 14 nt, Yersinia pestis
ggcgaucucuucgg

SEQ ID NO: 2270383 - RNA, 12 nt, Yersinia pestis
ggcgauaaucuc

SEQ ID NO: 2270384 - RNA, 21 nt, Yersinia pestis
ggcgauacaacguaggccgag

SEQ ID NO: 2270385 - RNA, 18 nt, Yersinia pestis
ggcuacugguagcagcca

SEQ ID NO: 2270386 - RNA, 17 nt, Yersinia pestis
ggcuaauaccaggcugg

SEQ ID NO: 2270387 - RNA, 21 nt, Yersinia pestis
ggcuaauagcgucagucuugc

SEQ ID NO: 2270388 - RNA, 20 nt, Yersinia pestis
ggcuaucuuaugacgcugca

SEQ ID NO: 2270389 - RNA, 17 nt, Yersinia pestis
ggcuaucaucaaaggca

SEQ ID NO: 2270390 - RNA, 15 nt, Yersinia pestis
ggcuauauugcugag

SEQ ID NO: 2270391 - RNA, 21 nt, Yersinia pestis
ggcuauagaucggccaguaag

SEQ ID NO: 2270392 - RNA, 15 nt, Yersinia pestis
ggcguuaucggcgca

SEQ ID NO: 2270393 - RNA, 14 nt, Yersinia pestis
ggcguuauguaaaa

SEQ ID NO: 2270394 - RNA, 17 nt, Yersinia pestis
ggcguucccgcaggcgg

SEQ ID NO: 2270395 - RNA, 12 nt, Yersinia pestis
ggcguucuguca

SEQ ID NO: 2270396 - RNA, 13 nt, Yersinia pestis
ggcguuggggugg

SEQ ID NO: 2270397 - RNA, 15 nt, Yersinia pestis
ggcguuuaaugcccc

SEQ ID NO: 2270398 - RNA, 19 nt, Yersinia pestis
ggcuaaaacucaaauagau

SEQ ID NO: 2270399 - RNA, 23 nt, Yersinia pestis
ggcgugaguuccagccccaaaca

SEQ ID NO: 2270400 - RNA, 11 nt, Yersinia pestis
ggcguaaguac

SEQ ID NO: 2270401 - RNA, 22 nt, Yersinia pestis
ggcguaccauaguuuuucuccu

SEQ ID NO: 2270402 - RNA, 22 nt, Yersinia pestis
ggcgguuaaccgugauguucaa

SEQ ID NO: 2270403 - RNA, 16 nt, Yersinia pestis
ggcguagcuugauucg

SEQ ID NO: 2270404 - RNA, 23 nt, Yersinia pestis
ggcguagguaguggcugauacuc

SEQ ID NO: 2270405 - RNA, 14 nt, Yersinia pestis
ggcguauaaacaga

SEQ ID NO: 2270406 - RNA, 13 nt, Yersinia pestis
ggcgucaaagcgg

SEQ ID NO: 2270407 - RNA, 13 nt, Yersinia pestis
ggcgucagccgcg

SEQ ID NO: 2270408 - RNA, 19 nt, Yersinia pestis
ggcgguaaccccggcggcu

SEQ ID NO: 2270409 - RNA, 16 nt, Yersinia pestis
ggcgggaucuccagaa

SEQ ID NO: 2270410 - RNA, 23 nt, Yersinia pestis
ggcgggaacacgucuacuggcug

SEQ ID NO: 2270411 - RNA, 15 nt, Yersinia pestis
ggcgcuuacaugaug

SEQ ID NO: 2270412 - RNA, 22 nt, Yersinia pestis
ggcgcuuuguguauaaaccggu

SEQ ID NO: 2270413 - RNA, 13 nt, Yersinia pestis
ggcgcucggcagc

SEQ ID NO: 2270414 - RNA, 22 nt, Yersinia pestis
ggcgcguuacaccgaaauuaga

SEQ ID NO: 2270415 - RNA, 23 nt, Yersinia pestis
ggcgcguuucuuagcugauuuga

SEQ ID NO: 2270416 - RNA, 20 nt, Yersinia pestis
ggcgcucaauguuccucagg

SEQ ID NO: 2270417 - RNA, 18 nt, Yersinia pestis
ggcgcgcauaguauccau

SEQ ID NO: 2270418 - RNA, 14 nt, Yersinia pestis
ggcggcgagcacug

SEQ ID NO: 2270419 - RNA, 13 nt, Yersinia pestis
ggcggccucugcu

SEQ ID NO: 2270420 - RNA, 22 nt, Yersinia pestis
ggcggagagaacaggcagagcg

SEQ ID NO: 2270421 - RNA, 16 nt, Yersinia pestis
ggcggaugucagaugg

SEQ ID NO: 2270422 - RNA, 14 nt, Yersinia pestis
ggcggcagcacaga

SEQ ID NO: 2270423 - RNA, 12 nt, Yersinia pestis
ggcggccagcaa

SEQ ID NO: 2270424 - RNA, 19 nt, Yersinia pestis
ggcggccagcaagagcagc

SEQ ID NO: 2270425 - RNA, 23 nt, Yersinia pestis
ggcggccagugauguuggcaggu

SEQ ID NO: 2270426 - RNA, 18 nt, Yersinia pestis
ggccacuucgguggcccu

SEQ ID NO: 2270427 - RNA, 16 nt, Yersinia pestis
ggccacuucgguggcc

SEQ ID NO: 2270428 - RNA, 14 nt, Yersinia pestis
ggccacucaccuca

SEQ ID NO: 2270429 - RNA, 14 nt, Yersinia pestis
ggccacaggcugca

SEQ ID NO: 2270430 - RNA, 15 nt, Yersinia pestis
ggccacaggcugcau

SEQ ID NO: 2270431 - RNA, 16 nt, Yersinia pestis
ggccaauuuggccaau

SEQ ID NO: 2270432 - RNA, 22 nt, Yersinia pestis
ggccaauagaaaaacacuggca

SEQ ID NO: 2270433 - RNA, 15 nt, Yersinia pestis
ggccaauaggccccu

SEQ ID NO: 2270434 - RNA, 22 nt, Yersinia pestis
ggcccacgauuacguuuucuuu

SEQ ID NO: 2270435 - RNA, 18 nt, Yersinia pestis
ggccaugaaucaaauuau

SEQ ID NO: 2270436 - RNA, 13 nt, Yersinia pestis
ggccauuucuuag

SEQ ID NO: 2270437 - RNA, 16 nt, Yersinia pestis
ggccauuugcucuggc

SEQ ID NO: 2270438 - RNA, 14 nt, Yersinia pestis
ggcccaagccaucc

SEQ ID NO: 2270439 - RNA, 18 nt, Yersinia pestis
ggcccaaaugagcagcaa

SEQ ID NO: 2270440 - RNA, 14 nt, Yersinia pestis
ggccaucaucuuca

SEQ ID NO: 2270441 - RNA, 17 nt, Yersinia pestis
ggccaaguuuacuuugu

SEQ ID NO: 2270442 - RNA, 16 nt, Yersinia pestis
ggccaacugcuggcca

SEQ ID NO: 2270443 - RNA, 18 nt, Yersinia pestis
ggccaaccguagugaguc

SEQ ID NO: 2270444 - RNA, 15 nt, Yersinia pestis
ggccaacaggccccu

SEQ ID NO: 2270445 - RNA, 12 nt, Yersinia pestis
ggccaacauaau

SEQ ID NO: 2270446 - RNA, 22 nt, Yersinia pestis
ggcauuuuuuauguuuauauuc

SEQ ID NO: 2270447 - RNA, 24 nt, Yersinia pestis
ggcaucuuucaguuuuauuguaua

SEQ ID NO: 2270448 - RNA, 12 nt, Yersinia pestis
ggcaugcaacuu

SEQ ID NO: 2270449 - RNA, 13 nt, Yersinia pestis
ggcaucauccuca

SEQ ID NO: 2270450 - RNA, 16 nt, Yersinia pestis
ggcauccgccagccac

SEQ ID NO: 2270451 - RNA, 14 nt, Yersinia pestis
ggcauaaagguuug

SEQ ID NO: 2270452 - RNA, 16 nt, Yersinia pestis
ggcaucaaucagcggg

SEQ ID NO: 2270453 - RNA, 23 nt, Yersinia pestis
ggcacuuugucaauaaccucaca

SEQ ID NO: 2270454 - RNA, 21 nt, Yersinia pestis
ggcagguagggcggcccacuu

SEQ ID NO: 2270455 - RNA, 15 nt, Yersinia pestis
ggcagguaaauccuu

SEQ ID NO: 2270456 - RNA, 21 nt, Yersinia pestis
ggcagggcgcuuucuggguga

SEQ ID NO: 2270457 - RNA, 13 nt, Yersinia pestis
ggcaggggcgcgu

SEQ ID NO: 2270458 - RNA, 20 nt, Yersinia pestis
ggcagguuaaaguugauaaa

SEQ ID NO: 2270459 - RNA, 14 nt, Yersinia pestis
ggccguaucauggg

SEQ ID NO: 2270460 - RNA, 14 nt, Yersinia pestis
ggccgcuugccaau

SEQ ID NO: 2270461 - RNA, 18 nt, Yersinia pestis
ggccgcuaagucacgcac

SEQ ID NO: 2270462 - RNA, 20 nt, Yersinia pestis
ggccgcuacugguaauaaug

SEQ ID NO: 2270463 - RNA, 20 nt, Yersinia pestis
ggccgcuugccaaucacggu

SEQ ID NO: 2270464 - RNA, 20 nt, Yersinia pestis
ggccccuaaugcgcucacca

SEQ ID NO: 2270465 - RNA, 15 nt, Yersinia pestis
ggccgacucugcaug

SEQ ID NO: 2270466 - RNA, 19 nt, Yersinia pestis
ggccgccgcggugaagaac

SEQ ID NO: 2270467 - RNA, 21 nt, Yersinia pestis
ggacuucugcgaccugaucca

SEQ ID NO: 2270468 - RNA, 19 nt, Yersinia pestis
ggagaucgcucucacccug

SEQ ID NO: 2270469 - RNA, 17 nt, Yersinia pestis
ggagauuucagacugcu

SEQ ID NO: 2270470 - RNA, 17 nt, Yersinia pestis
ggacucuuaguuucuac

SEQ ID NO: 2270471 - RNA, 19 nt, Yersinia pestis
ggacggcggccuuauuggg

SEQ ID NO: 2270472 - RNA, 17 nt, Yersinia pestis
ggaggauauuuauuuua

SEQ ID NO: 2270473 - RNA, 19 nt, Yersinia pestis
ggaggagauuucagacugc

SEQ ID NO: 2270474 - RNA, 16 nt, Yersinia pestis
ggaguaauuaauaauc

SEQ ID NO: 2270475 - RNA, 12 nt, Yersinia pestis
ggaguaaagcgu

SEQ ID NO: 2270476 - RNA, 16 nt, Yersinia pestis
ggagugaugaaaccaa

SEQ ID NO: 2270477 - RNA, 17 nt, Yersinia pestis
ggagugcccgguaaagu

SEQ ID NO: 2270478 - RNA, 23 nt, Yersinia pestis
ggaguuacucagcauccuccuga

SEQ ID NO: 2270479 - RNA, 15 nt, Yersinia pestis
ggauacuggugucuu

SEQ ID NO: 2270480 - RNA, 17 nt, Yersinia pestis
ggauauuuauuuauccu

SEQ ID NO: 2270481 - RNA, 11 nt, Yersinia pestis
ggauauuucgg

SEQ ID NO: 2270482 - RNA, 14 nt, Yersinia pestis
ggaucaaauguccc

SEQ ID NO: 2270483 - RNA, 11 nt, Yersinia pestis
ggaucaacaug

SEQ ID NO: 2270484 - RNA, 22 nt, Yersinia pestis
ggaauaccaccccuucguccag

SEQ ID NO: 2270485 - RNA, 16 nt, Yersinia pestis
ggaauagagccucuau

SEQ ID NO: 2270486 - RNA, 14 nt, Yersinia pestis
ggaaugacuuucag

SEQ ID NO: 2270487 - RNA, 18 nt, Yersinia pestis
ggacaaauaaaacagaac

SEQ ID NO: 2270488 - RNA, 22 nt, Yersinia pestis
gcucgggcguaauaccggccug

SEQ ID NO: 2270489 - RNA, 16 nt, Yersinia pestis
gcucggcucgaaccug

SEQ ID NO: 2270490 - RNA, 21 nt, Yersinia pestis
ggaaguacuuauuugaaacac

SEQ ID NO: 2270491 - RNA, 21 nt, Yersinia pestis
ggaauaacugagccgcauaca

SEQ ID NO: 2270492 - RNA, 23 nt, Yersinia pestis
ggacagaaaacaaucuggcagcc

SEQ ID NO: 2270493 - RNA, 21 nt, Yersinia pestis
ggacgaccuguagcuuuuuaa

SEQ ID NO: 2270494 - RNA, 23 nt, Yersinia pestis
ggcaaauugcgagcugagcuuau

SEQ ID NO: 2270495 - RNA, 21 nt, Yersinia pestis
ggcaacagcguaauaccacua

SEQ ID NO: 2270496 - RNA, 17 nt, Yersinia pestis
ggcaaagucugguggug

SEQ ID NO: 2270497 - RNA, 19 nt, Yersinia pestis
ggcaaauagaggggcgcug

SEQ ID NO: 2270498 - RNA, 14 nt, Yersinia pestis
ggauuuaaaauccc

SEQ ID NO: 2270499 - RNA, 23 nt, Yersinia pestis
ggcaaaaacagucauuaacacau

SEQ ID NO: 2270500 - RNA, 11 nt, Yersinia pestis
ggcaaaaaaau

SEQ ID NO: 2270501 - RNA, 14 nt, Yersinia pestis
ggaucucuucagca

SEQ ID NO: 2270502 - RNA, 10 nt, Yersinia pestis
ggaucuccaa

SEQ ID NO: 2270503 - RNA, 20 nt, Yersinia pestis
ggaucaccagcaaaggccac

SEQ ID NO: 2270504 - RNA, 19 nt, Yersinia pestis
ggauuaaauucuaccuggc

SEQ ID NO: 2270505 - RNA, 20 nt, Yersinia pestis
ggaugccggaaucagccaga

SEQ ID NO: 2270506 - RNA, 14 nt, Yersinia pestis
ggcaaucacaaccc

SEQ ID NO: 2270507 - RNA, 17 nt, Yersinia pestis
ggcaaucuccaguaaau

SEQ ID NO: 2270508 - RNA, 19 nt, Yersinia pestis
ggcaaugaccaucaacuca

SEQ ID NO: 2270509 - RNA, 13 nt, Yersinia pestis
ggcaauaauucag

SEQ ID NO: 2270510 - RNA, 15 nt, Yersinia pestis
ggcaauacaccgcca

SEQ ID NO: 2270511 - RNA, 22 nt, Yersinia pestis
ggcaagguaaacggguuuuugu

SEQ ID NO: 2270512 - RNA, 15 nt, Yersinia pestis
ggcaauaaaggcaag

SEQ ID NO: 2270513 - RNA, 18 nt, Yersinia pestis
ggcaacgguaaaagguua

SEQ ID NO: 2270514 - RNA, 22 nt, Yersinia pestis
ggcaagaacaccgucaguaugg

SEQ ID NO: 2270515 - RNA, 14 nt, Yersinia pestis
ggcaagauuucucu

SEQ ID NO: 2270516 - RNA, 16 nt, Yersinia pestis
ggcaagcaagcaaagc

SEQ ID NO: 2270517 - RNA, 14 nt, Yersinia pestis
ggcaagcucugggc

SEQ ID NO: 2270518 - RNA, 16 nt, Yersinia pestis
ggcaaggauggcgcgg

SEQ ID NO: 2270519 - RNA, 12 nt, Yersinia pestis
ggcaaggcacga

SEQ ID NO: 2270520 - RNA, 21 nt, Yersinia pestis
ggcaauuaucuuauccacagc

SEQ ID NO: 2270521 - RNA, 14 nt, Yersinia pestis
ggcaauuaaaggua

SEQ ID NO: 2270522 - RNA, 12 nt, Yersinia pestis
ggcaccaugcug

SEQ ID NO: 2270523 - RNA, 22 nt, Yersinia pestis
ggcacaauccaauuuaccacua

SEQ ID NO: 2270524 - RNA, 19 nt, Yersinia pestis
ggcaccgugggcaaagaau

SEQ ID NO: 2270525 - RNA, 14 nt, Yersinia pestis
ggcaccguggauaa

SEQ ID NO: 2270526 - RNA, 18 nt, Yersinia pestis
ggcacggaucucauucag

SEQ ID NO: 2270527 - RNA, 22 nt, Yersinia pestis
ggcacuggcaauaaagaggcca

SEQ ID NO: 2270528 - RNA, 21 nt, Yersinia pestis
cucuugauuaccaauaauuaa

SEQ ID NO: 2270529 - RNA, 16 nt, Yersinia pestis
cucuugagaaaugaau

SEQ ID NO: 2270530 - RNA, 22 nt, Yersinia pestis
cucuugacgccgacaaacccac

SEQ ID NO: 2270531 - RNA, 23 nt, Yersinia pestis
cucuugacgccgacaaacccaca

SEQ ID NO: 2270532 - RNA, 16 nt, Yersinia pestis
cucuucuucuuggugu

SEQ ID NO: 2270533 - RNA, 23 nt, Yersinia pestis
cucuucuucgauuuuagcuuuga

SEQ ID NO: 2270534 - RNA, 19 nt, Yersinia pestis
cucuucugggcugaacgug

SEQ ID NO: 2270535 - RNA, 22 nt, Yersinia pestis
cucuuguguaauuauauuuaau

SEQ ID NO: 2270536 - RNA, 14 nt, Yersinia pestis
cucuugggcgcagu

SEQ ID NO: 2270537 - RNA, 20 nt, Yersinia pestis
cucuugggcgcagucaucau

SEQ ID NO: 2270538 - RNA, 15 nt, Yersinia pestis
cucuuggcugacucc

SEQ ID NO: 2270539 - RNA, 15 nt, Yersinia pestis
cucuuuaaguucacu

SEQ ID NO: 2270540 - RNA, 13 nt, Yersinia pestis
cucuucugggcug

SEQ ID NO: 2270541 - RNA, 16 nt, Yersinia pestis
cucuuccaauagcagu

SEQ ID NO: 2270542 - RNA, 22 nt, Yersinia pestis
cucuuccgacaggcuaacaacu

SEQ ID NO: 2270543 - RNA, 15 nt, Yersinia pestis
cucuuauuaaaugga

SEQ ID NO: 2270544 - RNA, 23 nt, Yersinia pestis
cucuuaaagaaaauuuacccugc

SEQ ID NO: 2270545 - RNA, 13 nt, Yersinia pestis
cucuguuuuaaaa

SEQ ID NO: 2270546 - RNA, 20 nt, Yersinia pestis
cucuucagguaagccuuucu

SEQ ID NO: 2270547 - RNA, 18 nt, Yersinia pestis
cucuucagcaauuuuuag

SEQ ID NO: 2270548 - RNA, 18 nt, Yersinia pestis
cucuucagccuauccuca

SEQ ID NO: 2270549 - RNA, 20 nt, Yersinia pestis
cucuucagccuauccucacc

SEQ ID NO: 2270550 - RNA, 20 nt, Yersinia pestis
cucuguauuguaauaaugga

SEQ ID NO: 2270551 - RNA, 22 nt, Yersinia pestis
cucuguauuuucaaucgcuuuc

SEQ ID NO: 2270552 - RNA, 17 nt, Yersinia pestis
cucuguugccggauuuu

SEQ ID NO: 2270553 - RNA, 19 nt, Yersinia pestis
cucuggauggguaaugcau

SEQ ID NO: 2270554 - RNA, 21 nt, Yersinia pestis
cucuggcaacggcacauccca

SEQ ID NO: 2270555 - RNA, 15 nt, Yersinia pestis
cucugcugggacaga

SEQ ID NO: 2270556 - RNA, 14 nt, Yersinia pestis
cucuggagcuucug

SEQ ID NO: 2270557 - RNA, 16 nt, Yersinia pestis
cucuggguaagaacag

SEQ ID NO: 2270558 - RNA, 17 nt, Yersinia pestis
cucuggcuaaugucucu

SEQ ID NO: 2270559 - RNA, 22 nt, Yersinia pestis
cucuggccagcgucuucagugg

SEQ ID NO: 2270560 - RNA, 13 nt, Yersinia pestis
cugaaaaucauga

SEQ ID NO: 2270561 - RNA, 23 nt, Yersinia pestis
cugaaaaaugagucauuaucuga

SEQ ID NO: 2270562 - RNA, 17 nt, Yersinia pestis
cugaaaaaggcaccagc

SEQ ID NO: 2270563 - RNA, 18 nt, Yersinia pestis
cugaaaccuacgccuaaa

SEQ ID NO: 2270564 - RNA, 17 nt, Yersinia pestis
cugaaacuucaaaauca

SEQ ID NO: 2270565 - RNA, 21 nt, Yersinia pestis
cugaaagcaaacaauuaguca

SEQ ID NO: 2270566 - RNA, 12 nt, Yersinia pestis
cucuuucaacuu

SEQ ID NO: 2270567 - RNA, 19 nt, Yersinia pestis
cucuuuagccgcuacgugu

SEQ ID NO: 2270568 - RNA, 21 nt, Yersinia pestis
cucuuuauaaccgucaccaaa

SEQ ID NO: 2270569 - RNA, 15 nt, Yersinia pestis
cucuuuauacuuugc

SEQ ID NO: 2270570 - RNA, 20 nt, Yersinia pestis
cucuuucagcucuucaauuu

SEQ ID NO: 2270571 - RNA, 17 nt, Yersinia pestis
cucuuuccccauuuuuu

SEQ ID NO: 2270572 - RNA, 19 nt, Yersinia pestis
cucuuuuauucucuuuuuu

SEQ ID NO: 2270573 - RNA, 18 nt, Yersinia pestis
cugaaauauacacaaguc

SEQ ID NO: 2270574 - RNA, 20 nt, Yersinia pestis
cugaaaguguauuucucaaa

SEQ ID NO: 2270575 - RNA, 17 nt, Yersinia pestis
cugaaaguguauuucuc

SEQ ID NO: 2270576 - RNA, 18 nt, Yersinia pestis
cugaacccugacggccag

SEQ ID NO: 2270577 - RNA, 19 nt, Yersinia pestis
cugaacccugacggccagc

SEQ ID NO: 2270578 - RNA, 17 nt, Yersinia pestis
cugaacaccauacuuuu

SEQ ID NO: 2270579 - RNA, 12 nt, Yersinia pestis
cugaaauuuuuu

SEQ ID NO: 2270580 - RNA, 23 nt, Yersinia pestis
cugaaauuuuuuaauuugcuccu

SEQ ID NO: 2270581 - RNA, 19 nt, Yersinia pestis
cugaaccuuggcauugucu

SEQ ID NO: 2270582 - RNA, 16 nt, Yersinia pestis
cugaacgccucaaaaa

SEQ ID NO: 2270583 - RNA, 19 nt, Yersinia pestis
cugaacgccucaaaaaccu

SEQ ID NO: 2270584 - RNA, 18 nt, Yersinia pestis
cugaacuuuaacuuccaa

SEQ ID NO: 2270585 - RNA, 20 nt, Yersinia pestis
cugaacuuuaacuuccaauu

SEQ ID NO: 2270586 - RNA, 21 nt, Yersinia pestis
cugaacuuuaacuuccaauuu

SEQ ID NO: 2270587 - RNA, 15 nt, Yersinia pestis
cugaacuuuacuuua

SEQ ID NO: 2270588 - RNA, 14 nt, Yersinia pestis
cugaagcaucaaua

SEQ ID NO: 2270589 - RNA, 21 nt, Yersinia pestis
cugaagaugccaaucaaaaaa

SEQ ID NO: 2270590 - RNA, 12 nt, Yersinia pestis
cugagcaccaga

SEQ ID NO: 2270591 - RNA, 20 nt, Yersinia pestis
cugagcagcaaacgccucgu

SEQ ID NO: 2270592 - RNA, 14 nt, Yersinia pestis
cugagaaucaaaaa

SEQ ID NO: 2270593 - RNA, 12 nt, Yersinia pestis
cugagaacccau

SEQ ID NO: 2270594 - RNA, 19 nt, Yersinia pestis
cugagaagcggaauuugcu

SEQ ID NO: 2270595 - RNA, 14 nt, Yersinia pestis
cugacgaaugacuc

SEQ ID NO: 2270596 - RNA, 13 nt, Yersinia pestis
cugacgaaaugcc

SEQ ID NO: 2270597 - RNA, 14 nt, Yersinia pestis
cugacgaaaugccg

SEQ ID NO: 2270598 - RNA, 21 nt, Yersinia pestis
cugacgaaauuuaagaaaucu

SEQ ID NO: 2270599 - RNA, 13 nt, Yersinia pestis
cugacggcagaca

SEQ ID NO: 2270600 - RNA, 17 nt, Yersinia pestis
cugacggccagcaaccu

SEQ ID NO: 2270601 - RNA, 15 nt, Yersinia pestis
cugacucccucaccg

SEQ ID NO: 2270602 - RNA, 18 nt, Yersinia pestis
cugacucacguauuuuca

SEQ ID NO: 2270603 - RNA, 21 nt, Yersinia pestis
cugacugagugccagcaaaga

SEQ ID NO: 2270604 - RNA, 15 nt, Yersinia pestis
cugaaggccugcugu

SEQ ID NO: 2270605 - RNA, 22 nt, Yersinia pestis
cugaagggcaaauugccgcuuu

SEQ ID NO: 2270606 - RNA, 21 nt, Yersinia pestis
cugacaccggggauccauagg

SEQ ID NO: 2270607 - RNA, 11 nt, Yersinia pestis
cugacaaccac

SEQ ID NO: 2270608 - RNA, 17 nt, Yersinia pestis
cugacauuuucuaucuc

SEQ ID NO: 2270609 - RNA, 22 nt, Yersinia pestis
cugacauuuucuaucucaucca

SEQ ID NO: 2270610 - RNA, 16 nt, Yersinia pestis
cugacagaacgcaauc

SEQ ID NO: 2270611 - RNA, 13 nt, Yersinia pestis
cugacacuuucga

SEQ ID NO: 2270612 - RNA, 13 nt, Yersinia pestis
cugaccaaacauu

SEQ ID NO: 2270613 - RNA, 20 nt, Yersinia pestis
cugaccaaacauugucaccu

SEQ ID NO: 2270614 - RNA, 14 nt, Yersinia pestis
cugaccacaaaaac

SEQ ID NO: 2270615 - RNA, 21 nt, Yersinia pestis
cugaccagcggugccuugcca

SEQ ID NO: 2270616 - RNA, 22 nt, Yersinia pestis
cugaccuauugauaaaaccgcu

SEQ ID NO: 2270617 - RNA, 16 nt, Yersinia pestis
cugaccccaaauuuga

SEQ ID NO: 2270618 - RNA, 15 nt, Yersinia pestis
cugaguucugcugcc

SEQ ID NO: 2270619 - RNA, 18 nt, Yersinia pestis
cugaguuaucuguuucaa

SEQ ID NO: 2270620 - RNA, 18 nt, Yersinia pestis
cugaguggacgauaaauu

SEQ ID NO: 2270621 - RNA, 18 nt, Yersinia pestis
cugaguggucgcuggcau

SEQ ID NO: 2270622 - RNA, 19 nt, Yersinia pestis
cugaguggucggccagcgc

SEQ ID NO: 2270623 - RNA, 22 nt, Yersinia pestis
cugagucgcuugauucucauua

SEQ ID NO: 2270624 - RNA, 17 nt, Yersinia pestis
cugagucagucagggug

SEQ ID NO: 2270625 - RNA, 17 nt, Yersinia pestis
cugauaucucuuuauca

SEQ ID NO: 2270626 - RNA, 20 nt, Yersinia pestis
cugauauuccggugaucuug

SEQ ID NO: 2270627 - RNA, 13 nt, Yersinia pestis
cugaucaugccac

SEQ ID NO: 2270628 - RNA, 21 nt, Yersinia pestis
cugaucauuauuauccuccca

SEQ ID NO: 2270629 - RNA, 14 nt, Yersinia pestis
cugaucaucaucaa

SEQ ID NO: 2270630 - RNA, 13 nt, Yersinia pestis
cugaucacuggca

SEQ ID NO: 2270631 - RNA, 16 nt, Yersinia pestis
cugaucacuggcauug

SEQ ID NO: 2270632 - RNA, 14 nt, Yersinia pestis
cugaucagcauuuc

SEQ ID NO: 2270633 - RNA, 14 nt, Yersinia pestis
cugaucgcugugca

SEQ ID NO: 2270634 - RNA, 22 nt, Yersinia pestis
cugauccucuaaggggcgagaa

SEQ ID NO: 2270635 - RNA, 11 nt, Yersinia pestis
cugaucgagca

SEQ ID NO: 2270636 - RNA, 15 nt, Yersinia pestis
cugcaauaauguuga

SEQ ID NO: 2270637 - RNA, 16 nt, Yersinia pestis
cugcaauaacaccagc

SEQ ID NO: 2270638 - RNA, 15 nt, Yersinia pestis
cugcaacucuugcgc

SEQ ID NO: 2270639 - RNA, 16 nt, Yersinia pestis
cugcaagcaauguuca

SEQ ID NO: 2270640 - RNA, 19 nt, Yersinia pestis
cugcaagcaauguucaaau

SEQ ID NO: 2270641 - RNA, 14 nt, Yersinia pestis
cugcaacgccuuca

SEQ ID NO: 2270642 - RNA, 14 nt, Yersinia pestis
cugcaacucauuaa

SEQ ID NO: 2270643 - RNA, 13 nt, Yersinia pestis
cugcaaacgagag

SEQ ID NO: 2270644 - RNA, 13 nt, Yersinia pestis
cugaugcaccuca

SEQ ID NO: 2270645 - RNA, 22 nt, Yersinia pestis
cugauucgcgaccagcagaagu

SEQ ID NO: 2270646 - RNA, 20 nt, Yersinia pestis
cugaugcgcgacauuuugug

SEQ ID NO: 2270647 - RNA, 21 nt, Yersinia pestis
cugaugcgcgacauuuugugc

SEQ ID NO: 2270648 - RNA, 16 nt, Yersinia pestis
cugauuggauaaaaua

SEQ ID NO: 2270649 - RNA, 16 nt, Yersinia pestis
cugauucucuucaccu

SEQ ID NO: 2270650 - RNA, 19 nt, Yersinia pestis
cuggaaacgaccuguacug

SEQ ID NO: 2270651 - RNA, 21 nt, Yersinia pestis
cuggaaaggaauaucugugau

SEQ ID NO: 2270652 - RNA, 16 nt, Yersinia pestis
cugcuuuucuaccuga

SEQ ID NO: 2270653 - RNA, 17 nt, Yersinia pestis
cugcuuuguuuuugugg

SEQ ID NO: 2270654 - RNA, 22 nt, Yersinia pestis
cugcuuuuuauugucucuacuc

SEQ ID NO: 2270655 - RNA, 15 nt, Yersinia pestis
cugcuggaaugcagu

SEQ ID NO: 2270656 - RNA, 22 nt, Yersinia pestis
cugcuguuuaccuaucucagug

SEQ ID NO: 2270657 - RNA, 13 nt, Yersinia pestis
cugcugcuuuaau

SEQ ID NO: 2270658 - RNA, 23 nt, Yersinia pestis
cugcuuaccuuguuuguuacugc

SEQ ID NO: 2270659 - RNA, 13 nt, Yersinia pestis
cugcuuaccuugu

SEQ ID NO: 2270660 - RNA, 20 nt, Yersinia pestis
cugcuuauacgcuuccugcg

SEQ ID NO: 2270661 - RNA, 16 nt, Yersinia pestis
cuggacguuugcugcu

SEQ ID NO: 2270662 - RNA, 14 nt, Yersinia pestis
cuggacugguugcu

SEQ ID NO: 2270663 - RNA, 21 nt, Yersinia pestis
cuggacugguugcugguuaau

SEQ ID NO: 2270664 - RNA, 14 nt, Yersinia pestis
cuggacgcaucaga

SEQ ID NO: 2270665 - RNA, 16 nt, Yersinia pestis
cuggaccuuaucauca

SEQ ID NO: 2270666 - RNA, 20 nt, Yersinia pestis
cuggaucggcauacuccauu

SEQ ID NO: 2270667 - RNA, 12 nt, Yersinia pestis
cuggcauuuuuu

SEQ ID NO: 2270668 - RNA, 20 nt, Yersinia pestis
cuggccaaagccgguaucaa

SEQ ID NO: 2270669 - RNA, 15 nt, Yersinia pestis
cuggcauuuuacugg

SEQ ID NO: 2270670 - RNA, 18 nt, Yersinia pestis
cuggcaaaacucagguga

SEQ ID NO: 2270671 - RNA, 13 nt, Yersinia pestis
cuggcaaaauccc

SEQ ID NO: 2270672 - RNA, 16 nt, Yersinia pestis
cuggcaaacgcugggc

SEQ ID NO: 2270673 - RNA, 15 nt, Yersinia pestis
cuggccacagagugg

SEQ ID NO: 2270674 - RNA, 21 nt, Yersinia pestis
cuggccagaagguaagccagu

SEQ ID NO: 2270675 - RNA, 15 nt, Yersinia pestis
cugcucuaucucuuc

SEQ ID NO: 2270676 - RNA, 15 nt, Yersinia pestis
aaacucaccgagcau

SEQ ID NO: 2270677 - RNA, 20 nt, Yersinia pestis
aaacucaccgagcauauuuu

SEQ ID NO: 2270678 - RNA, 24 nt, Yersinia pestis
cugcuaauacgcuaucaacguagc

SEQ ID NO: 2270679 - RNA, 15 nt, Yersinia pestis
cugcucaacugcuca

SEQ ID NO: 2270680 - RNA, 17 nt, Yersinia pestis
cugcucaacugcucaac

SEQ ID NO: 2270681 - RNA, 20 nt, Yersinia pestis
cugcucaacugcucaacgcc

SEQ ID NO: 2270682 - RNA, 22 nt, Yersinia pestis
cugcucaaugcguuggcucaga

SEQ ID NO: 2270683 - RNA, 22 nt, Yersinia pestis
cugcucaaucgaaugcaauaac

SEQ ID NO: 2270684 - RNA, 20 nt, Yersinia pestis
cugcucaacugcucaacugc

SEQ ID NO: 2270685 - RNA, 23 nt, Yersinia pestis
cugcguauggggauuuuauuaca

SEQ ID NO: 2270686 - RNA, 20 nt, Yersinia pestis
cugcgguuuguuugcaucug

SEQ ID NO: 2270687 - RNA, 22 nt, Yersinia pestis
cugcgcuguaagcaccagcacc

SEQ ID NO: 2270688 - RNA, 12 nt, Yersinia pestis
cugcggcuuucu

SEQ ID NO: 2270689 - RNA, 17 nt, Yersinia pestis
cugcggcuuucugccug

SEQ ID NO: 2270690 - RNA, 18 nt, Yersinia pestis
cugcggcuuucugccugu

SEQ ID NO: 2270691 - RNA, 12 nt, Yersinia pestis
cugcgggcacua

SEQ ID NO: 2270692 - RNA, 16 nt, Yersinia pestis
cugcgguggccagagc

SEQ ID NO: 2270693 - RNA, 17 nt, Yersinia pestis
cugcggcgucugauaac

SEQ ID NO: 2270694 - RNA, 23 nt, Yersinia pestis
cugccagugggauaucugcggug

SEQ ID NO: 2270695 - RNA, 22 nt, Yersinia pestis
cugccauacggcgucuugauca

SEQ ID NO: 2270696 - RNA, 18 nt, Yersinia pestis
cugccagaauuuugcagc

SEQ ID NO: 2270697 - RNA, 23 nt, Yersinia pestis
cugccacacuuuugcugguguca

SEQ ID NO: 2270698 - RNA, 20 nt, Yersinia pestis
cugccaauauugaccaacgc

SEQ ID NO: 2270699 - RNA, 14 nt, Yersinia pestis
cugccaaucgcucu

SEQ ID NO: 2270700 - RNA, 23 nt, Yersinia pestis
cugccaaucgcucugcguuuuuc

SEQ ID NO: 2270701 - RNA, 17 nt, Yersinia pestis
cugccaauucaaggcca

SEQ ID NO: 2270702 - RNA, 14 nt, Yersinia pestis
cugcaaugcauaag

SEQ ID NO: 2270703 - RNA, 20 nt, Yersinia pestis
cugcacaauuugguagaacu

SEQ ID NO: 2270704 - RNA, 13 nt, Yersinia pestis
cugcagugaaaag

SEQ ID NO: 2270705 - RNA, 15 nt, Yersinia pestis
cugcaguacagauaa

SEQ ID NO: 2270706 - RNA, 13 nt, Yersinia pestis
cugccaaaaaaua

SEQ ID NO: 2270707 - RNA, 21 nt, Yersinia pestis
cugccaaaaaauaagggccac

SEQ ID NO: 2270708 - RNA, 23 nt, Yersinia pestis
cugccaaaaaauaagggccacca

SEQ ID NO: 2270709 - RNA, 13 nt, Yersinia pestis
cugcauuaaaaua

SEQ ID NO: 2270710 - RNA, 14 nt, Yersinia pestis
cugcauuaaaauaa

SEQ ID NO: 2270711 - RNA, 14 nt, Yersinia pestis
cugcauugauuaaa

SEQ ID NO: 2270712 - RNA, 20 nt, Yersinia pestis
cugcgccacccauugcucaa

SEQ ID NO: 2270713 - RNA, 18 nt, Yersinia pestis
cugcgcauuucacccucu

SEQ ID NO: 2270714 - RNA, 19 nt, Yersinia pestis
cugcgcauuucacccucug

SEQ ID NO: 2270715 - RNA, 17 nt, Yersinia pestis
cugcgccacgcuuuagc

SEQ ID NO: 2270716 - RNA, 14 nt, Yersinia pestis
cugcgccagcagca

SEQ ID NO: 2270717 - RNA, 22 nt, Yersinia pestis
cugcgcccuuaucuaucucagg

SEQ ID NO: 2270718 - RNA, 23 nt, Yersinia pestis
cugccuaugcguuggcugccuuc

SEQ ID NO: 2270719 - RNA, 14 nt, Yersinia pestis
cugccuauuuaucg

SEQ ID NO: 2270720 - RNA, 15 nt, Yersinia pestis
cugccuauccucacc

SEQ ID NO: 2270721 - RNA, 16 nt, Yersinia pestis
cugccgcacugccacc

SEQ ID NO: 2270722 - RNA, 21 nt, Yersinia pestis
cugccgccaccauaucagaac

SEQ ID NO: 2270723 - RNA, 21 nt, Yersinia pestis
cugccgccagauuauccagcc

SEQ ID NO: 2270724 - RNA, 14 nt, Yersinia pestis
cugccuuccugcca

SEQ ID NO: 2270725 - RNA, 14 nt, Yersinia pestis
cugccugagguucc

SEQ ID NO: 2270726 - RNA, 14 nt, Yersinia pestis
cugccugccugagg

SEQ ID NO: 2270727 - RNA, 14 nt, Yersinia pestis
cugccugccugcug

SEQ ID NO: 2270728 - RNA, 17 nt, Yersinia pestis
cugccugccugcugcuc

SEQ ID NO: 2270729 - RNA, 12 nt, Yersinia pestis
cugccugcugcu

SEQ ID NO: 2270730 - RNA, 13 nt, Yersinia pestis
cugccugcugcuc

SEQ ID NO: 2270731 - RNA, 15 nt, Yersinia pestis
cugccugcugcucca

SEQ ID NO: 2270732 - RNA, 20 nt, Yersinia pestis
cugcgauuuaugaaccguca

SEQ ID NO: 2270733 - RNA, 14 nt, Yersinia pestis
cugcgaucugccuu

SEQ ID NO: 2270734 - RNA, 19 nt, Yersinia pestis
cuacuccauccccaacucu

SEQ ID NO: 2270735 - RNA, 16 nt, Yersinia pestis
cuacuccauccccaac

SEQ ID NO: 2270736 - RNA, 13 nt, Yersinia pestis
cuacuccaacaac

SEQ ID NO: 2270737 - RNA, 18 nt, Yersinia pestis
cuacugacauuucuuaua

SEQ ID NO: 2270738 - RNA, 19 nt, Yersinia pestis
cuacugaugugcaugugga

SEQ ID NO: 2270739 - RNA, 20 nt, Yersinia pestis
cuacugauuggauaaaauau

SEQ ID NO: 2270740 - RNA, 22 nt, Yersinia pestis
cuacugcaagccguaauucaga

SEQ ID NO: 2270741 - RNA, 21 nt, Yersinia pestis
cuacuggcccgcccauaaauu

SEQ ID NO: 2270742 - RNA, 20 nt, Yersinia pestis
cuacuggcccgcccauaaau

SEQ ID NO: 2270743 - RNA, 20 nt, Yersinia pestis
cuacugcuuuuuauugucuc

SEQ ID NO: 2270744 - RNA, 14 nt, Yersinia pestis
cuacugguagcagc

SEQ ID NO: 2270745 - RNA, 20 nt, Yersinia pestis
cuacuguuauccagcgucac

SEQ ID NO: 2270746 - RNA, 22 nt, Yersinia pestis
cuacuguuauccagcgucaccg

SEQ ID NO: 2270747 - RNA, 15 nt, Yersinia pestis
cuacuguuuugguuu

SEQ ID NO: 2270748 - RNA, 14 nt, Yersinia pestis
cuacuuauuuccgc

SEQ ID NO: 2270749 - RNA, 21 nt, Yersinia pestis
cuaaccaccgucaccaaauau

SEQ ID NO: 2270750 - RNA, 14 nt, Yersinia pestis
cuaaccacagcaau

SEQ ID NO: 2270751 - RNA, 21 nt, Yersinia pestis
cuaaccaaacauuguuaccua

SEQ ID NO: 2270752 - RNA, 13 nt, Yersinia pestis
cuaaauuucucgc

SEQ ID NO: 2270753 - RNA, 14 nt, Yersinia pestis
cuaacaaaccuaaa

SEQ ID NO: 2270754 - RNA, 23 nt, Yersinia pestis
cuaacaucaauguauuaauuugg

SEQ ID NO: 2270755 - RNA, 17 nt, Yersinia pestis
cuaacaguuguuucaau

SEQ ID NO: 2270756 - RNA, 20 nt, Yersinia pestis
cuaacaguuguuucaauaaa

SEQ ID NO: 2270757 - RNA, 17 nt, Yersinia pestis
cuaccuuuugcauauuu

SEQ ID NO: 2270758 - RNA, 19 nt, Yersinia pestis
cuaccuuuugcauauuucu

SEQ ID NO: 2270759 - RNA, 22 nt, Yersinia pestis
cuagcaacaugguuaagagauc

SEQ ID NO: 2270760 - RNA, 12 nt, Yersinia pestis
cuagcaaauucc

SEQ ID NO: 2270761 - RNA, 21 nt, Yersinia pestis
cuagcuuggcguguuagcggc

SEQ ID NO: 2270762 - RNA, 17 nt, Yersinia pestis
cuacuucuauuacccua

SEQ ID NO: 2270763 - RNA, 13 nt, Yersinia pestis
cuacuuuuuucac

SEQ ID NO: 2270764 - RNA, 17 nt, Yersinia pestis
cuagauaccgccccuca

SEQ ID NO: 2270765 - RNA, 17 nt, Yersinia pestis
cuagauauaaugguggg

SEQ ID NO: 2270766 - RNA, 14 nt, Yersinia pestis
cuauaggcuauuuu

SEQ ID NO: 2270767 - RNA, 16 nt, Yersinia pestis
cuauaauuauuucucu

SEQ ID NO: 2270768 - RNA, 16 nt, Yersinia pestis
cuauacccaaguuacu

SEQ ID NO: 2270769 - RNA, 19 nt, Yersinia pestis
cuagggauuuuaagcagcc

SEQ ID NO: 2270770 - RNA, 15 nt, Yersinia pestis
cuaucaacuuucacc

SEQ ID NO: 2270771 - RNA, 23 nt, Yersinia pestis
cuauauucucauugcccccuuca

SEQ ID NO: 2270772 - RNA, 11 nt, Yersinia pestis
cuauauuuggc

SEQ ID NO: 2270773 - RNA, 23 nt, Yersinia pestis
cuauaucacuucaauguuuuuau

SEQ ID NO: 2270774 - RNA, 16 nt, Yersinia pestis
cuauaucaucagcaga

SEQ ID NO: 2270775 - RNA, 13 nt, Yersinia pestis
cuauauauggaua

SEQ ID NO: 2270776 - RNA, 13 nt, Yersinia pestis
cuauaucucaguu

SEQ ID NO: 2270777 - RNA, 16 nt, Yersinia pestis
cuaucgcgcuuuuuag

SEQ ID NO: 2270778 - RNA, 17 nt, Yersinia pestis
cuaucgcuguaugguau

SEQ ID NO: 2270779 - RNA, 22 nt, Yersinia pestis
cuaugcccaguuuaccauccac

SEQ ID NO: 2270780 - RNA, 19 nt, Yersinia pestis
cuaugcaguuaaggcuggc

SEQ ID NO: 2270781 - RNA, 23 nt, Yersinia pestis
cuaugugauauuuuacuguucug

SEQ ID NO: 2270782 - RNA, 18 nt, Yersinia pestis
cuauguucacguaaauga

SEQ ID NO: 2270783 - RNA, 13 nt, Yersinia pestis
cuaugcuaacucg

SEQ ID NO: 2270784 - RNA, 20 nt, Yersinia pestis
cuaucaccggcccaacuggc

SEQ ID NO: 2270785 - RNA, 17 nt, Yersinia pestis
cuaucaggucaaucuua

SEQ ID NO: 2270786 - RNA, 17 nt, Yersinia pestis
cuaucaucaccauucaa

SEQ ID NO: 2270787 - RNA, 17 nt, Yersinia pestis
cuaucgccugggcgaga

SEQ ID NO: 2270788 - RNA, 13 nt, Yersinia pestis
cuaucgccuucau

SEQ ID NO: 2270789 - RNA, 20 nt, Yersinia pestis
cuauccucuuaaugucuuua

SEQ ID NO: 2270790 - RNA, 12 nt, Yersinia pestis
cuauccgccccg

SEQ ID NO: 2270791 - RNA, 19 nt, Yersinia pestis
cuauccgaaaaauauucuc

SEQ ID NO: 2270792 - RNA, 16 nt, Yersinia pestis
cuauccucuuaauguc

SEQ ID NO: 2270793 - RNA, 22 nt, Yersinia pestis
cucaagaaauuuaaaaacccuc

SEQ ID NO: 2270794 - RNA, 15 nt, Yersinia pestis
cucaacugcucaacu

SEQ ID NO: 2270795 - RNA, 17 nt, Yersinia pestis
cucaacugcucaacugc

SEQ ID NO: 2270796 - RNA, 14 nt, Yersinia pestis
cucaacucaaaaca

SEQ ID NO: 2270797 - RNA, 15 nt, Yersinia pestis
cucaacucaaaacaa

SEQ ID NO: 2270798 - RNA, 17 nt, Yersinia pestis
cucaagggcacaguuua

SEQ ID NO: 2270799 - RNA, 21 nt, Yersinia pestis
cucaaggucuuucgcccacaa

SEQ ID NO: 2270800 - RNA, 19 nt, Yersinia pestis
cuauuacugucaaugcuca

SEQ ID NO: 2270801 - RNA, 21 nt, Yersinia pestis
cucaaauauuugcacaaauau

SEQ ID NO: 2270802 - RNA, 11 nt, Yersinia pestis
cuauuaauauc

SEQ ID NO: 2270803 - RNA, 19 nt, Yersinia pestis
cuauuaauuauuauuggug

SEQ ID NO: 2270804 - RNA, 16 nt, Yersinia pestis
cucaacagcaucauca

SEQ ID NO: 2270805 - RNA, 13 nt, Yersinia pestis
cucacucugugaa

SEQ ID NO: 2270806 - RNA, 14 nt, Yersinia pestis
cucacgcaaagggc

SEQ ID NO: 2270807 - RNA, 19 nt, Yersinia pestis
cucacguuuagcccacugu

SEQ ID NO: 2270808 - RNA, 22 nt, Yersinia pestis
cucacgaauaguaucuggggua

SEQ ID NO: 2270809 - RNA, 21 nt, Yersinia pestis
cucaccgucaacccacaguug

SEQ ID NO: 2270810 - RNA, 19 nt, Yersinia pestis
cucaauaaauucauuagcu

SEQ ID NO: 2270811 - RNA, 20 nt, Yersinia pestis
cucaaucaccgaaucaccga

SEQ ID NO: 2270812 - RNA, 12 nt, Yersinia pestis
cucaauauuaau

SEQ ID NO: 2270813 - RNA, 15 nt, Yersinia pestis
cucacauaagaaagu

SEQ ID NO: 2270814 - RNA, 14 nt, Yersinia pestis
cucacagcggcgga

SEQ ID NO: 2270815 - RNA, 23 nt, Yersinia pestis
cucaccaagaggaaaugccgcgc

SEQ ID NO: 2270816 - RNA, 18 nt, Yersinia pestis
cucacccgcuugucuuga

SEQ ID NO: 2270817 - RNA, 21 nt, Yersinia pestis
cucaguuaaacgguaaccauc

SEQ ID NO: 2270818 - RNA, 13 nt, Yersinia pestis
cucaguugaaacc

SEQ ID NO: 2270819 - RNA, 17 nt, Yersinia pestis
cucaguuaucagggccu

SEQ ID NO: 2270820 - RNA, 15 nt, Yersinia pestis
cucaguucagccccc

SEQ ID NO: 2270821 - RNA, 14 nt, Yersinia pestis
cucaguugauggcu

SEQ ID NO: 2270822 - RNA, 18 nt, Yersinia pestis
cucaguuggguaucuuug

SEQ ID NO: 2270823 - RNA, 21 nt, Yersinia pestis
cucagugacugggggugagca

SEQ ID NO: 2270824 - RNA, 17 nt, Yersinia pestis
cucaguaccugaagcua

SEQ ID NO: 2270825 - RNA, 13 nt, Yersinia pestis
cucagggccacuu

SEQ ID NO: 2270826 - RNA, 19 nt, Yersinia pestis
cucagggcgcuuaugcccu

SEQ ID NO: 2270827 - RNA, 15 nt, Yersinia pestis
cucaggggauaagcu

SEQ ID NO: 2270828 - RNA, 22 nt, Yersinia pestis
cucagacuaccaaaauuuaaau

SEQ ID NO: 2270829 - RNA, 13 nt, Yersinia pestis
cucagacuucuuc

SEQ ID NO: 2270830 - RNA, 18 nt, Yersinia pestis
cucagacuucuuccaucu

SEQ ID NO: 2270831 - RNA, 19 nt, Yersinia pestis
cucagacuucuuccaucuu

SEQ ID NO: 2270832 - RNA, 13 nt, Yersinia pestis
cucaggcucauca

SEQ ID NO: 2270833 - RNA, 18 nt, Yersinia pestis
cucagauaaauucaacuu

SEQ ID NO: 2270834 - RNA, 16 nt, Yersinia pestis
cucagaucccccugcu

SEQ ID NO: 2270835 - RNA, 12 nt, Yersinia pestis
cucaucgccaaa

SEQ ID NO: 2270836 - RNA, 20 nt, Yersinia pestis
cucaucgccaaagccgucag

SEQ ID NO: 2270837 - RNA, 16 nt, Yersinia pestis
cucauccgccaagauu

SEQ ID NO: 2270838 - RNA, 14 nt, Yersinia pestis
cucaucugaacuau

SEQ ID NO: 2270839 - RNA, 22 nt, Yersinia pestis
cucaucuugggcgggaucucca

SEQ ID NO: 2270840 - RNA, 16 nt, Yersinia pestis
cucaucaaccucagcc

SEQ ID NO: 2270841 - RNA, 17 nt, Yersinia pestis
cucaucaaguauuuuac

SEQ ID NO: 2270842 - RNA, 11 nt, Yersinia pestis
cucaucacccg

SEQ ID NO: 2270843 - RNA, 18 nt, Yersinia pestis
cucaucaccaaaaugaca

SEQ ID NO: 2270844 - RNA, 17 nt, Yersinia pestis
cucauauuguccaaagg

SEQ ID NO: 2270845 - RNA, 17 nt, Yersinia pestis
cucauaugcagcaucca

SEQ ID NO: 2270846 - RNA, 22 nt, Yersinia pestis
cucaucccaaaauagccagccc

SEQ ID NO: 2270847 - RNA, 19 nt, Yersinia pestis
cucauccauaaguauuuau

SEQ ID NO: 2270848 - RNA, 20 nt, Yersinia pestis
cucauccauaaguauuuauu

SEQ ID NO: 2270849 - RNA, 20 nt, Yersinia pestis
cucaucaggcggguaacugu

SEQ ID NO: 2270850 - RNA, 15 nt, Yersinia pestis
cucaucaguaacgcc

SEQ ID NO: 2270851 - RNA, 13 nt, Yersinia pestis
cucaucagcgccc

SEQ ID NO: 2270852 - RNA, 13 nt, Yersinia pestis
cucaucaccuucc

SEQ ID NO: 2270853 - RNA, 16 nt, Yersinia pestis
cuccuuacuaucuuua

SEQ ID NO: 2270854 - RNA, 23 nt, Yersinia pestis
cuccuuucuuuucgcuauuucuc

SEQ ID NO: 2270855 - RNA, 13 nt, Yersinia pestis
cucgaauuauuuu

SEQ ID NO: 2270856 - RNA, 16 nt, Yersinia pestis
cucgagcgcuaauauu

SEQ ID NO: 2270857 - RNA, 18 nt, Yersinia pestis
cucgagccgcgcccuccc

SEQ ID NO: 2270858 - RNA, 19 nt, Yersinia pestis
cucgacucucaagcccagu

SEQ ID NO: 2270859 - RNA, 18 nt, Yersinia pestis
cuccugcccaagaauaau

SEQ ID NO: 2270860 - RNA, 13 nt, Yersinia pestis
cuccugaggguga

SEQ ID NO: 2270861 - RNA, 19 nt, Yersinia pestis
cuccugcaacgccuucaca

SEQ ID NO: 2270862 - RNA, 22 nt, Yersinia pestis
cuccugaucuucauugccuucu

SEQ ID NO: 2270863 - RNA, 21 nt, Yersinia pestis
cuccugucuaggguuauuuua

SEQ ID NO: 2270864 - RNA, 15 nt, Yersinia pestis
cuccagcucgugcca

SEQ ID NO: 2270865 - RNA, 18 nt, Yersinia pestis
cuccaggcauuaaaauca

SEQ ID NO: 2270866 - RNA, 20 nt, Yersinia pestis
cucaugcucuucauaagcca

SEQ ID NO: 2270867 - RNA, 18 nt, Yersinia pestis
cucauguucgcacugcuc

SEQ ID NO: 2270868 - RNA, 19 nt, Yersinia pestis
cucauguucgcacugcucu

SEQ ID NO: 2270869 - RNA, 20 nt, Yersinia pestis
cuccaguuggcgcacguucc

SEQ ID NO: 2270870 - RNA, 13 nt, Yersinia pestis
cuccaguucgacu

SEQ ID NO: 2270871 - RNA, 22 nt, Yersinia pestis
cuccaguugcacaccaucagua

SEQ ID NO: 2270872 - RNA, 13 nt, Yersinia pestis
cuccauauagccc

SEQ ID NO: 2270873 - RNA, 22 nt, Yersinia pestis
cuccaucaagccaccgcuggug

SEQ ID NO: 2270874 - RNA, 24 nt, Yersinia pestis
cuccauauuuuagcggccucuagc

SEQ ID NO: 2270875 - RNA, 19 nt, Yersinia pestis
cuccaucacucuucgugcu

SEQ ID NO: 2270876 - RNA, 16 nt, Yersinia pestis
cuccagugcaaauuua

SEQ ID NO: 2270877 - RNA, 13 nt, Yersinia pestis
cucccaaucaaug

SEQ ID NO: 2270878 - RNA, 18 nt, Yersinia pestis
cucccagaauaauaagcc

SEQ ID NO: 2270879 - RNA, 14 nt, Yersinia pestis
cucccucuguauug

SEQ ID NO: 2270880 - RNA, 11 nt, Yersinia pestis
cucccugacuc

SEQ ID NO: 2270881 - RNA, 19 nt, Yersinia pestis
cucccgauacucauugcac

SEQ ID NO: 2270882 - RNA, 23 nt, Yersinia pestis
cucccuuuccagcgguuuuuucu

SEQ ID NO: 2270883 - RNA, 14 nt, Yersinia pestis
cucccuucaaucaa

SEQ ID NO: 2270884 - RNA, 20 nt, Yersinia pestis
cucccuguuacgguauuuga

SEQ ID NO: 2270885 - RNA, 16 nt, Yersinia pestis
cuccgcauccggcggu

SEQ ID NO: 2270886 - RNA, 14 nt, Yersinia pestis
cucguauaaaaaau

SEQ ID NO: 2270887 - RNA, 15 nt, Yersinia pestis
cucgucauucaccac

SEQ ID NO: 2270888 - RNA, 17 nt, Yersinia pestis
cucggucgaucgcuuuu

SEQ ID NO: 2270889 - RNA, 18 nt, Yersinia pestis
cucggucugaauaagaga

SEQ ID NO: 2270890 - RNA, 22 nt, Yersinia pestis
cucggucugaauaagagagacg

SEQ ID NO: 2270891 - RNA, 22 nt, Yersinia pestis
cucggcucgaaccugaacgcag

SEQ ID NO: 2270892 - RNA, 14 nt, Yersinia pestis
cucggcugacgaua

SEQ ID NO: 2270893 - RNA, 17 nt, Yersinia pestis
cucgcuaugcucagcaa

SEQ ID NO: 2270894 - RNA, 17 nt, Yersinia pestis
cucgcucaccacugagu

SEQ ID NO: 2270895 - RNA, 19 nt, Yersinia pestis
cucgcucaacaugccagaa

SEQ ID NO: 2270896 - RNA, 21 nt, Yersinia pestis
cucgaucagauacaaccccac

SEQ ID NO: 2270897 - RNA, 21 nt, Yersinia pestis
cucugcaaucaugauggucgu

SEQ ID NO: 2270898 - RNA, 19 nt, Yersinia pestis
cucugcaaugcccagagcg

SEQ ID NO: 2270899 - RNA, 17 nt, Yersinia pestis
cucugauuguaacaauc

SEQ ID NO: 2270900 - RNA, 19 nt, Yersinia pestis
cucugacuacugaaaccug

SEQ ID NO: 2270901 - RNA, 16 nt, Yersinia pestis
cucugaggauguaguc

SEQ ID NO: 2270902 - RNA, 16 nt, Yersinia pestis
cucugaugaacggaga

SEQ ID NO: 2270903 - RNA, 15 nt, Yersinia pestis
cucugccaacgugau

SEQ ID NO: 2270904 - RNA, 22 nt, Yersinia pestis
cucugccuauccucaccguuca

SEQ ID NO: 2270905 - RNA, 13 nt, Yersinia pestis
cucugccgcugaa

SEQ ID NO: 2270906 - RNA, 14 nt, Yersinia pestis
cucugcgacaucag

SEQ ID NO: 2270907 - RNA, 18 nt, Yersinia pestis
cucugcguacaacacauc

SEQ ID NO: 2270908 - RNA, 22 nt, Yersinia pestis
cucucuuuccagcaaaagccuc

SEQ ID NO: 2270909 - RNA, 23 nt, Yersinia pestis
cucucuuuccagcaaaagccucu

SEQ ID NO: 2270910 - RNA, 17 nt, Yersinia pestis
cucugaagccuucaugu

SEQ ID NO: 2270911 - RNA, 17 nt, Yersinia pestis
cucucuuuuuucucuuu

SEQ ID NO: 2270912 - RNA, 15 nt, Yersinia pestis
cucucuuuuuucucu

SEQ ID NO: 2270913 - RNA, 16 nt, Yersinia pestis
cucucuccgcaaugcc

SEQ ID NO: 2270914 - RNA, 19 nt, Yersinia pestis
cucucuacuucgucugccc

SEQ ID NO: 2270915 - RNA, 16 nt, Yersinia pestis
cucucugagccaucca

SEQ ID NO: 2270916 - RNA, 14 nt, Yersinia pestis
cucuauucugcuuu

SEQ ID NO: 2270917 - RNA, 20 nt, Yersinia pestis
cucuauucugcuuuuugcuu

SEQ ID NO: 2270918 - RNA, 17 nt, Yersinia pestis
cucucauauccccccca

SEQ ID NO: 2270919 - RNA, 14 nt, Yersinia pestis
cucucagaacaggu

SEQ ID NO: 2270920 - RNA, 13 nt, Yersinia pestis
cucuccaugauau

SEQ ID NO: 2270921 - RNA, 15 nt, Yersinia pestis
cucuccuaaaaucua

SEQ ID NO: 2270922 - RNA, 18 nt, Yersinia pestis
cucuccguugcaggcacu

SEQ ID NO: 2270923 - RNA, 15 nt, Yersinia pestis
cucuccguugcaggc

SEQ ID NO: 2270924 - RNA, 16 nt, Yersinia pestis
cucuccgucgcgggca

SEQ ID NO: 2270925 - RNA, 16 nt, Yersinia pestis
cguauaacgcagcccc

SEQ ID NO: 2270926 - RNA, 15 nt, Yersinia pestis
cguauaacauaauaa

SEQ ID NO: 2270927 - RNA, 18 nt, Yersinia pestis
cgucaaauaacggaauuu

SEQ ID NO: 2270928 - RNA, 23 nt, Yersinia pestis
cgucaaaccaucgcucuccugcc

SEQ ID NO: 2270929 - RNA, 14 nt, Yersinia pestis
cguauucagcacug

SEQ ID NO: 2270930 - RNA, 12 nt, Yersinia pestis
cguauuaucugc

SEQ ID NO: 2270931 - RNA, 16 nt, Yersinia pestis
cguauggcaugacuua

SEQ ID NO: 2270932 - RNA, 21 nt, Yersinia pestis
cguaauacccucgacaccaaa

SEQ ID NO: 2270933 - RNA, 17 nt, Yersinia pestis
cguaauauuucaagcug

SEQ ID NO: 2270934 - RNA, 23 nt, Yersinia pestis
cguaauaguuaaucgcagcagag

SEQ ID NO: 2270935 - RNA, 21 nt, Yersinia pestis
cguaauaguuaaucgcagcag

SEQ ID NO: 2270936 - RNA, 15 nt, Yersinia pestis
cguagcgauaacaga

SEQ ID NO: 2270937 - RNA, 16 nt, Yersinia pestis
cguaaucucucacagc

SEQ ID NO: 2270938 - RNA, 16 nt, Yersinia pestis
cguagccguuaaauau

SEQ ID NO: 2270939 - RNA, 18 nt, Yersinia pestis
cgucaauucacugcuagu

SEQ ID NO: 2270940 - RNA, 18 nt, Yersinia pestis
cgucaccacaaaggucag

SEQ ID NO: 2270941 - RNA, 13 nt, Yersinia pestis
cgucacagcaauu

SEQ ID NO: 2270942 - RNA, 23 nt, Yersinia pestis
cgucaccaucaauauaagagaaa

SEQ ID NO: 2270943 - RNA, 12 nt, Yersinia pestis
cgucaccaucaa

SEQ ID NO: 2270944 - RNA, 16 nt, Yersinia pestis
cgucaaucauccaagc

SEQ ID NO: 2270945 - RNA, 17 nt, Yersinia pestis
cgucaagccaaccccca

SEQ ID NO: 2270946 - RNA, 20 nt, Yersinia pestis
cgucaagguacccauuauuc

SEQ ID NO: 2270947 - RNA, 19 nt, Yersinia pestis
cgucagugcgguaaccagc

SEQ ID NO: 2270948 - RNA, 24 nt, Yersinia pestis
cgucacguacuggguguacgcucc

SEQ ID NO: 2270949 - RNA, 20 nt, Yersinia pestis
cguccugaugaugaagcauu

SEQ ID NO: 2270950 - RNA, 13 nt, Yersinia pestis
cgucaucaucuuc

SEQ ID NO: 2270951 - RNA, 21 nt, Yersinia pestis
cgucccauuccguuuaaacuc

SEQ ID NO: 2270952 - RNA, 16 nt, Yersinia pestis
cguccggcggcuagca

SEQ ID NO: 2270953 - RNA, 11 nt, Yersinia pestis
cguaaagcacc

SEQ ID NO: 2270954 - RNA, 21 nt, Yersinia pestis
cguaaaaaggcagugacagua

SEQ ID NO: 2270955 - RNA, 20 nt, Yersinia pestis
cgguuuucacccccacauca

SEQ ID NO: 2270956 - RNA, 17 nt, Yersinia pestis
cgguuuuaucaauaggu

SEQ ID NO: 2270957 - RNA, 23 nt, Yersinia pestis
cguaacuccuuuguuauuucugg

SEQ ID NO: 2270958 - RNA, 12 nt, Yersinia pestis
cguaagauuggg

SEQ ID NO: 2270959 - RNA, 18 nt, Yersinia pestis
cguaacgaauucagcagc

SEQ ID NO: 2270960 - RNA, 19 nt, Yersinia pestis
cguaacgaauucagcagcg

SEQ ID NO: 2270961 - RNA, 21 nt, Yersinia pestis
cguaaagaggccagcuucccu

SEQ ID NO: 2270962 - RNA, 12 nt, Yersinia pestis
cgguuuauauuu

SEQ ID NO: 2270963 - RNA, 16 nt, Yersinia pestis
cgguuucagcuugcaa

SEQ ID NO: 2270964 - RNA, 16 nt, Yersinia pestis
cgguuucacccucuuu

SEQ ID NO: 2270965 - RNA, 15 nt, Yersinia pestis
cgguuucaacuucaa

SEQ ID NO: 2270966 - RNA, 19 nt, Yersinia pestis
cgguuucgcaucaggcuua

SEQ ID NO: 2270967 - RNA, 22 nt, Yersinia pestis
cgguuggucagcacuuccaacu

SEQ ID NO: 2270968 - RNA, 19 nt, Yersinia pestis
cgguugccagccaggauag

SEQ ID NO: 2270969 - RNA, 22 nt, Yersinia pestis
cgguuauugaauauuuaaauua

SEQ ID NO: 2270970 - RNA, 22 nt, Yersinia pestis
cgguuaacgacgcauuaauccg

SEQ ID NO: 2270971 - RNA, 17 nt, Yersinia pestis
cgguuaauugaauugcc

SEQ ID NO: 2270972 - RNA, 16 nt, Yersinia pestis
cggugauuacugucau

SEQ ID NO: 2270973 - RNA, 22 nt, Yersinia pestis
cggugauuacugucauuuccuc

SEQ ID NO: 2270974 - RNA, 15 nt, Yersinia pestis
cggugcugacaaaca

SEQ ID NO: 2270975 - RNA, 15 nt, Yersinia pestis
cgguguuuggugaag

SEQ ID NO: 2270976 - RNA, 13 nt, Yersinia pestis
cgguuaaauacag

SEQ ID NO: 2270977 - RNA, 22 nt, Yersinia pestis
cgguguuagaucggccaaugcu

SEQ ID NO: 2270978 - RNA, 15 nt, Yersinia pestis
cggugugcaaugcag

SEQ ID NO: 2270979 - RNA, 14 nt, Yersinia pestis
cggugcuggugggc

SEQ ID NO: 2270980 - RNA, 13 nt, Yersinia pestis
cgguggccgccuu

SEQ ID NO: 2270981 - RNA, 20 nt, Yersinia pestis
cgucugcaucguucacggca

SEQ ID NO: 2270982 - RNA, 14 nt, Yersinia pestis
cgucugccauugcu

SEQ ID NO: 2270983 - RNA, 18 nt, Yersinia pestis
cgucucuaacccauuggu

SEQ ID NO: 2270984 - RNA, 21 nt, Yersinia pestis
cgugacggcagcgagcacugc

SEQ ID NO: 2270985 - RNA, 13 nt, Yersinia pestis
cgugacggcagcg

SEQ ID NO: 2270986 - RNA, 17 nt, Yersinia pestis
cgucuuuuaccaaugaa

SEQ ID NO: 2270987 - RNA, 21 nt, Yersinia pestis
cgugcguuuuugaaauaccac

SEQ ID NO: 2270988 - RNA, 18 nt, Yersinia pestis
cgugaguuuucgcuucuu

SEQ ID NO: 2270989 - RNA, 14 nt, Yersinia pestis
cgugcagaacaaaa

SEQ ID NO: 2270990 - RNA, 16 nt, Yersinia pestis
cgugccagauccucuu

SEQ ID NO: 2270991 - RNA, 22 nt, Yersinia pestis
cgugcaauaaagcgauaaauac

SEQ ID NO: 2270992 - RNA, 14 nt, Yersinia pestis
cgugugauuuccau

SEQ ID NO: 2270993 - RNA, 13 nt, Yersinia pestis
cgugugauaaacu

SEQ ID NO: 2270994 - RNA, 23 nt, Yersinia pestis
cguguuagcggcucuuacucauu

SEQ ID NO: 2270995 - RNA, 20 nt, Yersinia pestis
cguguuuuucaucugugccu

SEQ ID NO: 2270996 - RNA, 19 nt, Yersinia pestis
cguuaaacauuauuuuuca

SEQ ID NO: 2270997 - RNA, 19 nt, Yersinia pestis
cguguauaucacuauuuca

SEQ ID NO: 2270998 - RNA, 23 nt, Yersinia pestis
cguguauaucacuauuucagaca

SEQ ID NO: 2270999 - RNA, 18 nt, Yersinia pestis
cgugucagacugcugaca

SEQ ID NO: 2271000 - RNA, 21 nt, Yersinia pestis
cgugucaauauucuguuaguc

SEQ ID NO: 2271001 - RNA, 13 nt, Yersinia pestis
cguguaaaaccuu

SEQ ID NO: 2271002 - RNA, 16 nt, Yersinia pestis
cgugguuguaucacaa

SEQ ID NO: 2271003 - RNA, 20 nt, Yersinia pestis
cgugcucaucaaccucagcc

SEQ ID NO: 2271004 - RNA, 16 nt, Yersinia pestis
cguggauauccacauc

SEQ ID NO: 2271005 - RNA, 21 nt, Yersinia pestis
cguggcgcggaugcuuuauuc

SEQ ID NO: 2271006 - RNA, 21 nt, Yersinia pestis
cguggcccuuucgcagcccaa

SEQ ID NO: 2271007 - RNA, 21 nt, Yersinia pestis
cguggccccaagcauagaaga

SEQ ID NO: 2271008 - RNA, 15 nt, Yersinia pestis
cguggguucuucaaa

SEQ ID NO: 2271009 - RNA, 16 nt, Yersinia pestis
cguggcguucccgcag

SEQ ID NO: 2271010 - RNA, 16 nt, Yersinia pestis
cguuggcuaaauaacc

SEQ ID NO: 2271011 - RNA, 20 nt, Yersinia pestis
cguuuacugcuuaaaccaua

SEQ ID NO: 2271012 - RNA, 14 nt, Yersinia pestis
cguuuacugccuug

SEQ ID NO: 2271013 - RNA, 14 nt, Yersinia pestis
cguuuaaugccccu

SEQ ID NO: 2271014 - RNA, 19 nt, Yersinia pestis
cguugcucagcgcaucaaa

SEQ ID NO: 2271015 - RNA, 15 nt, Yersinia pestis
cguugcuaccagcaa

SEQ ID NO: 2271016 - RNA, 21 nt, Yersinia pestis
cguugcuuuuugccagugguu

SEQ ID NO: 2271017 - RNA, 21 nt, Yersinia pestis
cguuggaucaucgggaacagg

SEQ ID NO: 2271018 - RNA, 17 nt, Yersinia pestis
cguucuuauugaagggc

SEQ ID NO: 2271019 - RNA, 14 nt, Yersinia pestis
cguucugucacaau

SEQ ID NO: 2271020 - RNA, 23 nt, Yersinia pestis
cguucgcgguuuacggcaauaau

SEQ ID NO: 2271021 - RNA, 15 nt, Yersinia pestis
cguuaaccaguagcg

SEQ ID NO: 2271022 - RNA, 13 nt, Yersinia pestis
cguuaacccaaag

SEQ ID NO: 2271023 - RNA, 16 nt, Yersinia pestis
cguuccaaucugcgcc

SEQ ID NO: 2271024 - RNA, 17 nt, Yersinia pestis
cguuaaguucaagaacc

SEQ ID NO: 2271025 - RNA, 20 nt, Yersinia pestis
cuaaaauuaucgcaauuuca

SEQ ID NO: 2271026 - RNA, 18 nt, Yersinia pestis
cuaaaaugaucuuuauua

SEQ ID NO: 2271027 - RNA, 17 nt, Yersinia pestis
cuaaaaugaauaacgcc

SEQ ID NO: 2271028 - RNA, 19 nt, Yersinia pestis
cuaaacgccgcgucaauaa

SEQ ID NO: 2271029 - RNA, 21 nt, Yersinia pestis
cuaaagaaauaaucauaucaa

SEQ ID NO: 2271030 - RNA, 16 nt, Yersinia pestis
cuaaacugaucaucaa

SEQ ID NO: 2271031 - RNA, 16 nt, Yersinia pestis
cuaaagauaauuaauu

SEQ ID NO: 2271032 - RNA, 20 nt, Yersinia pestis
cuaaaaacucgcgccugaaa

SEQ ID NO: 2271033 - RNA, 21 nt, Yersinia pestis
cguuugcuugcugccugccug

SEQ ID NO: 2271034 - RNA, 20 nt, Yersinia pestis
cguuuccaaaacucaugucc

SEQ ID NO: 2271035 - RNA, 21 nt, Yersinia pestis
cuaaaugcuggcggaaauauc

SEQ ID NO: 2271036 - RNA, 24 nt, Yersinia pestis
cuaaauuagaaaacaaguuucacu

SEQ ID NO: 2271037 - RNA, 13 nt, Yersinia pestis
cuaaauuaauauc

SEQ ID NO: 2271038 - RNA, 23 nt, Yersinia pestis
cuaaagcguaagugcaauuauuu

SEQ ID NO: 2271039 - RNA, 18 nt, Yersinia pestis
cuaaagcgccuuccuuuu

SEQ ID NO: 2271040 - RNA, 13 nt, Yersinia pestis
cuaaauaauucca

SEQ ID NO: 2271041 - RNA, 12 nt, Yersinia pestis
cuaaauacugcu

SEQ ID NO: 2271042 - RNA, 13 nt, Yersinia pestis
cuaaauaaccaga

SEQ ID NO: 2271043 - RNA, 21 nt, Yersinia pestis
cuaaauaauccagaagcugag

SEQ ID NO: 2271044 - RNA, 15 nt, Yersinia pestis
cggucacacuggcac

SEQ ID NO: 2271045 - RNA, 13 nt, Yersinia pestis
cggucacaccaga

SEQ ID NO: 2271046 - RNA, 21 nt, Yersinia pestis
cggucaauaccauauccacgg

SEQ ID NO: 2271047 - RNA, 18 nt, Yersinia pestis
cgguauccaucccaacaa

SEQ ID NO: 2271048 - RNA, 24 nt, Yersinia pestis
cgguaucaacaauuuccauaucaa

SEQ ID NO: 2271049 - RNA, 13 nt, Yersinia pestis
aaacuaauaucuu

SEQ ID NO: 2271050 - RNA, 16 nt, Yersinia pestis
aaacuaauauuuucua

SEQ ID NO: 2271051 - RNA, 14 nt, Yersinia pestis
cgguaaccaggcga

SEQ ID NO: 2271052 - RNA, 23 nt, Yersinia pestis
cgguaacuuuuuguugcaccaac

SEQ ID NO: 2271053 - RNA, 16 nt, Yersinia pestis
cgguaacgcagauaaa

SEQ ID NO: 2271054 - RNA, 12 nt, Yersinia pestis
cgguaagcuggc

SEQ ID NO: 2271055 - RNA, 15 nt, Yersinia pestis
cgguaauaaaucaug

SEQ ID NO: 2271056 - RNA, 14 nt, Yersinia pestis
cgguaauuaauaua

SEQ ID NO: 2271057 - RNA, 22 nt, Yersinia pestis
cgguaaucccgauauaaauaaa

SEQ ID NO: 2271058 - RNA, 22 nt, Yersinia pestis
cgguaauauccacauuggaauu

SEQ ID NO: 2271059 - RNA, 14 nt, Yersinia pestis
cgguaccagcaaac

SEQ ID NO: 2271060 - RNA, 18 nt, Yersinia pestis
cgguagguuucugggcug

SEQ ID NO: 2271061 - RNA, 14 nt, Yersinia pestis
cgguaguaauaauu

SEQ ID NO: 2271062 - RNA, 16 nt, Yersinia pestis
cgguaccgcaggucag

SEQ ID NO: 2271063 - RNA, 19 nt, Yersinia pestis
cgguaccggcgguuaucac

SEQ ID NO: 2271064 - RNA, 15 nt, Yersinia pestis
cgguacugaaaucca

SEQ ID NO: 2271065 - RNA, 14 nt, Yersinia pestis
cgguagaccaccaa

SEQ ID NO: 2271066 - RNA, 15 nt, Yersinia pestis
cgguagaccaccaac

SEQ ID NO: 2271067 - RNA, 20 nt, Yersinia pestis
cggucgaacccauucaucaa

SEQ ID NO: 2271068 - RNA, 21 nt, Yersinia pestis
cggucagguggugcccgacca

SEQ ID NO: 2271069 - RNA, 19 nt, Yersinia pestis
cggugacucgggucaguga

SEQ ID NO: 2271070 - RNA, 18 nt, Yersinia pestis
cggugaggauaggcagag

SEQ ID NO: 2271071 - RNA, 11 nt, Yersinia pestis
cggugaacaga

SEQ ID NO: 2271072 - RNA, 21 nt, Yersinia pestis
cggugacauccgcuugcagca

SEQ ID NO: 2271073 - RNA, 17 nt, Yersinia pestis
cggugacccgugcggca

SEQ ID NO: 2271074 - RNA, 23 nt, Yersinia pestis
cgguaacauauaaaccagccagu

SEQ ID NO: 2271075 - RNA, 17 nt, Yersinia pestis
cggguuuacccagccaa

SEQ ID NO: 2271076 - RNA, 20 nt, Yersinia pestis
cggguugcccaucagcauca

SEQ ID NO: 2271077 - RNA, 17 nt, Yersinia pestis
cggguggcgcugacggu

SEQ ID NO: 2271078 - RNA, 16 nt, Yersinia pestis
cggguggugaaaucgg

SEQ ID NO: 2271079 - RNA, 23 nt, Yersinia pestis
cggguggcccaaaugagcagcaa

SEQ ID NO: 2271080 - RNA, 17 nt, Yersinia pestis
cggguggaccuccauca

SEQ ID NO: 2271081 - RNA, 18 nt, Yersinia pestis
cggguucgcgcucacgca

SEQ ID NO: 2271082 - RNA, 13 nt, Yersinia pestis
cggguucuaaauc

SEQ ID NO: 2271083 - RNA, 15 nt, Yersinia pestis
cgggucagugaaaaa

SEQ ID NO: 2271084 - RNA, 15 nt, Yersinia pestis
cgggucacagccacg

SEQ ID NO: 2271085 - RNA, 16 nt, Yersinia pestis
cggguauuugucgucc

SEQ ID NO: 2271086 - RNA, 19 nt, Yersinia pestis
cggguauauuccuguccuu

SEQ ID NO: 2271087 - RNA, 14 nt, Yersinia pestis
cggguauauugccc

SEQ ID NO: 2271088 - RNA, 14 nt, Yersinia pestis
cgggugagugagcg

SEQ ID NO: 2271089 - RNA, 13 nt, Yersinia pestis
cgggcugauuaau

SEQ ID NO: 2271090 - RNA, 23 nt, Yersinia pestis
cgggcugcugcagccgggaugau

SEQ ID NO: 2271091 - RNA, 18 nt, Yersinia pestis
cgggcuuccaucaggaag

SEQ ID NO: 2271092 - RNA, 16 nt, Yersinia pestis
cggggccaucaucuuc

SEQ ID NO: 2271093 - RNA, 17 nt, Yersinia pestis
cggggauccauaggauc

SEQ ID NO: 2271094 - RNA, 16 nt, Yersinia pestis
cggggguugucagcag

SEQ ID NO: 2271095 - RNA, 16 nt, Yersinia pestis
cgggcagugcgggcaa

SEQ ID NO: 2271096 - RNA, 22 nt, Yersinia pestis
cgggcagugcgggcaacacagc

SEQ ID NO: 2271097 - RNA, 22 nt, Yersinia pestis
cgggaggaaggcuugaacguga

SEQ ID NO: 2271098 - RNA, 22 nt, Yersinia pestis
cgggaggauaaguuccggcaga

SEQ ID NO: 2271099 - RNA, 19 nt, Yersinia pestis
cgggauaucgauggcaacc

SEQ ID NO: 2271100 - RNA, 15 nt, Yersinia pestis
cgggaucaccgcuuu

SEQ ID NO: 2271101 - RNA, 22 nt, Yersinia pestis
cgggauggaaauugaacgguuu

SEQ ID NO: 2271102 - RNA, 22 nt, Yersinia pestis
cgggccagcaaccacgguauca

SEQ ID NO: 2271103 - RNA, 14 nt, Yersinia pestis
cgggccuaauuuaa

SEQ ID NO: 2271104 - RNA, 16 nt, Yersinia pestis
cgggcgcaauggaaga

SEQ ID NO: 2271105 - RNA, 19 nt, Yersinia pestis
cgggcggaaauaaggcgca

SEQ ID NO: 2271106 - RNA, 15 nt, Yersinia pestis
cgggcggccucugcu

SEQ ID NO: 2271107 - RNA, 17 nt, Yersinia pestis
cggcugggaacccauca

SEQ ID NO: 2271108 - RNA, 12 nt, Yersinia pestis
cggcugguaaca

SEQ ID NO: 2271109 - RNA, 17 nt, Yersinia pestis
cggcugguaacagagcc

SEQ ID NO: 2271110 - RNA, 17 nt, Yersinia pestis
cggcugaccacaaaaac

SEQ ID NO: 2271111 - RNA, 20 nt, Yersinia pestis
cggcucuaucgauaaaguca

SEQ ID NO: 2271112 - RNA, 18 nt, Yersinia pestis
cggcuuucaggugacuga

SEQ ID NO: 2271113 - RNA, 15 nt, Yersinia pestis
cggcuuucugccugu

SEQ ID NO: 2271114 - RNA, 22 nt, Yersinia pestis
cggcuuuuuaaacuuguaucaa

SEQ ID NO: 2271115 - RNA, 22 nt, Yersinia pestis
cgggaaauaacuggugaugcuc

SEQ ID NO: 2271116 - RNA, 17 nt, Yersinia pestis
cggcucaccuggccucc

SEQ ID NO: 2271117 - RNA, 14 nt, Yersinia pestis
cggcucauccgcca

SEQ ID NO: 2271118 - RNA, 21 nt, Yersinia pestis
cggcguuaaugccacccccag

SEQ ID NO: 2271119 - RNA, 22 nt, Yersinia pestis
cggcguuaaugccacccccagu

SEQ ID NO: 2271120 - RNA, 16 nt, Yersinia pestis
cggcuaaccacagcaa

SEQ ID NO: 2271121 - RNA, 22 nt, Yersinia pestis
cggcuaaagcguggcgcaggaa

SEQ ID NO: 2271122 - RNA, 14 nt, Yersinia pestis
cggcgucugauaac

SEQ ID NO: 2271123 - RNA, 17 nt, Yersinia pestis
cuucugaacgaccagaa

SEQ ID NO: 2271124 - RNA, 20 nt, Yersinia pestis
cuucugccuauccucaccgu

SEQ ID NO: 2271125 - RNA, 19 nt, Yersinia pestis
cuucucucccgccaauuca

SEQ ID NO: 2271126 - RNA, 16 nt, Yersinia pestis
cuucucgugucacagu

SEQ ID NO: 2271127 - RNA, 18 nt, Yersinia pestis
cuucuaaaaucgcacuga

SEQ ID NO: 2271128 - RNA, 18 nt, Yersinia pestis
cuucguagaguugcaguu

SEQ ID NO: 2271129 - RNA, 17 nt, Yersinia pestis
cuucuacaaauuuuuua

SEQ ID NO: 2271130 - RNA, 22 nt, Yersinia pestis
cuucuacaaauuuuuuauauuc

SEQ ID NO: 2271131 - RNA, 18 nt, Yersinia pestis
cuucuaccguaucagccc

SEQ ID NO: 2271132 - RNA, 13 nt, Yersinia pestis
cuucuagcucuuc

SEQ ID NO: 2271133 - RNA, 19 nt, Yersinia pestis
cuucuagcucuuccagcaa

SEQ ID NO: 2271134 - RNA, 20 nt, Yersinia pestis
cuucuuaauucccagccacu

SEQ ID NO: 2271135 - RNA, 19 nt, Yersinia pestis
cuucuguugcccccugcuc

SEQ ID NO: 2271136 - RNA, 15 nt, Yersinia pestis
cuucuggugguguca

SEQ ID NO: 2271137 - RNA, 15 nt, Yersinia pestis
cuucuggcgugucau

SEQ ID NO: 2271138 - RNA, 15 nt, Yersinia pestis
cuucuuggguggcaa

SEQ ID NO: 2271139 - RNA, 13 nt, Yersinia pestis
cuucuuccaucuu

SEQ ID NO: 2271140 - RNA, 13 nt, Yersinia pestis
cuucuucauccca

SEQ ID NO: 2271141 - RNA, 16 nt, Yersinia pestis
cuugaauaauauucaa

SEQ ID NO: 2271142 - RNA, 13 nt, Yersinia pestis
cuugaccaaccug

SEQ ID NO: 2271143 - RNA, 11 nt, Yersinia pestis
cuugaagagug

SEQ ID NO: 2271144 - RNA, 18 nt, Yersinia pestis
cuucuuuuaaagaagaau

SEQ ID NO: 2271145 - RNA, 22 nt, Yersinia pestis
cuucuuuaucuaaaauaucuuu

SEQ ID NO: 2271146 - RNA, 15 nt, Yersinia pestis
cuucuuuacugcccu

SEQ ID NO: 2271147 - RNA, 23 nt, Yersinia pestis
cuugaaaugauaacaauaaaauc

SEQ ID NO: 2271148 - RNA, 14 nt, Yersinia pestis
cuugacugaccaua

SEQ ID NO: 2271149 - RNA, 16 nt, Yersinia pestis
cuugacugcguucugc

SEQ ID NO: 2271150 - RNA, 14 nt, Yersinia pestis
cuugagauccucca

SEQ ID NO: 2271151 - RNA, 20 nt, Yersinia pestis
cuugagauccuccauauccu

SEQ ID NO: 2271152 - RNA, 16 nt, Yersinia pestis
cuugaccuucccucuu

SEQ ID NO: 2271153 - RNA, 19 nt, Yersinia pestis
cuugacgcguugcccuucu

SEQ ID NO: 2271154 - RNA, 18 nt, Yersinia pestis
cuugaccuugccuugcau

SEQ ID NO: 2271155 - RNA, 16 nt, Yersinia pestis
cuugacuaacacgacu

SEQ ID NO: 2271156 - RNA, 18 nt, Yersinia pestis
cuugaguauccaauaagc

SEQ ID NO: 2271157 - RNA, 13 nt, Yersinia pestis
cuugagucagcac

SEQ ID NO: 2271158 - RNA, 21 nt, Yersinia pestis
cuugagggugaccaucuggcg

SEQ ID NO: 2271159 - RNA, 21 nt, Yersinia pestis
cuugauagggcugaagaccca

SEQ ID NO: 2271160 - RNA, 22 nt, Yersinia pestis
cuugauagggcugaagacccaa

SEQ ID NO: 2271161 - RNA, 18 nt, Yersinia pestis
cuugauacuugaaacagc

SEQ ID NO: 2271162 - RNA, 13 nt, Yersinia pestis
cuugaucaacuca

SEQ ID NO: 2271163 - RNA, 17 nt, Yersinia pestis
cuugcagcaacacgccg

SEQ ID NO: 2271164 - RNA, 13 nt, Yersinia pestis
cuugcagcaacag

SEQ ID NO: 2271165 - RNA, 14 nt, Yersinia pestis
cuugcagcaacagg

SEQ ID NO: 2271166 - RNA, 21 nt, Yersinia pestis
cuugcagcgaucacagauaaa

SEQ ID NO: 2271167 - RNA, 15 nt, Yersinia pestis
cuugcauaucagcaa

SEQ ID NO: 2271168 - RNA, 18 nt, Yersinia pestis
cuugccauaagugaacau

SEQ ID NO: 2271169 - RNA, 15 nt, Yersinia pestis
cuugccauuuugggc

SEQ ID NO: 2271170 - RNA, 15 nt, Yersinia pestis
cuugccauuuugggu

SEQ ID NO: 2271171 - RNA, 17 nt, Yersinia pestis
cuugccagagcaauaac

SEQ ID NO: 2271172 - RNA, 19 nt, Yersinia pestis
cuugccacucugcuccgca

SEQ ID NO: 2271173 - RNA, 13 nt, Yersinia pestis
cuugauggcauca

SEQ ID NO: 2271174 - RNA, 23 nt, Yersinia pestis
cuugauggcuaauuaauuuaaac

SEQ ID NO: 2271175 - RNA, 12 nt, Yersinia pestis
cuugauuaaaug

SEQ ID NO: 2271176 - RNA, 16 nt, Yersinia pestis
cuugcaagguauuuug

SEQ ID NO: 2271177 - RNA, 18 nt, Yersinia pestis
cuugcaacaaaauggccu

SEQ ID NO: 2271178 - RNA, 15 nt, Yersinia pestis
cuugcgcuccacgcc

SEQ ID NO: 2271179 - RNA, 21 nt, Yersinia pestis
cuugcgcguuaaucugcugcu

SEQ ID NO: 2271180 - RNA, 15 nt, Yersinia pestis
cuugcgcgaaauauu

SEQ ID NO: 2271181 - RNA, 13 nt, Yersinia pestis
cuugcgcgccugu

SEQ ID NO: 2271182 - RNA, 21 nt, Yersinia pestis
cuugcgccgaaauaaaaccau

SEQ ID NO: 2271183 - RNA, 15 nt, Yersinia pestis
cuugcugcaaccacu

SEQ ID NO: 2271184 - RNA, 17 nt, Yersinia pestis
cuugcugcaaccacuua

SEQ ID NO: 2271185 - RNA, 13 nt, Yersinia pestis
cuugcugcaaccg

SEQ ID NO: 2271186 - RNA, 20 nt, Yersinia pestis
cuugcuccaauaaaaaaucc

SEQ ID NO: 2271187 - RNA, 21 nt, Yersinia pestis
cuugcuucugaacgaccagaa

SEQ ID NO: 2271188 - RNA, 17 nt, Yersinia pestis
cuugcugccugccugcu

SEQ ID NO: 2271189 - RNA, 15 nt, Yersinia pestis
cuugccguuuugggc

SEQ ID NO: 2271190 - RNA, 18 nt, Yersinia pestis
cuucaaaaucaccuggcc

SEQ ID NO: 2271191 - RNA, 20 nt, Yersinia pestis
cuucaacugucacuaaaccu

SEQ ID NO: 2271192 - RNA, 16 nt, Yersinia pestis
cuucaaucauugagau

SEQ ID NO: 2271193 - RNA, 22 nt, Yersinia pestis
cuucaacuuuuuucuuaaggac

SEQ ID NO: 2271194 - RNA, 15 nt, Yersinia pestis
cuucaaucaacugaa

SEQ ID NO: 2271195 - RNA, 18 nt, Yersinia pestis
cuucaccaauacaaacag

SEQ ID NO: 2271196 - RNA, 14 nt, Yersinia pestis
cuucaccaauacaa

SEQ ID NO: 2271197 - RNA, 14 nt, Yersinia pestis
cuucaccaaaaaaa

SEQ ID NO: 2271198 - RNA, 16 nt, Yersinia pestis
cuucaccaaaggaagc

SEQ ID NO: 2271199 - RNA, 19 nt, Yersinia pestis
cuucaguaaagcgcaggaa

SEQ ID NO: 2271200 - RNA, 21 nt, Yersinia pestis
cuucaguaaagcgcaggaaag

SEQ ID NO: 2271201 - RNA, 19 nt, Yersinia pestis
cuucagguaccccauaaau

SEQ ID NO: 2271202 - RNA, 20 nt, Yersinia pestis
cuucaggccaagccugugcu

SEQ ID NO: 2271203 - RNA, 19 nt, Yersinia pestis
cuucaggccaagccugugc

SEQ ID NO: 2271204 - RNA, 22 nt, Yersinia pestis
cuucagcuuccgcuucaacuuc

SEQ ID NO: 2271205 - RNA, 22 nt, Yersinia pestis
cuucagaugaauccagccaugc

SEQ ID NO: 2271206 - RNA, 17 nt, Yersinia pestis
cuucaguggcuggaaag

SEQ ID NO: 2271207 - RNA, 12 nt, Yersinia pestis
cuucauugcugc

SEQ ID NO: 2271208 - RNA, 15 nt, Yersinia pestis
cuucauuucaggacu

SEQ ID NO: 2271209 - RNA, 17 nt, Yersinia pestis
cuucaucccaaucauca

SEQ ID NO: 2271210 - RNA, 16 nt, Yersinia pestis
cuucauuaucauguaa

SEQ ID NO: 2271211 - RNA, 16 nt, Yersinia pestis
cuucauuuucaucacu

SEQ ID NO: 2271212 - RNA, 16 nt, Yersinia pestis
aaacuucacuuucuuu

SEQ ID NO: 2271213 - RNA, 21 nt, Yersinia pestis
aaacuuccagcguauguuccu

SEQ ID NO: 2271214 - RNA, 21 nt, Yersinia pestis
cuuccaacucaccuaaaucau

SEQ ID NO: 2271215 - RNA, 16 nt, Yersinia pestis
cuuccaacucaccuaa

SEQ ID NO: 2271216 - RNA, 11 nt, Yersinia pestis
cuuccaccauc

SEQ ID NO: 2271217 - RNA, 15 nt, Yersinia pestis
cuuccggcaucuuuu

SEQ ID NO: 2271218 - RNA, 14 nt, Yersinia pestis
cuuccggcaucuuu

SEQ ID NO: 2271219 - RNA, 23 nt, Yersinia pestis
cuuccauaaacggaacucaucuu

SEQ ID NO: 2271220 - RNA, 19 nt, Yersinia pestis
cuucccgaguaauaccaaa

SEQ ID NO: 2271221 - RNA, 12 nt, Yersinia pestis
cuucgagcaccg

SEQ ID NO: 2271222 - RNA, 17 nt, Yersinia pestis
cuucgcgaacacaauug

SEQ ID NO: 2271223 - RNA, 21 nt, Yersinia pestis
cuucgccgggucaggaagaga

SEQ ID NO: 2271224 - RNA, 20 nt, Yersinia pestis
cuucgccguauaaacgccuc

SEQ ID NO: 2271225 - RNA, 23 nt, Yersinia pestis
cuucgcggacgcuggcacugcca

SEQ ID NO: 2271226 - RNA, 14 nt, Yersinia pestis
cuucgcgcaguaaa

SEQ ID NO: 2271227 - RNA, 23 nt, Yersinia pestis
cuuccuacaacgugguuuauuua

SEQ ID NO: 2271228 - RNA, 15 nt, Yersinia pestis
cuuccucaaugcaga

SEQ ID NO: 2271229 - RNA, 21 nt, Yersinia pestis
cuucgacagucacuaauaccu

SEQ ID NO: 2271230 - RNA, 20 nt, Yersinia pestis
cuucgacccagaggguuaac

SEQ ID NO: 2271231 - RNA, 17 nt, Yersinia pestis
cuuaacgccccgccccu

SEQ ID NO: 2271232 - RNA, 18 nt, Yersinia pestis
cuuaaucagcaaaaacaa

SEQ ID NO: 2271233 - RNA, 21 nt, Yersinia pestis
cuuaaucaucaucacaaauaa

SEQ ID NO: 2271234 - RNA, 17 nt, Yersinia pestis
aaacugcucauaaagca

SEQ ID NO: 2271235 - RNA, 21 nt, Yersinia pestis
cuuaacaaucagugcaauaaa

SEQ ID NO: 2271236 - RNA, 21 nt, Yersinia pestis
cuuaacacgaaccuucucugc

SEQ ID NO: 2271237 - RNA, 22 nt, Yersinia pestis
cuuaaauauaccgccaagcgcc

SEQ ID NO: 2271238 - RNA, 11 nt, Yersinia pestis
cuuaaauaacu

SEQ ID NO: 2271239 - RNA, 21 nt, Yersinia pestis
cuuaaagccuucaacuaauau

SEQ ID NO: 2271240 - RNA, 15 nt, Yersinia pestis
cuuaaagcccagguu

SEQ ID NO: 2271241 - RNA, 21 nt, Yersinia pestis
cuuaaagaaaauuuacccugc

SEQ ID NO: 2271242 - RNA, 22 nt, Yersinia pestis
cuuaaagaaaauuuacccugcu

SEQ ID NO: 2271243 - RNA, 19 nt, Yersinia pestis
cuuaaaaacccauaagucc

SEQ ID NO: 2271244 - RNA, 20 nt, Yersinia pestis
cuuaaaaaaugauaaauucu

SEQ ID NO: 2271245 - RNA, 13 nt, Yersinia pestis
cuuaaaaaucaaa

SEQ ID NO: 2271246 - RNA, 16 nt, Yersinia pestis
cuuaaaaaucaaaagu

SEQ ID NO: 2271247 - RNA, 22 nt, Yersinia pestis
cuuaaaaaucaauaaacucuuu

SEQ ID NO: 2271248 - RNA, 14 nt, Yersinia pestis
cuguuuuuuauccc

SEQ ID NO: 2271249 - RNA, 16 nt, Yersinia pestis
cuguuuuugaagauuc

SEQ ID NO: 2271250 - RNA, 14 nt, Yersinia pestis
cuguuuauugagua

SEQ ID NO: 2271251 - RNA, 12 nt, Yersinia pestis
cuguuucaacau

SEQ ID NO: 2271252 - RNA, 14 nt, Yersinia pestis
cuguuucaaauaag

SEQ ID NO: 2271253 - RNA, 18 nt, Yersinia pestis
cuguuuaccuaucucagu

SEQ ID NO: 2271254 - RNA, 17 nt, Yersinia pestis
cuguuuccucuucaucu

SEQ ID NO: 2271255 - RNA, 21 nt, Yersinia pestis
cuguuaucugguuauauugac

SEQ ID NO: 2271256 - RNA, 19 nt, Yersinia pestis
cuguuauuggggacaggcu

SEQ ID NO: 2271257 - RNA, 20 nt, Yersinia pestis
cuguuauaaggcuaacaccu

SEQ ID NO: 2271258 - RNA, 20 nt, Yersinia pestis
cuguuacgguauuugaacuu

SEQ ID NO: 2271259 - RNA, 22 nt, Yersinia pestis
cuguuagggcgcggcugguaac

SEQ ID NO: 2271260 - RNA, 22 nt, Yersinia pestis
cuguuaguaacuguaaggccaa

SEQ ID NO: 2271261 - RNA, 16 nt, Yersinia pestis
cuggcccaguagagca

SEQ ID NO: 2271262 - RNA, 22 nt, Yersinia pestis
cuggcccaguagagcacuucau

SEQ ID NO: 2271263 - RNA, 16 nt, Yersinia pestis
cuuacgagcuaaugcu

SEQ ID NO: 2271264 - RNA, 18 nt, Yersinia pestis
cuuaccugaguaagcuca

SEQ ID NO: 2271265 - RNA, 17 nt, Yersinia pestis
cuuacucauucgaauga

SEQ ID NO: 2271266 - RNA, 16 nt, Yersinia pestis
cuuacuaccgucuuug

SEQ ID NO: 2271267 - RNA, 16 nt, Yersinia pestis
cuuacuguaucaauac

SEQ ID NO: 2271268 - RNA, 22 nt, Yersinia pestis
cuuacuguaucaauaccuuacu

SEQ ID NO: 2271269 - RNA, 22 nt, Yersinia pestis
cuuagaguaaguaaaaaggaua

SEQ ID NO: 2271270 - RNA, 13 nt, Yersinia pestis
cuuagcaggcccu

SEQ ID NO: 2271271 - RNA, 21 nt, Yersinia pestis
cuuagcacguuuuucagcuuc

SEQ ID NO: 2271272 - RNA, 15 nt, Yersinia pestis
cuuaauucccagcca

SEQ ID NO: 2271273 - RNA, 23 nt, Yersinia pestis
cuuaauggcaccguggauaaaca

SEQ ID NO: 2271274 - RNA, 16 nt, Yersinia pestis
cuuaauggucuucuuu

SEQ ID NO: 2271275 - RNA, 15 nt, Yersinia pestis
cuuaaucgccagcaa

SEQ ID NO: 2271276 - RNA, 15 nt, Yersinia pestis
cuuacauaaguaagu

SEQ ID NO: 2271277 - RNA, 14 nt, Yersinia pestis
cuuacauaaguaag

SEQ ID NO: 2271278 - RNA, 17 nt, Yersinia pestis
cuuaaugucuuuacuaa

SEQ ID NO: 2271279 - RNA, 11 nt, Yersinia pestis
cuuacagugau

SEQ ID NO: 2271280 - RNA, 23 nt, Yersinia pestis
cuuacauuucaucuugauuagcg

SEQ ID NO: 2271281 - RNA, 16 nt, Yersinia pestis
cuuacccgaaucacuu

SEQ ID NO: 2271282 - RNA, 17 nt, Yersinia pestis
cuuacccgaaucacuua

SEQ ID NO: 2271283 - RNA, 17 nt, Yersinia pestis
cuuauuugaaauacuua

SEQ ID NO: 2271284 - RNA, 18 nt, Yersinia pestis
cuuauuugaaauacuuau

SEQ ID NO: 2271285 - RNA, 22 nt, Yersinia pestis
cuuauugggcgcgauaaaagau

SEQ ID NO: 2271286 - RNA, 20 nt, Yersinia pestis
cuuaucgaccaacuggcaau

SEQ ID NO: 2271287 - RNA, 15 nt, Yersinia pestis
cuuaucgguuuuuug

SEQ ID NO: 2271288 - RNA, 16 nt, Yersinia pestis
cuuaucgguuuuuugg

SEQ ID NO: 2271289 - RNA, 18 nt, Yersinia pestis
cuuaucgucaaguucaua

SEQ ID NO: 2271290 - RNA, 15 nt, Yersinia pestis
cuuauggcguuugau

SEQ ID NO: 2271291 - RNA, 18 nt, Yersinia pestis
cuuagcgcacggggaaac

SEQ ID NO: 2271292 - RNA, 14 nt, Yersinia pestis
cuuaguauuauagg

SEQ ID NO: 2271293 - RNA, 14 nt, Yersinia pestis
cuuauauaaaucca

SEQ ID NO: 2271294 - RNA, 17 nt, Yersinia pestis
cuuaucagcgaaaaauu

SEQ ID NO: 2271295 - RNA, 16 nt, Yersinia pestis
cuuuaaaucuagcccu

SEQ ID NO: 2271296 - RNA, 12 nt, Yersinia pestis
cuuuaaagccaa

SEQ ID NO: 2271297 - RNA, 11 nt, Yersinia pestis
cuuguuuuuuu

SEQ ID NO: 2271298 - RNA, 23 nt, Yersinia pestis
cuuuaaaaaaauuaucaucaaua

SEQ ID NO: 2271299 - RNA, 20 nt, Yersinia pestis
cuuguuugcgccguaaacug

SEQ ID NO: 2271300 - RNA, 24 nt, Yersinia pestis
aaagaaccccccaccaucaacaua

SEQ ID NO: 2271301 - RNA, 20 nt, Yersinia pestis
aaagaaauuuuuagaaaaca

SEQ ID NO: 2271302 - RNA, 14 nt, Yersinia pestis
aaagaagacauauc

SEQ ID NO: 2271303 - RNA, 23 nt, Yersinia pestis
aaagaagacgaguaaugaaaucu

SEQ ID NO: 2271304 - RNA, 20 nt, Yersinia pestis
aaagaagaauccacauaaaa

SEQ ID NO: 2271305 - RNA, 15 nt, Yersinia pestis
cuuguuaauuuaaac

SEQ ID NO: 2271306 - RNA, 19 nt, Yersinia pestis
cuugugggcaucugucuaa

SEQ ID NO: 2271307 - RNA, 21 nt, Yersinia pestis
cuuguguaauuauauuuaauu

SEQ ID NO: 2271308 - RNA, 16 nt, Yersinia pestis
cuuguucaaucagcau

SEQ ID NO: 2271309 - RNA, 16 nt, Yersinia pestis
cuuguggauccagcac

SEQ ID NO: 2271310 - RNA, 19 nt, Yersinia pestis
aaagaaauaaaagaaaacc

SEQ ID NO: 2271311 - RNA, 13 nt, Yersinia pestis
aaagaaaauuuac

SEQ ID NO: 2271312 - RNA, 12 nt, Yersinia pestis
aaagaaaaauag

SEQ ID NO: 2271313 - RNA, 18 nt, Yersinia pestis
cuugggccgacucugcau

SEQ ID NO: 2271314 - RNA, 16 nt, Yersinia pestis
cuuggcgauguuuugg

SEQ ID NO: 2271315 - RNA, 21 nt, Yersinia pestis
cuuggcgcggacgcuuuacuc

SEQ ID NO: 2271316 - RNA, 18 nt, Yersinia pestis
cuuggcguagcuugauuc

SEQ ID NO: 2271317 - RNA, 19 nt, Yersinia pestis
cuuggaacuuacucccuug

SEQ ID NO: 2271318 - RNA, 18 nt, Yersinia pestis
cuuggcaccuaauaagcu

SEQ ID NO: 2271319 - RNA, 14 nt, Yersinia pestis
cuuggcaucacaga

SEQ ID NO: 2271320 - RNA, 21 nt, Yersinia pestis
cuuggcauugucugcuggccu

SEQ ID NO: 2271321 - RNA, 22 nt, Yersinia pestis
cuuggccgauaugaagcacaaa

SEQ ID NO: 2271322 - RNA, 13 nt, Yersinia pestis
cuugguuaguucu

SEQ ID NO: 2271323 - RNA, 18 nt, Yersinia pestis
cuugguuaugggggcaaa

SEQ ID NO: 2271324 - RNA, 14 nt, Yersinia pestis
cuugguugcaagua

SEQ ID NO: 2271325 - RNA, 12 nt, Yersinia pestis
cuugguuguuuc

SEQ ID NO: 2271326 - RNA, 23 nt, Yersinia pestis
cuuggugauacccagcaggucac

SEQ ID NO: 2271327 - RNA, 19 nt, Yersinia pestis
cuuggugauuuucugugau

SEQ ID NO: 2271328 - RNA, 19 nt, Yersinia pestis
cuugguccgggauggaaau

SEQ ID NO: 2271329 - RNA, 19 nt, Yersinia pestis
cuuggucauaccggcggca

SEQ ID NO: 2271330 - RNA, 14 nt, Yersinia pestis
cuugggugaagaca

SEQ ID NO: 2271331 - RNA, 16 nt, Yersinia pestis
cuuggggaaguggccc

SEQ ID NO: 2271332 - RNA, 17 nt, Yersinia pestis
cuuggggcaacucccca

SEQ ID NO: 2271333 - RNA, 21 nt, Yersinia pestis
aaacuuuuauugucuuuaaua

SEQ ID NO: 2271334 - RNA, 23 nt, Yersinia pestis
cuugucaccguaaccauuggcac

SEQ ID NO: 2271335 - RNA, 14 nt, Yersinia pestis
cuuguauccuggcc

SEQ ID NO: 2271336 - RNA, 15 nt, Yersinia pestis
cuuguaccugugcca

SEQ ID NO: 2271337 - RNA, 22 nt, Yersinia pestis
cuuguaagaccaauugguaaga

SEQ ID NO: 2271338 - RNA, 19 nt, Yersinia pestis
cuuugguccucuuauggua

SEQ ID NO: 2271339 - RNA, 18 nt, Yersinia pestis
cuuuggguuguuucaaga

SEQ ID NO: 2271340 - RNA, 18 nt, Yersinia pestis
cuuugguugccagauaau

SEQ ID NO: 2271341 - RNA, 17 nt, Yersinia pestis
cuuuggcuucuggaugg

SEQ ID NO: 2271342 - RNA, 16 nt, Yersinia pestis
cuuugggugguggacu

SEQ ID NO: 2271343 - RNA, 18 nt, Yersinia pestis
cuuuggguauaugacugu

SEQ ID NO: 2271344 - RNA, 18 nt, Yersinia pestis
cuuugggauucaauaagu

SEQ ID NO: 2271345 - RNA, 15 nt, Yersinia pestis
cuuugggcugaucau

SEQ ID NO: 2271346 - RNA, 15 nt, Yersinia pestis
cuuuggaaccgccau

SEQ ID NO: 2271347 - RNA, 17 nt, Yersinia pestis
cuuuggcaaucacaacc

SEQ ID NO: 2271348 - RNA, 14 nt, Yersinia pestis
cuuugcuuugacua

SEQ ID NO: 2271349 - RNA, 21 nt, Yersinia pestis
cuuugcuucgauuuuauauug

SEQ ID NO: 2271350 - RNA, 14 nt, Yersinia pestis
cuuugcuucaggca

SEQ ID NO: 2271351 - RNA, 18 nt, Yersinia pestis
cuuugcccuuacuauuuu

SEQ ID NO: 2271352 - RNA, 14 nt, Yersinia pestis
cuuugauccccuua

SEQ ID NO: 2271353 - RNA, 17 nt, Yersinia pestis
cuuucugccugugggcu

SEQ ID NO: 2271354 - RNA, 16 nt, Yersinia pestis
cuuugaacugcacccc

SEQ ID NO: 2271355 - RNA, 21 nt, Yersinia pestis
cuuugaagcgcucaaguaauu

SEQ ID NO: 2271356 - RNA, 14 nt, Yersinia pestis
cuuuccuuccucuu

SEQ ID NO: 2271357 - RNA, 16 nt, Yersinia pestis
cuuucgcccacaacca

SEQ ID NO: 2271358 - RNA, 23 nt, Yersinia pestis
cuuucgcuugcaggucugcaugg

SEQ ID NO: 2271359 - RNA, 15 nt, Yersinia pestis
cuuucgcacuuuaaa

SEQ ID NO: 2271360 - RNA, 22 nt, Yersinia pestis
cuuucgauagucagcuucacuu

SEQ ID NO: 2271361 - RNA, 15 nt, Yersinia pestis
cuuuaacuuccaauu

SEQ ID NO: 2271362 - RNA, 22 nt, Yersinia pestis
cuuuaccagccccgguuaaauu

SEQ ID NO: 2271363 - RNA, 20 nt, Yersinia pestis
cuuuacgguuaaaacaguaa

SEQ ID NO: 2271364 - RNA, 23 nt, Yersinia pestis
cuuuacuccccugccuauccuca

SEQ ID NO: 2271365 - RNA, 16 nt, Yersinia pestis
cuuuacugcauugaga

SEQ ID NO: 2271366 - RNA, 16 nt, Yersinia pestis
cuuuacuccucugccu

SEQ ID NO: 2271367 - RNA, 17 nt, Yersinia pestis
cuuuacuccucugccua

SEQ ID NO: 2271368 - RNA, 23 nt, Yersinia pestis
cuuuacuccucugccuauccuca

SEQ ID NO: 2271369 - RNA, 18 nt, Yersinia pestis
aaagacauaucacaguua

SEQ ID NO: 2271370 - RNA, 17 nt, Yersinia pestis
aaagaaggguuagcauu

SEQ ID NO: 2271371 - RNA, 21 nt, Yersinia pestis
cuuuauacauauguugaguca

SEQ ID NO: 2271372 - RNA, 12 nt, Yersinia pestis
cuuuaucugcca

SEQ ID NO: 2271373 - RNA, 23 nt, Yersinia pestis
cuuuauguacauccaauuuuuuc

SEQ ID NO: 2271374 - RNA, 20 nt, Yersinia pestis
cuuucaaaauugagauauuu

SEQ ID NO: 2271375 - RNA, 23 nt, Yersinia pestis
cuuucaacuauugcaucuuuaau

SEQ ID NO: 2271376 - RNA, 11 nt, Yersinia pestis
cuuucaacgca

SEQ ID NO: 2271377 - RNA, 13 nt, Yersinia pestis
cuuucacguuggu

SEQ ID NO: 2271378 - RNA, 18 nt, Yersinia pestis
cuuuccacgcccaacucu

SEQ ID NO: 2271379 - RNA, 17 nt, Yersinia pestis
cuuuccacguuuguagc

SEQ ID NO: 2271380 - RNA, 19 nt, Yersinia pestis
cuuucagaauugugccccu

SEQ ID NO: 2271381 - RNA, 18 nt, Yersinia pestis
cuuucagacaacgcuugg

SEQ ID NO: 2271382 - RNA, 21 nt, Yersinia pestis
cuuucagacaagccagugacu

SEQ ID NO: 2271383 - RNA, 22 nt, Yersinia pestis
gaaaaggcagagaggagaauua

SEQ ID NO: 2271384 - RNA, 15 nt, Yersinia pestis
gaaaaauacaaauau

SEQ ID NO: 2271385 - RNA, 17 nt, Yersinia pestis
gaaaaguggcuaucuga

SEQ ID NO: 2271386 - RNA, 18 nt, Yersinia pestis
gaaaauaugccccauguu

SEQ ID NO: 2271387 - RNA, 17 nt, Yersinia pestis
gaaacaccguguuccag

SEQ ID NO: 2271388 - RNA, 23 nt, Yersinia pestis
gaaacacacuucgccgggucagg

SEQ ID NO: 2271389 - RNA, 19 nt, Yersinia pestis
gaaacaaaaccuaacgcca

SEQ ID NO: 2271390 - RNA, 15 nt, Yersinia pestis
gaaacauaauuaaau

SEQ ID NO: 2271391 - RNA, 19 nt, Yersinia pestis
gaaacaugcugaagccagc

SEQ ID NO: 2271392 - RNA, 21 nt, Yersinia pestis
gaaacaugcugaagccagcac

SEQ ID NO: 2271393 - RNA, 15 nt, Yersinia pestis
gaaaccaaaucugac

SEQ ID NO: 2271394 - RNA, 14 nt, Yersinia pestis
gaaaccuaaugcca

SEQ ID NO: 2271395 - RNA, 20 nt, Yersinia pestis
gaaaccuacgccuaaaaaug

SEQ ID NO: 2271396 - RNA, 19 nt, Yersinia pestis
gaaaccgcugauaaccagc

SEQ ID NO: 2271397 - RNA, 20 nt, Yersinia pestis
cuuuuugguugaacauuucc

SEQ ID NO: 2271398 - RNA, 14 nt, Yersinia pestis
cuuuuuguaagcca

SEQ ID NO: 2271399 - RNA, 15 nt, Yersinia pestis
cuuuuugugcuucau

SEQ ID NO: 2271400 - RNA, 14 nt, Yersinia pestis
cuuuuuucugcaaa

SEQ ID NO: 2271401 - RNA, 20 nt, Yersinia pestis
gaaaaaccuccggcuaugcc

SEQ ID NO: 2271402 - RNA, 21 nt, Yersinia pestis
gaaaaacacuuuauugagaau

SEQ ID NO: 2271403 - RNA, 21 nt, Yersinia pestis
gaaaaacaccuauuuuauccc

SEQ ID NO: 2271404 - RNA, 12 nt, Yersinia pestis
cuuuuuuguuuu

SEQ ID NO: 2271405 - RNA, 18 nt, Yersinia pestis
cuuuuuuguuguuuuuuu

SEQ ID NO: 2271406 - RNA, 20 nt, Yersinia pestis
cuuuuuuuaaccaauuuugg

SEQ ID NO: 2271407 - RNA, 21 nt, Yersinia pestis
gaaaaaaggauuuuauuaaau

SEQ ID NO: 2271408 - RNA, 15 nt, Yersinia pestis
gaaaaaauauauucc

SEQ ID NO: 2271409 - RNA, 17 nt, Yersinia pestis
gaaaaaauauauuccuc

SEQ ID NO: 2271410 - RNA, 13 nt, Yersinia pestis
cuuuuuauuucuu

SEQ ID NO: 2271411 - RNA, 19 nt, Yersinia pestis
cuuuuuauuucuuuuaaau

SEQ ID NO: 2271412 - RNA, 22 nt, Yersinia pestis
cuuuuuacugcguaaccccaac

SEQ ID NO: 2271413 - RNA, 19 nt, Yersinia pestis
cuuuuuaacuuacugcucu

SEQ ID NO: 2271414 - RNA, 22 nt, Yersinia pestis
cuuuuuacgccuauccucauga

SEQ ID NO: 2271415 - RNA, 14 nt, Yersinia pestis
cuuuuuaauuuaua

SEQ ID NO: 2271416 - RNA, 14 nt, Yersinia pestis
cuuuuuacaauaaa

SEQ ID NO: 2271417 - RNA, 16 nt, Yersinia pestis
cuuuugaauucaccaa

SEQ ID NO: 2271418 - RNA, 16 nt, Yersinia pestis
gaaauuagaagguuua

SEQ ID NO: 2271419 - RNA, 20 nt, Yersinia pestis
gaaauuaaaaauuaauuauu

SEQ ID NO: 2271420 - RNA, 23 nt, Yersinia pestis
aaagagcccgcaacgggagagaa

SEQ ID NO: 2271421 - RNA, 18 nt, Yersinia pestis
gaaauuuaaaaacccucu

SEQ ID NO: 2271422 - RNA, 13 nt, Yersinia pestis
gaaaucugcggca

SEQ ID NO: 2271423 - RNA, 17 nt, Yersinia pestis
gaaaucuucauaaacca

SEQ ID NO: 2271424 - RNA, 21 nt, Yersinia pestis
gaaaugccgccugacugcccg

SEQ ID NO: 2271425 - RNA, 17 nt, Yersinia pestis
gaacagauauugcgcag

SEQ ID NO: 2271426 - RNA, 14 nt, Yersinia pestis
gaacagccccaacc

SEQ ID NO: 2271427 - RNA, 16 nt, Yersinia pestis
gaacaagacuuucccc

SEQ ID NO: 2271428 - RNA, 20 nt, Yersinia pestis
gaacaaaugggccacaggcu

SEQ ID NO: 2271429 - RNA, 16 nt, Yersinia pestis
gaacaacagcauccgc

SEQ ID NO: 2271430 - RNA, 15 nt, Yersinia pestis
gaacaccauacuuuu

SEQ ID NO: 2271431 - RNA, 20 nt, Yersinia pestis
gaacaccagagaugauagca

SEQ ID NO: 2271432 - RNA, 16 nt, Yersinia pestis
gaaaggaauaucugug

SEQ ID NO: 2271433 - RNA, 17 nt, Yersinia pestis
gaaagggaaguuucuua

SEQ ID NO: 2271434 - RNA, 13 nt, Yersinia pestis
gaaaguggccacu

SEQ ID NO: 2271435 - RNA, 15 nt, Yersinia pestis
gaaaguugagcagca

SEQ ID NO: 2271436 - RNA, 14 nt, Yersinia pestis
gaaaguguauuucu

SEQ ID NO: 2271437 - RNA, 17 nt, Yersinia pestis
gaaauauggugauaacu

SEQ ID NO: 2271438 - RNA, 19 nt, Yersinia pestis
gaaauauggugauaacugc

SEQ ID NO: 2271439 - RNA, 18 nt, Yersinia pestis
gaaaucagaucaacagau

SEQ ID NO: 2271440 - RNA, 13 nt, Yersinia pestis
gaaauccaaaucu

SEQ ID NO: 2271441 - RNA, 17 nt, Yersinia pestis
gaaaucaucagcauuga

SEQ ID NO: 2271442 - RNA, 14 nt, Yersinia pestis
gaaauauaaaacag

SEQ ID NO: 2271443 - RNA, 15 nt, Yersinia pestis
gaaauagcugcuucu

SEQ ID NO: 2271444 - RNA, 15 nt, Yersinia pestis
gaaaguuuauaugcu

SEQ ID NO: 2271445 - RNA, 14 nt, Yersinia pestis
gaaagacguggcac

SEQ ID NO: 2271446 - RNA, 17 nt, Yersinia pestis
gaaacgauaugcuccag

SEQ ID NO: 2271447 - RNA, 16 nt, Yersinia pestis
gaaacgauuacccacc

SEQ ID NO: 2271448 - RNA, 20 nt, Yersinia pestis
gaaacgauuacccaccaccu

SEQ ID NO: 2271449 - RNA, 14 nt, Yersinia pestis
gaaacgccagccuc

SEQ ID NO: 2271450 - RNA, 20 nt, Yersinia pestis
gaaacgccagccucugcgcu

SEQ ID NO: 2271451 - RNA, 19 nt, Yersinia pestis
gaaacgccuccucuuggau

SEQ ID NO: 2271452 - RNA, 20 nt, Yersinia pestis
gaaacgcccaaaucugccug

SEQ ID NO: 2271453 - RNA, 17 nt, Yersinia pestis
gaaacggugaggauagg

SEQ ID NO: 2271454 - RNA, 14 nt, Yersinia pestis
gaaagaaauaaaag

SEQ ID NO: 2271455 - RNA, 14 nt, Yersinia pestis
gaaacuuugcuuug

SEQ ID NO: 2271456 - RNA, 15 nt, Yersinia pestis
gaagcucauaugcag

SEQ ID NO: 2271457 - RNA, 18 nt, Yersinia pestis
gaagcucauuaauccccg

SEQ ID NO: 2271458 - RNA, 20 nt, Yersinia pestis
gaagccgcugcaagcaaugu

SEQ ID NO: 2271459 - RNA, 22 nt, Yersinia pestis
gaagccucaugaaugaggcuga

SEQ ID NO: 2271460 - RNA, 17 nt, Yersinia pestis
gaagccucaugaaugag

SEQ ID NO: 2271461 - RNA, 17 nt, Yersinia pestis
gaagccgacgaucuugc

SEQ ID NO: 2271462 - RNA, 15 nt, Yersinia pestis
gaagauuuaacggcu

SEQ ID NO: 2271463 - RNA, 19 nt, Yersinia pestis
gaagcaguucacugaguug

SEQ ID NO: 2271464 - RNA, 18 nt, Yersinia pestis
gaagcccguuauggcaag

SEQ ID NO: 2271465 - RNA, 21 nt, Yersinia pestis
gaagaauccacauaaaaagaa

SEQ ID NO: 2271466 - RNA, 19 nt, Yersinia pestis
gaagaaucaccgaaagaag

SEQ ID NO: 2271467 - RNA, 22 nt, Yersinia pestis
gaagacaucgccagauucgcaa

SEQ ID NO: 2271468 - RNA, 21 nt, Yersinia pestis
gaagacacuuugguuugcagc

SEQ ID NO: 2271469 - RNA, 17 nt, Yersinia pestis
gaagacaacucuucuau

SEQ ID NO: 2271470 - RNA, 18 nt, Yersinia pestis
gaagagccugaaucugaa

SEQ ID NO: 2271471 - RNA, 18 nt, Yersinia pestis
gaagacgaguaaugaaau

SEQ ID NO: 2271472 - RNA, 22 nt, Yersinia pestis
gaagaugccaaucaaaaaaccg

SEQ ID NO: 2271473 - RNA, 21 nt, Yersinia pestis
aaagauagcaaaagaaucagu

SEQ ID NO: 2271474 - RNA, 20 nt, Yersinia pestis
aaagauacaguggaacauuu

SEQ ID NO: 2271475 - RNA, 18 nt, Yersinia pestis
aaagauaauuuagcaaag

SEQ ID NO: 2271476 - RNA, 17 nt, Yersinia pestis
gaaguguuuaccacggc

SEQ ID NO: 2271477 - RNA, 17 nt, Yersinia pestis
gaauaaaggggguuuuc

SEQ ID NO: 2271478 - RNA, 18 nt, Yersinia pestis
gaaguuuaccgcaugaau

SEQ ID NO: 2271479 - RNA, 19 nt, Yersinia pestis
gaauacguagcccuuugcu

SEQ ID NO: 2271480 - RNA, 16 nt, Yersinia pestis
gaauacgauccgcuau

SEQ ID NO: 2271481 - RNA, 15 nt, Yersinia pestis
gaaggcugauuaaua

SEQ ID NO: 2271482 - RNA, 16 nt, Yersinia pestis
gaaggcuauuuuuaua

SEQ ID NO: 2271483 - RNA, 12 nt, Yersinia pestis
gaagguuccccu

SEQ ID NO: 2271484 - RNA, 23 nt, Yersinia pestis
gaagugguagccggacucaaaau

SEQ ID NO: 2271485 - RNA, 12 nt, Yersinia pestis
gaaguggacacg

SEQ ID NO: 2271486 - RNA, 22 nt, Yersinia pestis
gacacaauucccguuagguuca

SEQ ID NO: 2271487 - RNA, 15 nt, Yersinia pestis
gacaauauaauaaug

SEQ ID NO: 2271488 - RNA, 14 nt, Yersinia pestis
gacaauauaauaau

SEQ ID NO: 2271489 - RNA, 20 nt, Yersinia pestis
gacaagcgcaguagcggcuc

SEQ ID NO: 2271490 - RNA, 18 nt, Yersinia pestis
gacaagauugccaccuuc

SEQ ID NO: 2271491 - RNA, 16 nt, Yersinia pestis
gacaacgucacuucca

SEQ ID NO: 2271492 - RNA, 16 nt, Yersinia pestis
gacaacaaacaguaac

SEQ ID NO: 2271493 - RNA, 17 nt, Yersinia pestis
gacaaauccuuuuaaaa

SEQ ID NO: 2271494 - RNA, 14 nt, Yersinia pestis
gacaaagagcccgc

SEQ ID NO: 2271495 - RNA, 20 nt, Yersinia pestis
gaauuuucucauuaauaaug

SEQ ID NO: 2271496 - RNA, 10 nt, Yersinia pestis
gacaaauaag

SEQ ID NO: 2271497 - RNA, 19 nt, Yersinia pestis
gacaaauaaaacagaaccc

SEQ ID NO: 2271498 - RNA, 16 nt, Yersinia pestis
gaauuuuauucagcaa

SEQ ID NO: 2271499 - RNA, 11 nt, Yersinia pestis
gaauuucauuu

SEQ ID NO: 2271500 - RNA, 14 nt, Yersinia pestis
gaauucaccaaauu

SEQ ID NO: 2271501 - RNA, 17 nt, Yersinia pestis
gaauucaccaaauugca

SEQ ID NO: 2271502 - RNA, 13 nt, Yersinia pestis
gaauucagcagcg

SEQ ID NO: 2271503 - RNA, 18 nt, Yersinia pestis
gaaugguacuugacgcug

SEQ ID NO: 2271504 - RNA, 17 nt, Yersinia pestis
gaauccggauccagcgc

SEQ ID NO: 2271505 - RNA, 13 nt, Yersinia pestis
gaauccgcuggcg

SEQ ID NO: 2271506 - RNA, 12 nt, Yersinia pestis
gaaucacuuauu

SEQ ID NO: 2271507 - RNA, 22 nt, Yersinia pestis
gaaucacuuauuggaaguacuu

SEQ ID NO: 2271508 - RNA, 22 nt, Yersinia pestis
gaaucucuccagugcaaauuua

SEQ ID NO: 2271509 - RNA, 19 nt, Yersinia pestis
gaaugaguuuuguccugag

SEQ ID NO: 2271510 - RNA, 16 nt, Yersinia pestis
gaaugaucagaggcug

SEQ ID NO: 2271511 - RNA, 19 nt, Yersinia pestis
gaaugcguugccgaaagcc

SEQ ID NO: 2271512 - RNA, 21 nt, Yersinia pestis
gaaugcuauauuuggcuuuca

SEQ ID NO: 2271513 - RNA, 19 nt, Yersinia pestis
gaaugcacgauaccaccac

SEQ ID NO: 2271514 - RNA, 22 nt, Yersinia pestis
gaaugcacgauaccaccaccaa

SEQ ID NO: 2271515 - RNA, 20 nt, Yersinia pestis
gaaugcagggagguuauauu

SEQ ID NO: 2271516 - RNA, 14 nt, Yersinia pestis
gaaugcagauauca

SEQ ID NO: 2271517 - RNA, 18 nt, Yersinia pestis
gaauauacuuuacauaua

SEQ ID NO: 2271518 - RNA, 21 nt, Yersinia pestis
gaauauaaaagcacagacaaa

SEQ ID NO: 2271519 - RNA, 17 nt, Yersinia pestis
gaauauaaacauaaaaa

SEQ ID NO: 2271520 - RNA, 15 nt, Yersinia pestis
gaauauaaauuuaau

SEQ ID NO: 2271521 - RNA, 21 nt, Yersinia pestis
gaauauaaauuuaauaaaaac

SEQ ID NO: 2271522 - RNA, 23 nt, Yersinia pestis
aaagaucugcauugauuaaauca

SEQ ID NO: 2271523 - RNA, 16 nt, Yersinia pestis
gaauacuucaggccaa

SEQ ID NO: 2271524 - RNA, 16 nt, Yersinia pestis
gaauaucuagcaacac

SEQ ID NO: 2271525 - RNA, 18 nt, Yersinia pestis
gaauaucuugcauacaac

SEQ ID NO: 2271526 - RNA, 18 nt, Yersinia pestis
gaauaucaccauauucau

SEQ ID NO: 2271527 - RNA, 15 nt, Yersinia pestis
gaaucacugacugau

SEQ ID NO: 2271528 - RNA, 13 nt, Yersinia pestis
gaaucacugguga

SEQ ID NO: 2271529 - RNA, 20 nt, Yersinia pestis
gaaucaccgaaagaagacau

SEQ ID NO: 2271530 - RNA, 16 nt, Yersinia pestis
gaauauuuaaauuaca

SEQ ID NO: 2271531 - RNA, 18 nt, Yersinia pestis
gacauaagaugaccacca

SEQ ID NO: 2271532 - RNA, 13 nt, Yersinia pestis
gacauaagaugac

SEQ ID NO: 2271533 - RNA, 19 nt, Yersinia pestis
gacagcgcggcuaaauaua

SEQ ID NO: 2271534 - RNA, 12 nt, Yersinia pestis
gacagcgcgcag

SEQ ID NO: 2271535 - RNA, 13 nt, Yersinia pestis
gacauuauguucu

SEQ ID NO: 2271536 - RNA, 12 nt, Yersinia pestis
gacaucuggcug

SEQ ID NO: 2271537 - RNA, 14 nt, Yersinia pestis
gacaucuggcuggc

SEQ ID NO: 2271538 - RNA, 20 nt, Yersinia pestis
gacauagccggagguuuuuc

SEQ ID NO: 2271539 - RNA, 15 nt, Yersinia pestis
gacauacuuugccuu

SEQ ID NO: 2271540 - RNA, 11 nt, Yersinia pestis
gacauagagau

SEQ ID NO: 2271541 - RNA, 17 nt, Yersinia pestis
gacauaucacaguuaaa

SEQ ID NO: 2271542 - RNA, 20 nt, Yersinia pestis
gacauaucuugaaccaauuu

SEQ ID NO: 2271543 - RNA, 19 nt, Yersinia pestis
gacacucagaucccccugc

SEQ ID NO: 2271544 - RNA, 23 nt, Yersinia pestis
gacacguaaaacagggagccgcc

SEQ ID NO: 2271545 - RNA, 14 nt, Yersinia pestis
gacacgcucaucca

SEQ ID NO: 2271546 - RNA, 13 nt, Yersinia pestis
gacacaucccaac

SEQ ID NO: 2271547 - RNA, 15 nt, Yersinia pestis
gacacauaaguguau

SEQ ID NO: 2271548 - RNA, 15 nt, Yersinia pestis
gacacgaucauuaua

SEQ ID NO: 2271549 - RNA, 20 nt, Yersinia pestis
gacagaaaacaaucuggcag

SEQ ID NO: 2271550 - RNA, 16 nt, Yersinia pestis
gacagaauuauuuaua

SEQ ID NO: 2271551 - RNA, 16 nt, Yersinia pestis
gacagaacugauuuca

SEQ ID NO: 2271552 - RNA, 18 nt, Yersinia pestis
gacagaacugauuucagg

SEQ ID NO: 2271553 - RNA, 15 nt, Yersinia pestis
gacagaaaaaucaca

SEQ ID NO: 2271554 - RNA, 16 nt, Yersinia pestis
gaccacugacaaaaac

SEQ ID NO: 2271555 - RNA, 16 nt, Yersinia pestis
gaccagauaaucgcca

SEQ ID NO: 2271556 - RNA, 20 nt, Yersinia pestis
gaccacuugcugaugcccau

SEQ ID NO: 2271557 - RNA, 21 nt, Yersinia pestis
gaccacuugcugaugcccauc

SEQ ID NO: 2271558 - RNA, 16 nt, Yersinia pestis
gaccaaauagcaagcc

SEQ ID NO: 2271559 - RNA, 17 nt, Yersinia pestis
gaccaaauagcaagcca

SEQ ID NO: 2271560 - RNA, 14 nt, Yersinia pestis
gaccaagcauuuua

SEQ ID NO: 2271561 - RNA, 15 nt, Yersinia pestis
gaccaaccuguuuca

SEQ ID NO: 2271562 - RNA, 14 nt, Yersinia pestis
gacccugcaccacg

SEQ ID NO: 2271563 - RNA, 16 nt, Yersinia pestis
gacccugcaccacgcc

SEQ ID NO: 2271564 - RNA, 18 nt, Yersinia pestis
gacccuggcacuaaaaua

SEQ ID NO: 2271565 - RNA, 15 nt, Yersinia pestis
gacccguuuauaaag

SEQ ID NO: 2271566 - RNA, 19 nt, Yersinia pestis
gacccgugaacaucuggcg

SEQ ID NO: 2271567 - RNA, 13 nt, Yersinia pestis
gaccauuucucug

SEQ ID NO: 2271568 - RNA, 13 nt, Yersinia pestis
gacccgauuucaa

SEQ ID NO: 2271569 - RNA, 15 nt, Yersinia pestis
gaccaguugacaggu

SEQ ID NO: 2271570 - RNA, 14 nt, Yersinia pestis
gaccagugcaccca

SEQ ID NO: 2271571 - RNA, 20 nt, Yersinia pestis
gacgugaauaugugcuugcg

SEQ ID NO: 2271572 - RNA, 19 nt, Yersinia pestis
gacgugaggguucaagucc

SEQ ID NO: 2271573 - RNA, 13 nt, Yersinia pestis
gacguccaaccca

SEQ ID NO: 2271574 - RNA, 20 nt, Yersinia pestis
gacguccccggucaugagaa

SEQ ID NO: 2271575 - RNA, 20 nt, Yersinia pestis
gacgggacaaucuguuccug

SEQ ID NO: 2271576 - RNA, 15 nt, Yersinia pestis
gacgcgaucuugaac

SEQ ID NO: 2271577 - RNA, 22 nt, Yersinia pestis
gacgacauuaauuugcaacgca

SEQ ID NO: 2271578 - RNA, 21 nt, Yersinia pestis
gaccuuaucaucacugaaagu

SEQ ID NO: 2271579 - RNA, 18 nt, Yersinia pestis
gaccuuacagugauaauc

SEQ ID NO: 2271580 - RNA, 16 nt, Yersinia pestis
gacgagcccaggcgac

SEQ ID NO: 2271581 - RNA, 19 nt, Yersinia pestis
gacgaugucggcaggcaac

SEQ ID NO: 2271582 - RNA, 12 nt, Yersinia pestis
gacgaucuugcc

SEQ ID NO: 2271583 - RNA, 19 nt, Yersinia pestis
gacgaucuuguucaccaau

SEQ ID NO: 2271584 - RNA, 16 nt, Yersinia pestis
gaccguagaaacuaag

SEQ ID NO: 2271585 - RNA, 13 nt, Yersinia pestis
gaccgucaccaaa

SEQ ID NO: 2271586 - RNA, 16 nt, Yersinia pestis
gaccgucaccaaauag

SEQ ID NO: 2271587 - RNA, 17 nt, Yersinia pestis
gaccgauaaacgccagu

SEQ ID NO: 2271588 - RNA, 18 nt, Yersinia pestis
gaccgaguguaaaaagca

SEQ ID NO: 2271589 - RNA, 22 nt, Yersinia pestis
gaccggggaucaauaaacgcuu

SEQ ID NO: 2271590 - RNA, 16 nt, Yersinia pestis
gacugcccgccugcuu

SEQ ID NO: 2271591 - RNA, 21 nt, Yersinia pestis
gacugacaaccacuaaaccac

SEQ ID NO: 2271592 - RNA, 20 nt, Yersinia pestis
gacugaacgccucaaaaacc

SEQ ID NO: 2271593 - RNA, 16 nt, Yersinia pestis
gacugaccauaaaagg

SEQ ID NO: 2271594 - RNA, 15 nt, Yersinia pestis
gacugauguaagcuc

SEQ ID NO: 2271595 - RNA, 22 nt, Yersinia pestis
gacuguacggcgcguuucuuag

SEQ ID NO: 2271596 - RNA, 19 nt, Yersinia pestis
gacuggucacucgaugacg

SEQ ID NO: 2271597 - RNA, 20 nt, Yersinia pestis
gacuggucacucgaugacgu

SEQ ID NO: 2271598 - RNA, 13 nt, Yersinia pestis
gacugguugcugg

SEQ ID NO: 2271599 - RNA, 14 nt, Yersinia pestis
gacugcuuuucaca

SEQ ID NO: 2271600 - RNA, 21 nt, Yersinia pestis
gacugcuugccaaauauagca

SEQ ID NO: 2271601 - RNA, 15 nt, Yersinia pestis
gacugcuggcagggu

SEQ ID NO: 2271602 - RNA, 14 nt, Yersinia pestis
gacugcucuuuccc

SEQ ID NO: 2271603 - RNA, 21 nt, Yersinia pestis
gacucugcgcucauacucagu

SEQ ID NO: 2271604 - RNA, 23 nt, Yersinia pestis
gacugaaaguagaaauaaaaacc

SEQ ID NO: 2271605 - RNA, 18 nt, Yersinia pestis
gacugaaauaaugguuuc

SEQ ID NO: 2271606 - RNA, 21 nt, Yersinia pestis
gacugaaauaaugguuuccag

SEQ ID NO: 2271607 - RNA, 22 nt, Yersinia pestis
gacugaaauaaugguuuccagu

SEQ ID NO: 2271608 - RNA, 18 nt, Yersinia pestis
gacucgggucagugaaaa

SEQ ID NO: 2271609 - RNA, 21 nt, Yersinia pestis
gacucgaugacaggggauagc

SEQ ID NO: 2271610 - RNA, 15 nt, Yersinia pestis
gacucgaucuugaac

SEQ ID NO: 2271611 - RNA, 23 nt, Yersinia pestis
gacucgauagaaaaagcaugguu

SEQ ID NO: 2271612 - RNA, 22 nt, Yersinia pestis
gacguugcucccaucccucacg

SEQ ID NO: 2271613 - RNA, 17 nt, Yersinia pestis
gacuccccgcucggccc

SEQ ID NO: 2271614 - RNA, 18 nt, Yersinia pestis
gacucccugacucccuca

SEQ ID NO: 2271615 - RNA, 18 nt, Yersinia pestis
gacucccucaccgccuag

SEQ ID NO: 2271616 - RNA, 14 nt, Yersinia pestis
gacuaaaaaccauc

SEQ ID NO: 2271617 - RNA, 18 nt, Yersinia pestis
gacuuuauguacauccaa

SEQ ID NO: 2271618 - RNA, 15 nt, Yersinia pestis
gacuuuaucugccaa

SEQ ID NO: 2271619 - RNA, 21 nt, Yersinia pestis
gacuugaacuucgaaagaaau

SEQ ID NO: 2271620 - RNA, 20 nt, Yersinia pestis
gacuugauuaacaucgccac

SEQ ID NO: 2271621 - RNA, 22 nt, Yersinia pestis
gacuucuuacgcguaugcuggu

SEQ ID NO: 2271622 - RNA, 13 nt, Yersinia pestis
gacuguuuugcua

SEQ ID NO: 2271623 - RNA, 18 nt, Yersinia pestis
gacuguucguaaugacug

SEQ ID NO: 2271624 - RNA, 18 nt, Yersinia pestis
gacuuccugcccagcggc

SEQ ID NO: 2271625 - RNA, 15 nt, Yersinia pestis
gagaacaaugguuca

SEQ ID NO: 2271626 - RNA, 20 nt, Yersinia pestis
gagaacaaugguucaucauu

SEQ ID NO: 2271627 - RNA, 21 nt, Yersinia pestis
gagaacacaaaagacgccuuc

SEQ ID NO: 2271628 - RNA, 22 nt, Yersinia pestis
gagaaccgauaacgccccggcc

SEQ ID NO: 2271629 - RNA, 18 nt, Yersinia pestis
gagaacgggcaaccugua

SEQ ID NO: 2271630 - RNA, 23 nt, Yersinia pestis
aaagauuuccuuucgcacuuuaa

SEQ ID NO: 2271631 - RNA, 14 nt, Yersinia pestis
aaagauuuccuuuc

SEQ ID NO: 2271632 - RNA, 21 nt, Yersinia pestis
gagaaauaaauacucuugaga

SEQ ID NO: 2271633 - RNA, 21 nt, Yersinia pestis
aaagauuucaucggcaaaaac

SEQ ID NO: 2271634 - RNA, 22 nt, Yersinia pestis
gagaaaggauuugaagacaacu

SEQ ID NO: 2271635 - RNA, 21 nt, Yersinia pestis
gacuuuuuuuaaccaauuuug

SEQ ID NO: 2271636 - RNA, 14 nt, Yersinia pestis
gagacaauuaacac

SEQ ID NO: 2271637 - RNA, 14 nt, Yersinia pestis
gagacauaaagccc

SEQ ID NO: 2271638 - RNA, 14 nt, Yersinia pestis
gagacaacaguaaa

SEQ ID NO: 2271639 - RNA, 12 nt, Yersinia pestis
gagaauguaaau

SEQ ID NO: 2271640 - RNA, 17 nt, Yersinia pestis
gagaauguuguuuauga

SEQ ID NO: 2271641 - RNA, 16 nt, Yersinia pestis
gagaccacagauaaau

SEQ ID NO: 2271642 - RNA, 13 nt, Yersinia pestis
gagaccagggcac

SEQ ID NO: 2271643 - RNA, 20 nt, Yersinia pestis
gagacggaaagagccagcac

SEQ ID NO: 2271644 - RNA, 14 nt, Yersinia pestis
gagacggaaagagc

SEQ ID NO: 2271645 - RNA, 17 nt, Yersinia pestis
gagaauauagagccguu

SEQ ID NO: 2271646 - RNA, 14 nt, Yersinia pestis
gagaaucaaucaau

SEQ ID NO: 2271647 - RNA, 21 nt, Yersinia pestis
gagaauaccuggcgggucucc

SEQ ID NO: 2271648 - RNA, 13 nt, Yersinia pestis
gagaaguuuuugg

SEQ ID NO: 2271649 - RNA, 17 nt, Yersinia pestis
gagaauaaaaaugauaa

SEQ ID NO: 2271650 - RNA, 16 nt, Yersinia pestis
gagaagugagaaguga

SEQ ID NO: 2271651 - RNA, 11 nt, Yersinia pestis
gagagagugaa

SEQ ID NO: 2271652 - RNA, 16 nt, Yersinia pestis
gagagaggccagacac

SEQ ID NO: 2271653 - RNA, 22 nt, Yersinia pestis
gagagaggccagacacaaugcu

SEQ ID NO: 2271654 - RNA, 12 nt, Yersinia pestis
gagagcagggcc

SEQ ID NO: 2271655 - RNA, 17 nt, Yersinia pestis
gagacgugcguuuuuga

SEQ ID NO: 2271656 - RNA, 16 nt, Yersinia pestis
gagagaccagggcacc

SEQ ID NO: 2271657 - RNA, 13 nt, Yersinia pestis
gagagaacaggca

SEQ ID NO: 2271658 - RNA, 22 nt, Yersinia pestis
gagagaacguucaaccaacuga

SEQ ID NO: 2271659 - RNA, 15 nt, Yersinia pestis
gagaguucacuuauu

SEQ ID NO: 2271660 - RNA, 17 nt, Yersinia pestis
gagagugauuauucugc

SEQ ID NO: 2271661 - RNA, 15 nt, Yersinia pestis
gagagugauuccagc

SEQ ID NO: 2271662 - RNA, 17 nt, Yersinia pestis
gagaucaguucaguauu

SEQ ID NO: 2271663 - RNA, 12 nt, Yersinia pestis
gagauaucaaau

SEQ ID NO: 2271664 - RNA, 13 nt, Yersinia pestis
gagauaucaaaug

SEQ ID NO: 2271665 - RNA, 13 nt, Yersinia pestis
gagauauaggcau

SEQ ID NO: 2271666 - RNA, 14 nt, Yersinia pestis
gagcccccagggaa

SEQ ID NO: 2271667 - RNA, 16 nt, Yersinia pestis
aaagcaggccuucuaa

SEQ ID NO: 2271668 - RNA, 12 nt, Yersinia pestis
aaagcagcguuu

SEQ ID NO: 2271669 - RNA, 17 nt, Yersinia pestis
aaagcagcguuuuuagu

SEQ ID NO: 2271670 - RNA, 16 nt, Yersinia pestis
gagcacgauuaccauu

SEQ ID NO: 2271671 - RNA, 16 nt, Yersinia pestis
gagcacgcagagauga

SEQ ID NO: 2271672 - RNA, 21 nt, Yersinia pestis
gagcacugccccgaagcucaa

SEQ ID NO: 2271673 - RNA, 15 nt, Yersinia pestis
gagcagugcagcaaa

SEQ ID NO: 2271674 - RNA, 20 nt, Yersinia pestis
gagcaguaauagcaaaaaaa

SEQ ID NO: 2271675 - RNA, 13 nt, Yersinia pestis
aaagcagcagcuu

SEQ ID NO: 2271676 - RNA, 14 nt, Yersinia pestis
gagauguauccaag

SEQ ID NO: 2271677 - RNA, 16 nt, Yersinia pestis
gauaccacaauccggu

SEQ ID NO: 2271678 - RNA, 13 nt, Yersinia pestis
gauaccagcgacu

SEQ ID NO: 2271679 - RNA, 14 nt, Yersinia pestis
gauacccagcaggu

SEQ ID NO: 2271680 - RNA, 22 nt, Yersinia pestis
gauacccuccgacuuugauauu

SEQ ID NO: 2271681 - RNA, 21 nt, Yersinia pestis
gauacccgccauaaauaaaga

SEQ ID NO: 2271682 - RNA, 22 nt, Yersinia pestis
gauaccgauaauaaauauccuc

SEQ ID NO: 2271683 - RNA, 24 nt, Yersinia pestis
aaagcaucaaucaucugcuguaca

SEQ ID NO: 2271684 - RNA, 14 nt, Yersinia pestis
aaagcaucaccaaa

SEQ ID NO: 2271685 - RNA, 21 nt, Yersinia pestis
aaagcagucgacaguguaaaa

SEQ ID NO: 2271686 - RNA, 16 nt, Yersinia pestis
gauaauuucagcagca

SEQ ID NO: 2271687 - RNA, 23 nt, Yersinia pestis
gauacaaagugaaacccgcgcag

SEQ ID NO: 2271688 - RNA, 15 nt, Yersinia pestis
gauacacaugguugc

SEQ ID NO: 2271689 - RNA, 14 nt, Yersinia pestis
aaagccaaaaccau

SEQ ID NO: 2271690 - RNA, 13 nt, Yersinia pestis
aaagccaaacccc

SEQ ID NO: 2271691 - RNA, 20 nt, Yersinia pestis
aaagcauuuaucauauuaac

SEQ ID NO: 2271692 - RNA, 15 nt, Yersinia pestis
gauaaccagagucag

SEQ ID NO: 2271693 - RNA, 19 nt, Yersinia pestis
gauaacauuuuuucuuuua

SEQ ID NO: 2271694 - RNA, 23 nt, Yersinia pestis
gauaaccacaacgacagccaaau

SEQ ID NO: 2271695 - RNA, 18 nt, Yersinia pestis
gauaaggccuuuuucugu

SEQ ID NO: 2271696 - RNA, 20 nt, Yersinia pestis
gauaauaguucauuuuguau

SEQ ID NO: 2271697 - RNA, 21 nt, Yersinia pestis
gauaauaaauacccugcacca

SEQ ID NO: 2271698 - RNA, 13 nt, Yersinia pestis
gauaauaaauugc

SEQ ID NO: 2271699 - RNA, 14 nt, Yersinia pestis
gauaauaaaaaaac

SEQ ID NO: 2271700 - RNA, 18 nt, Yersinia pestis
gauaauuggcaauaaugu

SEQ ID NO: 2271701 - RNA, 23 nt, Yersinia pestis
gauaauuauccauuuucugccaa

SEQ ID NO: 2271702 - RNA, 20 nt, Yersinia pestis
gauaauggaugaauauccac

SEQ ID NO: 2271703 - RNA, 20 nt, Yersinia pestis
gauaaucaauuugucauguu

SEQ ID NO: 2271704 - RNA, 12 nt, Yersinia pestis
gauaaucuccau

SEQ ID NO: 2271705 - RNA, 13 nt, Yersinia pestis
gauacucauugca

SEQ ID NO: 2271706 - RNA, 17 nt, Yersinia pestis
gauagcaucauccagcu

SEQ ID NO: 2271707 - RNA, 12 nt, Yersinia pestis
gauagccauaau

SEQ ID NO: 2271708 - RNA, 17 nt, Yersinia pestis
gauagccauaauaaugc

SEQ ID NO: 2271709 - RNA, 15 nt, Yersinia pestis
gauagccacuaacua

SEQ ID NO: 2271710 - RNA, 14 nt, Yersinia pestis
gauagccccauaua

SEQ ID NO: 2271711 - RNA, 22 nt, Yersinia pestis
gauacguuuggugccgcuggca

SEQ ID NO: 2271712 - RNA, 17 nt, Yersinia pestis
gauacguguaaaaccuu

SEQ ID NO: 2271713 - RNA, 15 nt, Yersinia pestis
gauacggcuccagaa

SEQ ID NO: 2271714 - RNA, 22 nt, Yersinia pestis
gauaccugagcgcugaguugua

SEQ ID NO: 2271715 - RNA, 13 nt, Yersinia pestis
gauauaacucaac

SEQ ID NO: 2271716 - RNA, 22 nt, Yersinia pestis
gauauaaacuaauaucuuucau

SEQ ID NO: 2271717 - RNA, 18 nt, Yersinia pestis
gauauaaauaaaauagcg

SEQ ID NO: 2271718 - RNA, 14 nt, Yersinia pestis
gauaucagccagug

SEQ ID NO: 2271719 - RNA, 16 nt, Yersinia pestis
gauaucaauaaagaac

SEQ ID NO: 2271720 - RNA, 14 nt, Yersinia pestis
gauaguuaucuccc

SEQ ID NO: 2271721 - RNA, 15 nt, Yersinia pestis
gauaguuaucuccca

SEQ ID NO: 2271722 - RNA, 16 nt, Yersinia pestis
gauaguuaucucccau

SEQ ID NO: 2271723 - RNA, 20 nt, Yersinia pestis
gauagcgggccuuugcuuuu

SEQ ID NO: 2271724 - RNA, 12 nt, Yersinia pestis
gauauuuugcag

SEQ ID NO: 2271725 - RNA, 12 nt, Yersinia pestis
gauauuuucggg

SEQ ID NO: 2271726 - RNA, 23 nt, Yersinia pestis
gaucaaauuauauaagagaugaa

SEQ ID NO: 2271727 - RNA, 20 nt, Yersinia pestis
gaucaauuugauagauuucu

SEQ ID NO: 2271728 - RNA, 16 nt, Yersinia pestis
gauauugauagccaca

SEQ ID NO: 2271729 - RNA, 20 nt, Yersinia pestis
gauauuucacguucaucaau

SEQ ID NO: 2271730 - RNA, 15 nt, Yersinia pestis
gauauuuauuucugc

SEQ ID NO: 2271731 - RNA, 17 nt, Yersinia pestis
gauauuuauuucugcaa

SEQ ID NO: 2271732 - RNA, 18 nt, Yersinia pestis
gauauuuauuuccagauc

SEQ ID NO: 2271733 - RNA, 13 nt, Yersinia pestis
gauauuuauucga

SEQ ID NO: 2271734 - RNA, 23 nt, Yersinia pestis
gauauuuauuguuaucaaaucag

SEQ ID NO: 2271735 - RNA, 15 nt, Yersinia pestis
gauauccgccaaaga

SEQ ID NO: 2271736 - RNA, 15 nt, Yersinia pestis
gauauccugcgucuc

SEQ ID NO: 2271737 - RNA, 18 nt, Yersinia pestis
gauauucacguuuuucca

SEQ ID NO: 2271738 - RNA, 19 nt, Yersinia pestis
gauauucacguuuuuccau

SEQ ID NO: 2271739 - RNA, 21 nt, Yersinia pestis
gauauuagggcugacagagcg

SEQ ID NO: 2271740 - RNA, 13 nt, Yersinia pestis
gauauuacuucuu

SEQ ID NO: 2271741 - RNA, 17 nt, Yersinia pestis
gauauucagugcaauca

SEQ ID NO: 2271742 - RNA, 16 nt, Yersinia pestis
gauauucauauuucuu

SEQ ID NO: 2271743 - RNA, 18 nt, Yersinia pestis
gauauucauauuucuuug

SEQ ID NO: 2271744 - RNA, 21 nt, Yersinia pestis
gagucucaucaaggaaaaugg

SEQ ID NO: 2271745 - RNA, 21 nt, Yersinia pestis
gagucuaucugcaguauuugc

SEQ ID NO: 2271746 - RNA, 17 nt, Yersinia pestis
gagucuauugaaaaaau

SEQ ID NO: 2271747 - RNA, 18 nt, Yersinia pestis
gagucuggucgguauuau

SEQ ID NO: 2271748 - RNA, 20 nt, Yersinia pestis
gagugccagcaaagacaaua

SEQ ID NO: 2271749 - RNA, 14 nt, Yersinia pestis
gagugcggccacac

SEQ ID NO: 2271750 - RNA, 21 nt, Yersinia pestis
gagugcggccaucuaacugca

SEQ ID NO: 2271751 - RNA, 19 nt, Yersinia pestis
gagucaguaauucacccuu

SEQ ID NO: 2271752 - RNA, 21 nt, Yersinia pestis
gagucagucagggugaaagcc

SEQ ID NO: 2271753 - RNA, 13 nt, Yersinia pestis
gagucagucuuug

SEQ ID NO: 2271754 - RNA, 20 nt, Yersinia pestis
gagucccguccgcaccgcca

SEQ ID NO: 2271755 - RNA, 20 nt, Yersinia pestis
gaguagcugugaacguacuu

SEQ ID NO: 2271756 - RNA, 14 nt, Yersinia pestis
gaguauacuaaaac

SEQ ID NO: 2271757 - RNA, 22 nt, Yersinia pestis
gaguauacuaaaacagcucacu

SEQ ID NO: 2271758 - RNA, 20 nt, Yersinia pestis
gaguuaccuugugucaccau

SEQ ID NO: 2271759 - RNA, 23 nt, Yersinia pestis
gaguuacgugagcaucuggcgca

SEQ ID NO: 2271760 - RNA, 19 nt, Yersinia pestis
gaguuaucuguuucaaaua

SEQ ID NO: 2271761 - RNA, 23 nt, Yersinia pestis
gaguuauucugauggucgucaug

SEQ ID NO: 2271762 - RNA, 18 nt, Yersinia pestis
gaguggacgauaaauuca

SEQ ID NO: 2271763 - RNA, 22 nt, Yersinia pestis
gauaaaggcggugauaaacccu

SEQ ID NO: 2271764 - RNA, 14 nt, Yersinia pestis
gauaaagucugaaa

SEQ ID NO: 2271765 - RNA, 20 nt, Yersinia pestis
gauaaauaccgccaaauaca

SEQ ID NO: 2271766 - RNA, 14 nt, Yersinia pestis
gauaaauucaaaua

SEQ ID NO: 2271767 - RNA, 20 nt, Yersinia pestis
gauaacaauaaaaucuuaau

SEQ ID NO: 2271768 - RNA, 13 nt, Yersinia pestis
gauaaaacaauag

SEQ ID NO: 2271769 - RNA, 20 nt, Yersinia pestis
gauaaaaauaaucaaugacc

SEQ ID NO: 2271770 - RNA, 14 nt, Yersinia pestis
gauaaaaccacuga

SEQ ID NO: 2271771 - RNA, 18 nt, Yersinia pestis
gauaaaggccgcagauaa

SEQ ID NO: 2271772 - RNA, 15 nt, Yersinia pestis
gauaaagcuggagcc

SEQ ID NO: 2271773 - RNA, 15 nt, Yersinia pestis
gauaaaaacauugaa

SEQ ID NO: 2271774 - RNA, 22 nt, Yersinia pestis
gaggcugcguguucuucucacc

SEQ ID NO: 2271775 - RNA, 23 nt, Yersinia pestis
gaggcucuggucacuaaaacuga

SEQ ID NO: 2271776 - RNA, 14 nt, Yersinia pestis
gaggcguggcacac

SEQ ID NO: 2271777 - RNA, 12 nt, Yersinia pestis
gaggaucuuccu

SEQ ID NO: 2271778 - RNA, 17 nt, Yersinia pestis
gaggauauuuauuuucc

SEQ ID NO: 2271779 - RNA, 16 nt, Yersinia pestis
gaggauauuuauuucc

SEQ ID NO: 2271780 - RNA, 21 nt, Yersinia pestis
gaggaucccuucugaaacuuc

SEQ ID NO: 2271781 - RNA, 17 nt, Yersinia pestis
gaggauuuuccgcagcu

SEQ ID NO: 2271782 - RNA, 22 nt, Yersinia pestis
gaggaaggcgguuaucuggaau

SEQ ID NO: 2271783 - RNA, 13 nt, Yersinia pestis
gaggaaucaaaga

SEQ ID NO: 2271784 - RNA, 15 nt, Yersinia pestis
gaggacagguggguu

SEQ ID NO: 2271785 - RNA, 21 nt, Yersinia pestis
gagcuuccagugcauuaucuu

SEQ ID NO: 2271786 - RNA, 22 nt, Yersinia pestis
gagcuuauggaaguaauccaga

SEQ ID NO: 2271787 - RNA, 16 nt, Yersinia pestis
gagcuucuucaaaagc

SEQ ID NO: 2271788 - RNA, 13 nt, Yersinia pestis
gagcuugcugcug

SEQ ID NO: 2271789 - RNA, 20 nt, Yersinia pestis
aaaguuuagcaaagcaucga

SEQ ID NO: 2271790 - RNA, 17 nt, Yersinia pestis
aaaguuuagcaaagcau

SEQ ID NO: 2271791 - RNA, 15 nt, Yersinia pestis
aaaguugagcagcaa

SEQ ID NO: 2271792 - RNA, 18 nt, Yersinia pestis
aaaguugagcagcaauaa

SEQ ID NO: 2271793 - RNA, 23 nt, Yersinia pestis
aaaguuaggguucaguaaaacca

SEQ ID NO: 2271794 - RNA, 16 nt, Yersinia pestis
ggccgcaugcaacaga

SEQ ID NO: 2271795 - RNA, 22 nt, Yersinia pestis
ggccgcccagauaaagaugaag

SEQ ID NO: 2271796 - RNA, 20 nt, Yersinia pestis
ggccgccgcggugaagaaca

SEQ ID NO: 2271797 - RNA, 18 nt, Yersinia pestis
ggcccaagccauccuuuu

SEQ ID NO: 2271798 - RNA, 17 nt, Yersinia pestis
ggccauuguuaugguau

SEQ ID NO: 2271799 - RNA, 19 nt, Yersinia pestis
ggccgcaauaguuaacagc

SEQ ID NO: 2271800 - RNA, 18 nt, Yersinia pestis
aaaguggccacucaccuc

SEQ ID NO: 2271801 - RNA, 20 nt, Yersinia pestis
aaagugcugcaaggcauuaa

SEQ ID NO: 2271802 - RNA, 14 nt, Yersinia pestis
aaagugcuucucug

SEQ ID NO: 2271803 - RNA, 17 nt, Yersinia pestis
aaaguuuuuugaaauua

SEQ ID NO: 2271804 - RNA, 18 nt, Yersinia pestis
aaaguuuuuuauuuauag

SEQ ID NO: 2271805 - RNA, 22 nt, Yersinia pestis
ggccggucaugguuggcccaau

SEQ ID NO: 2271806 - RNA, 15 nt, Yersinia pestis
ggccuacuggugccu

SEQ ID NO: 2271807 - RNA, 23 nt, Yersinia pestis
ggccgugcgggaugacucggccu

SEQ ID NO: 2271808 - RNA, 20 nt, Yersinia pestis
ggccguugaugcucauuuaa

SEQ ID NO: 2271809 - RNA, 14 nt, Yersinia pestis
ggccucuucuuuua

SEQ ID NO: 2271810 - RNA, 17 nt, Yersinia pestis
aaauaaaauaauaaugg

SEQ ID NO: 2271811 - RNA, 11 nt, Yersinia pestis
aaauaaaacaa

SEQ ID NO: 2271812 - RNA, 20 nt, Yersinia pestis
aaauaaacgcgaguuaggaa

SEQ ID NO: 2271813 - RNA, 12 nt, Yersinia pestis
aaauaaacaaaa

SEQ ID NO: 2271814 - RNA, 12 nt, Yersinia pestis
ggccugcggcca

SEQ ID NO: 2271815 - RNA, 23 nt, Yersinia pestis
ggccugcugugucgcuauuuccg

SEQ ID NO: 2271816 - RNA, 12 nt, Yersinia pestis
ggccugccgggu

SEQ ID NO: 2271817 - RNA, 19 nt, Yersinia pestis
aaauaaauaaguucagauu

SEQ ID NO: 2271818 - RNA, 23 nt, Yersinia pestis
aaauaaaugcucucgagaaauaa

SEQ ID NO: 2271819 - RNA, 22 nt, Yersinia pestis
ggccuguaccaccaccaacagc

SEQ ID NO: 2271820 - RNA, 16 nt, Yersinia pestis
ggccuucaauaccuug

SEQ ID NO: 2271821 - RNA, 13 nt, Yersinia pestis
ggccuucuaacuc

SEQ ID NO: 2271822 - RNA, 12 nt, Yersinia pestis
ggcuaucaucaa

SEQ ID NO: 2271823 - RNA, 12 nt, Yersinia pestis
ggcucaaauuug

SEQ ID NO: 2271824 - RNA, 17 nt, Yersinia pestis
ggcucaauccaaaugac

SEQ ID NO: 2271825 - RNA, 19 nt, Yersinia pestis
ggcucaauccaaaugacac

SEQ ID NO: 2271826 - RNA, 18 nt, Yersinia pestis
ggcucaaugcgaaaaaau

SEQ ID NO: 2271827 - RNA, 20 nt, Yersinia pestis
ggcuaaucguggugaagaau

SEQ ID NO: 2271828 - RNA, 19 nt, Yersinia pestis
ggcuaauuaauuuaaacaa

SEQ ID NO: 2271829 - RNA, 18 nt, Yersinia pestis
ggcuaacgguaaauaagu

SEQ ID NO: 2271830 - RNA, 17 nt, Yersinia pestis
ggcuaaccugcacgccu

SEQ ID NO: 2271831 - RNA, 16 nt, Yersinia pestis
ggcuaaaacucaaaua

SEQ ID NO: 2271832 - RNA, 18 nt, Yersinia pestis
ggcuaaaacucaaauaga

SEQ ID NO: 2271833 - RNA, 21 nt, Yersinia pestis
ggcuaaacucuggcacuggca

SEQ ID NO: 2271834 - RNA, 17 nt, Yersinia pestis
ggcguuucucagacugu

SEQ ID NO: 2271835 - RNA, 16 nt, Yersinia pestis
ggcguucuaguuuggu

SEQ ID NO: 2271836 - RNA, 14 nt, Yersinia pestis
ggcguugaugacua

SEQ ID NO: 2271837 - RNA, 23 nt, Yersinia pestis
ggcguuaauauaacaauguuuau

SEQ ID NO: 2271838 - RNA, 17 nt, Yersinia pestis
ggcguuauugagaagaa

SEQ ID NO: 2271839 - RNA, 22 nt, Yersinia pestis
ggcgguccuccugccccuacgg

SEQ ID NO: 2271840 - RNA, 15 nt, Yersinia pestis
ggcgcuuacuuaccc

SEQ ID NO: 2271841 - RNA, 17 nt, Yersinia pestis
ggcggaaauaaggcgca

SEQ ID NO: 2271842 - RNA, 18 nt, Yersinia pestis
ggcggaaauuaaaaauua

SEQ ID NO: 2271843 - RNA, 18 nt, Yersinia pestis
ggcggcuaaccugcacgc

SEQ ID NO: 2271844 - RNA, 17 nt, Yersinia pestis
aaauacaaccaacaaac

SEQ ID NO: 2271845 - RNA, 24 nt, Yersinia pestis
ggcgaguuucccuuuuccaucaga

SEQ ID NO: 2271846 - RNA, 16 nt, Yersinia pestis
ggcgauccagugaaau

SEQ ID NO: 2271847 - RNA, 17 nt, Yersinia pestis
ggcgcacugauucucuu

SEQ ID NO: 2271848 - RNA, 22 nt, Yersinia pestis
ggcgcagacccgugaacaucug

SEQ ID NO: 2271849 - RNA, 13 nt, Yersinia pestis
ggcgcauccccac

SEQ ID NO: 2271850 - RNA, 17 nt, Yersinia pestis
ggcgcauaaaaugagcc

SEQ ID NO: 2271851 - RNA, 18 nt, Yersinia pestis
ggcgcauaugaaaaaccu

SEQ ID NO: 2271852 - RNA, 23 nt, Yersinia pestis
ggcgcauaugaaaaaccuccggc

SEQ ID NO: 2271853 - RNA, 19 nt, Yersinia pestis
ggcgcauauccugauagga

SEQ ID NO: 2271854 - RNA, 23 nt, Yersinia pestis
aaauacucuugagaaaugaauau

SEQ ID NO: 2271855 - RNA, 23 nt, Yersinia pestis
aaauacugcacguuuaauuucac

SEQ ID NO: 2271856 - RNA, 14 nt, Yersinia pestis
aaauacuuaucugu

SEQ ID NO: 2271857 - RNA, 20 nt, Yersinia pestis
aaauacuuaucuguuuucca

SEQ ID NO: 2271858 - RNA, 12 nt, Yersinia pestis
aaauacuuauuu

SEQ ID NO: 2271859 - RNA, 16 nt, Yersinia pestis
aaauacuuauuugaaa

SEQ ID NO: 2271860 - RNA, 16 nt, Yersinia pestis
aaauacuucaaaugac

SEQ ID NO: 2271861 - RNA, 16 nt, Yersinia pestis
aaauacuuaacaauca

SEQ ID NO: 2271862 - RNA, 14 nt, Yersinia pestis
ggcgcggcucgagc

SEQ ID NO: 2271863 - RNA, 14 nt, Yersinia pestis
ggcgcucggcagcu

SEQ ID NO: 2271864 - RNA, 20 nt, Yersinia pestis
ggcgcugagguucuccaaca

SEQ ID NO: 2271865 - RNA, 21 nt, Yersinia pestis
ggcgcucaauguuccucagga

SEQ ID NO: 2271866 - RNA, 12 nt, Yersinia pestis
ggacaucugcuu

SEQ ID NO: 2271867 - RNA, 21 nt, Yersinia pestis
ggacagguuuguagcacucca

SEQ ID NO: 2271868 - RNA, 16 nt, Yersinia pestis
ggaaucauaaaagccc

SEQ ID NO: 2271869 - RNA, 18 nt, Yersinia pestis
ggacauuuuacucccuga

SEQ ID NO: 2271870 - RNA, 18 nt, Yersinia pestis
aaagggccguaacaaggc

SEQ ID NO: 2271871 - RNA, 21 nt, Yersinia pestis
ggagaacaaugguucaucauu

SEQ ID NO: 2271872 - RNA, 20 nt, Yersinia pestis
ggacuaauacggguuucugc

SEQ ID NO: 2271873 - RNA, 21 nt, Yersinia pestis
ggacgauaaauucaaauauca

SEQ ID NO: 2271874 - RNA, 15 nt, Yersinia pestis
ggaggcguuuccccu

SEQ ID NO: 2271875 - RNA, 12 nt, Yersinia pestis
ggaggcuggcag

SEQ ID NO: 2271876 - RNA, 11 nt, Yersinia pestis
ggaggauauuu

SEQ ID NO: 2271877 - RNA, 20 nt, Yersinia pestis
ggaggauauuuauuuauccu

SEQ ID NO: 2271878 - RNA, 22 nt, Yersinia pestis
ggaggauauuuauuuugguaaa

SEQ ID NO: 2271879 - RNA, 18 nt, Yersinia pestis
ggaggauauuuauuuuua

SEQ ID NO: 2271880 - RNA, 19 nt, Yersinia pestis
ggaggcacgugccgcuggg

SEQ ID NO: 2271881 - RNA, 21 nt, Yersinia pestis
ggaggagauuucagacugcug

SEQ ID NO: 2271882 - RNA, 15 nt, Yersinia pestis
ggaggagguagcaac

SEQ ID NO: 2271883 - RNA, 16 nt, Yersinia pestis
ggaggagguagcaaca

SEQ ID NO: 2271884 - RNA, 17 nt, Yersinia pestis
ggagauaguuaucuccc

SEQ ID NO: 2271885 - RNA, 18 nt, Yersinia pestis
ggagcggauaaagcgcug

SEQ ID NO: 2271886 - RNA, 17 nt, Yersinia pestis
ggaucaauuugauagau

SEQ ID NO: 2271887 - RNA, 22 nt, Yersinia pestis
ggaucacauagugcaaaauucc

SEQ ID NO: 2271888 - RNA, 16 nt, Yersinia pestis
ggauaucgauggcaac

SEQ ID NO: 2271889 - RNA, 23 nt, Yersinia pestis
ggaucaccaggcucucauauccc

SEQ ID NO: 2271890 - RNA, 14 nt, Yersinia pestis
ggagugaugaaacc

SEQ ID NO: 2271891 - RNA, 19 nt, Yersinia pestis
ggagugaugaaaccaaaac

SEQ ID NO: 2271892 - RNA, 21 nt, Yersinia pestis
ggauaggcagaggaguaaagc

SEQ ID NO: 2271893 - RNA, 15 nt, Yersinia pestis
ggauagguuggguuu

SEQ ID NO: 2271894 - RNA, 18 nt, Yersinia pestis
ggagguugccgguuuauu

SEQ ID NO: 2271895 - RNA, 16 nt, Yersinia pestis
ggagucgcuccucagc

SEQ ID NO: 2271896 - RNA, 21 nt, Yersinia pestis
ggagucagaugccgcuuuagu

SEQ ID NO: 2271897 - RNA, 21 nt, Yersinia pestis
ggaagacuuccagcaccacua

SEQ ID NO: 2271898 - RNA, 18 nt, Yersinia pestis
ggaacgaagccgcagaga

SEQ ID NO: 2271899 - RNA, 21 nt, Yersinia pestis
ggaacccauuugcacagcauu

SEQ ID NO: 2271900 - RNA, 16 nt, Yersinia pestis
ggaaggcccagccggg

SEQ ID NO: 2271901 - RNA, 17 nt, Yersinia pestis
ggaagggguucuuccaa

SEQ ID NO: 2271902 - RNA, 14 nt, Yersinia pestis
ggaaucaaagagcg

SEQ ID NO: 2271903 - RNA, 21 nt, Yersinia pestis
ggaaauaaacaucaaagguuu

SEQ ID NO: 2271904 - RNA, 22 nt, Yersinia pestis
ggaaaucgaaauuaaggaaaag

SEQ ID NO: 2271905 - RNA, 22 nt, Yersinia pestis
ggaaauccguuuuuugguggcu

SEQ ID NO: 2271906 - RNA, 18 nt, Yersinia pestis
ggaaaauuaacuuauuga

SEQ ID NO: 2271907 - RNA, 15 nt, Yersinia pestis
ggaaaaggcagagag

SEQ ID NO: 2271908 - RNA, 22 nt, Yersinia pestis
gcuuucucugcgcuguaagcac

SEQ ID NO: 2271909 - RNA, 15 nt, Yersinia pestis
gcuuucuugccauaa

SEQ ID NO: 2271910 - RNA, 21 nt, Yersinia pestis
gcugugccaugucggcaggua

SEQ ID NO: 2271911 - RNA, 19 nt, Yersinia pestis
gcuuugaugccuaauaauu

SEQ ID NO: 2271912 - RNA, 17 nt, Yersinia pestis
gcuuuggucaacagcaa

SEQ ID NO: 2271913 - RNA, 17 nt, Yersinia pestis
gcuuuuugcuuuuugcu

SEQ ID NO: 2271914 - RNA, 11 nt, Yersinia pestis
gcuuuuugcuu

SEQ ID NO: 2271915 - RNA, 14 nt, Yersinia pestis
gcuuuuuacccagu

SEQ ID NO: 2271916 - RNA, 13 nt, Yersinia pestis
gcuuuuuaucauu

SEQ ID NO: 2271917 - RNA, 15 nt, Yersinia pestis
gcuuuuuaucauuua

SEQ ID NO: 2271918 - RNA, 18 nt, Yersinia pestis
gcuuuugauuuucuuacc

SEQ ID NO: 2271919 - RNA, 23 nt, Yersinia pestis
gcuuuuguacgaaauugauauga

SEQ ID NO: 2271920 - RNA, 19 nt, Yersinia pestis
gcuuuuaucguugcuacca

SEQ ID NO: 2271921 - RNA, 15 nt, Yersinia pestis
gcuuuuaucuaaugg

SEQ ID NO: 2271922 - RNA, 12 nt, Yersinia pestis
gcuuuucacauu

SEQ ID NO: 2271923 - RNA, 20 nt, Yersinia pestis
ggcaacgaaggcaacaacac

SEQ ID NO: 2271924 - RNA, 15 nt, Yersinia pestis
ggcaacgacauguug

SEQ ID NO: 2271925 - RNA, 16 nt, Yersinia pestis
ggcaaauaggccgcau

SEQ ID NO: 2271926 - RNA, 17 nt, Yersinia pestis
ggcaaauucaacaauca

SEQ ID NO: 2271927 - RNA, 21 nt, Yersinia pestis
ggauuucaauccgaccacuga

SEQ ID NO: 2271928 - RNA, 20 nt, Yersinia pestis
ggauuggagucaugaggcag

SEQ ID NO: 2271929 - RNA, 16 nt, Yersinia pestis
ggauugcaaauccguc

SEQ ID NO: 2271930 - RNA, 15 nt, Yersinia pestis
ggauugccaaaugca

SEQ ID NO: 2271931 - RNA, 14 nt, Yersinia pestis
ggauugaaaucaga

SEQ ID NO: 2271932 - RNA, 17 nt, Yersinia pestis
ggcaccaaaacgucgug

SEQ ID NO: 2271933 - RNA, 17 nt, Yersinia pestis
ggcaccacggucagaga

SEQ ID NO: 2271934 - RNA, 12 nt, Yersinia pestis
ggcacaccagaa

SEQ ID NO: 2271935 - RNA, 14 nt, Yersinia pestis
ggcaauccagcgcc

SEQ ID NO: 2271936 - RNA, 18 nt, Yersinia pestis
ggcaauauuggcgcacaa

SEQ ID NO: 2271937 - RNA, 16 nt, Yersinia pestis
ggcaauaacaaacaca

SEQ ID NO: 2271938 - RNA, 20 nt, Yersinia pestis
ggcaacucuagcgccagcaa

SEQ ID NO: 2271939 - RNA, 21 nt, Yersinia pestis
ggcaacucuagcgccagcaau

SEQ ID NO: 2271940 - RNA, 23 nt, Yersinia pestis
ggcaauaacacggccuauugaau

SEQ ID NO: 2271941 - RNA, 20 nt, Yersinia pestis
ggcaauacaccgccaguaug

SEQ ID NO: 2271942 - RNA, 14 nt, Yersinia pestis
ggcaauggcucagg

SEQ ID NO: 2271943 - RNA, 19 nt, Yersinia pestis
ggcaauggcucaggcucau

SEQ ID NO: 2271944 - RNA, 21 nt, Yersinia pestis
ggcaauggcucaggcucauca

SEQ ID NO: 2271945 - RNA, 15 nt, Yersinia pestis
ggcacgggcgaucac

SEQ ID NO: 2271946 - RNA, 13 nt, Yersinia pestis
ggcaccaugccca

SEQ ID NO: 2271947 - RNA, 17 nt, Yersinia pestis
ggcaccaugcccauaca

SEQ ID NO: 2271948 - RNA, 18 nt, Yersinia pestis
ggcagaaauaauaucaag

SEQ ID NO: 2271949 - RNA, 12 nt, Yersinia pestis
ggcagaaaucag

SEQ ID NO: 2271950 - RNA, 23 nt, Yersinia pestis
ggcagaaaagcaaaggcccgcua

SEQ ID NO: 2271951 - RNA, 16 nt, Yersinia pestis
ggcagcacagagcaca

SEQ ID NO: 2271952 - RNA, 17 nt, Yersinia pestis
ggcacuggaaacaaaac

SEQ ID NO: 2271953 - RNA, 16 nt, Yersinia pestis
ggcacugcagaaaaug

SEQ ID NO: 2271954 - RNA, 23 nt, Yersinia pestis
ggcacugcagaaaaugcggcggc

SEQ ID NO: 2271955 - RNA, 18 nt, Yersinia pestis
aaaguaucgcuaucaccg

SEQ ID NO: 2271956 - RNA, 15 nt, Yersinia pestis
ggccagcauucaggc

SEQ ID NO: 2271957 - RNA, 22 nt, Yersinia pestis
ggccagugauguuggcagguga

SEQ ID NO: 2271958 - RNA, 15 nt, Yersinia pestis
ggccagugcgccggc

SEQ ID NO: 2271959 - RNA, 15 nt, Yersinia pestis
ggccauuacgccacc

SEQ ID NO: 2271960 - RNA, 23 nt, Yersinia pestis
ggccauugaacauaacuuugcca

SEQ ID NO: 2271961 - RNA, 19 nt, Yersinia pestis
ggccauguacuuaauacug

SEQ ID NO: 2271962 - RNA, 16 nt, Yersinia pestis
ggccauguguguucuu

SEQ ID NO: 2271963 - RNA, 18 nt, Yersinia pestis
ggccaugucaggccacca

SEQ ID NO: 2271964 - RNA, 13 nt, Yersinia pestis
ggccaacugcugg

SEQ ID NO: 2271965 - RNA, 22 nt, Yersinia pestis
ggccaaccggcgaagggcgcag

SEQ ID NO: 2271966 - RNA, 21 nt, Yersinia pestis
ggccaaccguagugagucagg

SEQ ID NO: 2271967 - RNA, 21 nt, Yersinia pestis
ggccaccaaauugcggccagu

SEQ ID NO: 2271968 - RNA, 20 nt, Yersinia pestis
ggccaacaucgaagggcggg

SEQ ID NO: 2271969 - RNA, 14 nt, Yersinia pestis
ggccaacaggcccc

SEQ ID NO: 2271970 - RNA, 19 nt, Yersinia pestis
ggcauuuuuauuuaccgaa

SEQ ID NO: 2271971 - RNA, 16 nt, Yersinia pestis
ggcauuaaacugaaua

SEQ ID NO: 2271972 - RNA, 20 nt, Yersinia pestis
ggcauguucacaucggucaa

SEQ ID NO: 2271973 - RNA, 17 nt, Yersinia pestis
ggcauuuuacuggguga

SEQ ID NO: 2271974 - RNA, 18 nt, Yersinia pestis
ggcauaaauaauaaauaa

SEQ ID NO: 2271975 - RNA, 11 nt, Yersinia pestis
ggcauagagag

SEQ ID NO: 2271976 - RNA, 19 nt, Yersinia pestis
ggcaucugcuguaagggaa

SEQ ID NO: 2271977 - RNA, 20 nt, Yersinia pestis
ggcaucuuucaguuuuauug

SEQ ID NO: 2271978 - RNA, 21 nt, Yersinia pestis
ggcaguuuuuuauggcauaaa

SEQ ID NO: 2271979 - RNA, 22 nt, Yersinia pestis
ggcaguucauuccccaucgcca

SEQ ID NO: 2271980 - RNA, 15 nt, Yersinia pestis
gcgucuucucaauuu

SEQ ID NO: 2271981 - RNA, 11 nt, Yersinia pestis
gcgucucuacg

SEQ ID NO: 2271982 - RNA, 16 nt, Yersinia pestis
gcgucucuacgacgcc

SEQ ID NO: 2271983 - RNA, 16 nt, Yersinia pestis
gcgugcugcuuccugc

SEQ ID NO: 2271984 - RNA, 15 nt, Yersinia pestis
gcgugcugcuuccug

SEQ ID NO: 2271985 - RNA, 20 nt, Yersinia pestis
gcgucuuucgggcugaugaa

SEQ ID NO: 2271986 - RNA, 20 nt, Yersinia pestis
gcgucuuuacgaucugccug

SEQ ID NO: 2271987 - RNA, 18 nt, Yersinia pestis
gcgucuuuagauuucacc

SEQ ID NO: 2271988 - RNA, 23 nt, Yersinia pestis
gcgugaaacguauuauucuuccc

SEQ ID NO: 2271989 - RNA, 15 nt, Yersinia pestis
gcgugagaauaauaa

SEQ ID NO: 2271990 - RNA, 17 nt, Yersinia pestis
gcgugacuauucugccu

SEQ ID NO: 2271991 - RNA, 13 nt, Yersinia pestis
gcguagagucagu

SEQ ID NO: 2271992 - RNA, 16 nt, Yersinia pestis
gcguagguuucagccu

SEQ ID NO: 2271993 - RNA, 19 nt, Yersinia pestis
gcguagguuucagccucug

SEQ ID NO: 2271994 - RNA, 13 nt, Yersinia pestis
gcguauaaacaga

SEQ ID NO: 2271995 - RNA, 14 nt, Yersinia pestis
gcguauaaacagag

SEQ ID NO: 2271996 - RNA, 21 nt, Yersinia pestis
gcguauugcuguucgccagau

SEQ ID NO: 2271997 - RNA, 17 nt, Yersinia pestis
gcgucagguaaguagaa

SEQ ID NO: 2271998 - RNA, 23 nt, Yersinia pestis
gcgucaagccaacccccauuagc

SEQ ID NO: 2271999 - RNA, 22 nt, Yersinia pestis
gcgucauaccauucucugucuu

SEQ ID NO: 2272000 - RNA, 15 nt, Yersinia pestis
gcgucaucgcggcgc

SEQ ID NO: 2272001 - RNA, 13 nt, Yersinia pestis
gcgucgccacccc

SEQ ID NO: 2272002 - RNA, 14 nt, Yersinia pestis
gcguaacuccuuug

SEQ ID NO: 2272003 - RNA, 13 nt, Yersinia pestis
gcguaaagcaccc

SEQ ID NO: 2272004 - RNA, 16 nt, Yersinia pestis
gcguaaaauauuguug

SEQ ID NO: 2272005 - RNA, 19 nt, Yersinia pestis
gcgguuuuuucuuucuuca

SEQ ID NO: 2272006 - RNA, 16 nt, Yersinia pestis
gcgguuucauggcugg

SEQ ID NO: 2272007 - RNA, 16 nt, Yersinia pestis
gcguacaucaggguga

SEQ ID NO: 2272008 - RNA, 22 nt, Yersinia pestis
gcguaccauaguuuuucuccua

SEQ ID NO: 2272009 - RNA, 18 nt, Yersinia pestis
gcgguuaucacaucaucc

SEQ ID NO: 2272010 - RNA, 18 nt, Yersinia pestis
gcgguuccaaagcaccaa

SEQ ID NO: 2272011 - RNA, 17 nt, Yersinia pestis
gcgguugggaaaagugg

SEQ ID NO: 2272012 - RNA, 14 nt, Yersinia pestis
gcgguugcuguggc

SEQ ID NO: 2272013 - RNA, 15 nt, Yersinia pestis
gcgguugcuguggca

SEQ ID NO: 2272014 - RNA, 20 nt, Yersinia pestis
gcgguuaagcuagccaagcu

SEQ ID NO: 2272015 - RNA, 22 nt, Yersinia pestis
gcgguggccagagcauagacga

SEQ ID NO: 2272016 - RNA, 15 nt, Yersinia pestis
gcggugacaaugaau

SEQ ID NO: 2272017 - RNA, 12 nt, Yersinia pestis
gcggugaacagu

SEQ ID NO: 2272018 - RNA, 20 nt, Yersinia pestis
gcggguuaucacauaaauaa

SEQ ID NO: 2272019 - RNA, 15 nt, Yersinia pestis
gcggcugguaacaga

SEQ ID NO: 2272020 - RNA, 17 nt, Yersinia pestis
gcggcugguaacagagc

SEQ ID NO: 2272021 - RNA, 21 nt, Yersinia pestis
gcggcugguaacagagccuua

SEQ ID NO: 2272022 - RNA, 22 nt, Yersinia pestis
gcggcgccgucacguacugggu

SEQ ID NO: 2272023 - RNA, 16 nt, Yersinia pestis
gcggcuuaccgccgcc

SEQ ID NO: 2272024 - RNA, 22 nt, Yersinia pestis
gcgggaguuugucgcucugggu

SEQ ID NO: 2272025 - RNA, 15 nt, Yersinia pestis
gcgggcaucagccca

SEQ ID NO: 2272026 - RNA, 23 nt, Yersinia pestis
gcgggcaacacagcuccccccuc

SEQ ID NO: 2272027 - RNA, 20 nt, Yersinia pestis
gcggauucacccauuaauag

SEQ ID NO: 2272028 - RNA, 19 nt, Yersinia pestis
gcggcagagccaaucccca

SEQ ID NO: 2272029 - RNA, 19 nt, Yersinia pestis
gcggcagcacagagcacaa

SEQ ID NO: 2272030 - RNA, 21 nt, Yersinia pestis
gcggauaaucuaggccugggu

SEQ ID NO: 2272031 - RNA, 16 nt, Yersinia pestis
gcggauaacggcggca

SEQ ID NO: 2272032 - RNA, 12 nt, Yersinia pestis
gcgcuuccagcg

SEQ ID NO: 2272033 - RNA, 16 nt, Yersinia pestis
gcgcuuccagcucugg

SEQ ID NO: 2272034 - RNA, 13 nt, Yersinia pestis
gcgcuuccaggcu

SEQ ID NO: 2272035 - RNA, 11 nt, Yersinia pestis
gcgcugacggu

SEQ ID NO: 2272036 - RNA, 13 nt, Yersinia pestis
gcggacaccaacu

SEQ ID NO: 2272037 - RNA, 17 nt, Yersinia pestis
gcggcauauaaccaugc

SEQ ID NO: 2272038 - RNA, 18 nt, Yersinia pestis
gcggccagcggcaccgcc

SEQ ID NO: 2272039 - RNA, 16 nt, Yersinia pestis
gcggccagccuugagc

SEQ ID NO: 2272040 - RNA, 18 nt, Yersinia pestis
gcggccaucaccaugccu

SEQ ID NO: 2272041 - RNA, 21 nt, Yersinia pestis
gcggccuuaauggccgccauu

SEQ ID NO: 2272042 - RNA, 23 nt, Yersinia pestis
gcggccuggguagacauggcaac

SEQ ID NO: 2272043 - RNA, 21 nt, Yersinia pestis
gcggccgucacugagcguggu

SEQ ID NO: 2272044 - RNA, 20 nt, Yersinia pestis
gcgcuauguuggcaaauaau

SEQ ID NO: 2272045 - RNA, 17 nt, Yersinia pestis
gcgcuccacgccccaac

SEQ ID NO: 2272046 - RNA, 15 nt, Yersinia pestis
gcgcucauacucagu

SEQ ID NO: 2272047 - RNA, 16 nt, Yersinia pestis
gcgcguuaaucugcug

SEQ ID NO: 2272048 - RNA, 22 nt, Yersinia pestis
gcgcgugguuuccuggaacgaa

SEQ ID NO: 2272049 - RNA, 18 nt, Yersinia pestis
gcgcguaucguccagcag

SEQ ID NO: 2272050 - RNA, 23 nt, Yersinia pestis
gcgauccaaaacaucggccagcg

SEQ ID NO: 2272051 - RNA, 16 nt, Yersinia pestis
gcgaucagguuguucc

SEQ ID NO: 2272052 - RNA, 17 nt, Yersinia pestis
gcgauccagugaaauca

SEQ ID NO: 2272053 - RNA, 19 nt, Yersinia pestis
gcgcgcacuacccgaauca

SEQ ID NO: 2272054 - RNA, 20 nt, Yersinia pestis
gcgcgcacuuacccgaauca

SEQ ID NO: 2272055 - RNA, 22 nt, Yersinia pestis
gcgcgaucccagaauggcaaag

SEQ ID NO: 2272056 - RNA, 20 nt, Yersinia pestis
gcgcgcuacucccggcagca

SEQ ID NO: 2272057 - RNA, 16 nt, Yersinia pestis
gcguggugcgguaguu

SEQ ID NO: 2272058 - RNA, 15 nt, Yersinia pestis
gcguuaaugccaccc

SEQ ID NO: 2272059 - RNA, 18 nt, Yersinia pestis
gcgugggugaugugacgu

SEQ ID NO: 2272060 - RNA, 21 nt, Yersinia pestis
gcguucaaucgugcacccccu

SEQ ID NO: 2272061 - RNA, 14 nt, Yersinia pestis
gcguuauugagaag

SEQ ID NO: 2272062 - RNA, 20 nt, Yersinia pestis
gcguuauugcgacauaaagc

SEQ ID NO: 2272063 - RNA, 16 nt, Yersinia pestis
gcguuacccacauuaa

SEQ ID NO: 2272064 - RNA, 19 nt, Yersinia pestis
gcguuacacaucaggcugu

SEQ ID NO: 2272065 - RNA, 22 nt, Yersinia pestis
gcguuacacaucaggcuguuga

SEQ ID NO: 2272066 - RNA, 21 nt, Yersinia pestis
gcguucagagcagcauuuuua

SEQ ID NO: 2272067 - RNA, 14 nt, Yersinia pestis
gcguucagcaauau

SEQ ID NO: 2272068 - RNA, 19 nt, Yersinia pestis
gcguuccuggauauucaua

SEQ ID NO: 2272069 - RNA, 13 nt, Yersinia pestis
gcguuuuuucggg

SEQ ID NO: 2272070 - RNA, 15 nt, Yersinia pestis
gcguuuuuuugccag

SEQ ID NO: 2272071 - RNA, 13 nt, Yersinia pestis
gcguuuucuucga

SEQ ID NO: 2272072 - RNA, 19 nt, Yersinia pestis
gcguuuuuauugggcagcg

SEQ ID NO: 2272073 - RNA, 22 nt, Yersinia pestis
gcguuucauuuuaacaauuuua

SEQ ID NO: 2272074 - RNA, 14 nt, Yersinia pestis
gcguuuaaauaccc

SEQ ID NO: 2272075 - RNA, 16 nt, Yersinia pestis
gcguucugcaaacccu

SEQ ID NO: 2272076 - RNA, 20 nt, Yersinia pestis
gcguugagacacaaaaaaga

SEQ ID NO: 2272077 - RNA, 16 nt, Yersinia pestis
gcguugucagccaugc

SEQ ID NO: 2272078 - RNA, 13 nt, Yersinia pestis
gcuacagcagcag

SEQ ID NO: 2272079 - RNA, 17 nt, Yersinia pestis
gcuacaagcaugugaug

SEQ ID NO: 2272080 - RNA, 15 nt, Yersinia pestis
gcuaauuuucccugu

SEQ ID NO: 2272081 - RNA, 18 nt, Yersinia pestis
gcuaauuaauuuaaacaa

SEQ ID NO: 2272082 - RNA, 18 nt, Yersinia pestis
gcuaauuagaugaguggu

SEQ ID NO: 2272083 - RNA, 19 nt, Yersinia pestis
gcuaccaggaagcggccag

SEQ ID NO: 2272084 - RNA, 17 nt, Yersinia pestis
gcuacagcucagacugg

SEQ ID NO: 2272085 - RNA, 14 nt, Yersinia pestis
gcuacugguaauaa

SEQ ID NO: 2272086 - RNA, 21 nt, Yersinia pestis
gcuacugcgagucuugguaga

SEQ ID NO: 2272087 - RNA, 22 nt, Yersinia pestis
gcuacugcgcguugccauguug

SEQ ID NO: 2272088 - RNA, 23 nt, Yersinia pestis
gcuacugcuuuuuauugucucua

SEQ ID NO: 2272089 - RNA, 18 nt, Yersinia pestis
gcuacggucguuacuugg

SEQ ID NO: 2272090 - RNA, 23 nt, Yersinia pestis
gcuacggaagacaaugcggccuu

SEQ ID NO: 2272091 - RNA, 24 nt, Yersinia pestis
gcuaccgguuaaacuucuuuaucu

SEQ ID NO: 2272092 - RNA, 22 nt, Yersinia pestis
gcuaccggaaccaacggcaaug

SEQ ID NO: 2272093 - RNA, 19 nt, Yersinia pestis
gcuaccgcgcugcuugcaa

SEQ ID NO: 2272094 - RNA, 22 nt, Yersinia pestis
gcuaacguuuauuuauaagaac

SEQ ID NO: 2272095 - RNA, 21 nt, Yersinia pestis
gcuaacgcuuucagguuguua

SEQ ID NO: 2272096 - RNA, 20 nt, Yersinia pestis
gcuaauacugccaaucgcug

SEQ ID NO: 2272097 - RNA, 22 nt, Yersinia pestis
gcuaauaccauuucuuauaucu

SEQ ID NO: 2272098 - RNA, 15 nt, Yersinia pestis
gcuaauauuuauaaa

SEQ ID NO: 2272099 - RNA, 19 nt, Yersinia pestis
gcuaauauuuauaaaaaau

SEQ ID NO: 2272100 - RNA, 16 nt, Yersinia pestis
gcuaagucacgcaccc

SEQ ID NO: 2272101 - RNA, 15 nt, Yersinia pestis
gcuaauaauuguuca

SEQ ID NO: 2272102 - RNA, 22 nt, Yersinia pestis
gcuaaucccuuuggguggugga

SEQ ID NO: 2272103 - RNA, 22 nt, Yersinia pestis
gcuaaacuaaaacagcuaacac

SEQ ID NO: 2272104 - RNA, 13 nt, Yersinia pestis
gcuaacagugacc

SEQ ID NO: 2272105 - RNA, 16 nt, Yersinia pestis
gcuaaccacagcaaug

SEQ ID NO: 2272106 - RNA, 12 nt, Yersinia pestis
gcuaaccagugu

SEQ ID NO: 2272107 - RNA, 16 nt, Yersinia pestis
gcuaaccaccgucacc

SEQ ID NO: 2272108 - RNA, 23 nt, Yersinia pestis
gcuaaauuaaccgccagucugaa

SEQ ID NO: 2272109 - RNA, 14 nt, Yersinia pestis
gcuaaauacugcug

SEQ ID NO: 2272110 - RNA, 19 nt, Yersinia pestis
gcuccaccguucagguuua

SEQ ID NO: 2272111 - RNA, 15 nt, Yersinia pestis
gcucauuaccaauac

SEQ ID NO: 2272112 - RNA, 16 nt, Yersinia pestis
gcucauuaaacuguuc

SEQ ID NO: 2272113 - RNA, 18 nt, Yersinia pestis
gcucaggcucaucaccuu

SEQ ID NO: 2272114 - RNA, 13 nt, Yersinia pestis
gcucagggccacu

SEQ ID NO: 2272115 - RNA, 20 nt, Yersinia pestis
gcucaggcucaucaccuucc

SEQ ID NO: 2272116 - RNA, 16 nt, Yersinia pestis
gcucaguauucgccag

SEQ ID NO: 2272117 - RNA, 23 nt, Yersinia pestis
gcucagaaaauaaagggggcacc

SEQ ID NO: 2272118 - RNA, 20 nt, Yersinia pestis
gcucacuuuuauauccgcca

SEQ ID NO: 2272119 - RNA, 20 nt, Yersinia pestis
gcucacuuuuauccagccau

SEQ ID NO: 2272120 - RNA, 22 nt, Yersinia pestis
gcucacuggaguuaaaucccug

SEQ ID NO: 2272121 - RNA, 19 nt, Yersinia pestis
gcucagccuguuggucaua

SEQ ID NO: 2272122 - RNA, 15 nt, Yersinia pestis
gcucagcgggcuaaa

SEQ ID NO: 2272123 - RNA, 19 nt, Yersinia pestis
gcucaaugcgaaaaaauau

SEQ ID NO: 2272124 - RNA, 12 nt, Yersinia pestis
gcucaauguucc

SEQ ID NO: 2272125 - RNA, 23 nt, Yersinia pestis
gcucaccauaaauucacagcgcg

SEQ ID NO: 2272126 - RNA, 21 nt, Yersinia pestis
gcucacccauuuuauccucuu

SEQ ID NO: 2272127 - RNA, 16 nt, Yersinia pestis
gcucaccuuucaacaa

SEQ ID NO: 2272128 - RNA, 15 nt, Yersinia pestis
gcuauaucaucagca

SEQ ID NO: 2272129 - RNA, 23 nt, Yersinia pestis
gcuauauugcgcugcgccaauac

SEQ ID NO: 2272130 - RNA, 22 nt, Yersinia pestis
gcuaucauccauaaugagugac

SEQ ID NO: 2272131 - RNA, 17 nt, Yersinia pestis
gcuaucgcgaaaaugaa

SEQ ID NO: 2272132 - RNA, 14 nt, Yersinia pestis
gcuagcuuauccag

SEQ ID NO: 2272133 - RNA, 15 nt, Yersinia pestis
gcuagugcugguuga

SEQ ID NO: 2272134 - RNA, 20 nt, Yersinia pestis
gcuagaauaaguugaugcag

SEQ ID NO: 2272135 - RNA, 19 nt, Yersinia pestis
gcuacuuuuuucacauuac

SEQ ID NO: 2272136 - RNA, 15 nt, Yersinia pestis
gcuacuguuauccag

SEQ ID NO: 2272137 - RNA, 16 nt, Yersinia pestis
gcuacugguagcagcc

SEQ ID NO: 2272138 - RNA, 16 nt, Yersinia pestis
gcuagcaaauuccgcu

SEQ ID NO: 2272139 - RNA, 14 nt, Yersinia pestis
gcucaacugcucaa

SEQ ID NO: 2272140 - RNA, 14 nt, Yersinia pestis
gcucaaacaaugug

SEQ ID NO: 2272141 - RNA, 17 nt, Yersinia pestis
gcucaaauauuugcaca

SEQ ID NO: 2272142 - RNA, 21 nt, Yersinia pestis
gcucaaauauuugcacaaaua

SEQ ID NO: 2272143 - RNA, 15 nt, Yersinia pestis
gcuauuuuuucucac

SEQ ID NO: 2272144 - RNA, 15 nt, Yersinia pestis
gcuauggauaaaucc

SEQ ID NO: 2272145 - RNA, 22 nt, Yersinia pestis
gcuauggauaaauccugaacau

SEQ ID NO: 2272146 - RNA, 23 nt, Yersinia pestis
gcuauggguaauccccaccaaca

SEQ ID NO: 2272147 - RNA, 15 nt, Yersinia pestis
gcuaugcuaaaaaac

SEQ ID NO: 2272148 - RNA, 22 nt, Yersinia pestis
gcuaugccggaggauauuuauu

SEQ ID NO: 2272149 - RNA, 18 nt, Yersinia pestis
gcuaugccuacuggccac

SEQ ID NO: 2272150 - RNA, 14 nt, Yersinia pestis
gcuaucuguuaucu

SEQ ID NO: 2272151 - RNA, 19 nt, Yersinia pestis
gcuaucuguuaucugguua

SEQ ID NO: 2272152 - RNA, 14 nt, Yersinia pestis
gcuaucuuugccug

SEQ ID NO: 2272153 - RNA, 11 nt, Yersinia pestis
gcuaucugcug

SEQ ID NO: 2272154 - RNA, 16 nt, Yersinia pestis
gcuaucugugucagua

SEQ ID NO: 2272155 - RNA, 14 nt, Yersinia pestis
gcuauuaagaaacc

SEQ ID NO: 2272156 - RNA, 13 nt, Yersinia pestis
gcuauucauaaau

SEQ ID NO: 2272157 - RNA, 19 nt, Yersinia pestis
gcuauuggcugauucaaca

SEQ ID NO: 2272158 - RNA, 21 nt, Yersinia pestis
gcuauuuacccccaagacuuu

SEQ ID NO: 2272159 - RNA, 11 nt, Yersinia pestis
gcuauuuaucg

SEQ ID NO: 2272160 - RNA, 14 nt, Yersinia pestis
gcuauuucaauggg

SEQ ID NO: 2272161 - RNA, 12 nt, Yersinia pestis
gcuauuucucuc

SEQ ID NO: 2272162 - RNA, 16 nt, Yersinia pestis
gcuauuucucucuacu

SEQ ID NO: 2272163 - RNA, 22 nt, Yersinia pestis
gcugguugagauuaucagccca

SEQ ID NO: 2272164 - RNA, 18 nt, Yersinia pestis
gcuguaaauauaaaauaa

SEQ ID NO: 2272165 - RNA, 21 nt, Yersinia pestis
gcuguaaaggcaaagaagaau

SEQ ID NO: 2272166 - RNA, 15 nt, Yersinia pestis
gcuguaaucuuggca

SEQ ID NO: 2272167 - RNA, 14 nt, Yersinia pestis
gcugucugaauagu

SEQ ID NO: 2272168 - RNA, 17 nt, Yersinia pestis
gcugugagauccccgcc

SEQ ID NO: 2272169 - RNA, 13 nt, Yersinia pestis
gcugugagccaga

SEQ ID NO: 2272170 - RNA, 12 nt, Yersinia pestis
gcugucgcugug

SEQ ID NO: 2272171 - RNA, 19 nt, Yersinia pestis
gcuguacugcugcaacuca

SEQ ID NO: 2272172 - RNA, 16 nt, Yersinia pestis
gcugggaauuaagaag

SEQ ID NO: 2272173 - RNA, 20 nt, Yersinia pestis
gcuggcuaauacuggcuaaa

SEQ ID NO: 2272174 - RNA, 18 nt, Yersinia pestis
gcugguagugauccccca

SEQ ID NO: 2272175 - RNA, 13 nt, Yersinia pestis
gcugguaacagag

SEQ ID NO: 2272176 - RNA, 21 nt, Yersinia pestis
gcuggguugagcaugacccaa

SEQ ID NO: 2272177 - RNA, 20 nt, Yersinia pestis
gcugggcugguaggugcuca

SEQ ID NO: 2272178 - RNA, 23 nt, Yersinia pestis
gcugcgucuuuaucgccagcugc

SEQ ID NO: 2272179 - RNA, 20 nt, Yersinia pestis
gcugcggcuugggagucaga

SEQ ID NO: 2272180 - RNA, 21 nt, Yersinia pestis
gcugcuuucguucaccccagu

SEQ ID NO: 2272181 - RNA, 23 nt, Yersinia pestis
gcugcuugcgcguuaaucugcug

SEQ ID NO: 2272182 - RNA, 19 nt, Yersinia pestis
gcugcuuuuacgcaaguaa

SEQ ID NO: 2272183 - RNA, 20 nt, Yersinia pestis
gcuggagccauaaguaaagc

SEQ ID NO: 2272184 - RNA, 20 nt, Yersinia pestis
gcugcugcaagaguccagca

SEQ ID NO: 2272185 - RNA, 12 nt, Yersinia pestis
gcugcuuccugc

SEQ ID NO: 2272186 - RNA, 15 nt, Yersinia pestis
gcugcugcagccggg

SEQ ID NO: 2272187 - RNA, 15 nt, Yersinia pestis
gcuggaucagcagac

SEQ ID NO: 2272188 - RNA, 12 nt, Yersinia pestis
gcuggcauuuuu

SEQ ID NO: 2272189 - RNA, 13 nt, Yersinia pestis
gcuggcauacuga

SEQ ID NO: 2272190 - RNA, 17 nt, Yersinia pestis
gcuggcccccaaugaca

SEQ ID NO: 2272191 - RNA, 16 nt, Yersinia pestis
gcuggcggauaaaaau

SEQ ID NO: 2272192 - RNA, 18 nt, Yersinia pestis
gcucuguuggugguggcc

SEQ ID NO: 2272193 - RNA, 14 nt, Yersinia pestis
gcucuggguuaaau

SEQ ID NO: 2272194 - RNA, 23 nt, Yersinia pestis
gcucuggguuaaauugcgggcug

SEQ ID NO: 2272195 - RNA, 21 nt, Yersinia pestis
gcucugggacgugcauaaaac

SEQ ID NO: 2272196 - RNA, 19 nt, Yersinia pestis
gcucugggacgugcauaaa

SEQ ID NO: 2272197 - RNA, 20 nt, Yersinia pestis
gcucuggccagcgucuucag

SEQ ID NO: 2272198 - RNA, 12 nt, Yersinia pestis
gcucuucugggc

SEQ ID NO: 2272199 - RNA, 16 nt, Yersinia pestis
gcucuucaauuuccau

SEQ ID NO: 2272200 - RNA, 12 nt, Yersinia pestis
gcucuucaucau

SEQ ID NO: 2272201 - RNA, 16 nt, Yersinia pestis
gcucuucaccaaagga

SEQ ID NO: 2272202 - RNA, 18 nt, Yersinia pestis
gcucuucaccaaaggaag

SEQ ID NO: 2272203 - RNA, 15 nt, Yersinia pestis
gcucucuuuuuucuc

SEQ ID NO: 2272204 - RNA, 17 nt, Yersinia pestis
gcucugauaguauuaga

SEQ ID NO: 2272205 - RNA, 17 nt, Yersinia pestis
gcucugcguuuuucccu

SEQ ID NO: 2272206 - RNA, 16 nt, Yersinia pestis
gcucugcuccgccuuc

SEQ ID NO: 2272207 - RNA, 13 nt, Yersinia pestis
gcucugccgcagu

SEQ ID NO: 2272208 - RNA, 20 nt, Yersinia pestis
gcucuaugccaguuauuauu

SEQ ID NO: 2272209 - RNA, 16 nt, Yersinia pestis
gcucucauaucccccc

SEQ ID NO: 2272210 - RNA, 18 nt, Yersinia pestis
gcucucauauccccccca

SEQ ID NO: 2272211 - RNA, 15 nt, Yersinia pestis
gcucuccacucgguc

SEQ ID NO: 2272212 - RNA, 14 nt, Yersinia pestis
gcucguuaucugua

SEQ ID NO: 2272213 - RNA, 17 nt, Yersinia pestis
gcucguugguguugacu

SEQ ID NO: 2272214 - RNA, 18 nt, Yersinia pestis
gcucuaacgucagauaaa

SEQ ID NO: 2272215 - RNA, 19 nt, Yersinia pestis
gcucuuuuuugaaguugua

SEQ ID NO: 2272216 - RNA, 16 nt, Yersinia pestis
gcugaaaaucaugaaa

SEQ ID NO: 2272217 - RNA, 22 nt, Yersinia pestis
gcugaaaaaugagucauuaucu

SEQ ID NO: 2272218 - RNA, 23 nt, Yersinia pestis
gcugaaaaauggugagaaacgug

SEQ ID NO: 2272219 - RNA, 14 nt, Yersinia pestis
gcugaccacaaaaa

SEQ ID NO: 2272220 - RNA, 22 nt, Yersinia pestis
gcugaccacaaaaacaguguca

SEQ ID NO: 2272221 - RNA, 21 nt, Yersinia pestis
gcugaccauggcgaucaaagg

SEQ ID NO: 2272222 - RNA, 17 nt, Yersinia pestis
gcugacggcgguauaca

SEQ ID NO: 2272223 - RNA, 19 nt, Yersinia pestis
gcugacggcgguauacaga

SEQ ID NO: 2272224 - RNA, 20 nt, Yersinia pestis
gcugacuuguggaacaacag

SEQ ID NO: 2272225 - RNA, 23 nt, Yersinia pestis
gcugacuggacaaauaaaacaga

SEQ ID NO: 2272226 - RNA, 20 nt, Yersinia pestis
gcugacuaaaucgcuuaucu

SEQ ID NO: 2272227 - RNA, 21 nt, Yersinia pestis
gcugagugaagacaucgccag

SEQ ID NO: 2272228 - RNA, 19 nt, Yersinia pestis
gcugaggcgacacccgcuu

SEQ ID NO: 2272229 - RNA, 18 nt, Yersinia pestis
gcugaggucagugcugca

SEQ ID NO: 2272230 - RNA, 14 nt, Yersinia pestis
gcugaguaaauuaa

SEQ ID NO: 2272231 - RNA, 13 nt, Yersinia pestis
gcugagguugaug

SEQ ID NO: 2272232 - RNA, 24 nt, Yersinia pestis
gcugaugauuuuggugcuggccug

SEQ ID NO: 2272233 - RNA, 22 nt, Yersinia pestis
gcugauagaaaguugagcagca

SEQ ID NO: 2272234 - RNA, 12 nt, Yersinia pestis
gcugcagggccu

SEQ ID NO: 2272235 - RNA, 19 nt, Yersinia pestis
gcugcacgcaggcggcggc

SEQ ID NO: 2272236 - RNA, 22 nt, Yersinia pestis
gcugcacaaguuggugcaguug

SEQ ID NO: 2272237 - RNA, 15 nt, Yersinia pestis
gcugcacaucauuua

SEQ ID NO: 2272238 - RNA, 13 nt, Yersinia pestis
gcugccauauauu

SEQ ID NO: 2272239 - RNA, 12 nt, Yersinia pestis
gcugccaucagc

SEQ ID NO: 2272240 - RNA, 23 nt, Yersinia pestis
gcugcccacauaaagauagccac

SEQ ID NO: 2272241 - RNA, 21 nt, Yersinia pestis
gcacguuuccccuucauuuga

SEQ ID NO: 2272242 - RNA, 18 nt, Yersinia pestis
gcacguuuuucagcuucu

SEQ ID NO: 2272243 - RNA, 14 nt, Yersinia pestis
gcacguucagcagc

SEQ ID NO: 2272244 - RNA, 14 nt, Yersinia pestis
gcacugaguucugc

SEQ ID NO: 2272245 - RNA, 18 nt, Yersinia pestis
gcacugauagcaauccca

SEQ ID NO: 2272246 - RNA, 19 nt, Yersinia pestis
gcacugauucucuucaccu

SEQ ID NO: 2272247 - RNA, 18 nt, Yersinia pestis
gcacugauucucuucacc

SEQ ID NO: 2272248 - RNA, 17 nt, Yersinia pestis
gcacugaguucugcugc

SEQ ID NO: 2272249 - RNA, 17 nt, Yersinia pestis
gcacugauucucuucac

SEQ ID NO: 2272250 - RNA, 16 nt, Yersinia pestis
gcacugacacuccccu

SEQ ID NO: 2272251 - RNA, 15 nt, Yersinia pestis
gcacuccugucuagg

SEQ ID NO: 2272252 - RNA, 19 nt, Yersinia pestis
gcacuccacuaugcccagu

SEQ ID NO: 2272253 - RNA, 17 nt, Yersinia pestis
gcacucgaaucacuuau

SEQ ID NO: 2272254 - RNA, 21 nt, Yersinia pestis
gcacuuuaaucgccaggccac

SEQ ID NO: 2272255 - RNA, 18 nt, Yersinia pestis
gcagaaaaugcggcggcu

SEQ ID NO: 2272256 - RNA, 19 nt, Yersinia pestis
gcacuuuucgucauuauua

SEQ ID NO: 2272257 - RNA, 16 nt, Yersinia pestis
gcacugcgggcaggua

SEQ ID NO: 2272258 - RNA, 23 nt, Yersinia pestis
gcacuggcaauaaagaggccagu

SEQ ID NO: 2272259 - RNA, 23 nt, Yersinia pestis
gcacugcagaaaaugcggcggcu

SEQ ID NO: 2272260 - RNA, 17 nt, Yersinia pestis
gcacugcaucugaccag

SEQ ID NO: 2272261 - RNA, 22 nt, Yersinia pestis
gcacugcagaaaaugcggcggc

SEQ ID NO: 2272262 - RNA, 13 nt, Yersinia pestis
gcacugccccgaa

SEQ ID NO: 2272263 - RNA, 18 nt, Yersinia pestis
gcacugccccgaagcuca

SEQ ID NO: 2272264 - RNA, 14 nt, Yersinia pestis
gcacuucaaccuga

SEQ ID NO: 2272265 - RNA, 15 nt, Yersinia pestis
gcacuucaagcagca

SEQ ID NO: 2272266 - RNA, 16 nt, Yersinia pestis
gcacuucaaccugauc

SEQ ID NO: 2272267 - RNA, 19 nt, Yersinia pestis
gcacuucaaccugauccag

SEQ ID NO: 2272268 - RNA, 12 nt, Yersinia pestis
gcacuggucagu

SEQ ID NO: 2272269 - RNA, 16 nt, Yersinia pestis
gcacuggucaguauaa

SEQ ID NO: 2272270 - RNA, 16 nt, Yersinia pestis
gcacugguuggcggcu

SEQ ID NO: 2272271 - RNA, 16 nt, Yersinia pestis
gcaccuucugauuuuu

SEQ ID NO: 2272272 - RNA, 12 nt, Yersinia pestis
gcaccuucacgc

SEQ ID NO: 2272273 - RNA, 15 nt, Yersinia pestis
gcaccuuugucauug

SEQ ID NO: 2272274 - RNA, 23 nt, Yersinia pestis
gcaccuuugucauugaggagcga

SEQ ID NO: 2272275 - RNA, 21 nt, Yersinia pestis
gcacgacaacaaagccgcugc

SEQ ID NO: 2272276 - RNA, 22 nt, Yersinia pestis
gcacgaaccguggcgcggaugc

SEQ ID NO: 2272277 - RNA, 21 nt, Yersinia pestis
gcacgacggauuugguuggcu

SEQ ID NO: 2272278 - RNA, 23 nt, Yersinia pestis
gcacgacggauuugguuggcuuu

SEQ ID NO: 2272279 - RNA, 17 nt, Yersinia pestis
gcacgauaccaccacca

SEQ ID NO: 2272280 - RNA, 16 nt, Yersinia pestis
gcacgcaggcggcggc

SEQ ID NO: 2272281 - RNA, 17 nt, Yersinia pestis
gcacgcaggcggcggcu

SEQ ID NO: 2272282 - RNA, 15 nt, Yersinia pestis
gcacggcaucgcugc

SEQ ID NO: 2272283 - RNA, 15 nt, Yersinia pestis
gcacggccgggugca

SEQ ID NO: 2272284 - RNA, 13 nt, Yersinia pestis
gcacgggccuugg

SEQ ID NO: 2272285 - RNA, 19 nt, Yersinia pestis
gcacgcugcaugccgccuc

SEQ ID NO: 2272286 - RNA, 14 nt, Yersinia pestis
gcacccuuacccug

SEQ ID NO: 2272287 - RNA, 21 nt, Yersinia pestis
gcaccgcgcuauaaaacagcu

SEQ ID NO: 2272288 - RNA, 23 nt, Yersinia pestis
gcaccgcuggucgggugcaggcc

SEQ ID NO: 2272289 - RNA, 21 nt, Yersinia pestis
gcaccgcugucauuccaaccu

SEQ ID NO: 2272290 - RNA, 20 nt, Yersinia pestis
gcaccucugcugaugucagu

SEQ ID NO: 2272291 - RNA, 23 nt, Yersinia pestis
gcaccucauuggucgcugggccu

SEQ ID NO: 2272292 - RNA, 15 nt, Yersinia pestis
gcaccuccggcggga

SEQ ID NO: 2272293 - RNA, 21 nt, Yersinia pestis
gcaccggagcaagggcgcauc

SEQ ID NO: 2272294 - RNA, 15 nt, Yersinia pestis
gcaccggacaaacca

SEQ ID NO: 2272295 - RNA, 18 nt, Yersinia pestis
gcaccggauuuauugcuc

SEQ ID NO: 2272296 - RNA, 12 nt, Yersinia pestis
gcacccacaccg

SEQ ID NO: 2272297 - RNA, 23 nt, Yersinia pestis
gcaccaugcugcuugauuugcug

SEQ ID NO: 2272298 - RNA, 14 nt, Yersinia pestis
gcaccauuugcccu

SEQ ID NO: 2272299 - RNA, 20 nt, Yersinia pestis
gcaccauaaauuucugguuu

SEQ ID NO: 2272300 - RNA, 13 nt, Yersinia pestis
gcaccauccagca

SEQ ID NO: 2272301 - RNA, 22 nt, Yersinia pestis
gcaccagggaugggcgccgcuu

SEQ ID NO: 2272302 - RNA, 19 nt, Yersinia pestis
gcacccauggagauugccu

SEQ ID NO: 2272303 - RNA, 14 nt, Yersinia pestis
gcaccaaugccggu

SEQ ID NO: 2272304 - RNA, 17 nt, Yersinia pestis
gcaccagaaaguuguuc

SEQ ID NO: 2272305 - RNA, 14 nt, Yersinia pestis
gcaccacggucaga

SEQ ID NO: 2272306 - RNA, 19 nt, Yersinia pestis
gcaauaauuagauugacac

SEQ ID NO: 2272307 - RNA, 15 nt, Yersinia pestis
gcaauaaccaacggg

SEQ ID NO: 2272308 - RNA, 18 nt, Yersinia pestis
gcaauaacgugaugguau

SEQ ID NO: 2272309 - RNA, 20 nt, Yersinia pestis
gcaauaaggugccacacaga

SEQ ID NO: 2272310 - RNA, 16 nt, Yersinia pestis
gcaauaauaucuggcg

SEQ ID NO: 2272311 - RNA, 16 nt, Yersinia pestis
gcaauaauagccaccg

SEQ ID NO: 2272312 - RNA, 22 nt, Yersinia pestis
gcaauagcgaucacggguuuuu

SEQ ID NO: 2272313 - RNA, 17 nt, Yersinia pestis
gcaauauaauaaucuau

SEQ ID NO: 2272314 - RNA, 21 nt, Yersinia pestis
gcaauaucaaugaaaaaaaga

SEQ ID NO: 2272315 - RNA, 13 nt, Yersinia pestis
gcaagguucucgc

SEQ ID NO: 2272316 - RNA, 13 nt, Yersinia pestis
gcaaguuagguac

SEQ ID NO: 2272317 - RNA, 15 nt, Yersinia pestis
gcaauaaaccacugg

SEQ ID NO: 2272318 - RNA, 17 nt, Yersinia pestis
gcaauaacaccagcagg

SEQ ID NO: 2272319 - RNA, 20 nt, Yersinia pestis
gcaauaaagcgucagaugcu

SEQ ID NO: 2272320 - RNA, 14 nt, Yersinia pestis
gcaauaaauucaaa

SEQ ID NO: 2272321 - RNA, 20 nt, Yersinia pestis
gcaauaacaaacacauccag

SEQ ID NO: 2272322 - RNA, 22 nt, Yersinia pestis
gcaauaacaaacacauccagga

SEQ ID NO: 2272323 - RNA, 16 nt, Yersinia pestis
gcaaggucgccucugg

SEQ ID NO: 2272324 - RNA, 11 nt, Yersinia pestis
gcaaggccagg

SEQ ID NO: 2272325 - RNA, 20 nt, Yersinia pestis
gcaaggauuccccccaguca

SEQ ID NO: 2272326 - RNA, 16 nt, Yersinia pestis
gcaagcaaccgcaaug

SEQ ID NO: 2272327 - RNA, 16 nt, Yersinia pestis
gcaagauuuuguagcc

SEQ ID NO: 2272328 - RNA, 17 nt, Yersinia pestis
gcaagcagcucaaaauc

SEQ ID NO: 2272329 - RNA, 14 nt, Yersinia pestis
gcaaccuuguuuua

SEQ ID NO: 2272330 - RNA, 15 nt, Yersinia pestis
gcaacgacagcaaca

SEQ ID NO: 2272331 - RNA, 21 nt, Yersinia pestis
gaucaauucgaugauuuauau

SEQ ID NO: 2272332 - RNA, 20 nt, Yersinia pestis
gaucacaauacagcaaauag

SEQ ID NO: 2272333 - RNA, 20 nt, Yersinia pestis
gaucacaucacagugccaaa

SEQ ID NO: 2272334 - RNA, 17 nt, Yersinia pestis
gcaacgccgaugaaggu

SEQ ID NO: 2272335 - RNA, 18 nt, Yersinia pestis
gcaacguuaaagaugaag

SEQ ID NO: 2272336 - RNA, 20 nt, Yersinia pestis
gcaacgguuucaacuucaac

SEQ ID NO: 2272337 - RNA, 13 nt, Yersinia pestis
gcaacgguaaaag

SEQ ID NO: 2272338 - RNA, 21 nt, Yersinia pestis
gcaacucuagcgccagcaauu

SEQ ID NO: 2272339 - RNA, 16 nt, Yersinia pestis
gcaacguuuuaccugc

SEQ ID NO: 2272340 - RNA, 20 nt, Yersinia pestis
aaagcgauaucguuaucaac

SEQ ID NO: 2272341 - RNA, 22 nt, Yersinia pestis
gcaacugagucgcuugauucuc

SEQ ID NO: 2272342 - RNA, 15 nt, Yersinia pestis
aaagcgccuuuuauu

SEQ ID NO: 2272343 - RNA, 14 nt, Yersinia pestis
aaagcgccuuuuau

SEQ ID NO: 2272344 - RNA, 14 nt, Yersinia pestis
aaagcgccuuccuu

SEQ ID NO: 2272345 - RNA, 23 nt, Yersinia pestis
aaagcgcguaucguccagcagca

SEQ ID NO: 2272346 - RNA, 21 nt, Yersinia pestis
gcaacuuaaaaguaggcuuau

SEQ ID NO: 2272347 - RNA, 17 nt, Yersinia pestis
gcaagaaacuucauuuc

SEQ ID NO: 2272348 - RNA, 20 nt, Yersinia pestis
gcaagaaacuucauuucagg

SEQ ID NO: 2272349 - RNA, 17 nt, Yersinia pestis
gcaagaaagaaaaauag

SEQ ID NO: 2272350 - RNA, 14 nt, Yersinia pestis
gcaagaauaacugg

SEQ ID NO: 2272351 - RNA, 21 nt, Yersinia pestis
gcaagaacauuuccacaauca

SEQ ID NO: 2272352 - RNA, 14 nt, Yersinia pestis
gcaagaacaaucca

SEQ ID NO: 2272353 - RNA, 19 nt, Yersinia pestis
gcaauccgcugacauugcc

SEQ ID NO: 2272354 - RNA, 13 nt, Yersinia pestis
gcaaucaauaagc

SEQ ID NO: 2272355 - RNA, 14 nt, Yersinia pestis
gcaaucaauaagcu

SEQ ID NO: 2272356 - RNA, 19 nt, Yersinia pestis
gcaaucaauguauugcucc

SEQ ID NO: 2272357 - RNA, 21 nt, Yersinia pestis
gcaaucaauguauugcuccag

SEQ ID NO: 2272358 - RNA, 21 nt, Yersinia pestis
gcaauauugucuuaugauaua

SEQ ID NO: 2272359 - RNA, 17 nt, Yersinia pestis
gcaaucugcaagccccc

SEQ ID NO: 2272360 - RNA, 17 nt, Yersinia pestis
gcaaugaccucccuguu

SEQ ID NO: 2272361 - RNA, 19 nt, Yersinia pestis
gcaaugaccuuacagugau

SEQ ID NO: 2272362 - RNA, 17 nt, Yersinia pestis
gcaaugcagauaaccgu

SEQ ID NO: 2272363 - RNA, 23 nt, Yersinia pestis
gcaaugggucauugcgugcaaua

SEQ ID NO: 2272364 - RNA, 17 nt, Yersinia pestis
gcaauggcguuccaaua

SEQ ID NO: 2272365 - RNA, 19 nt, Yersinia pestis
gcaauggaagaaucaccga

SEQ ID NO: 2272366 - RNA, 15 nt, Yersinia pestis
gcaauggcgcucuua

SEQ ID NO: 2272367 - RNA, 16 nt, Yersinia pestis
gcaauggcgauugugc

SEQ ID NO: 2272368 - RNA, 17 nt, Yersinia pestis
gcaaugcuuauuucaca

SEQ ID NO: 2272369 - RNA, 20 nt, Yersinia pestis
gcaaugcuccagcaacugaa

SEQ ID NO: 2272370 - RNA, 18 nt, Yersinia pestis
gcaauucagccucauaca

SEQ ID NO: 2272371 - RNA, 18 nt, Yersinia pestis
gcaauuaugacguucagu

SEQ ID NO: 2272372 - RNA, 18 nt, Yersinia pestis
gcaauuagcacauaugca

SEQ ID NO: 2272373 - RNA, 21 nt, Yersinia pestis
gcaaugucaccugaaccugac

SEQ ID NO: 2272374 - RNA, 14 nt, Yersinia pestis
gcaauguccccccu

SEQ ID NO: 2272375 - RNA, 17 nt, Yersinia pestis
gcacaaacauggcuguc

SEQ ID NO: 2272376 - RNA, 23 nt, Yersinia pestis
gcacaaacauggcggcagcacag

SEQ ID NO: 2272377 - RNA, 21 nt, Yersinia pestis
gcaauuuuuagcgcuaaauca

SEQ ID NO: 2272378 - RNA, 23 nt, Yersinia pestis
gcaauuuuuagcgcuaaaucagc

SEQ ID NO: 2272379 - RNA, 19 nt, Yersinia pestis
gcaauuugcccaucuuuua

SEQ ID NO: 2272380 - RNA, 23 nt, Yersinia pestis
gcaauuucuguuaccagaaaacc

SEQ ID NO: 2272381 - RNA, 21 nt, Yersinia pestis
gcaauuucucuguauuuucaa

SEQ ID NO: 2272382 - RNA, 17 nt, Yersinia pestis
gcacagcgagauaaacu

SEQ ID NO: 2272383 - RNA, 18 nt, Yersinia pestis
gcacaguuaauuuucacc

SEQ ID NO: 2272384 - RNA, 13 nt, Yersinia pestis
gcacaguuuucuu

SEQ ID NO: 2272385 - RNA, 23 nt, Yersinia pestis
gcacaucgggauccgccugcugg

SEQ ID NO: 2272386 - RNA, 21 nt, Yersinia pestis
gcacaucauuuauuuccaagc

SEQ ID NO: 2272387 - RNA, 19 nt, Yersinia pestis
gcacaucauuuauuuccaa

SEQ ID NO: 2272388 - RNA, 16 nt, Yersinia pestis
gcacauacuaauagaa

SEQ ID NO: 2272389 - RNA, 18 nt, Yersinia pestis
gcacauacuaauagaaga

SEQ ID NO: 2272390 - RNA, 23 nt, Yersinia pestis
gcacauaccccauuuaucgccaa

SEQ ID NO: 2272391 - RNA, 12 nt, Yersinia pestis
gcacagacgccc

SEQ ID NO: 2272392 - RNA, 17 nt, Yersinia pestis
gcacacuuuucacuccg

SEQ ID NO: 2272393 - RNA, 21 nt, Yersinia pestis
gcacacuuuucacuccggcau

SEQ ID NO: 2272394 - RNA, 16 nt, Yersinia pestis
gcacagaaaaugucca

SEQ ID NO: 2272395 - RNA, 22 nt, Yersinia pestis
gcacacucagaugaaaaacugu

SEQ ID NO: 2272396 - RNA, 22 nt, Yersinia pestis
gcacacgacagcgcggcuaaau

SEQ ID NO: 2272397 - RNA, 14 nt, Yersinia pestis
gcacaccagaaccg

SEQ ID NO: 2272398 - RNA, 19 nt, Yersinia pestis
gcacaaagcuuacuguuca

SEQ ID NO: 2272399 - RNA, 18 nt, Yersinia pestis
gcacaacaaauggguuau

SEQ ID NO: 2272400 - RNA, 14 nt, Yersinia pestis
gcacaaucagggca

SEQ ID NO: 2272401 - RNA, 15 nt, Yersinia pestis
gcacaaucagggcac

SEQ ID NO: 2272402 - RNA, 21 nt, Yersinia pestis
gcacaauccaauuuaccacua

SEQ ID NO: 2272403 - RNA, 16 nt, Yersinia pestis
gcacaaggcuggucag

SEQ ID NO: 2272404 - RNA, 22 nt, Yersinia pestis
gcacaauuugguagaacugcgg

SEQ ID NO: 2272405 - RNA, 14 nt, Yersinia pestis
gcacacagcccugc

SEQ ID NO: 2272406 - RNA, 14 nt, Yersinia pestis
gcacaaugcauuca

SEQ ID NO: 2272407 - RNA, 23 nt, Yersinia pestis
gcacaaugacuuaacugaaagcc

SEQ ID NO: 2272408 - RNA, 16 nt, Yersinia pestis
gcacacacagccuacg

SEQ ID NO: 2272409 - RNA, 13 nt, Yersinia pestis
gcacaaugguuga

SEQ ID NO: 2272410 - RNA, 15 nt, Yersinia pestis
gcagguaaugcauuc

SEQ ID NO: 2272411 - RNA, 19 nt, Yersinia pestis
gcagguaaugucacugcca

SEQ ID NO: 2272412 - RNA, 14 nt, Yersinia pestis
gcaggucagaauga

SEQ ID NO: 2272413 - RNA, 23 nt, Yersinia pestis
gcagguaucaauacagacgccga

SEQ ID NO: 2272414 - RNA, 21 nt, Yersinia pestis
gcaggucaaagaagcgcagga

SEQ ID NO: 2272415 - RNA, 19 nt, Yersinia pestis
gcagguagggcggcccacu

SEQ ID NO: 2272416 - RNA, 13 nt, Yersinia pestis
gcaggugguuaaa

SEQ ID NO: 2272417 - RNA, 17 nt, Yersinia pestis
gcaggugguuaaacuga

SEQ ID NO: 2272418 - RNA, 12 nt, Yersinia pestis
gcagguggaucc

SEQ ID NO: 2272419 - RNA, 23 nt, Yersinia pestis
gcagguuaaaguugauaaagcug

SEQ ID NO: 2272420 - RNA, 22 nt, Yersinia pestis
gcaggucucgcaaugaaagugg

SEQ ID NO: 2272421 - RNA, 22 nt, Yersinia pestis
gcaggcaaacaaugugccgcgc

SEQ ID NO: 2272422 - RNA, 18 nt, Yersinia pestis
gcaggcacugcagaaaau

SEQ ID NO: 2272423 - RNA, 20 nt, Yersinia pestis
gcaggccagcgacauggcgc

SEQ ID NO: 2272424 - RNA, 22 nt, Yersinia pestis
gcaggccagacccauuucugcu

SEQ ID NO: 2272425 - RNA, 14 nt, Yersinia pestis
gcaggcccugguug

SEQ ID NO: 2272426 - RNA, 23 nt, Yersinia pestis
gcaggccauuggcaaaggccagc

SEQ ID NO: 2272427 - RNA, 19 nt, Yersinia pestis
gcaggcccuuucaccgcug

SEQ ID NO: 2272428 - RNA, 14 nt, Yersinia pestis
gcaggcuucaacua

SEQ ID NO: 2272429 - RNA, 16 nt, Yersinia pestis
gcagcgagcacugccc

SEQ ID NO: 2272430 - RNA, 15 nt, Yersinia pestis
gcagcccuuauucaa

SEQ ID NO: 2272431 - RNA, 20 nt, Yersinia pestis
gcagcccuuauucaaagaau

SEQ ID NO: 2272432 - RNA, 14 nt, Yersinia pestis
gcagccgccgcugg

SEQ ID NO: 2272433 - RNA, 18 nt, Yersinia pestis
gcagcggcuagcagcagg

SEQ ID NO: 2272434 - RNA, 11 nt, Yersinia pestis
gcagcggggga

SEQ ID NO: 2272435 - RNA, 18 nt, Yersinia pestis
gcagagccugacucacag

SEQ ID NO: 2272436 - RNA, 15 nt, Yersinia pestis
gcagauaccacauca

SEQ ID NO: 2272437 - RNA, 19 nt, Yersinia pestis
gcagauaugaugcggaaga

SEQ ID NO: 2272438 - RNA, 19 nt, Yersinia pestis
gcagauaucagccagugcu

SEQ ID NO: 2272439 - RNA, 21 nt, Yersinia pestis
gcagaguucggucauaaaaac

SEQ ID NO: 2272440 - RNA, 18 nt, Yersinia pestis
gcagauaaaucuguggca

SEQ ID NO: 2272441 - RNA, 16 nt, Yersinia pestis
gcagauguaaccaccc

SEQ ID NO: 2272442 - RNA, 18 nt, Yersinia pestis
gcagauguaaccacccac

SEQ ID NO: 2272443 - RNA, 21 nt, Yersinia pestis
gcagauguauuagcgcugcuc

SEQ ID NO: 2272444 - RNA, 15 nt, Yersinia pestis
gcagaucguaaagac

SEQ ID NO: 2272445 - RNA, 17 nt, Yersinia pestis
gcagaucggcauuauua

SEQ ID NO: 2272446 - RNA, 19 nt, Yersinia pestis
gcagauauuggcgaccauc

SEQ ID NO: 2272447 - RNA, 15 nt, Yersinia pestis
gcagaaucacuggca

SEQ ID NO: 2272448 - RNA, 19 nt, Yersinia pestis
gcagaagggcggccagcaa

SEQ ID NO: 2272449 - RNA, 22 nt, Yersinia pestis
gcagaacuagcgccgcaucaaa

SEQ ID NO: 2272450 - RNA, 14 nt, Yersinia pestis
gcagaacaaaacaa

SEQ ID NO: 2272451 - RNA, 14 nt, Yersinia pestis
gcagaaagcagcag

SEQ ID NO: 2272452 - RNA, 20 nt, Yersinia pestis
gcagaaaucguauuaucaau

SEQ ID NO: 2272453 - RNA, 20 nt, Yersinia pestis
gcagacaugauuaaaucaag

SEQ ID NO: 2272454 - RNA, 22 nt, Yersinia pestis
gcagacaugauuaaaucaagcu

SEQ ID NO: 2272455 - RNA, 18 nt, Yersinia pestis
gcagacccgugaacaucu

SEQ ID NO: 2272456 - RNA, 22 nt, Yersinia pestis
gcagacccgugaacaucuggcg

SEQ ID NO: 2272457 - RNA, 20 nt, Yersinia pestis
gcagacggcguaagccuuca

SEQ ID NO: 2272458 - RNA, 16 nt, Yersinia pestis
gcagagaggagaauua

SEQ ID NO: 2272459 - RNA, 17 nt, Yersinia pestis
gcagcagacaacugaca

SEQ ID NO: 2272460 - RNA, 13 nt, Yersinia pestis
gcagcagagaaug

SEQ ID NO: 2272461 - RNA, 22 nt, Yersinia pestis
gcagcaaguuagcgauaucugc

SEQ ID NO: 2272462 - RNA, 13 nt, Yersinia pestis
gcagcaagaaacu

SEQ ID NO: 2272463 - RNA, 20 nt, Yersinia pestis
gcagcaaaagguaucgcagu

SEQ ID NO: 2272464 - RNA, 22 nt, Yersinia pestis
gcagcaaacgcacaacaaaugg

SEQ ID NO: 2272465 - RNA, 14 nt, Yersinia pestis
gcagccaaaauaau

SEQ ID NO: 2272466 - RNA, 13 nt, Yersinia pestis
gcagcauccagcu

SEQ ID NO: 2272467 - RNA, 16 nt, Yersinia pestis
gcaucacgauagccag

SEQ ID NO: 2272468 - RNA, 16 nt, Yersinia pestis
gcaucacuucauacac

SEQ ID NO: 2272469 - RNA, 15 nt, Yersinia pestis
gcaucaauaauaacg

SEQ ID NO: 2272470 - RNA, 16 nt, Yersinia pestis
gcaucaauaaauagag

SEQ ID NO: 2272471 - RNA, 14 nt, Yersinia pestis
gcaucaauaaaauu

SEQ ID NO: 2272472 - RNA, 18 nt, Yersinia pestis
gcauaucccuguuuucua

SEQ ID NO: 2272473 - RNA, 11 nt, Yersinia pestis
gcauacucagg

SEQ ID NO: 2272474 - RNA, 15 nt, Yersinia pestis
gcaucgcgggcgcgc

SEQ ID NO: 2272475 - RNA, 15 nt, Yersinia pestis
gcauccguacccgcu

SEQ ID NO: 2272476 - RNA, 20 nt, Yersinia pestis
gcaucgcgacugagaagcgg

SEQ ID NO: 2272477 - RNA, 14 nt, Yersinia pestis
gcauccccaucgcc

SEQ ID NO: 2272478 - RNA, 16 nt, Yersinia pestis
gcauccccaucgccaa

SEQ ID NO: 2272479 - RNA, 21 nt, Yersinia pestis
gcauccccggcaucccaccuu

SEQ ID NO: 2272480 - RNA, 22 nt, Yersinia pestis
gcauccgcgaugacacaauucc

SEQ ID NO: 2272481 - RNA, 18 nt, Yersinia pestis
gcauuggugucccaaacu

SEQ ID NO: 2272482 - RNA, 17 nt, Yersinia pestis
gcauugguugcggauga

SEQ ID NO: 2272483 - RNA, 21 nt, Yersinia pestis
gcauuguaaaauaaggcgaau

SEQ ID NO: 2272484 - RNA, 14 nt, Yersinia pestis
gcauucuuuaucac

SEQ ID NO: 2272485 - RNA, 15 nt, Yersinia pestis
gcauuagacauucaa

SEQ ID NO: 2272486 - RNA, 15 nt, Yersinia pestis
gcauuaucuuuaauu

SEQ ID NO: 2272487 - RNA, 16 nt, Yersinia pestis
gcauucugcugguuca

SEQ ID NO: 2272488 - RNA, 16 nt, Yersinia pestis
gcauucaggcuuuuuu

SEQ ID NO: 2272489 - RNA, 18 nt, Yersinia pestis
gcauguuccuguugcugg

SEQ ID NO: 2272490 - RNA, 23 nt, Yersinia pestis
gcauguuauuggcuaaaguguac

SEQ ID NO: 2272491 - RNA, 15 nt, Yersinia pestis
gcauguucagccgcu

SEQ ID NO: 2272492 - RNA, 17 nt, Yersinia pestis
gcauguuauuggcuaaa

SEQ ID NO: 2272493 - RNA, 16 nt, Yersinia pestis
gcauguggaagcgggc

SEQ ID NO: 2272494 - RNA, 20 nt, Yersinia pestis
gcaugugauguggcuugcaa

SEQ ID NO: 2272495 - RNA, 18 nt, Yersinia pestis
gcauuacucuuauaaaga

SEQ ID NO: 2272496 - RNA, 13 nt, Yersinia pestis
gcaugaaacacag

SEQ ID NO: 2272497 - RNA, 24 nt, Yersinia pestis
gcaugacuagugccacaacaagcc

SEQ ID NO: 2272498 - RNA, 15 nt, Yersinia pestis
gcaucuuuugcuauu

SEQ ID NO: 2272499 - RNA, 19 nt, Yersinia pestis
gcaucgucaaauuccccca

SEQ ID NO: 2272500 - RNA, 21 nt, Yersinia pestis
gccaaccggcgaagggcgcag

SEQ ID NO: 2272501 - RNA, 14 nt, Yersinia pestis
gccaacgucucuuc

SEQ ID NO: 2272502 - RNA, 12 nt, Yersinia pestis
gccaacagugaa

SEQ ID NO: 2272503 - RNA, 13 nt, Yersinia pestis
gccaacaggcccc

SEQ ID NO: 2272504 - RNA, 16 nt, Yersinia pestis
gccaaaccauggcuca

SEQ ID NO: 2272505 - RNA, 13 nt, Yersinia pestis
gccaaacaguaaa

SEQ ID NO: 2272506 - RNA, 16 nt, Yersinia pestis
gccaaacaaauguuua

SEQ ID NO: 2272507 - RNA, 16 nt, Yersinia pestis
gccaauaaccgcagca

SEQ ID NO: 2272508 - RNA, 19 nt, Yersinia pestis
gccaauaaccgcagcaggc

SEQ ID NO: 2272509 - RNA, 14 nt, Yersinia pestis
gccaauaaaacgcc

SEQ ID NO: 2272510 - RNA, 22 nt, Yersinia pestis
gccaauagaaaaacacuggcag

SEQ ID NO: 2272511 - RNA, 15 nt, Yersinia pestis
gccaauaggccccuc

SEQ ID NO: 2272512 - RNA, 16 nt, Yersinia pestis
gccaaucaaaaaaccg

SEQ ID NO: 2272513 - RNA, 23 nt, Yersinia pestis
gccaagcuacggccuguaccacc

SEQ ID NO: 2272514 - RNA, 20 nt, Yersinia pestis
gccaagguccaacucccaaa

SEQ ID NO: 2272515 - RNA, 20 nt, Yersinia pestis
gccaaggccagcgccccauc

SEQ ID NO: 2272516 - RNA, 16 nt, Yersinia pestis
gccaauuauucucuga

SEQ ID NO: 2272517 - RNA, 16 nt, Yersinia pestis
gccacaacccaauaau

SEQ ID NO: 2272518 - RNA, 17 nt, Yersinia pestis
gccacaacccaauaaua

SEQ ID NO: 2272519 - RNA, 18 nt, Yersinia pestis
gccaauuuggggcugcuu

SEQ ID NO: 2272520 - RNA, 21 nt, Yersinia pestis
gccaauuggucaugaugaaua

SEQ ID NO: 2272521 - RNA, 22 nt, Yersinia pestis
gccaaugacaaaggguaauuaa

SEQ ID NO: 2272522 - RNA, 21 nt, Yersinia pestis
gccaaucggccuuaaccaagc

SEQ ID NO: 2272523 - RNA, 12 nt, Yersinia pestis
gccaauccccag

SEQ ID NO: 2272524 - RNA, 21 nt, Yersinia pestis
gccaaucgaacccaaccagac

SEQ ID NO: 2272525 - RNA, 18 nt, Yersinia pestis
gccaaugccucuucaaua

SEQ ID NO: 2272526 - RNA, 23 nt, Yersinia pestis
gccaaugccuuagguaagucagc

SEQ ID NO: 2272527 - RNA, 22 nt, Yersinia pestis
gccaaugcgguuuuucuugcca

SEQ ID NO: 2272528 - RNA, 15 nt, Yersinia pestis
gccaauggccacugc

SEQ ID NO: 2272529 - RNA, 23 nt, Yersinia pestis
gccaccgcacaguuaauuuucac

SEQ ID NO: 2272530 - RNA, 15 nt, Yersinia pestis
gccaccggcaguuca

SEQ ID NO: 2272531 - RNA, 14 nt, Yersinia pestis
gccacagcaacagg

SEQ ID NO: 2272532 - RNA, 16 nt, Yersinia pestis
gccacaggcugcaugg

SEQ ID NO: 2272533 - RNA, 18 nt, Yersinia pestis
gccacaggcugcaugggu

SEQ ID NO: 2272534 - RNA, 19 nt, Yersinia pestis
gccaccccguggcaggccu

SEQ ID NO: 2272535 - RNA, 21 nt, Yersinia pestis
gccacugguccgucuauccua

SEQ ID NO: 2272536 - RNA, 12 nt, Yersinia pestis
gccacuggccug

SEQ ID NO: 2272537 - RNA, 14 nt, Yersinia pestis
gccacuggccuguu

SEQ ID NO: 2272538 - RNA, 21 nt, Yersinia pestis
gccacuggccuguugcaauug

SEQ ID NO: 2272539 - RNA, 21 nt, Yersinia pestis
gccacuacggcgacuugccgu

SEQ ID NO: 2272540 - RNA, 17 nt, Yersinia pestis
gccacuacgaccccaac

SEQ ID NO: 2272541 - RNA, 16 nt, Yersinia pestis
gccacucacauaagaa

SEQ ID NO: 2272542 - RNA, 13 nt, Yersinia pestis
gccaccuucuuau

SEQ ID NO: 2272543 - RNA, 20 nt, Yersinia pestis
gccacgaccauucgcaggcc

SEQ ID NO: 2272544 - RNA, 16 nt, Yersinia pestis
gccacggcauuagaag

SEQ ID NO: 2272545 - RNA, 21 nt, Yersinia pestis
gccacggcgagaccuacucgc

SEQ ID NO: 2272546 - RNA, 15 nt, Yersinia pestis
gccacguaauaccac

SEQ ID NO: 2272547 - RNA, 15 nt, Yersinia pestis
gccaguaaucaaaca

SEQ ID NO: 2272548 - RNA, 18 nt, Yersinia pestis
gccaguauccagaugauu

SEQ ID NO: 2272549 - RNA, 14 nt, Yersinia pestis
gccagucaaugacg

SEQ ID NO: 2272550 - RNA, 22 nt, Yersinia pestis
gccagugccaccguaaaaaacc

SEQ ID NO: 2272551 - RNA, 20 nt, Yersinia pestis
gccagugaugcugcacauca

SEQ ID NO: 2272552 - RNA, 17 nt, Yersinia pestis
gccagugcuggcaacag

SEQ ID NO: 2272553 - RNA, 20 nt, Yersinia pestis
gccagugggauaucugcggu

SEQ ID NO: 2272554 - RNA, 18 nt, Yersinia pestis
gccagugccgcggcggcc

SEQ ID NO: 2272555 - RNA, 14 nt, Yersinia pestis
gccagugcuauuca

SEQ ID NO: 2272556 - RNA, 15 nt, Yersinia pestis
gccagguaagaaaga

SEQ ID NO: 2272557 - RNA, 17 nt, Yersinia pestis
gccagggucauucacgu

SEQ ID NO: 2272558 - RNA, 14 nt, Yersinia pestis
gccaggucaggaag

SEQ ID NO: 2272559 - RNA, 17 nt, Yersinia pestis
gccacuucgguggcccu

SEQ ID NO: 2272560 - RNA, 15 nt, Yersinia pestis
gccacuucgguggcc

SEQ ID NO: 2272561 - RNA, 12 nt, Yersinia pestis
gccacuucggug

SEQ ID NO: 2272562 - RNA, 20 nt, Yersinia pestis
gccaugagaaccaguucugg

SEQ ID NO: 2272563 - RNA, 14 nt, Yersinia pestis
gccaugagguuuau

SEQ ID NO: 2272564 - RNA, 20 nt, Yersinia pestis
gccauggaauuuaugcacca

SEQ ID NO: 2272565 - RNA, 15 nt, Yersinia pestis
gccaugucaggccac

SEQ ID NO: 2272566 - RNA, 14 nt, Yersinia pestis
gccaugggaaauca

SEQ ID NO: 2272567 - RNA, 17 nt, Yersinia pestis
gccauggcgaaaauccu

SEQ ID NO: 2272568 - RNA, 21 nt, Yersinia pestis
gccauuugaacaaaccccacu

SEQ ID NO: 2272569 - RNA, 14 nt, Yersinia pestis
gccauuuuggguuu

SEQ ID NO: 2272570 - RNA, 12 nt, Yersinia pestis
gccauuuugcug

SEQ ID NO: 2272571 - RNA, 19 nt, Yersinia pestis
gcccaacucuuuagccgcu

SEQ ID NO: 2272572 - RNA, 14 nt, Yersinia pestis
gccauucuggcgca

SEQ ID NO: 2272573 - RNA, 16 nt, Yersinia pestis
gccauucuggcgcagg

SEQ ID NO: 2272574 - RNA, 19 nt, Yersinia pestis
gccauucauuuaucaagcc

SEQ ID NO: 2272575 - RNA, 13 nt, Yersinia pestis
gccauucagcagc

SEQ ID NO: 2272576 - RNA, 12 nt, Yersinia pestis
gccaucaauaaa

SEQ ID NO: 2272577 - RNA, 21 nt, Yersinia pestis
gccaucgcuaaucauauccau

SEQ ID NO: 2272578 - RNA, 17 nt, Yersinia pestis
gccaucgccccaaagau

SEQ ID NO: 2272579 - RNA, 12 nt, Yersinia pestis
gccauaaauaaa

SEQ ID NO: 2272580 - RNA, 16 nt, Yersinia pestis
gccauaaauaccaauu

SEQ ID NO: 2272581 - RNA, 17 nt, Yersinia pestis
gccauaagugcacugaa

SEQ ID NO: 2272582 - RNA, 21 nt, Yersinia pestis
gccauaaccugagcaccagaa

SEQ ID NO: 2272583 - RNA, 21 nt, Yersinia pestis
gcccaauacggcacucaaaua

SEQ ID NO: 2272584 - RNA, 16 nt, Yersinia pestis
gcccaauaagugaaac

SEQ ID NO: 2272585 - RNA, 21 nt, Yersinia pestis
gcccaauaagugaaacaaaua

SEQ ID NO: 2272586 - RNA, 14 nt, Yersinia pestis
gcccaagaauaaua

SEQ ID NO: 2272587 - RNA, 17 nt, Yersinia pestis
gcccagacgccggccgg

SEQ ID NO: 2272588 - RNA, 13 nt, Yersinia pestis
gcccagagcgcgg

SEQ ID NO: 2272589 - RNA, 21 nt, Yersinia pestis
gcccagauucauuagccagcc

SEQ ID NO: 2272590 - RNA, 12 nt, Yersinia pestis
gcccagauggca

SEQ ID NO: 2272591 - RNA, 16 nt, Yersinia pestis
gcccagccucuggaua

SEQ ID NO: 2272592 - RNA, 18 nt, Yersinia pestis
gccccaacacuggggcgc

SEQ ID NO: 2272593 - RNA, 22 nt, Yersinia pestis
gccccaaauaaucagcucauua

SEQ ID NO: 2272594 - RNA, 15 nt, Yersinia pestis
gccccaaaugccagc

SEQ ID NO: 2272595 - RNA, 22 nt, Yersinia pestis
gccccaaccaucuccggcugac

SEQ ID NO: 2272596 - RNA, 17 nt, Yersinia pestis
gccccaauagauagaga

SEQ ID NO: 2272597 - RNA, 15 nt, Yersinia pestis
gccccaaucaccggc

SEQ ID NO: 2272598 - RNA, 15 nt, Yersinia pestis
gccccaagcauagaa

SEQ ID NO: 2272599 - RNA, 16 nt, Yersinia pestis
gcccaucuuugauuua

SEQ ID NO: 2272600 - RNA, 14 nt, Yersinia pestis
gcccaugaccacuu

SEQ ID NO: 2272601 - RNA, 23 nt, Yersinia pestis
gcccaguauugcagagcaaaacu

SEQ ID NO: 2272602 - RNA, 13 nt, Yersinia pestis
gccccucagacug

SEQ ID NO: 2272603 - RNA, 17 nt, Yersinia pestis
gccccucagacugcuga

SEQ ID NO: 2272604 - RNA, 22 nt, Yersinia pestis
gccccggcaaguugaucacccg

SEQ ID NO: 2272605 - RNA, 16 nt, Yersinia pestis
gcccgcaacgggagag

SEQ ID NO: 2272606 - RNA, 13 nt, Yersinia pestis
gcccgcagacugc

SEQ ID NO: 2272607 - RNA, 17 nt, Yersinia pestis
gccccgcuauugcccau

SEQ ID NO: 2272608 - RNA, 11 nt, Yersinia pestis
aaagcgucagc

SEQ ID NO: 2272609 - RNA, 18 nt, Yersinia pestis
aaagcguccgcgccaggg

SEQ ID NO: 2272610 - RNA, 20 nt, Yersinia pestis
aaagcguauuaccacgccgu

SEQ ID NO: 2272611 - RNA, 23 nt, Yersinia pestis
aaagcguccgcgccaaggauggc

SEQ ID NO: 2272612 - RNA, 18 nt, Yersinia pestis
aaagcgggccagcaacca

SEQ ID NO: 2272613 - RNA, 14 nt, Yersinia pestis
aaagcuaauauucu

SEQ ID NO: 2272614 - RNA, 20 nt, Yersinia pestis
gccgacgaucuugcccaaug

SEQ ID NO: 2272615 - RNA, 19 nt, Yersinia pestis
gcccuuaucuacugggcca

SEQ ID NO: 2272616 - RNA, 19 nt, Yersinia pestis
gcccuuacuauuuuucuca

SEQ ID NO: 2272617 - RNA, 15 nt, Yersinia pestis
gcccuuggcugguga

SEQ ID NO: 2272618 - RNA, 23 nt, Yersinia pestis
gcccuuguaagauaccaacccac

SEQ ID NO: 2272619 - RNA, 14 nt, Yersinia pestis
gcccuuucuuguug

SEQ ID NO: 2272620 - RNA, 19 nt, Yersinia pestis
gcccuuuuugguuuucuau

SEQ ID NO: 2272621 - RNA, 17 nt, Yersinia pestis
gcccuuuuuuauugcgu

SEQ ID NO: 2272622 - RNA, 22 nt, Yersinia pestis
gcccugaauuucaauaacaccg

SEQ ID NO: 2272623 - RNA, 22 nt, Yersinia pestis
gcccugagguuauugacaaagu

SEQ ID NO: 2272624 - RNA, 14 nt, Yersinia pestis
gcccugaguuaagu

SEQ ID NO: 2272625 - RNA, 19 nt, Yersinia pestis
gcccugagauucaacccac

SEQ ID NO: 2272626 - RNA, 17 nt, Yersinia pestis
gcccugccauaaccgcu

SEQ ID NO: 2272627 - RNA, 19 nt, Yersinia pestis
gcccucccuggcgcggacg

SEQ ID NO: 2272628 - RNA, 17 nt, Yersinia pestis
gcccguugcccaccgag

SEQ ID NO: 2272629 - RNA, 22 nt, Yersinia pestis
gcccuaaccgcuuuuuacccag

SEQ ID NO: 2272630 - RNA, 23 nt, Yersinia pestis
gcccuaaccgcuuuuuacccagu

SEQ ID NO: 2272631 - RNA, 16 nt, Yersinia pestis
gcccuaauaaccgaca

SEQ ID NO: 2272632 - RNA, 16 nt, Yersinia pestis
gcccgguaucaccuuu

SEQ ID NO: 2272633 - RNA, 14 nt, Yersinia pestis
gcccguaaacgggc

SEQ ID NO: 2272634 - RNA, 14 nt, Yersinia pestis
gccgccucugcucc

SEQ ID NO: 2272635 - RNA, 16 nt, Yersinia pestis
gccgcgauaaaaaaua

SEQ ID NO: 2272636 - RNA, 20 nt, Yersinia pestis
gccgauugcgcuucuuguug

SEQ ID NO: 2272637 - RNA, 15 nt, Yersinia pestis
gccgaucauaaauca

SEQ ID NO: 2272638 - RNA, 20 nt, Yersinia pestis
gccgaugaucucuggccgug

SEQ ID NO: 2272639 - RNA, 19 nt, Yersinia pestis
gccgaguucgucgggggug

SEQ ID NO: 2272640 - RNA, 15 nt, Yersinia pestis
gccgccaacagugaa

SEQ ID NO: 2272641 - RNA, 21 nt, Yersinia pestis
gcgauagaguugauaaacaau

SEQ ID NO: 2272642 - RNA, 21 nt, Yersinia pestis
gcgauacaccauuuccaggcu

SEQ ID NO: 2272643 - RNA, 18 nt, Yersinia pestis
gcgauacggucaucgccg

SEQ ID NO: 2272644 - RNA, 15 nt, Yersinia pestis
gcgagucucaucaag

SEQ ID NO: 2272645 - RNA, 17 nt, Yersinia pestis
gcgagucagcacagaac

SEQ ID NO: 2272646 - RNA, 18 nt, Yersinia pestis
gcgacugugcuuugccau

SEQ ID NO: 2272647 - RNA, 20 nt, Yersinia pestis
gcgacugauugaccaucaac

SEQ ID NO: 2272648 - RNA, 13 nt, Yersinia pestis
gcgacuuuuauuu

SEQ ID NO: 2272649 - RNA, 18 nt, Yersinia pestis
gcgagauagucagcgacg

SEQ ID NO: 2272650 - RNA, 18 nt, Yersinia pestis
gcgagcaauaccaaaaau

SEQ ID NO: 2272651 - RNA, 13 nt, Yersinia pestis
gcgagcacugccc

SEQ ID NO: 2272652 - RNA, 14 nt, Yersinia pestis
gcgagcacugcccc

SEQ ID NO: 2272653 - RNA, 23 nt, Yersinia pestis
gcgagcacugccccgaagcucaa

SEQ ID NO: 2272654 - RNA, 19 nt, Yersinia pestis
gcgacgguacugaucauua

SEQ ID NO: 2272655 - RNA, 13 nt, Yersinia pestis
gcgaaucacauca

SEQ ID NO: 2272656 - RNA, 15 nt, Yersinia pestis
gcgaaucacaucauu

SEQ ID NO: 2272657 - RNA, 12 nt, Yersinia pestis
gcgaaucccccc

SEQ ID NO: 2272658 - RNA, 13 nt, Yersinia pestis
gcgaauuaucauc

SEQ ID NO: 2272659 - RNA, 21 nt, Yersinia pestis
gcgaaugcccugcuaauuuga

SEQ ID NO: 2272660 - RNA, 19 nt, Yersinia pestis
gcgacaaucaauggccagc

SEQ ID NO: 2272661 - RNA, 13 nt, Yersinia pestis
gcgacaaccugua

SEQ ID NO: 2272662 - RNA, 18 nt, Yersinia pestis
gcgacaggcucagcacaa

SEQ ID NO: 2272663 - RNA, 17 nt, Yersinia pestis
gcgacauuucggccacc

SEQ ID NO: 2272664 - RNA, 14 nt, Yersinia pestis
gcgaccaauucauc

SEQ ID NO: 2272665 - RNA, 13 nt, Yersinia pestis
gcgaccagcagaa

SEQ ID NO: 2272666 - RNA, 13 nt, Yersinia pestis
gcgacccaaagcu

SEQ ID NO: 2272667 - RNA, 22 nt, Yersinia pestis
gccuuguccaucacgcagcuuu

SEQ ID NO: 2272668 - RNA, 11 nt, Yersinia pestis
gccuugccgcu

SEQ ID NO: 2272669 - RNA, 18 nt, Yersinia pestis
gccuugugggcaucuguc

SEQ ID NO: 2272670 - RNA, 14 nt, Yersinia pestis
gccuucugcugcca

SEQ ID NO: 2272671 - RNA, 17 nt, Yersinia pestis
gccuucuccuuucuguu

SEQ ID NO: 2272672 - RNA, 22 nt, Yersinia pestis
gccuucuuggguggcaauuucu

SEQ ID NO: 2272673 - RNA, 18 nt, Yersinia pestis
gccuuaauggccgccauu

SEQ ID NO: 2272674 - RNA, 12 nt, Yersinia pestis
gccuguuagggc

SEQ ID NO: 2272675 - RNA, 23 nt, Yersinia pestis
gccuuaucagcgaaaaauuucac

SEQ ID NO: 2272676 - RNA, 20 nt, Yersinia pestis
gccuucagguaauuuauaga

SEQ ID NO: 2272677 - RNA, 17 nt, Yersinia pestis
gccuuaucagcgaaaaa

SEQ ID NO: 2272678 - RNA, 15 nt, Yersinia pestis
gccuuauaggcgcau

SEQ ID NO: 2272679 - RNA, 20 nt, Yersinia pestis
gccuuauaggcgcauaugaa

SEQ ID NO: 2272680 - RNA, 18 nt, Yersinia pestis
gccuucauguugcaacau

SEQ ID NO: 2272681 - RNA, 17 nt, Yersinia pestis
gccugucuuaggugaca

SEQ ID NO: 2272682 - RNA, 23 nt, Yersinia pestis
gccugguugcccugaagcaacga

SEQ ID NO: 2272683 - RNA, 10 nt, Yersinia pestis
gccugguugg

SEQ ID NO: 2272684 - RNA, 14 nt, Yersinia pestis
gccuguaccaccac

SEQ ID NO: 2272685 - RNA, 23 nt, Yersinia pestis
gccuguaccaccaccaacagcau

SEQ ID NO: 2272686 - RNA, 16 nt, Yersinia pestis
gccuguaaaucuuguu

SEQ ID NO: 2272687 - RNA, 14 nt, Yersinia pestis
gccuggugcaaccg

SEQ ID NO: 2272688 - RNA, 15 nt, Yersinia pestis
gccuggcaggaagcc

SEQ ID NO: 2272689 - RNA, 18 nt, Yersinia pestis
gccugaauggaaaaauua

SEQ ID NO: 2272690 - RNA, 12 nt, Yersinia pestis
gccuaccugccu

SEQ ID NO: 2272691 - RNA, 15 nt, Yersinia pestis
gccuauuucagggcg

SEQ ID NO: 2272692 - RNA, 21 nt, Yersinia pestis
gccuauuggauagguuggguu

SEQ ID NO: 2272693 - RNA, 17 nt, Yersinia pestis
gccucaacgcaccccac

SEQ ID NO: 2272694 - RNA, 16 nt, Yersinia pestis
gccucaacgcacccca

SEQ ID NO: 2272695 - RNA, 14 nt, Yersinia pestis
gccugauacaccau

SEQ ID NO: 2272696 - RNA, 20 nt, Yersinia pestis
gccugaucgauaacccccaa

SEQ ID NO: 2272697 - RNA, 21 nt, Yersinia pestis
gccugauaaaauuaccgcccc

SEQ ID NO: 2272698 - RNA, 16 nt, Yersinia pestis
gccugcucaccgccga

SEQ ID NO: 2272699 - RNA, 20 nt, Yersinia pestis
gccugccugcugcuccacca

SEQ ID NO: 2272700 - RNA, 21 nt, Yersinia pestis
gccugcgaauuaucauccaga

SEQ ID NO: 2272701 - RNA, 14 nt, Yersinia pestis
gccugcgacagcac

SEQ ID NO: 2272702 - RNA, 23 nt, Yersinia pestis
gccugcaccagugccaaucccca

SEQ ID NO: 2272703 - RNA, 15 nt, Yersinia pestis
gccuaacaacacgcu

SEQ ID NO: 2272704 - RNA, 14 nt, Yersinia pestis
gccguuuugcucgg

SEQ ID NO: 2272705 - RNA, 19 nt, Yersinia pestis
gccgugucgggccaauaaa

SEQ ID NO: 2272706 - RNA, 18 nt, Yersinia pestis
gccguucucgauagagaa

SEQ ID NO: 2272707 - RNA, 16 nt, Yersinia pestis
gccgucagcucuuguu

SEQ ID NO: 2272708 - RNA, 13 nt, Yersinia pestis
gccguacaacaau

SEQ ID NO: 2272709 - RNA, 21 nt, Yersinia pestis
gccguaaacugccguaaacaa

SEQ ID NO: 2272710 - RNA, 13 nt, Yersinia pestis
gccgggucaggaa

SEQ ID NO: 2272711 - RNA, 22 nt, Yersinia pestis
gccggguaugaaguugucagug

SEQ ID NO: 2272712 - RNA, 13 nt, Yersinia pestis
gccggccaacauc

SEQ ID NO: 2272713 - RNA, 20 nt, Yersinia pestis
gccggauuauuauucauagu

SEQ ID NO: 2272714 - RNA, 14 nt, Yersinia pestis
gccggauucaaggc

SEQ ID NO: 2272715 - RNA, 13 nt, Yersinia pestis
gccggcaacagcg

SEQ ID NO: 2272716 - RNA, 18 nt, Yersinia pestis
gccggcaacagcgccugc

SEQ ID NO: 2272717 - RNA, 17 nt, Yersinia pestis
gccggagugaugaaacc

SEQ ID NO: 2272718 - RNA, 19 nt, Yersinia pestis
gccggagugaugaaaccaa

SEQ ID NO: 2272719 - RNA, 22 nt, Yersinia pestis
gccggagucuaucugcaguauu

SEQ ID NO: 2272720 - RNA, 14 nt, Yersinia pestis
gccgggaugaucaa

SEQ ID NO: 2272721 - RNA, 14 nt, Yersinia pestis
gccggcuucccugu

SEQ ID NO: 2272722 - RNA, 20 nt, Yersinia pestis
gccggcguuaaugccacccc

SEQ ID NO: 2272723 - RNA, 17 nt, Yersinia pestis
ggugguuuucuuacaag

SEQ ID NO: 2272724 - RNA, 18 nt, Yersinia pestis
gguguguuguuggcuaau

SEQ ID NO: 2272725 - RNA, 19 nt, Yersinia pestis
gguguuaaccgccccaaca

SEQ ID NO: 2272726 - RNA, 13 nt, Yersinia pestis
gguguguggcaau

SEQ ID NO: 2272727 - RNA, 14 nt, Yersinia pestis
gguguuuggugaag

SEQ ID NO: 2272728 - RNA, 18 nt, Yersinia pestis
gguuaaacuucuuuaucu

SEQ ID NO: 2272729 - RNA, 22 nt, Yersinia pestis
gguuaaaguugauaaagcugga

SEQ ID NO: 2272730 - RNA, 20 nt, Yersinia pestis
gguguuauuuacaccgugca

SEQ ID NO: 2272731 - RNA, 16 nt, Yersinia pestis
gguuaucugacugcuu

SEQ ID NO: 2272732 - RNA, 15 nt, Yersinia pestis
gguuaucuggaauuu

SEQ ID NO: 2272733 - RNA, 17 nt, Yersinia pestis
gguuaucacauaaauaa

SEQ ID NO: 2272734 - RNA, 18 nt, Yersinia pestis
gguuaucacaucauccac

SEQ ID NO: 2272735 - RNA, 13 nt, Yersinia pestis
gguucaaaucagu

SEQ ID NO: 2272736 - RNA, 19 nt, Yersinia pestis
gguucacccgcacgcccau

SEQ ID NO: 2272737 - RNA, 21 nt, Yersinia pestis
gguucacccgcacgcccauag

SEQ ID NO: 2272738 - RNA, 22 nt, Yersinia pestis
gguuagcucccccguguucuga

SEQ ID NO: 2272739 - RNA, 23 nt, Yersinia pestis
gguuaucacacccuaaagaucuu

SEQ ID NO: 2272740 - RNA, 20 nt, Yersinia pestis
gguuaccguuagcaauguga

SEQ ID NO: 2272741 - RNA, 17 nt, Yersinia pestis
gguuaccaaaaagcaac

SEQ ID NO: 2272742 - RNA, 15 nt, Yersinia pestis
gguucauauuggcca

SEQ ID NO: 2272743 - RNA, 15 nt, Yersinia pestis
gguucuccaacaacc

SEQ ID NO: 2272744 - RNA, 12 nt, Yersinia pestis
guaaaaaaauag

SEQ ID NO: 2272745 - RNA, 19 nt, Yersinia pestis
gguuuuuugcgggacagaa

SEQ ID NO: 2272746 - RNA, 18 nt, Yersinia pestis
guaaaacaaaguaguacg

SEQ ID NO: 2272747 - RNA, 17 nt, Yersinia pestis
guaaaacacgcaacacu

SEQ ID NO: 2272748 - RNA, 14 nt, Yersinia pestis
guaaaacauuucau

SEQ ID NO: 2272749 - RNA, 17 nt, Yersinia pestis
gguuucugccuuaucaa

SEQ ID NO: 2272750 - RNA, 18 nt, Yersinia pestis
gguuucgcccaagccgac

SEQ ID NO: 2272751 - RNA, 22 nt, Yersinia pestis
gguuuccccaaacgcauuucgu

SEQ ID NO: 2272752 - RNA, 20 nt, Yersinia pestis
gguuuaggccaauuuggcca

SEQ ID NO: 2272753 - RNA, 22 nt, Yersinia pestis
gguuuaggccaauuuggccaau

SEQ ID NO: 2272754 - RNA, 15 nt, Yersinia pestis
gguuuaggccuauaa

SEQ ID NO: 2272755 - RNA, 17 nt, Yersinia pestis
gguuucaacauccaguu

SEQ ID NO: 2272756 - RNA, 13 nt, Yersinia pestis
gguuucaaauagc

SEQ ID NO: 2272757 - RNA, 10 nt, Yersinia pestis
gguuuuaauc

SEQ ID NO: 2272758 - RNA, 12 nt, Yersinia pestis
gguuuuccccuc

SEQ ID NO: 2272759 - RNA, 13 nt, Yersinia pestis
gguuugucagcag

SEQ ID NO: 2272760 - RNA, 17 nt, Yersinia pestis
gguuuguaagucagauu

SEQ ID NO: 2272761 - RNA, 15 nt, Yersinia pestis
gguuugaauccagug

SEQ ID NO: 2272762 - RNA, 15 nt, Yersinia pestis
gguuugaucaacaug

SEQ ID NO: 2272763 - RNA, 15 nt, Yersinia pestis
gguuguccgaagaga

SEQ ID NO: 2272764 - RNA, 21 nt, Yersinia pestis
gguugucuauguuugaugguu

SEQ ID NO: 2272765 - RNA, 22 nt, Yersinia pestis
gguugcucccguagcaaauaac

SEQ ID NO: 2272766 - RNA, 23 nt, Yersinia pestis
gguugcuucguagaguugcaguu

SEQ ID NO: 2272767 - RNA, 23 nt, Yersinia pestis
gguugggaaaaguggcuaucuga

SEQ ID NO: 2272768 - RNA, 18 nt, Yersinia pestis
gguugcauuugggcagau

SEQ ID NO: 2272769 - RNA, 16 nt, Yersinia pestis
gguugaggauuauaau

SEQ ID NO: 2272770 - RNA, 23 nt, Yersinia pestis
gguugccauuaauuggccgggac

SEQ ID NO: 2272771 - RNA, 16 nt, Yersinia pestis
gguugccggaagagaa

SEQ ID NO: 2272772 - RNA, 20 nt, Yersinia pestis
gguugccgguuuauuauuca

SEQ ID NO: 2272773 - RNA, 13 nt, Yersinia pestis
ggugaugcugcug

SEQ ID NO: 2272774 - RNA, 12 nt, Yersinia pestis
ggugagugagcg

SEQ ID NO: 2272775 - RNA, 14 nt, Yersinia pestis
ggugauacaucucg

SEQ ID NO: 2272776 - RNA, 20 nt, Yersinia pestis
ggugaucgguuagcuacuga

SEQ ID NO: 2272777 - RNA, 15 nt, Yersinia pestis
ggcucaucaaaggag

SEQ ID NO: 2272778 - RNA, 16 nt, Yersinia pestis
ggcuccuauagcucag

SEQ ID NO: 2272779 - RNA, 19 nt, Yersinia pestis
ggugacauccgcuugcagc

SEQ ID NO: 2272780 - RNA, 15 nt, Yersinia pestis
ggugacccgugcggc

SEQ ID NO: 2272781 - RNA, 15 nt, Yersinia pestis
ggugagggcaauuaa

SEQ ID NO: 2272782 - RNA, 20 nt, Yersinia pestis
ggugacggcuuuauaguccu

SEQ ID NO: 2272783 - RNA, 15 nt, Yersinia pestis
ggugcgccaguggca

SEQ ID NO: 2272784 - RNA, 15 nt, Yersinia pestis
ggugcgggccagaau

SEQ ID NO: 2272785 - RNA, 13 nt, Yersinia pestis
ggugcuauuucug

SEQ ID NO: 2272786 - RNA, 19 nt, Yersinia pestis
ggugcuaccucguaguaau

SEQ ID NO: 2272787 - RNA, 23 nt, Yersinia pestis
gguggauaaaaaacgggcuuggc

SEQ ID NO: 2272788 - RNA, 14 nt, Yersinia pestis
gguggccaguaacg

SEQ ID NO: 2272789 - RNA, 21 nt, Yersinia pestis
gguggcaggccccaucauaaa

SEQ ID NO: 2272790 - RNA, 15 nt, Yersinia pestis
ggugggucgugcggg

SEQ ID NO: 2272791 - RNA, 15 nt, Yersinia pestis
ggugggccgugcggg

SEQ ID NO: 2272792 - RNA, 16 nt, Yersinia pestis
guacaaaaaacaaacc

SEQ ID NO: 2272793 - RNA, 17 nt, Yersinia pestis
guacaacgcuuaucaaa

SEQ ID NO: 2272794 - RNA, 15 nt, Yersinia pestis
guacaacaagauccc

SEQ ID NO: 2272795 - RNA, 16 nt, Yersinia pestis
guacaacaagauccca

SEQ ID NO: 2272796 - RNA, 14 nt, Yersinia pestis
guacaacaauaaua

SEQ ID NO: 2272797 - RNA, 12 nt, Yersinia pestis
guacaacacaaa

SEQ ID NO: 2272798 - RNA, 20 nt, Yersinia pestis
guacaacacaaaaaccggcg

SEQ ID NO: 2272799 - RNA, 12 nt, Yersinia pestis
guacaacacauc

SEQ ID NO: 2272800 - RNA, 16 nt, Yersinia pestis
guacacauuauuuaua

SEQ ID NO: 2272801 - RNA, 14 nt, Yersinia pestis
guacacacagugau

SEQ ID NO: 2272802 - RNA, 21 nt, Yersinia pestis
guacaaucucugggugcugcu

SEQ ID NO: 2272803 - RNA, 22 nt, Yersinia pestis
guacaaucucugggugcugcuc

SEQ ID NO: 2272804 - RNA, 13 nt, Yersinia pestis
guaauuuauagac

SEQ ID NO: 2272805 - RNA, 19 nt, Yersinia pestis
guaauuggcgcauaaucgc

SEQ ID NO: 2272806 - RNA, 22 nt, Yersinia pestis
guaauuaauauauaaaauaaau

SEQ ID NO: 2272807 - RNA, 18 nt, Yersinia pestis
guaauucauuauuacuca

SEQ ID NO: 2272808 - RNA, 19 nt, Yersinia pestis
guaauucccaccacuugcu

SEQ ID NO: 2272809 - RNA, 16 nt, Yersinia pestis
guaauuauuuuggcua

SEQ ID NO: 2272810 - RNA, 21 nt, Yersinia pestis
guaauucacccuuuaaaucua

SEQ ID NO: 2272811 - RNA, 19 nt, Yersinia pestis
guaaucccgauauaaauaa

SEQ ID NO: 2272812 - RNA, 17 nt, Yersinia pestis
guaaucaugguuggaua

SEQ ID NO: 2272813 - RNA, 21 nt, Yersinia pestis
guaaucccgauauaaauaaaa

SEQ ID NO: 2272814 - RNA, 15 nt, Yersinia pestis
guaaucagacugcug

SEQ ID NO: 2272815 - RNA, 13 nt, Yersinia pestis
guaauauugaaga

SEQ ID NO: 2272816 - RNA, 20 nt, Yersinia pestis
guaaucaacacauaaaauca

SEQ ID NO: 2272817 - RNA, 16 nt, Yersinia pestis
guaaucaucagggaau

SEQ ID NO: 2272818 - RNA, 22 nt, Yersinia pestis
aaauagaagguaaucagacugc

SEQ ID NO: 2272819 - RNA, 13 nt, Yersinia pestis
aaauagauuaaaa

SEQ ID NO: 2272820 - RNA, 17 nt, Yersinia pestis
aaauagacucaacaaac

SEQ ID NO: 2272821 - RNA, 17 nt, Yersinia pestis
guaauggcgauaauauu

SEQ ID NO: 2272822 - RNA, 17 nt, Yersinia pestis
guaauggcgcacauuac

SEQ ID NO: 2272823 - RNA, 22 nt, Yersinia pestis
guaaugcuguuguagcgccagg

SEQ ID NO: 2272824 - RNA, 13 nt, Yersinia pestis
aaauagauuuaac

SEQ ID NO: 2272825 - RNA, 13 nt, Yersinia pestis
guaaucugacugu

SEQ ID NO: 2272826 - RNA, 14 nt, Yersinia pestis
guaaugaggcuacc

SEQ ID NO: 2272827 - RNA, 23 nt, Yersinia pestis
guacauauauaauacuauuugua

SEQ ID NO: 2272828 - RNA, 14 nt, Yersinia pestis
guacauuaaaugaa

SEQ ID NO: 2272829 - RNA, 16 nt, Yersinia pestis
guacauuaaaugaaua

SEQ ID NO: 2272830 - RNA, 23 nt, Yersinia pestis
guaccaaaucagcaagcugcuca

SEQ ID NO: 2272831 - RNA, 16 nt, Yersinia pestis
guaccaccaccacaaa

SEQ ID NO: 2272832 - RNA, 18 nt, Yersinia pestis
guaccugcacugagccag

SEQ ID NO: 2272833 - RNA, 23 nt, Yersinia pestis
guaccgggccauagcccaugauu

SEQ ID NO: 2272834 - RNA, 13 nt, Yersinia pestis
guaccgauaaaag

SEQ ID NO: 2272835 - RNA, 21 nt, Yersinia pestis
guacccguaggcccacaauca

SEQ ID NO: 2272836 - RNA, 23 nt, Yersinia pestis
guaccuugacgccgaugaauaua

SEQ ID NO: 2272837 - RNA, 17 nt, Yersinia pestis
guacgaaggggauaaau

SEQ ID NO: 2272838 - RNA, 18 nt, Yersinia pestis
guacgacgccagauagca

SEQ ID NO: 2272839 - RNA, 15 nt, Yersinia pestis
guaagcaucuuuuca

SEQ ID NO: 2272840 - RNA, 22 nt, Yersinia pestis
guaagcaugaaacacaguggaa

SEQ ID NO: 2272841 - RNA, 17 nt, Yersinia pestis
guaagacucaugauauu

SEQ ID NO: 2272842 - RNA, 18 nt, Yersinia pestis
guaacuugccguaaaauu

SEQ ID NO: 2272843 - RNA, 13 nt, Yersinia pestis
guaacuuuucggg

SEQ ID NO: 2272844 - RNA, 22 nt, Yersinia pestis
guaacuuuucgggcuaaagaca

SEQ ID NO: 2272845 - RNA, 20 nt, Yersinia pestis
guaagaaagagaugacccaa

SEQ ID NO: 2272846 - RNA, 17 nt, Yersinia pestis
guaacucccggcaggca

SEQ ID NO: 2272847 - RNA, 20 nt, Yersinia pestis
guaacugaguuggaaaugac

SEQ ID NO: 2272848 - RNA, 18 nt, Yersinia pestis
guaacucuuguuaucacc

SEQ ID NO: 2272849 - RNA, 20 nt, Yersinia pestis
guaacgggucucaaugcagu

SEQ ID NO: 2272850 - RNA, 22 nt, Yersinia pestis
guaacgcagauaaaucaguggg

SEQ ID NO: 2272851 - RNA, 17 nt, Yersinia pestis
guaacguccaacugacg

SEQ ID NO: 2272852 - RNA, 13 nt, Yersinia pestis
guaacuaaagccg

SEQ ID NO: 2272853 - RNA, 22 nt, Yersinia pestis
guaacucaggauccucgucgua

SEQ ID NO: 2272854 - RNA, 16 nt, Yersinia pestis
guaacgcagauaaauc

SEQ ID NO: 2272855 - RNA, 20 nt, Yersinia pestis
guaaccccgcguucacuuuc

SEQ ID NO: 2272856 - RNA, 22 nt, Yersinia pestis
guaaccggcuaggcucagcaug

SEQ ID NO: 2272857 - RNA, 12 nt, Yersinia pestis
guaaccuccacu

SEQ ID NO: 2272858 - RNA, 15 nt, Yersinia pestis
guaauaccggcacca

SEQ ID NO: 2272859 - RNA, 18 nt, Yersinia pestis
guaauaccacaccuuauc

SEQ ID NO: 2272860 - RNA, 23 nt, Yersinia pestis
guaauaccccacccagagcguuu

SEQ ID NO: 2272861 - RNA, 18 nt, Yersinia pestis
guaauaaaucaugucccu

SEQ ID NO: 2272862 - RNA, 20 nt, Yersinia pestis
guaauaacucagccauugcu

SEQ ID NO: 2272863 - RNA, 15 nt, Yersinia pestis
guaauaacgggcggc

SEQ ID NO: 2272864 - RNA, 12 nt, Yersinia pestis
guaauaaaucau

SEQ ID NO: 2272865 - RNA, 19 nt, Yersinia pestis
guaauagcuuaaucaucau

SEQ ID NO: 2272866 - RNA, 14 nt, Yersinia pestis
guaauaguaaaaca

SEQ ID NO: 2272867 - RNA, 18 nt, Yersinia pestis
guaauagcaaaaaaaaag

SEQ ID NO: 2272868 - RNA, 14 nt, Yersinia pestis
guaaucaaacauaa

SEQ ID NO: 2272869 - RNA, 13 nt, Yersinia pestis
guaauauuauuca

SEQ ID NO: 2272870 - RNA, 20 nt, Yersinia pestis
guaauaucgguaaaaaauca

SEQ ID NO: 2272871 - RNA, 13 nt, Yersinia pestis
guaauaucaccau

SEQ ID NO: 2272872 - RNA, 17 nt, Yersinia pestis
guaauauccacauugga

SEQ ID NO: 2272873 - RNA, 11 nt, Yersinia pestis
guaagccaacg

SEQ ID NO: 2272874 - RNA, 20 nt, Yersinia pestis
guaagccuucaaccugaauc

SEQ ID NO: 2272875 - RNA, 23 nt, Yersinia pestis
guaagcuuugugcaaaauacaaa

SEQ ID NO: 2272876 - RNA, 15 nt, Yersinia pestis
guaaggcaauaccaa

SEQ ID NO: 2272877 - RNA, 15 nt, Yersinia pestis
guaaggccaaacccg

SEQ ID NO: 2272878 - RNA, 17 nt, Yersinia pestis
guaaggccaauuggcuu

SEQ ID NO: 2272879 - RNA, 16 nt, Yersinia pestis
guaaagguuucugccu

SEQ ID NO: 2272880 - RNA, 23 nt, Yersinia pestis
guaaagcaaauucccaccauaau

SEQ ID NO: 2272881 - RNA, 16 nt, Yersinia pestis
guaaagcaggccuucu

SEQ ID NO: 2272882 - RNA, 21 nt, Yersinia pestis
guaaacuuggccgauaugaag

SEQ ID NO: 2272883 - RNA, 12 nt, Yersinia pestis
guaaagaaaaaa

SEQ ID NO: 2272884 - RNA, 22 nt, Yersinia pestis
guaaagacgccggcuucccugu

SEQ ID NO: 2272885 - RNA, 20 nt, Yersinia pestis
guaaagacgccguaaauaca

SEQ ID NO: 2272886 - RNA, 19 nt, Yersinia pestis
guaaagacgcuaauuaaag

SEQ ID NO: 2272887 - RNA, 23 nt, Yersinia pestis
guaaacguggcccuuucgcagcc

SEQ ID NO: 2272888 - RNA, 19 nt, Yersinia pestis
guaaacagacacagcaaca

SEQ ID NO: 2272889 - RNA, 15 nt, Yersinia pestis
guaaaccaauuuuaa

SEQ ID NO: 2272890 - RNA, 16 nt, Yersinia pestis
guaaacauccggcuga

SEQ ID NO: 2272891 - RNA, 16 nt, Yersinia pestis
guaaaagauucauaaa

SEQ ID NO: 2272892 - RNA, 17 nt, Yersinia pestis
guaaaagaauaaauguc

SEQ ID NO: 2272893 - RNA, 16 nt, Yersinia pestis
guaaaauaaaaaagua

SEQ ID NO: 2272894 - RNA, 18 nt, Yersinia pestis
guaaaagucagcaaauca

SEQ ID NO: 2272895 - RNA, 15 nt, Yersinia pestis
guaaaaggcccgcua

SEQ ID NO: 2272896 - RNA, 21 nt, Yersinia pestis
guaacauuuguauuuuuucuu

SEQ ID NO: 2272897 - RNA, 23 nt, Yersinia pestis
guaacauauaaaccagccaguga

SEQ ID NO: 2272898 - RNA, 18 nt, Yersinia pestis
guaaauugcgagucucau

SEQ ID NO: 2272899 - RNA, 22 nt, Yersinia pestis
guaacacuucagacugaaagua

SEQ ID NO: 2272900 - RNA, 17 nt, Yersinia pestis
guaacaggccauacugg

SEQ ID NO: 2272901 - RNA, 20 nt, Yersinia pestis
guaacacacagcagacagcg

SEQ ID NO: 2272902 - RNA, 15 nt, Yersinia pestis
guaacaacugaacca

SEQ ID NO: 2272903 - RNA, 23 nt, Yersinia pestis
guaaauuauuuuccagaugaaua

SEQ ID NO: 2272904 - RNA, 13 nt, Yersinia pestis
guaaauuaaauuu

SEQ ID NO: 2272905 - RNA, 22 nt, Yersinia pestis
guaaauucgggcuuuaauacaa

SEQ ID NO: 2272906 - RNA, 12 nt, Yersinia pestis
guaaauuccuau

SEQ ID NO: 2272907 - RNA, 19 nt, Yersinia pestis
guaaaugccccauuuuggc

SEQ ID NO: 2272908 - RNA, 19 nt, Yersinia pestis
guaaauauaauuucaaagu

SEQ ID NO: 2272909 - RNA, 21 nt, Yersinia pestis
guaaauauaauuucaaaguaa

SEQ ID NO: 2272910 - RNA, 15 nt, Yersinia pestis
guaaaucaggccggu

SEQ ID NO: 2272911 - RNA, 17 nt, Yersinia pestis
guagauaauuucuacgc

SEQ ID NO: 2272912 - RNA, 18 nt, Yersinia pestis
guagagcguagacuaaau

SEQ ID NO: 2272913 - RNA, 22 nt, Yersinia pestis
guagagcacuucauuuucucgc

SEQ ID NO: 2272914 - RNA, 19 nt, Yersinia pestis
guagacgacacaaaugcug

SEQ ID NO: 2272915 - RNA, 14 nt, Yersinia pestis
guagaccaccaacu

SEQ ID NO: 2272916 - RNA, 12 nt, Yersinia pestis
guagcaaauaac

SEQ ID NO: 2272917 - RNA, 18 nt, Yersinia pestis
guagcagcccaacacuuu

SEQ ID NO: 2272918 - RNA, 20 nt, Yersinia pestis
guagcagcccaacacuuuua

SEQ ID NO: 2272919 - RNA, 14 nt, Yersinia pestis
guagcccacugaca

SEQ ID NO: 2272920 - RNA, 17 nt, Yersinia pestis
guacuagaucacagacg

SEQ ID NO: 2272921 - RNA, 15 nt, Yersinia pestis
guacggugccagcag

SEQ ID NO: 2272922 - RNA, 17 nt, Yersinia pestis
guacggugccagcagca

SEQ ID NO: 2272923 - RNA, 17 nt, Yersinia pestis
guacguuggcgacgcuc

SEQ ID NO: 2272924 - RNA, 14 nt, Yersinia pestis
guacugcauguacg

SEQ ID NO: 2272925 - RNA, 23 nt, Yersinia pestis
guacugauuauuuggugaguaaa

SEQ ID NO: 2272926 - RNA, 20 nt, Yersinia pestis
guacuggcgcgcuuuggauc

SEQ ID NO: 2272927 - RNA, 16 nt, Yersinia pestis
guacuguuaacucaug

SEQ ID NO: 2272928 - RNA, 18 nt, Yersinia pestis
guagaaaaucguuguauu

SEQ ID NO: 2272929 - RNA, 19 nt, Yersinia pestis
guagaacuuauggggcacu

SEQ ID NO: 2272930 - RNA, 13 nt, Yersinia pestis
guacuuagcaaua

SEQ ID NO: 2272931 - RNA, 18 nt, Yersinia pestis
guacuguuaguucagacg

SEQ ID NO: 2272932 - RNA, 16 nt, Yersinia pestis
guacuugacgcugcag

SEQ ID NO: 2272933 - RNA, 16 nt, Yersinia pestis
guacuuggucacugua

SEQ ID NO: 2272934 - RNA, 20 nt, Yersinia pestis
guacuuugauucaaaaugcc

SEQ ID NO: 2272935 - RNA, 20 nt, Yersinia pestis
guaguacuggaucacaaugc

SEQ ID NO: 2272936 - RNA, 21 nt, Yersinia pestis
guagucauacaaaaugagccu

SEQ ID NO: 2272937 - RNA, 23 nt, Yersinia pestis
guagucauacaaaaugagccugu

SEQ ID NO: 2272938 - RNA, 19 nt, Yersinia pestis
guagugaagauaauaacgg

SEQ ID NO: 2272939 - RNA, 11 nt, Yersinia pestis
guaguggggcu

SEQ ID NO: 2272940 - RNA, 23 nt, Yersinia pestis
guaggggccaccaaauaaaacaa

SEQ ID NO: 2272941 - RNA, 13 nt, Yersinia pestis
guaguaaccacac

SEQ ID NO: 2272942 - RNA, 13 nt, Yersinia pestis
guagggauaaauc

SEQ ID NO: 2272943 - RNA, 21 nt, Yersinia pestis
guaggcuaaagacuucagccc

SEQ ID NO: 2272944 - RNA, 21 nt, Yersinia pestis
guagcuccgcagcuaauguug

SEQ ID NO: 2272945 - RNA, 22 nt, Yersinia pestis
guagcucgccuucauuaucaug

SEQ ID NO: 2272946 - RNA, 16 nt, Yersinia pestis
guaggcaaagagauua

SEQ ID NO: 2272947 - RNA, 19 nt, Yersinia pestis
guagcuuuuuaaauaccag

SEQ ID NO: 2272948 - RNA, 16 nt, Yersinia pestis
guaggacggugccaug

SEQ ID NO: 2272949 - RNA, 19 nt, Yersinia pestis
guagccgcaggcgaugcaa

SEQ ID NO: 2272950 - RNA, 16 nt, Yersinia pestis
guauacggucaaaagc

SEQ ID NO: 2272951 - RNA, 14 nt, Yersinia pestis
guauaccccugcuc

SEQ ID NO: 2272952 - RNA, 19 nt, Yersinia pestis
guauauguugggaaauaac

SEQ ID NO: 2272953 - RNA, 17 nt, Yersinia pestis
guaucaacaauuuccau

SEQ ID NO: 2272954 - RNA, 17 nt, Yersinia pestis
guauaacucaucaguaa

SEQ ID NO: 2272955 - RNA, 23 nt, Yersinia pestis
guauaacgaucaguuugccuugu

SEQ ID NO: 2272956 - RNA, 18 nt, Yersinia pestis
guauacaauugccugauu

SEQ ID NO: 2272957 - RNA, 19 nt, Yersinia pestis
guauacaauugccugauuu

SEQ ID NO: 2272958 - RNA, 20 nt, Yersinia pestis
guauacauuauuauuuacaa

SEQ ID NO: 2272959 - RNA, 12 nt, Yersinia pestis
guaguuuugcau

SEQ ID NO: 2272960 - RNA, 16 nt, Yersinia pestis
guauaaaaauagccuu

SEQ ID NO: 2272961 - RNA, 19 nt, Yersinia pestis
guaucgucaagcaauggca

SEQ ID NO: 2272962 - RNA, 16 nt, Yersinia pestis
guaucgucuauagugc

SEQ ID NO: 2272963 - RNA, 16 nt, Yersinia pestis
guaucgcuuucagcag

SEQ ID NO: 2272964 - RNA, 23 nt, Yersinia pestis
guauccuggccguguuuuucccu

SEQ ID NO: 2272965 - RNA, 22 nt, Yersinia pestis
guaucgcccuggcuaauuuuau

SEQ ID NO: 2272966 - RNA, 21 nt, Yersinia pestis
guaucgaugugguggauaaaa

SEQ ID NO: 2272967 - RNA, 22 nt, Yersinia pestis
guaucgaauugaucugauauua

SEQ ID NO: 2272968 - RNA, 23 nt, Yersinia pestis
guaucugggguauaacgcucgcc

SEQ ID NO: 2272969 - RNA, 18 nt, Yersinia pestis
guaucuguuuuugccacc

SEQ ID NO: 2272970 - RNA, 17 nt, Yersinia pestis
guaucuucauccgcucc

SEQ ID NO: 2272971 - RNA, 24 nt, Yersinia pestis
guaucuucauccgcuccagccugg

SEQ ID NO: 2272972 - RNA, 22 nt, Yersinia pestis
guaucagccccuaaauccugca

SEQ ID NO: 2272973 - RNA, 16 nt, Yersinia pestis
guaucaauaccuuacu

SEQ ID NO: 2272974 - RNA, 14 nt, Yersinia pestis
guaucaaugaaaau

SEQ ID NO: 2272975 - RNA, 20 nt, Yersinia pestis
guaucaaugaaaauuagcug

SEQ ID NO: 2272976 - RNA, 22 nt, Yersinia pestis
guaucauauguucgaucaaaac

SEQ ID NO: 2272977 - RNA, 19 nt, Yersinia pestis
guaucccuggcucaucaaa

SEQ ID NO: 2272978 - RNA, 22 nt, Yersinia pestis
guaucccuggcucaucaaagga

SEQ ID NO: 2272979 - RNA, 17 nt, Yersinia pestis
guauccagcagcgcugg

SEQ ID NO: 2272980 - RNA, 21 nt, Yersinia pestis
guauggcgcuuaacugcacga

SEQ ID NO: 2272981 - RNA, 19 nt, Yersinia pestis
guaugauauugaugacgcu

SEQ ID NO: 2272982 - RNA, 21 nt, Yersinia pestis
guaugcgcaccgaaauagucg

SEQ ID NO: 2272983 - RNA, 22 nt, Yersinia pestis
guauuaccgauaaaggccgcag

SEQ ID NO: 2272984 - RNA, 11 nt, Yersinia pestis
guauuacccac

SEQ ID NO: 2272985 - RNA, 21 nt, Yersinia pestis
guauuaauauaauacuuaagu

SEQ ID NO: 2272986 - RNA, 23 nt, Yersinia pestis
guauuaaucaacagauaugcauu

SEQ ID NO: 2272987 - RNA, 17 nt, Yersinia pestis
guauuacaggccccuuc

SEQ ID NO: 2272988 - RNA, 22 nt, Yersinia pestis
guauggcuugcucaauaccauu

SEQ ID NO: 2272989 - RNA, 20 nt, Yersinia pestis
guauuccgagcaaucaaaag

SEQ ID NO: 2272990 - RNA, 14 nt, Yersinia pestis
guauuccugccugg

SEQ ID NO: 2272991 - RNA, 20 nt, Yersinia pestis
guauucauaucgcuaaaaca

SEQ ID NO: 2272992 - RNA, 17 nt, Yersinia pestis
guauucauaucgcuaaa

SEQ ID NO: 2272993 - RNA, 16 nt, Yersinia pestis
guauucaguaaaaacu

SEQ ID NO: 2272994 - RNA, 14 nt, Yersinia pestis
guauugaagauacc

SEQ ID NO: 2272995 - RNA, 13 nt, Yersinia pestis
guauucuugauuc

SEQ ID NO: 2272996 - RNA, 12 nt, Yersinia pestis
guauucuuauca

SEQ ID NO: 2272997 - RNA, 17 nt, Yersinia pestis
guauugauaaaaauauc

SEQ ID NO: 2272998 - RNA, 12 nt, Yersinia pestis
guauugcacuga

SEQ ID NO: 2272999 - RNA, 19 nt, Yersinia pestis
guauugcagagcaaaacug

SEQ ID NO: 2273000 - RNA, 20 nt, Yersinia pestis
guauugagcgcgguaacuaa

SEQ ID NO: 2273001 - RNA, 13 nt, Yersinia pestis
guauugaugcaug

SEQ ID NO: 2273002 - RNA, 17 nt, Yersinia pestis
guauucugccggacuca

SEQ ID NO: 2273003 - RNA, 19 nt, Yersinia pestis
gucaaaaacccauuaaaaa

SEQ ID NO: 2273004 - RNA, 16 nt, Yersinia pestis
guauuuuucgcaguaa

SEQ ID NO: 2273005 - RNA, 23 nt, Yersinia pestis
guauuuugcacaaagcuuacugu

SEQ ID NO: 2273006 - RNA, 21 nt, Yersinia pestis
gucaaacucagcgaauaaaua

SEQ ID NO: 2273007 - RNA, 21 nt, Yersinia pestis
gucaaacuccccuggcaggcc

SEQ ID NO: 2273008 - RNA, 21 nt, Yersinia pestis
guauugcugaguaaauuaaau

SEQ ID NO: 2273009 - RNA, 19 nt, Yersinia pestis
guauuggcugcuuucguuc

SEQ ID NO: 2273010 - RNA, 12 nt, Yersinia pestis
guauugcucagg

SEQ ID NO: 2273011 - RNA, 20 nt, Yersinia pestis
guauuuccuguauuuccugu

SEQ ID NO: 2273012 - RNA, 17 nt, Yersinia pestis
guauuucaaauaagugu

SEQ ID NO: 2273013 - RNA, 14 nt, Yersinia pestis
guauuugguuauau

SEQ ID NO: 2273014 - RNA, 22 nt, Yersinia pestis
guauuugcuucgcugggcugcc

SEQ ID NO: 2273015 - RNA, 15 nt, Yersinia pestis
guauuugaacuucaa

SEQ ID NO: 2273016 - RNA, 15 nt, Yersinia pestis
guauuuucaaucgcu

SEQ ID NO: 2273017 - RNA, 12 nt, Yersinia pestis
gucgaaagcuca

SEQ ID NO: 2273018 - RNA, 14 nt, Yersinia pestis
guccuuaaagacca

SEQ ID NO: 2273019 - RNA, 14 nt, Yersinia pestis
gucgaacauaaaaa

SEQ ID NO: 2273020 - RNA, 18 nt, Yersinia pestis
gucgaacauaaaaaugca

SEQ ID NO: 2273021 - RNA, 16 nt, Yersinia pestis
guccgucuuguauuua

SEQ ID NO: 2273022 - RNA, 20 nt, Yersinia pestis
guccgcgccaaggauggcgc

SEQ ID NO: 2273023 - RNA, 15 nt, Yersinia pestis
gucgaggaucaccac

SEQ ID NO: 2273024 - RNA, 20 nt, Yersinia pestis
gucuacuggcugagagccgc

SEQ ID NO: 2273025 - RNA, 12 nt, Yersinia pestis
gucuacgcucuc

SEQ ID NO: 2273026 - RNA, 22 nt, Yersinia pestis
gucuaacaguuguuucaauaaa

SEQ ID NO: 2273027 - RNA, 14 nt, Yersinia pestis
gucuaaugacagac

SEQ ID NO: 2273028 - RNA, 22 nt, Yersinia pestis
gucgucgaauccaugaugacaa

SEQ ID NO: 2273029 - RNA, 13 nt, Yersinia pestis
gucgucagcgaca

SEQ ID NO: 2273030 - RNA, 14 nt, Yersinia pestis
gucgguaaccugaa

SEQ ID NO: 2273031 - RNA, 13 nt, Yersinia pestis
gucgccaccccau

SEQ ID NO: 2273032 - RNA, 16 nt, Yersinia pestis
gucgcguuggcuaaaa

SEQ ID NO: 2273033 - RNA, 13 nt, Yersinia pestis
gucggccaguucg

SEQ ID NO: 2273034 - RNA, 15 nt, Yersinia pestis
gucggccgaaaggua

SEQ ID NO: 2273035 - RNA, 23 nt, Yersinia pestis
gucaauuuuugccuuucugggcu

SEQ ID NO: 2273036 - RNA, 22 nt, Yersinia pestis
gucaauuuuugccuuucugggc

SEQ ID NO: 2273037 - RNA, 16 nt, Yersinia pestis
gucaauaucaucaucu

SEQ ID NO: 2273038 - RNA, 18 nt, Yersinia pestis
gucacaguaaaucaggcc

SEQ ID NO: 2273039 - RNA, 17 nt, Yersinia pestis
gucacagaggaaucaaa

SEQ ID NO: 2273040 - RNA, 22 nt, Yersinia pestis
gucacagaggaaucaaagagcg

SEQ ID NO: 2273041 - RNA, 16 nt, Yersinia pestis
gucaauaccuuacugu

SEQ ID NO: 2273042 - RNA, 19 nt, Yersinia pestis
gucaauaaccucagccuca

SEQ ID NO: 2273043 - RNA, 20 nt, Yersinia pestis
gucaauaaccucagccucau

SEQ ID NO: 2273044 - RNA, 21 nt, Yersinia pestis
gucaauaaccucaggcccgcu

SEQ ID NO: 2273045 - RNA, 23 nt, Yersinia pestis
gucaauaaaaugggccugagugg

SEQ ID NO: 2273046 - RNA, 23 nt, Yersinia pestis
gucaauaaccucacgggcuucca

SEQ ID NO: 2273047 - RNA, 17 nt, Yersinia pestis
gucaaggugauuucaaa

SEQ ID NO: 2273048 - RNA, 18 nt, Yersinia pestis
gucaagguacccauuauu

SEQ ID NO: 2273049 - RNA, 13 nt, Yersinia pestis
gucacccacuaau

SEQ ID NO: 2273050 - RNA, 22 nt, Yersinia pestis
gucaccaucaauauaagagaaa

SEQ ID NO: 2273051 - RNA, 16 nt, Yersinia pestis
gucaccaucaauauaa

SEQ ID NO: 2273052 - RNA, 19 nt, Yersinia pestis
gucaccuagauaaucaagu

SEQ ID NO: 2273053 - RNA, 19 nt, Yersinia pestis
gucaccaacggccccucag

SEQ ID NO: 2273054 - RNA, 15 nt, Yersinia pestis
gucaccaaauauuac

SEQ ID NO: 2273055 - RNA, 16 nt, Yersinia pestis
gucaccacaaagguca

SEQ ID NO: 2273056 - RNA, 21 nt, Yersinia pestis
gucaccacggcuuucaauaaa

SEQ ID NO: 2273057 - RNA, 17 nt, Yersinia pestis
gucacuuaaauaacuca

SEQ ID NO: 2273058 - RNA, 11 nt, Yersinia pestis
gucacuggcca

SEQ ID NO: 2273059 - RNA, 20 nt, Yersinia pestis
gucacuuaaauaacucagug

SEQ ID NO: 2273060 - RNA, 14 nt, Yersinia pestis
gucaccuuucuuga

SEQ ID NO: 2273061 - RNA, 20 nt, Yersinia pestis
gucaccugucaccuaccacc

SEQ ID NO: 2273062 - RNA, 20 nt, Yersinia pestis
gucagaucgcgaugcgccug

SEQ ID NO: 2273063 - RNA, 20 nt, Yersinia pestis
gucagauuaguuuuagacgu

SEQ ID NO: 2273064 - RNA, 14 nt, Yersinia pestis
gucagcaaaucaaa

SEQ ID NO: 2273065 - RNA, 17 nt, Yersinia pestis
gucagcaaaucaaacaa

SEQ ID NO: 2273066 - RNA, 13 nt, Yersinia pestis
gucagaaccugca

SEQ ID NO: 2273067 - RNA, 22 nt, Yersinia pestis
gucagacacgguauucaggaug

SEQ ID NO: 2273068 - RNA, 13 nt, Yersinia pestis
gucagacugcuga

SEQ ID NO: 2273069 - RNA, 15 nt, Yersinia pestis
gucagugguuuuaua

SEQ ID NO: 2273070 - RNA, 12 nt, Yersinia pestis
gucaguucaucg

SEQ ID NO: 2273071 - RNA, 15 nt, Yersinia pestis
gucagugaaaaauga

SEQ ID NO: 2273072 - RNA, 16 nt, Yersinia pestis
gucagugcuauucaua

SEQ ID NO: 2273073 - RNA, 20 nt, Yersinia pestis
gucaggaaacuggccaacuc

SEQ ID NO: 2273074 - RNA, 16 nt, Yersinia pestis
gucaggaacccauuug

SEQ ID NO: 2273075 - RNA, 12 nt, Yersinia pestis
gucaggaagaga

SEQ ID NO: 2273076 - RNA, 16 nt, Yersinia pestis
gucaguaauucacccu

SEQ ID NO: 2273077 - RNA, 14 nt, Yersinia pestis
gucaguaaugaauu

SEQ ID NO: 2273078 - RNA, 22 nt, Yersinia pestis
gucaguacggaaucauaaaagc

SEQ ID NO: 2273079 - RNA, 17 nt, Yersinia pestis
gucauuguagauggcca

SEQ ID NO: 2273080 - RNA, 15 nt, Yersinia pestis
gucauuccaaccuug

SEQ ID NO: 2273081 - RNA, 17 nt, Yersinia pestis
gucauugguguuacagc

SEQ ID NO: 2273082 - RNA, 12 nt, Yersinia pestis
gucauuggaguc

SEQ ID NO: 2273083 - RNA, 19 nt, Yersinia pestis
guccacuuucaccaaacca

SEQ ID NO: 2273084 - RNA, 20 nt, Yersinia pestis
gucauacaaaaugagccugu

SEQ ID NO: 2273085 - RNA, 15 nt, Yersinia pestis
gucauaauugccaaa

SEQ ID NO: 2273086 - RNA, 15 nt, Yersinia pestis
gucauaaauauuuua

SEQ ID NO: 2273087 - RNA, 19 nt, Yersinia pestis
gucaugaugaauacgauaa

SEQ ID NO: 2273088 - RNA, 14 nt, Yersinia pestis
gucauauauuuuuc

SEQ ID NO: 2273089 - RNA, 15 nt, Yersinia pestis
gucaugcucacaauc

SEQ ID NO: 2273090 - RNA, 13 nt, Yersinia pestis
gucauuauuaaac

SEQ ID NO: 2273091 - RNA, 12 nt, Yersinia pestis
gucccccucaca

SEQ ID NO: 2273092 - RNA, 21 nt, Yersinia pestis
guccccgagaggcuauuuauc

SEQ ID NO: 2273093 - RNA, 18 nt, Yersinia pestis
gucccuaaagccaucgcc

SEQ ID NO: 2273094 - RNA, 20 nt, Yersinia pestis
gucccaaacucuggaugggu

SEQ ID NO: 2273095 - RNA, 13 nt, Yersinia pestis
gucccaagaaaag

SEQ ID NO: 2273096 - RNA, 18 nt, Yersinia pestis
gucccaagaaaagcaccg

SEQ ID NO: 2273097 - RNA, 18 nt, Yersinia pestis
gugcacagauaggagaag

SEQ ID NO: 2273098 - RNA, 16 nt, Yersinia pestis
gugcaaacuuaaaaau

SEQ ID NO: 2273099 - RNA, 20 nt, Yersinia pestis
gugcaacaucaggccuucuu

SEQ ID NO: 2273100 - RNA, 16 nt, Yersinia pestis
gugcaacauuaaaaau

SEQ ID NO: 2273101 - RNA, 17 nt, Yersinia pestis
gugcaacauuaaaaaua

SEQ ID NO: 2273102 - RNA, 19 nt, Yersinia pestis
gugcagcgcgcagccaacg

SEQ ID NO: 2273103 - RNA, 18 nt, Yersinia pestis
gugcauaaaacgauuuuc

SEQ ID NO: 2273104 - RNA, 13 nt, Yersinia pestis
gugcauccccacu

SEQ ID NO: 2273105 - RNA, 15 nt, Yersinia pestis
aaauauagcauguac

SEQ ID NO: 2273106 - RNA, 18 nt, Yersinia pestis
gugcaucuuccaauucau

SEQ ID NO: 2273107 - RNA, 15 nt, Yersinia pestis
gugcauguaacugua

SEQ ID NO: 2273108 - RNA, 19 nt, Yersinia pestis
gugcauguggaagcgggcg

SEQ ID NO: 2273109 - RNA, 20 nt, Yersinia pestis
gugcauuaucuuuaauuuuu

SEQ ID NO: 2273110 - RNA, 14 nt, Yersinia pestis
gugaugcaguaaau

SEQ ID NO: 2273111 - RNA, 19 nt, Yersinia pestis
gugaugaaaccaaaaccuu

SEQ ID NO: 2273112 - RNA, 15 nt, Yersinia pestis
gugaugccccgcuau

SEQ ID NO: 2273113 - RNA, 14 nt, Yersinia pestis
gugauuacugucau

SEQ ID NO: 2273114 - RNA, 14 nt, Yersinia pestis
gugauggcggcugg

SEQ ID NO: 2273115 - RNA, 17 nt, Yersinia pestis
gucuauugaaaaaauaa

SEQ ID NO: 2273116 - RNA, 22 nt, Yersinia pestis
gucuauugaaaaaauaaugucc

SEQ ID NO: 2273117 - RNA, 13 nt, Yersinia pestis
gucuauuuucauu

SEQ ID NO: 2273118 - RNA, 21 nt, Yersinia pestis
gucuauuuucauuauuuucaa

SEQ ID NO: 2273119 - RNA, 22 nt, Yersinia pestis
gucuagcgcaguacucaccgcc

SEQ ID NO: 2273120 - RNA, 14 nt, Yersinia pestis
gucuauaaaaccgu

SEQ ID NO: 2273121 - RNA, 20 nt, Yersinia pestis
gugauauuauuuauuuuaua

SEQ ID NO: 2273122 - RNA, 17 nt, Yersinia pestis
gugauauugggccggag

SEQ ID NO: 2273123 - RNA, 14 nt, Yersinia pestis
gugaucaccugagc

SEQ ID NO: 2273124 - RNA, 14 nt, Yersinia pestis
gugauauaaaucca

SEQ ID NO: 2273125 - RNA, 17 nt, Yersinia pestis
gugauauaaauccaagg

SEQ ID NO: 2273126 - RNA, 22 nt, Yersinia pestis
gucuauuuuuauaaucaucuac

SEQ ID NO: 2273127 - RNA, 12 nt, Yersinia pestis
gucucaaggccu

SEQ ID NO: 2273128 - RNA, 23 nt, Yersinia pestis
gucucaaggucuuucgcccacaa

SEQ ID NO: 2273129 - RNA, 14 nt, Yersinia pestis
gucucaaugcagua

SEQ ID NO: 2273130 - RNA, 22 nt, Yersinia pestis
gucucacccgcuugucuugaaa

SEQ ID NO: 2273131 - RNA, 19 nt, Yersinia pestis
gugccgugucuuccagaca

SEQ ID NO: 2273132 - RNA, 14 nt, Yersinia pestis
gugccugcggcgga

SEQ ID NO: 2273133 - RNA, 18 nt, Yersinia pestis
gugcgaaauaccccucac

SEQ ID NO: 2273134 - RNA, 22 nt, Yersinia pestis
gugccguagguaauuaaacgcu

SEQ ID NO: 2273135 - RNA, 13 nt, Yersinia pestis
gugccgcggcggc

SEQ ID NO: 2273136 - RNA, 13 nt, Yersinia pestis
gugccgcuggggu

SEQ ID NO: 2273137 - RNA, 13 nt, Yersinia pestis
gugccaucgccaa

SEQ ID NO: 2273138 - RNA, 21 nt, Yersinia pestis
gugccauaaauaccaauuuca

SEQ ID NO: 2273139 - RNA, 15 nt, Yersinia pestis
gugccauaucgccag

SEQ ID NO: 2273140 - RNA, 17 nt, Yersinia pestis
gugccauaaauaccaau

SEQ ID NO: 2273141 - RNA, 21 nt, Yersinia pestis
gugccacaacaagccucgcug

SEQ ID NO: 2273142 - RNA, 15 nt, Yersinia pestis
gugccaaugccucuu

SEQ ID NO: 2273143 - RNA, 13 nt, Yersinia pestis
gugccaaaaaaag

SEQ ID NO: 2273144 - RNA, 19 nt, Yersinia pestis
gugcccgguaaagugacuc

SEQ ID NO: 2273145 - RNA, 14 nt, Yersinia pestis
gugguuuggugguu

SEQ ID NO: 2273146 - RNA, 19 nt, Yersinia pestis
guguaaaaacuuaucuaaa

SEQ ID NO: 2273147 - RNA, 14 nt, Yersinia pestis
gugguggcagagaa

SEQ ID NO: 2273148 - RNA, 18 nt, Yersinia pestis
guguauucgcaucuucca

SEQ ID NO: 2273149 - RNA, 15 nt, Yersinia pestis
guguauuuaaaagau

SEQ ID NO: 2273150 - RNA, 22 nt, Yersinia pestis
gugucaaaccaauuucucggcc

SEQ ID NO: 2273151 - RNA, 21 nt, Yersinia pestis
guguauaaaccggucauacau

SEQ ID NO: 2273152 - RNA, 13 nt, Yersinia pestis
guguaugcaaaau

SEQ ID NO: 2273153 - RNA, 18 nt, Yersinia pestis
gugguccccagagcgcaa

SEQ ID NO: 2273154 - RNA, 13 nt, Yersinia pestis
guggcuuggcaug

SEQ ID NO: 2273155 - RNA, 23 nt, Yersinia pestis
guggcucgacggccaauuucagu

SEQ ID NO: 2273156 - RNA, 20 nt, Yersinia pestis
guggcugaaucguacuucuu

SEQ ID NO: 2273157 - RNA, 15 nt, Yersinia pestis
guggcugagacuucu

SEQ ID NO: 2273158 - RNA, 23 nt, Yersinia pestis
gugcuaaaucccaggcguucugu

SEQ ID NO: 2273159 - RNA, 21 nt, Yersinia pestis
gugcguuacucggcgcaucca

SEQ ID NO: 2273160 - RNA, 15 nt, Yersinia pestis
gugcguuuagggaca

SEQ ID NO: 2273161 - RNA, 16 nt, Yersinia pestis
gugcuauucauaaauc

SEQ ID NO: 2273162 - RNA, 21 nt, Yersinia pestis
gugcucacaaucuucuucagu

SEQ ID NO: 2273163 - RNA, 15 nt, Yersinia pestis
gugcucacgucacca

SEQ ID NO: 2273164 - RNA, 20 nt, Yersinia pestis
gugcucgggugccucacgua

SEQ ID NO: 2273165 - RNA, 16 nt, Yersinia pestis
gugcucccaaucaaug

SEQ ID NO: 2273166 - RNA, 19 nt, Yersinia pestis
gugcuuuucuuaauaccua

SEQ ID NO: 2273167 - RNA, 14 nt, Yersinia pestis
gugcuuugccuucu

SEQ ID NO: 2273168 - RNA, 14 nt, Yersinia pestis
guggaaucggccuu

SEQ ID NO: 2273169 - RNA, 18 nt, Yersinia pestis
gugcuuacauuucaucuu

SEQ ID NO: 2273170 - RNA, 15 nt, Yersinia pestis
gugcuucagacagua

SEQ ID NO: 2273171 - RNA, 15 nt, Yersinia pestis
gugcuucucugccgc

SEQ ID NO: 2273172 - RNA, 21 nt, Yersinia pestis
gugcuugcggaauuucuucua

SEQ ID NO: 2273173 - RNA, 22 nt, Yersinia pestis
gugcgccacgcagugccgauga

SEQ ID NO: 2273174 - RNA, 14 nt, Yersinia pestis
gugcgcuccauuuc

SEQ ID NO: 2273175 - RNA, 16 nt, Yersinia pestis
gugcgggccagaauaa

SEQ ID NO: 2273176 - RNA, 15 nt, Yersinia pestis
gugcgcuuugcagua

SEQ ID NO: 2273177 - RNA, 15 nt, Yersinia pestis
gugcggauggcugcu

SEQ ID NO: 2273178 - RNA, 14 nt, Yersinia pestis
guuauuaacuucaa

SEQ ID NO: 2273179 - RNA, 15 nt, Yersinia pestis
guuauuaucaugaag

SEQ ID NO: 2273180 - RNA, 20 nt, Yersinia pestis
guuauucuuuauuuauuuua

SEQ ID NO: 2273181 - RNA, 15 nt, Yersinia pestis
guucaaaaaauaggc

SEQ ID NO: 2273182 - RNA, 21 nt, Yersinia pestis
guuaucgguaucaucgagaug

SEQ ID NO: 2273183 - RNA, 19 nt, Yersinia pestis
guuaucgguauuuuugucg

SEQ ID NO: 2273184 - RNA, 13 nt, Yersinia pestis
guuaucggugcug

SEQ ID NO: 2273185 - RNA, 14 nt, Yersinia pestis
guuaucgcucuuga

SEQ ID NO: 2273186 - RNA, 14 nt, Yersinia pestis
guuauacacuugcu

SEQ ID NO: 2273187 - RNA, 16 nt, Yersinia pestis
guuagcagauaauaaa

SEQ ID NO: 2273188 - RNA, 15 nt, Yersinia pestis
guuacgugagcaucu

SEQ ID NO: 2273189 - RNA, 16 nt, Yersinia pestis
guuacgugagcaucug

SEQ ID NO: 2273190 - RNA, 19 nt, Yersinia pestis
guuacgugagcaucuggcg

SEQ ID NO: 2273191 - RNA, 17 nt, Yersinia pestis
guuacgggcuugcugca

SEQ ID NO: 2273192 - RNA, 18 nt, Yersinia pestis
guuacgggcuugcugcaa

SEQ ID NO: 2273193 - RNA, 15 nt, Yersinia pestis
guuagcuaugcaguu

SEQ ID NO: 2273194 - RNA, 14 nt, Yersinia pestis
guuagcucuucacg

SEQ ID NO: 2273195 - RNA, 13 nt, Yersinia pestis
guuagcaucugau

SEQ ID NO: 2273196 - RNA, 21 nt, Yersinia pestis
guuagcgacgucuaauuguua

SEQ ID NO: 2273197 - RNA, 15 nt, Yersinia pestis
guuagcgaugacuga

SEQ ID NO: 2273198 - RNA, 13 nt, Yersinia pestis
guuauaauauuaa

SEQ ID NO: 2273199 - RNA, 19 nt, Yersinia pestis
guuauaaggcuaacaccuu

SEQ ID NO: 2273200 - RNA, 16 nt, Yersinia pestis
guuaaauacagcacca

SEQ ID NO: 2273201 - RNA, 17 nt, Yersinia pestis
guuaaacuucuuuaucu

SEQ ID NO: 2273202 - RNA, 17 nt, Yersinia pestis
guuaaaguuaucaccaa

SEQ ID NO: 2273203 - RNA, 17 nt, Yersinia pestis
guuaaacgguaaccauc

SEQ ID NO: 2273204 - RNA, 17 nt, Yersinia pestis
guuacaccgaaauuaga

SEQ ID NO: 2273205 - RNA, 17 nt, Yersinia pestis
guuacagcaaggcggca

SEQ ID NO: 2273206 - RNA, 17 nt, Yersinia pestis
guuacagcaaggcagca

SEQ ID NO: 2273207 - RNA, 20 nt, Yersinia pestis
guuacaucaugaguaaaaga

SEQ ID NO: 2273208 - RNA, 17 nt, Yersinia pestis
guuaccagaaaaccuuc

SEQ ID NO: 2273209 - RNA, 16 nt, Yersinia pestis
guuaauaccugcacca

SEQ ID NO: 2273210 - RNA, 23 nt, Yersinia pestis
guuaauauuuaucugcauuaaaa

SEQ ID NO: 2273211 - RNA, 13 nt, Yersinia pestis
guuaaucgcagca

SEQ ID NO: 2273212 - RNA, 22 nt, Yersinia pestis
guucauuuagcagcgcacuggg

SEQ ID NO: 2273213 - RNA, 20 nt, Yersinia pestis
guucauuuugaccagcauac

SEQ ID NO: 2273214 - RNA, 19 nt, Yersinia pestis
guucauggccaugaaucaa

SEQ ID NO: 2273215 - RNA, 22 nt, Yersinia pestis
guucauauaguugcuuaucguc

SEQ ID NO: 2273216 - RNA, 14 nt, Yersinia pestis
guucauauuggcca

SEQ ID NO: 2273217 - RNA, 18 nt, Yersinia pestis
guucaagucccucccuuc

SEQ ID NO: 2273218 - RNA, 12 nt, Yersinia pestis
guucaauaauua

SEQ ID NO: 2273219 - RNA, 14 nt, Yersinia pestis
guucaaaucugcuc

SEQ ID NO: 2273220 - RNA, 21 nt, Yersinia pestis
guucaaaucaguuccugauuc

SEQ ID NO: 2273221 - RNA, 14 nt, Yersinia pestis
guucaagagugagu

SEQ ID NO: 2273222 - RNA, 22 nt, Yersinia pestis
guucaagagcgauagaucgaua

SEQ ID NO: 2273223 - RNA, 19 nt, Yersinia pestis
guucaauggucaugcacag

SEQ ID NO: 2273224 - RNA, 19 nt, Yersinia pestis
guucaaucggcagugccau

SEQ ID NO: 2273225 - RNA, 21 nt, Yersinia pestis
guucacuucgcggacgcuggc

SEQ ID NO: 2273226 - RNA, 20 nt, Yersinia pestis
guucacuugagagaaacuuu

SEQ ID NO: 2273227 - RNA, 19 nt, Yersinia pestis
guuccccuucuucuccuau

SEQ ID NO: 2273228 - RNA, 23 nt, Yersinia pestis
guucccgauuauugugccgccuu

SEQ ID NO: 2273229 - RNA, 14 nt, Yersinia pestis
guucccguucaucc

SEQ ID NO: 2273230 - RNA, 19 nt, Yersinia pestis
guucgaggauaucacucug

SEQ ID NO: 2273231 - RNA, 15 nt, Yersinia pestis
guucgacuaucccac

SEQ ID NO: 2273232 - RNA, 19 nt, Yersinia pestis
guucguagccacgaucgau

SEQ ID NO: 2273233 - RNA, 19 nt, Yersinia pestis
guucugccaauuuggggcu

SEQ ID NO: 2273234 - RNA, 21 nt, Yersinia pestis
guucucuggaguuauacccau

SEQ ID NO: 2273235 - RNA, 19 nt, Yersinia pestis
guucugguagcugcucacg

SEQ ID NO: 2273236 - RNA, 14 nt, Yersinia pestis
guucugucacaauc

SEQ ID NO: 2273237 - RNA, 18 nt, Yersinia pestis
guucuggcccuaaauggg

SEQ ID NO: 2273238 - RNA, 19 nt, Yersinia pestis
guugaaauaaauaaguuca

SEQ ID NO: 2273239 - RNA, 20 nt, Yersinia pestis
guucuuccugugcgccacgc

SEQ ID NO: 2273240 - RNA, 18 nt, Yersinia pestis
guucuugaaaaaauaaau

SEQ ID NO: 2273241 - RNA, 19 nt, Yersinia pestis
guucuucugauaaaacagu

SEQ ID NO: 2273242 - RNA, 21 nt, Yersinia pestis
guucuucuuguggcaguucac

SEQ ID NO: 2273243 - RNA, 19 nt, Yersinia pestis
guugauauaagcagcacca

SEQ ID NO: 2273244 - RNA, 17 nt, Yersinia pestis
guugauccgauaaacuu

SEQ ID NO: 2273245 - RNA, 20 nt, Yersinia pestis
guugauccgauaaacuucac

SEQ ID NO: 2273246 - RNA, 19 nt, Yersinia pestis
guugaugcucauuuaaaau

SEQ ID NO: 2273247 - RNA, 15 nt, Yersinia pestis
guugaugaguaaaca

SEQ ID NO: 2273248 - RNA, 16 nt, Yersinia pestis
guugaugaguaaacag

SEQ ID NO: 2273249 - RNA, 15 nt, Yersinia pestis
guugcaaauuuccag

SEQ ID NO: 2273250 - RNA, 15 nt, Yersinia pestis
guugcaacggucauu

SEQ ID NO: 2273251 - RNA, 23 nt, Yersinia pestis
guugcaugcgccauauacccaaa

SEQ ID NO: 2273252 - RNA, 16 nt, Yersinia pestis
guugcauuuuucuguu

SEQ ID NO: 2273253 - RNA, 12 nt, Yersinia pestis
guugaacucaua

SEQ ID NO: 2273254 - RNA, 20 nt, Yersinia pestis
guugaccuugguaaauacca

SEQ ID NO: 2273255 - RNA, 19 nt, Yersinia pestis
guugaccugaagaaagguc

SEQ ID NO: 2273256 - RNA, 15 nt, Yersinia pestis
guugacuuuuuuuaa

SEQ ID NO: 2273257 - RNA, 18 nt, Yersinia pestis
guugacuuuuuuuaacca

SEQ ID NO: 2273258 - RNA, 23 nt, Yersinia pestis
guuuaaaucuuucuccaguaaaa

SEQ ID NO: 2273259 - RNA, 20 nt, Yersinia pestis
guuuaaaucuuucuccagua

SEQ ID NO: 2273260 - RNA, 14 nt, Yersinia pestis
guuuaaaaaauauc

SEQ ID NO: 2273261 - RNA, 15 nt, Yersinia pestis
guuguuucugaaggg

SEQ ID NO: 2273262 - RNA, 15 nt, Yersinia pestis
guuguuucaauaaau

SEQ ID NO: 2273263 - RNA, 18 nt, Yersinia pestis
guuguucaacgccauagc

SEQ ID NO: 2273264 - RNA, 21 nt, Yersinia pestis
guuguugaccucaaaauacau

SEQ ID NO: 2273265 - RNA, 16 nt, Yersinia pestis
guuuauacuauuuaug

SEQ ID NO: 2273266 - RNA, 12 nt, Yersinia pestis
guuuauuauuca

SEQ ID NO: 2273267 - RNA, 15 nt, Yersinia pestis
guuuauaaauuaaaa

SEQ ID NO: 2273268 - RNA, 16 nt, Yersinia pestis
guuuacccagccaaga

SEQ ID NO: 2273269 - RNA, 19 nt, Yersinia pestis
guuuacaugauugaaaaac

SEQ ID NO: 2273270 - RNA, 15 nt, Yersinia pestis
guuuagccaugaggu

SEQ ID NO: 2273271 - RNA, 13 nt, Yersinia pestis
guuggcaaauaau

SEQ ID NO: 2273272 - RNA, 17 nt, Yersinia pestis
guuggauacugcauuuc

SEQ ID NO: 2273273 - RNA, 22 nt, Yersinia pestis
guuggaucauccgcucagcaaa

SEQ ID NO: 2273274 - RNA, 14 nt, Yersinia pestis
guuggauaaccccc

SEQ ID NO: 2273275 - RNA, 20 nt, Yersinia pestis
guugccacccuaucugcucu

SEQ ID NO: 2273276 - RNA, 17 nt, Yersinia pestis
guugccauaaccugagc

SEQ ID NO: 2273277 - RNA, 19 nt, Yersinia pestis
guugccauggccgccagca

SEQ ID NO: 2273278 - RNA, 18 nt, Yersinia pestis
guugcccguuaauauuaa

SEQ ID NO: 2273279 - RNA, 14 nt, Yersinia pestis
guugugcauauauu

SEQ ID NO: 2273280 - RNA, 23 nt, Yersinia pestis
guuguaauacgcaugagccuuug

SEQ ID NO: 2273281 - RNA, 13 nt, Yersinia pestis
guuguaccgccau

SEQ ID NO: 2273282 - RNA, 14 nt, Yersinia pestis
guugggcaguaacg

SEQ ID NO: 2273283 - RNA, 19 nt, Yersinia pestis
guugggcggucaucagccc

SEQ ID NO: 2273284 - RNA, 17 nt, Yersinia pestis
uaaaaauagauuaaaag

SEQ ID NO: 2273285 - RNA, 21 nt, Yersinia pestis
uaaaaauacauaucaacacug

SEQ ID NO: 2273286 - RNA, 16 nt, Yersinia pestis
uaaaaauaaucaauga

SEQ ID NO: 2273287 - RNA, 17 nt, Yersinia pestis
uaaaaauaaauucuuua

SEQ ID NO: 2273288 - RNA, 19 nt, Yersinia pestis
uaaaaagcagcaaacgaac

SEQ ID NO: 2273289 - RNA, 19 nt, Yersinia pestis
uaaaaagccugaauucugu

SEQ ID NO: 2273290 - RNA, 19 nt, Yersinia pestis
uaaaaacuuaucuaaaaaa

SEQ ID NO: 2273291 - RNA, 23 nt, Yersinia pestis
uaaaaacuuaucuaaaaaaccag

SEQ ID NO: 2273292 - RNA, 15 nt, Yersinia pestis
uaaaaaauuauuaaa

SEQ ID NO: 2273293 - RNA, 17 nt, Yersinia pestis
uaaaaaauuauuaaaua

SEQ ID NO: 2273294 - RNA, 18 nt, Yersinia pestis
uaaaaaaugauaaauucu

SEQ ID NO: 2273295 - RNA, 21 nt, Yersinia pestis
uaaaaaccaucugaugcaggu

SEQ ID NO: 2273296 - RNA, 17 nt, Yersinia pestis
uaaaaaccaauggaaaa

SEQ ID NO: 2273297 - RNA, 22 nt, Yersinia pestis
uaaaaaccaauggaaaauacac

SEQ ID NO: 2273298 - RNA, 18 nt, Yersinia pestis
uaaaaacuaaggggccaa

SEQ ID NO: 2273299 - RNA, 19 nt, Yersinia pestis
uaaaaacccucucauccug

SEQ ID NO: 2273300 - RNA, 18 nt, Yersinia pestis
uaaaaacccucuucaauc

SEQ ID NO: 2273301 - RNA, 17 nt, Yersinia pestis
uaaaaaaaaauaaaauu

SEQ ID NO: 2273302 - RNA, 15 nt, Yersinia pestis
uaaaaaaaaagaaaa

SEQ ID NO: 2273303 - RNA, 21 nt, Yersinia pestis
uaaaaaaauucugagaucuaa

SEQ ID NO: 2273304 - RNA, 12 nt, Yersinia pestis
uaaaaaaauagc

SEQ ID NO: 2273305 - RNA, 13 nt, Yersinia pestis
uaaaaaaauuaaa

SEQ ID NO: 2273306 - RNA, 20 nt, Yersinia pestis
uaaaaaagugcuauccucuu

SEQ ID NO: 2273307 - RNA, 13 nt, Yersinia pestis
uaaaaaagucacu

SEQ ID NO: 2273308 - RNA, 18 nt, Yersinia pestis
uaaaaaacgcgacgguca

SEQ ID NO: 2273309 - RNA, 14 nt, Yersinia pestis
guuuuuuauuuaua

SEQ ID NO: 2273310 - RNA, 13 nt, Yersinia pestis
guuuuuucuuucu

SEQ ID NO: 2273311 - RNA, 14 nt, Yersinia pestis
guuuuuucuuucuu

SEQ ID NO: 2273312 - RNA, 13 nt, Yersinia pestis
guuuuuuaaaaaa

SEQ ID NO: 2273313 - RNA, 15 nt, Yersinia pestis
guuuuuucaacuggc

SEQ ID NO: 2273314 - RNA, 16 nt, Yersinia pestis
guuuuugaaauaccac

SEQ ID NO: 2273315 - RNA, 22 nt, Yersinia pestis
guuuguaaccgacuugcccaau

SEQ ID NO: 2273316 - RNA, 17 nt, Yersinia pestis
guuuuaaaaaaaaagaa

SEQ ID NO: 2273317 - RNA, 12 nt, Yersinia pestis
guuuggugguuu

SEQ ID NO: 2273318 - RNA, 20 nt, Yersinia pestis
aaaucagcguuuuaaucaca

SEQ ID NO: 2273319 - RNA, 22 nt, Yersinia pestis
aaaucagccacuuccuguuuau

SEQ ID NO: 2273320 - RNA, 16 nt, Yersinia pestis
aaaucagcaagcugcu

SEQ ID NO: 2273321 - RNA, 21 nt, Yersinia pestis
aaaucaggccuuuuucucaau

SEQ ID NO: 2273322 - RNA, 15 nt, Yersinia pestis
aaaucagcuucauua

SEQ ID NO: 2273323 - RNA, 23 nt, Yersinia pestis
guuugccagugcaugcaggucaa

SEQ ID NO: 2273324 - RNA, 17 nt, Yersinia pestis
guuucaaauaaguacuu

SEQ ID NO: 2273325 - RNA, 22 nt, Yersinia pestis
aaaucagugaaggaugaauaaa

SEQ ID NO: 2273326 - RNA, 23 nt, Yersinia pestis
aaaucagugaaggaugaauaaau

SEQ ID NO: 2273327 - RNA, 21 nt, Yersinia pestis
aaaucaguuccugauucgguu

SEQ ID NO: 2273328 - RNA, 23 nt, Yersinia pestis
aaaucaucgcucaucgccaaagc

SEQ ID NO: 2273329 - RNA, 14 nt, Yersinia pestis
aaauccagaucagc

SEQ ID NO: 2273330 - RNA, 15 nt, Yersinia pestis
guuuuaucaauaggu

SEQ ID NO: 2273331 - RNA, 18 nt, Yersinia pestis
guuuuaucaauaggucag

SEQ ID NO: 2273332 - RNA, 20 nt, Yersinia pestis
guuuuauugaugauuugacc

SEQ ID NO: 2273333 - RNA, 17 nt, Yersinia pestis
guuuucauuauuuucac

SEQ ID NO: 2273334 - RNA, 15 nt, Yersinia pestis
guuuucuauuuccac

SEQ ID NO: 2273335 - RNA, 21 nt, Yersinia pestis
guuuucccugcgccagcagca

SEQ ID NO: 2273336 - RNA, 14 nt, Yersinia pestis
guuuuccacauggc

SEQ ID NO: 2273337 - RNA, 18 nt, Yersinia pestis
guuuuguuuccccuaauu

SEQ ID NO: 2273338 - RNA, 17 nt, Yersinia pestis
uaaaagcacagacaaac

SEQ ID NO: 2273339 - RNA, 22 nt, Yersinia pestis
uaaaagcggguuaccaguaacu

SEQ ID NO: 2273340 - RNA, 17 nt, Yersinia pestis
uaaaagaaaaccuugac

SEQ ID NO: 2273341 - RNA, 14 nt, Yersinia pestis
uaaaagaaagggca

SEQ ID NO: 2273342 - RNA, 18 nt, Yersinia pestis
uaaaacuuuggcugaggg

SEQ ID NO: 2273343 - RNA, 15 nt, Yersinia pestis
uaaaagaaaaccuug

SEQ ID NO: 2273344 - RNA, 23 nt, Yersinia pestis
uaaaaccuucgccuuucaguuca

SEQ ID NO: 2273345 - RNA, 18 nt, Yersinia pestis
uaaaacgaguaaauacaa

SEQ ID NO: 2273346 - RNA, 21 nt, Yersinia pestis
uaaaacgaguaaauacaaaua

SEQ ID NO: 2273347 - RNA, 15 nt, Yersinia pestis
uaaaacugaagcauc

SEQ ID NO: 2273348 - RNA, 20 nt, Yersinia pestis
uaaaacugauauaaagcauu

SEQ ID NO: 2273349 - RNA, 14 nt, Yersinia pestis
uaaaacugaagcau

SEQ ID NO: 2273350 - RNA, 21 nt, Yersinia pestis
uaaaacucacgguuucuaaaa

SEQ ID NO: 2273351 - RNA, 15 nt, Yersinia pestis
uaaaacagaaccccc

SEQ ID NO: 2273352 - RNA, 14 nt, Yersinia pestis
uaaaacaaaguagu

SEQ ID NO: 2273353 - RNA, 12 nt, Yersinia pestis
uaaaaccacuga

SEQ ID NO: 2273354 - RNA, 21 nt, Yersinia pestis
uaaaaccacugaccuauugau

SEQ ID NO: 2273355 - RNA, 23 nt, Yersinia pestis
uaaaaccacugaccuauugauaa

SEQ ID NO: 2273356 - RNA, 15 nt, Yersinia pestis
uaaaaccggagucaa

SEQ ID NO: 2273357 - RNA, 20 nt, Yersinia pestis
uaaaaccggagucaaucauu

SEQ ID NO: 2273358 - RNA, 14 nt, Yersinia pestis
uaaaacauauuaag

SEQ ID NO: 2273359 - RNA, 19 nt, Yersinia pestis
uaaaacauuucauuccaga

SEQ ID NO: 2273360 - RNA, 16 nt, Yersinia pestis
uaaaacagcuaacacu

SEQ ID NO: 2273361 - RNA, 20 nt, Yersinia pestis
uaaaacagcagccaccaaaa

SEQ ID NO: 2273362 - RNA, 22 nt, Yersinia pestis
uaaaaaucaauacguugaauua

SEQ ID NO: 2273363 - RNA, 20 nt, Yersinia pestis
uaaaaaucaccucaaacuga

SEQ ID NO: 2273364 - RNA, 13 nt, Yersinia pestis
uaaaaauauuaac

SEQ ID NO: 2273365 - RNA, 12 nt, Yersinia pestis
uaaaaauuaauu

SEQ ID NO: 2273366 - RNA, 19 nt, Yersinia pestis
uaaaaauucacaacagugc

SEQ ID NO: 2273367 - RNA, 14 nt, Yersinia pestis
uaaaagucagcaaa

SEQ ID NO: 2273368 - RNA, 12 nt, Yersinia pestis
uaaaaggcccgc

SEQ ID NO: 2273369 - RNA, 20 nt, Yersinia pestis
uaaaauaguggcacaaauaa

SEQ ID NO: 2273370 - RNA, 15 nt, Yersinia pestis
uaaaauaauaauggu

SEQ ID NO: 2273371 - RNA, 17 nt, Yersinia pestis
uaaaauaacaauucacu

SEQ ID NO: 2273372 - RNA, 15 nt, Yersinia pestis
uaaaauaaauuggcc

SEQ ID NO: 2273373 - RNA, 12 nt, Yersinia pestis
uaaaauaaauuu

SEQ ID NO: 2273374 - RNA, 16 nt, Yersinia pestis
uaaaaucuugugccgc

SEQ ID NO: 2273375 - RNA, 12 nt, Yersinia pestis
uaaaauuaauua

SEQ ID NO: 2273376 - RNA, 20 nt, Yersinia pestis
uaaaauccccauuccaauua

SEQ ID NO: 2273377 - RNA, 12 nt, Yersinia pestis
uaaaauccccau

SEQ ID NO: 2273378 - RNA, 16 nt, Yersinia pestis
uaaaauccccauucca

SEQ ID NO: 2273379 - RNA, 17 nt, Yersinia pestis
uaaaauccccauuccaa

SEQ ID NO: 2273380 - RNA, 20 nt, Yersinia pestis
uaaaauaucuuucaaguccu

SEQ ID NO: 2273381 - RNA, 12 nt, Yersinia pestis
uaaaaucaucag

SEQ ID NO: 2273382 - RNA, 20 nt, Yersinia pestis
uaaaaucaucagccucuaac

SEQ ID NO: 2273383 - RNA, 15 nt, Yersinia pestis
uaaaaucaaaacagg

SEQ ID NO: 2273384 - RNA, 15 nt, Yersinia pestis
uaaaauauggcaggu

SEQ ID NO: 2273385 - RNA, 23 nt, Yersinia pestis
uaaaaucacguuuccaaaacuca

SEQ ID NO: 2273386 - RNA, 21 nt, Yersinia pestis
uaaagcagguaguuacagcaa

SEQ ID NO: 2273387 - RNA, 23 nt, Yersinia pestis
uaaagcgauaaauacucccgcca

SEQ ID NO: 2273388 - RNA, 13 nt, Yersinia pestis
uaaagccuugucc

SEQ ID NO: 2273389 - RNA, 14 nt, Yersinia pestis
uaaagccuuucagc

SEQ ID NO: 2273390 - RNA, 17 nt, Yersinia pestis
uaaagccuuucagcgcu

SEQ ID NO: 2273391 - RNA, 14 nt, Yersinia pestis
uaaaggugauauca

SEQ ID NO: 2273392 - RNA, 18 nt, Yersinia pestis
uaaagguauagcgauaga

SEQ ID NO: 2273393 - RNA, 19 nt, Yersinia pestis
uaaagguaaaaggcccgcu

SEQ ID NO: 2273394 - RNA, 15 nt, Yersinia pestis
uaaaggcgaugauuu

SEQ ID NO: 2273395 - RNA, 20 nt, Yersinia pestis
uaaaggcgaugauuugucaa

SEQ ID NO: 2273396 - RNA, 19 nt, Yersinia pestis
uaaaggcaagauuucucuu

SEQ ID NO: 2273397 - RNA, 13 nt, Yersinia pestis
uaaaggcaaagaa

SEQ ID NO: 2273398 - RNA, 19 nt, Yersinia pestis
uaaaggcccaaucuugcaa

SEQ ID NO: 2273399 - RNA, 22 nt, Yersinia pestis
uaaaggggggaaacgguuuuaa

SEQ ID NO: 2273400 - RNA, 17 nt, Yersinia pestis
uaaagauuuuaagcacu

SEQ ID NO: 2273401 - RNA, 17 nt, Yersinia pestis
uaaagccucuuguguaa

SEQ ID NO: 2273402 - RNA, 20 nt, Yersinia pestis
uaaagcaggccuucuaacuc

SEQ ID NO: 2273403 - RNA, 19 nt, Yersinia pestis
uaaagacgccguaaauaca

SEQ ID NO: 2273404 - RNA, 20 nt, Yersinia pestis
uaaagacgccguaaauacau

SEQ ID NO: 2273405 - RNA, 20 nt, Yersinia pestis
uaaagacgccggcuucccug

SEQ ID NO: 2273406 - RNA, 16 nt, Yersinia pestis
uaaagacgcaugagcu

SEQ ID NO: 2273407 - RNA, 17 nt, Yersinia pestis
uaaagagugaaauauac

SEQ ID NO: 2273408 - RNA, 16 nt, Yersinia pestis
uaaauauucauuaaaa

SEQ ID NO: 2273409 - RNA, 15 nt, Yersinia pestis
uaaauauuauuuaau

SEQ ID NO: 2273410 - RNA, 16 nt, Yersinia pestis
uaaauauuauuuaauu

SEQ ID NO: 2273411 - RNA, 17 nt, Yersinia pestis
uaaauauuauuuaauua

SEQ ID NO: 2273412 - RNA, 19 nt, Yersinia pestis
uaaauauuauuuaauuaaa

SEQ ID NO: 2273413 - RNA, 23 nt, Yersinia pestis
uaaauauuauuuaauuaaaugua

SEQ ID NO: 2273414 - RNA, 15 nt, Yersinia pestis
uaaauagccaaacac

SEQ ID NO: 2273415 - RNA, 18 nt, Yersinia pestis
uaaauagcaaaacugagg

SEQ ID NO: 2273416 - RNA, 20 nt, Yersinia pestis
uaaauagaaaaaugauuuuu

SEQ ID NO: 2273417 - RNA, 15 nt, Yersinia pestis
uaaauacucuugaga

SEQ ID NO: 2273418 - RNA, 18 nt, Yersinia pestis
uaaauacucuugagaaau

SEQ ID NO: 2273419 - RNA, 19 nt, Yersinia pestis
uaaauaaagugcuucucug

SEQ ID NO: 2273420 - RNA, 15 nt, Yersinia pestis
uaaauaaauagaaaa

SEQ ID NO: 2273421 - RNA, 19 nt, Yersinia pestis
uaaauaaaagauaacgcaa

SEQ ID NO: 2273422 - RNA, 14 nt, Yersinia pestis
uaaauaaaauagcg

SEQ ID NO: 2273423 - RNA, 15 nt, Yersinia pestis
uaaauaaaauaauaa

SEQ ID NO: 2273424 - RNA, 18 nt, Yersinia pestis
uaaauaaaauaauaaugg

SEQ ID NO: 2273425 - RNA, 14 nt, Yersinia pestis
uaaauaaaauaaau

SEQ ID NO: 2273426 - RNA, 13 nt, Yersinia pestis
uaaauaaaauaau

SEQ ID NO: 2273427 - RNA, 14 nt, Yersinia pestis
uaaauaaaauaaua

SEQ ID NO: 2273428 - RNA, 22 nt, Yersinia pestis
uaaauacaaaauuaacggcuca

SEQ ID NO: 2273429 - RNA, 15 nt, Yersinia pestis
uaaauaauuuguauu

SEQ ID NO: 2273430 - RNA, 17 nt, Yersinia pestis
uaaauaccaauuucaua

SEQ ID NO: 2273431 - RNA, 22 nt, Yersinia pestis
uaaauacccagcuucuuuuaaa

SEQ ID NO: 2273432 - RNA, 15 nt, Yersinia pestis
uaaaauucgcuauga

SEQ ID NO: 2273433 - RNA, 22 nt, Yersinia pestis
uaaaauucguuucucuaaaauu

SEQ ID NO: 2273434 - RNA, 13 nt, Yersinia pestis
uaaaauuuaaagu

SEQ ID NO: 2273435 - RNA, 14 nt, Yersinia pestis
uaaacaaugaaauu

SEQ ID NO: 2273436 - RNA, 15 nt, Yersinia pestis
uaaacaaguugcuua

SEQ ID NO: 2273437 - RNA, 20 nt, Yersinia pestis
uaaacaaucugaugaauuaa

SEQ ID NO: 2273438 - RNA, 13 nt, Yersinia pestis
uaaacaaaauagg

SEQ ID NO: 2273439 - RNA, 19 nt, Yersinia pestis
uaaacaucaugacaaaaau

SEQ ID NO: 2273440 - RNA, 17 nt, Yersinia pestis
uaaacagggcagaaaau

SEQ ID NO: 2273441 - RNA, 14 nt, Yersinia pestis
uaaagaaaauuuac

SEQ ID NO: 2273442 - RNA, 20 nt, Yersinia pestis
uaaagaaauaaucauaucaa

SEQ ID NO: 2273443 - RNA, 16 nt, Yersinia pestis
uaaacuuccagcguau

SEQ ID NO: 2273444 - RNA, 12 nt, Yersinia pestis
uaaacuaauauc

SEQ ID NO: 2273445 - RNA, 14 nt, Yersinia pestis
uaaacuaauaucuu

SEQ ID NO: 2273446 - RNA, 13 nt, Yersinia pestis
uaaacgucagauu

SEQ ID NO: 2273447 - RNA, 14 nt, Yersinia pestis
uaaacuucuuuauc

SEQ ID NO: 2273448 - RNA, 17 nt, Yersinia pestis
uaaacuuguaucaaaac

SEQ ID NO: 2273449 - RNA, 20 nt, Yersinia pestis
uaaacccaaccccaucagca

SEQ ID NO: 2273450 - RNA, 21 nt, Yersinia pestis
uaaacccccuguaaccgcaag

SEQ ID NO: 2273451 - RNA, 18 nt, Yersinia pestis
uaaaccgaguucagaucg

SEQ ID NO: 2273452 - RNA, 18 nt, Yersinia pestis
uaaacccggcaucaacca

SEQ ID NO: 2273453 - RNA, 15 nt, Yersinia pestis
uaaacgaguuuccag

SEQ ID NO: 2273454 - RNA, 16 nt, Yersinia pestis
uaaacgccagucagcu

SEQ ID NO: 2273455 - RNA, 15 nt, Yersinia pestis
uaaacgguugcugua

SEQ ID NO: 2273456 - RNA, 18 nt, Yersinia pestis
uaaacgguaaccauccau

SEQ ID NO: 2273457 - RNA, 16 nt, Yersinia pestis
uaaacggguaucggcc

SEQ ID NO: 2273458 - RNA, 14 nt, Yersinia pestis
uaaacgguaaccau

SEQ ID NO: 2273459 - RNA, 22 nt, Yersinia pestis
uaacagauauuacgcagccaua

SEQ ID NO: 2273460 - RNA, 19 nt, Yersinia pestis
uaacaauguuauauuucuu

SEQ ID NO: 2273461 - RNA, 13 nt, Yersinia pestis
uaacagcaucacu

SEQ ID NO: 2273462 - RNA, 19 nt, Yersinia pestis
uaacagcaucacugucuau

SEQ ID NO: 2273463 - RNA, 21 nt, Yersinia pestis
uaacagcguugaccaacuguc

SEQ ID NO: 2273464 - RNA, 20 nt, Yersinia pestis
uaacauuuguauuuuuucuu

SEQ ID NO: 2273465 - RNA, 18 nt, Yersinia pestis
uaacauaucaauaagugc

SEQ ID NO: 2273466 - RNA, 15 nt, Yersinia pestis
uaacauaaggcuaga

SEQ ID NO: 2273467 - RNA, 15 nt, Yersinia pestis
uaaccaauucuuagg

SEQ ID NO: 2273468 - RNA, 16 nt, Yersinia pestis
uaaccaugaugacaau

SEQ ID NO: 2273469 - RNA, 16 nt, Yersinia pestis
uaaccaugauguuagg

SEQ ID NO: 2273470 - RNA, 20 nt, Yersinia pestis
uaaccaugauguuaggcguu

SEQ ID NO: 2273471 - RNA, 13 nt, Yersinia pestis
uaacccaaagccc

SEQ ID NO: 2273472 - RNA, 22 nt, Yersinia pestis
uaaccaacaguuauuuuaauug

SEQ ID NO: 2273473 - RNA, 17 nt, Yersinia pestis
uaaccaauaacauuucg

SEQ ID NO: 2273474 - RNA, 20 nt, Yersinia pestis
uaaccaagccagugcgggag

SEQ ID NO: 2273475 - RNA, 15 nt, Yersinia pestis
uaaccgcagcaggca

SEQ ID NO: 2273476 - RNA, 22 nt, Yersinia pestis
uaaccgccaaaauaucgcgcuu

SEQ ID NO: 2273477 - RNA, 20 nt, Yersinia pestis
uaaccgccugugacgcuuga

SEQ ID NO: 2273478 - RNA, 18 nt, Yersinia pestis
uaacccaguugcgccgcu

SEQ ID NO: 2273479 - RNA, 23 nt, Yersinia pestis
uaaccgauuucagcaccauaaau

SEQ ID NO: 2273480 - RNA, 22 nt, Yersinia pestis
uaacccccaaauagcuggcauc

SEQ ID NO: 2273481 - RNA, 21 nt, Yersinia pestis
uaacccauugguuuuuagcuu

SEQ ID NO: 2273482 - RNA, 13 nt, Yersinia pestis
uaacccauugguu

SEQ ID NO: 2273483 - RNA, 18 nt, Yersinia pestis
uaaccuguaaaagcagcc

SEQ ID NO: 2273484 - RNA, 16 nt, Yersinia pestis
uaacgaagguaacuua

SEQ ID NO: 2273485 - RNA, 14 nt, Yersinia pestis
uaacgaauucagca

SEQ ID NO: 2273486 - RNA, 16 nt, Yersinia pestis
uaacgaauucagcagc

SEQ ID NO: 2273487 - RNA, 16 nt, Yersinia pestis
uaaccucagccucauu

SEQ ID NO: 2273488 - RNA, 14 nt, Yersinia pestis
uaaccucagccuca

SEQ ID NO: 2273489 - RNA, 22 nt, Yersinia pestis
uaaccugcuggcgcaacuguag

SEQ ID NO: 2273490 - RNA, 23 nt, Yersinia pestis
uaaccugcuggcgcaacuguagu

SEQ ID NO: 2273491 - RNA, 15 nt, Yersinia pestis
uaaccuguauuuguu

SEQ ID NO: 2273492 - RNA, 16 nt, Yersinia pestis
uaaccugcacuuucau

SEQ ID NO: 2273493 - RNA, 15 nt, Yersinia pestis
uaaauuagccacugg

SEQ ID NO: 2273494 - RNA, 15 nt, Yersinia pestis
uaaauuacucgccuu

SEQ ID NO: 2273495 - RNA, 14 nt, Yersinia pestis
uaaauuagaaaaca

SEQ ID NO: 2273496 - RNA, 15 nt, Yersinia pestis
uaaauuagaaaacaa

SEQ ID NO: 2273497 - RNA, 19 nt, Yersinia pestis
uaaauuggccgauagauuu

SEQ ID NO: 2273498 - RNA, 15 nt, Yersinia pestis
uaaauugcgggcugg

SEQ ID NO: 2273499 - RNA, 15 nt, Yersinia pestis
uaaauuuaauaugac

SEQ ID NO: 2273500 - RNA, 20 nt, Yersinia pestis
uaacaaauggucaggaaccc

SEQ ID NO: 2273501 - RNA, 21 nt, Yersinia pestis
uaacaacccuaacaccgagua

SEQ ID NO: 2273502 - RNA, 14 nt, Yersinia pestis
uaacaacagucaau

SEQ ID NO: 2273503 - RNA, 15 nt, Yersinia pestis
uaacaacagucaaua

SEQ ID NO: 2273504 - RNA, 17 nt, Yersinia pestis
uaaauuucuucaauaau

SEQ ID NO: 2273505 - RNA, 22 nt, Yersinia pestis
uaaauuucccuagcgaaguauu

SEQ ID NO: 2273506 - RNA, 23 nt, Yersinia pestis
uaaaugaaauugggggucagggc

SEQ ID NO: 2273507 - RNA, 19 nt, Yersinia pestis
uaaaucacgcagcaggcca

SEQ ID NO: 2273508 - RNA, 17 nt, Yersinia pestis
uaaaucacaauuucacc

SEQ ID NO: 2273509 - RNA, 21 nt, Yersinia pestis
uaaaucaauucuaucgcugua

SEQ ID NO: 2273510 - RNA, 15 nt, Yersinia pestis
uaaauguacagucau

SEQ ID NO: 2273511 - RNA, 18 nt, Yersinia pestis
uaaaugguuuauuuaagc

SEQ ID NO: 2273512 - RNA, 19 nt, Yersinia pestis
uaaaugucacuugcccuga

SEQ ID NO: 2273513 - RNA, 22 nt, Yersinia pestis
uaaaugacuaucccuucaauca

SEQ ID NO: 2273514 - RNA, 20 nt, Yersinia pestis
uaaaugagggauauacccua

SEQ ID NO: 2273515 - RNA, 14 nt, Yersinia pestis
uagggcgcggcugg

SEQ ID NO: 2273516 - RNA, 13 nt, Yersinia pestis
uagggccaccaga

SEQ ID NO: 2273517 - RNA, 16 nt, Yersinia pestis
uagggaacgccagcgg

SEQ ID NO: 2273518 - RNA, 13 nt, Yersinia pestis
uaggcuuuaaccu

SEQ ID NO: 2273519 - RNA, 16 nt, Yersinia pestis
uaggcuugagguuauu

SEQ ID NO: 2273520 - RNA, 14 nt, Yersinia pestis
uaggcuuuuuacuu

SEQ ID NO: 2273521 - RNA, 22 nt, Yersinia pestis
uaggcucgagccgcgccauccu

SEQ ID NO: 2273522 - RNA, 13 nt, Yersinia pestis
uaggcucccagac

SEQ ID NO: 2273523 - RNA, 17 nt, Yersinia pestis
uaggcuauugacaaagu

SEQ ID NO: 2273524 - RNA, 15 nt, Yersinia pestis
uaggcuauuuuacuu

SEQ ID NO: 2273525 - RNA, 16 nt, Yersinia pestis
uaggcucagcauggaa

SEQ ID NO: 2273526 - RNA, 22 nt, Yersinia pestis
uaggcuauugacaaaguaccua

SEQ ID NO: 2273527 - RNA, 14 nt, Yersinia pestis
uaggcuacagcuac

SEQ ID NO: 2273528 - RNA, 14 nt, Yersinia pestis
uaggccacuuaaca

SEQ ID NO: 2273529 - RNA, 13 nt, Yersinia pestis
uaggcaucucuga

SEQ ID NO: 2273530 - RNA, 13 nt, Yersinia pestis
uaggcaucugcca

SEQ ID NO: 2273531 - RNA, 21 nt, Yersinia pestis
uaggccaauagaaaaacacug

SEQ ID NO: 2273532 - RNA, 15 nt, Yersinia pestis
uaggccaccucuucc

SEQ ID NO: 2273533 - RNA, 16 nt, Yersinia pestis
uaggcauaaauaauaa

SEQ ID NO: 2273534 - RNA, 20 nt, Yersinia pestis
uaggcaggcccgcuucccua

SEQ ID NO: 2273535 - RNA, 19 nt, Yersinia pestis
uaggcagcaaacgcacaac

SEQ ID NO: 2273536 - RNA, 15 nt, Yersinia pestis
uaggccuaaacccca

SEQ ID NO: 2273537 - RNA, 18 nt, Yersinia pestis
uaggccuaaaccccacag

SEQ ID NO: 2273538 - RNA, 20 nt, Yersinia pestis
uaggcgaaauugacuuuaaa

SEQ ID NO: 2273539 - RNA, 13 nt, Yersinia pestis
uaggguugugugg

SEQ ID NO: 2273540 - RNA, 16 nt, Yersinia pestis
uagggucauacccaaa

SEQ ID NO: 2273541 - RNA, 21 nt, Yersinia pestis
uaggggccaccaaauaaaaca

SEQ ID NO: 2273542 - RNA, 21 nt, Yersinia pestis
uaggggaagguaaaaaagaau

SEQ ID NO: 2273543 - RNA, 17 nt, Yersinia pestis
uaggucagugguuuuau

SEQ ID NO: 2273544 - RNA, 13 nt, Yersinia pestis
uaggucagugguu

SEQ ID NO: 2273545 - RNA, 16 nt, Yersinia pestis
uaggucagugguuuua

SEQ ID NO: 2273546 - RNA, 13 nt, Yersinia pestis
uagguuucugggc

SEQ ID NO: 2273547 - RNA, 14 nt, Yersinia pestis
uaguauuuguagug

SEQ ID NO: 2273548 - RNA, 20 nt, Yersinia pestis
uaguaggucacauagcucga

SEQ ID NO: 2273549 - RNA, 14 nt, Yersinia pestis
uaguacuugccaca

SEQ ID NO: 2273550 - RNA, 20 nt, Yersinia pestis
uaguaaacuuaucgaucucc

SEQ ID NO: 2273551 - RNA, 18 nt, Yersinia pestis
uaguaaaaaaucuauuga

SEQ ID NO: 2273552 - RNA, 13 nt, Yersinia pestis
uaguuuauuuuau

SEQ ID NO: 2273553 - RNA, 23 nt, Yersinia pestis
uaguucacgauggaaaaaauaca

SEQ ID NO: 2273554 - RNA, 13 nt, Yersinia pestis
uaguucauuuugu

SEQ ID NO: 2273555 - RNA, 18 nt, Yersinia pestis
uaguguguguauuuaaaa

SEQ ID NO: 2273556 - RNA, 11 nt, Yersinia pestis
uaguucagucg

SEQ ID NO: 2273557 - RNA, 22 nt, Yersinia pestis
uaguuauugauuaauuuuucau

SEQ ID NO: 2273558 - RNA, 16 nt, Yersinia pestis
uagugcuacagcagca

SEQ ID NO: 2273559 - RNA, 11 nt, Yersinia pestis
uagugcuucca

SEQ ID NO: 2273560 - RNA, 15 nt, Yersinia pestis
uagugauuauuuaaa

SEQ ID NO: 2273561 - RNA, 21 nt, Yersinia pestis
uagugaugggggcaauugauu

SEQ ID NO: 2273562 - RNA, 17 nt, Yersinia pestis
uagucaaaacaauaucu

SEQ ID NO: 2273563 - RNA, 15 nt, Yersinia pestis
uagugaugcaguaaa

SEQ ID NO: 2273564 - RNA, 13 nt, Yersinia pestis
uaguuuuucuccu

SEQ ID NO: 2273565 - RNA, 17 nt, Yersinia pestis
uauaaauuaaaaagagu

SEQ ID NO: 2273566 - RNA, 14 nt, Yersinia pestis
uauaaauuuaauaa

SEQ ID NO: 2273567 - RNA, 15 nt, Yersinia pestis
uauaaauuuaauaaa

SEQ ID NO: 2273568 - RNA, 18 nt, Yersinia pestis
uauaaauuuaauaaaaac

SEQ ID NO: 2273569 - RNA, 12 nt, Yersinia pestis
uauaaauuaaaa

SEQ ID NO: 2273570 - RNA, 21 nt, Yersinia pestis
uauaacgcccggcaauaauag

SEQ ID NO: 2273571 - RNA, 17 nt, Yersinia pestis
uauaacgcucgccacga

SEQ ID NO: 2273572 - RNA, 16 nt, Yersinia pestis
uauaacgacuauuuau

SEQ ID NO: 2273573 - RNA, 21 nt, Yersinia pestis
uauaaacgccuccgaucagcu

SEQ ID NO: 2273574 - RNA, 17 nt, Yersinia pestis
uauaaacuaauaucuuu

SEQ ID NO: 2273575 - RNA, 16 nt, Yersinia pestis
uauaaaagcacagaca

SEQ ID NO: 2273576 - RNA, 18 nt, Yersinia pestis
uauaaaaccacugaccua

SEQ ID NO: 2273577 - RNA, 15 nt, Yersinia pestis
uauccaaggcauccg

SEQ ID NO: 2273578 - RNA, 12 nt, Yersinia pestis
uauccaauaagc

SEQ ID NO: 2273579 - RNA, 21 nt, Yersinia pestis
uauccaauaagcguauuuugu

SEQ ID NO: 2273580 - RNA, 15 nt, Yersinia pestis
uauccaaccaccuua

SEQ ID NO: 2273581 - RNA, 14 nt, Yersinia pestis
uaucauuauugauu

SEQ ID NO: 2273582 - RNA, 20 nt, Yersinia pestis
uaucauuuaaauacagauca

SEQ ID NO: 2273583 - RNA, 20 nt, Yersinia pestis
uauccaaucuugguuaauag

SEQ ID NO: 2273584 - RNA, 19 nt, Yersinia pestis
uauccaauggcucaccuuu

SEQ ID NO: 2273585 - RNA, 22 nt, Yersinia pestis
uauccaccugaucaugccacga

SEQ ID NO: 2273586 - RNA, 23 nt, Yersinia pestis
uauccaucaaccacgguuuaauc

SEQ ID NO: 2273587 - RNA, 14 nt, Yersinia pestis
uauccauaaaauca

SEQ ID NO: 2273588 - RNA, 12 nt, Yersinia pestis
uaucagucuuuu

SEQ ID NO: 2273589 - RNA, 17 nt, Yersinia pestis
uaucagugacaccauug

SEQ ID NO: 2273590 - RNA, 20 nt, Yersinia pestis
uaucaguagcuagaauaagu

SEQ ID NO: 2273591 - RNA, 22 nt, Yersinia pestis
uaucacugauacgaugcucacu

SEQ ID NO: 2273592 - RNA, 20 nt, Yersinia pestis
uaucacucuguacguaaaua

SEQ ID NO: 2273593 - RNA, 22 nt, Yersinia pestis
uaucacuguccaagaagccaag

SEQ ID NO: 2273594 - RNA, 19 nt, Yersinia pestis
uaucauaaauaaaagauaa

SEQ ID NO: 2273595 - RNA, 22 nt, Yersinia pestis
uaucaucgagaugcugacccug

SEQ ID NO: 2273596 - RNA, 16 nt, Yersinia pestis
uaucaauaagugcaaa

SEQ ID NO: 2273597 - RNA, 19 nt, Yersinia pestis
uaucaaagugcuuaaccca

SEQ ID NO: 2273598 - RNA, 19 nt, Yersinia pestis
uaucacuauaauuauuucu

SEQ ID NO: 2273599 - RNA, 15 nt, Yersinia pestis
uaucacuauuucaga

SEQ ID NO: 2273600 - RNA, 16 nt, Yersinia pestis
uaucaauugcuggcua

SEQ ID NO: 2273601 - RNA, 13 nt, Yersinia pestis
uaucaaugaaaau

SEQ ID NO: 2273602 - RNA, 12 nt, Yersinia pestis
uaucaauagguc

SEQ ID NO: 2273603 - RNA, 13 nt, Yersinia pestis
uaucaauagguca

SEQ ID NO: 2273604 - RNA, 24 nt, Yersinia pestis
uaucaaucagcugauaugaaaaau

SEQ ID NO: 2273605 - RNA, 17 nt, Yersinia pestis
uaucaaucaaaaaauaa

SEQ ID NO: 2273606 - RNA, 15 nt, Yersinia pestis
uaucaauaggucagu

SEQ ID NO: 2273607 - RNA, 19 nt, Yersinia pestis
uaucaaucaaaaaauaaau

SEQ ID NO: 2273608 - RNA, 21 nt, Yersinia pestis
uauauugcgccgcauuguucu

SEQ ID NO: 2273609 - RNA, 17 nt, Yersinia pestis
uauauuggccugcacau

SEQ ID NO: 2273610 - RNA, 22 nt, Yersinia pestis
uauauuuuuggggucugaauau

SEQ ID NO: 2273611 - RNA, 13 nt, Yersinia pestis
uaucaaaacugau

SEQ ID NO: 2273612 - RNA, 19 nt, Yersinia pestis
uaucaaaacugauuaauag

SEQ ID NO: 2273613 - RNA, 12 nt, Yersinia pestis
uaucaaaacuga

SEQ ID NO: 2273614 - RNA, 17 nt, Yersinia pestis
uauauucuacaauguca

SEQ ID NO: 2273615 - RNA, 23 nt, Yersinia pestis
uauauucuauugaggacaauuca

SEQ ID NO: 2273616 - RNA, 11 nt, Yersinia pestis
uauauuccucg

SEQ ID NO: 2273617 - RNA, 17 nt, Yersinia pestis
uauaucacuauuucaga

SEQ ID NO: 2273618 - RNA, 13 nt, Yersinia pestis
uauaguuaaaacu

SEQ ID NO: 2273619 - RNA, 23 nt, Yersinia pestis
uauauaauugaagauuuaaauaa

SEQ ID NO: 2273620 - RNA, 20 nt, Yersinia pestis
uauauacccgucauaaauaa

SEQ ID NO: 2273621 - RNA, 16 nt, Yersinia pestis
uauauagagaaaucua

SEQ ID NO: 2273622 - RNA, 17 nt, Yersinia pestis
uauauagagaaaucuac

SEQ ID NO: 2273623 - RNA, 12 nt, Yersinia pestis
uauaucacuauu

SEQ ID NO: 2273624 - RNA, 18 nt, Yersinia pestis
uauauauuuugaauauuu

SEQ ID NO: 2273625 - RNA, 16 nt, Yersinia pestis
uauauauuuuuaauuu

SEQ ID NO: 2273626 - RNA, 18 nt, Yersinia pestis
uauauagagaaaucuaca

SEQ ID NO: 2273627 - RNA, 20 nt, Yersinia pestis
uauagacuguuuuauuauau

SEQ ID NO: 2273628 - RNA, 22 nt, Yersinia pestis
uauagcagggccgguuaauuga

SEQ ID NO: 2273629 - RNA, 12 nt, Yersinia pestis
uauagcguucau

SEQ ID NO: 2273630 - RNA, 13 nt, Yersinia pestis
uauacuaaaacag

SEQ ID NO: 2273631 - RNA, 13 nt, Yersinia pestis
uauacucugucug

SEQ ID NO: 2273632 - RNA, 21 nt, Yersinia pestis
uauacagucaauugagaauaa

SEQ ID NO: 2273633 - RNA, 14 nt, Yersinia pestis
uauacccaccagag

SEQ ID NO: 2273634 - RNA, 23 nt, Yersinia pestis
uauacccaccagagaccacagau

SEQ ID NO: 2273635 - RNA, 21 nt, Yersinia pestis
uauacccagcaucauaagacu

SEQ ID NO: 2273636 - RNA, 19 nt, Yersinia pestis
uauaccaacucugaaguaa

SEQ ID NO: 2273637 - RNA, 18 nt, Yersinia pestis
uagcugcgcccgguuacu

SEQ ID NO: 2273638 - RNA, 18 nt, Yersinia pestis
uagcugaucgggcuuuac

SEQ ID NO: 2273639 - RNA, 17 nt, Yersinia pestis
uagcucgccuucauuau

SEQ ID NO: 2273640 - RNA, 12 nt, Yersinia pestis
uagcucuucacg

SEQ ID NO: 2273641 - RNA, 13 nt, Yersinia pestis
uagcucuuccagc

SEQ ID NO: 2273642 - RNA, 15 nt, Yersinia pestis
uagcucuuccagcaa

SEQ ID NO: 2273643 - RNA, 18 nt, Yersinia pestis
uagcucuuccagcaacau

SEQ ID NO: 2273644 - RNA, 14 nt, Yersinia pestis
uagcugcuuuugcu

SEQ ID NO: 2273645 - RNA, 17 nt, Yersinia pestis
uagcugucguaauaguu

SEQ ID NO: 2273646 - RNA, 21 nt, Yersinia pestis
uagcuggcuucaaaaucaccu

SEQ ID NO: 2273647 - RNA, 16 nt, Yersinia pestis
uagcuuauccagaucc

SEQ ID NO: 2273648 - RNA, 17 nt, Yersinia pestis
uagcuuaacgcccugcc

SEQ ID NO: 2273649 - RNA, 13 nt, Yersinia pestis
uagcuaaauuuaa

SEQ ID NO: 2273650 - RNA, 17 nt, Yersinia pestis
uagcgugagaauaauaa

SEQ ID NO: 2273651 - RNA, 22 nt, Yersinia pestis
uagcguucaucgcccuguaacu

SEQ ID NO: 2273652 - RNA, 15 nt, Yersinia pestis
uagcuaaccuuaacu

SEQ ID NO: 2273653 - RNA, 12 nt, Yersinia pestis
uagcuacugaug

SEQ ID NO: 2273654 - RNA, 17 nt, Yersinia pestis
uagcuacagcaccauua

SEQ ID NO: 2273655 - RNA, 12 nt, Yersinia pestis
uagcucaaauau

SEQ ID NO: 2273656 - RNA, 13 nt, Yersinia pestis
uagcuuuuuaaau

SEQ ID NO: 2273657 - RNA, 14 nt, Yersinia pestis
uagcuuuuuaaaua

SEQ ID NO: 2273658 - RNA, 16 nt, Yersinia pestis
uaggauguuauggauu

SEQ ID NO: 2273659 - RNA, 22 nt, Yersinia pestis
uagcgguguuagcccaaggcga

SEQ ID NO: 2273660 - RNA, 16 nt, Yersinia pestis
uagcggcguucagcaa

SEQ ID NO: 2273661 - RNA, 16 nt, Yersinia pestis
uagcgcugcaucagca

SEQ ID NO: 2273662 - RNA, 22 nt, Yersinia pestis
uagcgccuuuuuuauaauaaug

SEQ ID NO: 2273663 - RNA, 22 nt, Yersinia pestis
uagcgccgauggugugcagcaa

SEQ ID NO: 2273664 - RNA, 21 nt, Yersinia pestis
uagccuucguuugucaaugga

SEQ ID NO: 2273665 - RNA, 17 nt, Yersinia pestis
uagcgacacccucagag

SEQ ID NO: 2273666 - RNA, 17 nt, Yersinia pestis
uagcgaaucacaucauu

SEQ ID NO: 2273667 - RNA, 14 nt, Yersinia pestis
uagcgaugacugag

SEQ ID NO: 2273668 - RNA, 13 nt, Yersinia pestis
uagcgagaaaguc

SEQ ID NO: 2273669 - RNA, 14 nt, Yersinia pestis
uagcgauauccuua

SEQ ID NO: 2273670 - RNA, 14 nt, Yersinia pestis
uagccacuaacuaa

SEQ ID NO: 2273671 - RNA, 16 nt, Yersinia pestis
uagccagccaauggcc

SEQ ID NO: 2273672 - RNA, 22 nt, Yersinia pestis
uagccagcgugguguuggcugu

SEQ ID NO: 2273673 - RNA, 16 nt, Yersinia pestis
uagccacuuaauaaug

SEQ ID NO: 2273674 - RNA, 19 nt, Yersinia pestis
uagccagaaauagcaccau

SEQ ID NO: 2273675 - RNA, 13 nt, Yersinia pestis
uagccagaagcca

SEQ ID NO: 2273676 - RNA, 15 nt, Yersinia pestis
uagccauucaaaaau

SEQ ID NO: 2273677 - RNA, 16 nt, Yersinia pestis
uagccauucaaaaauu

SEQ ID NO: 2273678 - RNA, 20 nt, Yersinia pestis
uagccauucaaaaauuaaau

SEQ ID NO: 2273679 - RNA, 18 nt, Yersinia pestis
uagccaugagguuuauuc

SEQ ID NO: 2273680 - RNA, 21 nt, Yersinia pestis
uagccccggcaaguugaucac

SEQ ID NO: 2273681 - RNA, 20 nt, Yersinia pestis
uagcccggcucauccgccaa

SEQ ID NO: 2273682 - RNA, 12 nt, Yersinia pestis
uagcccucccug

SEQ ID NO: 2273683 - RNA, 12 nt, Yersinia pestis
uagccauuucaa

SEQ ID NO: 2273684 - RNA, 15 nt, Yersinia pestis
uagcccaaagcaaua

SEQ ID NO: 2273685 - RNA, 19 nt, Yersinia pestis
uagccccaacacuggggcg

SEQ ID NO: 2273686 - RNA, 23 nt, Yersinia pestis
uagcccuucagcaaaugauugca

SEQ ID NO: 2273687 - RNA, 14 nt, Yersinia pestis
uagccgccgcuugg

SEQ ID NO: 2273688 - RNA, 23 nt, Yersinia pestis
uagccgucacuuaaaaaucaaua

SEQ ID NO: 2273689 - RNA, 16 nt, Yersinia pestis
uagcaugaaugaaaua

SEQ ID NO: 2273690 - RNA, 20 nt, Yersinia pestis
uagccaaauacauauaacca

SEQ ID NO: 2273691 - RNA, 16 nt, Yersinia pestis
uagcagagcacgcaga

SEQ ID NO: 2273692 - RNA, 14 nt, Yersinia pestis
uagcagcgcacugg

SEQ ID NO: 2273693 - RNA, 14 nt, Yersinia pestis
uagcaggcagcacg

SEQ ID NO: 2273694 - RNA, 20 nt, Yersinia pestis
uagcagggucaccaccacuu

SEQ ID NO: 2273695 - RNA, 12 nt, Yersinia pestis
uagcagggccgc

SEQ ID NO: 2273696 - RNA, 15 nt, Yersinia pestis
uagcaguauuagcuu

SEQ ID NO: 2273697 - RNA, 22 nt, Yersinia pestis
uagcaguauuagcuuuacuggu

SEQ ID NO: 2273698 - RNA, 21 nt, Yersinia pestis
uagcacccaauguauauguug

SEQ ID NO: 2273699 - RNA, 14 nt, Yersinia pestis
uagcacauaugcag

SEQ ID NO: 2273700 - RNA, 21 nt, Yersinia pestis
uagcaauaccagccgauaauc

SEQ ID NO: 2273701 - RNA, 22 nt, Yersinia pestis
uagcaauaccuugcccuaggcc

SEQ ID NO: 2273702 - RNA, 20 nt, Yersinia pestis
uagcaaacccaccugaaucu

SEQ ID NO: 2273703 - RNA, 22 nt, Yersinia pestis
uagcaaaaggauuaauaauaau

SEQ ID NO: 2273704 - RNA, 17 nt, Yersinia pestis
uagcaaaacugaggucg

SEQ ID NO: 2273705 - RNA, 23 nt, Yersinia pestis
uagauuucugcacccauggagau

SEQ ID NO: 2273706 - RNA, 23 nt, Yersinia pestis
uagauuucaccuauaauuaacag

SEQ ID NO: 2273707 - RNA, 19 nt, Yersinia pestis
uagauuucacugccgaacc

SEQ ID NO: 2273708 - RNA, 19 nt, Yersinia pestis
uagagugaaguaucaccac

SEQ ID NO: 2273709 - RNA, 16 nt, Yersinia pestis
uagaguugauaaacaa

SEQ ID NO: 2273710 - RNA, 17 nt, Yersinia pestis
uagaguugauaaacaau

SEQ ID NO: 2273711 - RNA, 17 nt, Yersinia pestis
uagauacaauucaccca

SEQ ID NO: 2273712 - RNA, 16 nt, Yersinia pestis
uagauaccgcaaccau

SEQ ID NO: 2273713 - RNA, 18 nt, Yersinia pestis
uagauaccgcaaccauug

SEQ ID NO: 2273714 - RNA, 13 nt, Yersinia pestis
uagagcagugcag

SEQ ID NO: 2273715 - RNA, 22 nt, Yersinia pestis
uagagcauaacugguggcaggc

SEQ ID NO: 2273716 - RNA, 22 nt, Yersinia pestis
uagagcuguuuggcauggauau

SEQ ID NO: 2273717 - RNA, 14 nt, Yersinia pestis
uagaguaaaacuga

SEQ ID NO: 2273718 - RNA, 14 nt, Yersinia pestis
uagaguaaguaaaa

SEQ ID NO: 2273719 - RNA, 22 nt, Yersinia pestis
uagaucaacauuccauaccuga

SEQ ID NO: 2273720 - RNA, 14 nt, Yersinia pestis
uagauagccauaau

SEQ ID NO: 2273721 - RNA, 18 nt, Yersinia pestis
uagauaggcaguauucca

SEQ ID NO: 2273722 - RNA, 21 nt, Yersinia pestis
uagaucccauacccacuaaua

SEQ ID NO: 2273723 - RNA, 18 nt, Yersinia pestis
uagauccacuccagugcc

SEQ ID NO: 2273724 - RNA, 20 nt, Yersinia pestis
uagaucggguaaaccaauau

SEQ ID NO: 2273725 - RNA, 18 nt, Yersinia pestis
uagaucggccaaugcuuu

SEQ ID NO: 2273726 - RNA, 13 nt, Yersinia pestis
uagaugucagauu

SEQ ID NO: 2273727 - RNA, 14 nt, Yersinia pestis
uagauuauuuucuu

SEQ ID NO: 2273728 - RNA, 19 nt, Yersinia pestis
uagauuaaugaaaaggcau

SEQ ID NO: 2273729 - RNA, 17 nt, Yersinia pestis
uaccgggcgaacagaaa

SEQ ID NO: 2273730 - RNA, 18 nt, Yersinia pestis
uaccggcuccugccgcau

SEQ ID NO: 2273731 - RNA, 18 nt, Yersinia pestis
uaccuauggcgaagagaa

SEQ ID NO: 2273732 - RNA, 14 nt, Yersinia pestis
uaccuaggccagca

SEQ ID NO: 2273733 - RNA, 23 nt, Yersinia pestis
uaccucauccguaaaaaaccuua

SEQ ID NO: 2273734 - RNA, 19 nt, Yersinia pestis
uaccacggcaccuucugau

SEQ ID NO: 2273735 - RNA, 22 nt, Yersinia pestis
uaccacgucuaauugcugccca

SEQ ID NO: 2273736 - RNA, 15 nt, Yersinia pestis
uaccaccuacaaccu

SEQ ID NO: 2273737 - RNA, 16 nt, Yersinia pestis
uaccaccuacaaccua

SEQ ID NO: 2273738 - RNA, 19 nt, Yersinia pestis
uaccaccuaccaccuacca

SEQ ID NO: 2273739 - RNA, 14 nt, Yersinia pestis
uaccaauucuucau

SEQ ID NO: 2273740 - RNA, 15 nt, Yersinia pestis
uaccaauguuuaauu

SEQ ID NO: 2273741 - RNA, 22 nt, Yersinia pestis
uaccuggacgcuggcagccuuu

SEQ ID NO: 2273742 - RNA, 16 nt, Yersinia pestis
uaccuguuucaaacau

SEQ ID NO: 2273743 - RNA, 21 nt, Yersinia pestis
uaccuuaauuaacucuucugu

SEQ ID NO: 2273744 - RNA, 15 nt, Yersinia pestis
uaccugcauauccuc

SEQ ID NO: 2273745 - RNA, 20 nt, Yersinia pestis
uaccugcaucaagccgcuua

SEQ ID NO: 2273746 - RNA, 16 nt, Yersinia pestis
uaccugagagagguug

SEQ ID NO: 2273747 - RNA, 18 nt, Yersinia pestis
uaccuuuugcugcacugc

SEQ ID NO: 2273748 - RNA, 22 nt, Yersinia pestis
uaccuuuugcauauuucucuuu

SEQ ID NO: 2273749 - RNA, 18 nt, Yersinia pestis
uaccuuuugcauauuucu

SEQ ID NO: 2273750 - RNA, 23 nt, Yersinia pestis
uacgaaauugauaugauuucaua

SEQ ID NO: 2273751 - RNA, 17 nt, Yersinia pestis
uaccuuuacggccgcua

SEQ ID NO: 2273752 - RNA, 18 nt, Yersinia pestis
uaccuucacauuuucucc

SEQ ID NO: 2273753 - RNA, 21 nt, Yersinia pestis
uaccuucccguccacuuucac

SEQ ID NO: 2273754 - RNA, 13 nt, Yersinia pestis
uaccuucccaucc

SEQ ID NO: 2273755 - RNA, 16 nt, Yersinia pestis
uaccuuguuacucaua

SEQ ID NO: 2273756 - RNA, 14 nt, Yersinia pestis
uacucauccagauu

SEQ ID NO: 2273757 - RNA, 14 nt, Yersinia pestis
uacucaugauggca

SEQ ID NO: 2273758 - RNA, 22 nt, Yersinia pestis
uacucaguugccgccuuccugc

SEQ ID NO: 2273759 - RNA, 21 nt, Yersinia pestis
uacucaggauuagcuucugcu

SEQ ID NO: 2273760 - RNA, 17 nt, Yersinia pestis
uacucaggcccugagau

SEQ ID NO: 2273761 - RNA, 21 nt, Yersinia pestis
uacucauuauggauaauuuaa

SEQ ID NO: 2273762 - RNA, 13 nt, Yersinia pestis
uacucauugcacc

SEQ ID NO: 2273763 - RNA, 21 nt, Yersinia pestis
uacuccauuuuuuugaugcau

SEQ ID NO: 2273764 - RNA, 23 nt, Yersinia pestis
uacuccccaaagccuacgagaga

SEQ ID NO: 2273765 - RNA, 17 nt, Yersinia pestis
uacuccccaaagccuac

SEQ ID NO: 2273766 - RNA, 19 nt, Yersinia pestis
uacucaaaaaaaauacauu

SEQ ID NO: 2273767 - RNA, 17 nt, Yersinia pestis
uacucaccccacuuucc

SEQ ID NO: 2273768 - RNA, 18 nt, Yersinia pestis
uacuaucuuuauugcucc

SEQ ID NO: 2273769 - RNA, 12 nt, Yersinia pestis
uacuaucuauua

SEQ ID NO: 2273770 - RNA, 11 nt, Yersinia pestis
uacuaaaacag

SEQ ID NO: 2273771 - RNA, 14 nt, Yersinia pestis
uacuaaaauaucac

SEQ ID NO: 2273772 - RNA, 13 nt, Yersinia pestis
uacguuguaccag

SEQ ID NO: 2273773 - RNA, 20 nt, Yersinia pestis
uacguugucaauaaccucag

SEQ ID NO: 2273774 - RNA, 21 nt, Yersinia pestis
uacguugggcggucaucagcc

SEQ ID NO: 2273775 - RNA, 19 nt, Yersinia pestis
uacgcuccguugccugugc

SEQ ID NO: 2273776 - RNA, 18 nt, Yersinia pestis
uacgaauuuuucccugcu

SEQ ID NO: 2273777 - RNA, 13 nt, Yersinia pestis
uacgaucagcaag

SEQ ID NO: 2273778 - RNA, 17 nt, Yersinia pestis
uacgaucgauaguaaca

SEQ ID NO: 2273779 - RNA, 13 nt, Yersinia pestis
uacggucaaaagc

SEQ ID NO: 2273780 - RNA, 12 nt, Yersinia pestis
uacggucacuga

SEQ ID NO: 2273781 - RNA, 17 nt, Yersinia pestis
uacgguaccgcagguca

SEQ ID NO: 2273782 - RNA, 16 nt, Yersinia pestis
uacggugccagcagca

SEQ ID NO: 2273783 - RNA, 22 nt, Yersinia pestis
uacgguuuugccaauauugccu

SEQ ID NO: 2273784 - RNA, 19 nt, Yersinia pestis
uacgguucacuagccugag

SEQ ID NO: 2273785 - RNA, 14 nt, Yersinia pestis
uacgguucaucauu

SEQ ID NO: 2273786 - RNA, 15 nt, Yersinia pestis
uacgugaucaucuuu

SEQ ID NO: 2273787 - RNA, 15 nt, Yersinia pestis
uacguguaaaaccuu

SEQ ID NO: 2273788 - RNA, 15 nt, Yersinia pestis
uacggcauuagugaa

SEQ ID NO: 2273789 - RNA, 23 nt, Yersinia pestis
uacgggccucgcggaaaucagcu

SEQ ID NO: 2273790 - RNA, 23 nt, Yersinia pestis
uacggaucuccaguugcacacca

SEQ ID NO: 2273791 - RNA, 22 nt, Yersinia pestis
uagaacugagaauaaucacagg

SEQ ID NO: 2273792 - RNA, 12 nt, Yersinia pestis
uagaagcccuga

SEQ ID NO: 2273793 - RNA, 13 nt, Yersinia pestis
uagaagcggaaua

SEQ ID NO: 2273794 - RNA, 21 nt, Yersinia pestis
uagaauacaggguaaauuauu

SEQ ID NO: 2273795 - RNA, 22 nt, Yersinia pestis
uagaauacaggguaaauuauuu

SEQ ID NO: 2273796 - RNA, 14 nt, Yersinia pestis
uagaaucugcugca

SEQ ID NO: 2273797 - RNA, 18 nt, Yersinia pestis
uagaccugaggauaaaaa

SEQ ID NO: 2273798 - RNA, 13 nt, Yersinia pestis
uagaccaccaacu

SEQ ID NO: 2273799 - RNA, 15 nt, Yersinia pestis
uagaauuuaccucca

SEQ ID NO: 2273800 - RNA, 22 nt, Yersinia pestis
uagaauuuucucauuaauaaug

SEQ ID NO: 2273801 - RNA, 18 nt, Yersinia pestis
uagagagaacagcgaauc

SEQ ID NO: 2273802 - RNA, 19 nt, Yersinia pestis
uagagagaacagcgaauca

SEQ ID NO: 2273803 - RNA, 16 nt, Yersinia pestis
uagacuguuuuauuau

SEQ ID NO: 2273804 - RNA, 12 nt, Yersinia pestis
uagacgacacaa

SEQ ID NO: 2273805 - RNA, 17 nt, Yersinia pestis
uagacgaaggcacggcc

SEQ ID NO: 2273806 - RNA, 19 nt, Yersinia pestis
uagacgacacaaaugcugu

SEQ ID NO: 2273807 - RNA, 22 nt, Yersinia pestis
uagaaacuaagaguccuuaaaa

SEQ ID NO: 2273808 - RNA, 19 nt, Yersinia pestis
uagaaacccggauucacca

SEQ ID NO: 2273809 - RNA, 18 nt, Yersinia pestis
uacuuuuaauacaggcug

SEQ ID NO: 2273810 - RNA, 21 nt, Yersinia pestis
uacuuugauucaaaaugccag

SEQ ID NO: 2273811 - RNA, 23 nt, Yersinia pestis
uagaaaaaucacauacuggcauu

SEQ ID NO: 2273812 - RNA, 13 nt, Yersinia pestis
uagaaaacaaaaa

SEQ ID NO: 2273813 - RNA, 21 nt, Yersinia pestis
uacuuuaacuuuaguuucuuu

SEQ ID NO: 2273814 - RNA, 13 nt, Yersinia pestis
uacuuuccuuccu

SEQ ID NO: 2273815 - RNA, 16 nt, Yersinia pestis
uacuuuccuuccucuu

SEQ ID NO: 2273816 - RNA, 14 nt, Yersinia pestis
uacuccucugccua

SEQ ID NO: 2273817 - RNA, 15 nt, Yersinia pestis
uacucccggcagcac

SEQ ID NO: 2273818 - RNA, 22 nt, Yersinia pestis
uacucgagcguauugccuucuc

SEQ ID NO: 2273819 - RNA, 14 nt, Yersinia pestis
uacuccuacaccau

SEQ ID NO: 2273820 - RNA, 16 nt, Yersinia pestis
uacuccucugccuauc

SEQ ID NO: 2273821 - RNA, 17 nt, Yersinia pestis
uacuggucucaaggucu

SEQ ID NO: 2273822 - RNA, 18 nt, Yersinia pestis
uacuggcuaucuuaugac

SEQ ID NO: 2273823 - RNA, 20 nt, Yersinia pestis
uacuguaucaauaccuuacu

SEQ ID NO: 2273824 - RNA, 14 nt, Yersinia pestis
uacuguccucaaac

SEQ ID NO: 2273825 - RNA, 22 nt, Yersinia pestis
uacuuaacaaucagugcaauaa

SEQ ID NO: 2273826 - RNA, 17 nt, Yersinia pestis
uacuuagcaauaauaga

SEQ ID NO: 2273827 - RNA, 16 nt, Yersinia pestis
uacuuagcaauaauag

SEQ ID NO: 2273828 - RNA, 18 nt, Yersinia pestis
uaauuuaggugaaaauaa

SEQ ID NO: 2273829 - RNA, 14 nt, Yersinia pestis
uaauuuauaaacaa

SEQ ID NO: 2273830 - RNA, 21 nt, Yersinia pestis
uaauuuacugguaccaaacaa

SEQ ID NO: 2273831 - RNA, 16 nt, Yersinia pestis
uaauuuaaacucuuua

SEQ ID NO: 2273832 - RNA, 14 nt, Yersinia pestis
uaauuuaaauaaaa

SEQ ID NO: 2273833 - RNA, 17 nt, Yersinia pestis
uaauuuaaauaagaucc

SEQ ID NO: 2273834 - RNA, 20 nt, Yersinia pestis
uaauuuaaacaaccaaaaau

SEQ ID NO: 2273835 - RNA, 21 nt, Yersinia pestis
uaauuuaaauaagauccagaa

SEQ ID NO: 2273836 - RNA, 12 nt, Yersinia pestis
uaauuuauagac

SEQ ID NO: 2273837 - RNA, 13 nt, Yersinia pestis
uaauuuauacaua

SEQ ID NO: 2273838 - RNA, 21 nt, Yersinia pestis
uaauuucuacgccgucaucau

SEQ ID NO: 2273839 - RNA, 23 nt, Yersinia pestis
uaauucugcuauuaauuauuauu

SEQ ID NO: 2273840 - RNA, 15 nt, Yersinia pestis
uaauugaagauuuaa

SEQ ID NO: 2273841 - RNA, 20 nt, Yersinia pestis
uaauuggcaauaaugucacc

SEQ ID NO: 2273842 - RNA, 20 nt, Yersinia pestis
uaauuggcccauaacaauua

SEQ ID NO: 2273843 - RNA, 15 nt, Yersinia pestis
uaauugguuuauaac

SEQ ID NO: 2273844 - RNA, 22 nt, Yersinia pestis
uaauggguuagcgguuaaaaac

SEQ ID NO: 2273845 - RNA, 12 nt, Yersinia pestis
uaauuaaauauu

SEQ ID NO: 2273846 - RNA, 14 nt, Yersinia pestis
uaauuaaauauuaa

SEQ ID NO: 2273847 - RNA, 23 nt, Yersinia pestis
uaauggggagugcgcgcagugca

SEQ ID NO: 2273848 - RNA, 23 nt, Yersinia pestis
uaauggcgguauagaccaauuca

SEQ ID NO: 2273849 - RNA, 17 nt, Yersinia pestis
uaauggcgcacauuaca

SEQ ID NO: 2273850 - RNA, 14 nt, Yersinia pestis
uaauggccuaaauu

SEQ ID NO: 2273851 - RNA, 14 nt, Yersinia pestis
uaauuaauuuaaac

SEQ ID NO: 2273852 - RNA, 18 nt, Yersinia pestis
uaauuaauuuaaacaacc

SEQ ID NO: 2273853 - RNA, 16 nt, Yersinia pestis
uaauuaggauuuauuu

SEQ ID NO: 2273854 - RNA, 14 nt, Yersinia pestis
uaauuagugacagu

SEQ ID NO: 2273855 - RNA, 19 nt, Yersinia pestis
uaauuaacacccaauaaua

SEQ ID NO: 2273856 - RNA, 21 nt, Yersinia pestis
uaauuaaauguauaaaaaaga

SEQ ID NO: 2273857 - RNA, 19 nt, Yersinia pestis
uaauuaauauauaaaauaa

SEQ ID NO: 2273858 - RNA, 16 nt, Yersinia pestis
uaauuauagugaaaac

SEQ ID NO: 2273859 - RNA, 16 nt, Yersinia pestis
uaauucaggcaaauuc

SEQ ID NO: 2273860 - RNA, 15 nt, Yersinia pestis
uaauucaccaauugc

SEQ ID NO: 2273861 - RNA, 19 nt, Yersinia pestis
uaauucaccaauugcgguc

SEQ ID NO: 2273862 - RNA, 16 nt, Yersinia pestis
uaauucagcaaacuca

SEQ ID NO: 2273863 - RNA, 16 nt, Yersinia pestis
uaauucauuauuacuc

SEQ ID NO: 2273864 - RNA, 14 nt, Yersinia pestis
uaauucaucagauu

SEQ ID NO: 2273865 - RNA, 14 nt, Yersinia pestis
uaauucucucuuuu

SEQ ID NO: 2273866 - RNA, 13 nt, Yersinia pestis
uaauucuccuuuc

SEQ ID NO: 2273867 - RNA, 14 nt, Yersinia pestis
uaaugaagauuuaa

SEQ ID NO: 2273868 - RNA, 19 nt, Yersinia pestis
uaaugaacgaguaaaaaga

SEQ ID NO: 2273869 - RNA, 15 nt, Yersinia pestis
uaaugacauaaucag

SEQ ID NO: 2273870 - RNA, 15 nt, Yersinia pestis
uaaucuuuacugcau

SEQ ID NO: 2273871 - RNA, 23 nt, Yersinia pestis
uaaucuucuuuaaaacaggaucu

SEQ ID NO: 2273872 - RNA, 15 nt, Yersinia pestis
uaaucuuguaguaca

SEQ ID NO: 2273873 - RNA, 15 nt, Yersinia pestis
uaaucuuaaguaaau

SEQ ID NO: 2273874 - RNA, 21 nt, Yersinia pestis
uaaucuuauuuguaaauauua

SEQ ID NO: 2273875 - RNA, 22 nt, Yersinia pestis
uaaugaccacgcaucaauaaua

SEQ ID NO: 2273876 - RNA, 18 nt, Yersinia pestis
uaaugcauaacugcugug

SEQ ID NO: 2273877 - RNA, 20 nt, Yersinia pestis
uaaugcagguucauuacaca

SEQ ID NO: 2273878 - RNA, 17 nt, Yersinia pestis
uaaugcagguuuugcca

SEQ ID NO: 2273879 - RNA, 17 nt, Yersinia pestis
uaaugagaaucaaucaa

SEQ ID NO: 2273880 - RNA, 17 nt, Yersinia pestis
uaaugccgaaugauuca

SEQ ID NO: 2273881 - RNA, 19 nt, Yersinia pestis
uaaugccacccccagugcu

SEQ ID NO: 2273882 - RNA, 13 nt, Yersinia pestis
uaaugccaauuga

SEQ ID NO: 2273883 - RNA, 12 nt, Yersinia pestis
uaauggcagcau

SEQ ID NO: 2273884 - RNA, 20 nt, Yersinia pestis
uaaugccgcugaucaggaag

SEQ ID NO: 2273885 - RNA, 22 nt, Yersinia pestis
uaaucgcgcauuucuucucuca

SEQ ID NO: 2273886 - RNA, 16 nt, Yersinia pestis
uaaucgcugaacagac

SEQ ID NO: 2273887 - RNA, 21 nt, Yersinia pestis
uaaucgcguucagagcagcau

SEQ ID NO: 2273888 - RNA, 22 nt, Yersinia pestis
uaaucgccucgaccuuaaccgc

SEQ ID NO: 2273889 - RNA, 21 nt, Yersinia pestis
uaaucgccugcugagccaaau

SEQ ID NO: 2273890 - RNA, 22 nt, Yersinia pestis
uaacgaucgcuuaacgaggcgc

SEQ ID NO: 2273891 - RNA, 18 nt, Yersinia pestis
uaacgauauaauagcugg

SEQ ID NO: 2273892 - RNA, 14 nt, Yersinia pestis
uaacgauuauuaaa

SEQ ID NO: 2273893 - RNA, 22 nt, Yersinia pestis
uaauccgccugagauuaaccgc

SEQ ID NO: 2273894 - RNA, 18 nt, Yersinia pestis
uaaucgggaaauugugau

SEQ ID NO: 2273895 - RNA, 23 nt, Yersinia pestis
uaaucgucuuguuggucaccacu

SEQ ID NO: 2273896 - RNA, 17 nt, Yersinia pestis
uaaucguggugaagaau

SEQ ID NO: 2273897 - RNA, 14 nt, Yersinia pestis
uaaucugaucuguu

SEQ ID NO: 2273898 - RNA, 13 nt, Yersinia pestis
uaaucuccaucau

SEQ ID NO: 2273899 - RNA, 15 nt, Yersinia pestis
uaaucuccaucaugg

SEQ ID NO: 2273900 - RNA, 15 nt, Yersinia pestis
uaaucuccauugauu

SEQ ID NO: 2273901 - RNA, 15 nt, Yersinia pestis
uacagcucaucacca

SEQ ID NO: 2273902 - RNA, 19 nt, Yersinia pestis
uacaguuccuguuuuugaa

SEQ ID NO: 2273903 - RNA, 17 nt, Yersinia pestis
uacaggccacacaccag

SEQ ID NO: 2273904 - RNA, 14 nt, Yersinia pestis
uacagcaaauaggu

SEQ ID NO: 2273905 - RNA, 17 nt, Yersinia pestis
uacagcaaauagguuuu

SEQ ID NO: 2273906 - RNA, 23 nt, Yersinia pestis
uacagcaaacaucgguaaaucgc

SEQ ID NO: 2273907 - RNA, 14 nt, Yersinia pestis
uacagcaaauaccg

SEQ ID NO: 2273908 - RNA, 12 nt, Yersinia pestis
uacagcaccauu

SEQ ID NO: 2273909 - RNA, 14 nt, Yersinia pestis
uacagcaccauuca

SEQ ID NO: 2273910 - RNA, 22 nt, Yersinia pestis
uacagcaccauucaauguaaaa

SEQ ID NO: 2273911 - RNA, 16 nt, Yersinia pestis
uacagccguguagcau

SEQ ID NO: 2273912 - RNA, 23 nt, Yersinia pestis
uacagcgcaucggaucaauuuga

SEQ ID NO: 2273913 - RNA, 19 nt, Yersinia pestis
uacagcccgguaucaccuu

SEQ ID NO: 2273914 - RNA, 23 nt, Yersinia pestis
uacauaaaccgugugcuuccacc

SEQ ID NO: 2273915 - RNA, 18 nt, Yersinia pestis
uacauaggucuuuacgca

SEQ ID NO: 2273916 - RNA, 22 nt, Yersinia pestis
uacauaucuuuauuaucaaugg

SEQ ID NO: 2273917 - RNA, 14 nt, Yersinia pestis
uacauauaucacua

SEQ ID NO: 2273918 - RNA, 18 nt, Yersinia pestis
uacauauaucacuauuuc

SEQ ID NO: 2273919 - RNA, 18 nt, Yersinia pestis
uacauauaggaaaugucg

SEQ ID NO: 2273920 - RNA, 20 nt, Yersinia pestis
uacauauaaccaucaaauac

SEQ ID NO: 2273921 - RNA, 16 nt, Yersinia pestis
uacauauaaccaucaa

SEQ ID NO: 2273922 - RNA, 16 nt, Yersinia pestis
uacaugcguaaaugaa

SEQ ID NO: 2273923 - RNA, 16 nt, Yersinia pestis
uaccaauaccauuuua

SEQ ID NO: 2273924 - RNA, 19 nt, Yersinia pestis
uaccaagacuucaugacua

SEQ ID NO: 2273925 - RNA, 13 nt, Yersinia pestis
uacauuuuuaaca

SEQ ID NO: 2273926 - RNA, 15 nt, Yersinia pestis
uacacuggcagugcc

SEQ ID NO: 2273927 - RNA, 20 nt, Yersinia pestis
uacacugauugaaguccugg

SEQ ID NO: 2273928 - RNA, 19 nt, Yersinia pestis
uacacucggucgaucgcuu

SEQ ID NO: 2273929 - RNA, 21 nt, Yersinia pestis
uacacgugagaauugcugcuu

SEQ ID NO: 2273930 - RNA, 13 nt, Yersinia pestis
uacacgauaaaau

SEQ ID NO: 2273931 - RNA, 14 nt, Yersinia pestis
uacacgauaaaaua

SEQ ID NO: 2273932 - RNA, 14 nt, Yersinia pestis
uacaccauuuucaa

SEQ ID NO: 2273933 - RNA, 17 nt, Yersinia pestis
uacaccagacucugcua

SEQ ID NO: 2273934 - RNA, 23 nt, Yersinia pestis
uacaccaccgccgcaacaauaaa

SEQ ID NO: 2273935 - RNA, 16 nt, Yersinia pestis
uacacuuaaucuuauu

SEQ ID NO: 2273936 - RNA, 13 nt, Yersinia pestis
uacagaauuucau

SEQ ID NO: 2273937 - RNA, 16 nt, Yersinia pestis
uacaaccaacaaacaa

SEQ ID NO: 2273938 - RNA, 14 nt, Yersinia pestis
uacaaccaacaaac

SEQ ID NO: 2273939 - RNA, 15 nt, Yersinia pestis
uaauuuuauuaccaa

SEQ ID NO: 2273940 - RNA, 23 nt, Yersinia pestis
uaauuuuaacccgcuuaaucaua

SEQ ID NO: 2273941 - RNA, 21 nt, Yersinia pestis
uacaaccguuacgauaaucuc

SEQ ID NO: 2273942 - RNA, 14 nt, Yersinia pestis
uacaaccuaccacc

SEQ ID NO: 2273943 - RNA, 18 nt, Yersinia pestis
uacaaccuaccaccuacc

SEQ ID NO: 2273944 - RNA, 19 nt, Yersinia pestis
uacaaccuaucccccuucc

SEQ ID NO: 2273945 - RNA, 13 nt, Yersinia pestis
uacacaagucauu

SEQ ID NO: 2273946 - RNA, 15 nt, Yersinia pestis
uacacaauaggcuau

SEQ ID NO: 2273947 - RNA, 23 nt, Yersinia pestis
uacacaauaggcuauuuuacuug

SEQ ID NO: 2273948 - RNA, 13 nt, Yersinia pestis
uacacacucagua

SEQ ID NO: 2273949 - RNA, 14 nt, Yersinia pestis
uacacacucaguac

SEQ ID NO: 2273950 - RNA, 15 nt, Yersinia pestis
uacacacucaguaca

SEQ ID NO: 2273951 - RNA, 15 nt, Yersinia pestis
uauuucgugauuuuc

SEQ ID NO: 2273952 - RNA, 23 nt, Yersinia pestis
uauuucgccuuucauacaucauu

SEQ ID NO: 2273953 - RNA, 18 nt, Yersinia pestis
uauuuccacgacaugagc

SEQ ID NO: 2273954 - RNA, 14 nt, Yersinia pestis
uauuucauuagauc

SEQ ID NO: 2273955 - RNA, 13 nt, Yersinia pestis
uauuucuucauac

SEQ ID NO: 2273956 - RNA, 16 nt, Yersinia pestis
uauuucuuagagagag

SEQ ID NO: 2273957 - RNA, 12 nt, Yersinia pestis
uauuucucucua

SEQ ID NO: 2273958 - RNA, 20 nt, Yersinia pestis
uauuugagauauaggcaucu

SEQ ID NO: 2273959 - RNA, 16 nt, Yersinia pestis
uauuugaaauacuuau

SEQ ID NO: 2273960 - RNA, 21 nt, Yersinia pestis
uauuugaaauacuuauuugaa

SEQ ID NO: 2273961 - RNA, 13 nt, Yersinia pestis
uauuugaacuuca

SEQ ID NO: 2273962 - RNA, 15 nt, Yersinia pestis
uauuugaaauacuua

SEQ ID NO: 2273963 - RNA, 14 nt, Yersinia pestis
uauuuggcauucau

SEQ ID NO: 2273964 - RNA, 17 nt, Yersinia pestis
uauuuguacauccaacu

SEQ ID NO: 2273965 - RNA, 16 nt, Yersinia pestis
uauuugggguauauau

SEQ ID NO: 2273966 - RNA, 17 nt, Yersinia pestis
uauuuggugaguaaaug

SEQ ID NO: 2273967 - RNA, 22 nt, Yersinia pestis
uauuuggauuaaguccaagaag

SEQ ID NO: 2273968 - RNA, 13 nt, Yersinia pestis
uauuugcagaaag

SEQ ID NO: 2273969 - RNA, 23 nt, Yersinia pestis
uauuugcagcggaugauaaauau

SEQ ID NO: 2273970 - RNA, 18 nt, Yersinia pestis
uauuugcagaaaguaauc

SEQ ID NO: 2273971 - RNA, 24 nt, Yersinia pestis
uauuugcagaaaguaaucuuugag

SEQ ID NO: 2273972 - RNA, 15 nt, Yersinia pestis
uauuugcgugaaaac

SEQ ID NO: 2273973 - RNA, 20 nt, Yersinia pestis
uauuugccguauucagcagu

SEQ ID NO: 2273974 - RNA, 14 nt, Yersinia pestis
uauuuguaguuuuu

SEQ ID NO: 2273975 - RNA, 18 nt, Yersinia pestis
uauuuguaucaaugaaaa

SEQ ID NO: 2273976 - RNA, 22 nt, Yersinia pestis
uauuuguagugacguaaaaagg

SEQ ID NO: 2273977 - RNA, 18 nt, Yersinia pestis
uauuugucgcauuuauuu

SEQ ID NO: 2273978 - RNA, 23 nt, Yersinia pestis
uauuuuaucccaaaagaagacaa

SEQ ID NO: 2273979 - RNA, 16 nt, Yersinia pestis
uauuuuaucuuuuagu

SEQ ID NO: 2273980 - RNA, 17 nt, Yersinia pestis
uauuuuaucuacuucua

SEQ ID NO: 2273981 - RNA, 16 nt, Yersinia pestis
uauuuuauuuaaaauu

SEQ ID NO: 2273982 - RNA, 13 nt, Yersinia pestis
uauuuuauuuaau

SEQ ID NO: 2273983 - RNA, 18 nt, Yersinia pestis
uauuuuggguauauaguu

SEQ ID NO: 2273984 - RNA, 23 nt, Yersinia pestis
uauuuugggcuaaaacucaaaua

SEQ ID NO: 2273985 - RNA, 14 nt, Yersinia pestis
uauuuuuaauuuag

SEQ ID NO: 2273986 - RNA, 15 nt, Yersinia pestis
uauuuucuauaccaa

SEQ ID NO: 2273987 - RNA, 18 nt, Yersinia pestis
uauuuucauuauuuucaa

SEQ ID NO: 2273988 - RNA, 21 nt, Yersinia pestis
uauuuucugauguguauauuu

SEQ ID NO: 2273989 - RNA, 19 nt, Yersinia pestis
ucaaagacuaaccucugca

SEQ ID NO: 2273990 - RNA, 13 nt, Yersinia pestis
ucaaaguaaaaua

SEQ ID NO: 2273991 - RNA, 12 nt, Yersinia pestis
ucaaauaaguau

SEQ ID NO: 2273992 - RNA, 14 nt, Yersinia pestis
ucaaaauaaaaauu

SEQ ID NO: 2273993 - RNA, 15 nt, Yersinia pestis
ucaaaauaaaucagu

SEQ ID NO: 2273994 - RNA, 13 nt, Yersinia pestis
ucaaaauacccau

SEQ ID NO: 2273995 - RNA, 16 nt, Yersinia pestis
ucaaaauagaggaaau

SEQ ID NO: 2273996 - RNA, 22 nt, Yersinia pestis
ucaaaauacuuaacaaucagug

SEQ ID NO: 2273997 - RNA, 21 nt, Yersinia pestis
ucaaaauagaggaaauaaaug

SEQ ID NO: 2273998 - RNA, 21 nt, Yersinia pestis
ucaaaccgccagccacgcaga

SEQ ID NO: 2273999 - RNA, 17 nt, Yersinia pestis
ucaaacggugugcaaug

SEQ ID NO: 2274000 - RNA, 17 nt, Yersinia pestis
ucaaacggcuuuuuaaa

SEQ ID NO: 2274001 - RNA, 18 nt, Yersinia pestis
ucaaacgggugauguuua

SEQ ID NO: 2274002 - RNA, 20 nt, Yersinia pestis
ucaaacgaucaguuaaucaa

SEQ ID NO: 2274003 - RNA, 18 nt, Yersinia pestis
uauuuuugcauauaaaac

SEQ ID NO: 2274004 - RNA, 14 nt, Yersinia pestis
ucaaaaaagccccc

SEQ ID NO: 2274005 - RNA, 20 nt, Yersinia pestis
uauuuuuucuuucaccagug

SEQ ID NO: 2274006 - RNA, 14 nt, Yersinia pestis
ucaaaaacccauua

SEQ ID NO: 2274007 - RNA, 20 nt, Yersinia pestis
ucaaaaacccauuaaaaaca

SEQ ID NO: 2274008 - RNA, 18 nt, Yersinia pestis
ucaaaaauuaaauuaaua

SEQ ID NO: 2274009 - RNA, 12 nt, Yersinia pestis
ucaaaacaauau

SEQ ID NO: 2274010 - RNA, 22 nt, Yersinia pestis
uauugagcauauucaguaacaa

SEQ ID NO: 2274011 - RNA, 22 nt, Yersinia pestis
uauugagcguuauaacaaccuc

SEQ ID NO: 2274012 - RNA, 16 nt, Yersinia pestis
uauugaggacaauuca

SEQ ID NO: 2274013 - RNA, 15 nt, Yersinia pestis
uauugauaaaaccac

SEQ ID NO: 2274014 - RNA, 20 nt, Yersinia pestis
uauugauauagcgguaaccg

SEQ ID NO: 2274015 - RNA, 21 nt, Yersinia pestis
uauugccgaucgaugggugaa

SEQ ID NO: 2274016 - RNA, 17 nt, Yersinia pestis
uauugccgcagauaaau

SEQ ID NO: 2274017 - RNA, 16 nt, Yersinia pestis
uauugccgcaguccaa

SEQ ID NO: 2274018 - RNA, 22 nt, Yersinia pestis
uauugauuaagcggcaauaaca

SEQ ID NO: 2274019 - RNA, 22 nt, Yersinia pestis
uauucugcuuccaggauauuca

SEQ ID NO: 2274020 - RNA, 16 nt, Yersinia pestis
uauucugcuuuuugcu

SEQ ID NO: 2274021 - RNA, 15 nt, Yersinia pestis
uauugagaagaaauc

SEQ ID NO: 2274022 - RNA, 14 nt, Yersinia pestis
uauuguaagucagc

SEQ ID NO: 2274023 - RNA, 22 nt, Yersinia pestis
uauuggucguaccaauggugcc

SEQ ID NO: 2274024 - RNA, 15 nt, Yersinia pestis
uauuguauaaaacac

SEQ ID NO: 2274025 - RNA, 18 nt, Yersinia pestis
uauugcugaguaaauuaa

SEQ ID NO: 2274026 - RNA, 22 nt, Yersinia pestis
uauuguggggccuuuauucauu

SEQ ID NO: 2274027 - RNA, 18 nt, Yersinia pestis
uauuuaaaauuaauaguu

SEQ ID NO: 2274028 - RNA, 17 nt, Yersinia pestis
uauuguccaaaggaagg

SEQ ID NO: 2274029 - RNA, 19 nt, Yersinia pestis
uauugucuuuaauaaaauc

SEQ ID NO: 2274030 - RNA, 16 nt, Yersinia pestis
uauuucacguucauca

SEQ ID NO: 2274031 - RNA, 20 nt, Yersinia pestis
uauuucacguucaucaauac

SEQ ID NO: 2274032 - RNA, 17 nt, Yersinia pestis
uauuucaugauucucua

SEQ ID NO: 2274033 - RNA, 16 nt, Yersinia pestis
uauuucaaauaagugu

SEQ ID NO: 2274034 - RNA, 15 nt, Yersinia pestis
uauuuauuuuuucuu

SEQ ID NO: 2274035 - RNA, 21 nt, Yersinia pestis
uauuucaaauaaguguuucaa

SEQ ID NO: 2274036 - RNA, 21 nt, Yersinia pestis
uauuuauuuccagaucagcac

SEQ ID NO: 2274037 - RNA, 12 nt, Yersinia pestis
uauuuauuuccg

SEQ ID NO: 2274038 - RNA, 13 nt, Yersinia pestis
uauuuauugugag

SEQ ID NO: 2274039 - RNA, 14 nt, Yersinia pestis
uauuuauuuaauuu

SEQ ID NO: 2274040 - RNA, 20 nt, Yersinia pestis
uauuuauuuuuaugguuuuu

SEQ ID NO: 2274041 - RNA, 16 nt, Yersinia pestis
uauuuauuuuccccua

SEQ ID NO: 2274042 - RNA, 15 nt, Yersinia pestis
uauuuauuuuauaau

SEQ ID NO: 2274043 - RNA, 19 nt, Yersinia pestis
uauuuauccugugauucag

SEQ ID NO: 2274044 - RNA, 22 nt, Yersinia pestis
uauuuauccugugauucagcca

SEQ ID NO: 2274045 - RNA, 17 nt, Yersinia pestis
uauuuaucugcauuaaa

SEQ ID NO: 2274046 - RNA, 14 nt, Yersinia pestis
uauuuauuaaucua

SEQ ID NO: 2274047 - RNA, 16 nt, Yersinia pestis
uauuuauuaauucuuu

SEQ ID NO: 2274048 - RNA, 24 nt, Yersinia pestis
uauuuauucgacuguuuuuacaau

SEQ ID NO: 2274049 - RNA, 16 nt, Yersinia pestis
uauuuacuggaagcua

SEQ ID NO: 2274050 - RNA, 17 nt, Yersinia pestis
uauuuacggcgucuuua

SEQ ID NO: 2274051 - RNA, 15 nt, Yersinia pestis
uauuuaccugcucaa

SEQ ID NO: 2274052 - RNA, 15 nt, Yersinia pestis
uauuuaacaaaaaau

SEQ ID NO: 2274053 - RNA, 19 nt, Yersinia pestis
uauuuaaauuuuuauauaa

SEQ ID NO: 2274054 - RNA, 13 nt, Yersinia pestis
uauuuaaauuaca

SEQ ID NO: 2274055 - RNA, 19 nt, Yersinia pestis
uauuuauaugauaauaguu

SEQ ID NO: 2274056 - RNA, 14 nt, Yersinia pestis
uauuuauaugauaa

SEQ ID NO: 2274057 - RNA, 16 nt, Yersinia pestis
uauuuagagcguccug

SEQ ID NO: 2274058 - RNA, 21 nt, Yersinia pestis
uauuuagccugccaauaucca

SEQ ID NO: 2274059 - RNA, 14 nt, Yersinia pestis
uauuuaggcuacag

SEQ ID NO: 2274060 - RNA, 15 nt, Yersinia pestis
uauuuauaaaaccac

SEQ ID NO: 2274061 - RNA, 14 nt, Yersinia pestis
uauucugccuaucc

SEQ ID NO: 2274062 - RNA, 15 nt, Yersinia pestis
uauucucaucaucau

SEQ ID NO: 2274063 - RNA, 15 nt, Yersinia pestis
uauucgcguuucauu

SEQ ID NO: 2274064 - RNA, 15 nt, Yersinia pestis
uauucuauugaggac

SEQ ID NO: 2274065 - RNA, 20 nt, Yersinia pestis
uauuccacagaguauacaua

SEQ ID NO: 2274066 - RNA, 18 nt, Yersinia pestis
uauuccacauacaaagca

SEQ ID NO: 2274067 - RNA, 21 nt, Yersinia pestis
uauucgccagauugccaauca

SEQ ID NO: 2274068 - RNA, 17 nt, Yersinia pestis
uauucacguuuuuccau

SEQ ID NO: 2274069 - RNA, 17 nt, Yersinia pestis
uauucagcagcauuucu

SEQ ID NO: 2274070 - RNA, 11 nt, Yersinia pestis
uauucagcaag

SEQ ID NO: 2274071 - RNA, 12 nt, Yersinia pestis
uauucagcaagc

SEQ ID NO: 2274072 - RNA, 18 nt, Yersinia pestis
uauuauuuacacuuaauc

SEQ ID NO: 2274073 - RNA, 15 nt, Yersinia pestis
uauucaccacacaua

SEQ ID NO: 2274074 - RNA, 12 nt, Yersinia pestis
uauucauauuuc

SEQ ID NO: 2274075 - RNA, 14 nt, Yersinia pestis
uauucauauuucuu

SEQ ID NO: 2274076 - RNA, 15 nt, Yersinia pestis
uauucauauuucuuu

SEQ ID NO: 2274077 - RNA, 17 nt, Yersinia pestis
uauucauauuucuuuga

SEQ ID NO: 2274078 - RNA, 20 nt, Yersinia pestis
uauucauaaaucaguacuau

SEQ ID NO: 2274079 - RNA, 16 nt, Yersinia pestis
uauucaguaaaaacug

SEQ ID NO: 2274080 - RNA, 20 nt, Yersinia pestis
uauucauaucgcuaaaacac

SEQ ID NO: 2274081 - RNA, 11 nt, Yersinia pestis
uauucauaagu

SEQ ID NO: 2274082 - RNA, 20 nt, Yersinia pestis
uauucauaagucagugcuau

SEQ ID NO: 2274083 - RNA, 16 nt, Yersinia pestis
uauccaucugaugagu

SEQ ID NO: 2274084 - RNA, 16 nt, Yersinia pestis
uauuacugucaaugcu

SEQ ID NO: 2274085 - RNA, 19 nt, Yersinia pestis
uauuacgcagccauaccca

SEQ ID NO: 2274086 - RNA, 18 nt, Yersinia pestis
uauuaccugcuauuuuau

SEQ ID NO: 2274087 - RNA, 23 nt, Yersinia pestis
uauccgcuuuggucaacagcaaa

SEQ ID NO: 2274088 - RNA, 21 nt, Yersinia pestis
uauuauugcuaaguacuaucu

SEQ ID NO: 2274089 - RNA, 15 nt, Yersinia pestis
uauuauuaauguaca

SEQ ID NO: 2274090 - RNA, 13 nt, Yersinia pestis
uauuauuacuaga

SEQ ID NO: 2274091 - RNA, 20 nt, Yersinia pestis
uauuagagagugauuccagc

SEQ ID NO: 2274092 - RNA, 21 nt, Yersinia pestis
uauuagccgccagucauucac

SEQ ID NO: 2274093 - RNA, 22 nt, Yersinia pestis
uauuagcgauagccugaugaga

SEQ ID NO: 2274094 - RNA, 13 nt, Yersinia pestis
uauuaggccgcga

SEQ ID NO: 2274095 - RNA, 21 nt, Yersinia pestis
ucaaauccggauuucuaccag

SEQ ID NO: 2274096 - RNA, 20 nt, Yersinia pestis
ucaaaucgccaaacugcuca

SEQ ID NO: 2274097 - RNA, 22 nt, Yersinia pestis
ucaaaucugcuccaucaauaac

SEQ ID NO: 2274098 - RNA, 20 nt, Yersinia pestis
ucaacggguaauuuacugac

SEQ ID NO: 2274099 - RNA, 17 nt, Yersinia pestis
ucaacugcucaacugcu

SEQ ID NO: 2274100 - RNA, 19 nt, Yersinia pestis
ucaacugcucaacugcuca

SEQ ID NO: 2274101 - RNA, 19 nt, Yersinia pestis
ucaacguguuguuuucaug

SEQ ID NO: 2274102 - RNA, 19 nt, Yersinia pestis
ucaagaaccgaaauaucau

SEQ ID NO: 2274103 - RNA, 14 nt, Yersinia pestis
ucaagaaauuuaaa

SEQ ID NO: 2274104 - RNA, 19 nt, Yersinia pestis
ucaagacucaguaaauaua

SEQ ID NO: 2274105 - RNA, 15 nt, Yersinia pestis
ucaagacaacaaaca

SEQ ID NO: 2274106 - RNA, 22 nt, Yersinia pestis
ucaagaccgauuuguaagcgga

SEQ ID NO: 2274107 - RNA, 15 nt, Yersinia pestis
ucaagaccugccaau

SEQ ID NO: 2274108 - RNA, 16 nt, Yersinia pestis
ucaaggcggcagagcc

SEQ ID NO: 2274109 - RNA, 15 nt, Yersinia pestis
ucaaggcuacccaau

SEQ ID NO: 2274110 - RNA, 16 nt, Yersinia pestis
ucaaggccuucugggc

SEQ ID NO: 2274111 - RNA, 19 nt, Yersinia pestis
ucaagguacccauuauucu

SEQ ID NO: 2274112 - RNA, 19 nt, Yersinia pestis
ucaagcaccucaagaaauu

SEQ ID NO: 2274113 - RNA, 19 nt, Yersinia pestis
ucaagaucaaaagcagaga

SEQ ID NO: 2274114 - RNA, 15 nt, Yersinia pestis
ucaagaugcagggcg

SEQ ID NO: 2274115 - RNA, 14 nt, Yersinia pestis
ucaagccaguaacu

SEQ ID NO: 2274116 - RNA, 15 nt, Yersinia pestis
ucaagccguguaaau

SEQ ID NO: 2274117 - RNA, 20 nt, Yersinia pestis
ucaagcgcaucggaaaucug

SEQ ID NO: 2274118 - RNA, 17 nt, Yersinia pestis
ucaagccgauaaucccu

SEQ ID NO: 2274119 - RNA, 20 nt, Yersinia pestis
ucaagcccaguuuugcucug

SEQ ID NO: 2274120 - RNA, 21 nt, Yersinia pestis
ucaagcauugucauggccuga

SEQ ID NO: 2274121 - RNA, 15 nt, Yersinia pestis
ucaagccaccgcugg

SEQ ID NO: 2274122 - RNA, 15 nt, Yersinia pestis
ucaaugcagaugcca

SEQ ID NO: 2274123 - RNA, 14 nt, Yersinia pestis
ucaaugccuuggca

SEQ ID NO: 2274124 - RNA, 23 nt, Yersinia pestis
ucaauggauucuugcugcaaccg

SEQ ID NO: 2274125 - RNA, 15 nt, Yersinia pestis
ucaaugcuuuccgca

SEQ ID NO: 2274126 - RNA, 14 nt, Yersinia pestis
ucaaucucaucaau

SEQ ID NO: 2274127 - RNA, 16 nt, Yersinia pestis
ucaaugaaaaaaagaa

SEQ ID NO: 2274128 - RNA, 16 nt, Yersinia pestis
ucaaucguuuuaauuu

SEQ ID NO: 2274129 - RNA, 23 nt, Yersinia pestis
ucaaucguuuuaauuugccuuca

SEQ ID NO: 2274130 - RNA, 14 nt, Yersinia pestis
ucaaucggcagugc

SEQ ID NO: 2274131 - RNA, 19 nt, Yersinia pestis
ucaaucgucaauccaauca

SEQ ID NO: 2274132 - RNA, 15 nt, Yersinia pestis
ucaaucgcuuucugu

SEQ ID NO: 2274133 - RNA, 17 nt, Yersinia pestis
ucaaucgcgaugaaggc

SEQ ID NO: 2274134 - RNA, 16 nt, Yersinia pestis
ucaaguggucuaucau

SEQ ID NO: 2274135 - RNA, 21 nt, Yersinia pestis
ucaaguggucuaucauuuacg

SEQ ID NO: 2274136 - RNA, 16 nt, Yersinia pestis
ucaaguccugcuucaa

SEQ ID NO: 2274137 - RNA, 15 nt, Yersinia pestis
ucaauauuaauaaug

SEQ ID NO: 2274138 - RNA, 16 nt, Yersinia pestis
ucaauauuaauaaugc

SEQ ID NO: 2274139 - RNA, 22 nt, Yersinia pestis
ucaaucaauugcccccaucacu

SEQ ID NO: 2274140 - RNA, 19 nt, Yersinia pestis
ucaaucaccgaaucaccga

SEQ ID NO: 2274141 - RNA, 15 nt, Yersinia pestis
ucaaucaauugcccc

SEQ ID NO: 2274142 - RNA, 19 nt, Yersinia pestis
ucaauccggcacaggcucu

SEQ ID NO: 2274143 - RNA, 22 nt, Yersinia pestis
ucaauccuacaauaucuucccu

SEQ ID NO: 2274144 - RNA, 18 nt, Yersinia pestis
ucaauguuggcccaagau

SEQ ID NO: 2274145 - RNA, 13 nt, Yersinia pestis
ucaauuaucaaaa

SEQ ID NO: 2274146 - RNA, 20 nt, Yersinia pestis
ucacaacuuuuauuggcauu

SEQ ID NO: 2274147 - RNA, 21 nt, Yersinia pestis
ucacaagccacgccauucauu

SEQ ID NO: 2274148 - RNA, 18 nt, Yersinia pestis
ucacaauacagcaaauag

SEQ ID NO: 2274149 - RNA, 21 nt, Yersinia pestis
ucacaauacagcaaauagguu

SEQ ID NO: 2274150 - RNA, 22 nt, Yersinia pestis
ucacaauacagcaaauagguuu

SEQ ID NO: 2274151 - RNA, 16 nt, Yersinia pestis
ucacaaucucuggcaa

SEQ ID NO: 2274152 - RNA, 18 nt, Yersinia pestis
ucacaccgagauauuauu

SEQ ID NO: 2274153 - RNA, 12 nt, Yersinia pestis
ucacgaauagcg

SEQ ID NO: 2274154 - RNA, 20 nt, Yersinia pestis
ucacgacaagucaugguaca

SEQ ID NO: 2274155 - RNA, 13 nt, Yersinia pestis
ucaccuuggaaaa

SEQ ID NO: 2274156 - RNA, 18 nt, Yersinia pestis
ucacgagggcuuaugcuu

SEQ ID NO: 2274157 - RNA, 14 nt, Yersinia pestis
ucacgacgcgaugc

SEQ ID NO: 2274158 - RNA, 15 nt, Yersinia pestis
ucacgauagccagug

SEQ ID NO: 2274159 - RNA, 15 nt, Yersinia pestis
ucacgauggaaaaaa

SEQ ID NO: 2274160 - RNA, 16 nt, Yersinia pestis
ucaccuugauuaauaa

SEQ ID NO: 2274161 - RNA, 14 nt, Yersinia pestis
ucaccugcuuaguu

SEQ ID NO: 2274162 - RNA, 17 nt, Yersinia pestis
ucaccugucaccuacca

SEQ ID NO: 2274163 - RNA, 16 nt, Yersinia pestis
ucaccugucaccuguc

SEQ ID NO: 2274164 - RNA, 12 nt, Yersinia pestis
ucaccuggccag

SEQ ID NO: 2274165 - RNA, 15 nt, Yersinia pestis
ucaccucaaccugcc

SEQ ID NO: 2274166 - RNA, 22 nt, Yersinia pestis
ucaccuauaauuaacagcauca

SEQ ID NO: 2274167 - RNA, 12 nt, Yersinia pestis
ucaccucaucag

SEQ ID NO: 2274168 - RNA, 13 nt, Yersinia pestis
ucaccucaucagu

SEQ ID NO: 2274169 - RNA, 12 nt, Yersinia pestis
ucaccuaaauca

SEQ ID NO: 2274170 - RNA, 16 nt, Yersinia pestis
ucaccuaaaucaauaa

SEQ ID NO: 2274171 - RNA, 14 nt, Yersinia pestis
ucaccuaaaucaua

SEQ ID NO: 2274172 - RNA, 16 nt, Yersinia pestis
ucaccuaaaucauaca

SEQ ID NO: 2274173 - RNA, 17 nt, Yersinia pestis
ucaccuaaauuucgucc

SEQ ID NO: 2274174 - RNA, 13 nt, Yersinia pestis
ucaccuaccaccu

SEQ ID NO: 2274175 - RNA, 14 nt, Yersinia pestis
ucaccuaccaccua

SEQ ID NO: 2274176 - RNA, 21 nt, Yersinia pestis
ucaccuaccgguguugagguc

SEQ ID NO: 2274177 - RNA, 15 nt, Yersinia pestis
ucacguacugggugu

SEQ ID NO: 2274178 - RNA, 14 nt, Yersinia pestis
ucacuaaaacugaa

SEQ ID NO: 2274179 - RNA, 16 nt, Yersinia pestis
ucacuaaaccuugaau

SEQ ID NO: 2274180 - RNA, 17 nt, Yersinia pestis
ucacgguucaccccuca

SEQ ID NO: 2274181 - RNA, 21 nt, Yersinia pestis
ucacuaaauccaaaugcccau

SEQ ID NO: 2274182 - RNA, 18 nt, Yersinia pestis
ucacuaacgacagauuag

SEQ ID NO: 2274183 - RNA, 14 nt, Yersinia pestis
ucacuacagcauuu

SEQ ID NO: 2274184 - RNA, 13 nt, Yersinia pestis
ucacucauaauuu

SEQ ID NO: 2274185 - RNA, 21 nt, Yersinia pestis
ucacuauuucguguauaucac

SEQ ID NO: 2274186 - RNA, 12 nt, Yersinia pestis
ucacuauuucag

SEQ ID NO: 2274187 - RNA, 20 nt, Yersinia pestis
ucacuauuucaggcauauca

SEQ ID NO: 2274188 - RNA, 19 nt, Yersinia pestis
ucacucaagccaguaacua

SEQ ID NO: 2274189 - RNA, 23 nt, Yersinia pestis
ucacucaagccaguaacuacuau

SEQ ID NO: 2274190 - RNA, 20 nt, Yersinia pestis
ucacucaauuggacuaaccc

SEQ ID NO: 2274191 - RNA, 14 nt, Yersinia pestis
ucacgcacgguaca

SEQ ID NO: 2274192 - RNA, 18 nt, Yersinia pestis
ucacgauggaaaaaauac

SEQ ID NO: 2274193 - RNA, 12 nt, Yersinia pestis
ucacgcaaaggg

SEQ ID NO: 2274194 - RNA, 23 nt, Yersinia pestis
ucacgcacucgaaucacuuauug

SEQ ID NO: 2274195 - RNA, 14 nt, Yersinia pestis
ucacgcugaauaac

SEQ ID NO: 2274196 - RNA, 17 nt, Yersinia pestis
ucacgguaguaauaauu

SEQ ID NO: 2274197 - RNA, 18 nt, Yersinia pestis
ucacgguaguaauaauuu

SEQ ID NO: 2274198 - RNA, 18 nt, Yersinia pestis
ucacgguagguuucuggg

SEQ ID NO: 2274199 - RNA, 17 nt, Yersinia pestis
ucacgggcuuccaucag

SEQ ID NO: 2274200 - RNA, 13 nt, Yersinia pestis
ucacgggcuucca

SEQ ID NO: 2274201 - RNA, 20 nt, Yersinia pestis
ucacauuaacuucagguuca

SEQ ID NO: 2274202 - RNA, 17 nt, Yersinia pestis
ucacagaggaaucaaag

SEQ ID NO: 2274203 - RNA, 18 nt, Yersinia pestis
ucacagacguuuaaauaa

SEQ ID NO: 2274204 - RNA, 23 nt, Yersinia pestis
ucacacuggugcugcccaaaauc

SEQ ID NO: 2274205 - RNA, 14 nt, Yersinia pestis
ucacacgcccaggc

SEQ ID NO: 2274206 - RNA, 23 nt, Yersinia pestis
ucaccaauauguucaucagggaa

SEQ ID NO: 2274207 - RNA, 16 nt, Yersinia pestis
ucaccaagcuuuuauc

SEQ ID NO: 2274208 - RNA, 19 nt, Yersinia pestis
ucaccaagaggaaaugccg

SEQ ID NO: 2274209 - RNA, 21 nt, Yersinia pestis
ucaccaaccaaccaucaccau

SEQ ID NO: 2274210 - RNA, 15 nt, Yersinia pestis
ucaccaacaccacca

SEQ ID NO: 2274211 - RNA, 17 nt, Yersinia pestis
ucaccaacaccaccauc

SEQ ID NO: 2274212 - RNA, 20 nt, Yersinia pestis
ucaccaacaccaccaucacu

SEQ ID NO: 2274213 - RNA, 15 nt, Yersinia pestis
ucaccaaaggaagcc

SEQ ID NO: 2274214 - RNA, 20 nt, Yersinia pestis
ucacauuuuuaauaaugugu

SEQ ID NO: 2274215 - RNA, 19 nt, Yersinia pestis
ucaccaaaaucccaaaaua

SEQ ID NO: 2274216 - RNA, 23 nt, Yersinia pestis
ucaccaaaaaaaccaccaaaaua

SEQ ID NO: 2274217 - RNA, 18 nt, Yersinia pestis
ucacccaauaagauaaac

SEQ ID NO: 2274218 - RNA, 14 nt, Yersinia pestis
ucaccauuuauugc

SEQ ID NO: 2274219 - RNA, 15 nt, Yersinia pestis
ucaccauuuauugcc

SEQ ID NO: 2274220 - RNA, 15 nt, Yersinia pestis
ucaccauuauguuca

SEQ ID NO: 2274221 - RNA, 16 nt, Yersinia pestis
ucaccacgucaccuuu

SEQ ID NO: 2274222 - RNA, 16 nt, Yersinia pestis
ucaccagaucuggguu

SEQ ID NO: 2274223 - RNA, 16 nt, Yersinia pestis
ucaccagaugccgcac

SEQ ID NO: 2274224 - RNA, 14 nt, Yersinia pestis
ucaccagacaacca

SEQ ID NO: 2274225 - RNA, 15 nt, Yersinia pestis
ucaccagcaaaggcc

SEQ ID NO: 2274226 - RNA, 15 nt, Yersinia pestis
ucacccauuuuaucc

SEQ ID NO: 2274227 - RNA, 14 nt, Yersinia pestis
ucacccauuuuauc

SEQ ID NO: 2274228 - RNA, 14 nt, Yersinia pestis
ucaccccagucacu

SEQ ID NO: 2274229 - RNA, 12 nt, Yersinia pestis
ucacccagcaaa

SEQ ID NO: 2274230 - RNA, 16 nt, Yersinia pestis
ucaccgaaagaagaca

SEQ ID NO: 2274231 - RNA, 17 nt, Yersinia pestis
ucacccgauacaggcuc

SEQ ID NO: 2274232 - RNA, 14 nt, Yersinia pestis
ucaccgcaaccugu

SEQ ID NO: 2274233 - RNA, 23 nt, Yersinia pestis
ucaccgaugauaagugaauaaau

SEQ ID NO: 2274234 - RNA, 18 nt, Yersinia pestis
ucaccguucaagaucgcg

SEQ ID NO: 2274235 - RNA, 16 nt, Yersinia pestis
ucaccguuacucaggg

SEQ ID NO: 2274236 - RNA, 24 nt, Yersinia pestis
ucaccguagaacgucaccgccaaa

SEQ ID NO: 2274237 - RNA, 20 nt, Yersinia pestis
ucaccguauacgcugaauga

SEQ ID NO: 2274238 - RNA, 16 nt, Yersinia pestis
ucaccgcuuuucuggu

SEQ ID NO: 2274239 - RNA, 12 nt, Yersinia pestis
ucaccgcgggcu

SEQ ID NO: 2274240 - RNA, 16 nt, Yersinia pestis
ucauacacaugaaaau

SEQ ID NO: 2274241 - RNA, 23 nt, Yersinia pestis
ucauacacuaagugcaucaaucg

SEQ ID NO: 2274242 - RNA, 21 nt, Yersinia pestis
ucauacccaaauuacggcuca

SEQ ID NO: 2274243 - RNA, 19 nt, Yersinia pestis
ucauaccuuacuuccaaua

SEQ ID NO: 2274244 - RNA, 13 nt, Yersinia pestis
ucauaauuuugau

SEQ ID NO: 2274245 - RNA, 16 nt, Yersinia pestis
ucauauaagcaauacc

SEQ ID NO: 2274246 - RNA, 22 nt, Yersinia pestis
ucauauacaccgcaccacgauu

SEQ ID NO: 2274247 - RNA, 17 nt, Yersinia pestis
ucauaguuaagacaauu

SEQ ID NO: 2274248 - RNA, 19 nt, Yersinia pestis
ucauacucccccauuuccu

SEQ ID NO: 2274249 - RNA, 22 nt, Yersinia pestis
ucauacugacggggaguuuuua

SEQ ID NO: 2274250 - RNA, 21 nt, Yersinia pestis
ucaucaaaauugauggucugu

SEQ ID NO: 2274251 - RNA, 12 nt, Yersinia pestis
ucaucaaaggca

SEQ ID NO: 2274252 - RNA, 17 nt, Yersinia pestis
ucaucaaaggcaauacc

SEQ ID NO: 2274253 - RNA, 16 nt, Yersinia pestis
ucaucaaguauuuuac

SEQ ID NO: 2274254 - RNA, 15 nt, Yersinia pestis
ucaucaaccucagcc

SEQ ID NO: 2274255 - RNA, 15 nt, Yersinia pestis
ucaucaacgcgccuu

SEQ ID NO: 2274256 - RNA, 18 nt, Yersinia pestis
ucaucaaccucagccuca

SEQ ID NO: 2274257 - RNA, 23 nt, Yersinia pestis
ucaucacccaacguggcuucaau

SEQ ID NO: 2274258 - RNA, 18 nt, Yersinia pestis
ucaucacccagcaaaaua

SEQ ID NO: 2274259 - RNA, 22 nt, Yersinia pestis
ucaucacauucaaacacuuaug

SEQ ID NO: 2274260 - RNA, 15 nt, Yersinia pestis
ucaucaauaccgaaa

SEQ ID NO: 2274261 - RNA, 21 nt, Yersinia pestis
ucauauucaugguuucaaaau

SEQ ID NO: 2274262 - RNA, 13 nt, Yersinia pestis
ucauauugaauaa

SEQ ID NO: 2274263 - RNA, 15 nt, Yersinia pestis
ucauauuguuaauuu

SEQ ID NO: 2274264 - RNA, 20 nt, Yersinia pestis
ucauaucccagcgucuucug

SEQ ID NO: 2274265 - RNA, 15 nt, Yersinia pestis
ucauaucgcuaaaac

SEQ ID NO: 2274266 - RNA, 18 nt, Yersinia pestis
ucauaucgaucaaccauu

SEQ ID NO: 2274267 - RNA, 19 nt, Yersinia pestis
ucauaucgcuaaaacacag

SEQ ID NO: 2274268 - RNA, 19 nt, Yersinia pestis
ucauaugcgccuauaaggc

SEQ ID NO: 2274269 - RNA, 19 nt, Yersinia pestis
ucauaugcgcgucaaucca

SEQ ID NO: 2274270 - RNA, 23 nt, Yersinia pestis
ucaucaucaauggauucuugcug

SEQ ID NO: 2274271 - RNA, 16 nt, Yersinia pestis
ucaucaucacaaauaa

SEQ ID NO: 2274272 - RNA, 18 nt, Yersinia pestis
ucaucauaaaaauacaua

SEQ ID NO: 2274273 - RNA, 19 nt, Yersinia pestis
ucaucaggcggguaacugu

SEQ ID NO: 2274274 - RNA, 13 nt, Yersinia pestis
ucaucacugcuau

SEQ ID NO: 2274275 - RNA, 23 nt, Yersinia pestis
ucauccaacuuaccuugauccgc

SEQ ID NO: 2274276 - RNA, 18 nt, Yersinia pestis
ucauccaacucaccauuu

SEQ ID NO: 2274277 - RNA, 17 nt, Yersinia pestis
ucaucauuauuguccgc

SEQ ID NO: 2274278 - RNA, 15 nt, Yersinia pestis
ucaucaucuucuuca

SEQ ID NO: 2274279 - RNA, 14 nt, Yersinia pestis
ucaucaucgguacc

SEQ ID NO: 2274280 - RNA, 16 nt, Yersinia pestis
ucaucgacucuuuuug

SEQ ID NO: 2274281 - RNA, 23 nt, Yersinia pestis
ucaucgacuugaugaaguuauuu

SEQ ID NO: 2274282 - RNA, 18 nt, Yersinia pestis
ucaucgauugcuggcgcu

SEQ ID NO: 2274283 - RNA, 23 nt, Yersinia pestis
ucaucgauugcuggcgcugauca

SEQ ID NO: 2274284 - RNA, 14 nt, Yersinia pestis
ucaucgcaccauaa

SEQ ID NO: 2274285 - RNA, 20 nt, Yersinia pestis
ucaucgccaaagccgucagu

SEQ ID NO: 2274286 - RNA, 17 nt, Yersinia pestis
ucaucgcucaucgccaa

SEQ ID NO: 2274287 - RNA, 22 nt, Yersinia pestis
ucaucgggaacaggaucugcuc

SEQ ID NO: 2274288 - RNA, 21 nt, Yersinia pestis
ucaucggggguugucugcaga

SEQ ID NO: 2274289 - RNA, 22 nt, Yersinia pestis
ucaucggggguugucugcagaa

SEQ ID NO: 2274290 - RNA, 21 nt, Yersinia pestis
ucaucggcauacuccuuaauc

SEQ ID NO: 2274291 - RNA, 18 nt, Yersinia pestis
ucaucgcggguuuuuaac

SEQ ID NO: 2274292 - RNA, 19 nt, Yersinia pestis
ucaucgcggguuuuuaacu

SEQ ID NO: 2274293 - RNA, 23 nt, Yersinia pestis
ucaucccuaaaaucauugacguu

SEQ ID NO: 2274294 - RNA, 15 nt, Yersinia pestis
ucaucccuaaaauca

SEQ ID NO: 2274295 - RNA, 23 nt, Yersinia pestis
ucaucccaaucaucaucccaguc

SEQ ID NO: 2274296 - RNA, 16 nt, Yersinia pestis
ucaucccaaucaucau

SEQ ID NO: 2274297 - RNA, 19 nt, Yersinia pestis
ucauccgcucagcaaaaau

SEQ ID NO: 2274298 - RNA, 19 nt, Yersinia pestis
ucaucgaaaaaaauacuau

SEQ ID NO: 2274299 - RNA, 19 nt, Yersinia pestis
ucauccugcuauuuaacaa

SEQ ID NO: 2274300 - RNA, 14 nt, Yersinia pestis
ucauccucauugag

SEQ ID NO: 2274301 - RNA, 23 nt, Yersinia pestis
ucauaacuaagagucacagcauu

SEQ ID NO: 2274302 - RNA, 18 nt, Yersinia pestis
ucauaaauuaaaacugaa

SEQ ID NO: 2274303 - RNA, 22 nt, Yersinia pestis
ucauaagucagugcuauucaua

SEQ ID NO: 2274304 - RNA, 21 nt, Yersinia pestis
ucauaagccagugcuauucau

SEQ ID NO: 2274305 - RNA, 22 nt, Yersinia pestis
ucauaagccagugcuauucaua

SEQ ID NO: 2274306 - RNA, 23 nt, Yersinia pestis
ucauaagacuaacagaauauuga

SEQ ID NO: 2274307 - RNA, 16 nt, Yersinia pestis
ucauaaaucacaauuu

SEQ ID NO: 2274308 - RNA, 22 nt, Yersinia pestis
ucauaaaucacaauuucacccc

SEQ ID NO: 2274309 - RNA, 12 nt, Yersinia pestis
ucauaaauauug

SEQ ID NO: 2274310 - RNA, 19 nt, Yersinia pestis
ucaguuuuauuguauaaaa

SEQ ID NO: 2274311 - RNA, 20 nt, Yersinia pestis
ucauaaaaacgcaacacagu

SEQ ID NO: 2274312 - RNA, 13 nt, Yersinia pestis
ucaguuuuaauuu

SEQ ID NO: 2274313 - RNA, 20 nt, Yersinia pestis
ucaguuuuaauuuaugaaca

SEQ ID NO: 2274314 - RNA, 13 nt, Yersinia pestis
ucaguucaguauu

SEQ ID NO: 2274315 - RNA, 14 nt, Yersinia pestis
ucaguuccugauuc

SEQ ID NO: 2274316 - RNA, 20 nt, Yersinia pestis
ucagucgccuuaaaugcgua

SEQ ID NO: 2274317 - RNA, 20 nt, Yersinia pestis
ucagucacuuugggcugauc

SEQ ID NO: 2274318 - RNA, 18 nt, Yersinia pestis
ucagucagggugaaagcc

SEQ ID NO: 2274319 - RNA, 23 nt, Yersinia pestis
ucaggauuggagucaugaggcag

SEQ ID NO: 2274320 - RNA, 11 nt, Yersinia pestis
ucaggaugaac

SEQ ID NO: 2274321 - RNA, 23 nt, Yersinia pestis
ucaggaugaugaauaccaccauc

SEQ ID NO: 2274322 - RNA, 18 nt, Yersinia pestis
ucagggaauucaccggca

SEQ ID NO: 2274323 - RNA, 14 nt, Yersinia pestis
ucagggugaaagcc

SEQ ID NO: 2274324 - RNA, 22 nt, Yersinia pestis
ucaggggcaauuaucuuaucca

SEQ ID NO: 2274325 - RNA, 12 nt, Yersinia pestis
ucagggccacuu

SEQ ID NO: 2274326 - RNA, 19 nt, Yersinia pestis
ucagggcauaagcgcccug

SEQ ID NO: 2274327 - RNA, 18 nt, Yersinia pestis
ucagguugaaauaaauaa

SEQ ID NO: 2274328 - RNA, 19 nt, Yersinia pestis
ucagguugaaauaaauaag

SEQ ID NO: 2274329 - RNA, 16 nt, Yersinia pestis
ucagguguuguauaac

SEQ ID NO: 2274330 - RNA, 20 nt, Yersinia pestis
ucagguguuacacaguuauu

SEQ ID NO: 2274331 - RNA, 14 nt, Yersinia pestis
ucagguaauuuaua

SEQ ID NO: 2274332 - RNA, 18 nt, Yersinia pestis
ucaguaaacgcuaaacca

SEQ ID NO: 2274333 - RNA, 17 nt, Yersinia pestis
ucaguaaagcgcaggaa

SEQ ID NO: 2274334 - RNA, 12 nt, Yersinia pestis
ucaguaaaacca

SEQ ID NO: 2274335 - RNA, 23 nt, Yersinia pestis
ucaguacauaaaccgugugcuuc

SEQ ID NO: 2274336 - RNA, 13 nt, Yersinia pestis
ucaguaccaccac

SEQ ID NO: 2274337 - RNA, 14 nt, Yersinia pestis
ucaguaccaccacc

SEQ ID NO: 2274338 - RNA, 20 nt, Yersinia pestis
ucaguaacuucucucccgcc

SEQ ID NO: 2274339 - RNA, 13 nt, Yersinia pestis
ucaguaauucacc

SEQ ID NO: 2274340 - RNA, 17 nt, Yersinia pestis
ucacugaguugcuggaa

SEQ ID NO: 2274341 - RNA, 14 nt, Yersinia pestis
ucacugugcuuuuc

SEQ ID NO: 2274342 - RNA, 13 nt, Yersinia pestis
ucacuguuagcua

SEQ ID NO: 2274343 - RNA, 17 nt, Yersinia pestis
ucacuguccaagaagcc

SEQ ID NO: 2274344 - RNA, 22 nt, Yersinia pestis
ucacugucuauuuuuauaauca

SEQ ID NO: 2274345 - RNA, 16 nt, Yersinia pestis
ucacuuauucccacuu

SEQ ID NO: 2274346 - RNA, 20 nt, Yersinia pestis
ucacuuagugguucuggccc

SEQ ID NO: 2274347 - RNA, 18 nt, Yersinia pestis
ucacuuaaaaaucaauaa

SEQ ID NO: 2274348 - RNA, 14 nt, Yersinia pestis
ucacuuaaauaacu

SEQ ID NO: 2274349 - RNA, 15 nt, Yersinia pestis
ucagccuguugguca

SEQ ID NO: 2274350 - RNA, 16 nt, Yersinia pestis
ucagccucauucauga

SEQ ID NO: 2274351 - RNA, 13 nt, Yersinia pestis
ucagccauaacuu

SEQ ID NO: 2274352 - RNA, 15 nt, Yersinia pestis
ucagccaucucuggc

SEQ ID NO: 2274353 - RNA, 16 nt, Yersinia pestis
ucagccgcgaaaaacc

SEQ ID NO: 2274354 - RNA, 23 nt, Yersinia pestis
ucagccggagugaugaaaccaaa

SEQ ID NO: 2274355 - RNA, 23 nt, Yersinia pestis
ucagccguaucuucugccagccc

SEQ ID NO: 2274356 - RNA, 20 nt, Yersinia pestis
ucagccgcggcgcuggcaug

SEQ ID NO: 2274357 - RNA, 13 nt, Yersinia pestis
ucaggaagagaaa

SEQ ID NO: 2274358 - RNA, 17 nt, Yersinia pestis
ucaggaucaccagcaaa

SEQ ID NO: 2274359 - RNA, 23 nt, Yersinia pestis
ucagcuucuucugggucuaucag

SEQ ID NO: 2274360 - RNA, 22 nt, Yersinia pestis
ucagcugguuagagcacagcac

SEQ ID NO: 2274361 - RNA, 21 nt, Yersinia pestis
ucagcuugcaacaaaauggcc

SEQ ID NO: 2274362 - RNA, 20 nt, Yersinia pestis
ucagcguuuugaucaucaaa

SEQ ID NO: 2274363 - RNA, 20 nt, Yersinia pestis
ucagcguuggaugaguuuga

SEQ ID NO: 2274364 - RNA, 18 nt, Yersinia pestis
ucagcguggaauuaauau

SEQ ID NO: 2274365 - RNA, 17 nt, Yersinia pestis
ucagcgccuuugccccg

SEQ ID NO: 2274366 - RNA, 13 nt, Yersinia pestis
ucagcuagccugc

SEQ ID NO: 2274367 - RNA, 15 nt, Yersinia pestis
ucauuuuaggugcag

SEQ ID NO: 2274368 - RNA, 22 nt, Yersinia pestis
ucauuuuaaaaaaauuaaaaua

SEQ ID NO: 2274369 - RNA, 14 nt, Yersinia pestis
ucauuuuuuaucuu

SEQ ID NO: 2274370 - RNA, 23 nt, Yersinia pestis
ucauuuuuugggaugaaaaauac

SEQ ID NO: 2274371 - RNA, 14 nt, Yersinia pestis
ucauugguaauuuc

SEQ ID NO: 2274372 - RNA, 16 nt, Yersinia pestis
ucauucugucaucaag

SEQ ID NO: 2274373 - RNA, 17 nt, Yersinia pestis
ucauuuaucuaaaacug

SEQ ID NO: 2274374 - RNA, 21 nt, Yersinia pestis
ucauuuaucuaaaacugccua

SEQ ID NO: 2274375 - RNA, 15 nt, Yersinia pestis
ucauuuaucuaaaac

SEQ ID NO: 2274376 - RNA, 23 nt, Yersinia pestis
ucauuggugcugaugauuuuggu

SEQ ID NO: 2274377 - RNA, 19 nt, Yersinia pestis
ucauugguuaacuuauagc

SEQ ID NO: 2274378 - RNA, 14 nt, Yersinia pestis
ucauuucagguaaa

SEQ ID NO: 2274379 - RNA, 18 nt, Yersinia pestis
ucauuucccccaccugau

SEQ ID NO: 2274380 - RNA, 17 nt, Yersinia pestis
ucauuuccguuaaccca

SEQ ID NO: 2274381 - RNA, 22 nt, Yersinia pestis
ucauuuccguuaacccaaagcc

SEQ ID NO: 2274382 - RNA, 20 nt, Yersinia pestis
ucauuaaccgccgcagguau

SEQ ID NO: 2274383 - RNA, 23 nt, Yersinia pestis
ucauuaagaauccucugaauaaa

SEQ ID NO: 2274384 - RNA, 18 nt, Yersinia pestis
ucauuaauagaaucugcu

SEQ ID NO: 2274385 - RNA, 19 nt, Yersinia pestis
ucauuaauccccaggugcu

SEQ ID NO: 2274386 - RNA, 23 nt, Yersinia pestis
ucauggcgcuuuagccagucacc

SEQ ID NO: 2274387 - RNA, 19 nt, Yersinia pestis
ucauguaaggcaauaccaa

SEQ ID NO: 2274388 - RNA, 22 nt, Yersinia pestis
ucaugguuggauacugcauuuc

SEQ ID NO: 2274389 - RNA, 12 nt, Yersinia pestis
ucauguaacaca

SEQ ID NO: 2274390 - RNA, 13 nt, Yersinia pestis
ucauguaagccaa

SEQ ID NO: 2274391 - RNA, 19 nt, Yersinia pestis
ucauucgacggguuuuacc

SEQ ID NO: 2274392 - RNA, 22 nt, Yersinia pestis
ucauuauuuucaaccaguuaga

SEQ ID NO: 2274393 - RNA, 12 nt, Yersinia pestis
ucauuauuuuca

SEQ ID NO: 2274394 - RNA, 19 nt, Yersinia pestis
ucauuauuuucaaccaguu

SEQ ID NO: 2274395 - RNA, 16 nt, Yersinia pestis
ucauuaccgcacacua

SEQ ID NO: 2274396 - RNA, 14 nt, Yersinia pestis
ucauuacacugaau

SEQ ID NO: 2274397 - RNA, 13 nt, Yersinia pestis
ucauuacaucauc

SEQ ID NO: 2274398 - RNA, 21 nt, Yersinia pestis
ucauuaucccccuaugcuaac

SEQ ID NO: 2274399 - RNA, 18 nt, Yersinia pestis
ucauuauggauaauuuaa

SEQ ID NO: 2274400 - RNA, 19 nt, Yersinia pestis
ucauuauggauaauuuaau

SEQ ID NO: 2274401 - RNA, 14 nt, Yersinia pestis
ucauuaugugucag

SEQ ID NO: 2274402 - RNA, 20 nt, Yersinia pestis
ucauuauuaaacuugcucuu

SEQ ID NO: 2274403 - RNA, 22 nt, Yersinia pestis
ucaugacgaaaaacaccuauuu

SEQ ID NO: 2274404 - RNA, 12 nt, Yersinia pestis
ucaugaggcagu

SEQ ID NO: 2274405 - RNA, 16 nt, Yersinia pestis
ucaugaggcucagacu

SEQ ID NO: 2274406 - RNA, 23 nt, Yersinia pestis
ucaugacaucccagcacaaugca

SEQ ID NO: 2274407 - RNA, 16 nt, Yersinia pestis
ucaugaaugaggcuga

SEQ ID NO: 2274408 - RNA, 13 nt, Yersinia pestis
ucaugacaaaaau

SEQ ID NO: 2274409 - RNA, 13 nt, Yersinia pestis
ucaugacaaagaa

SEQ ID NO: 2274410 - RNA, 14 nt, Yersinia pestis
ucaugacaaagaau

SEQ ID NO: 2274411 - RNA, 12 nt, Yersinia pestis
ucaugaugacuu

SEQ ID NO: 2274412 - RNA, 15 nt, Yersinia pestis
ucaugaugaauacga

SEQ ID NO: 2274413 - RNA, 17 nt, Yersinia pestis
ucaugauagacagcaaa

SEQ ID NO: 2274414 - RNA, 14 nt, Yersinia pestis
ucaugauucucuau

SEQ ID NO: 2274415 - RNA, 21 nt, Yersinia pestis
ucauggccaugaaucaaauua

SEQ ID NO: 2274416 - RNA, 21 nt, Yersinia pestis
ucauggccugaugcaccucag

SEQ ID NO: 2274417 - RNA, 19 nt, Yersinia pestis
ucaugcucacaaucaucgu

SEQ ID NO: 2274418 - RNA, 18 nt, Yersinia pestis
ucaugcugcggguagcau

SEQ ID NO: 2274419 - RNA, 17 nt, Yersinia pestis
ucaugcucuucauaagc

SEQ ID NO: 2274420 - RNA, 21 nt, Yersinia pestis
ucaugcucuucauaagccagu

SEQ ID NO: 2274421 - RNA, 18 nt, Yersinia pestis
ucaugcugaaucuguaag

SEQ ID NO: 2274422 - RNA, 20 nt, Yersinia pestis
ucaugcugucauuggugcug

SEQ ID NO: 2274423 - RNA, 14 nt, Yersinia pestis
ucaugcgcagaaaa

SEQ ID NO: 2274424 - RNA, 16 nt, Yersinia pestis
ucaugccggucugcug

SEQ ID NO: 2274425 - RNA, 17 nt, Yersinia pestis
ucaucuugaaaauaugc

SEQ ID NO: 2274426 - RNA, 17 nt, Yersinia pestis
ucaucuucuucauccca

SEQ ID NO: 2274427 - RNA, 16 nt, Yersinia pestis
ucaucuuuaacaacaa

SEQ ID NO: 2274428 - RNA, 14 nt, Yersinia pestis
ucaucuuuuuuaau

SEQ ID NO: 2274429 - RNA, 22 nt, Yersinia pestis
ucaucuuuuuuuuuauuaucau

SEQ ID NO: 2274430 - RNA, 18 nt, Yersinia pestis
ucaucuuuuucugccuga

SEQ ID NO: 2274431 - RNA, 22 nt, Yersinia pestis
ucaucugcgguaaccaauaaca

SEQ ID NO: 2274432 - RNA, 17 nt, Yersinia pestis
ucaucuacaacaucauc

SEQ ID NO: 2274433 - RNA, 19 nt, Yersinia pestis
ucaucuacaacaucaucgu

SEQ ID NO: 2274434 - RNA, 16 nt, Yersinia pestis
ucaucgggguuuguca

SEQ ID NO: 2274435 - RNA, 21 nt, Yersinia pestis
ucaucgggguuugucagcagu

SEQ ID NO: 2274436 - RNA, 15 nt, Yersinia pestis
ucaucguaaccccca

SEQ ID NO: 2274437 - RNA, 22 nt, Yersinia pestis
uccaaaugacagcaucaauauc

SEQ ID NO: 2274438 - RNA, 23 nt, Yersinia pestis
uccaaaggaagggguucuuccaa

SEQ ID NO: 2274439 - RNA, 12 nt, Yersinia pestis
uccaaaggaagg

SEQ ID NO: 2274440 - RNA, 14 nt, Yersinia pestis
uccaaaggaagggg

SEQ ID NO: 2274441 - RNA, 23 nt, Yersinia pestis
uccacaaacucaugcucuucaua

SEQ ID NO: 2274442 - RNA, 18 nt, Yersinia pestis
uccacauaaaaagaaaaa

SEQ ID NO: 2274443 - RNA, 16 nt, Yersinia pestis
uccaccaaugauuuug

SEQ ID NO: 2274444 - RNA, 21 nt, Yersinia pestis
uccacauauauagagaaaucu

SEQ ID NO: 2274445 - RNA, 19 nt, Yersinia pestis
uccagaccgcguaagccgu

SEQ ID NO: 2274446 - RNA, 15 nt, Yersinia pestis
uccagacaaagugag

SEQ ID NO: 2274447 - RNA, 17 nt, Yersinia pestis
uccagaccgcguaagcc

SEQ ID NO: 2274448 - RNA, 20 nt, Yersinia pestis
uccagauuacgcaucgucag

SEQ ID NO: 2274449 - RNA, 13 nt, Yersinia pestis
uccagaucggcaa

SEQ ID NO: 2274450 - RNA, 23 nt, Yersinia pestis
uccagaugaauauguuccaucag

SEQ ID NO: 2274451 - RNA, 23 nt, Yersinia pestis
uccacucucugcuuacucuucca

SEQ ID NO: 2274452 - RNA, 21 nt, Yersinia pestis
uccacugcggccacucgcauc

SEQ ID NO: 2274453 - RNA, 20 nt, Yersinia pestis
uccacucuuugaguagcagg

SEQ ID NO: 2274454 - RNA, 18 nt, Yersinia pestis
uccagaauaucuucaacu

SEQ ID NO: 2274455 - RNA, 19 nt, Yersinia pestis
uccagaauagagaaaucaa

SEQ ID NO: 2274456 - RNA, 19 nt, Yersinia pestis
uccaccugacgaaaugccg

SEQ ID NO: 2274457 - RNA, 22 nt, Yersinia pestis
uccaccguuuuacucaggauua

SEQ ID NO: 2274458 - RNA, 18 nt, Yersinia pestis
uccagccaccccguggca

SEQ ID NO: 2274459 - RNA, 20 nt, Yersinia pestis
uccagcaacucaagccacuc

SEQ ID NO: 2274460 - RNA, 21 nt, Yersinia pestis
uccagcaccacaauggcagag

SEQ ID NO: 2274461 - RNA, 17 nt, Yersinia pestis
uccagcgaacguaguug

SEQ ID NO: 2274462 - RNA, 15 nt, Yersinia pestis
uccagccugguuggu

SEQ ID NO: 2274463 - RNA, 18 nt, Yersinia pestis
uccagggcaaucaggaaa

SEQ ID NO: 2274464 - RNA, 13 nt, Yersinia pestis
uccaguaauaccu

SEQ ID NO: 2274465 - RNA, 14 nt, Yersinia pestis
uccaguaauaccuu

SEQ ID NO: 2274466 - RNA, 12 nt, Yersinia pestis
uccaguaagcug

SEQ ID NO: 2274467 - RNA, 19 nt, Yersinia pestis
uccaggguuuugaaaucau

SEQ ID NO: 2274468 - RNA, 21 nt, Yersinia pestis
uccauaacauccuaaaaagcg

SEQ ID NO: 2274469 - RNA, 22 nt, Yersinia pestis
uccauaaaaucgaacccuucag

SEQ ID NO: 2274470 - RNA, 20 nt, Yersinia pestis
uccauaaacggaacucaucu

SEQ ID NO: 2274471 - RNA, 23 nt, Yersinia pestis
uccauaaacggaacucaucuuuc

SEQ ID NO: 2274472 - RNA, 15 nt, Yersinia pestis
uccagucccccucac

SEQ ID NO: 2274473 - RNA, 14 nt, Yersinia pestis
uccaguacugacca

SEQ ID NO: 2274474 - RNA, 13 nt, Yersinia pestis
ugauuugaacgac

SEQ ID NO: 2274475 - RNA, 22 nt, Yersinia pestis
ugauuugcuggcgcaaagacuu

SEQ ID NO: 2274476 - RNA, 15 nt, Yersinia pestis
ugcacccauggagau

SEQ ID NO: 2274477 - RNA, 17 nt, Yersinia pestis
ugcacccggccuugccc

SEQ ID NO: 2274478 - RNA, 18 nt, Yersinia pestis
ugcagaagggcggccagc

SEQ ID NO: 2274479 - RNA, 18 nt, Yersinia pestis
ugcagaacaaaagugaaa

SEQ ID NO: 2274480 - RNA, 16 nt, Yersinia pestis
ugcagaaaguaaucuu

SEQ ID NO: 2274481 - RNA, 10 nt, Yersinia pestis
ugcagaaaau

SEQ ID NO: 2274482 - RNA, 15 nt, Yersinia pestis
ugcagccaagauccc

SEQ ID NO: 2274483 - RNA, 17 nt, Yersinia pestis
ugcagcgauauacauca

SEQ ID NO: 2274484 - RNA, 18 nt, Yersinia pestis
ugcagcgauauacaucac

SEQ ID NO: 2274485 - RNA, 13 nt, Yersinia pestis
ugcagacugcuga

SEQ ID NO: 2274486 - RNA, 20 nt, Yersinia pestis
ugcagagguacccuugcaaa

SEQ ID NO: 2274487 - RNA, 15 nt, Yersinia pestis
ugcagauaaacuccg

SEQ ID NO: 2274488 - RNA, 20 nt, Yersinia pestis
ugcagagaugcagugucagg

SEQ ID NO: 2274489 - RNA, 15 nt, Yersinia pestis
ugcagagaugcagag

SEQ ID NO: 2274490 - RNA, 15 nt, Yersinia pestis
ugcagagaugcagug

SEQ ID NO: 2274491 - RNA, 20 nt, Yersinia pestis
ugcagcgcuauuuguaucaa

SEQ ID NO: 2274492 - RNA, 19 nt, Yersinia pestis
ugcaggaguugguggcaca

SEQ ID NO: 2274493 - RNA, 22 nt, Yersinia pestis
ugcaggauaaaccuacagccau

SEQ ID NO: 2274494 - RNA, 21 nt, Yersinia pestis
ugcaggaucuggauuuuccag

SEQ ID NO: 2274495 - RNA, 17 nt, Yersinia pestis
ugcauagcguuguucaa

SEQ ID NO: 2274496 - RNA, 14 nt, Yersinia pestis
ugcauagcuaaccu

SEQ ID NO: 2274497 - RNA, 19 nt, Yersinia pestis
ugcauauaaaacacgcaua

SEQ ID NO: 2274498 - RNA, 21 nt, Yersinia pestis
ugcauccacuuuuucucuccu

SEQ ID NO: 2274499 - RNA, 16 nt, Yersinia pestis
ugcagggccuuuagcg

SEQ ID NO: 2274500 - RNA, 21 nt, Yersinia pestis
ugcauccgcaaaauggguaua

SEQ ID NO: 2274501 - RNA, 21 nt, Yersinia pestis
ugcauguagcugcagccgcga

SEQ ID NO: 2274502 - RNA, 17 nt, Yersinia pestis
ugcauuuuuucauucca

SEQ ID NO: 2274503 - RNA, 22 nt, Yersinia pestis
ugccaacaacuggguggccagu

SEQ ID NO: 2274504 - RNA, 12 nt, Yersinia pestis
ugccaaauauug

SEQ ID NO: 2274505 - RNA, 16 nt, Yersinia pestis
ugccaaauauugcaca

SEQ ID NO: 2274506 - RNA, 21 nt, Yersinia pestis
ugccaacagcgagauagucag

SEQ ID NO: 2274507 - RNA, 23 nt, Yersinia pestis
ugccaaccggauaaaacaauagc

SEQ ID NO: 2274508 - RNA, 19 nt, Yersinia pestis
ugccaauauguuagcagca

SEQ ID NO: 2274509 - RNA, 19 nt, Yersinia pestis
ugccaagguucgaaaaaac

SEQ ID NO: 2274510 - RNA, 21 nt, Yersinia pestis
ugccacacagaaucaccaaca

SEQ ID NO: 2274511 - RNA, 23 nt, Yersinia pestis
ugccaauaaaguccaccucgaaa

SEQ ID NO: 2274512 - RNA, 18 nt, Yersinia pestis
ugccaaggccgaucaaca

SEQ ID NO: 2274513 - RNA, 12 nt, Yersinia pestis
ugccacuguuca

SEQ ID NO: 2274514 - RNA, 18 nt, Yersinia pestis
ugccacuuuacauaaccu

SEQ ID NO: 2274515 - RNA, 13 nt, Yersinia pestis
ugccacauuuccc

SEQ ID NO: 2274516 - RNA, 21 nt, Yersinia pestis
ugccacgccaguaaacagcca

SEQ ID NO: 2274517 - RNA, 14 nt, Yersinia pestis
ugccacgucaucga

SEQ ID NO: 2274518 - RNA, 14 nt, Yersinia pestis
ugccaucaggauuu

SEQ ID NO: 2274519 - RNA, 18 nt, Yersinia pestis
ugccaucaauaccaauaa

SEQ ID NO: 2274520 - RNA, 19 nt, Yersinia pestis
ugccaucaauaccaauaaa

SEQ ID NO: 2274521 - RNA, 16 nt, Yersinia pestis
ugccauacggcgucuu

SEQ ID NO: 2274522 - RNA, 14 nt, Yersinia pestis
ugccauagcugcug

SEQ ID NO: 2274523 - RNA, 23 nt, Yersinia pestis
ugccauagcugcugcuuucagug

SEQ ID NO: 2274524 - RNA, 23 nt, Yersinia pestis
ugccaucgcuuuggcuucuggau

SEQ ID NO: 2274525 - RNA, 15 nt, Yersinia pestis
ugccaucgggcaauu

SEQ ID NO: 2274526 - RNA, 18 nt, Yersinia pestis
ugccauccauuacauccu

SEQ ID NO: 2274527 - RNA, 12 nt, Yersinia pestis
ugccauccugcc

SEQ ID NO: 2274528 - RNA, 20 nt, Yersinia pestis
ugcccaacaacgccgcaccg

SEQ ID NO: 2274529 - RNA, 18 nt, Yersinia pestis
ugcccaauggcaaaacag

SEQ ID NO: 2274530 - RNA, 15 nt, Yersinia pestis
ugccauggucaguuu

SEQ ID NO: 2274531 - RNA, 22 nt, Yersinia pestis
ugccauguugaguuuacgcagu

SEQ ID NO: 2274532 - RNA, 12 nt, Yersinia pestis
ugccauucaagc

SEQ ID NO: 2274533 - RNA, 18 nt, Yersinia pestis
ugccaguaacggcuuauu

SEQ ID NO: 2274534 - RNA, 22 nt, Yersinia pestis
ugccagggcguuuaccauccag

SEQ ID NO: 2274535 - RNA, 15 nt, Yersinia pestis
ugccaguagcaauaa

SEQ ID NO: 2274536 - RNA, 23 nt, Yersinia pestis
ugccauaagcggacauggcaaca

SEQ ID NO: 2274537 - RNA, 21 nt, Yersinia pestis
ugccauaaccgcuaaggccaa

SEQ ID NO: 2274538 - RNA, 14 nt, Yersinia pestis
ugccauaacaucgu

SEQ ID NO: 2274539 - RNA, 21 nt, Yersinia pestis
ugccaguuauuauuuuuaaug

SEQ ID NO: 2274540 - RNA, 22 nt, Yersinia pestis
ugccauaaaguuuuuccucaaa

SEQ ID NO: 2274541 - RNA, 18 nt, Yersinia pestis
ugccagugaaucagccag

SEQ ID NO: 2274542 - RNA, 16 nt, Yersinia pestis
ugccagucuaaaaugg

SEQ ID NO: 2274543 - RNA, 13 nt, Yersinia pestis
ugccagugcaauc

SEQ ID NO: 2274544 - RNA, 19 nt, Yersinia pestis
ugccagugggauaucugcg

SEQ ID NO: 2274545 - RNA, 20 nt, Yersinia pestis
ugccaguuauuauuuuuaau

SEQ ID NO: 2274546 - RNA, 14 nt, Yersinia pestis
ugccagcgaaaauu

SEQ ID NO: 2274547 - RNA, 17 nt, Yersinia pestis
ugccagcagcaaguuag

SEQ ID NO: 2274548 - RNA, 16 nt, Yersinia pestis
ugccagccgcaaauag

SEQ ID NO: 2274549 - RNA, 16 nt, Yersinia pestis
ugccagccaggauagc

SEQ ID NO: 2274550 - RNA, 19 nt, Yersinia pestis
ugcccagagcgcggcuuca

SEQ ID NO: 2274551 - RNA, 21 nt, Yersinia pestis
ugcccagucacuaccgcucag

SEQ ID NO: 2274552 - RNA, 23 nt, Yersinia pestis
ugcccccagcggugaucgcugcc

SEQ ID NO: 2274553 - RNA, 23 nt, Yersinia pestis
ugccccaucagcacuccccgccc

SEQ ID NO: 2274554 - RNA, 13 nt, Yersinia pestis
ugcccaucaugcc

SEQ ID NO: 2274555 - RNA, 21 nt, Yersinia pestis
ugcccaucacaucgcccugag

SEQ ID NO: 2274556 - RNA, 21 nt, Yersinia pestis
ugccccaaugaugacuugauu

SEQ ID NO: 2274557 - RNA, 17 nt, Yersinia pestis
ugcccgcgcuuccaggc

SEQ ID NO: 2274558 - RNA, 21 nt, Yersinia pestis
ugcccgaucaggugaugucag

SEQ ID NO: 2274559 - RNA, 21 nt, Yersinia pestis
ugccuacaacuugcuggaggc

SEQ ID NO: 2274560 - RNA, 15 nt, Yersinia pestis
ugccuacuggccacu

SEQ ID NO: 2274561 - RNA, 16 nt, Yersinia pestis
ugccuacuggccacuu

SEQ ID NO: 2274562 - RNA, 23 nt, Yersinia pestis
ugccuauagccgucacuuaaaaa

SEQ ID NO: 2274563 - RNA, 13 nt, Yersinia pestis
ugccuauccucac

SEQ ID NO: 2274564 - RNA, 23 nt, Yersinia pestis
ugccguuuugcagaucaaucgca

SEQ ID NO: 2274565 - RNA, 18 nt, Yersinia pestis
ugccgugucuuccagaca

SEQ ID NO: 2274566 - RNA, 22 nt, Yersinia pestis
ugccguaucuuguaguaaccac

SEQ ID NO: 2274567 - RNA, 15 nt, Yersinia pestis
ugccgcucaugcccc

SEQ ID NO: 2274568 - RNA, 19 nt, Yersinia pestis
ugccgcuaccauaguugaa

SEQ ID NO: 2274569 - RNA, 12 nt, Yersinia pestis
ugccgcuuuagu

SEQ ID NO: 2274570 - RNA, 16 nt, Yersinia pestis
ugccgcuucauauccu

SEQ ID NO: 2274571 - RNA, 24 nt, Yersinia pestis
ugccggaggauauuuauuucugca

SEQ ID NO: 2274572 - RNA, 16 nt, Yersinia pestis
ugccgcacacagcccu

SEQ ID NO: 2274573 - RNA, 19 nt, Yersinia pestis
ugccgcaagaaagaaaaau

SEQ ID NO: 2274574 - RNA, 14 nt, Yersinia pestis
ugccgcccugcuca

SEQ ID NO: 2274575 - RNA, 20 nt, Yersinia pestis
ugcccguuagccaugcauua

SEQ ID NO: 2274576 - RNA, 13 nt, Yersinia pestis
ugcccuaauacca

SEQ ID NO: 2274577 - RNA, 13 nt, Yersinia pestis
ugcccuaaacagc

SEQ ID NO: 2274578 - RNA, 16 nt, Yersinia pestis
ugcccuuacuauuuuu

SEQ ID NO: 2274579 - RNA, 14 nt, Yersinia pestis
ugcccuuuuagccu

SEQ ID NO: 2274580 - RNA, 17 nt, Yersinia pestis
ugcccuuuuugguuuuc

SEQ ID NO: 2274581 - RNA, 21 nt, Yersinia pestis
ugccgauauagcgcaccaccg

SEQ ID NO: 2274582 - RNA, 19 nt, Yersinia pestis
ugccgagaacagaauguug

SEQ ID NO: 2274583 - RNA, 23 nt, Yersinia pestis
ugcguaccauauggaugaugcac

SEQ ID NO: 2274584 - RNA, 19 nt, Yersinia pestis
ugcguacgccaacuuuugc

SEQ ID NO: 2274585 - RNA, 23 nt, Yersinia pestis
ugcguaauaggcugcgcauuuca

SEQ ID NO: 2274586 - RNA, 18 nt, Yersinia pestis
ugcguaauuacccaagau

SEQ ID NO: 2274587 - RNA, 23 nt, Yersinia pestis
ugcgguaaccagcaucaguagca

SEQ ID NO: 2274588 - RNA, 13 nt, Yersinia pestis
ugcgguaguucag

SEQ ID NO: 2274589 - RNA, 18 nt, Yersinia pestis
ugcgguagaccaccaacu

SEQ ID NO: 2274590 - RNA, 14 nt, Yersinia pestis
ugcgggugccgcau

SEQ ID NO: 2274591 - RNA, 19 nt, Yersinia pestis
ugcgggcuaaaacuggcac

SEQ ID NO: 2274592 - RNA, 23 nt, Yersinia pestis
ugcggguauuugucgucccaggc

SEQ ID NO: 2274593 - RNA, 19 nt, Yersinia pestis
ugcgcguuaaucugcugcu

SEQ ID NO: 2274594 - RNA, 15 nt, Yersinia pestis
ugcgcuaacagcguu

SEQ ID NO: 2274595 - RNA, 19 nt, Yersinia pestis
ugcgcucuguauuguaaua

SEQ ID NO: 2274596 - RNA, 18 nt, Yersinia pestis
ugcgcuccauuucugguu

SEQ ID NO: 2274597 - RNA, 15 nt, Yersinia pestis
ugcgcucgcuugcug

SEQ ID NO: 2274598 - RNA, 16 nt, Yersinia pestis
ugcgcugagugauagu

SEQ ID NO: 2274599 - RNA, 17 nt, Yersinia pestis
ugcgcugagugauagug

SEQ ID NO: 2274600 - RNA, 16 nt, Yersinia pestis
ugcggauauaguuuuu

SEQ ID NO: 2274601 - RNA, 19 nt, Yersinia pestis
ugcggaguaacacuucaga

SEQ ID NO: 2274602 - RNA, 16 nt, Yersinia pestis
ugcgcauuucacccuc

SEQ ID NO: 2274603 - RNA, 21 nt, Yersinia pestis
ugcgcauuucacccucugcag

SEQ ID NO: 2274604 - RNA, 13 nt, Yersinia pestis
ugcgcaguaaccg

SEQ ID NO: 2274605 - RNA, 23 nt, Yersinia pestis
ugcgcaggcggucaaacuccccu

SEQ ID NO: 2274606 - RNA, 19 nt, Yersinia pestis
aaaugggccugaguggggg

SEQ ID NO: 2274607 - RNA, 16 nt, Yersinia pestis
aaauggccuugcccau

SEQ ID NO: 2274608 - RNA, 21 nt, Yersinia pestis
aaauggcagggccgauaaaaa

SEQ ID NO: 2274609 - RNA, 15 nt, Yersinia pestis
aaauggccuugccca

SEQ ID NO: 2274610 - RNA, 21 nt, Yersinia pestis
aaauggcacuggaaacaaaac

SEQ ID NO: 2274611 - RNA, 18 nt, Yersinia pestis
aaauggcagcccuuauuc

SEQ ID NO: 2274612 - RNA, 20 nt, Yersinia pestis
aaauggcacuggaaacaaaa

SEQ ID NO: 2274613 - RNA, 23 nt, Yersinia pestis
aaaugguaagucuuauaaugcag

SEQ ID NO: 2274614 - RNA, 14 nt, Yersinia pestis
aaauggucaggaac

SEQ ID NO: 2274615 - RNA, 22 nt, Yersinia pestis
ugcgccuguuagggcgcggcug

SEQ ID NO: 2274616 - RNA, 21 nt, Yersinia pestis
ugcgccuguuagggcgcggcu

SEQ ID NO: 2274617 - RNA, 17 nt, Yersinia pestis
ugcgcgaccaaguuuga

SEQ ID NO: 2274618 - RNA, 14 nt, Yersinia pestis
ugcgcagcaaauaa

SEQ ID NO: 2274619 - RNA, 12 nt, Yersinia pestis
ugccugcugcug

SEQ ID NO: 2274620 - RNA, 14 nt, Yersinia pestis
ugccugcugcugug

SEQ ID NO: 2274621 - RNA, 21 nt, Yersinia pestis
ugccugguauuuucuauacca

SEQ ID NO: 2274622 - RNA, 15 nt, Yersinia pestis
ugccuggugcaaccg

SEQ ID NO: 2274623 - RNA, 14 nt, Yersinia pestis
ugccugguugguga

SEQ ID NO: 2274624 - RNA, 13 nt, Yersinia pestis
ugcgacaggcuca

SEQ ID NO: 2274625 - RNA, 22 nt, Yersinia pestis
ugagcgaacugaaugcguugcc

SEQ ID NO: 2274626 - RNA, 20 nt, Yersinia pestis
ugagccgcauugauccucgu

SEQ ID NO: 2274627 - RNA, 19 nt, Yersinia pestis
ugagcauuuuaguuuuaua

SEQ ID NO: 2274628 - RNA, 18 nt, Yersinia pestis
ugagccacacauucaguc

SEQ ID NO: 2274629 - RNA, 20 nt, Yersinia pestis
ugagccagaaacgaucuugg

SEQ ID NO: 2274630 - RNA, 18 nt, Yersinia pestis
ugagcaucacuucauaca

SEQ ID NO: 2274631 - RNA, 11 nt, Yersinia pestis
ugagcagugcg

SEQ ID NO: 2274632 - RNA, 23 nt, Yersinia pestis
ugagcauacuguuggcaauuuca

SEQ ID NO: 2274633 - RNA, 15 nt, Yersinia pestis
ugagcauauucagua

SEQ ID NO: 2274634 - RNA, 13 nt, Yersinia pestis
ugagauuauuggc

SEQ ID NO: 2274635 - RNA, 15 nt, Yersinia pestis
ugagcaccacaauac

SEQ ID NO: 2274636 - RNA, 19 nt, Yersinia pestis
ugagcacggacagcagcac

SEQ ID NO: 2274637 - RNA, 20 nt, Yersinia pestis
ugagcacggacagcagcacg

SEQ ID NO: 2274638 - RNA, 16 nt, Yersinia pestis
ugagcaccgcaggaac

SEQ ID NO: 2274639 - RNA, 21 nt, Yersinia pestis
ugagcagcaacuguuuuauug

SEQ ID NO: 2274640 - RNA, 18 nt, Yersinia pestis
ugagaaacauccuaaaaa

SEQ ID NO: 2274641 - RNA, 15 nt, Yersinia pestis
ugagaagugaaaaac

SEQ ID NO: 2274642 - RNA, 14 nt, Yersinia pestis
ugagaauaaaaccu

SEQ ID NO: 2274643 - RNA, 18 nt, Yersinia pestis
ugagaaucaaaaaacaga

SEQ ID NO: 2274644 - RNA, 22 nt, Yersinia pestis
ugagaaucaguggucuuccgcc

SEQ ID NO: 2274645 - RNA, 15 nt, Yersinia pestis
ugagaauguaaauuu

SEQ ID NO: 2274646 - RNA, 18 nt, Yersinia pestis
ugagacacaaaaaagaaa

SEQ ID NO: 2274647 - RNA, 13 nt, Yersinia pestis
ugagacaacagua

SEQ ID NO: 2274648 - RNA, 23 nt, Yersinia pestis
ugagacagcgcgguuugguacau

SEQ ID NO: 2274649 - RNA, 14 nt, Yersinia pestis
ugacuuuuuuuaac

SEQ ID NO: 2274650 - RNA, 12 nt, Yersinia pestis
ugacuggcagga

SEQ ID NO: 2274651 - RNA, 14 nt, Yersinia pestis
ugacuggcaggaaa

SEQ ID NO: 2274652 - RNA, 19 nt, Yersinia pestis
ugacuggcaggaaaucuuc

SEQ ID NO: 2274653 - RNA, 14 nt, Yersinia pestis
ugacuggaauauuc

SEQ ID NO: 2274654 - RNA, 14 nt, Yersinia pestis
ugacugcuggcagg

SEQ ID NO: 2274655 - RNA, 15 nt, Yersinia pestis
ugacuuguggaacaa

SEQ ID NO: 2274656 - RNA, 21 nt, Yersinia pestis
ugacgaaauuuaagaaaucua

SEQ ID NO: 2274657 - RNA, 18 nt, Yersinia pestis
ugaccuugguaaauacca

SEQ ID NO: 2274658 - RNA, 21 nt, Yersinia pestis
ugaguaacgguguggcaccau

SEQ ID NO: 2274659 - RNA, 16 nt, Yersinia pestis
ugaguaaauuaaauuu

SEQ ID NO: 2274660 - RNA, 20 nt, Yersinia pestis
ugaguaaauuaaauuuuaau

SEQ ID NO: 2274661 - RNA, 16 nt, Yersinia pestis
ugaguaauauuauuca

SEQ ID NO: 2274662 - RNA, 19 nt, Yersinia pestis
ugaguaauucgcagacaga

SEQ ID NO: 2274663 - RNA, 18 nt, Yersinia pestis
ugaguauacuaaaacagc

SEQ ID NO: 2274664 - RNA, 22 nt, Yersinia pestis
ugaguagcuaauaaaauggcua

SEQ ID NO: 2274665 - RNA, 13 nt, Yersinia pestis
ugaguaucaauau

SEQ ID NO: 2274666 - RNA, 21 nt, Yersinia pestis
ugagguuauugacaaagugcc

SEQ ID NO: 2274667 - RNA, 21 nt, Yersinia pestis
ugagguuagaaaacaguuacu

SEQ ID NO: 2274668 - RNA, 21 nt, Yersinia pestis
ugagguuagcgagggacgcga

SEQ ID NO: 2274669 - RNA, 20 nt, Yersinia pestis
ugagguuuuaccaauccccg

SEQ ID NO: 2274670 - RNA, 19 nt, Yersinia pestis
ugaggcaacauuuguugca

SEQ ID NO: 2274671 - RNA, 18 nt, Yersinia pestis
ugagcuggcaaaacucag

SEQ ID NO: 2274672 - RNA, 15 nt, Yersinia pestis
ugagcgcuauuuauc

SEQ ID NO: 2274673 - RNA, 23 nt, Yersinia pestis
ugagcgcagaguccucucaccaa

SEQ ID NO: 2274674 - RNA, 12 nt, Yersinia pestis
ugagcgcauugc

SEQ ID NO: 2274675 - RNA, 21 nt, Yersinia pestis
ugagcgccaugcgcuuucagc

SEQ ID NO: 2274676 - RNA, 17 nt, Yersinia pestis
ugaggaugggcagaaga

SEQ ID NO: 2274677 - RNA, 20 nt, Yersinia pestis
ugaggauuauaauucauuuu

SEQ ID NO: 2274678 - RNA, 21 nt, Yersinia pestis
ugaggauuauaauucauuuuu

SEQ ID NO: 2274679 - RNA, 15 nt, Yersinia pestis
ugagcuguaaauaua

SEQ ID NO: 2274680 - RNA, 16 nt, Yersinia pestis
ugagcuguaaauauaa

SEQ ID NO: 2274681 - RNA, 20 nt, Yersinia pestis
ugagcuguaaauauaaaaua

SEQ ID NO: 2274682 - RNA, 15 nt, Yersinia pestis
ugagcuugcugcuga

SEQ ID NO: 2274683 - RNA, 14 nt, Yersinia pestis
ugagcuugcugcug

SEQ ID NO: 2274684 - RNA, 20 nt, Yersinia pestis
ugauaaaucuuauuuaaucu

SEQ ID NO: 2274685 - RNA, 21 nt, Yersinia pestis
ugaguuuuagcccaaaauaga

SEQ ID NO: 2274686 - RNA, 22 nt, Yersinia pestis
ugaguuuuagcccaaaauagaa

SEQ ID NO: 2274687 - RNA, 16 nt, Yersinia pestis
ugaguuucauuaguca

SEQ ID NO: 2274688 - RNA, 16 nt, Yersinia pestis
ugaguuggcauucuag

SEQ ID NO: 2274689 - RNA, 22 nt, Yersinia pestis
ugaguugcccuaaacagcaaca

SEQ ID NO: 2274690 - RNA, 20 nt, Yersinia pestis
ugaguugcuggaauccaagu

SEQ ID NO: 2274691 - RNA, 12 nt, Yersinia pestis
ugagucucaggg

SEQ ID NO: 2274692 - RNA, 12 nt, Yersinia pestis
ugagucagucag

SEQ ID NO: 2274693 - RNA, 21 nt, Yersinia pestis
ugagucacuggggugaaucaa

SEQ ID NO: 2274694 - RNA, 16 nt, Yersinia pestis
ugaguauguuugauua

SEQ ID NO: 2274695 - RNA, 17 nt, Yersinia pestis
ugaguauguuugauuaa

SEQ ID NO: 2274696 - RNA, 21 nt, Yersinia pestis
ugauaaugccuuuuaaaugaa

SEQ ID NO: 2274697 - RNA, 22 nt, Yersinia pestis
ugauaaugccuuuuaaaugaag

SEQ ID NO: 2274698 - RNA, 13 nt, Yersinia pestis
ugauaaauucuug

SEQ ID NO: 2274699 - RNA, 15 nt, Yersinia pestis
ugauaacaacccuaa

SEQ ID NO: 2274700 - RNA, 18 nt, Yersinia pestis
ugauaacaauaaaaucuu

SEQ ID NO: 2274701 - RNA, 15 nt, Yersinia pestis
ugauaacaccggcuu

SEQ ID NO: 2274702 - RNA, 19 nt, Yersinia pestis
ugauaacgccggauaaauu

SEQ ID NO: 2274703 - RNA, 17 nt, Yersinia pestis
ugauaauuuauuucaga

SEQ ID NO: 2274704 - RNA, 20 nt, Yersinia pestis
ugauaauuaaugcaccuaca

SEQ ID NO: 2274705 - RNA, 17 nt, Yersinia pestis
ugauacaggaaacucca

SEQ ID NO: 2274706 - RNA, 13 nt, Yersinia pestis
ugaucaacucacg

SEQ ID NO: 2274707 - RNA, 21 nt, Yersinia pestis
ugaucaauaucccgagaaaca

SEQ ID NO: 2274708 - RNA, 19 nt, Yersinia pestis
ugauauucucaccugcuua

SEQ ID NO: 2274709 - RNA, 15 nt, Yersinia pestis
ugauauuaauaucag

SEQ ID NO: 2274710 - RNA, 15 nt, Yersinia pestis
ugaucagcagacuca

SEQ ID NO: 2274711 - RNA, 14 nt, Yersinia pestis
ugauccaggggucg

SEQ ID NO: 2274712 - RNA, 20 nt, Yersinia pestis
ugaucuaacguccccugagc

SEQ ID NO: 2274713 - RNA, 18 nt, Yersinia pestis
ugaucguuacggcugcgc

SEQ ID NO: 2274714 - RNA, 14 nt, Yersinia pestis
ugaucccccaaauu

SEQ ID NO: 2274715 - RNA, 17 nt, Yersinia pestis
ugaucgguuagcuacug

SEQ ID NO: 2274716 - RNA, 14 nt, Yersinia pestis
ugauggcuuuaucc

SEQ ID NO: 2274717 - RNA, 15 nt, Yersinia pestis
ugaugggauuaauaa

SEQ ID NO: 2274718 - RNA, 22 nt, Yersinia pestis
ugauggcuaauuaauuuaaaca

SEQ ID NO: 2274719 - RNA, 18 nt, Yersinia pestis
ugauggcgugauggcgca

SEQ ID NO: 2274720 - RNA, 19 nt, Yersinia pestis
ugauggcgauagauuuuca

SEQ ID NO: 2274721 - RNA, 21 nt, Yersinia pestis
ugaugcuaauuucaucucaau

SEQ ID NO: 2274722 - RNA, 22 nt, Yersinia pestis
ugaugcguguaaugcgcaucug

SEQ ID NO: 2274723 - RNA, 18 nt, Yersinia pestis
ugaugcugcuggcguuau

SEQ ID NO: 2274724 - RNA, 14 nt, Yersinia pestis
ugaugcuggguaua

SEQ ID NO: 2274725 - RNA, 18 nt, Yersinia pestis
ugaugcuggguauauaua

SEQ ID NO: 2274726 - RNA, 17 nt, Yersinia pestis
ugaugcaccgcugucau

SEQ ID NO: 2274727 - RNA, 19 nt, Yersinia pestis
ugaugcaguaucccuggcu

SEQ ID NO: 2274728 - RNA, 22 nt, Yersinia pestis
ugauugguggucuuaucauaau

SEQ ID NO: 2274729 - RNA, 16 nt, Yersinia pestis
ugauugaaaaacagag

SEQ ID NO: 2274730 - RNA, 14 nt, Yersinia pestis
ugauucucuauucu

SEQ ID NO: 2274731 - RNA, 15 nt, Yersinia pestis
ugauuggauaaaaua

SEQ ID NO: 2274732 - RNA, 17 nt, Yersinia pestis
ugauuggauaaaauauu

SEQ ID NO: 2274733 - RNA, 14 nt, Yersinia pestis
ugauuggcuccuau

SEQ ID NO: 2274734 - RNA, 22 nt, Yersinia pestis
ugauuaucaaguuaaauacugc

SEQ ID NO: 2274735 - RNA, 18 nt, Yersinia pestis
ugauuaggcauaaauaau

SEQ ID NO: 2274736 - RNA, 17 nt, Yersinia pestis
ugauuaggcaugauaag

SEQ ID NO: 2274737 - RNA, 16 nt, Yersinia pestis
ugauucgucugccauu

SEQ ID NO: 2274738 - RNA, 23 nt, Yersinia pestis
ugauucucauuaauagaaucugc

SEQ ID NO: 2274739 - RNA, 21 nt, Yersinia pestis
ugauucguuuucggugcaugu

SEQ ID NO: 2274740 - RNA, 14 nt, Yersinia pestis
ugauucagccaaca

SEQ ID NO: 2274741 - RNA, 15 nt, Yersinia pestis
ugauucaauuucgac

SEQ ID NO: 2274742 - RNA, 13 nt, Yersinia pestis
ugauguaacucag

SEQ ID NO: 2274743 - RNA, 18 nt, Yersinia pestis
ugauguaacucaggaucc

SEQ ID NO: 2274744 - RNA, 12 nt, Yersinia pestis
ugauguaggcaa

SEQ ID NO: 2274745 - RNA, 22 nt, Yersinia pestis
ugauguagcagaucuauuugcu

SEQ ID NO: 2274746 - RNA, 16 nt, Yersinia pestis
ugaugucaauuaaaaa

SEQ ID NO: 2274747 - RNA, 20 nt, Yersinia pestis
ugaugucaucuuccgucagu

SEQ ID NO: 2274748 - RNA, 20 nt, Yersinia pestis
ugaugucaugauaaaacuau

SEQ ID NO: 2274749 - RNA, 14 nt, Yersinia pestis
ugaugucagugcuc

SEQ ID NO: 2274750 - RNA, 20 nt, Yersinia pestis
ugaugugcucugcuccgccu

SEQ ID NO: 2274751 - RNA, 17 nt, Yersinia pestis
ugauuaccaauaauuaa

SEQ ID NO: 2274752 - RNA, 21 nt, Yersinia pestis
ugauuaccaauaauuaauuuc

SEQ ID NO: 2274753 - RNA, 18 nt, Yersinia pestis
ugauuacgggucagcuca

SEQ ID NO: 2274754 - RNA, 14 nt, Yersinia pestis
ugauuaauuuuuca

SEQ ID NO: 2274755 - RNA, 13 nt, Yersinia pestis
ugauuaauaucaa

SEQ ID NO: 2274756 - RNA, 21 nt, Yersinia pestis
ugauuaauaucaaaacugauu

SEQ ID NO: 2274757 - RNA, 15 nt, Yersinia pestis
ugauguuauuaauga

SEQ ID NO: 2274758 - RNA, 16 nt, Yersinia pestis
ugauguucaauucacu

SEQ ID NO: 2274759 - RNA, 16 nt, Yersinia pestis
ugauguucugccaacc

SEQ ID NO: 2274760 - RNA, 19 nt, Yersinia pestis
ugauuaaaccgagccugcu

SEQ ID NO: 2274761 - RNA, 14 nt, Yersinia pestis
ugauuaaaagucaa

SEQ ID NO: 2274762 - RNA, 21 nt, Yersinia pestis
ugauuaaauggugguuuucuu

SEQ ID NO: 2274763 - RNA, 20 nt, Yersinia pestis
ugauuaagcggcaauaacac

SEQ ID NO: 2274764 - RNA, 22 nt, Yersinia pestis
ugauuaauacacgcuuccagua

SEQ ID NO: 2274765 - RNA, 17 nt, Yersinia pestis
ugacaacaucaaaugaa

SEQ ID NO: 2274766 - RNA, 18 nt, Yersinia pestis
ugacaacaucaaaugaag

SEQ ID NO: 2274767 - RNA, 20 nt, Yersinia pestis
ugacaaccacuaaaccacau

SEQ ID NO: 2274768 - RNA, 16 nt, Yersinia pestis
ugacaaagagcccgca

SEQ ID NO: 2274769 - RNA, 16 nt, Yersinia pestis
ugacaaacagauacau

SEQ ID NO: 2274770 - RNA, 16 nt, Yersinia pestis
ugacaaaguuaaauga

SEQ ID NO: 2274771 - RNA, 17 nt, Yersinia pestis
ugacaaaguuaaaugaa

SEQ ID NO: 2274772 - RNA, 19 nt, Yersinia pestis
ugacaaugcguuauaacca

SEQ ID NO: 2274773 - RNA, 17 nt, Yersinia pestis
ugacaaugcguuauaac

SEQ ID NO: 2274774 - RNA, 19 nt, Yersinia pestis
ugacaaugcguuauaacua

SEQ ID NO: 2274775 - RNA, 13 nt, Yersinia pestis
ugacacaauuccc

SEQ ID NO: 2274776 - RNA, 21 nt, Yersinia pestis
ugacagaaaaaucacaugcgg

SEQ ID NO: 2274777 - RNA, 23 nt, Yersinia pestis
ugacagcauacauccuaaauaau

SEQ ID NO: 2274778 - RNA, 21 nt, Yersinia pestis
ugacaggggauagcaacugcc

SEQ ID NO: 2274779 - RNA, 22 nt, Yersinia pestis
ugacaguagaauaccucacugg

SEQ ID NO: 2274780 - RNA, 22 nt, Yersinia pestis
ugacacucggcgguuugagcca

SEQ ID NO: 2274781 - RNA, 22 nt, Yersinia pestis
ugacauaacguuguacggguaa

SEQ ID NO: 2274782 - RNA, 13 nt, Yersinia pestis
ugacauaaacacg

SEQ ID NO: 2274783 - RNA, 21 nt, Yersinia pestis
ugaccagcauacgugccaaaa

SEQ ID NO: 2274784 - RNA, 19 nt, Yersinia pestis
ugaccagcauacgugccaa

SEQ ID NO: 2274785 - RNA, 17 nt, Yersinia pestis
ugaccaucaaccgugac

SEQ ID NO: 2274786 - RNA, 14 nt, Yersinia pestis
ugaccauaaaagga

SEQ ID NO: 2274787 - RNA, 17 nt, Yersinia pestis
ugaccagggcuaaaaug

SEQ ID NO: 2274788 - RNA, 22 nt, Yersinia pestis
ugaccagcgaaucaaacagguu

SEQ ID NO: 2274789 - RNA, 16 nt, Yersinia pestis
ugaccuuacagugaua

SEQ ID NO: 2274790 - RNA, 21 nt, Yersinia pestis
ugaccuuaauaccguguaccc

SEQ ID NO: 2274791 - RNA, 21 nt, Yersinia pestis
ugaccucgacaaucucggcau

SEQ ID NO: 2274792 - RNA, 22 nt, Yersinia pestis
ugaccauuuguuuuugaaucau

SEQ ID NO: 2274793 - RNA, 17 nt, Yersinia pestis
ugaccgauugaaucaag

SEQ ID NO: 2274794 - RNA, 17 nt, Yersinia pestis
ugaccgcacugcccagg

SEQ ID NO: 2274795 - RNA, 16 nt, Yersinia pestis
ugaccauuuauuucca

SEQ ID NO: 2274796 - RNA, 18 nt, Yersinia pestis
ugaccaugcuuauugcca

SEQ ID NO: 2274797 - RNA, 19 nt, Yersinia pestis
ugacaaaaacagcacuauc

SEQ ID NO: 2274798 - RNA, 22 nt, Yersinia pestis
ugacaaaaacagcacuaucccc

SEQ ID NO: 2274799 - RNA, 12 nt, Yersinia pestis
ugaauuucuucc

SEQ ID NO: 2274800 - RNA, 22 nt, Yersinia pestis
ugaauuuggugguggccugguu

SEQ ID NO: 2274801 - RNA, 19 nt, Yersinia pestis
ugaauuuuagucaaaacaa

SEQ ID NO: 2274802 - RNA, 19 nt, Yersinia pestis
ugaauuaauuuauuuucau

SEQ ID NO: 2274803 - RNA, 18 nt, Yersinia pestis
ugaauuacguuuuggauc

SEQ ID NO: 2274804 - RNA, 16 nt, Yersinia pestis
ugaauugaugucaauu

SEQ ID NO: 2274805 - RNA, 22 nt, Yersinia pestis
ugaauugauuuauuccucucug

SEQ ID NO: 2274806 - RNA, 17 nt, Yersinia pestis
ugaauguuccggacuuc

SEQ ID NO: 2274807 - RNA, 18 nt, Yersinia pestis
ugaaugucucuggcgcga

SEQ ID NO: 2274808 - RNA, 16 nt, Yersinia pestis
ugaaucgccgaaaucu

SEQ ID NO: 2274809 - RNA, 21 nt, Yersinia pestis
ugaaucgccgaaaucucacca

SEQ ID NO: 2274810 - RNA, 23 nt, Yersinia pestis
ugaaucccagaaccucaacauuc

SEQ ID NO: 2274811 - RNA, 14 nt, Yersinia pestis
ugaaucaucaauac

SEQ ID NO: 2274812 - RNA, 19 nt, Yersinia pestis
ugaaucacuaacguguccc

SEQ ID NO: 2274813 - RNA, 15 nt, Yersinia pestis
ugaaucaaaauaccc

SEQ ID NO: 2274814 - RNA, 17 nt, Yersinia pestis
ugaauauuuuuaaucug

SEQ ID NO: 2274815 - RNA, 15 nt, Yersinia pestis
ugaaucaacagauga

SEQ ID NO: 2274816 - RNA, 17 nt, Yersinia pestis
ugaaugagguuuacauu

SEQ ID NO: 2274817 - RNA, 14 nt, Yersinia pestis
ugaaugacuggcua

SEQ ID NO: 2274818 - RNA, 12 nt, Yersinia pestis
ugaaugauggua

SEQ ID NO: 2274819 - RNA, 12 nt, Yersinia pestis
ugaaucuguaag

SEQ ID NO: 2274820 - RNA, 21 nt, Yersinia pestis
ugaauggcaacgcgcagugcc

SEQ ID NO: 2274821 - RNA, 15 nt, Yersinia pestis
ugaaauuuuuuaauu

SEQ ID NO: 2274822 - RNA, 14 nt, Yersinia pestis
ugaacaaugccaua

SEQ ID NO: 2274823 - RNA, 17 nt, Yersinia pestis
ugaacaauugccaggcc

SEQ ID NO: 2274824 - RNA, 21 nt, Yersinia pestis
ugaacaucuggcgauuuugcg

SEQ ID NO: 2274825 - RNA, 20 nt, Yersinia pestis
ugaacagauagauaaauguu

SEQ ID NO: 2274826 - RNA, 22 nt, Yersinia pestis
ugaaauuagggguugcaggcug

SEQ ID NO: 2274827 - RNA, 16 nt, Yersinia pestis
ugaaauuggcuucacc

SEQ ID NO: 2274828 - RNA, 16 nt, Yersinia pestis
ugaaauuucacugugc

SEQ ID NO: 2274829 - RNA, 22 nt, Yersinia pestis
ugaaauuuuauucgcguuucau

SEQ ID NO: 2274830 - RNA, 18 nt, Yersinia pestis
ugaaaggcggugaacagu

SEQ ID NO: 2274831 - RNA, 24 nt, Yersinia pestis
ugaaaguggccacucaccucaguc

SEQ ID NO: 2274832 - RNA, 14 nt, Yersinia pestis
ugaaauacuuauuu

SEQ ID NO: 2274833 - RNA, 20 nt, Yersinia pestis
ucuucggccuaucaucacca

SEQ ID NO: 2274834 - RNA, 18 nt, Yersinia pestis
ucuucggccuaucaucac

SEQ ID NO: 2274835 - RNA, 21 nt, Yersinia pestis
ugaaaccuacaucacacccag

SEQ ID NO: 2274836 - RNA, 22 nt, Yersinia pestis
ugaaaccuacaucacacccagc

SEQ ID NO: 2274837 - RNA, 23 nt, Yersinia pestis
ucuucguugccccaucagcacuc

SEQ ID NO: 2274838 - RNA, 14 nt, Yersinia pestis
ugaauaccauaaca

SEQ ID NO: 2274839 - RNA, 15 nt, Yersinia pestis
ugaauaauauucaau

SEQ ID NO: 2274840 - RNA, 16 nt, Yersinia pestis
ugaauaauacugucaa

SEQ ID NO: 2274841 - RNA, 19 nt, Yersinia pestis
ugaaguuuauacuauuuau

SEQ ID NO: 2274842 - RNA, 19 nt, Yersinia pestis
ugaaguggcugaauaucau

SEQ ID NO: 2274843 - RNA, 17 nt, Yersinia pestis
ugaagugugcaaauaaa

SEQ ID NO: 2274844 - RNA, 15 nt, Yersinia pestis
ugaaguugucaguga

SEQ ID NO: 2274845 - RNA, 14 nt, Yersinia pestis
ugaauagcgcugca

SEQ ID NO: 2274846 - RNA, 17 nt, Yersinia pestis
ugaauacgauaaagaag

SEQ ID NO: 2274847 - RNA, 17 nt, Yersinia pestis
ugaauacgaauuuuuuc

SEQ ID NO: 2274848 - RNA, 23 nt, Yersinia pestis
ugaauagaggacuauucaaugac

SEQ ID NO: 2274849 - RNA, 18 nt, Yersinia pestis
ugaauauaaauuuaauaa

SEQ ID NO: 2274850 - RNA, 19 nt, Yersinia pestis
ugaauagggaauaaguaga

SEQ ID NO: 2274851 - RNA, 16 nt, Yersinia pestis
ugaauauccgccgccc

SEQ ID NO: 2274852 - RNA, 23 nt, Yersinia pestis
ugaauaucccccuccggaaucag

SEQ ID NO: 2274853 - RNA, 15 nt, Yersinia pestis
ugaauaucaucuuuu

SEQ ID NO: 2274854 - RNA, 15 nt, Yersinia pestis
ugaauauccaauggu

SEQ ID NO: 2274855 - RNA, 16 nt, Yersinia pestis
ugaauaucaccauauu

SEQ ID NO: 2274856 - RNA, 11 nt, Yersinia pestis
ugaauaucuug

SEQ ID NO: 2274857 - RNA, 13 nt, Yersinia pestis
ugaauauuauuca

SEQ ID NO: 2274858 - RNA, 13 nt, Yersinia pestis
ugaacgcaaaccc

SEQ ID NO: 2274859 - RNA, 15 nt, Yersinia pestis
ugaacgauaaauugc

SEQ ID NO: 2274860 - RNA, 23 nt, Yersinia pestis
ugaagaacgaagguauaaccauu

SEQ ID NO: 2274861 - RNA, 18 nt, Yersinia pestis
ugaagagugaccaaagca

SEQ ID NO: 2274862 - RNA, 18 nt, Yersinia pestis
ugaagaggguuuuuaaau

SEQ ID NO: 2274863 - RNA, 20 nt, Yersinia pestis
ugaagaggguuuuuaaauuu

SEQ ID NO: 2274864 - RNA, 23 nt, Yersinia pestis
ugaagccgccggagaacuugaac

SEQ ID NO: 2274865 - RNA, 18 nt, Yersinia pestis
ugaagauucaaccaauua

SEQ ID NO: 2274866 - RNA, 17 nt, Yersinia pestis
ugaagaugcuucagcca

SEQ ID NO: 2274867 - RNA, 23 nt, Yersinia pestis
ugaagauacccuucucuuuauca

SEQ ID NO: 2274868 - RNA, 21 nt, Yersinia pestis
ugaagguacgcaccauugagc

SEQ ID NO: 2274869 - RNA, 16 nt, Yersinia pestis
ugaagguagucccuca

SEQ ID NO: 2274870 - RNA, 21 nt, Yersinia pestis
ugaagguaugagugaucauau

SEQ ID NO: 2274871 - RNA, 18 nt, Yersinia pestis
ugaaggcugauuaauauc

SEQ ID NO: 2274872 - RNA, 17 nt, Yersinia pestis
ugaagggcaaaacguga

SEQ ID NO: 2274873 - RNA, 17 nt, Yersinia pestis
ugaaggcugauuaauau

SEQ ID NO: 2274874 - RNA, 22 nt, Yersinia pestis
ucgccaacauaaguaauaagua

SEQ ID NO: 2274875 - RNA, 22 nt, Yersinia pestis
ucgccaacacguggguauccag

SEQ ID NO: 2274876 - RNA, 20 nt, Yersinia pestis
ucgccaacaggccuaaugcc

SEQ ID NO: 2274877 - RNA, 17 nt, Yersinia pestis
uccauacgaauuuuucc

SEQ ID NO: 2274878 - RNA, 17 nt, Yersinia pestis
ucgccacggauaaggug

SEQ ID NO: 2274879 - RNA, 15 nt, Yersinia pestis
ucgccacgcugauac

SEQ ID NO: 2274880 - RNA, 18 nt, Yersinia pestis
ucgccagcggguacacug

SEQ ID NO: 2274881 - RNA, 13 nt, Yersinia pestis
ucgccgaaaucuc

SEQ ID NO: 2274882 - RNA, 12 nt, Yersinia pestis
ucgcccuuucuu

SEQ ID NO: 2274883 - RNA, 16 nt, Yersinia pestis
ucgccgccgccagccc

SEQ ID NO: 2274884 - RNA, 20 nt, Yersinia pestis
ucgccccuuagcgcacgggg

SEQ ID NO: 2274885 - RNA, 17 nt, Yersinia pestis
ucgcccccucuggcaua

SEQ ID NO: 2274886 - RNA, 14 nt, Yersinia pestis
ucgcccucuggugc

SEQ ID NO: 2274887 - RNA, 15 nt, Yersinia pestis
ucgcccgucuggcag

SEQ ID NO: 2274888 - RNA, 13 nt, Yersinia pestis
ucgccuauaaaaa

SEQ ID NO: 2274889 - RNA, 18 nt, Yersinia pestis
ucgccugaugcuuuucuu

SEQ ID NO: 2274890 - RNA, 18 nt, Yersinia pestis
ucgccguucuccgucguc

SEQ ID NO: 2274891 - RNA, 23 nt, Yersinia pestis
ucgccguuacccccuucaccaau

SEQ ID NO: 2274892 - RNA, 14 nt, Yersinia pestis
ucgccgccuccgau

SEQ ID NO: 2274893 - RNA, 15 nt, Yersinia pestis
ucgcgaccagcagaa

SEQ ID NO: 2274894 - RNA, 16 nt, Yersinia pestis
ucgcgaccagcagaag

SEQ ID NO: 2274895 - RNA, 14 nt, Yersinia pestis
ucgcuuccaggaca

SEQ ID NO: 2274896 - RNA, 21 nt, Yersinia pestis
ucgcuuccaggacauccagcg

SEQ ID NO: 2274897 - RNA, 12 nt, Yersinia pestis
ucgcuugcugcc

SEQ ID NO: 2274898 - RNA, 14 nt, Yersinia pestis
ucggccaacaucuu

SEQ ID NO: 2274899 - RNA, 16 nt, Yersinia pestis
ucggccacccgccauc

SEQ ID NO: 2274900 - RNA, 11 nt, Yersinia pestis
ucggcaggcaa

SEQ ID NO: 2274901 - RNA, 20 nt, Yersinia pestis
ucggauaaccgcgaagaggg

SEQ ID NO: 2274902 - RNA, 17 nt, Yersinia pestis
ucggauaguuaucuggg

SEQ ID NO: 2274903 - RNA, 16 nt, Yersinia pestis
ucggauggucauccac

SEQ ID NO: 2274904 - RNA, 19 nt, Yersinia pestis
ucggaugccgcuccagcac

SEQ ID NO: 2274905 - RNA, 16 nt, Yersinia pestis
ucggcaauauaaagcc

SEQ ID NO: 2274906 - RNA, 12 nt, Yersinia pestis
ucgcguggcaga

SEQ ID NO: 2274907 - RNA, 20 nt, Yersinia pestis
ucgcgggcgcgcugcugcuc

SEQ ID NO: 2274908 - RNA, 15 nt, Yersinia pestis
ucgcgggcacuuugu

SEQ ID NO: 2274909 - RNA, 16 nt, Yersinia pestis
ucgcgccuaccugccu

SEQ ID NO: 2274910 - RNA, 18 nt, Yersinia pestis
ucgcgccugaaaucauuu

SEQ ID NO: 2274911 - RNA, 16 nt, Yersinia pestis
ucgcgcugucuuucau

SEQ ID NO: 2274912 - RNA, 13 nt, Yersinia pestis
ucgcgcuucaggu

SEQ ID NO: 2274913 - RNA, 20 nt, Yersinia pestis
ucgcucaggcggucaccgaa

SEQ ID NO: 2274914 - RNA, 20 nt, Yersinia pestis
ucgcucccccggaucacugg

SEQ ID NO: 2274915 - RNA, 16 nt, Yersinia pestis
ucgcguuggcuaaaau

SEQ ID NO: 2274916 - RNA, 16 nt, Yersinia pestis
ucgcuaucugugucag

SEQ ID NO: 2274917 - RNA, 13 nt, Yersinia pestis
ucgcucuccugcc

SEQ ID NO: 2274918 - RNA, 17 nt, Yersinia pestis
ucgcucugcguuuuucc

SEQ ID NO: 2274919 - RNA, 13 nt, Yersinia pestis
ucgcugaaaugcu

SEQ ID NO: 2274920 - RNA, 22 nt, Yersinia pestis
ucgcugagacccgauuucacgc

SEQ ID NO: 2274921 - RNA, 12 nt, Yersinia pestis
ucgcugccaccg

SEQ ID NO: 2274922 - RNA, 21 nt, Yersinia pestis
ucgcugccaccgucgcagaac

SEQ ID NO: 2274923 - RNA, 20 nt, Yersinia pestis
ucgcuggacgcaucagaucg

SEQ ID NO: 2274924 - RNA, 14 nt, Yersinia pestis
ucgugaaagcagaa

SEQ ID NO: 2274925 - RNA, 15 nt, Yersinia pestis
ucgugaauaaaaaua

SEQ ID NO: 2274926 - RNA, 15 nt, Yersinia pestis
ucgugaccaauaaua

SEQ ID NO: 2274927 - RNA, 15 nt, Yersinia pestis
ucgucguaauauuuc

SEQ ID NO: 2274928 - RNA, 22 nt, Yersinia pestis
ucgugccgcacacagcccugcc

SEQ ID NO: 2274929 - RNA, 20 nt, Yersinia pestis
ucguggaguagagcuuccag

SEQ ID NO: 2274930 - RNA, 21 nt, Yersinia pestis
ucguggaaaucgggugauaaa

SEQ ID NO: 2274931 - RNA, 20 nt, Yersinia pestis
ucguggcguucccgcaggcg

SEQ ID NO: 2274932 - RNA, 13 nt, Yersinia pestis
ucguuauaauauu

SEQ ID NO: 2274933 - RNA, 22 nt, Yersinia pestis
ucguuagcacggaauugaucga

SEQ ID NO: 2274934 - RNA, 21 nt, Yersinia pestis
ucguuaaacauuauuuuucac

SEQ ID NO: 2274935 - RNA, 22 nt, Yersinia pestis
ucguuacaucaugaguaaaaga

SEQ ID NO: 2274936 - RNA, 17 nt, Yersinia pestis
ucguuuaaaaaauaucu

SEQ ID NO: 2274937 - RNA, 15 nt, Yersinia pestis
ucguuucucuaaaau

SEQ ID NO: 2274938 - RNA, 16 nt, Yersinia pestis
ucguuucucuaaaauu

SEQ ID NO: 2274939 - RNA, 13 nt, Yersinia pestis
ucguuucugucug

SEQ ID NO: 2274940 - RNA, 15 nt, Yersinia pestis
ucguugcuaccagca

SEQ ID NO: 2274941 - RNA, 18 nt, Yersinia pestis
ucguugccccaucagcac

SEQ ID NO: 2274942 - RNA, 21 nt, Yersinia pestis
ucgucagugcgguaaccagca

SEQ ID NO: 2274943 - RNA, 13 nt, Yersinia pestis
ucgucagccccug

SEQ ID NO: 2274944 - RNA, 14 nt, Yersinia pestis
ucguccagcagcag

SEQ ID NO: 2274945 - RNA, 11 nt, Yersinia pestis
ucguccaaagg

SEQ ID NO: 2274946 - RNA, 14 nt, Yersinia pestis
ucguccaaagggag

SEQ ID NO: 2274947 - RNA, 20 nt, Yersinia pestis
ucgucccaggccuccgcaaa

SEQ ID NO: 2274948 - RNA, 18 nt, Yersinia pestis
ucgucgaauccaugauga

SEQ ID NO: 2274949 - RNA, 17 nt, Yersinia pestis
ucgucgaggaucaccac

SEQ ID NO: 2274950 - RNA, 21 nt, Yersinia pestis
ucgucggcccggccaggcucc

SEQ ID NO: 2274951 - RNA, 15 nt, Yersinia pestis
ucgucaaguucauau

SEQ ID NO: 2274952 - RNA, 15 nt, Yersinia pestis
ucguauguuuuuaac

SEQ ID NO: 2274953 - RNA, 15 nt, Yersinia pestis
ucguauuaucaauag

SEQ ID NO: 2274954 - RNA, 13 nt, Yersinia pestis
ucguauuuccagu

SEQ ID NO: 2274955 - RNA, 17 nt, Yersinia pestis
ucguaguaauagguggu

SEQ ID NO: 2274956 - RNA, 19 nt, Yersinia pestis
ucguaauggcgauaauauu

SEQ ID NO: 2274957 - RNA, 22 nt, Yersinia pestis
ucggccaguguuuucuccacac

SEQ ID NO: 2274958 - RNA, 22 nt, Yersinia pestis
ucggcccaacuugcuggcagga

SEQ ID NO: 2274959 - RNA, 15 nt, Yersinia pestis
ucggccccuuaccua

SEQ ID NO: 2274960 - RNA, 22 nt, Yersinia pestis
ucggcccgcaaccugacugcug

SEQ ID NO: 2274961 - RNA, 22 nt, Yersinia pestis
ucgggaaauugugauucaacug

SEQ ID NO: 2274962 - RNA, 17 nt, Yersinia pestis
ucgggaaaacaggcaau

SEQ ID NO: 2274963 - RNA, 15 nt, Yersinia pestis
ucggcggccauguca

SEQ ID NO: 2274964 - RNA, 20 nt, Yersinia pestis
ucggcgcgguaggggugcug

SEQ ID NO: 2274965 - RNA, 23 nt, Yersinia pestis
ucggugcauguaacuguaacgau

SEQ ID NO: 2274966 - RNA, 16 nt, Yersinia pestis
ucgguuucacccucuu

SEQ ID NO: 2274967 - RNA, 14 nt, Yersinia pestis
ucgguugccgccuu

SEQ ID NO: 2274968 - RNA, 13 nt, Yersinia pestis
ucgguuauuuauc

SEQ ID NO: 2274969 - RNA, 22 nt, Yersinia pestis
ucgguuaauauugaauaaccua

SEQ ID NO: 2274970 - RNA, 15 nt, Yersinia pestis
ucggugugacuuuca

SEQ ID NO: 2274971 - RNA, 11 nt, Yersinia pestis
ucgguggcccu

SEQ ID NO: 2274972 - RNA, 17 nt, Yersinia pestis
ucgggcuugguguugca

SEQ ID NO: 2274973 - RNA, 18 nt, Yersinia pestis
ucgguaccgccagaauaa

SEQ ID NO: 2274974 - RNA, 19 nt, Yersinia pestis
ucggguucuaaauccugca

SEQ ID NO: 2274975 - RNA, 14 nt, Yersinia pestis
ucgguaaccugaaa

SEQ ID NO: 2274976 - RNA, 22 nt, Yersinia pestis
ucgguacaaucucugggugcug

SEQ ID NO: 2274977 - RNA, 20 nt, Yersinia pestis
ucgguaagcuggcuucuuuu

SEQ ID NO: 2274978 - RNA, 13 nt, Yersinia pestis
ucgggguuuguca

SEQ ID NO: 2274979 - RNA, 19 nt, Yersinia pestis
ucggggguugucagcaguc

SEQ ID NO: 2274980 - RNA, 21 nt, Yersinia pestis
ucgggugauggcugucugaug

SEQ ID NO: 2274981 - RNA, 19 nt, Yersinia pestis
ucgggguuugucagcaguc

SEQ ID NO: 2274982 - RNA, 13 nt, Yersinia pestis
ucggguagcaucc

SEQ ID NO: 2274983 - RNA, 14 nt, Yersinia pestis
ucuccaucacucuu

SEQ ID NO: 2274984 - RNA, 16 nt, Yersinia pestis
ucuccagugcaaauuu

SEQ ID NO: 2274985 - RNA, 18 nt, Yersinia pestis
ucuccagugcaaauuuau

SEQ ID NO: 2274986 - RNA, 20 nt, Yersinia pestis
ucuccaguaaaagaauaaau

SEQ ID NO: 2274987 - RNA, 19 nt, Yersinia pestis
ucucccauuaauuaaucag

SEQ ID NO: 2274988 - RNA, 21 nt, Yersinia pestis
ucuccauggucaaacguucug

SEQ ID NO: 2274989 - RNA, 14 nt, Yersinia pestis
ucucauuaauaaug

SEQ ID NO: 2274990 - RNA, 15 nt, Yersinia pestis
ucucauuaauaauga

SEQ ID NO: 2274991 - RNA, 15 nt, Yersinia pestis
ucucauuccauaauu

SEQ ID NO: 2274992 - RNA, 19 nt, Yersinia pestis
ucucauuucgucuuaauuu

SEQ ID NO: 2274993 - RNA, 15 nt, Yersinia pestis
ucucauuuagcauua

SEQ ID NO: 2274994 - RNA, 15 nt, Yersinia pestis
ucucgcacucaucuu

SEQ ID NO: 2274995 - RNA, 14 nt, Yersinia pestis
ucucgccuaaguuu

SEQ ID NO: 2274996 - RNA, 15 nt, Yersinia pestis
ucucgauauuaaccc

SEQ ID NO: 2274997 - RNA, 21 nt, Yersinia pestis
ucucgacaaauccuuuuaaaa

SEQ ID NO: 2274998 - RNA, 15 nt, Yersinia pestis
ucuccuuauacuaaa

SEQ ID NO: 2274999 - RNA, 21 nt, Yersinia pestis
ucuccugcccuaauaccaaua

SEQ ID NO: 2275000 - RNA, 23 nt, Yersinia pestis
ucuccucuccccuaccucauccg

SEQ ID NO: 2275001 - RNA, 20 nt, Yersinia pestis
ucuccgucgcgggcacuuug

SEQ ID NO: 2275002 - RNA, 22 nt, Yersinia pestis
ucuccgucgcgggcacuuuguc

SEQ ID NO: 2275003 - RNA, 15 nt, Yersinia pestis
ucuccuaaaaucuau

SEQ ID NO: 2275004 - RNA, 21 nt, Yersinia pestis
ucuccuaaaaucuaucgauac

SEQ ID NO: 2275005 - RNA, 23 nt, Yersinia pestis
ucuccguugcaggcacuuuguca

SEQ ID NO: 2275006 - RNA, 17 nt, Yersinia pestis
ucugacacacaaauccu

SEQ ID NO: 2275007 - RNA, 13 nt, Yersinia pestis
ucugaccaaacau

SEQ ID NO: 2275008 - RNA, 15 nt, Yersinia pestis
ucugaccaaacauug

SEQ ID NO: 2275009 - RNA, 19 nt, Yersinia pestis
ucugagccucaugaaugag

SEQ ID NO: 2275010 - RNA, 13 nt, Yersinia pestis
ucugagccuucaa

SEQ ID NO: 2275011 - RNA, 17 nt, Yersinia pestis
ucugagccuucaacaaa

SEQ ID NO: 2275012 - RNA, 15 nt, Yersinia pestis
ucucuuguuuugcaa

SEQ ID NO: 2275013 - RNA, 14 nt, Yersinia pestis
ucugaaacggugag

SEQ ID NO: 2275014 - RNA, 18 nt, Yersinia pestis
ucugaaacggugaggaua

SEQ ID NO: 2275015 - RNA, 15 nt, Yersinia pestis
ucugaaacuucaaaa

SEQ ID NO: 2275016 - RNA, 16 nt, Yersinia pestis
ucugaguaccagcaaa

SEQ ID NO: 2275017 - RNA, 23 nt, Yersinia pestis
ucugaguuucauuagucaauguu

SEQ ID NO: 2275018 - RNA, 19 nt, Yersinia pestis
ucugaggcguggcacaccg

SEQ ID NO: 2275019 - RNA, 13 nt, Yersinia pestis
ucugauaaaacag

SEQ ID NO: 2275020 - RNA, 20 nt, Yersinia pestis
ucugagugauuuuccuccca

SEQ ID NO: 2275021 - RNA, 14 nt, Yersinia pestis
ucugauacugaacg

SEQ ID NO: 2275022 - RNA, 13 nt, Yersinia pestis
ucugcaagccccc

SEQ ID NO: 2275023 - RNA, 14 nt, Yersinia pestis
ucugcagaaugaag

SEQ ID NO: 2275024 - RNA, 13 nt, Yersinia pestis
ucugcaauagcuc

SEQ ID NO: 2275025 - RNA, 20 nt, Yersinia pestis
aaaugcuuuuugcgcugcgu

SEQ ID NO: 2275026 - RNA, 17 nt, Yersinia pestis
ucucuugauuaccaaua

SEQ ID NO: 2275027 - RNA, 21 nt, Yersinia pestis
ucucuuggggaaguggcccuu

SEQ ID NO: 2275028 - RNA, 21 nt, Yersinia pestis
ucucuugaaaugauaacaaua

SEQ ID NO: 2275029 - RNA, 23 nt, Yersinia pestis
ucucugaguuguaaugaauucag

SEQ ID NO: 2275030 - RNA, 23 nt, Yersinia pestis
ucucuggguaagaacagagagaa

SEQ ID NO: 2275031 - RNA, 21 nt, Yersinia pestis
ucucugcuuacucuuccaacu

SEQ ID NO: 2275032 - RNA, 17 nt, Yersinia pestis
ucucugcugcgaauauu

SEQ ID NO: 2275033 - RNA, 19 nt, Yersinia pestis
ucucggccaacaucuucca

SEQ ID NO: 2275034 - RNA, 14 nt, Yersinia pestis
ucucuccagugcaa

SEQ ID NO: 2275035 - RNA, 21 nt, Yersinia pestis
ucucuaugcguguugccaccu

SEQ ID NO: 2275036 - RNA, 17 nt, Yersinia pestis
ucuuaggucaucgucac

SEQ ID NO: 2275037 - RNA, 17 nt, Yersinia pestis
ucuuacauaaagaccca

SEQ ID NO: 2275038 - RNA, 15 nt, Yersinia pestis
ucuuaauuuuaucac

SEQ ID NO: 2275039 - RNA, 23 nt, Yersinia pestis
ucuguuucaaauaaguauuucaa

SEQ ID NO: 2275040 - RNA, 20 nt, Yersinia pestis
ucuguugauaaaaaucuuuu

SEQ ID NO: 2275041 - RNA, 20 nt, Yersinia pestis
ucuguuaauccuaaugaaca

SEQ ID NO: 2275042 - RNA, 23 nt, Yersinia pestis
ucuguuaucgcuacguacuaucu

SEQ ID NO: 2275043 - RNA, 17 nt, Yersinia pestis
ucuuauauaaauccagc

SEQ ID NO: 2275044 - RNA, 15 nt, Yersinia pestis
ucuuauauaaaucca

SEQ ID NO: 2275045 - RNA, 18 nt, Yersinia pestis
ucuuauauuauuaacgau

SEQ ID NO: 2275046 - RNA, 22 nt, Yersinia pestis
ucuuaucaaucaaaaaauaaau

SEQ ID NO: 2275047 - RNA, 15 nt, Yersinia pestis
ucuuaucaaucaaaa

SEQ ID NO: 2275048 - RNA, 14 nt, Yersinia pestis
ucuuccaaaggaag

SEQ ID NO: 2275049 - RNA, 18 nt, Yersinia pestis
ucuuccagcaacaugcca

SEQ ID NO: 2275050 - RNA, 15 nt, Yersinia pestis
ucuucaccaaugauu

SEQ ID NO: 2275051 - RNA, 22 nt, Yersinia pestis
ucuucacuggaucuuuuagcuc

SEQ ID NO: 2275052 - RNA, 18 nt, Yersinia pestis
ucuuccggcguaccacaa

SEQ ID NO: 2275053 - RNA, 20 nt, Yersinia pestis
ucuuccugugcgccacgcuc

SEQ ID NO: 2275054 - RNA, 13 nt, Yersinia pestis
ucuuccuaacccg

SEQ ID NO: 2275055 - RNA, 18 nt, Yersinia pestis
ucugugauuacgucugca

SEQ ID NO: 2275056 - RNA, 18 nt, Yersinia pestis
ucugugccagucuaaaau

SEQ ID NO: 2275057 - RNA, 18 nt, Yersinia pestis
ucuguggcagggcgcuuu

SEQ ID NO: 2275058 - RNA, 19 nt, Yersinia pestis
ucugugucaguaccugaug

SEQ ID NO: 2275059 - RNA, 22 nt, Yersinia pestis
ucugucuuccauuuuauuuaac

SEQ ID NO: 2275060 - RNA, 14 nt, Yersinia pestis
ucugucuaagugcc

SEQ ID NO: 2275061 - RNA, 16 nt, Yersinia pestis
ucugucguacuuuccu

SEQ ID NO: 2275062 - RNA, 22 nt, Yersinia pestis
ucugucagcccuaauauccuca

SEQ ID NO: 2275063 - RNA, 17 nt, Yersinia pestis
ucugguuugaauccagu

SEQ ID NO: 2275064 - RNA, 18 nt, Yersinia pestis
ucuguagaguaaaacuga

SEQ ID NO: 2275065 - RNA, 17 nt, Yersinia pestis
ucuguagagaaauucau

SEQ ID NO: 2275066 - RNA, 18 nt, Yersinia pestis
ucuguacguaaauagguu

SEQ ID NO: 2275067 - RNA, 15 nt, Yersinia pestis
ucuggcaauuucugu

SEQ ID NO: 2275068 - RNA, 22 nt, Yersinia pestis
ucuggcagauguaaccacccac

SEQ ID NO: 2275069 - RNA, 18 nt, Yersinia pestis
ucuggcaaaaucccagca

SEQ ID NO: 2275070 - RNA, 20 nt, Yersinia pestis
ucuggcguagguaguggcug

SEQ ID NO: 2275071 - RNA, 16 nt, Yersinia pestis
ucuggcguuucaucuu

SEQ ID NO: 2275072 - RNA, 17 nt, Yersinia pestis
ucuggcguuucaucuuc

SEQ ID NO: 2275073 - RNA, 23 nt, Yersinia pestis
ucuggcuaaacgaucagaacuaa

SEQ ID NO: 2275074 - RNA, 22 nt, Yersinia pestis
ucuggcuaauacugccaaucgc

SEQ ID NO: 2275075 - RNA, 17 nt, Yersinia pestis
ucuggcuaauagcguca

SEQ ID NO: 2275076 - RNA, 21 nt, Yersinia pestis
ucuggcuuaaucgccagcaaa

SEQ ID NO: 2275077 - RNA, 13 nt, Yersinia pestis
ucuggugccaacg

SEQ ID NO: 2275078 - RNA, 15 nt, Yersinia pestis
ucugcauuaaaauaa

SEQ ID NO: 2275079 - RNA, 18 nt, Yersinia pestis
ucugcauuaaaauaacaa

SEQ ID NO: 2275080 - RNA, 12 nt, Yersinia pestis
ucugccaaccaa

SEQ ID NO: 2275081 - RNA, 15 nt, Yersinia pestis
ucugccaaccaggcc

SEQ ID NO: 2275082 - RNA, 22 nt, Yersinia pestis
ucugccagaauuuugcagcgcu

SEQ ID NO: 2275083 - RNA, 15 nt, Yersinia pestis
ucugccaccgcacag

SEQ ID NO: 2275084 - RNA, 17 nt, Yersinia pestis
ucugccacacugaauuu

SEQ ID NO: 2275085 - RNA, 18 nt, Yersinia pestis
ucugccaauucaaggcca

SEQ ID NO: 2275086 - RNA, 18 nt, Yersinia pestis
ucugccaauuuggggcug

SEQ ID NO: 2275087 - RNA, 22 nt, Yersinia pestis
ucugcaucgguaagauaaccca

SEQ ID NO: 2275088 - RNA, 18 nt, Yersinia pestis
ucugcuguugccacagac

SEQ ID NO: 2275089 - RNA, 13 nt, Yersinia pestis
ucugcuuacucuu

SEQ ID NO: 2275090 - RNA, 14 nt, Yersinia pestis
ucugcuuacucuuc

SEQ ID NO: 2275091 - RNA, 23 nt, Yersinia pestis
ucugccagauagucaucuuucca

SEQ ID NO: 2275092 - RNA, 19 nt, Yersinia pestis
ucugccagauagucaucuu

SEQ ID NO: 2275093 - RNA, 22 nt, Yersinia pestis
ucuaaauuaauaucuuuaaauu

SEQ ID NO: 2275094 - RNA, 17 nt, Yersinia pestis
ucuaacagggaugaaua

SEQ ID NO: 2275095 - RNA, 15 nt, Yersinia pestis
ucuaacauacucaga

SEQ ID NO: 2275096 - RNA, 21 nt, Yersinia pestis
ucuaaacgaccaauuucaaua

SEQ ID NO: 2275097 - RNA, 23 nt, Yersinia pestis
aaaucuuuuuguaauguuucuau

SEQ ID NO: 2275098 - RNA, 10 nt, Yersinia pestis
aaaugaaaca

SEQ ID NO: 2275099 - RNA, 20 nt, Yersinia pestis
aaaugaagggggcuuauucu

SEQ ID NO: 2275100 - RNA, 21 nt, Yersinia pestis
aaaugaagggggcuuauucua

SEQ ID NO: 2275101 - RNA, 15 nt, Yersinia pestis
ucuaauaaugagcca

SEQ ID NO: 2275102 - RNA, 12 nt, Yersinia pestis
ucuaaguccaag

SEQ ID NO: 2275103 - RNA, 13 nt, Yersinia pestis
aaaucuuaaucag

SEQ ID NO: 2275104 - RNA, 22 nt, Yersinia pestis
aaaucuugugaugcauauuauu

SEQ ID NO: 2275105 - RNA, 19 nt, Yersinia pestis
aaaucuuguuaauuuaaac

SEQ ID NO: 2275106 - RNA, 16 nt, Yersinia pestis
ucuaacuaauaauaau

SEQ ID NO: 2275107 - RNA, 15 nt, Yersinia pestis
ucuaacucauucaua

SEQ ID NO: 2275108 - RNA, 14 nt, Yersinia pestis
ucuaacucauucau

SEQ ID NO: 2275109 - RNA, 15 nt, Yersinia pestis
ucuaacuaauaauaa

SEQ ID NO: 2275110 - RNA, 18 nt, Yersinia pestis
ucuacgccgucaucaucu

SEQ ID NO: 2275111 - RNA, 14 nt, Yersinia pestis
aaaugauaacaaua

SEQ ID NO: 2275112 - RNA, 15 nt, Yersinia pestis
aaaugauaacaauaa

SEQ ID NO: 2275113 - RNA, 18 nt, Yersinia pestis
aaaugauaacaauaaaau

SEQ ID NO: 2275114 - RNA, 17 nt, Yersinia pestis
aaaugagggauauaccc

SEQ ID NO: 2275115 - RNA, 12 nt, Yersinia pestis
aaaugagccugu

SEQ ID NO: 2275116 - RNA, 19 nt, Yersinia pestis
ucuacuuacgagcuaaugc

SEQ ID NO: 2275117 - RNA, 17 nt, Yersinia pestis
ucuaccaguuuuuuccu

SEQ ID NO: 2275118 - RNA, 17 nt, Yersinia pestis
ucuaccugaaugcgccg

SEQ ID NO: 2275119 - RNA, 22 nt, Yersinia pestis
ucuaccuucccguccacuuuca

SEQ ID NO: 2275120 - RNA, 23 nt, Yersinia pestis
ucuaccuucaggccuuuacuguu

SEQ ID NO: 2275121 - RNA, 15 nt, Yersinia pestis
aaaugacauucuuug

SEQ ID NO: 2275122 - RNA, 13 nt, Yersinia pestis
aaaugacaaauca

SEQ ID NO: 2275123 - RNA, 14 nt, Yersinia pestis
ucuaauuuauaacc

SEQ ID NO: 2275124 - RNA, 16 nt, Yersinia pestis
ucuaauuguuauuauu

SEQ ID NO: 2275125 - RNA, 14 nt, Yersinia pestis
ucuaauugcugccc

SEQ ID NO: 2275126 - RNA, 15 nt, Yersinia pestis
ucuaauguaauaauc

SEQ ID NO: 2275127 - RNA, 18 nt, Yersinia pestis
ucuaauguaauaaucuaa

SEQ ID NO: 2275128 - RNA, 16 nt, Yersinia pestis
ucuacaaauuuuuuau

SEQ ID NO: 2275129 - RNA, 23 nt, Yersinia pestis
ucuacauuuagucuacgcucuac

SEQ ID NO: 2275130 - RNA, 17 nt, Yersinia pestis
ucuacauaaucuuuacu

SEQ ID NO: 2275131 - RNA, 21 nt, Yersinia pestis
ucucaacauaguugaauaacu

SEQ ID NO: 2275132 - RNA, 13 nt, Yersinia pestis
ucucaaccaaaua

SEQ ID NO: 2275133 - RNA, 14 nt, Yersinia pestis
ucucacaaaauaau

SEQ ID NO: 2275134 - RNA, 22 nt, Yersinia pestis
ucucaaggucuuucgcccacaa

SEQ ID NO: 2275135 - RNA, 17 nt, Yersinia pestis
ucucaagacacuauucc

SEQ ID NO: 2275136 - RNA, 14 nt, Yersinia pestis
ucuauuuuuauaau

SEQ ID NO: 2275137 - RNA, 22 nt, Yersinia pestis
ucuauugugucaauaccuuacu

SEQ ID NO: 2275138 - RNA, 18 nt, Yersinia pestis
ucuauuucaugauucucu

SEQ ID NO: 2275139 - RNA, 11 nt, Yersinia pestis
ucuauuuccac

SEQ ID NO: 2275140 - RNA, 12 nt, Yersinia pestis
ucuauuuccauc

SEQ ID NO: 2275141 - RNA, 14 nt, Yersinia pestis
ucuauugaaaaaau

SEQ ID NO: 2275142 - RNA, 15 nt, Yersinia pestis
ucuauucugcuuuuu

SEQ ID NO: 2275143 - RNA, 18 nt, Yersinia pestis
ucuauucugcuuuuugcu

SEQ ID NO: 2275144 - RNA, 19 nt, Yersinia pestis
ucuauugaaaaaauaaugu

SEQ ID NO: 2275145 - RNA, 20 nt, Yersinia pestis
ucuauugaaaaaauaauguc

SEQ ID NO: 2275146 - RNA, 18 nt, Yersinia pestis
ucucaguugaaacccaca

SEQ ID NO: 2275147 - RNA, 21 nt, Yersinia pestis
ucucaggugugagguuauuga

SEQ ID NO: 2275148 - RNA, 15 nt, Yersinia pestis
ucucaucggcauacu

SEQ ID NO: 2275149 - RNA, 14 nt, Yersinia pestis
ucucaucaaggaaa

SEQ ID NO: 2275150 - RNA, 17 nt, Yersinia pestis
ucucaucaauaccgaaa

SEQ ID NO: 2275151 - RNA, 16 nt, Yersinia pestis
ucucagaacaagacag

SEQ ID NO: 2275152 - RNA, 21 nt, Yersinia pestis
ucucacuuggguagcagccca

SEQ ID NO: 2275153 - RNA, 15 nt, Yersinia pestis
ucucaggcucagcgg

SEQ ID NO: 2275154 - RNA, 15 nt, Yersinia pestis
aaaugccgccugacu

SEQ ID NO: 2275155 - RNA, 17 nt, Yersinia pestis
aaaugccguacaacaau

SEQ ID NO: 2275156 - RNA, 15 nt, Yersinia pestis
ucucacuuacuauga

SEQ ID NO: 2275157 - RNA, 19 nt, Yersinia pestis
ucucaccugcuuaguuaca

SEQ ID NO: 2275158 - RNA, 15 nt, Yersinia pestis
ucucacgaugccuuu

SEQ ID NO: 2275159 - RNA, 19 nt, Yersinia pestis
aaaugcggcggcugaccac

SEQ ID NO: 2275160 - RNA, 16 nt, Yersinia pestis
ucucacccaauaagau

SEQ ID NO: 2275161 - RNA, 24 nt, Yersinia pestis
aaaugauuauuuauuuacagccac

SEQ ID NO: 2275162 - RNA, 17 nt, Yersinia pestis
aaaugcauuauaaggaa

SEQ ID NO: 2275163 - RNA, 20 nt, Yersinia pestis
aaaugcacugaacaaugcca

SEQ ID NO: 2275164 - RNA, 13 nt, Yersinia pestis
aaaugauggcggc

SEQ ID NO: 2275165 - RNA, 15 nt, Yersinia pestis
ucuagcgccagcaau

SEQ ID NO: 2275166 - RNA, 21 nt, Yersinia pestis
aaaugaucaucaagccaaugg

SEQ ID NO: 2275167 - RNA, 21 nt, Yersinia pestis
ucuagaccugaggauaaaaac

SEQ ID NO: 2275168 - RNA, 17 nt, Yersinia pestis
ucuagcccuucagcaaa

SEQ ID NO: 2275169 - RNA, 18 nt, Yersinia pestis
ucuagcagugauuucagu

SEQ ID NO: 2275170 - RNA, 17 nt, Yersinia pestis
ucuagcagugauuucag

SEQ ID NO: 2275171 - RNA, 19 nt, Yersinia pestis
ucuagcaacacaucgguau

SEQ ID NO: 2275172 - RNA, 24 nt, Yersinia pestis
ucuaucaggagcauuuguagccug

SEQ ID NO: 2275173 - RNA, 21 nt, Yersinia pestis
ucuaucaggucaaucuuauug

SEQ ID NO: 2275174 - RNA, 13 nt, Yersinia pestis
ucuaucaauauau

SEQ ID NO: 2275175 - RNA, 18 nt, Yersinia pestis
ucuaucaauauauacccg

SEQ ID NO: 2275176 - RNA, 17 nt, Yersinia pestis
ucuaucgggcagguaaa

SEQ ID NO: 2275177 - RNA, 18 nt, Yersinia pestis
ucuaucgauacccuucau

SEQ ID NO: 2275178 - RNA, 16 nt, Yersinia pestis
ucuauccgaaaaauau

SEQ ID NO: 2275179 - RNA, 17 nt, Yersinia pestis
ucuauccgaaaaauauu

SEQ ID NO: 2275180 - RNA, 20 nt, Yersinia pestis
ucuaucuugucguuauuuuc

SEQ ID NO: 2275181 - RNA, 18 nt, Yersinia pestis
ucuaugccaguuauuauu

SEQ ID NO: 2275182 - RNA, 19 nt, Yersinia pestis
uuaaauggugguuuucuua

SEQ ID NO: 2275183 - RNA, 19 nt, Yersinia pestis
uuaaaugaaccaaaauuca

SEQ ID NO: 2275184 - RNA, 17 nt, Yersinia pestis
uuaaaucuuacugguuu

SEQ ID NO: 2275185 - RNA, 15 nt, Yersinia pestis
uuaaauuacagacaa

SEQ ID NO: 2275186 - RNA, 17 nt, Yersinia pestis
uuaaauuacagacaaau

SEQ ID NO: 2275187 - RNA, 21 nt, Yersinia pestis
uuaaauuacgguuuaccaccu

SEQ ID NO: 2275188 - RNA, 20 nt, Yersinia pestis
uuaaauuauugaguaacauu

SEQ ID NO: 2275189 - RNA, 21 nt, Yersinia pestis
uuaaauuaucccguucaauaa

SEQ ID NO: 2275190 - RNA, 20 nt, Yersinia pestis
uuaaauuaucccguucaaua

SEQ ID NO: 2275191 - RNA, 20 nt, Yersinia pestis
uuaaauugucuccaucccug

SEQ ID NO: 2275192 - RNA, 20 nt, Yersinia pestis
uuaacaaucagugcaauaaa

SEQ ID NO: 2275193 - RNA, 13 nt, Yersinia pestis
uuaacaauguuau

SEQ ID NO: 2275194 - RNA, 19 nt, Yersinia pestis
uuaacaauuacuuuggcau

SEQ ID NO: 2275195 - RNA, 20 nt, Yersinia pestis
uuaacacauuccaguaaaaa

SEQ ID NO: 2275196 - RNA, 21 nt, Yersinia pestis
uuaacacauuccaguaaaaaa

SEQ ID NO: 2275197 - RNA, 19 nt, Yersinia pestis
uuaacacccaauaauaaaa

SEQ ID NO: 2275198 - RNA, 22 nt, Yersinia pestis
uuaacacccaauaauaaaaaaa

SEQ ID NO: 2275199 - RNA, 15 nt, Yersinia pestis
uuaacacgggcauga

SEQ ID NO: 2275200 - RNA, 20 nt, Yersinia pestis
uuaaauuuuuauauaauuga

SEQ ID NO: 2275201 - RNA, 17 nt, Yersinia pestis
uuaacaauauuauauuc

SEQ ID NO: 2275202 - RNA, 19 nt, Yersinia pestis
uuaacaaucagugcaauaa

SEQ ID NO: 2275203 - RNA, 17 nt, Yersinia pestis
uuaaauuuuaauuauaa

SEQ ID NO: 2275204 - RNA, 11 nt, Yersinia pestis
uuaaauuucug

SEQ ID NO: 2275205 - RNA, 15 nt, Yersinia pestis
uuaaauuuuuauaua

SEQ ID NO: 2275206 - RNA, 17 nt, Yersinia pestis
uuaacaaagcuauuuuu

SEQ ID NO: 2275207 - RNA, 20 nt, Yersinia pestis
uuaaagccuucaacuaauau

SEQ ID NO: 2275208 - RNA, 21 nt, Yersinia pestis
uuaaagccauucagcagcaag

SEQ ID NO: 2275209 - RNA, 18 nt, Yersinia pestis
uuaaagugagaaggguau

SEQ ID NO: 2275210 - RNA, 14 nt, Yersinia pestis
uuaaauaaaacacc

SEQ ID NO: 2275211 - RNA, 16 nt, Yersinia pestis
uuaaaguuuuuuauuu

SEQ ID NO: 2275212 - RNA, 19 nt, Yersinia pestis
uuaaaguuuuuuauuuaua

SEQ ID NO: 2275213 - RNA, 17 nt, Yersinia pestis
uuaaaguuuagcaaagc

SEQ ID NO: 2275214 - RNA, 15 nt, Yersinia pestis
uuaaauaccagagac

SEQ ID NO: 2275215 - RNA, 20 nt, Yersinia pestis
uuaaaucaagcugcucgcca

SEQ ID NO: 2275216 - RNA, 19 nt, Yersinia pestis
uuaacuuuuucuaucccua

SEQ ID NO: 2275217 - RNA, 22 nt, Yersinia pestis
uuaacuuuucuucauugcugcu

SEQ ID NO: 2275218 - RNA, 21 nt, Yersinia pestis
uuaacuggccaauuaacggau

SEQ ID NO: 2275219 - RNA, 22 nt, Yersinia pestis
uuaacugcauagcuaaccuuaa

SEQ ID NO: 2275220 - RNA, 17 nt, Yersinia pestis
uuaacuguuuuauauuu

SEQ ID NO: 2275221 - RNA, 20 nt, Yersinia pestis
uuaagauaggcagaaaagca

SEQ ID NO: 2275222 - RNA, 15 nt, Yersinia pestis
uuaacagcaucacug

SEQ ID NO: 2275223 - RNA, 18 nt, Yersinia pestis
uuaacagccccgucucaa

SEQ ID NO: 2275224 - RNA, 17 nt, Yersinia pestis
uuaacaucgccacgaau

SEQ ID NO: 2275225 - RNA, 17 nt, Yersinia pestis
uuaaccugcacuuucau

SEQ ID NO: 2275226 - RNA, 16 nt, Yersinia pestis
uuaaccuguaaaagca

SEQ ID NO: 2275227 - RNA, 13 nt, Yersinia pestis
uuaaccaacauga

SEQ ID NO: 2275228 - RNA, 12 nt, Yersinia pestis
uuaacugaaagc

SEQ ID NO: 2275229 - RNA, 20 nt, Yersinia pestis
uuaacucuuuuuaaacuauu

SEQ ID NO: 2275230 - RNA, 15 nt, Yersinia pestis
uuaacugcaguaaaa

SEQ ID NO: 2275231 - RNA, 19 nt, Yersinia pestis
uuaacugcauagcuaaccu

SEQ ID NO: 2275232 - RNA, 17 nt, Yersinia pestis
uuaacgauauagucuug

SEQ ID NO: 2275233 - RNA, 15 nt, Yersinia pestis
uuaagguuagcuaug

SEQ ID NO: 2275234 - RNA, 22 nt, Yersinia pestis
uuaagguuagcuaugcaguuaa

SEQ ID NO: 2275235 - RNA, 15 nt, Yersinia pestis
uuaagguaacggcau

SEQ ID NO: 2275236 - RNA, 23 nt, Yersinia pestis
uuaaguuuucuggcaauuucugu

SEQ ID NO: 2275237 - RNA, 13 nt, Yersinia pestis
uuaauaccaugca

SEQ ID NO: 2275238 - RNA, 19 nt, Yersinia pestis
uuaauacaggcugacauuu

SEQ ID NO: 2275239 - RNA, 19 nt, Yersinia pestis
uuaauaucuuuaaauuauu

SEQ ID NO: 2275240 - RNA, 21 nt, Yersinia pestis
uuaauaucuuuaaauuauuga

SEQ ID NO: 2275241 - RNA, 15 nt, Yersinia pestis
uuaauaugcaaaaaa

SEQ ID NO: 2275242 - RNA, 16 nt, Yersinia pestis
uuaauaucaaaacuga

SEQ ID NO: 2275243 - RNA, 12 nt, Yersinia pestis
uuaaucagugac

SEQ ID NO: 2275244 - RNA, 17 nt, Yersinia pestis
uuaaucaucaucacaaa

SEQ ID NO: 2275245 - RNA, 15 nt, Yersinia pestis
uuacgucagaaauaa

SEQ ID NO: 2275246 - RNA, 14 nt, Yersinia pestis
uuacguaauaguaa

SEQ ID NO: 2275247 - RNA, 22 nt, Yersinia pestis
uuacgccaccuucuuauuuauc

SEQ ID NO: 2275248 - RNA, 20 nt, Yersinia pestis
uuacgccugggcauacuguu

SEQ ID NO: 2275249 - RNA, 22 nt, Yersinia pestis
uuacuccucugccuauccucac

SEQ ID NO: 2275250 - RNA, 18 nt, Yersinia pestis
uuacucguauaaaaaaua

SEQ ID NO: 2275251 - RNA, 16 nt, Yersinia pestis
uuacucguauaaaaaa

SEQ ID NO: 2275252 - RNA, 17 nt, Yersinia pestis
uuacucguuuuacauug

SEQ ID NO: 2275253 - RNA, 14 nt, Yersinia pestis
uuacucucgccaaa

SEQ ID NO: 2275254 - RNA, 21 nt, Yersinia pestis
uuacuccucugccuauccuca

SEQ ID NO: 2275255 - RNA, 14 nt, Yersinia pestis
uuacuaucuuuauu

SEQ ID NO: 2275256 - RNA, 20 nt, Yersinia pestis
uuacuguaucaauaccuuac

SEQ ID NO: 2275257 - RNA, 21 nt, Yersinia pestis
uuacuguaucaauaccuuacu

SEQ ID NO: 2275258 - RNA, 17 nt, Yersinia pestis
uuacuguccuuuaacuc

SEQ ID NO: 2275259 - RNA, 14 nt, Yersinia pestis
uuacucuucugccu

SEQ ID NO: 2275260 - RNA, 16 nt, Yersinia pestis
uuacugaaaagaggca

SEQ ID NO: 2275261 - RNA, 17 nt, Yersinia pestis
uuacugaaaagaggcac

SEQ ID NO: 2275262 - RNA, 22 nt, Yersinia pestis
uuacucuucagccuauccucac

SEQ ID NO: 2275263 - RNA, 21 nt, Yersinia pestis
uuacucuucagccuauccuca

SEQ ID NO: 2275264 - RNA, 13 nt, Yersinia pestis
uuagaaaacauuu

SEQ ID NO: 2275265 - RNA, 17 nt, Yersinia pestis
uuagacagaauuauuua

SEQ ID NO: 2275266 - RNA, 19 nt, Yersinia pestis
uuagaauguguaguugaag

SEQ ID NO: 2275267 - RNA, 14 nt, Yersinia pestis
uuagauuucaccua

SEQ ID NO: 2275268 - RNA, 20 nt, Yersinia pestis
uuagauguguuuaaaucuuu

SEQ ID NO: 2275269 - RNA, 18 nt, Yersinia pestis
uuagccuucguuugucaa

SEQ ID NO: 2275270 - RNA, 14 nt, Yersinia pestis
uuagcgagaaaguc

SEQ ID NO: 2275271 - RNA, 23 nt, Yersinia pestis
uuagcgaugaccauuuauuucca

SEQ ID NO: 2275272 - RNA, 15 nt, Yersinia pestis
uuagcgagaaaguca

SEQ ID NO: 2275273 - RNA, 17 nt, Yersinia pestis
uuagcgccgcuucgguc

SEQ ID NO: 2275274 - RNA, 15 nt, Yersinia pestis
uuacgaucugccugu

SEQ ID NO: 2275275 - RNA, 14 nt, Yersinia pestis
uuacgcaacaagcc

SEQ ID NO: 2275276 - RNA, 22 nt, Yersinia pestis
uuacgcaacguaauaucugcca

SEQ ID NO: 2275277 - RNA, 22 nt, Yersinia pestis
uuacgauaaaggcgagucagca

SEQ ID NO: 2275278 - RNA, 15 nt, Yersinia pestis
uuacgauaaucuccc

SEQ ID NO: 2275279 - RNA, 15 nt, Yersinia pestis
uuaccugcaauaaug

SEQ ID NO: 2275280 - RNA, 14 nt, Yersinia pestis
uuaccugcucaacu

SEQ ID NO: 2275281 - RNA, 15 nt, Yersinia pestis
uuaccguugauugga

SEQ ID NO: 2275282 - RNA, 20 nt, Yersinia pestis
uuaccgucgucucuauuggc

SEQ ID NO: 2275283 - RNA, 11 nt, Yersinia pestis
uuaccuaacca

SEQ ID NO: 2275284 - RNA, 18 nt, Yersinia pestis
uuaccuaaccaaacauug

SEQ ID NO: 2275285 - RNA, 16 nt, Yersinia pestis
uuaccuauuuuaaaac

SEQ ID NO: 2275286 - RNA, 19 nt, Yersinia pestis
uuacauauaggaaaugucg

SEQ ID NO: 2275287 - RNA, 17 nt, Yersinia pestis
uuacauauaauccaaaa

SEQ ID NO: 2275288 - RNA, 17 nt, Yersinia pestis
uuaccacuggccuccca

SEQ ID NO: 2275289 - RNA, 16 nt, Yersinia pestis
uuaccacggccaagua

SEQ ID NO: 2275290 - RNA, 21 nt, Yersinia pestis
uuacaucaaccccuuucuuaa

SEQ ID NO: 2275291 - RNA, 15 nt, Yersinia pestis
uuaccguaagauucg

SEQ ID NO: 2275292 - RNA, 18 nt, Yersinia pestis
uuaccgccgucaugcuga

SEQ ID NO: 2275293 - RNA, 14 nt, Yersinia pestis
uuacccacauuaaa

SEQ ID NO: 2275294 - RNA, 14 nt, Yersinia pestis
uuaccauccacuag

SEQ ID NO: 2275295 - RNA, 17 nt, Yersinia pestis
uuaaucuuguaaagacg

SEQ ID NO: 2275296 - RNA, 23 nt, Yersinia pestis
uuaauccccggucacuuaaauaa

SEQ ID NO: 2275297 - RNA, 21 nt, Yersinia pestis
uuaaucugcccagccugguuu

SEQ ID NO: 2275298 - RNA, 23 nt, Yersinia pestis
uuaauccccaugaugauaucacc

SEQ ID NO: 2275299 - RNA, 21 nt, Yersinia pestis
uuaauccauagugauuauuua

SEQ ID NO: 2275300 - RNA, 20 nt, Yersinia pestis
uuaauuuagccauucaaaaa

SEQ ID NO: 2275301 - RNA, 14 nt, Yersinia pestis
uuaauuucacuucc

SEQ ID NO: 2275302 - RNA, 15 nt, Yersinia pestis
uuaauuucagucaau

SEQ ID NO: 2275303 - RNA, 22 nt, Yersinia pestis
uuaauuucagucaauaaacauu

SEQ ID NO: 2275304 - RNA, 13 nt, Yersinia pestis
uuaauuuaaauaa

SEQ ID NO: 2275305 - RNA, 15 nt, Yersinia pestis
uuaauuuaaauaaaa

SEQ ID NO: 2275306 - RNA, 18 nt, Yersinia pestis
uuaauuggcccauaacaa

SEQ ID NO: 2275307 - RNA, 18 nt, Yersinia pestis
uuaauuuuucauaauaau

SEQ ID NO: 2275308 - RNA, 19 nt, Yersinia pestis
uuacaaauuugacauuucc

SEQ ID NO: 2275309 - RNA, 19 nt, Yersinia pestis
uuacacugucgacugcuuu

SEQ ID NO: 2275310 - RNA, 20 nt, Yersinia pestis
uuacaccgugcaauagcuag

SEQ ID NO: 2275311 - RNA, 16 nt, Yersinia pestis
uuacacccaacuuuuu

SEQ ID NO: 2275312 - RNA, 23 nt, Yersinia pestis
uuacacaauaggcuauuuuacuu

SEQ ID NO: 2275313 - RNA, 21 nt, Yersinia pestis
uuacacacccucaacucaaaa

SEQ ID NO: 2275314 - RNA, 15 nt, Yersinia pestis
uguuuuguaaaugcu

SEQ ID NO: 2275315 - RNA, 18 nt, Yersinia pestis
uguuuuuaacaaaaugga

SEQ ID NO: 2275316 - RNA, 18 nt, Yersinia pestis
uguuuuuccaaaugaaaa

SEQ ID NO: 2275317 - RNA, 14 nt, Yersinia pestis
uguuuuauuauaua

SEQ ID NO: 2275318 - RNA, 22 nt, Yersinia pestis
uguuuuauuauauauuuugaau

SEQ ID NO: 2275319 - RNA, 12 nt, Yersinia pestis
uguuuuaaaaaa

SEQ ID NO: 2275320 - RNA, 20 nt, Yersinia pestis
uguuuggcauggauaucagc

SEQ ID NO: 2275321 - RNA, 14 nt, Yersinia pestis
uguuugggauaaag

SEQ ID NO: 2275322 - RNA, 22 nt, Yersinia pestis
uguuucaaauaaguacuuccaa

SEQ ID NO: 2275323 - RNA, 11 nt, Yersinia pestis
uguuucaagau

SEQ ID NO: 2275324 - RNA, 17 nt, Yersinia pestis
uguuucaauacuauucc

SEQ ID NO: 2275325 - RNA, 13 nt, Yersinia pestis
uguuucaaauaag

SEQ ID NO: 2275326 - RNA, 17 nt, Yersinia pestis
uguuuccucuucaucua

SEQ ID NO: 2275327 - RNA, 19 nt, Yersinia pestis
uguuucauuucgcuccacc

SEQ ID NO: 2275328 - RNA, 22 nt, Yersinia pestis
uguuugauaaggccaugucacu

SEQ ID NO: 2275329 - RNA, 21 nt, Yersinia pestis
uguuugaugguuauguguauu

SEQ ID NO: 2275330 - RNA, 17 nt, Yersinia pestis
uguuugauuacuggccg

SEQ ID NO: 2275331 - RNA, 13 nt, Yersinia pestis
uguuugcccuaga

SEQ ID NO: 2275332 - RNA, 21 nt, Yersinia pestis
uguuugcgcagcaaauaaaca

SEQ ID NO: 2275333 - RNA, 16 nt, Yersinia pestis
uguuucugauaucuaa

SEQ ID NO: 2275334 - RNA, 19 nt, Yersinia pestis
uguuucugauaucuaaaaa

SEQ ID NO: 2275335 - RNA, 21 nt, Yersinia pestis
uguuucggguauucggcggcu

SEQ ID NO: 2275336 - RNA, 18 nt, Yersinia pestis
uguuucuauccgaaaaau

SEQ ID NO: 2275337 - RNA, 21 nt, Yersinia pestis
uguuucuauccgaaaaauauu

SEQ ID NO: 2275338 - RNA, 16 nt, Yersinia pestis
uuaaacuguuauuggg

SEQ ID NO: 2275339 - RNA, 16 nt, Yersinia pestis
uuaaacgcucaucaac

SEQ ID NO: 2275340 - RNA, 19 nt, Yersinia pestis
uuaaagauuucaucauuca

SEQ ID NO: 2275341 - RNA, 23 nt, Yersinia pestis
uuaaagaagaauccacauaaaaa

SEQ ID NO: 2275342 - RNA, 13 nt, Yersinia pestis
uuaaagaagacga

SEQ ID NO: 2275343 - RNA, 14 nt, Yersinia pestis
uuaaagaaugcaac

SEQ ID NO: 2275344 - RNA, 13 nt, Yersinia pestis
uuaaagacauauc

SEQ ID NO: 2275345 - RNA, 21 nt, Yersinia pestis
uuaaagacauaucacaguuaa

SEQ ID NO: 2275346 - RNA, 22 nt, Yersinia pestis
uuaaagaccaacgcuguaaucu

SEQ ID NO: 2275347 - RNA, 21 nt, Yersinia pestis
uuaaacauuauuuuucaccug

SEQ ID NO: 2275348 - RNA, 19 nt, Yersinia pestis
uuaaacccggcaucaacca

SEQ ID NO: 2275349 - RNA, 23 nt, Yersinia pestis
uuaaaaauacaaccaacaaacaa

SEQ ID NO: 2275350 - RNA, 13 nt, Yersinia pestis
uguuuuuuugaua

SEQ ID NO: 2275351 - RNA, 20 nt, Yersinia pestis
uguuuuuuugauauucucac

SEQ ID NO: 2275352 - RNA, 15 nt, Yersinia pestis
uuaaaaaaauuauca

SEQ ID NO: 2275353 - RNA, 13 nt, Yersinia pestis
uuaaaaauccaua

SEQ ID NO: 2275354 - RNA, 13 nt, Yersinia pestis
uuaaaacaggcga

SEQ ID NO: 2275355 - RNA, 22 nt, Yersinia pestis
uuaaaacaggcgaguuucccuu

SEQ ID NO: 2275356 - RNA, 22 nt, Yersinia pestis
uuaaaauacugccaaucgcucu

SEQ ID NO: 2275357 - RNA, 23 nt, Yersinia pestis
uuaaaauaguggcacaaauaaaa

SEQ ID NO: 2275358 - RNA, 14 nt, Yersinia pestis
uuaaaauaguggca

SEQ ID NO: 2275359 - RNA, 22 nt, Yersinia pestis
uuaaaauaguggcacaaauaaa

SEQ ID NO: 2275360 - RNA, 13 nt, Yersinia pestis
uguuagcaucuga

SEQ ID NO: 2275361 - RNA, 15 nt, Yersinia pestis
uguuagcaauuugag

SEQ ID NO: 2275362 - RNA, 16 nt, Yersinia pestis
uguuagaugcuaucug

SEQ ID NO: 2275363 - RNA, 17 nt, Yersinia pestis
uguuagagagcggucuc

SEQ ID NO: 2275364 - RNA, 15 nt, Yersinia pestis
uguuaucaccuguca

SEQ ID NO: 2275365 - RNA, 20 nt, Yersinia pestis
uguuauccaucaaccacggu

SEQ ID NO: 2275366 - RNA, 21 nt, Yersinia pestis
uguuaucgcuacguacuaucu

SEQ ID NO: 2275367 - RNA, 20 nt, Yersinia pestis
uguuauggauuuuuaaggac

SEQ ID NO: 2275368 - RNA, 15 nt, Yersinia pestis
uguuauuucugggau

SEQ ID NO: 2275369 - RNA, 15 nt, Yersinia pestis
uguuauuacugucac

SEQ ID NO: 2275370 - RNA, 13 nt, Yersinia pestis
uguuauuaucaug

SEQ ID NO: 2275371 - RNA, 20 nt, Yersinia pestis
uguucaaaucugcuccauca

SEQ ID NO: 2275372 - RNA, 16 nt, Yersinia pestis
uguucaagcaccucaa

SEQ ID NO: 2275373 - RNA, 14 nt, Yersinia pestis
uguuauuuuucucu

SEQ ID NO: 2275374 - RNA, 20 nt, Yersinia pestis
uguuauuuuucucuuucagc

SEQ ID NO: 2275375 - RNA, 14 nt, Yersinia pestis
uguucaaaaacgca

SEQ ID NO: 2275376 - RNA, 13 nt, Yersinia pestis
uguucacggcuuu

SEQ ID NO: 2275377 - RNA, 13 nt, Yersinia pestis
uguucgugaaagc

SEQ ID NO: 2275378 - RNA, 15 nt, Yersinia pestis
uguucuaucucaucu

SEQ ID NO: 2275379 - RNA, 22 nt, Yersinia pestis
uguucucuggguaagaacagag

SEQ ID NO: 2275380 - RNA, 20 nt, Yersinia pestis
uguucgaucaaaacaauaaa

SEQ ID NO: 2275381 - RNA, 22 nt, Yersinia pestis
uguucgaucaaaacaauaaaaa

SEQ ID NO: 2275382 - RNA, 14 nt, Yersinia pestis
uguucguagguuug

SEQ ID NO: 2275383 - RNA, 20 nt, Yersinia pestis
uguuccacuguaucuuugcu

SEQ ID NO: 2275384 - RNA, 20 nt, Yersinia pestis
uguucauauaguugcuuauc

SEQ ID NO: 2275385 - RNA, 14 nt, Yersinia pestis
uguucauaaauuaa

SEQ ID NO: 2275386 - RNA, 15 nt, Yersinia pestis
uguucauaaauuaaa

SEQ ID NO: 2275387 - RNA, 16 nt, Yersinia pestis
uguucauaaauuaaaa

SEQ ID NO: 2275388 - RNA, 17 nt, Yersinia pestis
uguuccauaugaacauc

SEQ ID NO: 2275389 - RNA, 16 nt, Yersinia pestis
uguuccugauuccaaa

SEQ ID NO: 2275390 - RNA, 11 nt, Yersinia pestis
uguuccucagg

SEQ ID NO: 2275391 - RNA, 22 nt, Yersinia pestis
uguugagaaauauuugagauau

SEQ ID NO: 2275392 - RNA, 16 nt, Yersinia pestis
uguugagucaacucuu

SEQ ID NO: 2275393 - RNA, 18 nt, Yersinia pestis
uguugaccucaaaauaca

SEQ ID NO: 2275394 - RNA, 22 nt, Yersinia pestis
uguugcaugcgccauauaccca

SEQ ID NO: 2275395 - RNA, 16 nt, Yersinia pestis
uguugccauggccgcc

SEQ ID NO: 2275396 - RNA, 17 nt, Yersinia pestis
uguugccacccuaucug

SEQ ID NO: 2275397 - RNA, 21 nt, Yersinia pestis
uguugccacccuaucugcucu

SEQ ID NO: 2275398 - RNA, 22 nt, Yersinia pestis
uguugccaaugggccaagguca

SEQ ID NO: 2275399 - RNA, 14 nt, Yersinia pestis
uguugaucugaguu

SEQ ID NO: 2275400 - RNA, 16 nt, Yersinia pestis
uguugaugaguaaaca

SEQ ID NO: 2275401 - RNA, 22 nt, Yersinia pestis
uguugauuaacauccauuguau

SEQ ID NO: 2275402 - RNA, 17 nt, Yersinia pestis
uguugcccccugcucca

SEQ ID NO: 2275403 - RNA, 15 nt, Yersinia pestis
uguugcgccauaauu

SEQ ID NO: 2275404 - RNA, 13 nt, Yersinia pestis
uguuguauaaccc

SEQ ID NO: 2275405 - RNA, 13 nt, Yersinia pestis
uguuggcaaauaa

SEQ ID NO: 2275406 - RNA, 17 nt, Yersinia pestis
uguuggugaucuggcuu

SEQ ID NO: 2275407 - RNA, 22 nt, Yersinia pestis
uguuuaaucaccgcuguggaau

SEQ ID NO: 2275408 - RNA, 17 nt, Yersinia pestis
uguuuaacccaaugcuc

SEQ ID NO: 2275409 - RNA, 13 nt, Yersinia pestis
uguacaacaagau

SEQ ID NO: 2275410 - RNA, 18 nt, Yersinia pestis
uguacaacaagaucccaa

SEQ ID NO: 2275411 - RNA, 13 nt, Yersinia pestis
uguaauccaaccc

SEQ ID NO: 2275412 - RNA, 17 nt, Yersinia pestis
uguaacgggcaauggua

SEQ ID NO: 2275413 - RNA, 18 nt, Yersinia pestis
uguaacgaugaauuauca

SEQ ID NO: 2275414 - RNA, 20 nt, Yersinia pestis
uguacaacuucuucauaacg

SEQ ID NO: 2275415 - RNA, 22 nt, Yersinia pestis
uguaccccggauagcugauugc

SEQ ID NO: 2275416 - RNA, 16 nt, Yersinia pestis
uguacgaaauugauau

SEQ ID NO: 2275417 - RNA, 18 nt, Yersinia pestis
uguagaauguugauauaa

SEQ ID NO: 2275418 - RNA, 18 nt, Yersinia pestis
uguacuuugauucaaaau

SEQ ID NO: 2275419 - RNA, 20 nt, Yersinia pestis
uguaacagcggcgauuaucg

SEQ ID NO: 2275420 - RNA, 13 nt, Yersinia pestis
uguaacagcggcg

SEQ ID NO: 2275421 - RNA, 20 nt, Yersinia pestis
uguaacaauccgaacaaaau

SEQ ID NO: 2275422 - RNA, 13 nt, Yersinia pestis
ugguuuuuuaaaa

SEQ ID NO: 2275423 - RNA, 14 nt, Yersinia pestis
uguaaaaaucaccu

SEQ ID NO: 2275424 - RNA, 20 nt, Yersinia pestis
uguaaaaacuuaucuaaaaa

SEQ ID NO: 2275425 - RNA, 21 nt, Yersinia pestis
uguaaaaacuuaucuaaaaaa

SEQ ID NO: 2275426 - RNA, 18 nt, Yersinia pestis
uguaaaagauagauaacu

SEQ ID NO: 2275427 - RNA, 11 nt, Yersinia pestis
uguaaaacaag

SEQ ID NO: 2275428 - RNA, 16 nt, Yersinia pestis
ugguuuauccccuucg

SEQ ID NO: 2275429 - RNA, 12 nt, Yersinia pestis
ugguuuuuuaaa

SEQ ID NO: 2275430 - RNA, 13 nt, Yersinia pestis
ugguuuccgcuga

SEQ ID NO: 2275431 - RNA, 13 nt, Yersinia pestis
uggugaaaaauga

SEQ ID NO: 2275432 - RNA, 17 nt, Yersinia pestis
uggugaaccagauaaca

SEQ ID NO: 2275433 - RNA, 16 nt, Yersinia pestis
uggugaagaaaccuaa

SEQ ID NO: 2275434 - RNA, 18 nt, Yersinia pestis
uguaguucaucauuauua

SEQ ID NO: 2275435 - RNA, 15 nt, Yersinia pestis
uguaguuuuucauua

SEQ ID NO: 2275436 - RNA, 18 nt, Yersinia pestis
uguauagucuccaaauuc

SEQ ID NO: 2275437 - RNA, 20 nt, Yersinia pestis
uguauagucuccaaauucau

SEQ ID NO: 2275438 - RNA, 20 nt, Yersinia pestis
uguauacccgccgcaucuaa

SEQ ID NO: 2275439 - RNA, 21 nt, Yersinia pestis
uguauagucuccaaauucauu

SEQ ID NO: 2275440 - RNA, 18 nt, Yersinia pestis
uguauaucacuauuucag

SEQ ID NO: 2275441 - RNA, 19 nt, Yersinia pestis
uguauaugcugauaaaauu

SEQ ID NO: 2275442 - RNA, 13 nt, Yersinia pestis
uguaguacagcac

SEQ ID NO: 2275443 - RNA, 20 nt, Yersinia pestis
uguaguacagcacucaguac

SEQ ID NO: 2275444 - RNA, 17 nt, Yersinia pestis
uguaguaacucaaguau

SEQ ID NO: 2275445 - RNA, 21 nt, Yersinia pestis
uguagguuggggaugaaaaug

SEQ ID NO: 2275446 - RNA, 22 nt, Yersinia pestis
uguagugacguaaaaaggcagu

SEQ ID NO: 2275447 - RNA, 22 nt, Yersinia pestis
uguaguuaagguuagcuaugca

SEQ ID NO: 2275448 - RNA, 17 nt, Yersinia pestis
uguaguuaaucuacccg

SEQ ID NO: 2275449 - RNA, 14 nt, Yersinia pestis
uguaguggaaguga

SEQ ID NO: 2275450 - RNA, 18 nt, Yersinia pestis
uguagugacguaaaaagg

SEQ ID NO: 2275451 - RNA, 12 nt, Yersinia pestis
uguaggcaccac

SEQ ID NO: 2275452 - RNA, 19 nt, Yersinia pestis
uguagcuuuuuaaauacca

SEQ ID NO: 2275453 - RNA, 14 nt, Yersinia pestis
uguagcuuuuuaaa

SEQ ID NO: 2275454 - RNA, 15 nt, Yersinia pestis
uguagcuuuuuaaau

SEQ ID NO: 2275455 - RNA, 14 nt, Yersinia pestis
uguagcgccaggua

SEQ ID NO: 2275456 - RNA, 13 nt, Yersinia pestis
ugucaccugagua

SEQ ID NO: 2275457 - RNA, 14 nt, Yersinia pestis
ugucaauaaacuga

SEQ ID NO: 2275458 - RNA, 17 nt, Yersinia pestis
ugucacugccaucucau

SEQ ID NO: 2275459 - RNA, 18 nt, Yersinia pestis
uguaugguauagacuguu

SEQ ID NO: 2275460 - RNA, 13 nt, Yersinia pestis
uguaucaauaccu

SEQ ID NO: 2275461 - RNA, 17 nt, Yersinia pestis
ugucaucgcuaaauacu

SEQ ID NO: 2275462 - RNA, 13 nt, Yersinia pestis
ugucguauuucca

SEQ ID NO: 2275463 - RNA, 15 nt, Yersinia pestis
ugucguacuuuccuu

SEQ ID NO: 2275464 - RNA, 19 nt, Yersinia pestis
ugucuauuuagucaucaug

SEQ ID NO: 2275465 - RNA, 13 nt, Yersinia pestis
ugucuauuuucau

SEQ ID NO: 2275466 - RNA, 20 nt, Yersinia pestis
ugucuaggguuauuuuauug

SEQ ID NO: 2275467 - RNA, 18 nt, Yersinia pestis
ugucuauguuugaugguu

SEQ ID NO: 2275468 - RNA, 18 nt, Yersinia pestis
ugucgggccaauaaaacg

SEQ ID NO: 2275469 - RNA, 14 nt, Yersinia pestis
ugucgcuauuuccg

SEQ ID NO: 2275470 - RNA, 20 nt, Yersinia pestis
ugucauugcuguuguuauua

SEQ ID NO: 2275471 - RNA, 18 nt, Yersinia pestis
ugucauuuccuccgcuuu

SEQ ID NO: 2275472 - RNA, 20 nt, Yersinia pestis
ugucauuuccuguauuuccu

SEQ ID NO: 2275473 - RNA, 16 nt, Yersinia pestis
uguccaaaggaagggg

SEQ ID NO: 2275474 - RNA, 14 nt, Yersinia pestis
uguccacauagcug

SEQ ID NO: 2275475 - RNA, 18 nt, Yersinia pestis
ugucgcccgucuggcagg

SEQ ID NO: 2275476 - RNA, 18 nt, Yersinia pestis
ugucgcccugaauuucaa

SEQ ID NO: 2275477 - RNA, 12 nt, Yersinia pestis
ugucuuaugaua

SEQ ID NO: 2275478 - RNA, 22 nt, Yersinia pestis
ugucuuaugauauagcuguuug

SEQ ID NO: 2275479 - RNA, 19 nt, Yersinia pestis
ugugaauuuaucaggcuaa

SEQ ID NO: 2275480 - RNA, 21 nt, Yersinia pestis
ugucuuaucauuaaccgccgc

SEQ ID NO: 2275481 - RNA, 18 nt, Yersinia pestis
ugugaaucuuuuugcuga

SEQ ID NO: 2275482 - RNA, 14 nt, Yersinia pestis
ugucuggcaaucca

SEQ ID NO: 2275483 - RNA, 15 nt, Yersinia pestis
ugucuggcaauccag

SEQ ID NO: 2275484 - RNA, 19 nt, Yersinia pestis
ugucugccgcucaugcccc

SEQ ID NO: 2275485 - RNA, 14 nt, Yersinia pestis
ugugagagugaaug

SEQ ID NO: 2275486 - RNA, 17 nt, Yersinia pestis
ugugagguuagaaaaca

SEQ ID NO: 2275487 - RNA, 14 nt, Yersinia pestis
ugugauaaacuguu

SEQ ID NO: 2275488 - RNA, 21 nt, Yersinia pestis
ugugauaaccguucaagaggg

SEQ ID NO: 2275489 - RNA, 20 nt, Yersinia pestis
ugugugguaccccgugcuuu

SEQ ID NO: 2275490 - RNA, 14 nt, Yersinia pestis
uguguguauuuaaa

SEQ ID NO: 2275491 - RNA, 23 nt, Yersinia pestis
ugugugagagcgguuuauauuuu

SEQ ID NO: 2275492 - RNA, 12 nt, Yersinia pestis
uguuaaaccccc

SEQ ID NO: 2275493 - RNA, 17 nt, Yersinia pestis
uguuaaauucgcuuuuc

SEQ ID NO: 2275494 - RNA, 20 nt, Yersinia pestis
uguuaaauucgcuuuucgca

SEQ ID NO: 2275495 - RNA, 22 nt, Yersinia pestis
uguuaaacccccuguaaccgca

SEQ ID NO: 2275496 - RNA, 13 nt, Yersinia pestis
uguguuuuggcua

SEQ ID NO: 2275497 - RNA, 17 nt, Yersinia pestis
uguuaauccuaaugaac

SEQ ID NO: 2275498 - RNA, 14 nt, Yersinia pestis
uguuaauuuaaaca

SEQ ID NO: 2275499 - RNA, 18 nt, Yersinia pestis
uguuacccgcgaucauuu

SEQ ID NO: 2275500 - RNA, 18 nt, Yersinia pestis
uguuaccuaaccaaacau

SEQ ID NO: 2275501 - RNA, 18 nt, Yersinia pestis
ugugguuguuuuuuccca

SEQ ID NO: 2275502 - RNA, 17 nt, Yersinia pestis
uguguaaacuccuugga

SEQ ID NO: 2275503 - RNA, 19 nt, Yersinia pestis
uguguaauuauauuuaauu

SEQ ID NO: 2275504 - RNA, 19 nt, Yersinia pestis
uguguaccaaaacgaacaa

SEQ ID NO: 2275505 - RNA, 20 nt, Yersinia pestis
ugugucauuaccuggacgcu

SEQ ID NO: 2275506 - RNA, 17 nt, Yersinia pestis
ugugucaauaccuuacu

SEQ ID NO: 2275507 - RNA, 14 nt, Yersinia pestis
uguggcuaaaccca

SEQ ID NO: 2275508 - RNA, 16 nt, Yersinia pestis
uguggcuaauaaugca

SEQ ID NO: 2275509 - RNA, 15 nt, Yersinia pestis
ugugggcacucgcaa

SEQ ID NO: 2275510 - RNA, 15 nt, Yersinia pestis
uguggcgauaaaccg

SEQ ID NO: 2275511 - RNA, 12 nt, Yersinia pestis
ugugcuucauau

SEQ ID NO: 2275512 - RNA, 18 nt, Yersinia pestis
uguggauccagcaccaca

SEQ ID NO: 2275513 - RNA, 19 nt, Yersinia pestis
ugugcugcuaauauuuaua

SEQ ID NO: 2275514 - RNA, 21 nt, Yersinia pestis
ugugcucacaaucuucuucag

SEQ ID NO: 2275515 - RNA, 17 nt, Yersinia pestis
ugugcucuauuuuuuua

SEQ ID NO: 2275516 - RNA, 16 nt, Yersinia pestis
ugugcucugcuccgcc

SEQ ID NO: 2275517 - RNA, 12 nt, Yersinia pestis
ugugcugaauug

SEQ ID NO: 2275518 - RNA, 16 nt, Yersinia pestis
uggcuucaaaaucacc

SEQ ID NO: 2275519 - RNA, 17 nt, Yersinia pestis
uggcuuagucauuaaga

SEQ ID NO: 2275520 - RNA, 23 nt, Yersinia pestis
uggcuuuacggcucaccuggccu

SEQ ID NO: 2275521 - RNA, 13 nt, Yersinia pestis
uggcuuuauuaua

SEQ ID NO: 2275522 - RNA, 13 nt, Yersinia pestis
uggcuucuuuuuc

SEQ ID NO: 2275523 - RNA, 22 nt, Yersinia pestis
uggcuugcaaucagaggccauc

SEQ ID NO: 2275524 - RNA, 17 nt, Yersinia pestis
uggcuugcuugauggca

SEQ ID NO: 2275525 - RNA, 20 nt, Yersinia pestis
uggcguuguaccaccaaacc

SEQ ID NO: 2275526 - RNA, 16 nt, Yersinia pestis
uggcuuuuucuuccag

SEQ ID NO: 2275527 - RNA, 14 nt, Yersinia pestis
uggcuuuuuuaaua

SEQ ID NO: 2275528 - RNA, 19 nt, Yersinia pestis
uggcuuuuuuaauaaaaaa

SEQ ID NO: 2275529 - RNA, 14 nt, Yersinia pestis
uggcuuuuucacac

SEQ ID NO: 2275530 - RNA, 16 nt, Yersinia pestis
uggcuuucucaacagc

SEQ ID NO: 2275531 - RNA, 19 nt, Yersinia pestis
ugggauuaauaaugguggg

SEQ ID NO: 2275532 - RNA, 17 nt, Yersinia pestis
ugggcaaagaauugagg

SEQ ID NO: 2275533 - RNA, 20 nt, Yersinia pestis
ugggcaaaggcccaaguaug

SEQ ID NO: 2275534 - RNA, 19 nt, Yersinia pestis
ugggcguauccacacccuc

SEQ ID NO: 2275535 - RNA, 16 nt, Yersinia pestis
ugggcgggaucuccag

SEQ ID NO: 2275536 - RNA, 16 nt, Yersinia pestis
ugggcggucaucagcc

SEQ ID NO: 2275537 - RNA, 20 nt, Yersinia pestis
ugggcgguaguauuuguagu

SEQ ID NO: 2275538 - RNA, 18 nt, Yersinia pestis
ugggugauguccuguugu

SEQ ID NO: 2275539 - RNA, 16 nt, Yersinia pestis
ugggugaaagcuaaua

SEQ ID NO: 2275540 - RNA, 19 nt, Yersinia pestis
ugggguauauauuuuuaau

SEQ ID NO: 2275541 - RNA, 19 nt, Yersinia pestis
ugggggcgcucggcagcug

SEQ ID NO: 2275542 - RNA, 13 nt, Yersinia pestis
ugggggaccagca

SEQ ID NO: 2275543 - RNA, 11 nt, Yersinia pestis
uggggccaccu

SEQ ID NO: 2275544 - RNA, 21 nt, Yersinia pestis
uggggccaccuaauccaaggc

SEQ ID NO: 2275545 - RNA, 22 nt, Yersinia pestis
uggggccaccuaauccaaggcg

SEQ ID NO: 2275546 - RNA, 17 nt, Yersinia pestis
ugguauagacuguuuua

SEQ ID NO: 2275547 - RNA, 17 nt, Yersinia pestis
ugguaggugcucaucag

SEQ ID NO: 2275548 - RNA, 19 nt, Yersinia pestis
ugguacugugucuuuaggg

SEQ ID NO: 2275549 - RNA, 18 nt, Yersinia pestis
ugguaccugcaucaucac

SEQ ID NO: 2275550 - RNA, 17 nt, Yersinia pestis
uggguuaaaaacuuuua

SEQ ID NO: 2275551 - RNA, 21 nt, Yersinia pestis
uggguuaaauagugggcuaaa

SEQ ID NO: 2275552 - RNA, 21 nt, Yersinia pestis
uggguuaaauugcgggcuggg

SEQ ID NO: 2275553 - RNA, 17 nt, Yersinia pestis
uggguuacauccugaau

SEQ ID NO: 2275554 - RNA, 20 nt, Yersinia pestis
uggguuaccgccagaacacu

SEQ ID NO: 2275555 - RNA, 16 nt, Yersinia pestis
ugguaccaaucuccaa

SEQ ID NO: 2275556 - RNA, 15 nt, Yersinia pestis
ugguaagguuucaaa

SEQ ID NO: 2275557 - RNA, 13 nt, Yersinia pestis
ugguaagucuuau

SEQ ID NO: 2275558 - RNA, 15 nt, Yersinia pestis
ugguaacagagccuu

SEQ ID NO: 2275559 - RNA, 17 nt, Yersinia pestis
ugguaacagagccuuau

SEQ ID NO: 2275560 - RNA, 14 nt, Yersinia pestis
uggucaauaaaauu

SEQ ID NO: 2275561 - RNA, 19 nt, Yersinia pestis
uggucaaggugauuucaaa

SEQ ID NO: 2275562 - RNA, 13 nt, Yersinia pestis
uggucaacagcaa

SEQ ID NO: 2275563 - RNA, 22 nt, Yersinia pestis
uggucacuguaguaaagcagca

SEQ ID NO: 2275564 - RNA, 24 nt, Yersinia pestis
uggucacuguaguaaagcagcauc

SEQ ID NO: 2275565 - RNA, 22 nt, Yersinia pestis
uggucaccgccaaaugaaaacc

SEQ ID NO: 2275566 - RNA, 14 nt, Yersinia pestis
uggucagcaauaac

SEQ ID NO: 2275567 - RNA, 18 nt, Yersinia pestis
uggucaguugaauauucc

SEQ ID NO: 2275568 - RNA, 14 nt, Yersinia pestis
uggucaguuuaaug

SEQ ID NO: 2275569 - RNA, 16 nt, Yersinia pestis
uggucagcacaaacag

SEQ ID NO: 2275570 - RNA, 17 nt, Yersinia pestis
uggucagcggagcagau

SEQ ID NO: 2275571 - RNA, 15 nt, Yersinia pestis
uggucgaugaccugc

SEQ ID NO: 2275572 - RNA, 14 nt, Yersinia pestis
uggucauuuuuccc

SEQ ID NO: 2275573 - RNA, 19 nt, Yersinia pestis
ugguccacagucaguucau

SEQ ID NO: 2275574 - RNA, 15 nt, Yersinia pestis
uggcaaauugcuggc

SEQ ID NO: 2275575 - RNA, 13 nt, Yersinia pestis
uggcaaaggccag

SEQ ID NO: 2275576 - RNA, 15 nt, Yersinia pestis
uggcaaacucagcca

SEQ ID NO: 2275577 - RNA, 21 nt, Yersinia pestis
uggcaaacgcugcacaucauu

SEQ ID NO: 2275578 - RNA, 15 nt, Yersinia pestis
uggauucuugcugca

SEQ ID NO: 2275579 - RNA, 15 nt, Yersinia pestis
ugcguguugccaccu

SEQ ID NO: 2275580 - RNA, 19 nt, Yersinia pestis
uggcaccacggucagagau

SEQ ID NO: 2275581 - RNA, 17 nt, Yersinia pestis
uggcaccauuugcccug

SEQ ID NO: 2275582 - RNA, 17 nt, Yersinia pestis
uggcaccucaucccaaa

SEQ ID NO: 2275583 - RNA, 18 nt, Yersinia pestis
uggcaaccccugccaaua

SEQ ID NO: 2275584 - RNA, 19 nt, Yersinia pestis
uggcaaccccugccaauau

SEQ ID NO: 2275585 - RNA, 20 nt, Yersinia pestis
uggcaaccgguaacauauaa

SEQ ID NO: 2275586 - RNA, 19 nt, Yersinia pestis
uggcaaccccuaauccagc

SEQ ID NO: 2275587 - RNA, 14 nt, Yersinia pestis
uggcaauuucucug

SEQ ID NO: 2275588 - RNA, 18 nt, Yersinia pestis
uggcaauuucuguuacca

SEQ ID NO: 2275589 - RNA, 23 nt, Yersinia pestis
uggcaauuaugacguucaguagu

SEQ ID NO: 2275590 - RNA, 15 nt, Yersinia pestis
uggcaaucucuugau

SEQ ID NO: 2275591 - RNA, 16 nt, Yersinia pestis
uggcaauccagcgccu

SEQ ID NO: 2275592 - RNA, 13 nt, Yersinia pestis
uggcaaucauggg

SEQ ID NO: 2275593 - RNA, 19 nt, Yersinia pestis
uggccagcgggaaucaaac

SEQ ID NO: 2275594 - RNA, 15 nt, Yersinia pestis
uggccaguaaaaccu

SEQ ID NO: 2275595 - RNA, 14 nt, Yersinia pestis
uggccaguuuuagu

SEQ ID NO: 2275596 - RNA, 23 nt, Yersinia pestis
uggccaguuuuagucucgcagcc

SEQ ID NO: 2275597 - RNA, 12 nt, Yersinia pestis
uggcauuuucag

SEQ ID NO: 2275598 - RNA, 15 nt, Yersinia pestis
uggcaggccccauca

SEQ ID NO: 2275599 - RNA, 20 nt, Yersinia pestis
uggcagccuuuauccaacca

SEQ ID NO: 2275600 - RNA, 22 nt, Yersinia pestis
uggcgaacauguuggcgggggg

SEQ ID NO: 2275601 - RNA, 14 nt, Yersinia pestis
uggcgaaaaucaag

SEQ ID NO: 2275602 - RNA, 14 nt, Yersinia pestis
uggccuaacaacug

SEQ ID NO: 2275603 - RNA, 21 nt, Yersinia pestis
uggccuauuaagauaauuauc

SEQ ID NO: 2275604 - RNA, 13 nt, Yersinia pestis
uggccgcuacugg

SEQ ID NO: 2275605 - RNA, 22 nt, Yersinia pestis
uggcgagguaccgcugcccggc

SEQ ID NO: 2275606 - RNA, 15 nt, Yersinia pestis
uggcgaucaaaggcg

SEQ ID NO: 2275607 - RNA, 21 nt, Yersinia pestis
uggcgcucauuucccgugcac

SEQ ID NO: 2275608 - RNA, 13 nt, Yersinia pestis
uggcggcuugguu

SEQ ID NO: 2275609 - RNA, 20 nt, Yersinia pestis
uucaacacggugaauaaacc

SEQ ID NO: 2275610 - RNA, 17 nt, Yersinia pestis
uucaacuuccugaaucg

SEQ ID NO: 2275611 - RNA, 14 nt, Yersinia pestis
uucaacuucuccug

SEQ ID NO: 2275612 - RNA, 18 nt, Yersinia pestis
uucaacgucaaucaucca

SEQ ID NO: 2275613 - RNA, 16 nt, Yersinia pestis
uucaaaguaaaauaaa

SEQ ID NO: 2275614 - RNA, 22 nt, Yersinia pestis
uucaaauaaguauuucaaauaa

SEQ ID NO: 2275615 - RNA, 18 nt, Yersinia pestis
uucaaauaaguguuucaa

SEQ ID NO: 2275616 - RNA, 14 nt, Yersinia pestis
uucaaauaucauua

SEQ ID NO: 2275617 - RNA, 20 nt, Yersinia pestis
uuauuauguuugcuagggcu

SEQ ID NO: 2275618 - RNA, 22 nt, Yersinia pestis
uuauuaugacaacugaaaauac

SEQ ID NO: 2275619 - RNA, 13 nt, Yersinia pestis
uuauucaauacug

SEQ ID NO: 2275620 - RNA, 19 nt, Yersinia pestis
uuauucauaguuaagacaa

SEQ ID NO: 2275621 - RNA, 11 nt, Yersinia pestis
uuauucauuca

SEQ ID NO: 2275622 - RNA, 15 nt, Yersinia pestis
uuauucccacuuauu

SEQ ID NO: 2275623 - RNA, 18 nt, Yersinia pestis
uuaggccaauuuggccaa

SEQ ID NO: 2275624 - RNA, 15 nt, Yersinia pestis
uuaggcauaaauaau

SEQ ID NO: 2275625 - RNA, 13 nt, Yersinia pestis
uuagggcgcggcu

SEQ ID NO: 2275626 - RNA, 15 nt, Yersinia pestis
uuauuuacacuuaau

SEQ ID NO: 2275627 - RNA, 14 nt, Yersinia pestis
uuauuuaucauaaa

SEQ ID NO: 2275628 - RNA, 23 nt, Yersinia pestis
uuauuucacacuguuuaguucac

SEQ ID NO: 2275629 - RNA, 21 nt, Yersinia pestis
uuauuucagccaugggcugaa

SEQ ID NO: 2275630 - RNA, 11 nt, Yersinia pestis
uuauuuaauuu

SEQ ID NO: 2275631 - RNA, 18 nt, Yersinia pestis
uuauuuacaaaccauauu

SEQ ID NO: 2275632 - RNA, 14 nt, Yersinia pestis
uuauuuacaccgug

SEQ ID NO: 2275633 - RNA, 18 nt, Yersinia pestis
uuauuggucaauaaaauu

SEQ ID NO: 2275634 - RNA, 16 nt, Yersinia pestis
uuauugguuauuuuau

SEQ ID NO: 2275635 - RNA, 23 nt, Yersinia pestis
uuauuuagagucuauaaugcuau

SEQ ID NO: 2275636 - RNA, 17 nt, Yersinia pestis
uuauuuacgauaagaau

SEQ ID NO: 2275637 - RNA, 23 nt, Yersinia pestis
uuauuuaggcuacagcuacugca

SEQ ID NO: 2275638 - RNA, 17 nt, Yersinia pestis
uuauuggaaguacuuau

SEQ ID NO: 2275639 - RNA, 22 nt, Yersinia pestis
uuauuggaaguacuuauuugaa

SEQ ID NO: 2275640 - RNA, 15 nt, Yersinia pestis
uuauuggaugccaau

SEQ ID NO: 2275641 - RNA, 19 nt, Yersinia pestis
uuauugcuaaguacuaucu

SEQ ID NO: 2275642 - RNA, 21 nt, Yersinia pestis
uuauugcuaaguacuaucuau

SEQ ID NO: 2275643 - RNA, 21 nt, Yersinia pestis
uuauugcucucgcuccagcuc

SEQ ID NO: 2275644 - RNA, 18 nt, Yersinia pestis
uuauugaugagcuguaga

SEQ ID NO: 2275645 - RNA, 16 nt, Yersinia pestis
uucagaguaagucuuu

SEQ ID NO: 2275646 - RNA, 13 nt, Yersinia pestis
uucagauuuacca

SEQ ID NO: 2275647 - RNA, 21 nt, Yersinia pestis
uucagcaaagagucgcaaaac

SEQ ID NO: 2275648 - RNA, 15 nt, Yersinia pestis
uucacuuucaacuau

SEQ ID NO: 2275649 - RNA, 19 nt, Yersinia pestis
uucagaaaacccccugcua

SEQ ID NO: 2275650 - RNA, 21 nt, Yersinia pestis
uucacuggggagaucagugcc

SEQ ID NO: 2275651 - RNA, 23 nt, Yersinia pestis
uucacuggggagaucagugccag

SEQ ID NO: 2275652 - RNA, 19 nt, Yersinia pestis
uucacucuguuuuaaaaaa

SEQ ID NO: 2275653 - RNA, 13 nt, Yersinia pestis
uucacugaauacc

SEQ ID NO: 2275654 - RNA, 19 nt, Yersinia pestis
uucacuccggcaucauccu

SEQ ID NO: 2275655 - RNA, 22 nt, Yersinia pestis
uucacuccggcaucauccucau

SEQ ID NO: 2275656 - RNA, 21 nt, Yersinia pestis
uucacucauaauuuugaugcu

SEQ ID NO: 2275657 - RNA, 17 nt, Yersinia pestis
uucacggcaccaaccau

SEQ ID NO: 2275658 - RNA, 12 nt, Yersinia pestis
uucacggauauc

SEQ ID NO: 2275659 - RNA, 20 nt, Yersinia pestis
uucaccaaccaaccaucacc

SEQ ID NO: 2275660 - RNA, 16 nt, Yersinia pestis
uucaccaauacaaaca

SEQ ID NO: 2275661 - RNA, 17 nt, Yersinia pestis
uucaccaaauugcagaa

SEQ ID NO: 2275662 - RNA, 10 nt, Yersinia pestis
uucaccagua

SEQ ID NO: 2275663 - RNA, 22 nt, Yersinia pestis
uucaccauccggguuuauccca

SEQ ID NO: 2275664 - RNA, 12 nt, Yersinia pestis
uucaaugcuuuc

SEQ ID NO: 2275665 - RNA, 19 nt, Yersinia pestis
uucaauggucaugcacagu

SEQ ID NO: 2275666 - RNA, 18 nt, Yersinia pestis
uucaaugacuccugaaau

SEQ ID NO: 2275667 - RNA, 21 nt, Yersinia pestis
uucaaugacuccugaaauaaa

SEQ ID NO: 2275668 - RNA, 14 nt, Yersinia pestis
uucaagucccuccc

SEQ ID NO: 2275669 - RNA, 14 nt, Yersinia pestis
uucaaguccugcuu

SEQ ID NO: 2275670 - RNA, 13 nt, Yersinia pestis
uucaagugcucac

SEQ ID NO: 2275671 - RNA, 23 nt, Yersinia pestis
uucaaguacgaaggggauaaaug

SEQ ID NO: 2275672 - RNA, 16 nt, Yersinia pestis
uucaauuccugauauu

SEQ ID NO: 2275673 - RNA, 20 nt, Yersinia pestis
uucaauucucccauuuauua

SEQ ID NO: 2275674 - RNA, 11 nt, Yersinia pestis
uucacauuacg

SEQ ID NO: 2275675 - RNA, 14 nt, Yersinia pestis
uucaccaaaaaaac

SEQ ID NO: 2275676 - RNA, 22 nt, Yersinia pestis
uucaauuugguaauuuccaaga

SEQ ID NO: 2275677 - RNA, 13 nt, Yersinia pestis
uucaguuacucac

SEQ ID NO: 2275678 - RNA, 15 nt, Yersinia pestis
uucaguucagaaagg

SEQ ID NO: 2275679 - RNA, 19 nt, Yersinia pestis
uucaguuuauuuaagcuga

SEQ ID NO: 2275680 - RNA, 17 nt, Yersinia pestis
uucaguuuuaauuuaug

SEQ ID NO: 2275681 - RNA, 21 nt, Yersinia pestis
uucaguuuuauuguauaaaac

SEQ ID NO: 2275682 - RNA, 16 nt, Yersinia pestis
uucauaaaaaaagaag

SEQ ID NO: 2275683 - RNA, 18 nt, Yersinia pestis
uucauaaauuaaaacuga

SEQ ID NO: 2275684 - RNA, 14 nt, Yersinia pestis
uucauaaucaccuu

SEQ ID NO: 2275685 - RNA, 19 nt, Yersinia pestis
uucagcguuuugaucauca

SEQ ID NO: 2275686 - RNA, 18 nt, Yersinia pestis
uucagcguugacaccaga

SEQ ID NO: 2275687 - RNA, 16 nt, Yersinia pestis
uucagcgucagucaau

SEQ ID NO: 2275688 - RNA, 19 nt, Yersinia pestis
uucagcgucagucaaugag

SEQ ID NO: 2275689 - RNA, 18 nt, Yersinia pestis
uucaguaaagcgcaggaa

SEQ ID NO: 2275690 - RNA, 19 nt, Yersinia pestis
uucaguaaagcgcaggaaa

SEQ ID NO: 2275691 - RNA, 15 nt, Yersinia pestis
uucagucaguaggcu

SEQ ID NO: 2275692 - RNA, 20 nt, Yersinia pestis
uucaguauuguauacaugcc

SEQ ID NO: 2275693 - RNA, 18 nt, Yersinia pestis
uucaucgaaaaaaauacu

SEQ ID NO: 2275694 - RNA, 21 nt, Yersinia pestis
uucauccuguaccgcgcuuuu

SEQ ID NO: 2275695 - RNA, 22 nt, Yersinia pestis
uucaucgcccuguaacuuuauu

SEQ ID NO: 2275696 - RNA, 22 nt, Yersinia pestis
uucauccaggguuuugaaauca

SEQ ID NO: 2275697 - RNA, 17 nt, Yersinia pestis
uucaucccaagagaacg

SEQ ID NO: 2275698 - RNA, 18 nt, Yersinia pestis
uucauccuaaagauaauu

SEQ ID NO: 2275699 - RNA, 13 nt, Yersinia pestis
uucaucacuuagu

SEQ ID NO: 2275700 - RNA, 15 nt, Yersinia pestis
uucauccaacucacc

SEQ ID NO: 2275701 - RNA, 18 nt, Yersinia pestis
uucauccaacuuaccuug

SEQ ID NO: 2275702 - RNA, 20 nt, Yersinia pestis
uucaucauggauaaagccuu

SEQ ID NO: 2275703 - RNA, 22 nt, Yersinia pestis
uucauaauugaagaguugaucc

SEQ ID NO: 2275704 - RNA, 16 nt, Yersinia pestis
uucauauauugcauuu

SEQ ID NO: 2275705 - RNA, 22 nt, Yersinia pestis
uucaucaauagguguugccggc

SEQ ID NO: 2275706 - RNA, 12 nt, Yersinia pestis
uucauauuucuu

SEQ ID NO: 2275707 - RNA, 14 nt, Yersinia pestis
uucauauuucuuug

SEQ ID NO: 2275708 - RNA, 19 nt, Yersinia pestis
uucauaucgauaccgauaa

SEQ ID NO: 2275709 - RNA, 19 nt, Yersinia pestis
uucauaugcgccuauaagg

SEQ ID NO: 2275710 - RNA, 21 nt, Yersinia pestis
uucauauucaugguuucaaaa

SEQ ID NO: 2275711 - RNA, 14 nt, Yersinia pestis
uucauuugcugugg

SEQ ID NO: 2275712 - RNA, 12 nt, Yersinia pestis
uucauuuaacug

SEQ ID NO: 2275713 - RNA, 18 nt, Yersinia pestis
uucauugguaauuucagg

SEQ ID NO: 2275714 - RNA, 21 nt, Yersinia pestis
uucauucuauuauuuaacccc

SEQ ID NO: 2275715 - RNA, 21 nt, Yersinia pestis
uucauugccgaugucaauaaa

SEQ ID NO: 2275716 - RNA, 14 nt, Yersinia pestis
uucauuauuugaua

SEQ ID NO: 2275717 - RNA, 20 nt, Yersinia pestis
uucauuaucauguaaggcaa

SEQ ID NO: 2275718 - RNA, 14 nt, Yersinia pestis
uucauuuugaccag

SEQ ID NO: 2275719 - RNA, 15 nt, Yersinia pestis
uucauuuucaucacu

SEQ ID NO: 2275720 - RNA, 13 nt, Yersinia pestis
uucauuuuaaaaa

SEQ ID NO: 2275721 - RNA, 23 nt, Yersinia pestis
uucauuuuaacaacccauuuccc

SEQ ID NO: 2275722 - RNA, 22 nt, Yersinia pestis
uucauuuuuugggaugaaaaau

SEQ ID NO: 2275723 - RNA, 17 nt, Yersinia pestis
uuccaaccuuguaacuu

SEQ ID NO: 2275724 - RNA, 20 nt, Yersinia pestis
uuccaacugauaauucagug

SEQ ID NO: 2275725 - RNA, 16 nt, Yersinia pestis
uuccaaaggaagggau

SEQ ID NO: 2275726 - RNA, 22 nt, Yersinia pestis
uuccaaaugacagcaucaauau

SEQ ID NO: 2275727 - RNA, 16 nt, Yersinia pestis
uucaugacgaaaaaca

SEQ ID NO: 2275728 - RNA, 22 nt, Yersinia pestis
uucaugaggcucagacugcuga

SEQ ID NO: 2275729 - RNA, 16 nt, Yersinia pestis
uucaucggcaaaaaca

SEQ ID NO: 2275730 - RNA, 16 nt, Yersinia pestis
uucaucucaauaacua

SEQ ID NO: 2275731 - RNA, 17 nt, Yersinia pestis
uucaucucaauaacuau

SEQ ID NO: 2275732 - RNA, 21 nt, Yersinia pestis
uucaucugaccaaacauuguc

SEQ ID NO: 2275733 - RNA, 17 nt, Yersinia pestis
uucauuaaaaaauaauu

SEQ ID NO: 2275734 - RNA, 15 nt, Yersinia pestis
uucauuaaaaaauaa

SEQ ID NO: 2275735 - RNA, 14 nt, Yersinia pestis
uucauguugcaaca

SEQ ID NO: 2275736 - RNA, 17 nt, Yersinia pestis
uucaugcaucuccacuc

SEQ ID NO: 2275737 - RNA, 19 nt, Yersinia pestis
uucaugguaaauuccuaua

SEQ ID NO: 2275738 - RNA, 16 nt, Yersinia pestis
uucaugcuaauaccac

SEQ ID NO: 2275739 - RNA, 19 nt, Yersinia pestis
uucccugcaauugcagacg

SEQ ID NO: 2275740 - RNA, 18 nt, Yersinia pestis
uuccgccgccaacaguga

SEQ ID NO: 2275741 - RNA, 21 nt, Yersinia pestis
uuccgccucuuuuuccacacc

SEQ ID NO: 2275742 - RNA, 16 nt, Yersinia pestis
uuccaaucugcgcccu

SEQ ID NO: 2275743 - RNA, 14 nt, Yersinia pestis
uuccccccagucac

SEQ ID NO: 2275744 - RNA, 20 nt, Yersinia pestis
uucccuagcgaaguauuaau

SEQ ID NO: 2275745 - RNA, 24 nt, Yersinia pestis
uucccuagcgaaguauuaauauaa

SEQ ID NO: 2275746 - RNA, 18 nt, Yersinia pestis
uucccguaggcugaccac

SEQ ID NO: 2275747 - RNA, 18 nt, Yersinia pestis
uucccuaccguaucaacg

SEQ ID NO: 2275748 - RNA, 20 nt, Yersinia pestis
uucccucaauagcuaauaau

SEQ ID NO: 2275749 - RNA, 18 nt, Yersinia pestis
uuccuuauaaauccgcua

SEQ ID NO: 2275750 - RNA, 23 nt, Yersinia pestis
uuccugaaucgccgaaaucucac

SEQ ID NO: 2275751 - RNA, 23 nt, Yersinia pestis
uuccguuauuaaacagucuuauu

SEQ ID NO: 2275752 - RNA, 17 nt, Yersinia pestis
uucgaccaaacguuuua

SEQ ID NO: 2275753 - RNA, 21 nt, Yersinia pestis
uucgacaucagguuguauuuu

SEQ ID NO: 2275754 - RNA, 19 nt, Yersinia pestis
uucgacauggaugguauuu

SEQ ID NO: 2275755 - RNA, 13 nt, Yersinia pestis
uucgacauucucu

SEQ ID NO: 2275756 - RNA, 21 nt, Yersinia pestis
uucgacagucacuaauaccug

SEQ ID NO: 2275757 - RNA, 18 nt, Yersinia pestis
uucgacaggcaauuaucc

SEQ ID NO: 2275758 - RNA, 20 nt, Yersinia pestis
uucgaccaauaauaggguca

SEQ ID NO: 2275759 - RNA, 22 nt, Yersinia pestis
uucgaagggaauaaugguauuu

SEQ ID NO: 2275760 - RNA, 17 nt, Yersinia pestis
uucgacaggcaauuauc

SEQ ID NO: 2275761 - RNA, 13 nt, Yersinia pestis
uucgacaaaaaag

SEQ ID NO: 2275762 - RNA, 20 nt, Yersinia pestis
uuccuucaguucuuuaucug

SEQ ID NO: 2275763 - RNA, 13 nt, Yersinia pestis
uuccuuccucuuu

SEQ ID NO: 2275764 - RNA, 20 nt, Yersinia pestis
uucgacggguuuuaccguca

SEQ ID NO: 2275765 - RNA, 21 nt, Yersinia pestis
uucgagguggcgauaaagagu

SEQ ID NO: 2275766 - RNA, 14 nt, Yersinia pestis
uucgagcaccgcgc

SEQ ID NO: 2275767 - RNA, 16 nt, Yersinia pestis
uucgagcuugacgcug

SEQ ID NO: 2275768 - RNA, 19 nt, Yersinia pestis
uucgauagucagcuucacu

SEQ ID NO: 2275769 - RNA, 22 nt, Yersinia pestis
uucgauaugaucagauuucuga

SEQ ID NO: 2275770 - RNA, 14 nt, Yersinia pestis
uucgaucaaaacaa

SEQ ID NO: 2275771 - RNA, 23 nt, Yersinia pestis
uucgcaaagcgggccagcaacca

SEQ ID NO: 2275772 - RNA, 21 nt, Yersinia pestis
uucgccagguucuaccgcuag

SEQ ID NO: 2275773 - RNA, 19 nt, Yersinia pestis
uucgccacgcugauacauu

SEQ ID NO: 2275774 - RNA, 17 nt, Yersinia pestis
uucgcaaaaugccaaca

SEQ ID NO: 2275775 - RNA, 23 nt, Yersinia pestis
uucgcggacgcuggcacugccau

SEQ ID NO: 2275776 - RNA, 16 nt, Yersinia pestis
uucgcccuaacauuga

SEQ ID NO: 2275777 - RNA, 13 nt, Yersinia pestis
uucguuucugucu

SEQ ID NO: 2275778 - RNA, 23 nt, Yersinia pestis
uucgucgggggugccguagguaa

SEQ ID NO: 2275779 - RNA, 11 nt, Yersinia pestis
uucgugaaagc

SEQ ID NO: 2275780 - RNA, 20 nt, Yersinia pestis
uucgucuaaugucauuuccu

SEQ ID NO: 2275781 - RNA, 18 nt, Yersinia pestis
uucgggcugaugaauaga

SEQ ID NO: 2275782 - RNA, 17 nt, Yersinia pestis
uucggggguugucagca

SEQ ID NO: 2275783 - RNA, 17 nt, Yersinia pestis
uucggguaucuguuuuu

SEQ ID NO: 2275784 - RNA, 21 nt, Yersinia pestis
uucggauaaccgcauucccug

SEQ ID NO: 2275785 - RNA, 15 nt, Yersinia pestis
uucgcguuucauuuu

SEQ ID NO: 2275786 - RNA, 15 nt, Yersinia pestis
uucggcuacuguuuu

SEQ ID NO: 2275787 - RNA, 18 nt, Yersinia pestis
uucggcuuucucuugcca

SEQ ID NO: 2275788 - RNA, 17 nt, Yersinia pestis
uucggcgucgccacccc

SEQ ID NO: 2275789 - RNA, 19 nt, Yersinia pestis
uucggcaggcagaaauaau

SEQ ID NO: 2275790 - RNA, 13 nt, Yersinia pestis
uucggccacccgc

SEQ ID NO: 2275791 - RNA, 21 nt, Yersinia pestis
uucuggguacaacacaaaaac

SEQ ID NO: 2275792 - RNA, 17 nt, Yersinia pestis
uucuggguacaacacaa

SEQ ID NO: 2275793 - RNA, 23 nt, Yersinia pestis
uucuggggcgguuuuccucuuua

SEQ ID NO: 2275794 - RNA, 13 nt, Yersinia pestis
uucuggggucauc

SEQ ID NO: 2275795 - RNA, 21 nt, Yersinia pestis
uucuguagcugacacgccaua

SEQ ID NO: 2275796 - RNA, 22 nt, Yersinia pestis
uucuguagugccgccagugcuu

SEQ ID NO: 2275797 - RNA, 16 nt, Yersinia pestis
uucuguuccaggcaag

SEQ ID NO: 2275798 - RNA, 13 nt, Yersinia pestis
uucuguuccaggc

SEQ ID NO: 2275799 - RNA, 13 nt, Yersinia pestis
uucuuauauuauu

SEQ ID NO: 2275800 - RNA, 18 nt, Yersinia pestis
uucuuaucaaucaaaaaa

SEQ ID NO: 2275801 - RNA, 17 nt, Yersinia pestis
uucuuagaccaccgcca

SEQ ID NO: 2275802 - RNA, 18 nt, Yersinia pestis
uucuuaggauaaccaauu

SEQ ID NO: 2275803 - RNA, 14 nt, Yersinia pestis
uucuuaauaauauc

SEQ ID NO: 2275804 - RNA, 15 nt, Yersinia pestis
uucuuaauaccuaaa

SEQ ID NO: 2275805 - RNA, 17 nt, Yersinia pestis
uucuuaauaccuaaaau

SEQ ID NO: 2275806 - RNA, 21 nt, Yersinia pestis
uucuuaauaccuaaaauuauc

SEQ ID NO: 2275807 - RNA, 14 nt, Yersinia pestis
uucuuacuguuuuc

SEQ ID NO: 2275808 - RNA, 17 nt, Yersinia pestis
uucuuacuaaaauauca

SEQ ID NO: 2275809 - RNA, 18 nt, Yersinia pestis
uucuuacaagaaugcaga

SEQ ID NO: 2275810 - RNA, 20 nt, Yersinia pestis
uucuucugggucuaucaggu

SEQ ID NO: 2275811 - RNA, 14 nt, Yersinia pestis
uucuuccacuucgc

SEQ ID NO: 2275812 - RNA, 10 nt, Yersinia pestis
uucuuccaac

SEQ ID NO: 2275813 - RNA, 15 nt, Yersinia pestis
uucuucauugcugcu

SEQ ID NO: 2275814 - RNA, 21 nt, Yersinia pestis
uucuucagcgauacguguaaa

SEQ ID NO: 2275815 - RNA, 22 nt, Yersinia pestis
uucuucagcgguagagaucucu

SEQ ID NO: 2275816 - RNA, 19 nt, Yersinia pestis
uucuucauaacgcuuuuuc

SEQ ID NO: 2275817 - RNA, 23 nt, Yersinia pestis
uucuauccgaaaaauauucucaa

SEQ ID NO: 2275818 - RNA, 17 nt, Yersinia pestis
uucuaucgggcagguaa

SEQ ID NO: 2275819 - RNA, 13 nt, Yersinia pestis
uucuccaacaacu

SEQ ID NO: 2275820 - RNA, 19 nt, Yersinia pestis
uucuccaacaacugccccu

SEQ ID NO: 2275821 - RNA, 18 nt, Yersinia pestis
uucuacucugucugcugu

SEQ ID NO: 2275822 - RNA, 15 nt, Yersinia pestis
uucuagcaacauggu

SEQ ID NO: 2275823 - RNA, 17 nt, Yersinia pestis
uucuccuuugauuugaa

SEQ ID NO: 2275824 - RNA, 14 nt, Yersinia pestis
uucugaagaugcca

SEQ ID NO: 2275825 - RNA, 14 nt, Yersinia pestis
uucuccgauucacc

SEQ ID NO: 2275826 - RNA, 18 nt, Yersinia pestis
uucuccugcgguggccag

SEQ ID NO: 2275827 - RNA, 23 nt, Yersinia pestis
uucuccugcgguggccagagcau

SEQ ID NO: 2275828 - RNA, 14 nt, Yersinia pestis
uucugauaaaacag

SEQ ID NO: 2275829 - RNA, 15 nt, Yersinia pestis
uucugagauauguag

SEQ ID NO: 2275830 - RNA, 13 nt, Yersinia pestis
uucuggcccuaaa

SEQ ID NO: 2275831 - RNA, 12 nt, Yersinia pestis
uucugcuuggac

SEQ ID NO: 2275832 - RNA, 11 nt, Yersinia pestis
uucugcugcca

SEQ ID NO: 2275833 - RNA, 20 nt, Yersinia pestis
uugugagugacaugcuuaau

SEQ ID NO: 2275834 - RNA, 19 nt, Yersinia pestis
uugugcacucguuguauuu

SEQ ID NO: 2275835 - RNA, 19 nt, Yersinia pestis
uugugcguaaagaaaaaau

SEQ ID NO: 2275836 - RNA, 16 nt, Yersinia pestis
uugugcguaaagaaaa

SEQ ID NO: 2275837 - RNA, 17 nt, Yersinia pestis
uugugcugccgcuauug

SEQ ID NO: 2275838 - RNA, 16 nt, Yersinia pestis
uugugcuuuuuggcaa

SEQ ID NO: 2275839 - RNA, 18 nt, Yersinia pestis
uugugagcgauauuuauc

SEQ ID NO: 2275840 - RNA, 15 nt, Yersinia pestis
uugucguauuuccag

SEQ ID NO: 2275841 - RNA, 20 nt, Yersinia pestis
uugucggcauaacaggugca

SEQ ID NO: 2275842 - RNA, 18 nt, Yersinia pestis
uugucuguaauaauaauu

SEQ ID NO: 2275843 - RNA, 14 nt, Yersinia pestis
uuguggcgaaagac

SEQ ID NO: 2275844 - RNA, 12 nt, Yersinia pestis
uugugugaguug

SEQ ID NO: 2275845 - RNA, 17 nt, Yersinia pestis
uugugucaauaccuuac

SEQ ID NO: 2275846 - RNA, 22 nt, Yersinia pestis
uugugucaauaccuuacuguau

SEQ ID NO: 2275847 - RNA, 22 nt, Yersinia pestis
uuguuccgguucggauucuguu

SEQ ID NO: 2275848 - RNA, 17 nt, Yersinia pestis
uuguucacggcuuugcu

SEQ ID NO: 2275849 - RNA, 22 nt, Yersinia pestis
uuguuuucguuuaaaaaauauc

SEQ ID NO: 2275850 - RNA, 14 nt, Yersinia pestis
uuguugaauaccaa

SEQ ID NO: 2275851 - RNA, 16 nt, Yersinia pestis
uuguugaccucaaaau

SEQ ID NO: 2275852 - RNA, 12 nt, Yersinia pestis
uuguugcaauac

SEQ ID NO: 2275853 - RNA, 20 nt, Yersinia pestis
uuguuugaauuuuagucaaa

SEQ ID NO: 2275854 - RNA, 15 nt, Yersinia pestis
uuguucuuacuguuu

SEQ ID NO: 2275855 - RNA, 14 nt, Yersinia pestis
uuguaaauuuuuuu

SEQ ID NO: 2275856 - RNA, 17 nt, Yersinia pestis
uuguaaccgacuugccc

SEQ ID NO: 2275857 - RNA, 22 nt, Yersinia pestis
uuguaauuguauuauaugcgcu

SEQ ID NO: 2275858 - RNA, 18 nt, Yersinia pestis
uuguaaggugcuagugcu

SEQ ID NO: 2275859 - RNA, 20 nt, Yersinia pestis
uuguaagucagauugucaga

SEQ ID NO: 2275860 - RNA, 23 nt, Yersinia pestis
uuguaacuuuaguaggucacaua

SEQ ID NO: 2275861 - RNA, 20 nt, Yersinia pestis
uuguaagcgauccugcucaa

SEQ ID NO: 2275862 - RNA, 17 nt, Yersinia pestis
uuguagguuaugacacc

SEQ ID NO: 2275863 - RNA, 13 nt, Yersinia pestis
uuguaguaaccac

SEQ ID NO: 2275864 - RNA, 12 nt, Yersinia pestis
uuguagcaaacc

SEQ ID NO: 2275865 - RNA, 19 nt, Yersinia pestis
uuguagcccacugacacug

SEQ ID NO: 2275866 - RNA, 20 nt, Yersinia pestis
uuguagcgccagguaagaaa

SEQ ID NO: 2275867 - RNA, 15 nt, Yersinia pestis
uuguaccccugaauc

SEQ ID NO: 2275868 - RNA, 19 nt, Yersinia pestis
uuguaccgauuuacguguu

SEQ ID NO: 2275869 - RNA, 14 nt, Yersinia pestis
uuguauugcucagg

SEQ ID NO: 2275870 - RNA, 14 nt, Yersinia pestis
uuguauuuugaaug

SEQ ID NO: 2275871 - RNA, 11 nt, Yersinia pestis
uuguauuuugu

SEQ ID NO: 2275872 - RNA, 18 nt, Yersinia pestis
uuguauuuagagauuauu

SEQ ID NO: 2275873 - RNA, 21 nt, Yersinia pestis
uugucaauaaccucaaaagga

SEQ ID NO: 2275874 - RNA, 14 nt, Yersinia pestis
uugucaaucacugg

SEQ ID NO: 2275875 - RNA, 22 nt, Yersinia pestis
uugucaauaaccucaaaaggau

SEQ ID NO: 2275876 - RNA, 23 nt, Yersinia pestis
uugucacugcacuccugucuagg

SEQ ID NO: 2275877 - RNA, 24 nt, Yersinia pestis
uugucaauaaccucuaaucuccuc

SEQ ID NO: 2275878 - RNA, 13 nt, Yersinia pestis
uugucauacacgg

SEQ ID NO: 2275879 - RNA, 19 nt, Yersinia pestis
uugucaggcugaugccauc

SEQ ID NO: 2275880 - RNA, 22 nt, Yersinia pestis
uugucagcagucugagccucau

SEQ ID NO: 2275881 - RNA, 22 nt, Yersinia pestis
uugucagcagucugaagccuac

SEQ ID NO: 2275882 - RNA, 13 nt, Yersinia pestis
uugucagccaugc

SEQ ID NO: 2275883 - RNA, 16 nt, Yersinia pestis
uuguccaacaucuccg

SEQ ID NO: 2275884 - RNA, 19 nt, Yersinia pestis
uuguccaacaucuccgcca

SEQ ID NO: 2275885 - RNA, 16 nt, Yersinia pestis
uugucauguugaccaa

SEQ ID NO: 2275886 - RNA, 18 nt, Yersinia pestis
uugucauggccugaugca

SEQ ID NO: 2275887 - RNA, 19 nt, Yersinia pestis
uugucauguugaccaaaca

SEQ ID NO: 2275888 - RNA, 16 nt, Yersinia pestis
uuuaagucugccugga

SEQ ID NO: 2275889 - RNA, 20 nt, Yersinia pestis
uuuaaguucacuugagagaa

SEQ ID NO: 2275890 - RNA, 14 nt, Yersinia pestis
uuuaagcugaaauu

SEQ ID NO: 2275891 - RNA, 22 nt, Yersinia pestis
uuuaagcgggcuuuaauagcca

SEQ ID NO: 2275892 - RNA, 23 nt, Yersinia pestis
uuuaagaaaucuauuaauauacc

SEQ ID NO: 2275893 - RNA, 20 nt, Yersinia pestis
uuuaauagcccgcgaauuaa

SEQ ID NO: 2275894 - RNA, 16 nt, Yersinia pestis
uuuaauauuucaaaug

SEQ ID NO: 2275895 - RNA, 21 nt, Yersinia pestis
uuuaaugaguuggcauucuag

SEQ ID NO: 2275896 - RNA, 14 nt, Yersinia pestis
uuuaaucugcauca

SEQ ID NO: 2275897 - RNA, 18 nt, Yersinia pestis
uuuaauccacuuuucaga

SEQ ID NO: 2275898 - RNA, 21 nt, Yersinia pestis
uuuacgggugcugggauaauu

SEQ ID NO: 2275899 - RNA, 16 nt, Yersinia pestis
uuuacgugaucaucuu

SEQ ID NO: 2275900 - RNA, 18 nt, Yersinia pestis
uuuacggcuuaucaaucu

SEQ ID NO: 2275901 - RNA, 12 nt, Yersinia pestis
uuuacaggaacg

SEQ ID NO: 2275902 - RNA, 13 nt, Yersinia pestis
uuuacaggccaca

SEQ ID NO: 2275903 - RNA, 19 nt, Yersinia pestis
uuuacaugauugaaaaaca

SEQ ID NO: 2275904 - RNA, 18 nt, Yersinia pestis
uuuaaugguuuccauaau

SEQ ID NO: 2275905 - RNA, 13 nt, Yersinia pestis
uuuacacuuaauc

SEQ ID NO: 2275906 - RNA, 18 nt, Yersinia pestis
uuuaccugcucaacugcu

SEQ ID NO: 2275907 - RNA, 16 nt, Yersinia pestis
uuuaccguugggcuuu

SEQ ID NO: 2275908 - RNA, 22 nt, Yersinia pestis
uuuaccuguuucgauccagcua

SEQ ID NO: 2275909 - RNA, 16 nt, Yersinia pestis
uuuacggcucaccugg

SEQ ID NO: 2275910 - RNA, 13 nt, Yersinia pestis
uuuacccugcuac

SEQ ID NO: 2275911 - RNA, 12 nt, Yersinia pestis
uuuauaucagau

SEQ ID NO: 2275912 - RNA, 15 nt, Yersinia pestis
uuuauacauaucaga

SEQ ID NO: 2275913 - RNA, 18 nt, Yersinia pestis
uuuauaaugagaauguaa

SEQ ID NO: 2275914 - RNA, 19 nt, Yersinia pestis
uuuauaaugagaauguaaa

SEQ ID NO: 2275915 - RNA, 18 nt, Yersinia pestis
uuuagcauuacucugaca

SEQ ID NO: 2275916 - RNA, 14 nt, Yersinia pestis
uuuaucaaucagcu

SEQ ID NO: 2275917 - RNA, 17 nt, Yersinia pestis
uuuaucaauaggucagu

SEQ ID NO: 2275918 - RNA, 19 nt, Yersinia pestis
uuuauauugauaaaaauca

SEQ ID NO: 2275919 - RNA, 22 nt, Yersinia pestis
uuuauauugaugugaaacauaa

SEQ ID NO: 2275920 - RNA, 15 nt, Yersinia pestis
uuuauauuccacaua

SEQ ID NO: 2275921 - RNA, 15 nt, Yersinia pestis
uuuaucgaccacuuu

SEQ ID NO: 2275922 - RNA, 14 nt, Yersinia pestis
uuuaucuucuucag

SEQ ID NO: 2275923 - RNA, 19 nt, Yersinia pestis
uuuaucuuguaaauaguca

SEQ ID NO: 2275924 - RNA, 19 nt, Yersinia pestis
uuuaucugcauuaaaauaa

SEQ ID NO: 2275925 - RNA, 19 nt, Yersinia pestis
uuuaucugaugaaaaaguc

SEQ ID NO: 2275926 - RNA, 21 nt, Yersinia pestis
uuuaucucacgcugaauaaca

SEQ ID NO: 2275927 - RNA, 16 nt, Yersinia pestis
uuuaucuaaaauaucu

SEQ ID NO: 2275928 - RNA, 15 nt, Yersinia pestis
uuuaucuuccacucu

SEQ ID NO: 2275929 - RNA, 20 nt, Yersinia pestis
uuuaucuuccacucuuucaa

SEQ ID NO: 2275930 - RNA, 15 nt, Yersinia pestis
uuuaucuaucuguuc

SEQ ID NO: 2275931 - RNA, 14 nt, Yersinia pestis
uuuaucgcaguaau

SEQ ID NO: 2275932 - RNA, 14 nt, Yersinia pestis
uuuauuaaguuuuu

SEQ ID NO: 2275933 - RNA, 15 nt, Yersinia pestis
uuuauguaacacaua

SEQ ID NO: 2275934 - RNA, 21 nt, Yersinia pestis
uuuauuggucaauaaaauuaa

SEQ ID NO: 2275935 - RNA, 15 nt, Yersinia pestis
uuuauuguuaucaaa

SEQ ID NO: 2275936 - RNA, 16 nt, Yersinia pestis
uuuauuguuaucaaau

SEQ ID NO: 2275937 - RNA, 23 nt, Yersinia pestis
uuuauuguuaucaaaucaggccu

SEQ ID NO: 2275938 - RNA, 20 nt, Yersinia pestis
uuuauuuaagcugaaauuuu

SEQ ID NO: 2275939 - RNA, 19 nt, Yersinia pestis
uuuauugagaaucacuacg

SEQ ID NO: 2275940 - RNA, 16 nt, Yersinia pestis
uuuauugggaaccccu

SEQ ID NO: 2275941 - RNA, 21 nt, Yersinia pestis
uucuugguacaaggucuugga

SEQ ID NO: 2275942 - RNA, 23 nt, Yersinia pestis
uugagcggugaauacguucaaau

SEQ ID NO: 2275943 - RNA, 22 nt, Yersinia pestis
uugagccaccgagguuaucagc

SEQ ID NO: 2275944 - RNA, 21 nt, Yersinia pestis
uugagccaccgcauuccagcg

SEQ ID NO: 2275945 - RNA, 22 nt, Yersinia pestis
uugagccuacgucugaaaaaca

SEQ ID NO: 2275946 - RNA, 21 nt, Yersinia pestis
uugagcaggcucuucucugag

SEQ ID NO: 2275947 - RNA, 17 nt, Yersinia pestis
uugagcagugcgcggcg

SEQ ID NO: 2275948 - RNA, 11 nt, Yersinia pestis
uugagcagcaa

SEQ ID NO: 2275949 - RNA, 13 nt, Yersinia pestis
uugauaaucucca

SEQ ID NO: 2275950 - RNA, 13 nt, Yersinia pestis
uugagguuuucug

SEQ ID NO: 2275951 - RNA, 23 nt, Yersinia pestis
uugaguacgcuaagacauuagga

SEQ ID NO: 2275952 - RNA, 16 nt, Yersinia pestis
uugagguuauugacaa

SEQ ID NO: 2275953 - RNA, 16 nt, Yersinia pestis
uugaggguugucagca

SEQ ID NO: 2275954 - RNA, 19 nt, Yersinia pestis
uugaggauauuagggcuga

SEQ ID NO: 2275955 - RNA, 16 nt, Yersinia pestis
uugaggagcgauaaca

SEQ ID NO: 2275956 - RNA, 21 nt, Yersinia pestis
uugaucggauagcuuagccca

SEQ ID NO: 2275957 - RNA, 18 nt, Yersinia pestis
uugaugcuaauuucaucu

SEQ ID NO: 2275958 - RNA, 18 nt, Yersinia pestis
uugaugcucauuuaaaau

SEQ ID NO: 2275959 - RNA, 22 nt, Yersinia pestis
uugaucugaguuucauuaguca

SEQ ID NO: 2275960 - RNA, 19 nt, Yersinia pestis
uugauuaucaaguuaaaua

SEQ ID NO: 2275961 - RNA, 13 nt, Yersinia pestis
uugauuuaaauau

SEQ ID NO: 2275962 - RNA, 19 nt, Yersinia pestis
uugauuaccaauaauuaau

SEQ ID NO: 2275963 - RNA, 22 nt, Yersinia pestis
uugauuaacauccauuguauug

SEQ ID NO: 2275964 - RNA, 16 nt, Yersinia pestis
uugauuaauuuuucau

SEQ ID NO: 2275965 - RNA, 20 nt, Yersinia pestis
uugauggcgcaguaacugug

SEQ ID NO: 2275966 - RNA, 23 nt, Yersinia pestis
uugaugucgggugguugucuaug

SEQ ID NO: 2275967 - RNA, 22 nt, Yersinia pestis
uugcagagguugcgcacaauca

SEQ ID NO: 2275968 - RNA, 22 nt, Yersinia pestis
uugcagcaagccgauaaucaau

SEQ ID NO: 2275969 - RNA, 14 nt, Yersinia pestis
uugcagaaaguaau

SEQ ID NO: 2275970 - RNA, 14 nt, Yersinia pestis
uugauuuuauauug

SEQ ID NO: 2275971 - RNA, 15 nt, Yersinia pestis
uugcaggucugcaug

SEQ ID NO: 2275972 - RNA, 23 nt, Yersinia pestis
uugcaggauaauagugucauaau

SEQ ID NO: 2275973 - RNA, 23 nt, Yersinia pestis
uugcaugaaaucaguguauuacu

SEQ ID NO: 2275974 - RNA, 14 nt, Yersinia pestis
uugcaucuuuaauu

SEQ ID NO: 2275975 - RNA, 20 nt, Yersinia pestis
uugcauauguagccagauaa

SEQ ID NO: 2275976 - RNA, 17 nt, Yersinia pestis
uugcauacucaggcccu

SEQ ID NO: 2275977 - RNA, 11 nt, Yersinia pestis
uugccaccuga

SEQ ID NO: 2275978 - RNA, 22 nt, Yersinia pestis
uugccacgccaguaaacagcca

SEQ ID NO: 2275979 - RNA, 19 nt, Yersinia pestis
uugccagccaucuugggcc

SEQ ID NO: 2275980 - RNA, 15 nt, Yersinia pestis
uugccuacuaccaaa

SEQ ID NO: 2275981 - RNA, 23 nt, Yersinia pestis
uugccguuugaugcgcugagcaa

SEQ ID NO: 2275982 - RNA, 16 nt, Yersinia pestis
uugccguguaagaacu

SEQ ID NO: 2275983 - RNA, 16 nt, Yersinia pestis
uugcccaauggcaaaa

SEQ ID NO: 2275984 - RNA, 21 nt, Yersinia pestis
uugcccaaucuaacuggcccu

SEQ ID NO: 2275985 - RNA, 21 nt, Yersinia pestis
uugccaucuuguucuaauaau

SEQ ID NO: 2275986 - RNA, 19 nt, Yersinia pestis
uugccagugcaugcagguc

SEQ ID NO: 2275987 - RNA, 22 nt, Yersinia pestis
uugccauaaaugggaagggcgc

SEQ ID NO: 2275988 - RNA, 18 nt, Yersinia pestis
uugccagugaaucagcca

SEQ ID NO: 2275989 - RNA, 13 nt, Yersinia pestis
uugcgcgaaauau

SEQ ID NO: 2275990 - RNA, 21 nt, Yersinia pestis
uugcgggcucuuugucaauaa

SEQ ID NO: 2275991 - RNA, 21 nt, Yersinia pestis
uugcggcgcacccuccaauaa

SEQ ID NO: 2275992 - RNA, 15 nt, Yersinia pestis
uugcgcucaaccgaa

SEQ ID NO: 2275993 - RNA, 22 nt, Yersinia pestis
uugcggaguaacacuucagacu

SEQ ID NO: 2275994 - RNA, 21 nt, Yersinia pestis
uugcggcaaccaaacggcccu

SEQ ID NO: 2275995 - RNA, 19 nt, Yersinia pestis
uugcuuuuugccagugguu

SEQ ID NO: 2275996 - RNA, 15 nt, Yersinia pestis
uuggaaaugacaaau

SEQ ID NO: 2275997 - RNA, 16 nt, Yersinia pestis
uuggacuaaccccaau

SEQ ID NO: 2275998 - RNA, 19 nt, Yersinia pestis
uuggagucgcauguaggca

SEQ ID NO: 2275999 - RNA, 20 nt, Yersinia pestis
uuggauaauaaccugauauu

SEQ ID NO: 2276000 - RNA, 11 nt, Yersinia pestis
uuggaaugagu

SEQ ID NO: 2276001 - RNA, 15 nt, Yersinia pestis
uuggacccgucacca

SEQ ID NO: 2276002 - RNA, 17 nt, Yersinia pestis
uuggaucaucgggaaca

SEQ ID NO: 2276003 - RNA, 17 nt, Yersinia pestis
uuggaucaggaucacca

SEQ ID NO: 2276004 - RNA, 23 nt, Yersinia pestis
uuggcaaauucaacaaucaauca

SEQ ID NO: 2276005 - RNA, 16 nt, Yersinia pestis
uuggauuggucagguu

SEQ ID NO: 2276006 - RNA, 15 nt, Yersinia pestis
uuggauugagccacc

SEQ ID NO: 2276007 - RNA, 17 nt, Yersinia pestis
uuggcaaucacaacccc

SEQ ID NO: 2276008 - RNA, 18 nt, Yersinia pestis
uuggcaggugaagaaaag

SEQ ID NO: 2276009 - RNA, 18 nt, Yersinia pestis
uugcuugauagcgggcag

SEQ ID NO: 2276010 - RNA, 14 nt, Yersinia pestis
uugcuugauuaccu

SEQ ID NO: 2276011 - RNA, 17 nt, Yersinia pestis
uugcuucgauuuuauau

SEQ ID NO: 2276012 - RNA, 18 nt, Yersinia pestis
uugcuguaaugccuggug

SEQ ID NO: 2276013 - RNA, 18 nt, Yersinia pestis
uugcuauuaaacauuuau

SEQ ID NO: 2276014 - RNA, 18 nt, Yersinia pestis
uugcuauugaacauucau

SEQ ID NO: 2276015 - RNA, 15 nt, Yersinia pestis
uuggcuaaauaacca

SEQ ID NO: 2276016 - RNA, 14 nt, Yersinia pestis
uuggcucaugguug

SEQ ID NO: 2276017 - RNA, 23 nt, Yersinia pestis
uuggcucgugaucagcagacuca

SEQ ID NO: 2276018 - RNA, 18 nt, Yersinia pestis
uuggcggaagacuuccag

SEQ ID NO: 2276019 - RNA, 14 nt, Yersinia pestis
uuggcuucuggaug

SEQ ID NO: 2276020 - RNA, 18 nt, Yersinia pestis
uuggcuuggacagaaaac

SEQ ID NO: 2276021 - RNA, 16 nt, Yersinia pestis
uugggcaucaacgccc

SEQ ID NO: 2276022 - RNA, 15 nt, Yersinia pestis
uuggcaugacaucag

SEQ ID NO: 2276023 - RNA, 23 nt, Yersinia pestis
uuggcauuaaacugaauaucccc

SEQ ID NO: 2276024 - RNA, 13 nt, Yersinia pestis
uuggcccaaucga

SEQ ID NO: 2276025 - RNA, 16 nt, Yersinia pestis
uuggguuugagcagug

SEQ ID NO: 2276026 - RNA, 18 nt, Yersinia pestis
uugguaaaauauuuugcu

SEQ ID NO: 2276027 - RNA, 13 nt, Yersinia pestis
uugguaacgcaga

SEQ ID NO: 2276028 - RNA, 18 nt, Yersinia pestis
uugguaauacugagaccu

SEQ ID NO: 2276029 - RNA, 21 nt, Yersinia pestis
uugguagcuccgcagcuaaug

SEQ ID NO: 2276030 - RNA, 21 nt, Yersinia pestis
uugggguauauauuuuuaauu

SEQ ID NO: 2276031 - RNA, 13 nt, Yersinia pestis
uuggguauaggcc

SEQ ID NO: 2276032 - RNA, 17 nt, Yersinia pestis
uuggguauaugacugug

SEQ ID NO: 2276033 - RNA, 22 nt, Yersinia pestis
uugggucgaucuguugauaaaa

SEQ ID NO: 2276034 - RNA, 16 nt, Yersinia pestis
uugggucaguuuuauu

SEQ ID NO: 2276035 - RNA, 15 nt, Yersinia pestis
uugggugaacacaga

SEQ ID NO: 2276036 - RNA, 23 nt, Yersinia pestis
uugggugacaacgucacuuccau

SEQ ID NO: 2276037 - RNA, 19 nt, Yersinia pestis
uugggcgggaucuccagaa

SEQ ID NO: 2276038 - RNA, 13 nt, Yersinia pestis
uugggcuaaaacu

SEQ ID NO: 2276039 - RNA, 22 nt, Yersinia pestis
uuggugccgcuggcauacaguu

SEQ ID NO: 2276040 - RNA, 17 nt, Yersinia pestis
uuggucucagaacaaga

SEQ ID NO: 2276041 - RNA, 14 nt, Yersinia pestis
uuggucucagaaca

SEQ ID NO: 2276042 - RNA, 13 nt, Yersinia pestis
uuggucaaucaag

SEQ ID NO: 2276043 - RNA, 13 nt, Yersinia pestis
uugguggcuuuac

SEQ ID NO: 2276044 - RNA, 18 nt, Yersinia pestis
uugguugaacauuuccac

SEQ ID NO: 2276045 - RNA, 22 nt, Yersinia pestis
aauaaugaccacgcaucaauaa

SEQ ID NO: 2276046 - RNA, 15 nt, Yersinia pestis
aauaaugagccauaa

SEQ ID NO: 2276047 - RNA, 16 nt, Yersinia pestis
aauaaugagccauaaa

SEQ ID NO: 2276048 - RNA, 20 nt, Yersinia pestis
aauaaugaacguugucaggc

SEQ ID NO: 2276049 - RNA, 15 nt, Yersinia pestis
aauaaugaauuauua

SEQ ID NO: 2276050 - RNA, 16 nt, Yersinia pestis
aauaaugcaccaauca

SEQ ID NO: 2276051 - RNA, 20 nt, Yersinia pestis
aauaaugcaccaaucaacau

SEQ ID NO: 2276052 - RNA, 17 nt, Yersinia pestis
aauaaucuaaauuaaua

SEQ ID NO: 2276053 - RNA, 19 nt, Yersinia pestis
aauaauccgguuagcaaaa

SEQ ID NO: 2276054 - RNA, 14 nt, Yersinia pestis
aauaauucagguug

SEQ ID NO: 2276055 - RNA, 22 nt, Yersinia pestis
aauaauucaugcuaauaccaca

SEQ ID NO: 2276056 - RNA, 21 nt, Yersinia pestis
aauaauuaggauuuauuuuug

SEQ ID NO: 2276057 - RNA, 20 nt, Yersinia pestis
aauaauugccgcucaaguug

SEQ ID NO: 2276058 - RNA, 14 nt, Yersinia pestis
aauaauuaauuuca

SEQ ID NO: 2276059 - RNA, 15 nt, Yersinia pestis
aauaaguacuuccaa

SEQ ID NO: 2276060 - RNA, 16 nt, Yersinia pestis
aauaaguaaauauuau

SEQ ID NO: 2276061 - RNA, 14 nt, Yersinia pestis
aauaagucacuuuc

SEQ ID NO: 2276062 - RNA, 14 nt, Yersinia pestis
aauaaguauuucaa

SEQ ID NO: 2276063 - RNA, 15 nt, Yersinia pestis
aauaagugaaacaaa

SEQ ID NO: 2276064 - RNA, 18 nt, Yersinia pestis
aauaauaaaaaaaaauaa

SEQ ID NO: 2276065 - RNA, 16 nt, Yersinia pestis
aauaauaaaaaaaaau

SEQ ID NO: 2276066 - RNA, 12 nt, Yersinia pestis
aauaauaaaaaa

SEQ ID NO: 2276067 - RNA, 11 nt, Yersinia pestis
aauaauaaaaa

SEQ ID NO: 2276068 - RNA, 12 nt, Yersinia pestis
aauaaguucaga

SEQ ID NO: 2276069 - RNA, 20 nt, Yersinia pestis
aauaaguguuucaaauaagu

SEQ ID NO: 2276070 - RNA, 18 nt, Yersinia pestis
aauaaggugccacacaga

SEQ ID NO: 2276071 - RNA, 19 nt, Yersinia pestis
aauaaggguagguucaaua

SEQ ID NO: 2276072 - RNA, 13 nt, Yersinia pestis
aauaagcucuggg

SEQ ID NO: 2276073 - RNA, 21 nt, Yersinia pestis
aauaagccgcaggcaaacaau

SEQ ID NO: 2276074 - RNA, 23 nt, Yersinia pestis
aauaagcccaguauugcagagca

SEQ ID NO: 2276075 - RNA, 15 nt, Yersinia pestis
aauaauaauggugaa

SEQ ID NO: 2276076 - RNA, 11 nt, Yersinia pestis
aauaauaaugc

SEQ ID NO: 2276077 - RNA, 23 nt, Yersinia pestis
aauaauaacgguuuuaacaucau

SEQ ID NO: 2276078 - RNA, 15 nt, Yersinia pestis
aauaauaaauaaauu

SEQ ID NO: 2276079 - RNA, 13 nt, Yersinia pestis
aauaauagauagu

SEQ ID NO: 2276080 - RNA, 14 nt, Yersinia pestis
aauaauauaauuca

SEQ ID NO: 2276081 - RNA, 14 nt, Yersinia pestis
aauaauauucaaua

SEQ ID NO: 2276082 - RNA, 12 nt, Yersinia pestis
aauaaucaauga

SEQ ID NO: 2276083 - RNA, 16 nt, Yersinia pestis
aauaaucaccagacaa

SEQ ID NO: 2276084 - RNA, 22 nt, Yersinia pestis
aauaaucauaucaaaauaaaaa

SEQ ID NO: 2276085 - RNA, 14 nt, Yersinia pestis
aauaaucauaucaa

SEQ ID NO: 2276086 - RNA, 15 nt, Yersinia pestis
aauaaucauaucaaa

SEQ ID NO: 2276087 - RNA, 17 nt, Yersinia pestis
aaguugagcagcaauaa

SEQ ID NO: 2276088 - RNA, 13 nt, Yersinia pestis
aaguugauaacgc

SEQ ID NO: 2276089 - RNA, 15 nt, Yersinia pestis
aauaaauccaucaau

SEQ ID NO: 2276090 - RNA, 11 nt, Yersinia pestis
aauaacaauau

SEQ ID NO: 2276091 - RNA, 15 nt, Yersinia pestis
aauaaauucaaaaua

SEQ ID NO: 2276092 - RNA, 16 nt, Yersinia pestis
aauaaauucaaaauag

SEQ ID NO: 2276093 - RNA, 15 nt, Yersinia pestis
aauaaauuacucgcc

SEQ ID NO: 2276094 - RNA, 22 nt, Yersinia pestis
aauaaccucacgggcuuccauc

SEQ ID NO: 2276095 - RNA, 23 nt, Yersinia pestis
aauaaccucacgggcuuccauca

SEQ ID NO: 2276096 - RNA, 13 nt, Yersinia pestis
aauaaccggguaa

SEQ ID NO: 2276097 - RNA, 15 nt, Yersinia pestis
aauaaccucagccuc

SEQ ID NO: 2276098 - RNA, 22 nt, Yersinia pestis
aauaaccucaggcccgcuauca

SEQ ID NO: 2276099 - RNA, 17 nt, Yersinia pestis
aauaaccucaggggcca

SEQ ID NO: 2276100 - RNA, 18 nt, Yersinia pestis
aauaacgccguuaaaaug

SEQ ID NO: 2276101 - RNA, 23 nt, Yersinia pestis
aauaacgccccuguaaauaaaua

SEQ ID NO: 2276102 - RNA, 17 nt, Yersinia pestis
aauaacgcggcacauac

SEQ ID NO: 2276103 - RNA, 18 nt, Yersinia pestis
aauaacagcuaaaaugau

SEQ ID NO: 2276104 - RNA, 13 nt, Yersinia pestis
aauaaccauuuau

SEQ ID NO: 2276105 - RNA, 16 nt, Yersinia pestis
aauaaccauuuauaua

SEQ ID NO: 2276106 - RNA, 20 nt, Yersinia pestis
aauaaccauaaaauaaauaa

SEQ ID NO: 2276107 - RNA, 20 nt, Yersinia pestis
aauaaccaccucggaaggcc

SEQ ID NO: 2276108 - RNA, 15 nt, Yersinia pestis
aauaaccaaaagccc

SEQ ID NO: 2276109 - RNA, 17 nt, Yersinia pestis
aauaagaucaauauguu

SEQ ID NO: 2276110 - RNA, 11 nt, Yersinia pestis
aauaagaucca

SEQ ID NO: 2276111 - RNA, 14 nt, Yersinia pestis
aauaagaucccaga

SEQ ID NO: 2276112 - RNA, 18 nt, Yersinia pestis
aauaacuucaguuacuca

SEQ ID NO: 2276113 - RNA, 19 nt, Yersinia pestis
aauaacucagccauugcuu

SEQ ID NO: 2276114 - RNA, 14 nt, Yersinia pestis
aauaacuauuuuug

SEQ ID NO: 2276115 - RNA, 20 nt, Yersinia pestis
aauaacucagccauugcuuu

SEQ ID NO: 2276116 - RNA, 23 nt, Yersinia pestis
aauaacugccaauauugaccaac

SEQ ID NO: 2276117 - RNA, 19 nt, Yersinia pestis
aauaacgcuggauaaguga

SEQ ID NO: 2276118 - RNA, 16 nt, Yersinia pestis
aauaacguccugauga

SEQ ID NO: 2276119 - RNA, 16 nt, Yersinia pestis
aauaucagcgauuaaa

SEQ ID NO: 2276120 - RNA, 14 nt, Yersinia pestis
aauauauaaaauaa

SEQ ID NO: 2276121 - RNA, 21 nt, Yersinia pestis
aauauauacccguaauauuuc

SEQ ID NO: 2276122 - RNA, 17 nt, Yersinia pestis
aauaucauguucuuugu

SEQ ID NO: 2276123 - RNA, 14 nt, Yersinia pestis
aauaucauuaacaa

SEQ ID NO: 2276124 - RNA, 14 nt, Yersinia pestis
aauaucauccccuu

SEQ ID NO: 2276125 - RNA, 18 nt, Yersinia pestis
aauaucauccccuuucug

SEQ ID NO: 2276126 - RNA, 18 nt, Yersinia pestis
aauaucaucuuuuucugc

SEQ ID NO: 2276127 - RNA, 20 nt, Yersinia pestis
aauauccauauuaaaugcau

SEQ ID NO: 2276128 - RNA, 18 nt, Yersinia pestis
aauauggcggcaucagca

SEQ ID NO: 2276129 - RNA, 15 nt, Yersinia pestis
aauaugcugaccacu

SEQ ID NO: 2276130 - RNA, 16 nt, Yersinia pestis
aauaugcuucaucacu

SEQ ID NO: 2276131 - RNA, 21 nt, Yersinia pestis
aauaucccgagaaacaaaacc

SEQ ID NO: 2276132 - RNA, 16 nt, Yersinia pestis
aauauccgugggcaaa

SEQ ID NO: 2276133 - RNA, 23 nt, Yersinia pestis
aauauccgugggcaaaggcccaa

SEQ ID NO: 2276134 - RNA, 12 nt, Yersinia pestis
aauaucugucug

SEQ ID NO: 2276135 - RNA, 20 nt, Yersinia pestis
aauaucuguggugacaugau

SEQ ID NO: 2276136 - RNA, 12 nt, Yersinia pestis
aauaucuauuuc

SEQ ID NO: 2276137 - RNA, 16 nt, Yersinia pestis
aauaucuauuuccauc

SEQ ID NO: 2276138 - RNA, 15 nt, Yersinia pestis
aauaggucagugguu

SEQ ID NO: 2276139 - RNA, 20 nt, Yersinia pestis
aauaggucagugguuuuaua

SEQ ID NO: 2276140 - RNA, 20 nt, Yersinia pestis
aauagggcugucagccaccg

SEQ ID NO: 2276141 - RNA, 17 nt, Yersinia pestis
aauaggggaauuuuuag

SEQ ID NO: 2276142 - RNA, 20 nt, Yersinia pestis
aauaggggcaccguaaauga

SEQ ID NO: 2276143 - RNA, 16 nt, Yersinia pestis
aauagucuguuucauu

SEQ ID NO: 2276144 - RNA, 21 nt, Yersinia pestis
aauaggucagugguuuuauca

SEQ ID NO: 2276145 - RNA, 22 nt, Yersinia pestis
aauagucuuuuuaauaugugac

SEQ ID NO: 2276146 - RNA, 16 nt, Yersinia pestis
aauagcgccugcccuc

SEQ ID NO: 2276147 - RNA, 22 nt, Yersinia pestis
aauaggcaggcccgcuucccua

SEQ ID NO: 2276148 - RNA, 21 nt, Yersinia pestis
aauagccggcucuucucgaau

SEQ ID NO: 2276149 - RNA, 14 nt, Yersinia pestis
aauagcccgcgaau

SEQ ID NO: 2276150 - RNA, 21 nt, Yersinia pestis
aauauacuuuacauauaggaa

SEQ ID NO: 2276151 - RNA, 18 nt, Yersinia pestis
aauauagcaaucauuuau

SEQ ID NO: 2276152 - RNA, 19 nt, Yersinia pestis
aauauagcaaucauuuaua

SEQ ID NO: 2276153 - RNA, 13 nt, Yersinia pestis
aauauacuuuaca

SEQ ID NO: 2276154 - RNA, 21 nt, Yersinia pestis
aauauacccgacuaaucugau

SEQ ID NO: 2276155 - RNA, 22 nt, Yersinia pestis
aauaguuauccaaacuuuuuaa

SEQ ID NO: 2276156 - RNA, 13 nt, Yersinia pestis
aauaguucauuuu

SEQ ID NO: 2276157 - RNA, 18 nt, Yersinia pestis
aauauaauaaucuauaua

SEQ ID NO: 2276158 - RNA, 14 nt, Yersinia pestis
aauagugucauaau

SEQ ID NO: 2276159 - RNA, 20 nt, Yersinia pestis
aauaguguuguaagauuuca

SEQ ID NO: 2276160 - RNA, 23 nt, Yersinia pestis
aauauacacaagucauuggaguc

SEQ ID NO: 2276161 - RNA, 14 nt, Yersinia pestis
aauagcaccauuag

SEQ ID NO: 2276162 - RNA, 15 nt, Yersinia pestis
aauagcauaaauauc

SEQ ID NO: 2276163 - RNA, 18 nt, Yersinia pestis
aauagcccaaauaaccuc

SEQ ID NO: 2276164 - RNA, 14 nt, Yersinia pestis
aauagccagaagcc

SEQ ID NO: 2276165 - RNA, 13 nt, Yersinia pestis
aauagcaaaccca

SEQ ID NO: 2276166 - RNA, 13 nt, Yersinia pestis
aauagcaagccaa

SEQ ID NO: 2276167 - RNA, 22 nt, Yersinia pestis
aauagcaagccaaaacagccua

SEQ ID NO: 2276168 - RNA, 21 nt, Yersinia pestis
aauagauacugaaauauacac

SEQ ID NO: 2276169 - RNA, 23 nt, Yersinia pestis
aauagauacugaaauauacacaa

SEQ ID NO: 2276170 - RNA, 18 nt, Yersinia pestis
aauagauagcaaucaaua

SEQ ID NO: 2276171 - RNA, 18 nt, Yersinia pestis
aauagaaccggaauaaau

SEQ ID NO: 2276172 - RNA, 20 nt, Yersinia pestis
aauacugcgguccuacccuu

SEQ ID NO: 2276173 - RNA, 14 nt, Yersinia pestis
aauacuguuaucac

SEQ ID NO: 2276174 - RNA, 15 nt, Yersinia pestis
aauacugucaaaauc

SEQ ID NO: 2276175 - RNA, 23 nt, Yersinia pestis
aauacggcguuugacaauaucaa

SEQ ID NO: 2276176 - RNA, 21 nt, Yersinia pestis
aauacucuugagaaaugaaua

SEQ ID NO: 2276177 - RNA, 23 nt, Yersinia pestis
aauacucuugagaaaugaauauu

SEQ ID NO: 2276178 - RNA, 12 nt, Yersinia pestis
aauaccacaaca

SEQ ID NO: 2276179 - RNA, 13 nt, Yersinia pestis
aauaccacggcac

SEQ ID NO: 2276180 - RNA, 20 nt, Yersinia pestis
aauaauuuuucuuccaccau

SEQ ID NO: 2276181 - RNA, 18 nt, Yersinia pestis
aauacgcugucugaauag

SEQ ID NO: 2276182 - RNA, 16 nt, Yersinia pestis
aauaccugcaccaaug

SEQ ID NO: 2276183 - RNA, 13 nt, Yersinia pestis
aauaccuuacugc

SEQ ID NO: 2276184 - RNA, 19 nt, Yersinia pestis
aauaccuuacugcaucaau

SEQ ID NO: 2276185 - RNA, 19 nt, Yersinia pestis
aauaccuuacuguaucaau

SEQ ID NO: 2276186 - RNA, 12 nt, Yersinia pestis
aauaccuaaaau

SEQ ID NO: 2276187 - RNA, 19 nt, Yersinia pestis
aauaccguguacccgaucu

SEQ ID NO: 2276188 - RNA, 19 nt, Yersinia pestis
aauaccgcugcuaccagca

SEQ ID NO: 2276189 - RNA, 14 nt, Yersinia pestis
aauaccggcaccaa

SEQ ID NO: 2276190 - RNA, 18 nt, Yersinia pestis
aauaccgccgguuuuugc

SEQ ID NO: 2276191 - RNA, 19 nt, Yersinia pestis
aauaccgccggcaacagcg

SEQ ID NO: 2276192 - RNA, 21 nt, Yersinia pestis
aauaccggauuguucagcaac

SEQ ID NO: 2276193 - RNA, 18 nt, Yersinia pestis
aauaccgcgaucaacaag

SEQ ID NO: 2276194 - RNA, 17 nt, Yersinia pestis
aauaccgccacacaaua

SEQ ID NO: 2276195 - RNA, 15 nt, Yersinia pestis
aauaccgacgugugc

SEQ ID NO: 2276196 - RNA, 16 nt, Yersinia pestis
aagccgugaccaaagu

SEQ ID NO: 2276197 - RNA, 22 nt, Yersinia pestis
aagccgugaccaaagugcucac

SEQ ID NO: 2276198 - RNA, 13 nt, Yersinia pestis
aagccgucaguuc

SEQ ID NO: 2276199 - RNA, 21 nt, Yersinia pestis
aagccucuuguguaauuauau

SEQ ID NO: 2276200 - RNA, 9 nt, Yersinia pestis
aagccucuu

SEQ ID NO: 2276201 - RNA, 20 nt, Yersinia pestis
aagccguaauucagauaaga

SEQ ID NO: 2276202 - RNA, 20 nt, Yersinia pestis
aagccgguaucaacucugau

SEQ ID NO: 2276203 - RNA, 14 nt, Yersinia pestis
aagccgcgccaucu

SEQ ID NO: 2276204 - RNA, 13 nt, Yersinia pestis
aagccgcugcuca

SEQ ID NO: 2276205 - RNA, 16 nt, Yersinia pestis
aagccuucaaccugaa

SEQ ID NO: 2276206 - RNA, 21 nt, Yersinia pestis
aagcgaucaccucuugcauac

SEQ ID NO: 2276207 - RNA, 16 nt, Yersinia pestis
aagcgauccugcucaa

SEQ ID NO: 2276208 - RNA, 14 nt, Yersinia pestis
aagccagucagggc

SEQ ID NO: 2276209 - RNA, 16 nt, Yersinia pestis
aagccagugucaggau

SEQ ID NO: 2276210 - RNA, 21 nt, Yersinia pestis
aagccagauugugcggcuggc

SEQ ID NO: 2276211 - RNA, 16 nt, Yersinia pestis
aagcccuguuucauuu

SEQ ID NO: 2276212 - RNA, 15 nt, Yersinia pestis
aagcccuguuucauu

SEQ ID NO: 2276213 - RNA, 17 nt, Yersinia pestis
aagccgacgaucuugcc

SEQ ID NO: 2276214 - RNA, 20 nt, Yersinia pestis
aagccgauccgggaaaaaau

SEQ ID NO: 2276215 - RNA, 15 nt, Yersinia pestis
aagcccucauuuucg

SEQ ID NO: 2276216 - RNA, 18 nt, Yersinia pestis
aagcccggaaacguccag

SEQ ID NO: 2276217 - RNA, 16 nt, Yersinia pestis
aagcugacgcacauua

SEQ ID NO: 2276218 - RNA, 22 nt, Yersinia pestis
aagcugcuuuuaccgcagggcg

SEQ ID NO: 2276219 - RNA, 14 nt, Yersinia pestis
aagcuggcccugau

SEQ ID NO: 2276220 - RNA, 21 nt, Yersinia pestis
aagcuggcagcgcuugcaaca

SEQ ID NO: 2276221 - RNA, 15 nt, Yersinia pestis
aagcuucaacuuaau

SEQ ID NO: 2276222 - RNA, 14 nt, Yersinia pestis
aagcuucucccuuu

SEQ ID NO: 2276223 - RNA, 17 nt, Yersinia pestis
aaggaaaaggcagagag

SEQ ID NO: 2276224 - RNA, 18 nt, Yersinia pestis
aaggaaaaggcagagagg

SEQ ID NO: 2276225 - RNA, 16 nt, Yersinia pestis
aaggacccguuuauaa

SEQ ID NO: 2276226 - RNA, 20 nt, Yersinia pestis
aaggacaguaauauuuucau

SEQ ID NO: 2276227 - RNA, 21 nt, Yersinia pestis
aaggacgacggguauauugcc

SEQ ID NO: 2276228 - RNA, 23 nt, Yersinia pestis
aaggacuuggcguaacugcauuu

SEQ ID NO: 2276229 - RNA, 19 nt, Yersinia pestis
aagcuaaacguaaugcgaa

SEQ ID NO: 2276230 - RNA, 16 nt, Yersinia pestis
aagcguagggauaaau

SEQ ID NO: 2276231 - RNA, 17 nt, Yersinia pestis
aagcgguuucauggcug

SEQ ID NO: 2276232 - RNA, 18 nt, Yersinia pestis
aagcgguuuuaucaauag

SEQ ID NO: 2276233 - RNA, 13 nt, Yersinia pestis
aagcucauaugca

SEQ ID NO: 2276234 - RNA, 18 nt, Yersinia pestis
aagcuauuacugcucggc

SEQ ID NO: 2276235 - RNA, 14 nt, Yersinia pestis
aagcgccugcgaca

SEQ ID NO: 2276236 - RNA, 22 nt, Yersinia pestis
aagcgccgugcauaauggacga

SEQ ID NO: 2276237 - RNA, 11 nt, Yersinia pestis
aagcgcccuga

SEQ ID NO: 2276238 - RNA, 21 nt, Yersinia pestis
aagcgcagguuaugcagcuca

SEQ ID NO: 2276239 - RNA, 12 nt, Yersinia pestis
aagcgcaggaua

SEQ ID NO: 2276240 - RNA, 19 nt, Yersinia pestis
aagcgguauccaccuucca

SEQ ID NO: 2276241 - RNA, 15 nt, Yersinia pestis
aagcgcucaaauacg

SEQ ID NO: 2276242 - RNA, 22 nt, Yersinia pestis
aagcgcguaucguccagcagca

SEQ ID NO: 2276243 - RNA, 23 nt, Yersinia pestis
aagcgccuuccuuuuauuuagag

SEQ ID NO: 2276244 - RNA, 20 nt, Yersinia pestis
aagugaucagcuaacaaaac

SEQ ID NO: 2276245 - RNA, 22 nt, Yersinia pestis
aagugaucagcuaacaaaaccg

SEQ ID NO: 2276246 - RNA, 23 nt, Yersinia pestis
aagugccugcggcggagagaaca

SEQ ID NO: 2276247 - RNA, 19 nt, Yersinia pestis
aagugcgggaaaguaauau

SEQ ID NO: 2276248 - RNA, 18 nt, Yersinia pestis
aagugacccaagaugacc

SEQ ID NO: 2276249 - RNA, 17 nt, Yersinia pestis
aagucuuaaucuuuaau

SEQ ID NO: 2276250 - RNA, 13 nt, Yersinia pestis
aagugagaagggu

SEQ ID NO: 2276251 - RNA, 20 nt, Yersinia pestis
aagugagaaggguauugaag

SEQ ID NO: 2276252 - RNA, 21 nt, Yersinia pestis
aagugagaaggguauugaaga

SEQ ID NO: 2276253 - RNA, 22 nt, Yersinia pestis
aaguguauucgcaucuuccaaa

SEQ ID NO: 2276254 - RNA, 16 nt, Yersinia pestis
aagugucaauaacccu

SEQ ID NO: 2276255 - RNA, 24 nt, Yersinia pestis
aagugucaauaacccuugccaccu

SEQ ID NO: 2276256 - RNA, 19 nt, Yersinia pestis
aaguuagcgugagaauaau

SEQ ID NO: 2276257 - RNA, 20 nt, Yersinia pestis
aaguuagcgugagaauaaua

SEQ ID NO: 2276258 - RNA, 21 nt, Yersinia pestis
aaguuagcgugagaauaauaa

SEQ ID NO: 2276259 - RNA, 18 nt, Yersinia pestis
aaguuaggguucaguaaa

SEQ ID NO: 2276260 - RNA, 14 nt, Yersinia pestis
aaguuagugguguu

SEQ ID NO: 2276261 - RNA, 13 nt, Yersinia pestis
aaguuaucaccaa

SEQ ID NO: 2276262 - RNA, 16 nt, Yersinia pestis
aaguuaugccacauca

SEQ ID NO: 2276263 - RNA, 23 nt, Yersinia pestis
aaguuaggguucaguaaaaccaa

SEQ ID NO: 2276264 - RNA, 21 nt, Yersinia pestis
aaguucacuugagagaaacuu

SEQ ID NO: 2276265 - RNA, 22 nt, Yersinia pestis
aaguucacuugagagaaacuuu

SEQ ID NO: 2276266 - RNA, 13 nt, Yersinia pestis
aaguccuuaaaaa

SEQ ID NO: 2276267 - RNA, 18 nt, Yersinia pestis
aaguccuuaaaaauccau

SEQ ID NO: 2276268 - RNA, 17 nt, Yersinia pestis
aagucaaauuuaaaguu

SEQ ID NO: 2276269 - RNA, 23 nt, Yersinia pestis
aagucaaauuuaaaguuuuuuau

SEQ ID NO: 2276270 - RNA, 21 nt, Yersinia pestis
aagucauucuugguggagccu

SEQ ID NO: 2276271 - RNA, 22 nt, Yersinia pestis
aagucaugguacaacugcggcg

SEQ ID NO: 2276272 - RNA, 13 nt, Yersinia pestis
aaguagucagcaa

SEQ ID NO: 2276273 - RNA, 20 nt, Yersinia pestis
aaguaggcuuauuaugacaa

SEQ ID NO: 2276274 - RNA, 18 nt, Yersinia pestis
aaguaggcaucugccaca

SEQ ID NO: 2276275 - RNA, 19 nt, Yersinia pestis
aaguagccacuuaauaaug

SEQ ID NO: 2276276 - RNA, 16 nt, Yersinia pestis
aaguacuuauuugaaa

SEQ ID NO: 2276277 - RNA, 21 nt, Yersinia pestis
aaguacuuauuugaaacacuu

SEQ ID NO: 2276278 - RNA, 22 nt, Yersinia pestis
aaguaccgcuuugugaugcacc

SEQ ID NO: 2276279 - RNA, 17 nt, Yersinia pestis
aaguaaaagucagcaaa

SEQ ID NO: 2276280 - RNA, 12 nt, Yersinia pestis
aaguaaaagcca

SEQ ID NO: 2276281 - RNA, 20 nt, Yersinia pestis
aaguaaaacgugaaacgccu

SEQ ID NO: 2276282 - RNA, 16 nt, Yersinia pestis
aaguaauccagauggc

SEQ ID NO: 2276283 - RNA, 21 nt, Yersinia pestis
aagguccaacucccaaauaua

SEQ ID NO: 2276284 - RNA, 17 nt, Yersinia pestis
aaggguauugaagauac

SEQ ID NO: 2276285 - RNA, 13 nt, Yersinia pestis
aaggguauugaag

SEQ ID NO: 2276286 - RNA, 16 nt, Yersinia pestis
aaggguauugaagaua

SEQ ID NO: 2276287 - RNA, 23 nt, Yersinia pestis
aagggguuucagacuccugcccc

SEQ ID NO: 2276288 - RNA, 21 nt, Yersinia pestis
aagggcggccagcaagagcag

SEQ ID NO: 2276289 - RNA, 17 nt, Yersinia pestis
aaggggcggaaaugccg

SEQ ID NO: 2276290 - RNA, 16 nt, Yersinia pestis
aaggggagcuuccccc

SEQ ID NO: 2276291 - RNA, 16 nt, Yersinia pestis
aagggcaagcgcuguu

SEQ ID NO: 2276292 - RNA, 20 nt, Yersinia pestis
aagggccaccacgaaaaaau

SEQ ID NO: 2276293 - RNA, 22 nt, Yersinia pestis
aagggccacccugccaaaaaau

SEQ ID NO: 2276294 - RNA, 13 nt, Yersinia pestis
aagggauaugaca

SEQ ID NO: 2276295 - RNA, 14 nt, Yersinia pestis
aaggauggcccaag

SEQ ID NO: 2276296 - RNA, 18 nt, Yersinia pestis
aaggauggcccaagccau

SEQ ID NO: 2276297 - RNA, 21 nt, Yersinia pestis
aaggcuaaccggguggcccaa

SEQ ID NO: 2276298 - RNA, 16 nt, Yersinia pestis
aaggcguuacccacau

SEQ ID NO: 2276299 - RNA, 15 nt, Yersinia pestis
aaggcggugaacagu

SEQ ID NO: 2276300 - RNA, 16 nt, Yersinia pestis
aaggcggugaacagua

SEQ ID NO: 2276301 - RNA, 17 nt, Yersinia pestis
aauucuuaggauaacca

SEQ ID NO: 2276302 - RNA, 18 nt, Yersinia pestis
aauucuguguaacugcca

SEQ ID NO: 2276303 - RNA, 15 nt, Yersinia pestis
aauucuguagaguaa

SEQ ID NO: 2276304 - RNA, 20 nt, Yersinia pestis
aauucuggguacaacacaaa

SEQ ID NO: 2276305 - RNA, 20 nt, Yersinia pestis
aauugagauauuugucgcau

SEQ ID NO: 2276306 - RNA, 23 nt, Yersinia pestis
aauugacuuuaaaaaaauuauca

SEQ ID NO: 2276307 - RNA, 15 nt, Yersinia pestis
aauugacuuuaaaaa

SEQ ID NO: 2276308 - RNA, 15 nt, Yersinia pestis
aauugacuguauaua

SEQ ID NO: 2276309 - RNA, 19 nt, Yersinia pestis
aauugaguaguaaaaccua

SEQ ID NO: 2276310 - RNA, 18 nt, Yersinia pestis
aauugaagcagauaaaga

SEQ ID NO: 2276311 - RNA, 17 nt, Yersinia pestis
aauugccugauuuuuau

SEQ ID NO: 2276312 - RNA, 22 nt, Yersinia pestis
aauugaugcacaguaggcugaa

SEQ ID NO: 2276313 - RNA, 14 nt, Yersinia pestis
aauugaucugauau

SEQ ID NO: 2276314 - RNA, 23 nt, Yersinia pestis
aauugauauuauuuauaugauaa

SEQ ID NO: 2276315 - RNA, 21 nt, Yersinia pestis
aauugauauuauuuauaugau

SEQ ID NO: 2276316 - RNA, 14 nt, Yersinia pestis
aauugaucagggca

SEQ ID NO: 2276317 - RNA, 13 nt, Yersinia pestis
aauugauaugauu

SEQ ID NO: 2276318 - RNA, 14 nt, Yersinia pestis
aauugauaugauuu

SEQ ID NO: 2276319 - RNA, 15 nt, Yersinia pestis
aauugauauuauuua

SEQ ID NO: 2276320 - RNA, 17 nt, Yersinia pestis
aauugauauuauuuaua

SEQ ID NO: 2276321 - RNA, 20 nt, Yersinia pestis
aauugauauuauuuauauga

SEQ ID NO: 2276322 - RNA, 20 nt, Yersinia pestis
aauugcgcuucgcgcagcau

SEQ ID NO: 2276323 - RNA, 23 nt, Yersinia pestis
aauugcgauuaggacaaauagau

SEQ ID NO: 2276324 - RNA, 19 nt, Yersinia pestis
aauugcugcuugcgcgccu

SEQ ID NO: 2276325 - RNA, 20 nt, Yersinia pestis
aauugcuggcuaucaucccu

SEQ ID NO: 2276326 - RNA, 20 nt, Yersinia pestis
aauuggcuuaacucgccacu

SEQ ID NO: 2276327 - RNA, 18 nt, Yersinia pestis
aauugggggucagggcgg

SEQ ID NO: 2276328 - RNA, 17 nt, Yersinia pestis
aauugggggucagggcg

SEQ ID NO: 2276329 - RNA, 21 nt, Yersinia pestis
aauuucacuaucguuagcaua

SEQ ID NO: 2276330 - RNA, 22 nt, Yersinia pestis
aauuuauccuguacauauauaa

SEQ ID NO: 2276331 - RNA, 14 nt, Yersinia pestis
aauuuaucagacaa

SEQ ID NO: 2276332 - RNA, 19 nt, Yersinia pestis
aauuuaucaggcuaauaca

SEQ ID NO: 2276333 - RNA, 14 nt, Yersinia pestis
aauuuaugauuaaa

SEQ ID NO: 2276334 - RNA, 15 nt, Yersinia pestis
aauuuagccauucaa

SEQ ID NO: 2276335 - RNA, 18 nt, Yersinia pestis
aauuuagccauucaaaaa

SEQ ID NO: 2276336 - RNA, 19 nt, Yersinia pestis
aauuuagccauucaaaaau

SEQ ID NO: 2276337 - RNA, 14 nt, Yersinia pestis
aauuuaagaaaucu

SEQ ID NO: 2276338 - RNA, 14 nt, Yersinia pestis
aauuuacugacggu

SEQ ID NO: 2276339 - RNA, 11 nt, Yersinia pestis
aauuuacccug

SEQ ID NO: 2276340 - RNA, 15 nt, Yersinia pestis
aauuguuucuucccc

SEQ ID NO: 2276341 - RNA, 20 nt, Yersinia pestis
aauuuaaccaucuaauguaa

SEQ ID NO: 2276342 - RNA, 19 nt, Yersinia pestis
aauuuaaacaaccaaaaau

SEQ ID NO: 2276343 - RNA, 15 nt, Yersinia pestis
aauuuaaauaaaaua

SEQ ID NO: 2276344 - RNA, 20 nt, Yersinia pestis
aauuguuauuauuaaauuuu

SEQ ID NO: 2276345 - RNA, 14 nt, Yersinia pestis
aauuguucaucgcu

SEQ ID NO: 2276346 - RNA, 19 nt, Yersinia pestis
aauuggugcuuuauguauu

SEQ ID NO: 2276347 - RNA, 23 nt, Yersinia pestis
aauugguuagcgccuuuuuuaua

SEQ ID NO: 2276348 - RNA, 22 nt, Yersinia pestis
aauugguuuauaacaaggaaau

SEQ ID NO: 2276349 - RNA, 22 nt, Yersinia pestis
aauuagccaagcaaccuuguuu

SEQ ID NO: 2276350 - RNA, 19 nt, Yersinia pestis
aauuagcuguacucacuca

SEQ ID NO: 2276351 - RNA, 21 nt, Yersinia pestis
aauuaggggaagguaaaaaag

SEQ ID NO: 2276352 - RNA, 24 nt, Yersinia pestis
aauuagggguugcaggcugucagg

SEQ ID NO: 2276353 - RNA, 17 nt, Yersinia pestis
aauuagguaacuuucca

SEQ ID NO: 2276354 - RNA, 22 nt, Yersinia pestis
aauuauagccaaaucuggauaa

SEQ ID NO: 2276355 - RNA, 19 nt, Yersinia pestis
aauuauagccaaaucugga

SEQ ID NO: 2276356 - RNA, 17 nt, Yersinia pestis
aauuacucguauaaaaa

SEQ ID NO: 2276357 - RNA, 17 nt, Yersinia pestis
aauuacacccaacuuuu

SEQ ID NO: 2276358 - RNA, 14 nt, Yersinia pestis
aauuacgcacugcc

SEQ ID NO: 2276359 - RNA, 15 nt, Yersinia pestis
aauuacgcacugccu

SEQ ID NO: 2276360 - RNA, 18 nt, Yersinia pestis
aauuacggcucaguugau

SEQ ID NO: 2276361 - RNA, 22 nt, Yersinia pestis
aauuacggcucaguugaugcaa

SEQ ID NO: 2276362 - RNA, 14 nt, Yersinia pestis
aauuaaauuuuaau

SEQ ID NO: 2276363 - RNA, 12 nt, Yersinia pestis
aauguaauaauc

SEQ ID NO: 2276364 - RNA, 14 nt, Yersinia pestis
aauguacaccuaaa

SEQ ID NO: 2276365 - RNA, 15 nt, Yersinia pestis
aauguaagcaucuuu

SEQ ID NO: 2276366 - RNA, 16 nt, Yersinia pestis
aauguaagcaucuuuu

SEQ ID NO: 2276367 - RNA, 19 nt, Yersinia pestis
aauguaagcaucuuuucau

SEQ ID NO: 2276368 - RNA, 20 nt, Yersinia pestis
aauguagagcguagacuaaa

SEQ ID NO: 2276369 - RNA, 13 nt, Yersinia pestis
aauuaauuuaaac

SEQ ID NO: 2276370 - RNA, 23 nt, Yersinia pestis
aauuaaccugcuggcgcaacugu

SEQ ID NO: 2276371 - RNA, 22 nt, Yersinia pestis
aauuaacacccaauaauaaaaa

SEQ ID NO: 2276372 - RNA, 20 nt, Yersinia pestis
aauuaacacccaauaauaaa

SEQ ID NO: 2276373 - RNA, 21 nt, Yersinia pestis
aauuaacacccaauaauaaaa

SEQ ID NO: 2276374 - RNA, 22 nt, Yersinia pestis
aauuaucgaucacaugcucagu

SEQ ID NO: 2276375 - RNA, 15 nt, Yersinia pestis
aauuaucaucaauag

SEQ ID NO: 2276376 - RNA, 18 nt, Yersinia pestis
aauuauccauuuucugcc

SEQ ID NO: 2276377 - RNA, 20 nt, Yersinia pestis
aauuaucgaucacaugcuca

SEQ ID NO: 2276378 - RNA, 15 nt, Yersinia pestis
aauuauauaagagau

SEQ ID NO: 2276379 - RNA, 13 nt, Yersinia pestis
aauuauagugaaa

SEQ ID NO: 2276380 - RNA, 16 nt, Yersinia pestis
aauuauauuuaauuua

SEQ ID NO: 2276381 - RNA, 20 nt, Yersinia pestis
aauuauuuuccagaugaaua

SEQ ID NO: 2276382 - RNA, 17 nt, Yersinia pestis
aauuauuguucaaaaac

SEQ ID NO: 2276383 - RNA, 23 nt, Yersinia pestis
aauucaaaauguauuauuuugua

SEQ ID NO: 2276384 - RNA, 11 nt, Yersinia pestis
aauucaaaaua

SEQ ID NO: 2276385 - RNA, 20 nt, Yersinia pestis
aauucagguugaucaguaaa

SEQ ID NO: 2276386 - RNA, 20 nt, Yersinia pestis
aauucaucagauuguuuaua

SEQ ID NO: 2276387 - RNA, 18 nt, Yersinia pestis
aauucaucagcgcuggcu

SEQ ID NO: 2276388 - RNA, 18 nt, Yersinia pestis
aauucauaccgcagauaa

SEQ ID NO: 2276389 - RNA, 19 nt, Yersinia pestis
aauucauaugacaaauaag

SEQ ID NO: 2276390 - RNA, 22 nt, Yersinia pestis
aauucagaugagaaucucucca

SEQ ID NO: 2276391 - RNA, 15 nt, Yersinia pestis
aauucagauguuaac

SEQ ID NO: 2276392 - RNA, 18 nt, Yersinia pestis
aauucagauaagaucuca

SEQ ID NO: 2276393 - RNA, 21 nt, Yersinia pestis
aauucagcguauugugauuca

SEQ ID NO: 2276394 - RNA, 14 nt, Yersinia pestis
aauucacguuuacu

SEQ ID NO: 2276395 - RNA, 22 nt, Yersinia pestis
aauuccaccauucucaaaauaa

SEQ ID NO: 2276396 - RNA, 22 nt, Yersinia pestis
aauucauguugccaaugggcca

SEQ ID NO: 2276397 - RNA, 13 nt, Yersinia pestis
aauucauuauuac

SEQ ID NO: 2276398 - RNA, 16 nt, Yersinia pestis
aauucauuauuacuca

SEQ ID NO: 2276399 - RNA, 17 nt, Yersinia pestis
aauucccccaaaaccuc

SEQ ID NO: 2276400 - RNA, 23 nt, Yersinia pestis
aauucccgucagguucaauuccc

SEQ ID NO: 2276401 - RNA, 17 nt, Yersinia pestis
aauucguuucucuaaaa

SEQ ID NO: 2276402 - RNA, 20 nt, Yersinia pestis
aauucuauccggauuaaauu

SEQ ID NO: 2276403 - RNA, 15 nt, Yersinia pestis
aauucuaucugguuu

SEQ ID NO: 2276404 - RNA, 18 nt, Yersinia pestis
aauucuccuuucuuuucg

SEQ ID NO: 2276405 - RNA, 19 nt, Yersinia pestis
aauucugagaucuaaaaaa

SEQ ID NO: 2276406 - RNA, 19 nt, Yersinia pestis
aauuccuauaaauuuuaag

SEQ ID NO: 2276407 - RNA, 22 nt, Yersinia pestis
aauuccuauaaauuuuaaguua

SEQ ID NO: 2276408 - RNA, 12 nt, Yersinia pestis
aauucggcuggc

SEQ ID NO: 2276409 - RNA, 19 nt, Yersinia pestis
aaucauucugucaucaaga

SEQ ID NO: 2276410 - RNA, 19 nt, Yersinia pestis
aaucauugacguuacagau

SEQ ID NO: 2276411 - RNA, 17 nt, Yersinia pestis
aaucaucgcucaucgcc

SEQ ID NO: 2276412 - RNA, 18 nt, Yersinia pestis
aaucauaucaaaauaaaa

SEQ ID NO: 2276413 - RNA, 17 nt, Yersinia pestis
aaucauagccaucccaa

SEQ ID NO: 2276414 - RNA, 17 nt, Yersinia pestis
aaucaugcucugcuaau

SEQ ID NO: 2276415 - RNA, 20 nt, Yersinia pestis
aaucauguaacacacagcag

SEQ ID NO: 2276416 - RNA, 21 nt, Yersinia pestis
aaucaucugcuguacacuaac

SEQ ID NO: 2276417 - RNA, 12 nt, Yersinia pestis
aauaugugcuuc

SEQ ID NO: 2276418 - RNA, 20 nt, Yersinia pestis
aauaugugacaauaguguug

SEQ ID NO: 2276419 - RNA, 13 nt, Yersinia pestis
aaucagcuucauu

SEQ ID NO: 2276420 - RNA, 18 nt, Yersinia pestis
aaucagcuucauuaagga

SEQ ID NO: 2276421 - RNA, 17 nt, Yersinia pestis
aauauuaaagccauuca

SEQ ID NO: 2276422 - RNA, 12 nt, Yersinia pestis
aauauuaaaauc

SEQ ID NO: 2276423 - RNA, 17 nt, Yersinia pestis
aauauggguaaauacau

SEQ ID NO: 2276424 - RNA, 21 nt, Yersinia pestis
aaucaguaccgacaccaauac

SEQ ID NO: 2276425 - RNA, 22 nt, Yersinia pestis
aaucaguacuauucacgagcua

SEQ ID NO: 2276426 - RNA, 14 nt, Yersinia pestis
aaucagggcacucu

SEQ ID NO: 2276427 - RNA, 15 nt, Yersinia pestis
aaucagggcacucug

SEQ ID NO: 2276428 - RNA, 21 nt, Yersinia pestis
aauccaccugacgaaaugccg

SEQ ID NO: 2276429 - RNA, 18 nt, Yersinia pestis
aauccacauaaaaagaaa

SEQ ID NO: 2276430 - RNA, 16 nt, Yersinia pestis
aauccaauuuaccacu

SEQ ID NO: 2276431 - RNA, 18 nt, Yersinia pestis
aauccaaccuauauagcc

SEQ ID NO: 2276432 - RNA, 14 nt, Yersinia pestis
aaucauuuuuuuau

SEQ ID NO: 2276433 - RNA, 21 nt, Yersinia pestis
aaucauuuaggcguuucuucc

SEQ ID NO: 2276434 - RNA, 15 nt, Yersinia pestis
aauccacucuugcac

SEQ ID NO: 2276435 - RNA, 21 nt, Yersinia pestis
aauccagcgccuguuccaacg

SEQ ID NO: 2276436 - RNA, 17 nt, Yersinia pestis
aauccaguugaguaauu

SEQ ID NO: 2276437 - RNA, 18 nt, Yersinia pestis
aauccagugcgcgauaaa

SEQ ID NO: 2276438 - RNA, 14 nt, Yersinia pestis
aauccaguguauua

SEQ ID NO: 2276439 - RNA, 22 nt, Yersinia pestis
aauccauagugauuauuuaaac

SEQ ID NO: 2276440 - RNA, 23 nt, Yersinia pestis
aauccauaagauugagggcgucu

SEQ ID NO: 2276441 - RNA, 23 nt, Yersinia pestis
aauccaugccagcccaucaccau

SEQ ID NO: 2276442 - RNA, 21 nt, Yersinia pestis
aaucccaaagcuuaucgauaa

SEQ ID NO: 2276443 - RNA, 21 nt, Yersinia pestis
aauccugcaaauuaaccugcu

SEQ ID NO: 2276444 - RNA, 15 nt, Yersinia pestis
aauccuaaugaacac

SEQ ID NO: 2276445 - RNA, 17 nt, Yersinia pestis
aauccgguuagcaaaaa

SEQ ID NO: 2276446 - RNA, 16 nt, Yersinia pestis
aauccgaccacugaca

SEQ ID NO: 2276447 - RNA, 17 nt, Yersinia pestis
aauccgcgccaaaauua

SEQ ID NO: 2276448 - RNA, 13 nt, Yersinia pestis
aaucccuacggca

SEQ ID NO: 2276449 - RNA, 15 nt, Yersinia pestis
aaucccucggcuuau

SEQ ID NO: 2276450 - RNA, 14 nt, Yersinia pestis
aaucccugccagaa

SEQ ID NO: 2276451 - RNA, 23 nt, Yersinia pestis
aaucccugccagaaucagcccca

SEQ ID NO: 2276452 - RNA, 17 nt, Yersinia pestis
aaucccguuccgcuucc

SEQ ID NO: 2276453 - RNA, 19 nt, Yersinia pestis
aaucccccacgaucuccuc

SEQ ID NO: 2276454 - RNA, 23 nt, Yersinia pestis
aauccccccuuuuucaaucacuu

SEQ ID NO: 2276455 - RNA, 15 nt, Yersinia pestis
aauccccucaaaauu

SEQ ID NO: 2276456 - RNA, 22 nt, Yersinia pestis
aaucuacugugggacugaucaa

SEQ ID NO: 2276457 - RNA, 15 nt, Yersinia pestis
aaucuacuuuauuca

SEQ ID NO: 2276458 - RNA, 22 nt, Yersinia pestis
aaucuagaggacggcggccuua

SEQ ID NO: 2276459 - RNA, 18 nt, Yersinia pestis
aaucguauaacauaauaa

SEQ ID NO: 2276460 - RNA, 18 nt, Yersinia pestis
aaucgcugccaaaccaaa

SEQ ID NO: 2276461 - RNA, 15 nt, Yersinia pestis
aaucgcccaauguca

SEQ ID NO: 2276462 - RNA, 19 nt, Yersinia pestis
aaucgcucugcguuuuucc

SEQ ID NO: 2276463 - RNA, 20 nt, Yersinia pestis
aaucgcucugcguuuuuccc

SEQ ID NO: 2276464 - RNA, 14 nt, Yersinia pestis
aauccuucuggcuu

SEQ ID NO: 2276465 - RNA, 23 nt, Yersinia pestis
aaugguuuccaguacugaccacg

SEQ ID NO: 2276466 - RNA, 12 nt, Yersinia pestis
aaugguuuugcc

SEQ ID NO: 2276467 - RNA, 23 nt, Yersinia pestis
aaugguuuccuucaccaaaaaaa

SEQ ID NO: 2276468 - RNA, 14 nt, Yersinia pestis
aaugguuuggccau

SEQ ID NO: 2276469 - RNA, 13 nt, Yersinia pestis
aauguaaauuucc

SEQ ID NO: 2276470 - RNA, 21 nt, Yersinia pestis
aauguaaaacgaguaaauaca

SEQ ID NO: 2276471 - RNA, 23 nt, Yersinia pestis
aauguaaaacgaguaaauacaaa

SEQ ID NO: 2276472 - RNA, 17 nt, Yersinia pestis
aaugguugaaugaccaa

SEQ ID NO: 2276473 - RNA, 15 nt, Yersinia pestis
aauggcgcucuuauu

SEQ ID NO: 2276474 - RNA, 12 nt, Yersinia pestis
aauggccuugcc

SEQ ID NO: 2276475 - RNA, 20 nt, Yersinia pestis
aauggccgccauuuuuaugu

SEQ ID NO: 2276476 - RNA, 16 nt, Yersinia pestis
aauggaucacaucaca

SEQ ID NO: 2276477 - RNA, 11 nt, Yersinia pestis
aauggaagaau

SEQ ID NO: 2276478 - RNA, 13 nt, Yersinia pestis
aaugcggcggcug

SEQ ID NO: 2276479 - RNA, 17 nt, Yersinia pestis
aaugcgauggucuauau

SEQ ID NO: 2276480 - RNA, 13 nt, Yersinia pestis
aaugcgaaaaaau

SEQ ID NO: 2276481 - RNA, 20 nt, Yersinia pestis
aaugcgaaaaaauauauucc

SEQ ID NO: 2276482 - RNA, 20 nt, Yersinia pestis
aaugccucgaccugaauauc

SEQ ID NO: 2276483 - RNA, 19 nt, Yersinia pestis
aaugccgcugugauuaagc

SEQ ID NO: 2276484 - RNA, 21 nt, Yersinia pestis
aaugccgcugugauuaagcgu

SEQ ID NO: 2276485 - RNA, 16 nt, Yersinia pestis
aaugccguacaacaau

SEQ ID NO: 2276486 - RNA, 16 nt, Yersinia pestis
aaugccgaaugauuca

SEQ ID NO: 2276487 - RNA, 18 nt, Yersinia pestis
aaugccgagucuggucgg

SEQ ID NO: 2276488 - RNA, 21 nt, Yersinia pestis
aaugccgcgcccccagccauu

SEQ ID NO: 2276489 - RNA, 17 nt, Yersinia pestis
aaugcccgucauauuua

SEQ ID NO: 2276490 - RNA, 16 nt, Yersinia pestis
aaugccacgucaucga

SEQ ID NO: 2276491 - RNA, 14 nt, Yersinia pestis
aaugcagguuuugc

SEQ ID NO: 2276492 - RNA, 20 nt, Yersinia pestis
aaugcagguucauuacacag

SEQ ID NO: 2276493 - RNA, 23 nt, Yersinia pestis
aaugcagguucauuacacagcau

SEQ ID NO: 2276494 - RNA, 17 nt, Yersinia pestis
aaugauuuuuuugcuuu

SEQ ID NO: 2276495 - RNA, 23 nt, Yersinia pestis
aaugauggcggcuaaauguucaa

SEQ ID NO: 2276496 - RNA, 18 nt, Yersinia pestis
aaugaugacuugauuaac

SEQ ID NO: 2276497 - RNA, 16 nt, Yersinia pestis
aaugagccuuaccccu

SEQ ID NO: 2276498 - RNA, 22 nt, Yersinia pestis
aaugagcgccaaauguagagcg

SEQ ID NO: 2276499 - RNA, 12 nt, Yersinia pestis
aaugagccuguc

SEQ ID NO: 2276500 - RNA, 14 nt, Yersinia pestis
aaugagauugauca

SEQ ID NO: 2276501 - RNA, 20 nt, Yersinia pestis
aaugagcacggacagcagca

SEQ ID NO: 2276502 - RNA, 16 nt, Yersinia pestis
aaugacgaucacugcu

SEQ ID NO: 2276503 - RNA, 17 nt, Yersinia pestis
aaugacgaucacugcuu

SEQ ID NO: 2276504 - RNA, 17 nt, Yersinia pestis
aaugacgcgaucugaaa

SEQ ID NO: 2276505 - RNA, 15 nt, Yersinia pestis
aaugaauauuauuca

SEQ ID NO: 2276506 - RNA, 16 nt, Yersinia pestis
aaucugucgcugugaa

SEQ ID NO: 2276507 - RNA, 18 nt, Yersinia pestis
aaucuguaagucauucuu

SEQ ID NO: 2276508 - RNA, 16 nt, Yersinia pestis
aaucuuaaauugaaga

SEQ ID NO: 2276509 - RNA, 15 nt, Yersinia pestis
aaucuauuguauaua

SEQ ID NO: 2276510 - RNA, 16 nt, Yersinia pestis
aaucuauuguauauac

SEQ ID NO: 2276511 - RNA, 20 nt, Yersinia pestis
aaucuuuuuguaauguuucu

SEQ ID NO: 2276512 - RNA, 14 nt, Yersinia pestis
aaucuuauuuaauc

SEQ ID NO: 2276513 - RNA, 17 nt, Yersinia pestis
aaucuuauuuguaaaua

SEQ ID NO: 2276514 - RNA, 20 nt, Yersinia pestis
aaucuuugccuauuucaggg

SEQ ID NO: 2276515 - RNA, 23 nt, Yersinia pestis
aaugaaauugcgauuaggacaaa

SEQ ID NO: 2276516 - RNA, 20 nt, Yersinia pestis
aaugaaguuauccuccauuc

SEQ ID NO: 2276517 - RNA, 19 nt, Yersinia pestis
aaccuuucgaguugaacuc

SEQ ID NO: 2276518 - RNA, 16 nt, Yersinia pestis
aaccuuuacaauuaca

SEQ ID NO: 2276519 - RNA, 22 nt, Yersinia pestis
aaccuuuaccagcgucaaacca

SEQ ID NO: 2276520 - RNA, 22 nt, Yersinia pestis
aaccuuguuuuaucgcaguaau

SEQ ID NO: 2276521 - RNA, 20 nt, Yersinia pestis
aaccuugggggaccagcaca

SEQ ID NO: 2276522 - RNA, 16 nt, Yersinia pestis
aaccuuaucaccaacg

SEQ ID NO: 2276523 - RNA, 13 nt, Yersinia pestis
aaccuucucugca

SEQ ID NO: 2276524 - RNA, 14 nt, Yersinia pestis
aaccuucucugcac

SEQ ID NO: 2276525 - RNA, 15 nt, Yersinia pestis
aacgaacgcucuuua

SEQ ID NO: 2276526 - RNA, 18 nt, Yersinia pestis
aacgaacgcucuuuaaca

SEQ ID NO: 2276527 - RNA, 12 nt, Yersinia pestis
aacgacaaccca

SEQ ID NO: 2276528 - RNA, 15 nt, Yersinia pestis
aacgaauucagcagc

SEQ ID NO: 2276529 - RNA, 16 nt, Yersinia pestis
aacgaauucagcagcg

SEQ ID NO: 2276530 - RNA, 12 nt, Yersinia pestis
aacgaauuucau

SEQ ID NO: 2276531 - RNA, 18 nt, Yersinia pestis
aacgaauuucauuuuaaa

SEQ ID NO: 2276532 - RNA, 22 nt, Yersinia pestis
aaccguuuuuucaacuggcugu

SEQ ID NO: 2276533 - RNA, 17 nt, Yersinia pestis
aaccuaaaaaaaacaac

SEQ ID NO: 2276534 - RNA, 19 nt, Yersinia pestis
aaccgucgacuguaacagg

SEQ ID NO: 2276535 - RNA, 16 nt, Yersinia pestis
aaccucacgggcuucc

SEQ ID NO: 2276536 - RNA, 20 nt, Yersinia pestis
aaccucaaaaggauggccca

SEQ ID NO: 2276537 - RNA, 16 nt, Yersinia pestis
aaccuagcugcugcaa

SEQ ID NO: 2276538 - RNA, 19 nt, Yersinia pestis
aaccuagcugcugcaagag

SEQ ID NO: 2276539 - RNA, 18 nt, Yersinia pestis
aaccuaaugccagacaca

SEQ ID NO: 2276540 - RNA, 14 nt, Yersinia pestis
aaccugcacuuuca

SEQ ID NO: 2276541 - RNA, 23 nt, Yersinia pestis
aaccugcacuuucaugccuugaa

SEQ ID NO: 2276542 - RNA, 19 nt, Yersinia pestis
aaccugcuugaaagcaccg

SEQ ID NO: 2276543 - RNA, 13 nt, Yersinia pestis
aaccugagcacca

SEQ ID NO: 2276544 - RNA, 22 nt, Yersinia pestis
aaccugagcggcguuguucucu

SEQ ID NO: 2276545 - RNA, 19 nt, Yersinia pestis
aaccuccgcgauaccaaua

SEQ ID NO: 2276546 - RNA, 19 nt, Yersinia pestis
aaccuccggcuaugccgga

SEQ ID NO: 2276547 - RNA, 20 nt, Yersinia pestis
aaccuccggcuaugccggag

SEQ ID NO: 2276548 - RNA, 22 nt, Yersinia pestis
aaccucuaaucuccucuccgga

SEQ ID NO: 2276549 - RNA, 23 nt, Yersinia pestis
aaccucgggcgcuuaaauaaaac

SEQ ID NO: 2276550 - RNA, 20 nt, Yersinia pestis
aaccucggucugaauaagag

SEQ ID NO: 2276551 - RNA, 17 nt, Yersinia pestis
aaccucgguggcucaau

SEQ ID NO: 2276552 - RNA, 17 nt, Yersinia pestis
aacgauuauuaaacuau

SEQ ID NO: 2276553 - RNA, 13 nt, Yersinia pestis
aacgcagauaaau

SEQ ID NO: 2276554 - RNA, 21 nt, Yersinia pestis
aacgcacuggucaguauaaau

SEQ ID NO: 2276555 - RNA, 13 nt, Yersinia pestis
aacgcacaugccg

SEQ ID NO: 2276556 - RNA, 19 nt, Yersinia pestis
aacgaucaguuugccuugu

SEQ ID NO: 2276557 - RNA, 16 nt, Yersinia pestis
aacgaucuggucugcc

SEQ ID NO: 2276558 - RNA, 19 nt, Yersinia pestis
aacgauaugcuccagauca

SEQ ID NO: 2276559 - RNA, 12 nt, Yersinia pestis
aacgaguaaaua

SEQ ID NO: 2276560 - RNA, 21 nt, Yersinia pestis
aacgagggcucaaucucugcc

SEQ ID NO: 2276561 - RNA, 19 nt, Yersinia pestis
aacgacuaaauaauccaga

SEQ ID NO: 2276562 - RNA, 20 nt, Yersinia pestis
aacgccuccucuuggauuau

SEQ ID NO: 2276563 - RNA, 13 nt, Yersinia pestis
aacgccgaguaag

SEQ ID NO: 2276564 - RNA, 15 nt, Yersinia pestis
aacgccgcuaaauca

SEQ ID NO: 2276565 - RNA, 20 nt, Yersinia pestis
aacgccgcgucaauaacauu

SEQ ID NO: 2276566 - RNA, 17 nt, Yersinia pestis
aacgccucaaaaaccug

SEQ ID NO: 2276567 - RNA, 13 nt, Yersinia pestis
aacgcaucccagg

SEQ ID NO: 2276568 - RNA, 19 nt, Yersinia pestis
aacgcauucaucagggcag

SEQ ID NO: 2276569 - RNA, 21 nt, Yersinia pestis
aacgccaccagcgccaugaua

SEQ ID NO: 2276570 - RNA, 21 nt, Yersinia pestis
aacgcauuugaguaaacaucc

SEQ ID NO: 2276571 - RNA, 15 nt, Yersinia pestis
aacgccagauaacga

SEQ ID NO: 2276572 - RNA, 17 nt, Yersinia pestis
aacgccagauaugauca

SEQ ID NO: 2276573 - RNA, 19 nt, Yersinia pestis
aacgccagugcaaaaugcu

SEQ ID NO: 2276574 - RNA, 22 nt, Yersinia pestis
aacgcuaccaugagugaaaaua

SEQ ID NO: 2276575 - RNA, 23 nt, Yersinia pestis
aacgcucccuccgccagcaaguu

SEQ ID NO: 2276576 - RNA, 21 nt, Yersinia pestis
aacgcugauguaggcaauaca

SEQ ID NO: 2276577 - RNA, 17 nt, Yersinia pestis
aacgcugauuaaccugu

SEQ ID NO: 2276578 - RNA, 22 nt, Yersinia pestis
aacgcugcaauuauaagcacaa

SEQ ID NO: 2276579 - RNA, 20 nt, Yersinia pestis
aacgcgccuuucggcaauau

SEQ ID NO: 2276580 - RNA, 22 nt, Yersinia pestis
aacgcgccggaauuagcgaaau

SEQ ID NO: 2276581 - RNA, 21 nt, Yersinia pestis
aacgcgccauauucaccacac

SEQ ID NO: 2276582 - RNA, 22 nt, Yersinia pestis
aacgcgccauauucaccacaca

SEQ ID NO: 2276583 - RNA, 23 nt, Yersinia pestis
aacgcgccauauucaccacacau

SEQ ID NO: 2276584 - RNA, 13 nt, Yersinia pestis
aacgcgucacugg

SEQ ID NO: 2276585 - RNA, 17 nt, Yersinia pestis
aacgcgucacuggccac

SEQ ID NO: 2276586 - RNA, 15 nt, Yersinia pestis
aacggaguaacaaau

SEQ ID NO: 2276587 - RNA, 17 nt, Yersinia pestis
aacggacgaccuguagc

SEQ ID NO: 2276588 - RNA, 22 nt, Yersinia pestis
aacggacuaucgcgaaagcacu

SEQ ID NO: 2276589 - RNA, 16 nt, Yersinia pestis
aacggauacccagcac

SEQ ID NO: 2276590 - RNA, 21 nt, Yersinia pestis
aacggcaaugaccaucaacuc

SEQ ID NO: 2276591 - RNA, 13 nt, Yersinia pestis
aacggacauuuua

SEQ ID NO: 2276592 - RNA, 12 nt, Yersinia pestis
aacgcuucagua

SEQ ID NO: 2276593 - RNA, 15 nt, Yersinia pestis
aacgcuucaucaugg

SEQ ID NO: 2276594 - RNA, 16 nt, Yersinia pestis
aacgggcaaccuguac

SEQ ID NO: 2276595 - RNA, 19 nt, Yersinia pestis
aacgggcuuccaucaggaa

SEQ ID NO: 2276596 - RNA, 14 nt, Yersinia pestis
aacgggcuuccauc

SEQ ID NO: 2276597 - RNA, 16 nt, Yersinia pestis
aacgggguuagcagac

SEQ ID NO: 2276598 - RNA, 14 nt, Yersinia pestis
aacggcucaucgcu

SEQ ID NO: 2276599 - RNA, 21 nt, Yersinia pestis
aacggcuuaaaguuauguuuu

SEQ ID NO: 2276600 - RNA, 17 nt, Yersinia pestis
aacggcccucuuggcgu

SEQ ID NO: 2276601 - RNA, 12 nt, Yersinia pestis
aacggccccuca

SEQ ID NO: 2276602 - RNA, 20 nt, Yersinia pestis
aacggcgcggcaucaccaaa

SEQ ID NO: 2276603 - RNA, 21 nt, Yersinia pestis
aacggucagauccacauucug

SEQ ID NO: 2276604 - RNA, 18 nt, Yersinia pestis
aacggguggccgccgcgg

SEQ ID NO: 2276605 - RNA, 15 nt, Yersinia pestis
aacgguaaaagguua

SEQ ID NO: 2276606 - RNA, 17 nt, Yersinia pestis
aacgggugauguuuaac

SEQ ID NO: 2276607 - RNA, 22 nt, Yersinia pestis
aacggucucuuucgggcaaaaa

SEQ ID NO: 2276608 - RNA, 16 nt, Yersinia pestis
aacggucuguuaaucc

SEQ ID NO: 2276609 - RNA, 14 nt, Yersinia pestis
aacguacccuccca

SEQ ID NO: 2276610 - RNA, 17 nt, Yersinia pestis
aacguaauaucugccac

SEQ ID NO: 2276611 - RNA, 18 nt, Yersinia pestis
aacguaauaucugccacc

SEQ ID NO: 2276612 - RNA, 19 nt, Yersinia pestis
aacgguuucaacuucaacg

SEQ ID NO: 2276613 - RNA, 12 nt, Yersinia pestis
aacgucagauua

SEQ ID NO: 2276614 - RNA, 20 nt, Yersinia pestis
aacgucagauaaaaaagggu

SEQ ID NO: 2276615 - RNA, 17 nt, Yersinia pestis
aacgucagauaaacaaa

SEQ ID NO: 2276616 - RNA, 15 nt, Yersinia pestis
aacgucacuuccauc

SEQ ID NO: 2276617 - RNA, 19 nt, Yersinia pestis
aacgucaucgccacacgca

SEQ ID NO: 2276618 - RNA, 16 nt, Yersinia pestis
aacgucauaauugcca

SEQ ID NO: 2276619 - RNA, 16 nt, Yersinia pestis
aacgucaauggcaccg

SEQ ID NO: 2276620 - RNA, 19 nt, Yersinia pestis
aacgugacucuuuguuacu

SEQ ID NO: 2276621 - RNA, 18 nt, Yersinia pestis
aacgugaacauugcagua

SEQ ID NO: 2276622 - RNA, 12 nt, Yersinia pestis
aacgucccauuc

SEQ ID NO: 2276623 - RNA, 12 nt, Yersinia pestis
aacgucgccagu

SEQ ID NO: 2276624 - RNA, 13 nt, Yersinia pestis
aacguuaacugca

SEQ ID NO: 2276625 - RNA, 16 nt, Yersinia pestis
aacguuaacugcagua

SEQ ID NO: 2276626 - RNA, 18 nt, Yersinia pestis
aacguguuuaucgaucaa

SEQ ID NO: 2276627 - RNA, 22 nt, Yersinia pestis
aacguguuagguaauaccaaug

SEQ ID NO: 2276628 - RNA, 16 nt, Yersinia pestis
aacguucguagauaau

SEQ ID NO: 2276629 - RNA, 21 nt, Yersinia pestis
aacguucguagauaauuucua

SEQ ID NO: 2276630 - RNA, 13 nt, Yersinia pestis
aacguucugccaa

SEQ ID NO: 2276631 - RNA, 14 nt, Yersinia pestis
aacguugucaggcg

SEQ ID NO: 2276632 - RNA, 19 nt, Yersinia pestis
aacguuguuauuucuguuc

SEQ ID NO: 2276633 - RNA, 16 nt, Yersinia pestis
aacuaaacagaucacc

SEQ ID NO: 2276634 - RNA, 18 nt, Yersinia pestis
aacuaaacagaucacccg

SEQ ID NO: 2276635 - RNA, 20 nt, Yersinia pestis
aacuaaacagggcagaaaau

SEQ ID NO: 2276636 - RNA, 21 nt, Yersinia pestis
aacuaaacagggcagaaaaua

SEQ ID NO: 2276637 - RNA, 19 nt, Yersinia pestis
aacuaagagucacagcauu

SEQ ID NO: 2276638 - RNA, 22 nt, Yersinia pestis
aacuaacgauugacggaaaauu

SEQ ID NO: 2276639 - RNA, 16 nt, Yersinia pestis
aacuaacguuuuguaa

SEQ ID NO: 2276640 - RNA, 14 nt, Yersinia pestis
aacuaacaucagcg

SEQ ID NO: 2276641 - RNA, 15 nt, Yersinia pestis
aacuaacaucagcga

SEQ ID NO: 2276642 - RNA, 15 nt, Yersinia pestis
aacuaauauuuucua

SEQ ID NO: 2276643 - RNA, 13 nt, Yersinia pestis
aacuaaggggcca

SEQ ID NO: 2276644 - RNA, 23 nt, Yersinia pestis
aacuacgccucgcagauccagaa

SEQ ID NO: 2276645 - RNA, 13 nt, Yersinia pestis
aacuacuccaucc

SEQ ID NO: 2276646 - RNA, 16 nt, Yersinia pestis
aacuacuccaucccca

SEQ ID NO: 2276647 - RNA, 16 nt, Yersinia pestis
aacuaucgccugggcg

SEQ ID NO: 2276648 - RNA, 20 nt, Yersinia pestis
aacuaucuccggccugccgg

SEQ ID NO: 2276649 - RNA, 23 nt, Yersinia pestis
aacuauuuuugacuuuaauuaaa

SEQ ID NO: 2276650 - RNA, 21 nt, Yersinia pestis
aacucaaacugauaaagcaaa

SEQ ID NO: 2276651 - RNA, 13 nt, Yersinia pestis
aacucaaaacaau

SEQ ID NO: 2276652 - RNA, 20 nt, Yersinia pestis
aacucaauuuuggcugaugu

SEQ ID NO: 2276653 - RNA, 16 nt, Yersinia pestis
aacucaauaaauucau

SEQ ID NO: 2276654 - RNA, 19 nt, Yersinia pestis
aacucauuuaucuaaaacu

SEQ ID NO: 2276655 - RNA, 15 nt, Yersinia pestis
aacucaugcucuuca

SEQ ID NO: 2276656 - RNA, 21 nt, Yersinia pestis
aacucaugcucuucauaagcc

SEQ ID NO: 2276657 - RNA, 18 nt, Yersinia pestis
aacucaugacaucccagc

SEQ ID NO: 2276658 - RNA, 20 nt, Yersinia pestis
aacucagcgaauaaauaauu

SEQ ID NO: 2276659 - RNA, 22 nt, Yersinia pestis
aacucaggauccucgucguaau

SEQ ID NO: 2276660 - RNA, 11 nt, Yersinia pestis
aacucagggcu

SEQ ID NO: 2276661 - RNA, 18 nt, Yersinia pestis
aacucagccaauccagca

SEQ ID NO: 2276662 - RNA, 19 nt, Yersinia pestis
aacucagccaauccagcaa

SEQ ID NO: 2276663 - RNA, 23 nt, Yersinia pestis
aacucagccaucaguucacugaa

SEQ ID NO: 2276664 - RNA, 15 nt, Yersinia pestis
aacucagccauugcu

SEQ ID NO: 2276665 - RNA, 20 nt, Yersinia pestis
aacucacgguuucuaaaaaa

SEQ ID NO: 2276666 - RNA, 16 nt, Yersinia pestis
aacucacguaccaaau

SEQ ID NO: 2276667 - RNA, 22 nt, Yersinia pestis
aacucagcagagucgcaaaaaa

SEQ ID NO: 2276668 - RNA, 16 nt, Yersinia pestis
aacucaccuaaaucau

SEQ ID NO: 2276669 - RNA, 22 nt, Yersinia pestis
aacucaccgagcauauuuuuua

SEQ ID NO: 2276670 - RNA, 17 nt, Yersinia pestis
aacucaccuaaaucaua

SEQ ID NO: 2276671 - RNA, 18 nt, Yersinia pestis
aacucaccuaaaucauac

SEQ ID NO: 2276672 - RNA, 19 nt, Yersinia pestis
aacucgaucaccacgucac

SEQ ID NO: 2276673 - RNA, 18 nt, Yersinia pestis
aacucgagcauuugaccg

SEQ ID NO: 2276674 - RNA, 21 nt, Yersinia pestis
aacucgccacccgcuuucaga

SEQ ID NO: 2276675 - RNA, 16 nt, Yersinia pestis
aacucgccacucacaa

SEQ ID NO: 2276676 - RNA, 19 nt, Yersinia pestis
aacucggccgggcugacau

SEQ ID NO: 2276677 - RNA, 23 nt, Yersinia pestis
aacucccgauucagcucugccag

SEQ ID NO: 2276678 - RNA, 22 nt, Yersinia pestis
aacucuaaggguaaaaucccca

SEQ ID NO: 2276679 - RNA, 20 nt, Yersinia pestis
aacucuuuuuaaacuauuag

SEQ ID NO: 2276680 - RNA, 21 nt, Yersinia pestis
aacucuuucaucccauaugcu

SEQ ID NO: 2276681 - RNA, 21 nt, Yersinia pestis
aacucuggauggguaaugcau

SEQ ID NO: 2276682 - RNA, 14 nt, Yersinia pestis
aacucuucuguugc

SEQ ID NO: 2276683 - RNA, 15 nt, Yersinia pestis
aacuuaaaaaucaaa

SEQ ID NO: 2276684 - RNA, 23 nt, Yersinia pestis
aacuguuuugcugauucagauuu

SEQ ID NO: 2276685 - RNA, 17 nt, Yersinia pestis
aacuguguuuauaccaa

SEQ ID NO: 2276686 - RNA, 19 nt, Yersinia pestis
aacuguucuuauugcuauc

SEQ ID NO: 2276687 - RNA, 21 nt, Yersinia pestis
aacuguccgcaauagccaaga

SEQ ID NO: 2276688 - RNA, 19 nt, Yersinia pestis
aacuguggauuaugugcgg

SEQ ID NO: 2276689 - RNA, 20 nt, Yersinia pestis
aacugucgggggcucguugg

SEQ ID NO: 2276690 - RNA, 22 nt, Yersinia pestis
aacuggcccgcguggcaacagu

SEQ ID NO: 2276691 - RNA, 13 nt, Yersinia pestis
aacuguaaaaucu

SEQ ID NO: 2276692 - RNA, 20 nt, Yersinia pestis
aacugggcgacaaucaaugg

SEQ ID NO: 2276693 - RNA, 16 nt, Yersinia pestis
aacuggcuccgcacgg

SEQ ID NO: 2276694 - RNA, 15 nt, Yersinia pestis
aacugcauagcuaac

SEQ ID NO: 2276695 - RNA, 20 nt, Yersinia pestis
aacugcauagcuaaccuuaa

SEQ ID NO: 2276696 - RNA, 14 nt, Yersinia pestis
aacugcucaacugc

SEQ ID NO: 2276697 - RNA, 22 nt, Yersinia pestis
aacugcucauaaagcaucagac

SEQ ID NO: 2276698 - RNA, 20 nt, Yersinia pestis
aacugcuggccaacugcgcc

SEQ ID NO: 2276699 - RNA, 21 nt, Yersinia pestis
aacugcggcaauaagcauuau

SEQ ID NO: 2276700 - RNA, 22 nt, Yersinia pestis
aacugcggcauuaaugcagguu

SEQ ID NO: 2276701 - RNA, 19 nt, Yersinia pestis
aacugcgaccaaaagccac

SEQ ID NO: 2276702 - RNA, 21 nt, Yersinia pestis
aacugauauaaagcauuuauc

SEQ ID NO: 2276703 - RNA, 17 nt, Yersinia pestis
aacugauguauucccuc

SEQ ID NO: 2276704 - RNA, 15 nt, Yersinia pestis
aacugauacccacuc

SEQ ID NO: 2276705 - RNA, 23 nt, Yersinia pestis
aacugaguuggaaaugacaaauc

SEQ ID NO: 2276706 - RNA, 13 nt, Yersinia pestis
aacugaucacugg

SEQ ID NO: 2276707 - RNA, 15 nt, Yersinia pestis
aacugaucacuggca

SEQ ID NO: 2276708 - RNA, 21 nt, Yersinia pestis
aacugaaccgccauugcauau

SEQ ID NO: 2276709 - RNA, 16 nt, Yersinia pestis
aacugacaacaucaaa

SEQ ID NO: 2276710 - RNA, 19 nt, Yersinia pestis
aacugagaauaaucacagg

SEQ ID NO: 2276711 - RNA, 20 nt, Yersinia pestis
aacugacucacgucaguaau

SEQ ID NO: 2276712 - RNA, 10 nt, Yersinia pestis
aacuuacugc

SEQ ID NO: 2276713 - RNA, 12 nt, Yersinia pestis
aacuuaucacug

SEQ ID NO: 2276714 - RNA, 22 nt, Yersinia pestis
aacuucaaaucgccaaacugcu

SEQ ID NO: 2276715 - RNA, 18 nt, Yersinia pestis
aacuucaauaccaaauuu

SEQ ID NO: 2276716 - RNA, 22 nt, Yersinia pestis
aacuucaagccgauaaucccug

SEQ ID NO: 2276717 - RNA, 15 nt, Yersinia pestis
aacuuaucgacacca

SEQ ID NO: 2276718 - RNA, 15 nt, Yersinia pestis
aacuuaucgaccaac

SEQ ID NO: 2276719 - RNA, 16 nt, Yersinia pestis
aacuuauggggcacuu

SEQ ID NO: 2276720 - RNA, 19 nt, Yersinia pestis
aacuuauuacaccuuaaaa

SEQ ID NO: 2276721 - RNA, 18 nt, Yersinia pestis
aacuucaucggauugaac

SEQ ID NO: 2276722 - RNA, 16 nt, Yersinia pestis
aacuucagguucaccu

SEQ ID NO: 2276723 - RNA, 19 nt, Yersinia pestis
aacuucaugacgaaaaaca

SEQ ID NO: 2276724 - RNA, 15 nt, Yersinia pestis
aacuuccacacaaac

SEQ ID NO: 2276725 - RNA, 14 nt, Yersinia pestis
aacuucauuuuucu

SEQ ID NO: 2276726 - RNA, 20 nt, Yersinia pestis
aacuuccagcguauguuccu

SEQ ID NO: 2276727 - RNA, 14 nt, Yersinia pestis
aacuuccuaacaau

SEQ ID NO: 2276728 - RNA, 16 nt, Yersinia pestis
aacuuccuaacaauau

SEQ ID NO: 2276729 - RNA, 13 nt, Yersinia pestis
aacuuccuuugcc

SEQ ID NO: 2276730 - RNA, 23 nt, Yersinia pestis
aacuucuuuaucuaaaauaucuu

SEQ ID NO: 2276731 - RNA, 15 nt, Yersinia pestis
aacuugccguaaaau

SEQ ID NO: 2276732 - RNA, 14 nt, Yersinia pestis
aacuuuaacuucca

SEQ ID NO: 2276733 - RNA, 13 nt, Yersinia pestis
aacuuucucuuuc

SEQ ID NO: 2276734 - RNA, 18 nt, Yersinia pestis
aacuuuaucagucuguag

SEQ ID NO: 2276735 - RNA, 15 nt, Yersinia pestis
aacuuucccagucau

SEQ ID NO: 2276736 - RNA, 15 nt, Yersinia pestis
aacuuuaguuucuuu

SEQ ID NO: 2276737 - RNA, 20 nt, Yersinia pestis
aacuuuauugacuguaaaua

SEQ ID NO: 2276738 - RNA, 12 nt, Yersinia pestis
aacuuugccagu

SEQ ID NO: 2276739 - RNA, 19 nt, Yersinia pestis
aacuuuggguauaugacug

SEQ ID NO: 2276740 - RNA, 23 nt, Yersinia pestis
aacuuuucaguuuuaauuuauga

SEQ ID NO: 2276741 - RNA, 22 nt, Yersinia pestis
aacuuuucaucgcauaggccaa

SEQ ID NO: 2276742 - RNA, 13 nt, Yersinia pestis
aacuuuucaguuu

SEQ ID NO: 2276743 - RNA, 19 nt, Yersinia pestis
aacuuuucuucauugcugc

SEQ ID NO: 2276744 - RNA, 22 nt, Yersinia pestis
aagaaggcgaguuucucugcuc

SEQ ID NO: 2276745 - RNA, 21 nt, Yersinia pestis
aagaagcgggcggccucugcu

SEQ ID NO: 2276746 - RNA, 14 nt, Yersinia pestis
aagaagccucauga

SEQ ID NO: 2276747 - RNA, 17 nt, Yersinia pestis
aagaagccucaugaaug

SEQ ID NO: 2276748 - RNA, 20 nt, Yersinia pestis
aagaacuggcuggaucagca

SEQ ID NO: 2276749 - RNA, 16 nt, Yersinia pestis
aagaagacaauagagu

SEQ ID NO: 2276750 - RNA, 19 nt, Yersinia pestis
aagaagacaauagagucac

SEQ ID NO: 2276751 - RNA, 19 nt, Yersinia pestis
aagaagaauccacauaaaa

SEQ ID NO: 2276752 - RNA, 20 nt, Yersinia pestis
aagaaccggugauuacuguc

SEQ ID NO: 2276753 - RNA, 16 nt, Yersinia pestis
aagaaccgcagacaua

SEQ ID NO: 2276754 - RNA, 15 nt, Yersinia pestis
aagaaccgaaauauc

SEQ ID NO: 2276755 - RNA, 18 nt, Yersinia pestis
aagaaauuuuuagaaaac

SEQ ID NO: 2276756 - RNA, 14 nt, Yersinia pestis
aagaaagaaaaaua

SEQ ID NO: 2276757 - RNA, 16 nt, Yersinia pestis
aagaaagaaaaauaga

SEQ ID NO: 2276758 - RNA, 21 nt, Yersinia pestis
aagaaacgccccgauaaacca

SEQ ID NO: 2276759 - RNA, 23 nt, Yersinia pestis
aagaaaucauuuaggcguuucuu

SEQ ID NO: 2276760 - RNA, 15 nt, Yersinia pestis
aagaaauaccugagu

SEQ ID NO: 2276761 - RNA, 12 nt, Yersinia pestis
aagaaaccagcg

SEQ ID NO: 2276762 - RNA, 13 nt, Yersinia pestis
aagaaaagcaccg

SEQ ID NO: 2276763 - RNA, 18 nt, Yersinia pestis
aaauugggggucagggcg

SEQ ID NO: 2276764 - RNA, 16 nt, Yersinia pestis
aaauugcugaaaaaaa

SEQ ID NO: 2276765 - RNA, 19 nt, Yersinia pestis
aaauugcgcccggcccacu

SEQ ID NO: 2276766 - RNA, 18 nt, Yersinia pestis
aaauugcccgcguaaucu

SEQ ID NO: 2276767 - RNA, 15 nt, Yersinia pestis
aaauugccgcuuuag

SEQ ID NO: 2276768 - RNA, 14 nt, Yersinia pestis
aaauuguaacucuu

SEQ ID NO: 2276769 - RNA, 20 nt, Yersinia pestis
aaauuguauguuucuuuaau

SEQ ID NO: 2276770 - RNA, 23 nt, Yersinia pestis
aaauuguauguuucuuuaauaag

SEQ ID NO: 2276771 - RNA, 20 nt, Yersinia pestis
aaauugugauucaacugccg

SEQ ID NO: 2276772 - RNA, 19 nt, Yersinia pestis
aaauugugaguuaaaaaua

SEQ ID NO: 2276773 - RNA, 21 nt, Yersinia pestis
aaauuguuccguuucucuuug

SEQ ID NO: 2276774 - RNA, 14 nt, Yersinia pestis
aaauuuaaaguaaa

SEQ ID NO: 2276775 - RNA, 13 nt, Yersinia pestis
aaauuuaaaguuu

SEQ ID NO: 2276776 - RNA, 22 nt, Yersinia pestis
aaauuuaaaguuuuuuauuuau

SEQ ID NO: 2276777 - RNA, 17 nt, Yersinia pestis
aaauuuaagaaaucuau

SEQ ID NO: 2276778 - RNA, 14 nt, Yersinia pestis
aaauuuaauaaguu

SEQ ID NO: 2276779 - RNA, 22 nt, Yersinia pestis
aaauuuuauucgcguuucauuu

SEQ ID NO: 2276780 - RNA, 20 nt, Yersinia pestis
aaauuuuguacaacuucuuc

SEQ ID NO: 2276781 - RNA, 14 nt, Yersinia pestis
aaauuuauccugua

SEQ ID NO: 2276782 - RNA, 15 nt, Yersinia pestis
aaauuuaucaguagc

SEQ ID NO: 2276783 - RNA, 14 nt, Yersinia pestis
aaauuuaucucuau

SEQ ID NO: 2276784 - RNA, 22 nt, Yersinia pestis
aaauuucugguuugaauccagu

SEQ ID NO: 2276785 - RNA, 13 nt, Yersinia pestis
aaauuucucuuuu

SEQ ID NO: 2276786 - RNA, 12 nt, Yersinia pestis
aaauuucccccu

SEQ ID NO: 2276787 - RNA, 16 nt, Yersinia pestis
aacaagcgaccaucau

SEQ ID NO: 2276788 - RNA, 21 nt, Yersinia pestis
aacaagaucccaagcaggaaa

SEQ ID NO: 2276789 - RNA, 18 nt, Yersinia pestis
aacaagauuacaucagug

SEQ ID NO: 2276790 - RNA, 23 nt, Yersinia pestis
aacaagacuuuccccagaugaau

SEQ ID NO: 2276791 - RNA, 17 nt, Yersinia pestis
aacaaguugaaccauaa

SEQ ID NO: 2276792 - RNA, 18 nt, Yersinia pestis
aacaaguuacauuuuuaa

SEQ ID NO: 2276793 - RNA, 21 nt, Yersinia pestis
aacaauaaaaagaucugcauu

SEQ ID NO: 2276794 - RNA, 14 nt, Yersinia pestis
aacaaguugcuuaa

SEQ ID NO: 2276795 - RNA, 16 nt, Yersinia pestis
aacaaguuucacuuuc

SEQ ID NO: 2276796 - RNA, 23 nt, Yersinia pestis
aacaaggaaaucgaaauuaagga

SEQ ID NO: 2276797 - RNA, 15 nt, Yersinia pestis
aacaagaacaccaga

SEQ ID NO: 2276798 - RNA, 18 nt, Yersinia pestis
aacaacucgaauuauuuu

SEQ ID NO: 2276799 - RNA, 15 nt, Yersinia pestis
aacaacggugaacag

SEQ ID NO: 2276800 - RNA, 15 nt, Yersinia pestis
aacaaccaagcuuug

SEQ ID NO: 2276801 - RNA, 17 nt, Yersinia pestis
aacaacccgaauuaaua

SEQ ID NO: 2276802 - RNA, 23 nt, Yersinia pestis
aacaaccauuguggcuaaaccca

SEQ ID NO: 2276803 - RNA, 22 nt, Yersinia pestis
aacaaccguggcgucgcccguu

SEQ ID NO: 2276804 - RNA, 22 nt, Yersinia pestis
aacaaaucuuaaauugaagagu

SEQ ID NO: 2276805 - RNA, 23 nt, Yersinia pestis
aacaaaucuuaaauugaagaguu

SEQ ID NO: 2276806 - RNA, 15 nt, Yersinia pestis
aacaaaugaacccuu

SEQ ID NO: 2276807 - RNA, 20 nt, Yersinia pestis
aacaaaugggccacaggcug

SEQ ID NO: 2276808 - RNA, 21 nt, Yersinia pestis
aacaaaugggccacaggcugc

SEQ ID NO: 2276809 - RNA, 18 nt, Yersinia pestis
aacaaaugggucgggaau

SEQ ID NO: 2276810 - RNA, 13 nt, Yersinia pestis
aacaacacaauua

SEQ ID NO: 2276811 - RNA, 12 nt, Yersinia pestis
aacaacaacaca

SEQ ID NO: 2276812 - RNA, 18 nt, Yersinia pestis
aacaacaaaggcgccaag

SEQ ID NO: 2276813 - RNA, 22 nt, Yersinia pestis
aacaaacuacuugguuuaaauu

SEQ ID NO: 2276814 - RNA, 22 nt, Yersinia pestis
aacaaaccuaaaccuuucagac

SEQ ID NO: 2276815 - RNA, 12 nt, Yersinia pestis
aacaaacagccg

SEQ ID NO: 2276816 - RNA, 16 nt, Yersinia pestis
aacaaaaaguuaaaua

SEQ ID NO: 2276817 - RNA, 23 nt, Yersinia pestis
aacaaugaccaucuuccagcauc

SEQ ID NO: 2276818 - RNA, 16 nt, Yersinia pestis
aacaaugcuuuuugga

SEQ ID NO: 2276819 - RNA, 14 nt, Yersinia pestis
aacaauccgaacaa

SEQ ID NO: 2276820 - RNA, 17 nt, Yersinia pestis
aacaauccuauauacaa

SEQ ID NO: 2276821 - RNA, 15 nt, Yersinia pestis
aacaauaccgccaau

SEQ ID NO: 2276822 - RNA, 15 nt, Yersinia pestis
aacaauaaucucagc

SEQ ID NO: 2276823 - RNA, 14 nt, Yersinia pestis
aacaaucaccaccu

SEQ ID NO: 2276824 - RNA, 21 nt, Yersinia pestis
aacaauauucauuuugcugga

SEQ ID NO: 2276825 - RNA, 17 nt, Yersinia pestis
aacaauguuauauuucu

SEQ ID NO: 2276826 - RNA, 19 nt, Yersinia pestis
aacaauuuacgguccauaa

SEQ ID NO: 2276827 - RNA, 12 nt, Yersinia pestis
aacaauuucgaa

SEQ ID NO: 2276828 - RNA, 12 nt, Yersinia pestis
aacacaauugau

SEQ ID NO: 2276829 - RNA, 22 nt, Yersinia pestis
aacacaccugcaacguuaaaga

SEQ ID NO: 2276830 - RNA, 23 nt, Yersinia pestis
aacacacuuagcuaagcucuucc

SEQ ID NO: 2276831 - RNA, 18 nt, Yersinia pestis
aacaauuuuauuguuuuc

SEQ ID NO: 2276832 - RNA, 19 nt, Yersinia pestis
aacacccaacucaacggca

SEQ ID NO: 2276833 - RNA, 11 nt, Yersinia pestis
aacaccaucaa

SEQ ID NO: 2276834 - RNA, 16 nt, Yersinia pestis
aacaccggcuucuccu

SEQ ID NO: 2276835 - RNA, 20 nt, Yersinia pestis
aacaccuaacuuccuaacaa

SEQ ID NO: 2276836 - RNA, 19 nt, Yersinia pestis
aacaccuaguuauucugua

SEQ ID NO: 2276837 - RNA, 15 nt, Yersinia pestis
aacaccuucagacug

SEQ ID NO: 2276838 - RNA, 17 nt, Yersinia pestis
aacaccuuuaccuuuac

SEQ ID NO: 2276839 - RNA, 13 nt, Yersinia pestis
aacacgaaaagca

SEQ ID NO: 2276840 - RNA, 21 nt, Yersinia pestis
aacacauuccaguaaaaaaau

SEQ ID NO: 2276841 - RNA, 14 nt, Yersinia pestis
aacaccauacuuuu

SEQ ID NO: 2276842 - RNA, 21 nt, Yersinia pestis
aacacacuucgccaggucagg

SEQ ID NO: 2276843 - RNA, 21 nt, Yersinia pestis
aacacacuucgccgggucagg

SEQ ID NO: 2276844 - RNA, 13 nt, Yersinia pestis
aacacagcucccc

SEQ ID NO: 2276845 - RNA, 21 nt, Yersinia pestis
aacacagguucuccaggguuu

SEQ ID NO: 2276846 - RNA, 13 nt, Yersinia pestis
aacacauaaaauc

SEQ ID NO: 2276847 - RNA, 18 nt, Yersinia pestis
aacacgguuugaucaaca

SEQ ID NO: 2276848 - RNA, 18 nt, Yersinia pestis
aacacgguugaaaaguuu

SEQ ID NO: 2276849 - RNA, 15 nt, Yersinia pestis
aacacggugaauaaa

SEQ ID NO: 2276850 - RNA, 20 nt, Yersinia pestis
aacacggugaauaaacccuu

SEQ ID NO: 2276851 - RNA, 14 nt, Yersinia pestis
aacacgaaaagcag

SEQ ID NO: 2276852 - RNA, 19 nt, Yersinia pestis
aacacgacuuuuggccccc

SEQ ID NO: 2276853 - RNA, 15 nt, Yersinia pestis
aacacgauauaccuc

SEQ ID NO: 2276854 - RNA, 19 nt, Yersinia pestis
aacacgauccgcuuuuuag

SEQ ID NO: 2276855 - RNA, 21 nt, Yersinia pestis
aacacguucggcgucgccacc

SEQ ID NO: 2276856 - RNA, 22 nt, Yersinia pestis
aacacguggguauccaguguca

SEQ ID NO: 2276857 - RNA, 17 nt, Yersinia pestis
aacacuuagccagcaug

SEQ ID NO: 2276858 - RNA, 16 nt, Yersinia pestis
aacacuuauuaaccua

SEQ ID NO: 2276859 - RNA, 15 nt, Yersinia pestis
aacacuucagacuga

SEQ ID NO: 2276860 - RNA, 19 nt, Yersinia pestis
aacacucuuuuuaauuuau

SEQ ID NO: 2276861 - RNA, 20 nt, Yersinia pestis
aacagauagauaaauguuca

SEQ ID NO: 2276862 - RNA, 19 nt, Yersinia pestis
aacagauaugcauuauuga

SEQ ID NO: 2276863 - RNA, 17 nt, Yersinia pestis
aacagaugaugauuuuu

SEQ ID NO: 2276864 - RNA, 19 nt, Yersinia pestis
aacagaucacccgcaaaac

SEQ ID NO: 2276865 - RNA, 20 nt, Yersinia pestis
aacagauauugcgcaguaaa

SEQ ID NO: 2276866 - RNA, 21 nt, Yersinia pestis
aacagauauugcgcaguaaau

SEQ ID NO: 2276867 - RNA, 18 nt, Yersinia pestis
aacagagcgcgagugaac

SEQ ID NO: 2276868 - RNA, 18 nt, Yersinia pestis
aacagauaacucagggcg

SEQ ID NO: 2276869 - RNA, 23 nt, Yersinia pestis
aacagagccuuauaggcgcauau

SEQ ID NO: 2276870 - RNA, 20 nt, Yersinia pestis
aacagaacccccgcgaacag

SEQ ID NO: 2276871 - RNA, 21 nt, Yersinia pestis
aacacuuuaucgaccacuuuu

SEQ ID NO: 2276872 - RNA, 16 nt, Yersinia pestis
aacacuuuauugagaa

SEQ ID NO: 2276873 - RNA, 16 nt, Yersinia pestis
aacagacacagcaaca

SEQ ID NO: 2276874 - RNA, 15 nt, Yersinia pestis
aacagacucacucuc

SEQ ID NO: 2276875 - RNA, 22 nt, Yersinia pestis
aacagaauguuggugaucagca

SEQ ID NO: 2276876 - RNA, 20 nt, Yersinia pestis
aacagcugacuaaaucgcuu

SEQ ID NO: 2276877 - RNA, 21 nt, Yersinia pestis
aacagcuugauagggcugaag

SEQ ID NO: 2276878 - RNA, 15 nt, Yersinia pestis
aacagcguugaccaa

SEQ ID NO: 2276879 - RNA, 17 nt, Yersinia pestis
aacagcguaauaccacu

SEQ ID NO: 2276880 - RNA, 23 nt, Yersinia pestis
aacagccuaaggccaucaauaaa

SEQ ID NO: 2276881 - RNA, 20 nt, Yersinia pestis
aacagcggcgauuaucggcu

SEQ ID NO: 2276882 - RNA, 16 nt, Yersinia pestis
aacagcauuuaugcug

SEQ ID NO: 2276883 - RNA, 17 nt, Yersinia pestis
aacagccagcaucacga

SEQ ID NO: 2276884 - RNA, 15 nt, Yersinia pestis
aacagcccagauggc

SEQ ID NO: 2276885 - RNA, 17 nt, Yersinia pestis
aacagccccaaccaucu

SEQ ID NO: 2276886 - RNA, 21 nt, Yersinia pestis
aacagcaggauuaagcggagg

SEQ ID NO: 2276887 - RNA, 17 nt, Yersinia pestis
aacauaaguaauaagua

SEQ ID NO: 2276888 - RNA, 16 nt, Yersinia pestis
aacauaacuuugccag

SEQ ID NO: 2276889 - RNA, 18 nt, Yersinia pestis
aacauaaaaaugcacuga

SEQ ID NO: 2276890 - RNA, 16 nt, Yersinia pestis
aacaguuacuccuaca

SEQ ID NO: 2276891 - RNA, 14 nt, Yersinia pestis
aacaguagcagggc

SEQ ID NO: 2276892 - RNA, 21 nt, Yersinia pestis
aacaguagcagggccgcccag

SEQ ID NO: 2276893 - RNA, 22 nt, Yersinia pestis
aacaguagcagggccgcccaga

SEQ ID NO: 2276894 - RNA, 15 nt, Yersinia pestis
aacagucacaccaac

SEQ ID NO: 2276895 - RNA, 17 nt, Yersinia pestis
aacagucacaccaacac

SEQ ID NO: 2276896 - RNA, 20 nt, Yersinia pestis
aacagugcauucaucaugcu

SEQ ID NO: 2276897 - RNA, 18 nt, Yersinia pestis
aacagugcaacauuaaaa

SEQ ID NO: 2276898 - RNA, 21 nt, Yersinia pestis
aacagugcaacauuaaaaaua

SEQ ID NO: 2276899 - RNA, 22 nt, Yersinia pestis
aacaguaacccagccccuaaca

SEQ ID NO: 2276900 - RNA, 14 nt, Yersinia pestis
aacaguaaauuauu

SEQ ID NO: 2276901 - RNA, 16 nt, Yersinia pestis
aacaguaaauuauuuu

SEQ ID NO: 2276902 - RNA, 22 nt, Yersinia pestis
aacagggcagccaauuacgcug

SEQ ID NO: 2276903 - RNA, 14 nt, Yersinia pestis
aacagggcagaaaa

SEQ ID NO: 2276904 - RNA, 15 nt, Yersinia pestis
aacagggcagccaau

SEQ ID NO: 2276905 - RNA, 17 nt, Yersinia pestis
aacauauugguaauuuc

SEQ ID NO: 2276906 - RNA, 21 nt, Yersinia pestis
aacauauugcucugccgcagu

SEQ ID NO: 2276907 - RNA, 21 nt, Yersinia pestis
aacaucacauccgaucagcca

SEQ ID NO: 2276908 - RNA, 13 nt, Yersinia pestis
aacaucacacuug

SEQ ID NO: 2276909 - RNA, 17 nt, Yersinia pestis
aacauccagaccuucac

SEQ ID NO: 2276910 - RNA, 14 nt, Yersinia pestis
aacauccauguaag

SEQ ID NO: 2276911 - RNA, 14 nt, Yersinia pestis
aacaucauccccaa

SEQ ID NO: 2276912 - RNA, 21 nt, Yersinia pestis
aacaucaggccuucuuuucuc

SEQ ID NO: 2276913 - RNA, 18 nt, Yersinia pestis
aacauacggacgcucuau

SEQ ID NO: 2276914 - RNA, 17 nt, Yersinia pestis
aacauaauuaaauauua

SEQ ID NO: 2276915 - RNA, 17 nt, Yersinia pestis
aacauacaaccacugaa

SEQ ID NO: 2276916 - RNA, 12 nt, Yersinia pestis
aacauacaccau

SEQ ID NO: 2276917 - RNA, 14 nt, Yersinia pestis
aacauaaucaaucc

SEQ ID NO: 2276918 - RNA, 23 nt, Yersinia pestis
aacauaauccgcuccugauuuaa

SEQ ID NO: 2276919 - RNA, 12 nt, Yersinia pestis
aacauaucaaua

SEQ ID NO: 2276920 - RNA, 12 nt, Yersinia pestis
aacauaucguuu

SEQ ID NO: 2276921 - RNA, 13 nt, Yersinia pestis
aaccaaucaagca

SEQ ID NO: 2276922 - RNA, 14 nt, Yersinia pestis
aaccaagacauaau

SEQ ID NO: 2276923 - RNA, 19 nt, Yersinia pestis
aaccaacgggcacaaucca

SEQ ID NO: 2276924 - RNA, 14 nt, Yersinia pestis
aaccaacaugagcc

SEQ ID NO: 2276925 - RNA, 14 nt, Yersinia pestis
aaccaacaaacaau

SEQ ID NO: 2276926 - RNA, 16 nt, Yersinia pestis
aaccaaauuacuuuaa

SEQ ID NO: 2276927 - RNA, 18 nt, Yersinia pestis
aaccaaauuacuuuaaag

SEQ ID NO: 2276928 - RNA, 14 nt, Yersinia pestis
aacauucaucuuuu

SEQ ID NO: 2276929 - RNA, 16 nt, Yersinia pestis
aacauuauuuuucacc

SEQ ID NO: 2276930 - RNA, 17 nt, Yersinia pestis
aacauucaaggucgcca

SEQ ID NO: 2276931 - RNA, 16 nt, Yersinia pestis
aacauugccaaauuau

SEQ ID NO: 2276932 - RNA, 21 nt, Yersinia pestis
aacauuuaucuaucuguucac

SEQ ID NO: 2276933 - RNA, 21 nt, Yersinia pestis
aacauuucauuccagauaaaa

SEQ ID NO: 2276934 - RNA, 23 nt, Yersinia pestis
aacauuuucaucugaccaaacau

SEQ ID NO: 2276935 - RNA, 13 nt, Yersinia pestis
aaccaaaaacucc

SEQ ID NO: 2276936 - RNA, 19 nt, Yersinia pestis
aacaugagccacacauuca

SEQ ID NO: 2276937 - RNA, 22 nt, Yersinia pestis
aacaugagccacacauucaguc

SEQ ID NO: 2276938 - RNA, 18 nt, Yersinia pestis
aacaucguuaauccauuu

SEQ ID NO: 2276939 - RNA, 16 nt, Yersinia pestis
aacauccggcugaugu

SEQ ID NO: 2276940 - RNA, 16 nt, Yersinia pestis
aacaucgacaccaaga

SEQ ID NO: 2276941 - RNA, 12 nt, Yersinia pestis
aacauguagcac

SEQ ID NO: 2276942 - RNA, 13 nt, Yersinia pestis
aacauuaaaaaua

SEQ ID NO: 2276943 - RNA, 23 nt, Yersinia pestis
aacauuaccaccgucaagacaac

SEQ ID NO: 2276944 - RNA, 22 nt, Yersinia pestis
aacauuagggccaccagacuga

SEQ ID NO: 2276945 - RNA, 19 nt, Yersinia pestis
aacaugguccacagucagu

SEQ ID NO: 2276946 - RNA, 15 nt, Yersinia pestis
aacauggauccugca

SEQ ID NO: 2276947 - RNA, 13 nt, Yersinia pestis
aacaugcugaagc

SEQ ID NO: 2276948 - RNA, 12 nt, Yersinia pestis
aacccugacggc

SEQ ID NO: 2276949 - RNA, 15 nt, Yersinia pestis
aacccuaccuaggcc

SEQ ID NO: 2276950 - RNA, 20 nt, Yersinia pestis
aacccuuuuugaaucaagca

SEQ ID NO: 2276951 - RNA, 14 nt, Yersinia pestis
aaccgaaaugaucu

SEQ ID NO: 2276952 - RNA, 16 nt, Yersinia pestis
aaccgaagcugcggcu

SEQ ID NO: 2276953 - RNA, 14 nt, Yersinia pestis
aaccgaacgcucua

SEQ ID NO: 2276954 - RNA, 14 nt, Yersinia pestis
aaccgaagauaacc

SEQ ID NO: 2276955 - RNA, 21 nt, Yersinia pestis
aaccgaguucagaucgcauuu

SEQ ID NO: 2276956 - RNA, 21 nt, Yersinia pestis
aaccgaugaagaagcguucaa

SEQ ID NO: 2276957 - RNA, 15 nt, Yersinia pestis
aaccgaugagugaaa

SEQ ID NO: 2276958 - RNA, 16 nt, Yersinia pestis
aaccgagccugcuuua

SEQ ID NO: 2276959 - RNA, 15 nt, Yersinia pestis
aacccggcaucaacc

SEQ ID NO: 2276960 - RNA, 22 nt, Yersinia pestis
aacccguauuaguccguagaaa

SEQ ID NO: 2276961 - RNA, 15 nt, Yersinia pestis
aaccccgaugacuca

SEQ ID NO: 2276962 - RNA, 22 nt, Yersinia pestis
aaccccguagcacacacagccu

SEQ ID NO: 2276963 - RNA, 14 nt, Yersinia pestis
aaccccgugccagg

SEQ ID NO: 2276964 - RNA, 13 nt, Yersinia pestis
aaccccuagccag

SEQ ID NO: 2276965 - RNA, 22 nt, Yersinia pestis
aaccccuagccagccaccgcac

SEQ ID NO: 2276966 - RNA, 15 nt, Yersinia pestis
aacccgaauuaauaa

SEQ ID NO: 2276967 - RNA, 23 nt, Yersinia pestis
aacccauuaaaaacaaaugauua

SEQ ID NO: 2276968 - RNA, 23 nt, Yersinia pestis
aacccauuuccccuuucuggugg

SEQ ID NO: 2276969 - RNA, 24 nt, Yersinia pestis
aaccccacccugugaaauaccgau

SEQ ID NO: 2276970 - RNA, 15 nt, Yersinia pestis
aaccccaacugaaug

SEQ ID NO: 2276971 - RNA, 13 nt, Yersinia pestis
aaccccauauugc

SEQ ID NO: 2276972 - RNA, 17 nt, Yersinia pestis
aaccgcuuuuuacccag

SEQ ID NO: 2276973 - RNA, 13 nt, Yersinia pestis
aaccggaauaaau

SEQ ID NO: 2276974 - RNA, 13 nt, Yersinia pestis
aaccggcgcaaau

SEQ ID NO: 2276975 - RNA, 17 nt, Yersinia pestis
aaccguagugagucagg

SEQ ID NO: 2276976 - RNA, 12 nt, Yersinia pestis
aaccguaaagua

SEQ ID NO: 2276977 - RNA, 19 nt, Yersinia pestis
aaccggggcgauacaccaa

SEQ ID NO: 2276978 - RNA, 23 nt, Yersinia pestis
aaccgcugaaguggcugaauauc

SEQ ID NO: 2276979 - RNA, 14 nt, Yersinia pestis
aaccgauuucagca

SEQ ID NO: 2276980 - RNA, 15 nt, Yersinia pestis
aaccgcagcaggcag

SEQ ID NO: 2276981 - RNA, 17 nt, Yersinia pestis
aaccgccauugcauauu

SEQ ID NO: 2276982 - RNA, 15 nt, Yersinia pestis
aaccgccccccaucc

SEQ ID NO: 2276983 - RNA, 17 nt, Yersinia pestis
aaccgccccccaucccc

SEQ ID NO: 2276984 - RNA, 14 nt, Yersinia pestis
aaccagcguugaga

SEQ ID NO: 2276985 - RNA, 18 nt, Yersinia pestis
aaccagcguccugugcaa

SEQ ID NO: 2276986 - RNA, 14 nt, Yersinia pestis
aaccagcaagccgu

SEQ ID NO: 2276987 - RNA, 21 nt, Yersinia pestis
aaccagauaacaacaaagaua

SEQ ID NO: 2276988 - RNA, 20 nt, Yersinia pestis
aaccagacguuaugaauaaa

SEQ ID NO: 2276989 - RNA, 22 nt, Yersinia pestis
aaccagacguuaugaauaaacc

SEQ ID NO: 2276990 - RNA, 18 nt, Yersinia pestis
aaccagagaaagguuuac

SEQ ID NO: 2276991 - RNA, 20 nt, Yersinia pestis
aaccagagcggagccucagu

SEQ ID NO: 2276992 - RNA, 19 nt, Yersinia pestis
aaccagauaacaacaaaga

SEQ ID NO: 2276993 - RNA, 15 nt, Yersinia pestis
aaccaccuuaaguaa

SEQ ID NO: 2276994 - RNA, 18 nt, Yersinia pestis
aaccaccugaccuagcaa

SEQ ID NO: 2276995 - RNA, 20 nt, Yersinia pestis
aaccacgcauuccaucagcc

SEQ ID NO: 2276996 - RNA, 21 nt, Yersinia pestis
aaccacugaccuauugauaaa

SEQ ID NO: 2276997 - RNA, 19 nt, Yersinia pestis
aaccacugcggucaaagaa

SEQ ID NO: 2276998 - RNA, 18 nt, Yersinia pestis
aaccaccggguuuaguau

SEQ ID NO: 2276999 - RNA, 16 nt, Yersinia pestis
aaccaccgucaccaaa

SEQ ID NO: 2277000 - RNA, 14 nt, Yersinia pestis
aaccaccaaaauag

SEQ ID NO: 2277001 - RNA, 17 nt, Yersinia pestis
aaccacauaacgcacug

SEQ ID NO: 2277002 - RNA, 14 nt, Yersinia pestis
aaccaucaaauaca

SEQ ID NO: 2277003 - RNA, 15 nt, Yersinia pestis
aaccaucaaauacac

SEQ ID NO: 2277004 - RNA, 22 nt, Yersinia pestis
aaccaucaaggacuucaucacc

SEQ ID NO: 2277005 - RNA, 11 nt, Yersinia pestis
aaccaucagcg

SEQ ID NO: 2277006 - RNA, 22 nt, Yersinia pestis
aaccaucagcgauagcugcuuu

SEQ ID NO: 2277007 - RNA, 14 nt, Yersinia pestis
aaccaugagaauac

SEQ ID NO: 2277008 - RNA, 15 nt, Yersinia pestis
aaccaugaugacaau

SEQ ID NO: 2277009 - RNA, 19 nt, Yersinia pestis
aaccauaaaauaaauaauu

SEQ ID NO: 2277010 - RNA, 17 nt, Yersinia pestis
aaccaggugcagauaaa

SEQ ID NO: 2277011 - RNA, 17 nt, Yersinia pestis
aaccaggucaguuuuac

SEQ ID NO: 2277012 - RNA, 16 nt, Yersinia pestis
aaccaguuagaaucca

SEQ ID NO: 2277013 - RNA, 18 nt, Yersinia pestis
aaccauuuucaauugccc

SEQ ID NO: 2277014 - RNA, 20 nt, Yersinia pestis
aaccauuuuacuaaaccagu

SEQ ID NO: 2277015 - RNA, 13 nt, Yersinia pestis
aaccauuuauaua

SEQ ID NO: 2277016 - RNA, 21 nt, Yersinia pestis
aaccauggcucaccauaaauu

SEQ ID NO: 2277017 - RNA, 20 nt, Yersinia pestis
aacccacaucccggcagcag

SEQ ID NO: 2277018 - RNA, 15 nt, Yersinia pestis
aacccaaagcccuua

SEQ ID NO: 2277019 - RNA, 16 nt, Yersinia pestis
aacccauugguuuuua

SEQ ID NO: 2277020 - RNA, 21 nt, Yersinia pestis
aacccagccccuaacagcagu

SEQ ID NO: 2277021 - RNA, 14 nt, Yersinia pestis
accguaacuucuuc

SEQ ID NO: 2277022 - RNA, 17 nt, Yersinia pestis
accgguuuacccugcgc

SEQ ID NO: 2277023 - RNA, 20 nt, Yersinia pestis
accgguuuacccugcgccug

SEQ ID NO: 2277024 - RNA, 23 nt, Yersinia pestis
accgguacggcccaaugucccca

SEQ ID NO: 2277025 - RNA, 15 nt, Yersinia pestis
accgguuaaacuucu

SEQ ID NO: 2277026 - RNA, 17 nt, Yersinia pestis
accgguuaaacuucuuu

SEQ ID NO: 2277027 - RNA, 22 nt, Yersinia pestis
accggugauuacugucauuucc

SEQ ID NO: 2277028 - RNA, 18 nt, Yersinia pestis
accggggaagagauaaau

SEQ ID NO: 2277029 - RNA, 16 nt, Yersinia pestis
accgggcuugauuaaa

SEQ ID NO: 2277030 - RNA, 19 nt, Yersinia pestis
accgggguucgcaaugaac

SEQ ID NO: 2277031 - RNA, 21 nt, Yersinia pestis
accgguaacauauaaaccagc

SEQ ID NO: 2277032 - RNA, 15 nt, Yersinia pestis
accgcuuacugaugu

SEQ ID NO: 2277033 - RNA, 17 nt, Yersinia pestis
accggcauucuucgccg

SEQ ID NO: 2277034 - RNA, 22 nt, Yersinia pestis
accggcgaagggcgcagccccc

SEQ ID NO: 2277035 - RNA, 21 nt, Yersinia pestis
accggcuaacgaggcauaauc

SEQ ID NO: 2277036 - RNA, 15 nt, Yersinia pestis
accggcuaaccacag

SEQ ID NO: 2277037 - RNA, 18 nt, Yersinia pestis
accggcuggcauuuuuau

SEQ ID NO: 2277038 - RNA, 15 nt, Yersinia pestis
accggcguaaauaaa

SEQ ID NO: 2277039 - RNA, 16 nt, Yersinia pestis
accgccuucugguggu

SEQ ID NO: 2277040 - RNA, 21 nt, Yersinia pestis
accgcccccaauaagggccac

SEQ ID NO: 2277041 - RNA, 16 nt, Yersinia pestis
accgccccccaucccc

SEQ ID NO: 2277042 - RNA, 17 nt, Yersinia pestis
accgccccccaucccca

SEQ ID NO: 2277043 - RNA, 23 nt, Yersinia pestis
accgccaucuugucgucacccau

SEQ ID NO: 2277044 - RNA, 12 nt, Yersinia pestis
accgcugucauu

SEQ ID NO: 2277045 - RNA, 16 nt, Yersinia pestis
accgcugauaaccagc

SEQ ID NO: 2277046 - RNA, 23 nt, Yersinia pestis
accgcugaaguggcugaauauca

SEQ ID NO: 2277047 - RNA, 19 nt, Yersinia pestis
accgcugauaaccagcagc

SEQ ID NO: 2277048 - RNA, 21 nt, Yersinia pestis
accgcgcuuuugauuuucuua

SEQ ID NO: 2277049 - RNA, 13 nt, Yersinia pestis
accgcucuucaca

SEQ ID NO: 2277050 - RNA, 15 nt, Yersinia pestis
accgcucuucacauu

SEQ ID NO: 2277051 - RNA, 16 nt, Yersinia pestis
accgcgcuuuugauuu

SEQ ID NO: 2277052 - RNA, 17 nt, Yersinia pestis
accgccaauauaaggcu

SEQ ID NO: 2277053 - RNA, 17 nt, Yersinia pestis
accgccaaauacaaacc

SEQ ID NO: 2277054 - RNA, 15 nt, Yersinia pestis
accgccacacaauac

SEQ ID NO: 2277055 - RNA, 16 nt, Yersinia pestis
accgccacacaauaca

SEQ ID NO: 2277056 - RNA, 14 nt, Yersinia pestis
accgccagucugaa

SEQ ID NO: 2277057 - RNA, 14 nt, Yersinia pestis
accgccagugccac

SEQ ID NO: 2277058 - RNA, 13 nt, Yersinia pestis
accgccagugccg

SEQ ID NO: 2277059 - RNA, 16 nt, Yersinia pestis
accccugcgauaaucu

SEQ ID NO: 2277060 - RNA, 23 nt, Yersinia pestis
accgaugauaagugaauaaauca

SEQ ID NO: 2277061 - RNA, 15 nt, Yersinia pestis
accccguugcucuac

SEQ ID NO: 2277062 - RNA, 15 nt, Yersinia pestis
accccuagccagcca

SEQ ID NO: 2277063 - RNA, 14 nt, Yersinia pestis
accccguggcggcg

SEQ ID NO: 2277064 - RNA, 21 nt, Yersinia pestis
accccuaauccagcagccucu

SEQ ID NO: 2277065 - RNA, 16 nt, Yersinia pestis
accccuauuagggaac

SEQ ID NO: 2277066 - RNA, 16 nt, Yersinia pestis
accuaauacagcacca

SEQ ID NO: 2277067 - RNA, 14 nt, Yersinia pestis
accuaauccaaggc

SEQ ID NO: 2277068 - RNA, 18 nt, Yersinia pestis
accuacaaccuaccaccu

SEQ ID NO: 2277069 - RNA, 13 nt, Yersinia pestis
accuaccaccuac

SEQ ID NO: 2277070 - RNA, 14 nt, Yersinia pestis
accuaccaccuaca

SEQ ID NO: 2277071 - RNA, 19 nt, Yersinia pestis
accuaccaccuacaaccua

SEQ ID NO: 2277072 - RNA, 19 nt, Yersinia pestis
accuaccaccuaccaccua

SEQ ID NO: 2277073 - RNA, 13 nt, Yersinia pestis
accuaccggauaa

SEQ ID NO: 2277074 - RNA, 14 nt, Yersinia pestis
accuacugacauuu

SEQ ID NO: 2277075 - RNA, 19 nt, Yersinia pestis
accuauaauuaacagcauc

SEQ ID NO: 2277076 - RNA, 23 nt, Yersinia pestis
accuauaaacuugauucaccaga

SEQ ID NO: 2277077 - RNA, 18 nt, Yersinia pestis
accuaucgccgccgccag

SEQ ID NO: 2277078 - RNA, 14 nt, Yersinia pestis
accuaacaugcuga

SEQ ID NO: 2277079 - RNA, 15 nt, Yersinia pestis
accuaaccaaacauu

SEQ ID NO: 2277080 - RNA, 16 nt, Yersinia pestis
accuaaccaaacauug

SEQ ID NO: 2277081 - RNA, 14 nt, Yersinia pestis
accuaaaaaaaaca

SEQ ID NO: 2277082 - RNA, 18 nt, Yersinia pestis
accuaaaacauaccaucc

SEQ ID NO: 2277083 - RNA, 15 nt, Yersinia pestis
accuaaaaugacgau

SEQ ID NO: 2277084 - RNA, 17 nt, Yersinia pestis
accguuguauguggcug

SEQ ID NO: 2277085 - RNA, 20 nt, Yersinia pestis
accguuucagaucgcgucau

SEQ ID NO: 2277086 - RNA, 20 nt, Yersinia pestis
accguaucaucaccaaacag

SEQ ID NO: 2277087 - RNA, 22 nt, Yersinia pestis
accgucaagacaacaaacagua

SEQ ID NO: 2277088 - RNA, 17 nt, Yersinia pestis
accgucaagacaacaaa

SEQ ID NO: 2277089 - RNA, 18 nt, Yersinia pestis
accguaugcuuucaucuu

SEQ ID NO: 2277090 - RNA, 18 nt, Yersinia pestis
accgugacuaaaacaagc

SEQ ID NO: 2277091 - RNA, 19 nt, Yersinia pestis
accgugauguucaauucac

SEQ ID NO: 2277092 - RNA, 21 nt, Yersinia pestis
accgugcuggguaauucauua

SEQ ID NO: 2277093 - RNA, 16 nt, Yersinia pestis
accguggauaaacaaa

SEQ ID NO: 2277094 - RNA, 13 nt, Yersinia pestis
accgugugauaaa

SEQ ID NO: 2277095 - RNA, 14 nt, Yersinia pestis
accuauuuuauccc

SEQ ID NO: 2277096 - RNA, 18 nt, Yersinia pestis
accuauugauaaaaccac

SEQ ID NO: 2277097 - RNA, 22 nt, Yersinia pestis
accuaucgguaucucccgcaaa

SEQ ID NO: 2277098 - RNA, 14 nt, Yersinia pestis
accucaaaaggaug

SEQ ID NO: 2277099 - RNA, 20 nt, Yersinia pestis
accuauugauaaaaccgcuu

SEQ ID NO: 2277100 - RNA, 23 nt, Yersinia pestis
accucauuggcgguuauuauuua

SEQ ID NO: 2277101 - RNA, 21 nt, Yersinia pestis
accucauuggucgcugggccu

SEQ ID NO: 2277102 - RNA, 14 nt, Yersinia pestis
accucaucacccgc

SEQ ID NO: 2277103 - RNA, 15 nt, Yersinia pestis
accucagucaucgcc

SEQ ID NO: 2277104 - RNA, 13 nt, Yersinia pestis
accucacgggcuu

SEQ ID NO: 2277105 - RNA, 16 nt, Yersinia pestis
accucagccucauuca

SEQ ID NO: 2277106 - RNA, 18 nt, Yersinia pestis
accuccggcuaugccgga

SEQ ID NO: 2277107 - RNA, 15 nt, Yersinia pestis
accuccauauccugg

SEQ ID NO: 2277108 - RNA, 15 nt, Yersinia pestis
accuccacaggaggu

SEQ ID NO: 2277109 - RNA, 22 nt, Yersinia pestis
accuccggcuaugccggaggau

SEQ ID NO: 2277110 - RNA, 20 nt, Yersinia pestis
accuccggggccugcggcca

SEQ ID NO: 2277111 - RNA, 15 nt, Yersinia pestis
accugaguaauauua

SEQ ID NO: 2277112 - RNA, 14 nt, Yersinia pestis
accugauaggccaa

SEQ ID NO: 2277113 - RNA, 19 nt, Yersinia pestis
accugauaggccaaaaaug

SEQ ID NO: 2277114 - RNA, 22 nt, Yersinia pestis
accugauaggccaaaaaugcga

SEQ ID NO: 2277115 - RNA, 20 nt, Yersinia pestis
accugacuguggcugcucug

SEQ ID NO: 2277116 - RNA, 20 nt, Yersinia pestis
accugacgaaaugccgccug

SEQ ID NO: 2277117 - RNA, 19 nt, Yersinia pestis
accugaggauaaaaacuac

SEQ ID NO: 2277118 - RNA, 17 nt, Yersinia pestis
accugauccaguuucag

SEQ ID NO: 2277119 - RNA, 22 nt, Yersinia pestis
accugauccaguuucaguggcu

SEQ ID NO: 2277120 - RNA, 16 nt, Yersinia pestis
accugacgaaaugccg

SEQ ID NO: 2277121 - RNA, 21 nt, Yersinia pestis
accugaaugcgccgcggcccu

SEQ ID NO: 2277122 - RNA, 19 nt, Yersinia pestis
accugaaucaacucauuua

SEQ ID NO: 2277123 - RNA, 20 nt, Yersinia pestis
accugaaucaacucauuuau

SEQ ID NO: 2277124 - RNA, 13 nt, Yersinia pestis
accugaaccugac

SEQ ID NO: 2277125 - RNA, 14 nt, Yersinia pestis
accucugcugaugu

SEQ ID NO: 2277126 - RNA, 19 nt, Yersinia pestis
accucuucuuccgccaccg

SEQ ID NO: 2277127 - RNA, 17 nt, Yersinia pestis
accucuuguaaaccagc

SEQ ID NO: 2277128 - RNA, 18 nt, Yersinia pestis
accucggaaggccagagu

SEQ ID NO: 2277129 - RNA, 16 nt, Yersinia pestis
accucgggcgcuuaaa

SEQ ID NO: 2277130 - RNA, 20 nt, Yersinia pestis
accucgggcgcuuaaauaaa

SEQ ID NO: 2277131 - RNA, 19 nt, Yersinia pestis
accuuaucaccaacguuua

SEQ ID NO: 2277132 - RNA, 11 nt, Yersinia pestis
accuuaucacu

SEQ ID NO: 2277133 - RNA, 22 nt, Yersinia pestis
accuucaaucauugagaucagu

SEQ ID NO: 2277134 - RNA, 13 nt, Yersinia pestis
accuucaaucauu

SEQ ID NO: 2277135 - RNA, 15 nt, Yersinia pestis
accuucaaucauuga

SEQ ID NO: 2277136 - RNA, 16 nt, Yersinia pestis
accuuacgucacccgc

SEQ ID NO: 2277137 - RNA, 12 nt, Yersinia pestis
accuuaaaacag

SEQ ID NO: 2277138 - RNA, 19 nt, Yersinia pestis
accuuaacugcauagcuaa

SEQ ID NO: 2277139 - RNA, 23 nt, Yersinia pestis
accuuaacugcauagcuaaccuu

SEQ ID NO: 2277140 - RNA, 17 nt, Yersinia pestis
accuuaaguaaguuuaa

SEQ ID NO: 2277141 - RNA, 17 nt, Yersinia pestis
accuuacagugauaauc

SEQ ID NO: 2277142 - RNA, 13 nt, Yersinia pestis
accugucgcagaa

SEQ ID NO: 2277143 - RNA, 18 nt, Yersinia pestis
accugucaccugucaccu

SEQ ID NO: 2277144 - RNA, 23 nt, Yersinia pestis
accuguagcuuuuuaaauaccag

SEQ ID NO: 2277145 - RNA, 17 nt, Yersinia pestis
accuguacuuugauuca

SEQ ID NO: 2277146 - RNA, 14 nt, Yersinia pestis
accugcaucaagcc

SEQ ID NO: 2277147 - RNA, 14 nt, Yersinia pestis
accugcauauccuc

SEQ ID NO: 2277148 - RNA, 14 nt, Yersinia pestis
accugcacuuucau

SEQ ID NO: 2277149 - RNA, 17 nt, Yersinia pestis
accugcaacguuaaaga

SEQ ID NO: 2277150 - RNA, 22 nt, Yersinia pestis
accugcaacguuaaagaugaag

SEQ ID NO: 2277151 - RNA, 15 nt, Yersinia pestis
accugcaucaucaca

SEQ ID NO: 2277152 - RNA, 19 nt, Yersinia pestis
accugcgaccaauugauua

SEQ ID NO: 2277153 - RNA, 12 nt, Yersinia pestis
accugccuucag

SEQ ID NO: 2277154 - RNA, 17 nt, Yersinia pestis
accugccugcugcugug

SEQ ID NO: 2277155 - RNA, 20 nt, Yersinia pestis
accugcgguugcuguggcag

SEQ ID NO: 2277156 - RNA, 10 nt, Yersinia pestis
accugcucaa

SEQ ID NO: 2277157 - RNA, 15 nt, Yersinia pestis
accuggaacagugca

SEQ ID NO: 2277158 - RNA, 15 nt, Yersinia pestis
accugcuuaguuaca

SEQ ID NO: 2277159 - RNA, 18 nt, Yersinia pestis
accuuugaucauggcuug

SEQ ID NO: 2277160 - RNA, 17 nt, Yersinia pestis
accuuuugcugcacugc

SEQ ID NO: 2277161 - RNA, 19 nt, Yersinia pestis
accuuuuuaggguuguugg

SEQ ID NO: 2277162 - RNA, 18 nt, Yersinia pestis
accuuucagacaagccag

SEQ ID NO: 2277163 - RNA, 23 nt, Yersinia pestis
accuuuaccagcgucaaaccauu

SEQ ID NO: 2277164 - RNA, 18 nt, Yersinia pestis
acgaaauagcgccugccc

SEQ ID NO: 2277165 - RNA, 16 nt, Yersinia pestis
acgaaauuuaagaaau

SEQ ID NO: 2277166 - RNA, 16 nt, Yersinia pestis
acgaaauugauaugau

SEQ ID NO: 2277167 - RNA, 17 nt, Yersinia pestis
acgaaauugauaugauu

SEQ ID NO: 2277168 - RNA, 12 nt, Yersinia pestis
acgaaaugccgc

SEQ ID NO: 2277169 - RNA, 19 nt, Yersinia pestis
acgaaagagaacacaaaag

SEQ ID NO: 2277170 - RNA, 13 nt, Yersinia pestis
acgaaaagcagca

SEQ ID NO: 2277171 - RNA, 14 nt, Yersinia pestis
acgaaaagcagcag

SEQ ID NO: 2277172 - RNA, 16 nt, Yersinia pestis
acgaaaaccuaauacu

SEQ ID NO: 2277173 - RNA, 15 nt, Yersinia pestis
accuuggaaaacagc

SEQ ID NO: 2277174 - RNA, 19 nt, Yersinia pestis
accuugcuggcuaucugug

SEQ ID NO: 2277175 - RNA, 22 nt, Yersinia pestis
accuugcuccgcaauuugccca

SEQ ID NO: 2277176 - RNA, 17 nt, Yersinia pestis
accuugcgccaaguccu

SEQ ID NO: 2277177 - RNA, 15 nt, Yersinia pestis
accuugguaaauacc

SEQ ID NO: 2277178 - RNA, 23 nt, Yersinia pestis
accuugguuugauagcaaaacac

SEQ ID NO: 2277179 - RNA, 14 nt, Yersinia pestis
accuugauccgcca

SEQ ID NO: 2277180 - RNA, 13 nt, Yersinia pestis
accuugaauauca

SEQ ID NO: 2277181 - RNA, 18 nt, Yersinia pestis
accuucuacaaauuuuuu

SEQ ID NO: 2277182 - RNA, 18 nt, Yersinia pestis
accuucaguuuauuuaag

SEQ ID NO: 2277183 - RNA, 19 nt, Yersinia pestis
accuucaguuuauuuaagc

SEQ ID NO: 2277184 - RNA, 20 nt, Yersinia pestis
accuucaggaauaaacagca

SEQ ID NO: 2277185 - RNA, 15 nt, Yersinia pestis
accuucagcaaagag

SEQ ID NO: 2277186 - RNA, 22 nt, Yersinia pestis
accuucagacugacgcagagcu

SEQ ID NO: 2277187 - RNA, 21 nt, Yersinia pestis
accuucagacugacgcagagc

SEQ ID NO: 2277188 - RNA, 14 nt, Yersinia pestis
accuucacugaaua

SEQ ID NO: 2277189 - RNA, 15 nt, Yersinia pestis
accuucacauuuucu

SEQ ID NO: 2277190 - RNA, 11 nt, Yersinia pestis
acgacagccaa

SEQ ID NO: 2277191 - RNA, 21 nt, Yersinia pestis
acgacagccaaaucaguacca

SEQ ID NO: 2277192 - RNA, 19 nt, Yersinia pestis
acgacacaaaugcugugcc

SEQ ID NO: 2277193 - RNA, 22 nt, Yersinia pestis
acgacacaaaugcugugccaug

SEQ ID NO: 2277194 - RNA, 13 nt, Yersinia pestis
acgacaacaucaa

SEQ ID NO: 2277195 - RNA, 21 nt, Yersinia pestis
acgaauaacucucaucuaucg

SEQ ID NO: 2277196 - RNA, 21 nt, Yersinia pestis
acgaaugagcaguaauagcaa

SEQ ID NO: 2277197 - RNA, 19 nt, Yersinia pestis
acgaauuaaaacauauuaa

SEQ ID NO: 2277198 - RNA, 22 nt, Yersinia pestis
acgaaugagcaguaauagcaaa

SEQ ID NO: 2277199 - RNA, 18 nt, Yersinia pestis
acgaauggcgacuaaugg

SEQ ID NO: 2277200 - RNA, 20 nt, Yersinia pestis
acgaagcgugaaagcauccc

SEQ ID NO: 2277201 - RNA, 20 nt, Yersinia pestis
acgaaggcaacaacacccga

SEQ ID NO: 2277202 - RNA, 16 nt, Yersinia pestis
acgacgcccccgccag

SEQ ID NO: 2277203 - RNA, 14 nt, Yersinia pestis
acgacgcccgcaga

SEQ ID NO: 2277204 - RNA, 18 nt, Yersinia pestis
acgacgcccgcagacugc

SEQ ID NO: 2277205 - RNA, 16 nt, Yersinia pestis
acgacuuuaauaugau

SEQ ID NO: 2277206 - RNA, 22 nt, Yersinia pestis
acgagagcucgguugaccauuu

SEQ ID NO: 2277207 - RNA, 17 nt, Yersinia pestis
acgacgaaauagcgccu

SEQ ID NO: 2277208 - RNA, 14 nt, Yersinia pestis
acgaccuugccaag

SEQ ID NO: 2277209 - RNA, 22 nt, Yersinia pestis
acgacccacucguucucaacca

SEQ ID NO: 2277210 - RNA, 18 nt, Yersinia pestis
acgacccacucguucuca

SEQ ID NO: 2277211 - RNA, 18 nt, Yersinia pestis
acgaucuugcccaaugcc

SEQ ID NO: 2277212 - RNA, 19 nt, Yersinia pestis
acgaucuggucugccagaa

SEQ ID NO: 2277213 - RNA, 16 nt, Yersinia pestis
acgaucuccuccagaa

SEQ ID NO: 2277214 - RNA, 13 nt, Yersinia pestis
acgaugucggcag

SEQ ID NO: 2277215 - RNA, 23 nt, Yersinia pestis
acgaugguguaacccgccuugcg

SEQ ID NO: 2277216 - RNA, 22 nt, Yersinia pestis
acgauggaguggucaugcucac

SEQ ID NO: 2277217 - RNA, 20 nt, Yersinia pestis
acgauggaguggucaugcuc

SEQ ID NO: 2277218 - RNA, 14 nt, Yersinia pestis
acgauggaaaaaau

SEQ ID NO: 2277219 - RNA, 22 nt, Yersinia pestis
acgcaaaccccgaaccaaaaua

SEQ ID NO: 2277220 - RNA, 22 nt, Yersinia pestis
acgcaaauaaagggccugcaaa

SEQ ID NO: 2277221 - RNA, 21 nt, Yersinia pestis
acgcaaauaaagggccugcaa

SEQ ID NO: 2277222 - RNA, 23 nt, Yersinia pestis
acgcaacguaauaucugccaccg

SEQ ID NO: 2277223 - RNA, 23 nt, Yersinia pestis
acgauuguuacgccuucagcgau

SEQ ID NO: 2277224 - RNA, 19 nt, Yersinia pestis
acgauugccggaaauuuau

SEQ ID NO: 2277225 - RNA, 17 nt, Yersinia pestis
acgauuacccaccaccu

SEQ ID NO: 2277226 - RNA, 15 nt, Yersinia pestis
acgauuaccugcaua

SEQ ID NO: 2277227 - RNA, 22 nt, Yersinia pestis
acgauuaucucuuacauaaaga

SEQ ID NO: 2277228 - RNA, 13 nt, Yersinia pestis
acgaguaaauaca

SEQ ID NO: 2277229 - RNA, 14 nt, Yersinia pestis
acgaguaaugaaau

SEQ ID NO: 2277230 - RNA, 20 nt, Yersinia pestis
acgaguuaacacgggcauga

SEQ ID NO: 2277231 - RNA, 14 nt, Yersinia pestis
acgauaaaggcggu

SEQ ID NO: 2277232 - RNA, 17 nt, Yersinia pestis
acgauaguauaaauacc

SEQ ID NO: 2277233 - RNA, 19 nt, Yersinia pestis
acgauauagagcucagcuu

SEQ ID NO: 2277234 - RNA, 20 nt, Yersinia pestis
acgauauaggguauaugccu

SEQ ID NO: 2277235 - RNA, 16 nt, Yersinia pestis
acgauaucaauaaaga

SEQ ID NO: 2277236 - RNA, 16 nt, Yersinia pestis
acgauaagaauauuua

SEQ ID NO: 2277237 - RNA, 18 nt, Yersinia pestis
acgauacgacuucuuauu

SEQ ID NO: 2277238 - RNA, 18 nt, Yersinia pestis
acgauacguugcagguca

SEQ ID NO: 2277239 - RNA, 16 nt, Yersinia pestis
acgauaauuugcagcc

SEQ ID NO: 2277240 - RNA, 15 nt, Yersinia pestis
acgauaccaccacca

SEQ ID NO: 2277241 - RNA, 14 nt, Yersinia pestis
acgaucacugcuuu

SEQ ID NO: 2277242 - RNA, 19 nt, Yersinia pestis
acgaucagugaagagauaa

SEQ ID NO: 2277243 - RNA, 23 nt, Yersinia pestis
acgauccacgauugguugcauuu

SEQ ID NO: 2277244 - RNA, 21 nt, Yersinia pestis
acgaucccucggugauaaguu

SEQ ID NO: 2277245 - RNA, 20 nt, Yersinia pestis
acgauccgcuauuuucucug

SEQ ID NO: 2277246 - RNA, 13 nt, Yersinia pestis
acgaucgauagua

SEQ ID NO: 2277247 - RNA, 22 nt, Yersinia pestis
acaugugcguuggcuaugcgca

SEQ ID NO: 2277248 - RNA, 13 nt, Yersinia pestis
acaugggcagugc

SEQ ID NO: 2277249 - RNA, 22 nt, Yersinia pestis
acaugguucacccgcacgccca

SEQ ID NO: 2277250 - RNA, 18 nt, Yersinia pestis
acaugggcaagcucuggg

SEQ ID NO: 2277251 - RNA, 20 nt, Yersinia pestis
accaaaacgccaccagcgcc

SEQ ID NO: 2277252 - RNA, 17 nt, Yersinia pestis
acauuuuuuaaaaccaa

SEQ ID NO: 2277253 - RNA, 21 nt, Yersinia pestis
acauuuuuuaaaaccaaauua

SEQ ID NO: 2277254 - RNA, 12 nt, Yersinia pestis
accaaauauuac

SEQ ID NO: 2277255 - RNA, 20 nt, Yersinia pestis
accaacaugagccacacauu

SEQ ID NO: 2277256 - RNA, 17 nt, Yersinia pestis
accaaauagccggcucu

SEQ ID NO: 2277257 - RNA, 15 nt, Yersinia pestis
accaaauaaaacaag

SEQ ID NO: 2277258 - RNA, 14 nt, Yersinia pestis
accaaagauauguu

SEQ ID NO: 2277259 - RNA, 15 nt, Yersinia pestis
accaaucaauacacu

SEQ ID NO: 2277260 - RNA, 23 nt, Yersinia pestis
accaaucaucacgauaauaucga

SEQ ID NO: 2277261 - RNA, 12 nt, Yersinia pestis
accaauucaguu

SEQ ID NO: 2277262 - RNA, 18 nt, Yersinia pestis
accaaucguugcugguua

SEQ ID NO: 2277263 - RNA, 15 nt, Yersinia pestis
accaaucuccaauga

SEQ ID NO: 2277264 - RNA, 23 nt, Yersinia pestis
accaauuugccauaccaggccac

SEQ ID NO: 2277265 - RNA, 16 nt, Yersinia pestis
accacaaaaacagugu

SEQ ID NO: 2277266 - RNA, 18 nt, Yersinia pestis
accacaaaaacaguguca

SEQ ID NO: 2277267 - RNA, 21 nt, Yersinia pestis
accaauugaugucaugauaaa

SEQ ID NO: 2277268 - RNA, 19 nt, Yersinia pestis
accaauugcaggcuuucac

SEQ ID NO: 2277269 - RNA, 12 nt, Yersinia pestis
accaauucuuag

SEQ ID NO: 2277270 - RNA, 14 nt, Yersinia pestis
accaccaacagcau

SEQ ID NO: 2277271 - RNA, 15 nt, Yersinia pestis
accaccaacagcauu

SEQ ID NO: 2277272 - RNA, 16 nt, Yersinia pestis
accaaggcucuggcaa

SEQ ID NO: 2277273 - RNA, 14 nt, Yersinia pestis
accaacgaaaucac

SEQ ID NO: 2277274 - RNA, 15 nt, Yersinia pestis
accaaccaucaccau

SEQ ID NO: 2277275 - RNA, 16 nt, Yersinia pestis
accaacugauuuuuau

SEQ ID NO: 2277276 - RNA, 15 nt, Yersinia pestis
accagauaacaacaa

SEQ ID NO: 2277277 - RNA, 16 nt, Yersinia pestis
accagauaacaacaaa

SEQ ID NO: 2277278 - RNA, 23 nt, Yersinia pestis
accagcaguugcugcucugucaa

SEQ ID NO: 2277279 - RNA, 15 nt, Yersinia pestis
accagcaucaguagc

SEQ ID NO: 2277280 - RNA, 16 nt, Yersinia pestis
accagacaacagucac

SEQ ID NO: 2277281 - RNA, 17 nt, Yersinia pestis
accagacaaccaauaca

SEQ ID NO: 2277282 - RNA, 20 nt, Yersinia pestis
accagagaugauagcaaugu

SEQ ID NO: 2277283 - RNA, 23 nt, Yersinia pestis
accagacucugcuaccaggaagc

SEQ ID NO: 2277284 - RNA, 18 nt, Yersinia pestis
accacugcggucaaagaa

SEQ ID NO: 2277285 - RNA, 18 nt, Yersinia pestis
accacgacgaucuuguuc

SEQ ID NO: 2277286 - RNA, 21 nt, Yersinia pestis
accacugaccuauugauaaaa

SEQ ID NO: 2277287 - RNA, 18 nt, Yersinia pestis
accacugaguugcucaag

SEQ ID NO: 2277288 - RNA, 16 nt, Yersinia pestis
accacugauaggucau

SEQ ID NO: 2277289 - RNA, 16 nt, Yersinia pestis
accacgguaucaauca

SEQ ID NO: 2277290 - RNA, 16 nt, Yersinia pestis
accacggccagaauca

SEQ ID NO: 2277291 - RNA, 21 nt, Yersinia pestis
accacccguugcauuuuucug

SEQ ID NO: 2277292 - RNA, 14 nt, Yersinia pestis
accaccaacccgcc

SEQ ID NO: 2277293 - RNA, 14 nt, Yersinia pestis
accaccacggccag

SEQ ID NO: 2277294 - RNA, 13 nt, Yersinia pestis
accaccaccaaca

SEQ ID NO: 2277295 - RNA, 15 nt, Yersinia pestis
accaccaccaacagc

SEQ ID NO: 2277296 - RNA, 15 nt, Yersinia pestis
accaccaccacaaac

SEQ ID NO: 2277297 - RNA, 11 nt, Yersinia pestis
accaccaacuc

SEQ ID NO: 2277298 - RNA, 14 nt, Yersinia pestis
accauaucagaacc

SEQ ID NO: 2277299 - RNA, 22 nt, Yersinia pestis
accauaucagaaccaagcaaua

SEQ ID NO: 2277300 - RNA, 15 nt, Yersinia pestis
accaucaggauuaau

SEQ ID NO: 2277301 - RNA, 22 nt, Yersinia pestis
accaucaggauuaaugcggaua

SEQ ID NO: 2277302 - RNA, 18 nt, Yersinia pestis
accaucacuuccagcgcc

SEQ ID NO: 2277303 - RNA, 14 nt, Yersinia pestis
accauaaauucaca

SEQ ID NO: 2277304 - RNA, 14 nt, Yersinia pestis
accauaaaaggaug

SEQ ID NO: 2277305 - RNA, 19 nt, Yersinia pestis
accauaaaaggauggccca

SEQ ID NO: 2277306 - RNA, 23 nt, Yersinia pestis
accauaaaauaaauaauuuguaa

SEQ ID NO: 2277307 - RNA, 22 nt, Yersinia pestis
accauaaaauaaauaauuugua

SEQ ID NO: 2277308 - RNA, 14 nt, Yersinia pestis
accauaacgcugcu

SEQ ID NO: 2277309 - RNA, 14 nt, Yersinia pestis
accauaacaauggc

SEQ ID NO: 2277310 - RNA, 13 nt, Yersinia pestis
accagucugcaua

SEQ ID NO: 2277311 - RNA, 23 nt, Yersinia pestis
accagugaauaaguucugcgacu

SEQ ID NO: 2277312 - RNA, 13 nt, Yersinia pestis
accaguucuggua

SEQ ID NO: 2277313 - RNA, 20 nt, Yersinia pestis
accaguuuauuuucccuuuc

SEQ ID NO: 2277314 - RNA, 14 nt, Yersinia pestis
accagugucuggca

SEQ ID NO: 2277315 - RNA, 22 nt, Yersinia pestis
accaguuaaagaauacagccag

SEQ ID NO: 2277316 - RNA, 17 nt, Yersinia pestis
accagguauuucuccau

SEQ ID NO: 2277317 - RNA, 14 nt, Yersinia pestis
accaguaaacgcca

SEQ ID NO: 2277318 - RNA, 15 nt, Yersinia pestis
accaguaaacgccaa

SEQ ID NO: 2277319 - RNA, 19 nt, Yersinia pestis
accaguaaacgccaaucac

SEQ ID NO: 2277320 - RNA, 19 nt, Yersinia pestis
accagggcuaaaauggcac

SEQ ID NO: 2277321 - RNA, 21 nt, Yersinia pestis
accaggccacggccgccuuca

SEQ ID NO: 2277322 - RNA, 14 nt, Yersinia pestis
accaggccacuugg

SEQ ID NO: 2277323 - RNA, 14 nt, Yersinia pestis
acccccuucaccaa

SEQ ID NO: 2277324 - RNA, 23 nt, Yersinia pestis
accccauuuaucgccaagccagu

SEQ ID NO: 2277325 - RNA, 16 nt, Yersinia pestis
acccccaucaggaggu

SEQ ID NO: 2277326 - RNA, 12 nt, Yersinia pestis
acccccccgacc

SEQ ID NO: 2277327 - RNA, 17 nt, Yersinia pestis
accccccauugccaaau

SEQ ID NO: 2277328 - RNA, 15 nt, Yersinia pestis
accccauaaaucccg

SEQ ID NO: 2277329 - RNA, 19 nt, Yersinia pestis
acccccaacccaaggagau

SEQ ID NO: 2277330 - RNA, 18 nt, Yersinia pestis
accccagucacuuacuga

SEQ ID NO: 2277331 - RNA, 12 nt, Yersinia pestis
accccagauaac

SEQ ID NO: 2277332 - RNA, 16 nt, Yersinia pestis
accccaacgcuggcug

SEQ ID NO: 2277333 - RNA, 20 nt, Yersinia pestis
accccaaagcgcauuuuucu

SEQ ID NO: 2277334 - RNA, 17 nt, Yersinia pestis
accccacguaauuauug

SEQ ID NO: 2277335 - RNA, 13 nt, Yersinia pestis
accccaauucuua

SEQ ID NO: 2277336 - RNA, 12 nt, Yersinia pestis
acccagcaaaau

SEQ ID NO: 2277337 - RNA, 19 nt, Yersinia pestis
acccagcgaacguaaaaag

SEQ ID NO: 2277338 - RNA, 21 nt, Yersinia pestis
acccagccguggaucauggcu

SEQ ID NO: 2277339 - RNA, 12 nt, Yersinia pestis
acccagccaaga

SEQ ID NO: 2277340 - RNA, 12 nt, Yersinia pestis
accauugaccag

SEQ ID NO: 2277341 - RNA, 15 nt, Yersinia pestis
accauucucaaaaua

SEQ ID NO: 2277342 - RNA, 20 nt, Yersinia pestis
accauucacgccgcuccuga

SEQ ID NO: 2277343 - RNA, 18 nt, Yersinia pestis
accauuacuucuacucug

SEQ ID NO: 2277344 - RNA, 18 nt, Yersinia pestis
acccaccagagaccacag

SEQ ID NO: 2277345 - RNA, 21 nt, Yersinia pestis
acccacuugccauaagugaac

SEQ ID NO: 2277346 - RNA, 22 nt, Yersinia pestis
acccacuugccauaagugaaca

SEQ ID NO: 2277347 - RNA, 16 nt, Yersinia pestis
acccaauaauaaucca

SEQ ID NO: 2277348 - RNA, 16 nt, Yersinia pestis
acccaacaguaccuuc

SEQ ID NO: 2277349 - RNA, 23 nt, Yersinia pestis
acccaacagugcucgcaaacgau

SEQ ID NO: 2277350 - RNA, 19 nt, Yersinia pestis
acagcaccaccgauggcac

SEQ ID NO: 2277351 - RNA, 15 nt, Yersinia pestis
acagcacucaguaca

SEQ ID NO: 2277352 - RNA, 22 nt, Yersinia pestis
acagcagaacaaaacaagcccc

SEQ ID NO: 2277353 - RNA, 13 nt, Yersinia pestis
acagcagaacaaa

SEQ ID NO: 2277354 - RNA, 17 nt, Yersinia pestis
acagccaucacccgaua

SEQ ID NO: 2277355 - RNA, 12 nt, Yersinia pestis
acagccagccuu

SEQ ID NO: 2277356 - RNA, 23 nt, Yersinia pestis
acagcaaugcaccgacaaagaua

SEQ ID NO: 2277357 - RNA, 14 nt, Yersinia pestis
acagaguauacaua

SEQ ID NO: 2277358 - RNA, 22 nt, Yersinia pestis
acagaggccgaguaaucagagu

SEQ ID NO: 2277359 - RNA, 18 nt, Yersinia pestis
acagagcagaaagcagca

SEQ ID NO: 2277360 - RNA, 21 nt, Yersinia pestis
acagagccagaauaucgugga

SEQ ID NO: 2277361 - RNA, 21 nt, Yersinia pestis
acagagcagaaagcagcagcu

SEQ ID NO: 2277362 - RNA, 15 nt, Yersinia pestis
acagagcagaaagca

SEQ ID NO: 2277363 - RNA, 14 nt, Yersinia pestis
acagagcacaacgg

SEQ ID NO: 2277364 - RNA, 23 nt, Yersinia pestis
acacuuaaauagaaaaaugauuu

SEQ ID NO: 2277365 - RNA, 22 nt, Yersinia pestis
acacuucgccaggucaggaaga

SEQ ID NO: 2277366 - RNA, 14 nt, Yersinia pestis
acacuuuugcuggu

SEQ ID NO: 2277367 - RNA, 21 nt, Yersinia pestis
acagacaaacaaccuaaaaaa

SEQ ID NO: 2277368 - RNA, 19 nt, Yersinia pestis
aauuucagcagcacguuca

SEQ ID NO: 2277369 - RNA, 16 nt, Yersinia pestis
aauuucagauaaaaau

SEQ ID NO: 2277370 - RNA, 14 nt, Yersinia pestis
aauuucacugugcu

SEQ ID NO: 2277371 - RNA, 13 nt, Yersinia pestis
aauuucacuggca

SEQ ID NO: 2277372 - RNA, 11 nt, Yersinia pestis
aauuucaguaa

SEQ ID NO: 2277373 - RNA, 14 nt, Yersinia pestis
aauuucagucaaua

SEQ ID NO: 2277374 - RNA, 13 nt, Yersinia pestis
acacucuacuuuc

SEQ ID NO: 2277375 - RNA, 19 nt, Yersinia pestis
acacugucgacugcuuuuc

SEQ ID NO: 2277376 - RNA, 20 nt, Yersinia pestis
acacugagcaccgcaggaac

SEQ ID NO: 2277377 - RNA, 15 nt, Yersinia pestis
acacugacaucauca

SEQ ID NO: 2277378 - RNA, 14 nt, Yersinia pestis
acagcguauucacg

SEQ ID NO: 2277379 - RNA, 16 nt, Yersinia pestis
acagcgcgcagccaac

SEQ ID NO: 2277380 - RNA, 20 nt, Yersinia pestis
acagccuauggcgguuccaa

SEQ ID NO: 2277381 - RNA, 14 nt, Yersinia pestis
acagccuaaccgcu

SEQ ID NO: 2277382 - RNA, 21 nt, Yersinia pestis
acagccguauaucuuaccuuc

SEQ ID NO: 2277383 - RNA, 23 nt, Yersinia pestis
acagccguguagcauggcuuuau

SEQ ID NO: 2277384 - RNA, 14 nt, Yersinia pestis
acagcgagcggcga

SEQ ID NO: 2277385 - RNA, 19 nt, Yersinia pestis
acagcgagauaaacugugc

SEQ ID NO: 2277386 - RNA, 12 nt, Yersinia pestis
acagcccaagag

SEQ ID NO: 2277387 - RNA, 15 nt, Yersinia pestis
acagcccaagagaaa

SEQ ID NO: 2277388 - RNA, 21 nt, Yersinia pestis
acagcccagauggcaaucugc

SEQ ID NO: 2277389 - RNA, 15 nt, Yersinia pestis
acagccguguagcau

SEQ ID NO: 2277390 - RNA, 19 nt, Yersinia pestis
acagcuaauuuucauugau

SEQ ID NO: 2277391 - RNA, 22 nt, Yersinia pestis
acagcucagacuggccagaagg

SEQ ID NO: 2277392 - RNA, 14 nt, Yersinia pestis
acaggaucugcucc

SEQ ID NO: 2277393 - RNA, 12 nt, Yersinia pestis
acaggaaacucc

SEQ ID NO: 2277394 - RNA, 16 nt, Yersinia pestis
acaggaacguucaauu

SEQ ID NO: 2277395 - RNA, 16 nt, Yersinia pestis
acaggccauacugggu

SEQ ID NO: 2277396 - RNA, 19 nt, Yersinia pestis
acaggccgugggcaauaac

SEQ ID NO: 2277397 - RNA, 18 nt, Yersinia pestis
acaggccccaauccacca

SEQ ID NO: 2277398 - RNA, 13 nt, Yersinia pestis
acagucauuaaca

SEQ ID NO: 2277399 - RNA, 12 nt, Yersinia pestis
acagucauuuac

SEQ ID NO: 2277400 - RNA, 17 nt, Yersinia pestis
acagucaguucauuaca

SEQ ID NO: 2277401 - RNA, 16 nt, Yersinia pestis
acagucacaccaacac

SEQ ID NO: 2277402 - RNA, 18 nt, Yersinia pestis
acagucacgcuaccagaa

SEQ ID NO: 2277403 - RNA, 18 nt, Yersinia pestis
acagucugucguacuuuc

SEQ ID NO: 2277404 - RNA, 18 nt, Yersinia pestis
acagucuuauuacucauu

SEQ ID NO: 2277405 - RNA, 12 nt, Yersinia pestis
acagucgcugcu

SEQ ID NO: 2277406 - RNA, 22 nt, Yersinia pestis
acaguguaaaaagcgaucgacc

SEQ ID NO: 2277407 - RNA, 18 nt, Yersinia pestis
acagugauaaucacguuc

SEQ ID NO: 2277408 - RNA, 22 nt, Yersinia pestis
acagucugucguacuuuccuuc

SEQ ID NO: 2277409 - RNA, 16 nt, Yersinia pestis
acagugcauucaucau

SEQ ID NO: 2277410 - RNA, 16 nt, Yersinia pestis
acagugccaacagcga

SEQ ID NO: 2277411 - RNA, 18 nt, Yersinia pestis
acagugcaacauuaaaaa

SEQ ID NO: 2277412 - RNA, 20 nt, Yersinia pestis
acagugcaacauuaaaaaua

SEQ ID NO: 2277413 - RNA, 20 nt, Yersinia pestis
acaguuaaacaacgcugaaa

SEQ ID NO: 2277414 - RNA, 15 nt, Yersinia pestis
acaguuaauuuucac

SEQ ID NO: 2277415 - RNA, 13 nt, Yersinia pestis
acaguuaaaaaua

SEQ ID NO: 2277416 - RNA, 12 nt, Yersinia pestis
acaguguugacc

SEQ ID NO: 2277417 - RNA, 14 nt, Yersinia pestis
acaguuauuaggca

SEQ ID NO: 2277418 - RNA, 20 nt, Yersinia pestis
acaguuccuguuuuugaaua

SEQ ID NO: 2277419 - RNA, 21 nt, Yersinia pestis
acaguuauuuuaauugcugau

SEQ ID NO: 2277420 - RNA, 18 nt, Yersinia pestis
acaguugugucagaccaa

SEQ ID NO: 2277421 - RNA, 19 nt, Yersinia pestis
acauaaauaaguucagguu

SEQ ID NO: 2277422 - RNA, 22 nt, Yersinia pestis
acauaaauuuaucucuaucaau

SEQ ID NO: 2277423 - RNA, 18 nt, Yersinia pestis
acauaaaccgugugcuuc

SEQ ID NO: 2277424 - RNA, 20 nt, Yersinia pestis
acauaaagcaaacgccgcuc

SEQ ID NO: 2277425 - RNA, 18 nt, Yersinia pestis
acaguaggcugaaggccu

SEQ ID NO: 2277426 - RNA, 21 nt, Yersinia pestis
acaguaggcugaaggccugcu

SEQ ID NO: 2277427 - RNA, 18 nt, Yersinia pestis
acaguaucaaccaccgcu

SEQ ID NO: 2277428 - RNA, 21 nt, Yersinia pestis
acaguacaaaaaacaaaccgg

SEQ ID NO: 2277429 - RNA, 18 nt, Yersinia pestis
acaguaagauaggccacc

SEQ ID NO: 2277430 - RNA, 16 nt, Yersinia pestis
acaggugucaucaagg

SEQ ID NO: 2277431 - RNA, 16 nt, Yersinia pestis
acaggugcccuguggc

SEQ ID NO: 2277432 - RNA, 16 nt, Yersinia pestis
acaggcuuucaggacu

SEQ ID NO: 2277433 - RNA, 23 nt, Yersinia pestis
acagggaggccagcaaugaccuc

SEQ ID NO: 2277434 - RNA, 15 nt, Yersinia pestis
acagggcagaaaaua

SEQ ID NO: 2277435 - RNA, 13 nt, Yersinia pestis
acaggcugcaugg

SEQ ID NO: 2277436 - RNA, 14 nt, Yersinia pestis
acaggcugccugcc

SEQ ID NO: 2277437 - RNA, 16 nt, Yersinia pestis
acaggcucauuuugua

SEQ ID NO: 2277438 - RNA, 15 nt, Yersinia pestis
acaucacgcuuaaga

SEQ ID NO: 2277439 - RNA, 23 nt, Yersinia pestis
acaucacgcagcgcuugcuggua

SEQ ID NO: 2277440 - RNA, 14 nt, Yersinia pestis
acaucagcgccaca

SEQ ID NO: 2277441 - RNA, 13 nt, Yersinia pestis
acaucgacaccaa

SEQ ID NO: 2277442 - RNA, 14 nt, Yersinia pestis
acauccaauucagu

SEQ ID NO: 2277443 - RNA, 11 nt, Yersinia pestis
acauccacauu

SEQ ID NO: 2277444 - RNA, 20 nt, Yersinia pestis
acauccaauuuuuucaucau

SEQ ID NO: 2277445 - RNA, 17 nt, Yersinia pestis
acaucgagcgggcuuca

SEQ ID NO: 2277446 - RNA, 21 nt, Yersinia pestis
acaucgagcgggcuucaccau

SEQ ID NO: 2277447 - RNA, 13 nt, Yersinia pestis
acaucauugguuu

SEQ ID NO: 2277448 - RNA, 18 nt, Yersinia pestis
acaucaaagguuucacau

SEQ ID NO: 2277449 - RNA, 14 nt, Yersinia pestis
acaucaaaccggcu

SEQ ID NO: 2277450 - RNA, 16 nt, Yersinia pestis
acaucaaaccggcuaa

SEQ ID NO: 2277451 - RNA, 22 nt, Yersinia pestis
acauauuggucauuuuucccuu

SEQ ID NO: 2277452 - RNA, 14 nt, Yersinia pestis
acaugccagaaacg

SEQ ID NO: 2277453 - RNA, 17 nt, Yersinia pestis
acaugcugaagccagca

SEQ ID NO: 2277454 - RNA, 20 nt, Yersinia pestis
acaugcaccguaacuucuuc

SEQ ID NO: 2277455 - RNA, 11 nt, Yersinia pestis
acaugcagcau

SEQ ID NO: 2277456 - RNA, 16 nt, Yersinia pestis
acaugaugaaugcgaa

SEQ ID NO: 2277457 - RNA, 13 nt, Yersinia pestis
acaugagauggca

SEQ ID NO: 2277458 - RNA, 14 nt, Yersinia pestis
acaugacugaacau

SEQ ID NO: 2277459 - RNA, 14 nt, Yersinia pestis
acaugagccacaca

SEQ ID NO: 2277460 - RNA, 15 nt, Yersinia pestis
acaucguuguauguu

SEQ ID NO: 2277461 - RNA, 13 nt, Yersinia pestis
acaucgcccggua

SEQ ID NO: 2277462 - RNA, 22 nt, Yersinia pestis
acaucucuugggcgcagucauc

SEQ ID NO: 2277463 - RNA, 16 nt, Yersinia pestis
acaucucggcuuucag

SEQ ID NO: 2277464 - RNA, 20 nt, Yersinia pestis
acaucuggcuggcauauuuc

SEQ ID NO: 2277465 - RNA, 21 nt, Yersinia pestis
acaucugcuuuacugcuuuuc

SEQ ID NO: 2277466 - RNA, 14 nt, Yersinia pestis
acaucugcuuuacu

SEQ ID NO: 2277467 - RNA, 13 nt, Yersinia pestis
acaucugccaggc

SEQ ID NO: 2277468 - RNA, 22 nt, Yersinia pestis
agaagcucauaugcagcaucca

SEQ ID NO: 2277469 - RNA, 13 nt, Yersinia pestis
agaauacagccag

SEQ ID NO: 2277470 - RNA, 13 nt, Yersinia pestis
agaagguuccccu

SEQ ID NO: 2277471 - RNA, 15 nt, Yersinia pestis
agaaguagaaugaga

SEQ ID NO: 2277472 - RNA, 22 nt, Yersinia pestis
agaagaauaucugccgggagga

SEQ ID NO: 2277473 - RNA, 20 nt, Yersinia pestis
agaagaauugcagauaccac

SEQ ID NO: 2277474 - RNA, 15 nt, Yersinia pestis
agaagaaaaucacuu

SEQ ID NO: 2277475 - RNA, 21 nt, Yersinia pestis
agaauccucugaauaaaaaau

SEQ ID NO: 2277476 - RNA, 19 nt, Yersinia pestis
agaaucaccaacaccacca

SEQ ID NO: 2277477 - RNA, 16 nt, Yersinia pestis
agaaucaaugggauau

SEQ ID NO: 2277478 - RNA, 14 nt, Yersinia pestis
agaaucaaucaauu

SEQ ID NO: 2277479 - RNA, 12 nt, Yersinia pestis
agaauuauuuau

SEQ ID NO: 2277480 - RNA, 13 nt, Yersinia pestis
agaaugaacugau

SEQ ID NO: 2277481 - RNA, 15 nt, Yersinia pestis
agaaucucuccagug

SEQ ID NO: 2277482 - RNA, 11 nt, Yersinia pestis
agaaucugcug

SEQ ID NO: 2277483 - RNA, 18 nt, Yersinia pestis
agacaacucuucuaucuu

SEQ ID NO: 2277484 - RNA, 20 nt, Yersinia pestis
agacaacugacaacaucaaa

SEQ ID NO: 2277485 - RNA, 20 nt, Yersinia pestis
agaauuuaccuccauauccu

SEQ ID NO: 2277486 - RNA, 16 nt, Yersinia pestis
agaauuuaccuccaua

SEQ ID NO: 2277487 - RNA, 22 nt, Yersinia pestis
agacaacgcuuggcaucacaga

SEQ ID NO: 2277488 - RNA, 12 nt, Yersinia pestis
agaccagauaau

SEQ ID NO: 2277489 - RNA, 21 nt, Yersinia pestis
agacacuuugguuugcagcga

SEQ ID NO: 2277490 - RNA, 20 nt, Yersinia pestis
agacauagagagaacagcga

SEQ ID NO: 2277491 - RNA, 12 nt, Yersinia pestis
agacauaaagcc

SEQ ID NO: 2277492 - RNA, 14 nt, Yersinia pestis
agaccugccaauuc

SEQ ID NO: 2277493 - RNA, 20 nt, Yersinia pestis
agacgacgugcagcgcgcag

SEQ ID NO: 2277494 - RNA, 19 nt, Yersinia pestis
agaccugaggauaaaaacu

SEQ ID NO: 2277495 - RNA, 23 nt, Yersinia pestis
agacgagucuauugaaaaaauaa

SEQ ID NO: 2277496 - RNA, 16 nt, Yersinia pestis
agacggcguaagccuu

SEQ ID NO: 2277497 - RNA, 18 nt, Yersinia pestis
agacgucauaaauauuuu

SEQ ID NO: 2277498 - RNA, 22 nt, Yersinia pestis
agacguaucgcaguuaaagaca

SEQ ID NO: 2277499 - RNA, 21 nt, Yersinia pestis
agacguuuaaauaagcuauca

SEQ ID NO: 2277500 - RNA, 22 nt, Yersinia pestis
agaacccccgcgaacagcagaa

SEQ ID NO: 2277501 - RNA, 15 nt, Yersinia pestis
agaaccggaauaaau

SEQ ID NO: 2277502 - RNA, 15 nt, Yersinia pestis
agaaccggcugacau

SEQ ID NO: 2277503 - RNA, 12 nt, Yersinia pestis
agaaccggggcg

SEQ ID NO: 2277504 - RNA, 15 nt, Yersinia pestis
agaaccguaaucuug

SEQ ID NO: 2277505 - RNA, 14 nt, Yersinia pestis
agaaccugucgcag

SEQ ID NO: 2277506 - RNA, 21 nt, Yersinia pestis
agaaccuguuacaucagagcu

SEQ ID NO: 2277507 - RNA, 19 nt, Yersinia pestis
agaacugauuucaggaaug

SEQ ID NO: 2277508 - RNA, 22 nt, Yersinia pestis
agaacgucaccgccaaaauaaa

SEQ ID NO: 2277509 - RNA, 21 nt, Yersinia pestis
agaacaccaacaccacacuga

SEQ ID NO: 2277510 - RNA, 12 nt, Yersinia pestis
agaacaggcaga

SEQ ID NO: 2277511 - RNA, 22 nt, Yersinia pestis
agaacaggcagaucguaaagac

SEQ ID NO: 2277512 - RNA, 21 nt, Yersinia pestis
agaacaggcagcaaauaaagc

SEQ ID NO: 2277513 - RNA, 22 nt, Yersinia pestis
agaaaaaguauugcacugagag

SEQ ID NO: 2277514 - RNA, 12 nt, Yersinia pestis
acuuuuuuuaac

SEQ ID NO: 2277515 - RNA, 19 nt, Yersinia pestis
acuuuuuuaccacauuucc

SEQ ID NO: 2277516 - RNA, 23 nt, Yersinia pestis
acuuuuuuaccacauuuccuaug

SEQ ID NO: 2277517 - RNA, 15 nt, Yersinia pestis
acuuuuucucuccua

SEQ ID NO: 2277518 - RNA, 11 nt, Yersinia pestis
acuuuuuguga

SEQ ID NO: 2277519 - RNA, 18 nt, Yersinia pestis
acuuuucuucauugcugc

SEQ ID NO: 2277520 - RNA, 17 nt, Yersinia pestis
acuucgccgggucagga

SEQ ID NO: 2277521 - RNA, 21 nt, Yersinia pestis
acuucgccgggucaggaagag

SEQ ID NO: 2277522 - RNA, 13 nt, Yersinia pestis
acuucgcacgccc

SEQ ID NO: 2277523 - RNA, 23 nt, Yersinia pestis
acuucgcacgcccaucaaggccu

SEQ ID NO: 2277524 - RNA, 19 nt, Yersinia pestis
acuucgauacuacaaucau

SEQ ID NO: 2277525 - RNA, 13 nt, Yersinia pestis
acuuccuuugccc

SEQ ID NO: 2277526 - RNA, 21 nt, Yersinia pestis
acuucgaaagaaauaaaagaa

SEQ ID NO: 2277527 - RNA, 14 nt, Yersinia pestis
agaaaauuucucuu

SEQ ID NO: 2277528 - RNA, 21 nt, Yersinia pestis
agaaacgugaauugcuacugg

SEQ ID NO: 2277529 - RNA, 20 nt, Yersinia pestis
agaaacggugaaaauaccca

SEQ ID NO: 2277530 - RNA, 16 nt, Yersinia pestis
agaaacgccccgauaa

SEQ ID NO: 2277531 - RNA, 19 nt, Yersinia pestis
agaaaccuaaugccagaca

SEQ ID NO: 2277532 - RNA, 16 nt, Yersinia pestis
agaaacccauagcaaa

SEQ ID NO: 2277533 - RNA, 23 nt, Yersinia pestis
agaaaggcggauaaucuaggccu

SEQ ID NO: 2277534 - RNA, 16 nt, Yersinia pestis
agaaagccggaaaaga

SEQ ID NO: 2277535 - RNA, 14 nt, Yersinia pestis
agaaagcagcagcu

SEQ ID NO: 2277536 - RNA, 20 nt, Yersinia pestis
agaaacucccuucaaucaau

SEQ ID NO: 2277537 - RNA, 19 nt, Yersinia pestis
agaaacugugauaaccaac

SEQ ID NO: 2277538 - RNA, 18 nt, Yersinia pestis
agacuaccggaaccgccg

SEQ ID NO: 2277539 - RNA, 15 nt, Yersinia pestis
agacuaaauguagag

SEQ ID NO: 2277540 - RNA, 15 nt, Yersinia pestis
agacuaaccucugca

SEQ ID NO: 2277541 - RNA, 16 nt, Yersinia pestis
agagaugcaaucuaac

SEQ ID NO: 2277542 - RNA, 21 nt, Yersinia pestis
agagaugacccaaagucauug

SEQ ID NO: 2277543 - RNA, 14 nt, Yersinia pestis
agagaugauagcaa

SEQ ID NO: 2277544 - RNA, 23 nt, Yersinia pestis
agagaucguaggcuuuuuacuuu

SEQ ID NO: 2277545 - RNA, 20 nt, Yersinia pestis
agagaucguaggcuuuuuac

SEQ ID NO: 2277546 - RNA, 21 nt, Yersinia pestis
agagauaaaucggcggccaug

SEQ ID NO: 2277547 - RNA, 18 nt, Yersinia pestis
agagauaacggcguucua

SEQ ID NO: 2277548 - RNA, 22 nt, Yersinia pestis
agagauugccggauuccaccug

SEQ ID NO: 2277549 - RNA, 13 nt, Yersinia pestis
agagaugcagaga

SEQ ID NO: 2277550 - RNA, 23 nt, Yersinia pestis
agagauucguuuuuuuaucaaug

SEQ ID NO: 2277551 - RNA, 19 nt, Yersinia pestis
agagauguucgcagaaaag

SEQ ID NO: 2277552 - RNA, 14 nt, Yersinia pestis
agagucacagagga

SEQ ID NO: 2277553 - RNA, 12 nt, Yersinia pestis
agagucacagca

SEQ ID NO: 2277554 - RNA, 18 nt, Yersinia pestis
agagguagacguaucaug

SEQ ID NO: 2277555 - RNA, 18 nt, Yersinia pestis
agagucacagcauucaga

SEQ ID NO: 2277556 - RNA, 14 nt, Yersinia pestis
agaguccuuaaaaa

SEQ ID NO: 2277557 - RNA, 20 nt, Yersinia pestis
agagucugucauggcacgcu

SEQ ID NO: 2277558 - RNA, 14 nt, Yersinia pestis
agagugaagauuuu

SEQ ID NO: 2277559 - RNA, 17 nt, Yersinia pestis
agagucgcaaaaaauau

SEQ ID NO: 2277560 - RNA, 20 nt, Yersinia pestis
agagucgagcggggcaaaaa

SEQ ID NO: 2277561 - RNA, 21 nt, Yersinia pestis
agagucgagcggggcaaaaau

SEQ ID NO: 2277562 - RNA, 19 nt, Yersinia pestis
agagucgaugaaacacaac

SEQ ID NO: 2277563 - RNA, 17 nt, Yersinia pestis
agagcgaauggcaaugg

SEQ ID NO: 2277564 - RNA, 23 nt, Yersinia pestis
agagcgcaaugcuccagcaacug

SEQ ID NO: 2277565 - RNA, 19 nt, Yersinia pestis
agagcgcaaaagaccaagu

SEQ ID NO: 2277566 - RNA, 18 nt, Yersinia pestis
agagugaaugugaguguu

SEQ ID NO: 2277567 - RNA, 16 nt, Yersinia pestis
agagugaccaaagcag

SEQ ID NO: 2277568 - RNA, 17 nt, Yersinia pestis
agauacccuucucuuua

SEQ ID NO: 2277569 - RNA, 20 nt, Yersinia pestis
agauaccgccccucacuucg

SEQ ID NO: 2277570 - RNA, 15 nt, Yersinia pestis
agauaccacaucaaa

SEQ ID NO: 2277571 - RNA, 16 nt, Yersinia pestis
agauaccacaucaaac

SEQ ID NO: 2277572 - RNA, 19 nt, Yersinia pestis
agauaccacaucaaaccgg

SEQ ID NO: 2277573 - RNA, 19 nt, Yersinia pestis
agauacccgccauaaauaa

SEQ ID NO: 2277574 - RNA, 14 nt, Yersinia pestis
agauacuugcguuc

SEQ ID NO: 2277575 - RNA, 16 nt, Yersinia pestis
agauacuggaagaaac

SEQ ID NO: 2277576 - RNA, 13 nt, Yersinia pestis
agauacucaugau

SEQ ID NO: 2277577 - RNA, 14 nt, Yersinia pestis
agauagauuucacu

SEQ ID NO: 2277578 - RNA, 15 nt, Yersinia pestis
agauagcaaucaaua

SEQ ID NO: 2277579 - RNA, 12 nt, Yersinia pestis
agauagcgaauc

SEQ ID NO: 2277580 - RNA, 16 nt, Yersinia pestis
agauagcgaaucacau

SEQ ID NO: 2277581 - RNA, 23 nt, Yersinia pestis
agauagcaaucaauaagcuacag

SEQ ID NO: 2277582 - RNA, 21 nt, Yersinia pestis
agauaggagaagguuccccuu

SEQ ID NO: 2277583 - RNA, 22 nt, Yersinia pestis
agauagagcagugcagcaaaag

SEQ ID NO: 2277584 - RNA, 16 nt, Yersinia pestis
agauauugcgcaguaa

SEQ ID NO: 2277585 - RNA, 14 nt, Yersinia pestis
agauauuugcugcc

SEQ ID NO: 2277586 - RNA, 20 nt, Yersinia pestis
agauaucuaauuuauaaccu

SEQ ID NO: 2277587 - RNA, 14 nt, Yersinia pestis
agauauuacgcagc

SEQ ID NO: 2277588 - RNA, 15 nt, Yersinia pestis
agauaucuaauuuau

SEQ ID NO: 2277589 - RNA, 19 nt, Yersinia pestis
agauaucagccagugcuaa

SEQ ID NO: 2277590 - RNA, 22 nt, Yersinia pestis
agauaugccaggcaucaucugc

SEQ ID NO: 2277591 - RNA, 18 nt, Yersinia pestis
agaucaaaagcagagaau

SEQ ID NO: 2277592 - RNA, 23 nt, Yersinia pestis
agaucacagacguuuaaauaagc

SEQ ID NO: 2277593 - RNA, 15 nt, Yersinia pestis
agaucaguucaguau

SEQ ID NO: 2277594 - RNA, 12 nt, Yersinia pestis
agaucagugcca

SEQ ID NO: 2277595 - RNA, 16 nt, Yersinia pestis
agaucagugccaguaa

SEQ ID NO: 2277596 - RNA, 17 nt, Yersinia pestis
agaucagugccaguaau

SEQ ID NO: 2277597 - RNA, 20 nt, Yersinia pestis
agaugcauauuugcagaaag

SEQ ID NO: 2277598 - RNA, 18 nt, Yersinia pestis
agaugccaaucaaaaaac

SEQ ID NO: 2277599 - RNA, 23 nt, Yersinia pestis
agaugccaaucaaaaaaccggcu

SEQ ID NO: 2277600 - RNA, 13 nt, Yersinia pestis
agaugccagacuu

SEQ ID NO: 2277601 - RNA, 20 nt, Yersinia pestis
agaugccuauuugcagaaag

SEQ ID NO: 2277602 - RNA, 13 nt, Yersinia pestis
agaugaucaaauu

SEQ ID NO: 2277603 - RNA, 12 nt, Yersinia pestis
agaugaacacag

SEQ ID NO: 2277604 - RNA, 16 nt, Yersinia pestis
agaugaacacagaaac

SEQ ID NO: 2277605 - RNA, 16 nt, Yersinia pestis
agaucuuuuucauucu

SEQ ID NO: 2277606 - RNA, 19 nt, Yersinia pestis
agaucucugcgacaucagc

SEQ ID NO: 2277607 - RNA, 19 nt, Yersinia pestis
agaucggggcgcuuaauuc

SEQ ID NO: 2277608 - RNA, 16 nt, Yersinia pestis
agaucggguaaaccaa

SEQ ID NO: 2277609 - RNA, 20 nt, Yersinia pestis
agaucgggucagguuucagu

SEQ ID NO: 2277610 - RNA, 16 nt, Yersinia pestis
agaucggcauuauuau

SEQ ID NO: 2277611 - RNA, 22 nt, Yersinia pestis
agaucggcauuauuaucuugau

SEQ ID NO: 2277612 - RNA, 14 nt, Yersinia pestis
agaucgcucucacc

SEQ ID NO: 2277613 - RNA, 21 nt, Yersinia pestis
agaucgcgaugcgccuguuag

SEQ ID NO: 2277614 - RNA, 23 nt, Yersinia pestis
agauccgugcgccugaacagccu

SEQ ID NO: 2277615 - RNA, 17 nt, Yersinia pestis
agauccaguucagucca

SEQ ID NO: 2277616 - RNA, 20 nt, Yersinia pestis
agauuggcagcguaaagguu

SEQ ID NO: 2277617 - RNA, 19 nt, Yersinia pestis
agauugccaaucagaacua

SEQ ID NO: 2277618 - RNA, 19 nt, Yersinia pestis
agauugccucauucgggca

SEQ ID NO: 2277619 - RNA, 16 nt, Yersinia pestis
agauugaucaguggcu

SEQ ID NO: 2277620 - RNA, 14 nt, Yersinia pestis
agauucaaguugca

SEQ ID NO: 2277621 - RNA, 12 nt, Yersinia pestis
agauucaccagu

SEQ ID NO: 2277622 - RNA, 14 nt, Yersinia pestis
agauuccuuaccug

SEQ ID NO: 2277623 - RNA, 22 nt, Yersinia pestis
agauuaguuuuagaugucagau

SEQ ID NO: 2277624 - RNA, 15 nt, Yersinia pestis
agauuagguuuuauu

SEQ ID NO: 2277625 - RNA, 22 nt, Yersinia pestis
agauuagagguuauugacaaag

SEQ ID NO: 2277626 - RNA, 23 nt, Yersinia pestis
agauuauuggcgauuuaauguau

SEQ ID NO: 2277627 - RNA, 15 nt, Yersinia pestis
agauuauuauuacua

SEQ ID NO: 2277628 - RNA, 16 nt, Yersinia pestis
agauuauuucagcuuc

SEQ ID NO: 2277629 - RNA, 17 nt, Yersinia pestis
agaugucccagaaauau

SEQ ID NO: 2277630 - RNA, 20 nt, Yersinia pestis
agauguauuaguuucaaaua

SEQ ID NO: 2277631 - RNA, 13 nt, Yersinia pestis
agaugucagauua

SEQ ID NO: 2277632 - RNA, 13 nt, Yersinia pestis
agauuaagacuuu

SEQ ID NO: 2277633 - RNA, 19 nt, Yersinia pestis
agauuacgcaucgucaguu

SEQ ID NO: 2277634 - RNA, 19 nt, Yersinia pestis
agauuaauacaucaucaaa

SEQ ID NO: 2277635 - RNA, 23 nt, Yersinia pestis
agauuaaaagucuaucucggccc

SEQ ID NO: 2277636 - RNA, 18 nt, Yersinia pestis
agauggcuuuggugauca

SEQ ID NO: 2277637 - RNA, 20 nt, Yersinia pestis
agaugggaagacagauccug

SEQ ID NO: 2277638 - RNA, 21 nt, Yersinia pestis
agauggcggucgcacugugag

SEQ ID NO: 2277639 - RNA, 21 nt, Yersinia pestis
agauggccagauucaccagua

SEQ ID NO: 2277640 - RNA, 16 nt, Yersinia pestis
agauggccccaauugu

SEQ ID NO: 2277641 - RNA, 13 nt, Yersinia pestis
agaugcugacccu

SEQ ID NO: 2277642 - RNA, 17 nt, Yersinia pestis
acucaagcguacaucag

SEQ ID NO: 2277643 - RNA, 18 nt, Yersinia pestis
acucaaccccagccggug

SEQ ID NO: 2277644 - RNA, 22 nt, Yersinia pestis
acucaaucuuugccuauuucag

SEQ ID NO: 2277645 - RNA, 16 nt, Yersinia pestis
acuccggcaggaugau

SEQ ID NO: 2277646 - RNA, 21 nt, Yersinia pestis
acucaauguaagcaucuuuuc

SEQ ID NO: 2277647 - RNA, 16 nt, Yersinia pestis
acucaaugucaugcaa

SEQ ID NO: 2277648 - RNA, 13 nt, Yersinia pestis
acuccucugccua

SEQ ID NO: 2277649 - RNA, 14 nt, Yersinia pestis
acuccucugccuau

SEQ ID NO: 2277650 - RNA, 19 nt, Yersinia pestis
acuccucugccuauccuca

SEQ ID NO: 2277651 - RNA, 13 nt, Yersinia pestis
acuccucuucuuc

SEQ ID NO: 2277652 - RNA, 21 nt, Yersinia pestis
acuccucuucuucgauuuuag

SEQ ID NO: 2277653 - RNA, 15 nt, Yersinia pestis
acuccucugccuauc

SEQ ID NO: 2277654 - RNA, 16 nt, Yersinia pestis
acuccucuuucuuaau

SEQ ID NO: 2277655 - RNA, 15 nt, Yersinia pestis
acuccugaaauaaag

SEQ ID NO: 2277656 - RNA, 18 nt, Yersinia pestis
acuccucuuucuuaauaa

SEQ ID NO: 2277657 - RNA, 13 nt, Yersinia pestis
acucgaauuauuu

SEQ ID NO: 2277658 - RNA, 23 nt, Yersinia pestis
acuccuucucgaugccuucuuuc

SEQ ID NO: 2277659 - RNA, 18 nt, Yersinia pestis
acuccuugaauagccaga

SEQ ID NO: 2277660 - RNA, 22 nt, Yersinia pestis
acuccuuggaacuuacucccuu

SEQ ID NO: 2277661 - RNA, 23 nt, Yersinia pestis
acucuaaggguaaaauccccauu

SEQ ID NO: 2277662 - RNA, 23 nt, Yersinia pestis
acucuaucagcgcccuacugcau

SEQ ID NO: 2277663 - RNA, 17 nt, Yersinia pestis
acucuagcgccagcaau

SEQ ID NO: 2277664 - RNA, 14 nt, Yersinia pestis
acucgauagaaaaa

SEQ ID NO: 2277665 - RNA, 12 nt, Yersinia pestis
acucgauaguga

SEQ ID NO: 2277666 - RNA, 12 nt, Yersinia pestis
acucgcuccgag

SEQ ID NO: 2277667 - RNA, 22 nt, Yersinia pestis
acucgcuuaacugugcagccca

SEQ ID NO: 2277668 - RNA, 23 nt, Yersinia pestis
acucggccaaacaaaguuaugcc

SEQ ID NO: 2277669 - RNA, 23 nt, Yersinia pestis
acucugcgcucauacucagucau

SEQ ID NO: 2277670 - RNA, 19 nt, Yersinia pestis
acucugcuaccaggaagcg

SEQ ID NO: 2277671 - RNA, 18 nt, Yersinia pestis
acucuggaauuaaaguau

SEQ ID NO: 2277672 - RNA, 19 nt, Yersinia pestis
acucuggauggguaaugca

SEQ ID NO: 2277673 - RNA, 18 nt, Yersinia pestis
acucugccagauagucau

SEQ ID NO: 2277674 - RNA, 21 nt, Yersinia pestis
acucugccagauagucaucuu

SEQ ID NO: 2277675 - RNA, 22 nt, Yersinia pestis
acucugccagauagucaucuuu

SEQ ID NO: 2277676 - RNA, 16 nt, Yersinia pestis
acucugaugaaaucgc

SEQ ID NO: 2277677 - RNA, 21 nt, Yersinia pestis
acucugaacccugcgauuuau

SEQ ID NO: 2277678 - RNA, 13 nt, Yersinia pestis
acucuggcacugg

SEQ ID NO: 2277679 - RNA, 23 nt, Yersinia pestis
acucuggggcaaucaauguauug

SEQ ID NO: 2277680 - RNA, 16 nt, Yersinia pestis
acucuggggcaaucaa

SEQ ID NO: 2277681 - RNA, 15 nt, Yersinia pestis
acucuguuaccaaug

SEQ ID NO: 2277682 - RNA, 21 nt, Yersinia pestis
acucugucugcuguugccaca

SEQ ID NO: 2277683 - RNA, 14 nt, Yersinia pestis
acucuguaccgccc

SEQ ID NO: 2277684 - RNA, 12 nt, Yersinia pestis
acucuguuuuaa

SEQ ID NO: 2277685 - RNA, 15 nt, Yersinia pestis
acucugucuggugcu

SEQ ID NO: 2277686 - RNA, 15 nt, Yersinia pestis
acucuuuuuaaacua

SEQ ID NO: 2277687 - RNA, 12 nt, Yersinia pestis
acucuuuuuaau

SEQ ID NO: 2277688 - RNA, 22 nt, Yersinia pestis
acugagauuugccaaacgugaa

SEQ ID NO: 2277689 - RNA, 13 nt, Yersinia pestis
acugagcaccgca

SEQ ID NO: 2277690 - RNA, 18 nt, Yersinia pestis
acugacuuagcucaucgu

SEQ ID NO: 2277691 - RNA, 23 nt, Yersinia pestis
acucuuuuuuauguuugauuacu

SEQ ID NO: 2277692 - RNA, 12 nt, Yersinia pestis
acugacugccau

SEQ ID NO: 2277693 - RNA, 18 nt, Yersinia pestis
acugaguugggccuugcu

SEQ ID NO: 2277694 - RNA, 16 nt, Yersinia pestis
acugaguucugcugcc

SEQ ID NO: 2277695 - RNA, 19 nt, Yersinia pestis
acugaggcaacauuuguug

SEQ ID NO: 2277696 - RNA, 13 nt, Yersinia pestis
acugaguaugagc

SEQ ID NO: 2277697 - RNA, 22 nt, Yersinia pestis
acugaucaauaucccgagaaac

SEQ ID NO: 2277698 - RNA, 20 nt, Yersinia pestis
acugauauagccuucuucac

SEQ ID NO: 2277699 - RNA, 17 nt, Yersinia pestis
acugauaucuucacuca

SEQ ID NO: 2277700 - RNA, 16 nt, Yersinia pestis
acugauagcaauccca

SEQ ID NO: 2277701 - RNA, 16 nt, Yersinia pestis
acugauucagaaaggu

SEQ ID NO: 2277702 - RNA, 20 nt, Yersinia pestis
acugauuauuuggugaguaa

SEQ ID NO: 2277703 - RNA, 15 nt, Yersinia pestis
acugaugcuuggccc

SEQ ID NO: 2277704 - RNA, 14 nt, Yersinia pestis
acugaucacuggca

SEQ ID NO: 2277705 - RNA, 20 nt, Yersinia pestis
acugaucacuggcauugcau

SEQ ID NO: 2277706 - RNA, 16 nt, Yersinia pestis
acugauugaccaucaa

SEQ ID NO: 2277707 - RNA, 16 nt, Yersinia pestis
acugauuggauaaaau

SEQ ID NO: 2277708 - RNA, 17 nt, Yersinia pestis
acugauuggauaaaaua

SEQ ID NO: 2277709 - RNA, 15 nt, Yersinia pestis
acugcaaacgagagu

SEQ ID NO: 2277710 - RNA, 21 nt, Yersinia pestis
acugcaagccguaauucagau

SEQ ID NO: 2277711 - RNA, 13 nt, Yersinia pestis
acugccauacauc

SEQ ID NO: 2277712 - RNA, 13 nt, Yersinia pestis
acugcccgccugc

SEQ ID NO: 2277713 - RNA, 18 nt, Yersinia pestis
acugccccgaagcucaag

SEQ ID NO: 2277714 - RNA, 20 nt, Yersinia pestis
acugccccgaagcucaagcu

SEQ ID NO: 2277715 - RNA, 21 nt, Yersinia pestis
acugcagaaaaugcggcggcu

SEQ ID NO: 2277716 - RNA, 15 nt, Yersinia pestis
acugccaaucgcucu

SEQ ID NO: 2277717 - RNA, 13 nt, Yersinia pestis
acugcauagcuaa

SEQ ID NO: 2277718 - RNA, 12 nt, Yersinia pestis
acugcaucaaua

SEQ ID NO: 2277719 - RNA, 20 nt, Yersinia pestis
acugcaucagcgacgcuaaa

SEQ ID NO: 2277720 - RNA, 13 nt, Yersinia pestis
acugccugcagca

SEQ ID NO: 2277721 - RNA, 18 nt, Yersinia pestis
acugcgaccaaaagccac

SEQ ID NO: 2277722 - RNA, 17 nt, Yersinia pestis
acuguguuuauaccaaa

SEQ ID NO: 2277723 - RNA, 20 nt, Yersinia pestis
acugucuauuuuuauaauca

SEQ ID NO: 2277724 - RNA, 12 nt, Yersinia pestis
acuguuaucacu

SEQ ID NO: 2277725 - RNA, 15 nt, Yersinia pestis
acuguucaccgccuu

SEQ ID NO: 2277726 - RNA, 17 nt, Yersinia pestis
acugucgcauaagacaa

SEQ ID NO: 2277727 - RNA, 15 nt, Yersinia pestis
acugguugaaaccuc

SEQ ID NO: 2277728 - RNA, 20 nt, Yersinia pestis
acugguugaaaccucaucau

SEQ ID NO: 2277729 - RNA, 13 nt, Yersinia pestis
acuguaaaaucuu

SEQ ID NO: 2277730 - RNA, 16 nt, Yersinia pestis
acuguuuuauuauaua

SEQ ID NO: 2277731 - RNA, 14 nt, Yersinia pestis
acuuaaaaaucaaa

SEQ ID NO: 2277732 - RNA, 21 nt, Yersinia pestis
acuguuuuuuaaagaaaaaac

SEQ ID NO: 2277733 - RNA, 19 nt, Yersinia pestis
acuuaaaaaucaaaaguua

SEQ ID NO: 2277734 - RNA, 16 nt, Yersinia pestis
acuuagcucaaucggc

SEQ ID NO: 2277735 - RNA, 20 nt, Yersinia pestis
acuuagcacggcaucgcugc

SEQ ID NO: 2277736 - RNA, 22 nt, Yersinia pestis
acuuagguucaaucggcagugc

SEQ ID NO: 2277737 - RNA, 19 nt, Yersinia pestis
acuuagugcuggccuaggc

SEQ ID NO: 2277738 - RNA, 22 nt, Yersinia pestis
acuuaauaaugaccacgcauca

SEQ ID NO: 2277739 - RNA, 17 nt, Yersinia pestis
acuuaagucaaauuuaa

SEQ ID NO: 2277740 - RNA, 15 nt, Yersinia pestis
acuucaaucacuuua

SEQ ID NO: 2277741 - RNA, 19 nt, Yersinia pestis
acuucaauaccaaauuuac

SEQ ID NO: 2277742 - RNA, 21 nt, Yersinia pestis
acuucaauuuggccauuaacc

SEQ ID NO: 2277743 - RNA, 23 nt, Yersinia pestis
acuucaauuuggccauuaaccua

SEQ ID NO: 2277744 - RNA, 18 nt, Yersinia pestis
acuucaauuugguaauuu

SEQ ID NO: 2277745 - RNA, 17 nt, Yersinia pestis
acuucacaaugcacagu

SEQ ID NO: 2277746 - RNA, 16 nt, Yersinia pestis
acuuaucgacaccaau

SEQ ID NO: 2277747 - RNA, 22 nt, Yersinia pestis
acuuaucugagccuucaacaaa

SEQ ID NO: 2277748 - RNA, 16 nt, Yersinia pestis
acuuaucuaaaaaacc

SEQ ID NO: 2277749 - RNA, 16 nt, Yersinia pestis
acuuaucgguuuuuug

SEQ ID NO: 2277750 - RNA, 20 nt, Yersinia pestis
acuuaucgguuuuuuggagc

SEQ ID NO: 2277751 - RNA, 14 nt, Yersinia pestis
acuucaggccaaua

SEQ ID NO: 2277752 - RNA, 20 nt, Yersinia pestis
acuuccgccgccaacaguga

SEQ ID NO: 2277753 - RNA, 20 nt, Yersinia pestis
acugcucgcccaagcggcug

SEQ ID NO: 2277754 - RNA, 13 nt, Yersinia pestis
acugcugacaacc

SEQ ID NO: 2277755 - RNA, 21 nt, Yersinia pestis
acugcugcaacucauuaacaa

SEQ ID NO: 2277756 - RNA, 16 nt, Yersinia pestis
acugcgguccuacccu

SEQ ID NO: 2277757 - RNA, 13 nt, Yersinia pestis
acugcucaacugc

SEQ ID NO: 2277758 - RNA, 21 nt, Yersinia pestis
acugcucaacugcucaacugc

SEQ ID NO: 2277759 - RNA, 12 nt, Yersinia pestis
acugcuggccaa

SEQ ID NO: 2277760 - RNA, 12 nt, Yersinia pestis
acugcugggcug

SEQ ID NO: 2277761 - RNA, 15 nt, Yersinia pestis
acugcuuuucacauu

SEQ ID NO: 2277762 - RNA, 12 nt, Yersinia pestis
acugcuuuucua

SEQ ID NO: 2277763 - RNA, 15 nt, Yersinia pestis
acuggauauuuuccc

SEQ ID NO: 2277764 - RNA, 18 nt, Yersinia pestis
acuggaucacaaugcaaa

SEQ ID NO: 2277765 - RNA, 21 nt, Yersinia pestis
acuggaauauggguaaauaca

SEQ ID NO: 2277766 - RNA, 22 nt, Yersinia pestis
acuggaagccgacgaucuugcc

SEQ ID NO: 2277767 - RNA, 13 nt, Yersinia pestis
acugcuuuuuaca

SEQ ID NO: 2277768 - RNA, 14 nt, Yersinia pestis
acugcuuuuuacac

SEQ ID NO: 2277769 - RNA, 22 nt, Yersinia pestis
acugcuuuuuauugucucuacu

SEQ ID NO: 2277770 - RNA, 21 nt, Yersinia pestis
acugggucaucacccagcaaa

SEQ ID NO: 2277771 - RNA, 15 nt, Yersinia pestis
acugggauauucugg

SEQ ID NO: 2277772 - RNA, 22 nt, Yersinia pestis
acugggaugaagaaauaccuga

SEQ ID NO: 2277773 - RNA, 16 nt, Yersinia pestis
acuggcugaaguuaau

SEQ ID NO: 2277774 - RNA, 19 nt, Yersinia pestis
acuggcucucaaaagauaa

SEQ ID NO: 2277775 - RNA, 15 nt, Yersinia pestis
acuggcuuuauuaua

SEQ ID NO: 2277776 - RNA, 22 nt, Yersinia pestis
acuggguuuaaagguggcuggu

SEQ ID NO: 2277777 - RNA, 16 nt, Yersinia pestis
acugguaauaaugcug

SEQ ID NO: 2277778 - RNA, 16 nt, Yersinia pestis
acugguaccaaacaac

SEQ ID NO: 2277779 - RNA, 23 nt, Yersinia pestis
acugguacggcgcaucgccaucc

SEQ ID NO: 2277780 - RNA, 22 nt, Yersinia pestis
acugguccaacuaaacagggca

SEQ ID NO: 2277781 - RNA, 19 nt, Yersinia pestis
acuggccuauuaagauaau

SEQ ID NO: 2277782 - RNA, 20 nt, Yersinia pestis
acuggccuauuaagauaauu

SEQ ID NO: 2277783 - RNA, 14 nt, Yersinia pestis
acuggccgcaggcg

SEQ ID NO: 2277784 - RNA, 23 nt, Yersinia pestis
acuggcuagauagccauaauaau

SEQ ID NO: 2277785 - RNA, 18 nt, Yersinia pestis
acuggcgcgggaaaaacc

SEQ ID NO: 2277786 - RNA, 15 nt, Yersinia pestis
acuggcgggccguuu

SEQ ID NO: 2277787 - RNA, 12 nt, Yersinia pestis
acuggcaccgcu

SEQ ID NO: 2277788 - RNA, 16 nt, Yersinia pestis
acuggcagggaaaggu

SEQ ID NO: 2277789 - RNA, 13 nt, Yersinia pestis
acuggccaugugu

SEQ ID NO: 2277790 - RNA, 21 nt, Yersinia pestis
acuggcaaaaaaacgccucca

SEQ ID NO: 2277791 - RNA, 20 nt, Yersinia pestis
acuggcaauaauucagauga

SEQ ID NO: 2277792 - RNA, 16 nt, Yersinia pestis
acgucucuuccagugg

SEQ ID NO: 2277793 - RNA, 16 nt, Yersinia pestis
acgucugcaauagcuc

SEQ ID NO: 2277794 - RNA, 19 nt, Yersinia pestis
acgugccccaaugaugacu

SEQ ID NO: 2277795 - RNA, 13 nt, Yersinia pestis
acgucugaaaaac

SEQ ID NO: 2277796 - RNA, 16 nt, Yersinia pestis
acguacauauaucacu

SEQ ID NO: 2277797 - RNA, 17 nt, Yersinia pestis
acguuaugaauaaacca

SEQ ID NO: 2277798 - RNA, 23 nt, Yersinia pestis
acguuaugaauaaaccagcaagc

SEQ ID NO: 2277799 - RNA, 12 nt, Yersinia pestis
acguucaccaaa

SEQ ID NO: 2277800 - RNA, 21 nt, Yersinia pestis
acguuggccuuucaccgguuc

SEQ ID NO: 2277801 - RNA, 18 nt, Yersinia pestis
acguuuccccuucauuug

SEQ ID NO: 2277802 - RNA, 21 nt, Yersinia pestis
acguuuauuuauaagaacaac

SEQ ID NO: 2277803 - RNA, 15 nt, Yersinia pestis
acguuuccaaaacuc

SEQ ID NO: 2277804 - RNA, 15 nt, Yersinia pestis
acguuuaccggcaac

SEQ ID NO: 2277805 - RNA, 19 nt, Yersinia pestis
acguuguuucugaagggca

SEQ ID NO: 2277806 - RNA, 21 nt, Yersinia pestis
acguuguuaucaucaccaccc

SEQ ID NO: 2277807 - RNA, 19 nt, Yersinia pestis
acguugggcggucaucagc

SEQ ID NO: 2277808 - RNA, 16 nt, Yersinia pestis
acuaaaauucaaacaa

SEQ ID NO: 2277809 - RNA, 17 nt, Yersinia pestis
acuaaaauucaaacaaa

SEQ ID NO: 2277810 - RNA, 17 nt, Yersinia pestis
acuaaaaucugcucccg

SEQ ID NO: 2277811 - RNA, 16 nt, Yersinia pestis
acuaaacagaucaccc

SEQ ID NO: 2277812 - RNA, 15 nt, Yersinia pestis
acuaaaccacauaac

SEQ ID NO: 2277813 - RNA, 17 nt, Yersinia pestis
acuaccgcucagauaaa

SEQ ID NO: 2277814 - RNA, 15 nt, Yersinia pestis
acuaccgaucaucag

SEQ ID NO: 2277815 - RNA, 18 nt, Yersinia pestis
acuaccccacauucagua

SEQ ID NO: 2277816 - RNA, 22 nt, Yersinia pestis
acuaccuuuugcauauuucucu

SEQ ID NO: 2277817 - RNA, 18 nt, Yersinia pestis
acuaccuugcuccgcaau

SEQ ID NO: 2277818 - RNA, 14 nt, Yersinia pestis
acuaguuaaaacca

SEQ ID NO: 2277819 - RNA, 14 nt, Yersinia pestis
acuacuugguuuaa

SEQ ID NO: 2277820 - RNA, 19 nt, Yersinia pestis
acuaaagaaauaaucauau

SEQ ID NO: 2277821 - RNA, 21 nt, Yersinia pestis
acuaaugccucacggcuacca

SEQ ID NO: 2277822 - RNA, 18 nt, Yersinia pestis
acuaauggccagacacug

SEQ ID NO: 2277823 - RNA, 19 nt, Yersinia pestis
acuaauggccagacacuga

SEQ ID NO: 2277824 - RNA, 19 nt, Yersinia pestis
acuaauguuuguuucucug

SEQ ID NO: 2277825 - RNA, 13 nt, Yersinia pestis
acuacaucgaguu

SEQ ID NO: 2277826 - RNA, 22 nt, Yersinia pestis
acuaccaaauaaauauccuccg

SEQ ID NO: 2277827 - RNA, 22 nt, Yersinia pestis
acuaauggguuagcgguuaaaa

SEQ ID NO: 2277828 - RNA, 15 nt, Yersinia pestis
acuaauuaauaacca

SEQ ID NO: 2277829 - RNA, 14 nt, Yersinia pestis
acuauuaacucuuu

SEQ ID NO: 2277830 - RNA, 15 nt, Yersinia pestis
acuauuaauuuuauu

SEQ ID NO: 2277831 - RNA, 16 nt, Yersinia pestis
acuaucccuucaauca

SEQ ID NO: 2277832 - RNA, 20 nt, Yersinia pestis
acuaucacaucaaauuuuug

SEQ ID NO: 2277833 - RNA, 18 nt, Yersinia pestis
acuauaagcgcucaaaua

SEQ ID NO: 2277834 - RNA, 20 nt, Yersinia pestis
acuauugcaucuuuaauuaa

SEQ ID NO: 2277835 - RNA, 22 nt, Yersinia pestis
acuauuuacauaauaaccauuu

SEQ ID NO: 2277836 - RNA, 22 nt, Yersinia pestis
acuauuuauuaaucuauuaaua

SEQ ID NO: 2277837 - RNA, 19 nt, Yersinia pestis
acuauuuguaguuuuucau

SEQ ID NO: 2277838 - RNA, 16 nt, Yersinia pestis
acuauucucgaaaaag

SEQ ID NO: 2277839 - RNA, 17 nt, Yersinia pestis
acuauucucgaaaaaga

SEQ ID NO: 2277840 - RNA, 19 nt, Yersinia pestis
acuauucucgaaaaagaga

SEQ ID NO: 2277841 - RNA, 19 nt, Yersinia pestis
acuauucugccuauccuca

SEQ ID NO: 2277842 - RNA, 18 nt, Yersinia pestis
acuauucaucccuaaaau

SEQ ID NO: 2277843 - RNA, 20 nt, Yersinia pestis
acuauucccauggugauaaa

SEQ ID NO: 2277844 - RNA, 19 nt, Yersinia pestis
acuauucaaugacuccuga

SEQ ID NO: 2277845 - RNA, 17 nt, Yersinia pestis
acuauugcaucuuuaau

SEQ ID NO: 2277846 - RNA, 18 nt, Yersinia pestis
acuauuggucaaucuaga

SEQ ID NO: 2277847 - RNA, 12 nt, Yersinia pestis
acucaaaacaau

SEQ ID NO: 2277848 - RNA, 13 nt, Yersinia pestis
acucaaaacaauu

SEQ ID NO: 2277849 - RNA, 14 nt, Yersinia pestis
acuauuuuucucaa

SEQ ID NO: 2277850 - RNA, 17 nt, Yersinia pestis
acuauuuuugacuuuaa

SEQ ID NO: 2277851 - RNA, 15 nt, Yersinia pestis
acucaaaauacuuaa

SEQ ID NO: 2277852 - RNA, 18 nt, Yersinia pestis
acgguggguacuccucgc

SEQ ID NO: 2277853 - RNA, 16 nt, Yersinia pestis
acggugagaauaaaua

SEQ ID NO: 2277854 - RNA, 16 nt, Yersinia pestis
acggugccagcagcaa

SEQ ID NO: 2277855 - RNA, 23 nt, Yersinia pestis
acggucauucacuguggcggcca

SEQ ID NO: 2277856 - RNA, 13 nt, Yersinia pestis
acggucucuuucg

SEQ ID NO: 2277857 - RNA, 13 nt, Yersinia pestis
acguaauaccacu

SEQ ID NO: 2277858 - RNA, 13 nt, Yersinia pestis
acguaauacccuc

SEQ ID NO: 2277859 - RNA, 20 nt, Yersinia pestis
acguaacgaauucagcagcg

SEQ ID NO: 2277860 - RNA, 21 nt, Yersinia pestis
acgguguuuggugaagaaacc

SEQ ID NO: 2277861 - RNA, 13 nt, Yersinia pestis
acgguucaucauu

SEQ ID NO: 2277862 - RNA, 18 nt, Yersinia pestis
acgguuuuaaucuccugg

SEQ ID NO: 2277863 - RNA, 18 nt, Yersinia pestis
acgguaucugcuuuauca

SEQ ID NO: 2277864 - RNA, 22 nt, Yersinia pestis
acgguagugacucaucaaaaca

SEQ ID NO: 2277865 - RNA, 14 nt, Yersinia pestis
acgguaaucugaga

SEQ ID NO: 2277866 - RNA, 13 nt, Yersinia pestis
acgggucacagcc

SEQ ID NO: 2277867 - RNA, 13 nt, Yersinia pestis
acgggucagcuga

SEQ ID NO: 2277868 - RNA, 14 nt, Yersinia pestis
acgggucagcugac

SEQ ID NO: 2277869 - RNA, 16 nt, Yersinia pestis
acgguaaccauccaua

SEQ ID NO: 2277870 - RNA, 21 nt, Yersinia pestis
acgguaaacgcaucccaggca

SEQ ID NO: 2277871 - RNA, 23 nt, Yersinia pestis
acgguaaacgcaucccaggcauc

SEQ ID NO: 2277872 - RNA, 18 nt, Yersinia pestis
acgggcuuccaucaggaa

SEQ ID NO: 2277873 - RNA, 22 nt, Yersinia pestis
acggggaaacaguaaauuauuu

SEQ ID NO: 2277874 - RNA, 16 nt, Yersinia pestis
acggcggcgagcacug

SEQ ID NO: 2277875 - RNA, 20 nt, Yersinia pestis
acgcugguguaacggcugcu

SEQ ID NO: 2277876 - RNA, 17 nt, Yersinia pestis
acgcugguuaucacagc

SEQ ID NO: 2277877 - RNA, 14 nt, Yersinia pestis
acgcaauuuuaugg

SEQ ID NO: 2277878 - RNA, 16 nt, Yersinia pestis
acgcaauugcaccgcg

SEQ ID NO: 2277879 - RNA, 14 nt, Yersinia pestis
acgcaaguaaaagu

SEQ ID NO: 2277880 - RNA, 16 nt, Yersinia pestis
acgcaaguaaaaguca

SEQ ID NO: 2277881 - RNA, 17 nt, Yersinia pestis
acgcaagcgggccaagg

SEQ ID NO: 2277882 - RNA, 11 nt, Yersinia pestis
acgcaaguaaa

SEQ ID NO: 2277883 - RNA, 15 nt, Yersinia pestis
acgcuuuugcugcaa

SEQ ID NO: 2277884 - RNA, 14 nt, Yersinia pestis
acggaacucaucuu

SEQ ID NO: 2277885 - RNA, 19 nt, Yersinia pestis
acggccuguaccaccacca

SEQ ID NO: 2277886 - RNA, 21 nt, Yersinia pestis
acggccaucaauaaagcuggc

SEQ ID NO: 2277887 - RNA, 21 nt, Yersinia pestis
acggccauuucuuagaccacc

SEQ ID NO: 2277888 - RNA, 22 nt, Yersinia pestis
acggaugaaaagugauccacuu

SEQ ID NO: 2277889 - RNA, 20 nt, Yersinia pestis
acggcaacuucuacauagaa

SEQ ID NO: 2277890 - RNA, 14 nt, Yersinia pestis
acggcaaugaccau

SEQ ID NO: 2277891 - RNA, 20 nt, Yersinia pestis
acggccagagccaccagaau

SEQ ID NO: 2277892 - RNA, 22 nt, Yersinia pestis
acggccagcaaccuggcggccc

SEQ ID NO: 2277893 - RNA, 16 nt, Yersinia pestis
acggccaacugcuggc

SEQ ID NO: 2277894 - RNA, 19 nt, Yersinia pestis
acggccaacugcuggccaa

SEQ ID NO: 2277895 - RNA, 15 nt, Yersinia pestis
aggucaggaagagaa

SEQ ID NO: 2277896 - RNA, 16 nt, Yersinia pestis
aggucaucccagcaca

SEQ ID NO: 2277897 - RNA, 16 nt, Yersinia pestis
agguccagauuucgcc

SEQ ID NO: 2277898 - RNA, 23 nt, Yersinia pestis
aggucucgcaaugaaaguggcca

SEQ ID NO: 2277899 - RNA, 14 nt, Yersinia pestis
aggugaaaauaaua

SEQ ID NO: 2277900 - RNA, 17 nt, Yersinia pestis
aggucuuucgcccacaa

SEQ ID NO: 2277901 - RNA, 20 nt, Yersinia pestis
aggucuuucgcccacaacca

SEQ ID NO: 2277902 - RNA, 13 nt, Yersinia pestis
aggugcuuauuua

SEQ ID NO: 2277903 - RNA, 20 nt, Yersinia pestis
aggugcuuauuuauuuuuaa

SEQ ID NO: 2277904 - RNA, 22 nt, Yersinia pestis
aggugccuuuuaacguuagagc

SEQ ID NO: 2277905 - RNA, 17 nt, Yersinia pestis
agguggguacugauaaa

SEQ ID NO: 2277906 - RNA, 19 nt, Yersinia pestis
agguggccauuacgccacc

SEQ ID NO: 2277907 - RNA, 21 nt, Yersinia pestis
agguggcgauaaagagugaaa

SEQ ID NO: 2277908 - RNA, 13 nt, Yersinia pestis
aggugauuucaaa

SEQ ID NO: 2277909 - RNA, 16 nt, Yersinia pestis
aggugaugucagccgu

SEQ ID NO: 2277910 - RNA, 13 nt, Yersinia pestis
aggugcaguaacc

SEQ ID NO: 2277911 - RNA, 23 nt, Yersinia pestis
aggugccacacagaaucaccaac

SEQ ID NO: 2277912 - RNA, 20 nt, Yersinia pestis
aggugauacaucaaaucaga

SEQ ID NO: 2277913 - RNA, 16 nt, Yersinia pestis
aggugacaggcaaaga

SEQ ID NO: 2277914 - RNA, 16 nt, Yersinia pestis
aggucaaucuuauuga

SEQ ID NO: 2277915 - RNA, 23 nt, Yersinia pestis
agguauuucuccauugcgguuca

SEQ ID NO: 2277916 - RNA, 18 nt, Yersinia pestis
aggucacuguuucgccuu

SEQ ID NO: 2277917 - RNA, 19 nt, Yersinia pestis
agguaucauuuuccugcau

SEQ ID NO: 2277918 - RNA, 19 nt, Yersinia pestis
agguauacaccucaacgug

SEQ ID NO: 2277919 - RNA, 18 nt, Yersinia pestis
agguaauauugaagacaa

SEQ ID NO: 2277920 - RNA, 20 nt, Yersinia pestis
agguaaucagacugcugaca

SEQ ID NO: 2277921 - RNA, 19 nt, Yersinia pestis
agguaaugcauucugcugg

SEQ ID NO: 2277922 - RNA, 16 nt, Yersinia pestis
agguaaugucacugcc

SEQ ID NO: 2277923 - RNA, 17 nt, Yersinia pestis
agguaaugguaaaaaau

SEQ ID NO: 2277924 - RNA, 22 nt, Yersinia pestis
agguaccgcugcccggcucauc

SEQ ID NO: 2277925 - RNA, 18 nt, Yersinia pestis
agguaccugaucagcauu

SEQ ID NO: 2277926 - RNA, 13 nt, Yersinia pestis
agguaauuuauag

SEQ ID NO: 2277927 - RNA, 23 nt, Yersinia pestis
aggguguggcgaaaaccccaccc

SEQ ID NO: 2277928 - RNA, 19 nt, Yersinia pestis
aggguggucaacugugcca

SEQ ID NO: 2277929 - RNA, 21 nt, Yersinia pestis
agggugggauauuaauuccac

SEQ ID NO: 2277930 - RNA, 14 nt, Yersinia pestis
aggguauugaagau

SEQ ID NO: 2277931 - RNA, 13 nt, Yersinia pestis
aggguauaugccu

SEQ ID NO: 2277932 - RNA, 17 nt, Yersinia pestis
aggguauugaagauacc

SEQ ID NO: 2277933 - RNA, 17 nt, Yersinia pestis
agggugaaagcccaacu

SEQ ID NO: 2277934 - RNA, 20 nt, Yersinia pestis
aggguucaagucccucccuu

SEQ ID NO: 2277935 - RNA, 17 nt, Yersinia pestis
aggguucaguaaaacca

SEQ ID NO: 2277936 - RNA, 17 nt, Yersinia pestis
aggguuucuccacagug

SEQ ID NO: 2277937 - RNA, 20 nt, Yersinia pestis
aggguugcgggccucuucuu

SEQ ID NO: 2277938 - RNA, 14 nt, Yersinia pestis
agguaaaaaagaau

SEQ ID NO: 2277939 - RNA, 16 nt, Yersinia pestis
aggguuuugaaaucau

SEQ ID NO: 2277940 - RNA, 18 nt, Yersinia pestis
aggguuuugugggagagg

SEQ ID NO: 2277941 - RNA, 15 nt, Yersinia pestis
agguaaauagccaaa

SEQ ID NO: 2277942 - RNA, 16 nt, Yersinia pestis
agguaaauccuucugg

SEQ ID NO: 2277943 - RNA, 20 nt, Yersinia pestis
agguaagccuuucuccacau

SEQ ID NO: 2277944 - RNA, 15 nt, Yersinia pestis
agguaauaccaaugc

SEQ ID NO: 2277945 - RNA, 19 nt, Yersinia pestis
agguaauacucauccagau

SEQ ID NO: 2277946 - RNA, 13 nt, Yersinia pestis
aguaaauagcaaa

SEQ ID NO: 2277947 - RNA, 13 nt, Yersinia pestis
aguaaauauaauu

SEQ ID NO: 2277948 - RNA, 18 nt, Yersinia pestis
aguaaauauaauuucaaa

SEQ ID NO: 2277949 - RNA, 20 nt, Yersinia pestis
aguaaagcaaauucccacca

SEQ ID NO: 2277950 - RNA, 21 nt, Yersinia pestis
aguaaacaccuucagacugac

SEQ ID NO: 2277951 - RNA, 12 nt, Yersinia pestis
aguaaacagcca

SEQ ID NO: 2277952 - RNA, 16 nt, Yersinia pestis
aguaaaaucaucagcc

SEQ ID NO: 2277953 - RNA, 17 nt, Yersinia pestis
aguaaaacugauauaaa

SEQ ID NO: 2277954 - RNA, 18 nt, Yersinia pestis
aguaaaagauucauaaaa

SEQ ID NO: 2277955 - RNA, 15 nt, Yersinia pestis
agguuugcuccaccg

SEQ ID NO: 2277956 - RNA, 23 nt, Yersinia pestis
agguuuuucauaugcgccuauaa

SEQ ID NO: 2277957 - RNA, 12 nt, Yersinia pestis
agguuuucugcg

SEQ ID NO: 2277958 - RNA, 17 nt, Yersinia pestis
agguuguauuuugcagg

SEQ ID NO: 2277959 - RNA, 17 nt, Yersinia pestis
agguuguccgaagagaa

SEQ ID NO: 2277960 - RNA, 13 nt, Yersinia pestis
agguuucacccgg

SEQ ID NO: 2277961 - RNA, 15 nt, Yersinia pestis
agguuucagccucug

SEQ ID NO: 2277962 - RNA, 18 nt, Yersinia pestis
agguuggggaugccauuu

SEQ ID NO: 2277963 - RNA, 15 nt, Yersinia pestis
agguugaaauaaaua

SEQ ID NO: 2277964 - RNA, 18 nt, Yersinia pestis
agguucggcgcaaucaua

SEQ ID NO: 2277965 - RNA, 18 nt, Yersinia pestis
agguucuccaggguuucu

SEQ ID NO: 2277966 - RNA, 18 nt, Yersinia pestis
agguucauuacacagcau

SEQ ID NO: 2277967 - RNA, 14 nt, Yersinia pestis
agguucaauucccg

SEQ ID NO: 2277968 - RNA, 15 nt, Yersinia pestis
agguuagcuaugcag

SEQ ID NO: 2277969 - RNA, 16 nt, Yersinia pestis
agguuauugacaaaga

SEQ ID NO: 2277970 - RNA, 23 nt, Yersinia pestis
agguuauugacaaagagcccgca

SEQ ID NO: 2277971 - RNA, 20 nt, Yersinia pestis
agguuaaauucacuuucccc

SEQ ID NO: 2277972 - RNA, 16 nt, Yersinia pestis
agguuaacugcaguga

SEQ ID NO: 2277973 - RNA, 14 nt, Yersinia pestis
agguuacugcccug

SEQ ID NO: 2277974 - RNA, 14 nt, Yersinia pestis
agguuagaaaacag

SEQ ID NO: 2277975 - RNA, 20 nt, Yersinia pestis
agguguuacaacaugaaagg

SEQ ID NO: 2277976 - RNA, 18 nt, Yersinia pestis
agguuaaaguugauaaag

SEQ ID NO: 2277977 - RNA, 17 nt, Yersinia pestis
agguguuucgugccgca

SEQ ID NO: 2277978 - RNA, 18 nt, Yersinia pestis
aggugugcggauggcugc

SEQ ID NO: 2277979 - RNA, 13 nt, Yersinia pestis
aguaauucacccu

SEQ ID NO: 2277980 - RNA, 19 nt, Yersinia pestis
aguaauuucagauaaaaau

SEQ ID NO: 2277981 - RNA, 22 nt, Yersinia pestis
aguaauuucagauaaaaauaau

SEQ ID NO: 2277982 - RNA, 23 nt, Yersinia pestis
aguaaucgccugcugagccaaau

SEQ ID NO: 2277983 - RNA, 19 nt, Yersinia pestis
aguaaugaggcuaccugca

SEQ ID NO: 2277984 - RNA, 23 nt, Yersinia pestis
aguaaugaggcuaccugcaccaa

SEQ ID NO: 2277985 - RNA, 11 nt, Yersinia pestis
aguaaucagag

SEQ ID NO: 2277986 - RNA, 15 nt, Yersinia pestis
aguaauauuauucaa

SEQ ID NO: 2277987 - RNA, 17 nt, Yersinia pestis
aguaauauuauucaauu

SEQ ID NO: 2277988 - RNA, 20 nt, Yersinia pestis
aguacaaggggcaucugcug

SEQ ID NO: 2277989 - RNA, 14 nt, Yersinia pestis
aguacagaauuuca

SEQ ID NO: 2277990 - RNA, 16 nt, Yersinia pestis
aguacagaauuucauu

SEQ ID NO: 2277991 - RNA, 20 nt, Yersinia pestis
aguacagugaaaaugguuuc

SEQ ID NO: 2277992 - RNA, 18 nt, Yersinia pestis
aguaagugauucggguga

SEQ ID NO: 2277993 - RNA, 13 nt, Yersinia pestis
aguaauagcaaaa

SEQ ID NO: 2277994 - RNA, 19 nt, Yersinia pestis
aguaauagcaaaaaaaaag

SEQ ID NO: 2277995 - RNA, 16 nt, Yersinia pestis
aguaagcguuuacucg

SEQ ID NO: 2277996 - RNA, 21 nt, Yersinia pestis
aguaagcgcggucauauccua

SEQ ID NO: 2277997 - RNA, 23 nt, Yersinia pestis
aguaagguauugauacaguaagg

SEQ ID NO: 2277998 - RNA, 15 nt, Yersinia pestis
aguaaggugccgcuu

SEQ ID NO: 2277999 - RNA, 16 nt, Yersinia pestis
aguaaguaaaaaggau

SEQ ID NO: 2278000 - RNA, 13 nt, Yersinia pestis
aguaagaugucau

SEQ ID NO: 2278001 - RNA, 23 nt, Yersinia pestis
aguaacuugccguaaaauuuaaa

SEQ ID NO: 2278002 - RNA, 17 nt, Yersinia pestis
aguaaauuaaauuuuaa

SEQ ID NO: 2278003 - RNA, 21 nt, Yersinia pestis
aguaacacuucagacugaaag

SEQ ID NO: 2278004 - RNA, 17 nt, Yersinia pestis
aguaacaccagcauccu

SEQ ID NO: 2278005 - RNA, 20 nt, Yersinia pestis
aguaacaccagcauccugca

SEQ ID NO: 2278006 - RNA, 22 nt, Yersinia pestis
aguaacaaaaugcgguggcacu

SEQ ID NO: 2278007 - RNA, 12 nt, Yersinia pestis
aguaacaaaugg

SEQ ID NO: 2278008 - RNA, 21 nt, Yersinia pestis
aguaacauuuguauuuuuucu

SEQ ID NO: 2278009 - RNA, 21 nt, Yersinia pestis
aguaaccgggcuugauuaaau

SEQ ID NO: 2278010 - RNA, 14 nt, Yersinia pestis
aguaacguccaacu

SEQ ID NO: 2278011 - RNA, 15 nt, Yersinia pestis
aguaacugaucaaua

SEQ ID NO: 2278012 - RNA, 15 nt, Yersinia pestis
aggccuucugggccg

SEQ ID NO: 2278013 - RNA, 22 nt, Yersinia pestis
aggccuuuuucuguaggaaaau

SEQ ID NO: 2278014 - RNA, 17 nt, Yersinia pestis
aggcgaauaugauuaau

SEQ ID NO: 2278015 - RNA, 15 nt, Yersinia pestis
aggcgaguuucccuu

SEQ ID NO: 2278016 - RNA, 22 nt, Yersinia pestis
aggcgaguuucccuuuuccauc

SEQ ID NO: 2278017 - RNA, 17 nt, Yersinia pestis
aggcgaugcaaggaagu

SEQ ID NO: 2278018 - RNA, 20 nt, Yersinia pestis
aggcgaucccgguauaagua

SEQ ID NO: 2278019 - RNA, 13 nt, Yersinia pestis
aggcgaucugggc

SEQ ID NO: 2278020 - RNA, 15 nt, Yersinia pestis
aggcgaucugggcug

SEQ ID NO: 2278021 - RNA, 20 nt, Yersinia pestis
aggcgcaucgcgaucugaca

SEQ ID NO: 2278022 - RNA, 20 nt, Yersinia pestis
aggccguuuaaaggucccuu

SEQ ID NO: 2278023 - RNA, 13 nt, Yersinia pestis
aggccuaaacccc

SEQ ID NO: 2278024 - RNA, 17 nt, Yersinia pestis
aggccguucacccuuug

SEQ ID NO: 2278025 - RNA, 14 nt, Yersinia pestis
aggccguucacccu

SEQ ID NO: 2278026 - RNA, 18 nt, Yersinia pestis
aggccgugggcaauaaca

SEQ ID NO: 2278027 - RNA, 21 nt, Yersinia pestis
aggccgccaucaucaucaaua

SEQ ID NO: 2278028 - RNA, 21 nt, Yersinia pestis
aggccgcgaauaacagacguu

SEQ ID NO: 2278029 - RNA, 18 nt, Yersinia pestis
aggcucaucaccuuccaa

SEQ ID NO: 2278030 - RNA, 17 nt, Yersinia pestis
aggcucagcauggaaga

SEQ ID NO: 2278031 - RNA, 15 nt, Yersinia pestis
aggcucauucagugg

SEQ ID NO: 2278032 - RNA, 20 nt, Yersinia pestis
aggcucgaaccgcgccaucc

SEQ ID NO: 2278033 - RNA, 19 nt, Yersinia pestis
aggcuccuccuuggggccu

SEQ ID NO: 2278034 - RNA, 19 nt, Yersinia pestis
aggcucuggcaauggcuag

SEQ ID NO: 2278035 - RNA, 17 nt, Yersinia pestis
aggcucuggucacuaaa

SEQ ID NO: 2278036 - RNA, 22 nt, Yersinia pestis
aggcucucauaucccccccaag

SEQ ID NO: 2278037 - RNA, 11 nt, Yersinia pestis
aggcuaauuua

SEQ ID NO: 2278038 - RNA, 17 nt, Yersinia pestis
aggcuaccugcaccaau

SEQ ID NO: 2278039 - RNA, 15 nt, Yersinia pestis
aggcguuuuuuugcc

SEQ ID NO: 2278040 - RNA, 17 nt, Yersinia pestis
aggcuauuuuacuugcc

SEQ ID NO: 2278041 - RNA, 21 nt, Yersinia pestis
aggcucaaugcgaaaaaauau

SEQ ID NO: 2278042 - RNA, 18 nt, Yersinia pestis
aggcucagcacaaacaug

SEQ ID NO: 2278043 - RNA, 13 nt, Yersinia pestis
aggcguuacccac

SEQ ID NO: 2278044 - RNA, 13 nt, Yersinia pestis
aggcgcuccccug

SEQ ID NO: 2278045 - RNA, 22 nt, Yersinia pestis
aggcggcaucacuaugggggau

SEQ ID NO: 2278046 - RNA, 15 nt, Yersinia pestis
aggcgguuaucugga

SEQ ID NO: 2278047 - RNA, 21 nt, Yersinia pestis
aggcguagguuucagccucug

SEQ ID NO: 2278048 - RNA, 22 nt, Yersinia pestis
aggcggugagggagucagggag

SEQ ID NO: 2278049 - RNA, 16 nt, Yersinia pestis
aggcggugagggaguc

SEQ ID NO: 2278050 - RNA, 21 nt, Yersinia pestis
aggcggugagggagucaggga

SEQ ID NO: 2278051 - RNA, 14 nt, Yersinia pestis
agggcaaucaggaa

SEQ ID NO: 2278052 - RNA, 20 nt, Yersinia pestis
agggccacccugccaaaaaa

SEQ ID NO: 2278053 - RNA, 22 nt, Yersinia pestis
agggccacccugccaaaaaaua

SEQ ID NO: 2278054 - RNA, 18 nt, Yersinia pestis
agggccgcccagauaaag

SEQ ID NO: 2278055 - RNA, 16 nt, Yersinia pestis
agggcgcuuucugggu

SEQ ID NO: 2278056 - RNA, 13 nt, Yersinia pestis
agggcgcggcugg

SEQ ID NO: 2278057 - RNA, 11 nt, Yersinia pestis
agggcgccccg

SEQ ID NO: 2278058 - RNA, 20 nt, Yersinia pestis
agggcgcauguaaauuaaua

SEQ ID NO: 2278059 - RNA, 16 nt, Yersinia pestis
agggcgcauccccauc

SEQ ID NO: 2278060 - RNA, 16 nt, Yersinia pestis
agggccuacguucagg

SEQ ID NO: 2278061 - RNA, 23 nt, Yersinia pestis
agggccugcaaacggcucaucac

SEQ ID NO: 2278062 - RNA, 17 nt, Yersinia pestis
agggccgcuagugagug

SEQ ID NO: 2278063 - RNA, 19 nt, Yersinia pestis
aggggagccgaagcgcccc

SEQ ID NO: 2278064 - RNA, 16 nt, Yersinia pestis
agggcuguuauccggg

SEQ ID NO: 2278065 - RNA, 22 nt, Yersinia pestis
agggcuguuauccggguggcuu

SEQ ID NO: 2278066 - RNA, 18 nt, Yersinia pestis
agggcuuuguucacccca

SEQ ID NO: 2278067 - RNA, 15 nt, Yersinia pestis
agggcugaauaucau

SEQ ID NO: 2278068 - RNA, 14 nt, Yersinia pestis
agggcugacagagc

SEQ ID NO: 2278069 - RNA, 19 nt, Yersinia pestis
agggcugauccguuaucua

SEQ ID NO: 2278070 - RNA, 20 nt, Yersinia pestis
agggcucgguuucacccucu

SEQ ID NO: 2278071 - RNA, 19 nt, Yersinia pestis
agggcguucugucacaauc

SEQ ID NO: 2278072 - RNA, 17 nt, Yersinia pestis
agggcguuaccgaggcu

SEQ ID NO: 2278073 - RNA, 21 nt, Yersinia pestis
agggcguuuaccauccagugc

SEQ ID NO: 2278074 - RNA, 23 nt, Yersinia pestis
aggggugcuguuccaaccaaccu

SEQ ID NO: 2278075 - RNA, 14 nt, Yersinia pestis
agggguucuuccaa

SEQ ID NO: 2278076 - RNA, 14 nt, Yersinia pestis
aggguaaccaaugu

SEQ ID NO: 2278077 - RNA, 22 nt, Yersinia pestis
aggguacuguugaugcagauga

SEQ ID NO: 2278078 - RNA, 18 nt, Yersinia pestis
aggggccaacaggccccu

SEQ ID NO: 2278079 - RNA, 18 nt, Yersinia pestis
aggggcguuuaaugcccc

SEQ ID NO: 2278080 - RNA, 20 nt, Yersinia pestis
aggggcguuuaaugccccuu

SEQ ID NO: 2278081 - RNA, 19 nt, Yersinia pestis
aggggguuuuccccucaga

SEQ ID NO: 2278082 - RNA, 15 nt, Yersinia pestis
agggggacuacaucc

SEQ ID NO: 2278083 - RNA, 19 nt, Yersinia pestis
agggggcaauugaaaaugg

SEQ ID NO: 2278084 - RNA, 23 nt, Yersinia pestis
aggcuucuuaauucccagccacu

SEQ ID NO: 2278085 - RNA, 15 nt, Yersinia pestis
aggcuuggcgggcug

SEQ ID NO: 2278086 - RNA, 20 nt, Yersinia pestis
aggcuugagguuauugacaa

SEQ ID NO: 2278087 - RNA, 16 nt, Yersinia pestis
aggcuuuaggugcgca

SEQ ID NO: 2278088 - RNA, 15 nt, Yersinia pestis
aggcuuugccugccc

SEQ ID NO: 2278089 - RNA, 17 nt, Yersinia pestis
aggcuggccacuuccac

SEQ ID NO: 2278090 - RNA, 19 nt, Yersinia pestis
aggcugcgauucgccccgc

SEQ ID NO: 2278091 - RNA, 14 nt, Yersinia pestis
agggaaauugucug

SEQ ID NO: 2278092 - RNA, 23 nt, Yersinia pestis
agggaaagguagaucggggacag

SEQ ID NO: 2278093 - RNA, 21 nt, Yersinia pestis
aggcuuuugggucaggguaag

SEQ ID NO: 2278094 - RNA, 23 nt, Yersinia pestis
agggacaacaucauauauuaaau

SEQ ID NO: 2278095 - RNA, 13 nt, Yersinia pestis
agggagccgcccu

SEQ ID NO: 2278096 - RNA, 22 nt, Yersinia pestis
agggagccgcccugcauucugg

SEQ ID NO: 2278097 - RNA, 13 nt, Yersinia pestis
agggauucuguca

SEQ ID NO: 2278098 - RNA, 12 nt, Yersinia pestis
agggagggcgcg

SEQ ID NO: 2278099 - RNA, 16 nt, Yersinia pestis
agggaguuacucagca

SEQ ID NO: 2278100 - RNA, 14 nt, Yersinia pestis
agggagucagggag

SEQ ID NO: 2278101 - RNA, 16 nt, Yersinia pestis
agggagucagggagua

SEQ ID NO: 2278102 - RNA, 21 nt, Yersinia pestis
agcucuacagugacuuuguca

SEQ ID NO: 2278103 - RNA, 13 nt, Yersinia pestis
agcucaucaccaa

SEQ ID NO: 2278104 - RNA, 14 nt, Yersinia pestis
agcucauauaauca

SEQ ID NO: 2278105 - RNA, 16 nt, Yersinia pestis
agcucagcuggauaga

SEQ ID NO: 2278106 - RNA, 24 nt, Yersinia pestis
agcugaauugcuuauccagccgcu

SEQ ID NO: 2278107 - RNA, 14 nt, Yersinia pestis
agcugcaauugccg

SEQ ID NO: 2278108 - RNA, 15 nt, Yersinia pestis
agcugcaauugccgc

SEQ ID NO: 2278109 - RNA, 18 nt, Yersinia pestis
agcuguuagccagauagg

SEQ ID NO: 2278110 - RNA, 13 nt, Yersinia pestis
agcuguuguuguu

SEQ ID NO: 2278111 - RNA, 18 nt, Yersinia pestis
agcuguaaaggcaaagaa

SEQ ID NO: 2278112 - RNA, 18 nt, Yersinia pestis
agcuguaaauauaaaaua

SEQ ID NO: 2278113 - RNA, 18 nt, Yersinia pestis
agcuguagcaauauaucu

SEQ ID NO: 2278114 - RNA, 16 nt, Yersinia pestis
agcuggcuucaaaauc

SEQ ID NO: 2278115 - RNA, 21 nt, Yersinia pestis
agcugcuuuaucguagccaau

SEQ ID NO: 2278116 - RNA, 19 nt, Yersinia pestis
agcuuaucagcguagauuu

SEQ ID NO: 2278117 - RNA, 12 nt, Yersinia pestis
agcuuauccauu

SEQ ID NO: 2278118 - RNA, 22 nt, Yersinia pestis
agcuuauccauuacagcaccug

SEQ ID NO: 2278119 - RNA, 17 nt, Yersinia pestis
agcuuaccgcggugaag

SEQ ID NO: 2278120 - RNA, 21 nt, Yersinia pestis
agcuuacaccauguucuucaa

SEQ ID NO: 2278121 - RNA, 23 nt, Yersinia pestis
agcuucaagguacugauaaugga

SEQ ID NO: 2278122 - RNA, 17 nt, Yersinia pestis
agcuucaccuuuguguu

SEQ ID NO: 2278123 - RNA, 21 nt, Yersinia pestis
agcuuauggaaguaauccaga

SEQ ID NO: 2278124 - RNA, 20 nt, Yersinia pestis
agcuuccagcaccccuucac

SEQ ID NO: 2278125 - RNA, 15 nt, Yersinia pestis
agcuucuucaaaagc

SEQ ID NO: 2278126 - RNA, 19 nt, Yersinia pestis
agcuucuucaaaagcaagu

SEQ ID NO: 2278127 - RNA, 13 nt, Yersinia pestis
agcuucuuuuaaa

SEQ ID NO: 2278128 - RNA, 24 nt, Yersinia pestis
agcuugacgaccaauaucauaaua

SEQ ID NO: 2278129 - RNA, 19 nt, Yersinia pestis
agcuucgccaccagauagu

SEQ ID NO: 2278130 - RNA, 11 nt, Yersinia pestis
agcuucccugg

SEQ ID NO: 2278131 - RNA, 17 nt, Yersinia pestis
agcuucucgcaccagau

SEQ ID NO: 2278132 - RNA, 22 nt, Yersinia pestis
agcuuguugauaucaaucucuu

SEQ ID NO: 2278133 - RNA, 23 nt, Yersinia pestis
agcuuguugauaucaaucucuug

SEQ ID NO: 2278134 - RNA, 15 nt, Yersinia pestis
agcuugcaaguguau

SEQ ID NO: 2278135 - RNA, 17 nt, Yersinia pestis
agcuuuagcauugcaga

SEQ ID NO: 2278136 - RNA, 22 nt, Yersinia pestis
agcuuuagcauugcagauuucu

SEQ ID NO: 2278137 - RNA, 20 nt, Yersinia pestis
agcuuugugcaaaauacaaa

SEQ ID NO: 2278138 - RNA, 14 nt, Yersinia pestis
agcggcuagcagca

SEQ ID NO: 2278139 - RNA, 17 nt, Yersinia pestis
agcggcguucagcaaua

SEQ ID NO: 2278140 - RNA, 20 nt, Yersinia pestis
agcggcguauuaucaguaac

SEQ ID NO: 2278141 - RNA, 15 nt, Yersinia pestis
agcggcgaccgggga

SEQ ID NO: 2278142 - RNA, 15 nt, Yersinia pestis
agcgcugcaucagca

SEQ ID NO: 2278143 - RNA, 19 nt, Yersinia pestis
agcgcuggugcuggugaau

SEQ ID NO: 2278144 - RNA, 24 nt, Yersinia pestis
agcuaauuuucauugauacaaaua

SEQ ID NO: 2278145 - RNA, 19 nt, Yersinia pestis
agcuaauguuggcaacuau

SEQ ID NO: 2278146 - RNA, 16 nt, Yersinia pestis
agcuaaugcuauccac

SEQ ID NO: 2278147 - RNA, 16 nt, Yersinia pestis
agcuauguucacguaa

SEQ ID NO: 2278148 - RNA, 13 nt, Yersinia pestis
agcuaucuugccu

SEQ ID NO: 2278149 - RNA, 16 nt, Yersinia pestis
agcuaucuuugccugg

SEQ ID NO: 2278150 - RNA, 15 nt, Yersinia pestis
agcuaugcaguuaag

SEQ ID NO: 2278151 - RNA, 19 nt, Yersinia pestis
agcuaugcaguuaagguua

SEQ ID NO: 2278152 - RNA, 19 nt, Yersinia pestis
agcuauucucaaacucguu

SEQ ID NO: 2278153 - RNA, 23 nt, Yersinia pestis
agcguucaaaucugcucccggca

SEQ ID NO: 2278154 - RNA, 20 nt, Yersinia pestis
agcgugcgguagaccaccaa

SEQ ID NO: 2278155 - RNA, 22 nt, Yersinia pestis
agcgugguauaaauggcacugg

SEQ ID NO: 2278156 - RNA, 15 nt, Yersinia pestis
agcguauaagcaggg

SEQ ID NO: 2278157 - RNA, 20 nt, Yersinia pestis
agcguauucaguaaaaacug

SEQ ID NO: 2278158 - RNA, 13 nt, Yersinia pestis
agcgguaauuaau

SEQ ID NO: 2278159 - RNA, 22 nt, Yersinia pestis
agcgguaauuaauauauaaaau

SEQ ID NO: 2278160 - RNA, 23 nt, Yersinia pestis
agcgguaauuaauauauaaaaua

SEQ ID NO: 2278161 - RNA, 17 nt, Yersinia pestis
agcgggcggccucugcu

SEQ ID NO: 2278162 - RNA, 16 nt, Yersinia pestis
agcgggccagcaacca

SEQ ID NO: 2278163 - RNA, 14 nt, Yersinia pestis
agcguacacgcagu

SEQ ID NO: 2278164 - RNA, 14 nt, Yersinia pestis
agcggugacagacc

SEQ ID NO: 2278165 - RNA, 14 nt, Yersinia pestis
agcggugccuugcc

SEQ ID NO: 2278166 - RNA, 15 nt, Yersinia pestis
aggauauuagggcug

SEQ ID NO: 2278167 - RNA, 16 nt, Yersinia pestis
aggauauuuauuaaaa

SEQ ID NO: 2278168 - RNA, 17 nt, Yersinia pestis
aggauauuuauuaaaac

SEQ ID NO: 2278169 - RNA, 18 nt, Yersinia pestis
aggauauuuauuaaaaca

SEQ ID NO: 2278170 - RNA, 14 nt, Yersinia pestis
aggauauuuauucg

SEQ ID NO: 2278171 - RNA, 16 nt, Yersinia pestis
aggauauuuauugcau

SEQ ID NO: 2278172 - RNA, 20 nt, Yersinia pestis
aggauauuuauuguuaucaa

SEQ ID NO: 2278173 - RNA, 22 nt, Yersinia pestis
aggauauuuauuguuaucaaau

SEQ ID NO: 2278174 - RNA, 20 nt, Yersinia pestis
aggauauuuauuuacucuuu

SEQ ID NO: 2278175 - RNA, 19 nt, Yersinia pestis
aggauauuuauuuuuaugg

SEQ ID NO: 2278176 - RNA, 18 nt, Yersinia pestis
aggauaggcugaagagua

SEQ ID NO: 2278177 - RNA, 15 nt, Yersinia pestis
aggauaggcagaaua

SEQ ID NO: 2278178 - RNA, 23 nt, Yersinia pestis
aggagcgauaacauuuuuucuuu

SEQ ID NO: 2278179 - RNA, 16 nt, Yersinia pestis
aggagccauugauugg

SEQ ID NO: 2278180 - RNA, 19 nt, Yersinia pestis
aggagugaauuucuucccu

SEQ ID NO: 2278181 - RNA, 15 nt, Yersinia pestis
aggacggaugguaaa

SEQ ID NO: 2278182 - RNA, 21 nt, Yersinia pestis
aggacauccagcgguguuacc

SEQ ID NO: 2278183 - RNA, 21 nt, Yersinia pestis
aggagaucgauaaagccgagc

SEQ ID NO: 2278184 - RNA, 17 nt, Yersinia pestis
aggagauuucagacugc

SEQ ID NO: 2278185 - RNA, 19 nt, Yersinia pestis
aggagauuucagacugcug

SEQ ID NO: 2278186 - RNA, 13 nt, Yersinia pestis
aggacuucaucac

SEQ ID NO: 2278187 - RNA, 22 nt, Yersinia pestis
aggacuauucaaugacuccuga

SEQ ID NO: 2278188 - RNA, 18 nt, Yersinia pestis
agcuuuuuacgcaacaag

SEQ ID NO: 2278189 - RNA, 21 nt, Yersinia pestis
aggaaauaaaugacuaucccu

SEQ ID NO: 2278190 - RNA, 15 nt, Yersinia pestis
aggaaacuccaguca

SEQ ID NO: 2278191 - RNA, 15 nt, Yersinia pestis
aggaaacguauggcu

SEQ ID NO: 2278192 - RNA, 12 nt, Yersinia pestis
aggaaacucaug

SEQ ID NO: 2278193 - RNA, 21 nt, Yersinia pestis
aggaaacucaugacaucccag

SEQ ID NO: 2278194 - RNA, 22 nt, Yersinia pestis
aggaacccauuugcacagcauu

SEQ ID NO: 2278195 - RNA, 20 nt, Yersinia pestis
aggaacgaaguuagacccaa

SEQ ID NO: 2278196 - RNA, 17 nt, Yersinia pestis
aggacaaauagauuuaa

SEQ ID NO: 2278197 - RNA, 19 nt, Yersinia pestis
aggaauaucugugauaacc

SEQ ID NO: 2278198 - RNA, 17 nt, Yersinia pestis
aggaaugcgcccuuuuc

SEQ ID NO: 2278199 - RNA, 20 nt, Yersinia pestis
aggaaguccaguaauaccuu

SEQ ID NO: 2278200 - RNA, 16 nt, Yersinia pestis
aggaagcaaugaaaua

SEQ ID NO: 2278201 - RNA, 14 nt, Yersinia pestis
aggaagagaaaagc

SEQ ID NO: 2278202 - RNA, 12 nt, Yersinia pestis
aggauugagaga

SEQ ID NO: 2278203 - RNA, 16 nt, Yersinia pestis
aggauuucauaccgcu

SEQ ID NO: 2278204 - RNA, 11 nt, Yersinia pestis
aggcaaagaag

SEQ ID NO: 2278205 - RNA, 13 nt, Yersinia pestis
aggcaaagaagaa

SEQ ID NO: 2278206 - RNA, 15 nt, Yersinia pestis
aggcaaagaagaaua

SEQ ID NO: 2278207 - RNA, 17 nt, Yersinia pestis
aggcaaaaagagucagu

SEQ ID NO: 2278208 - RNA, 18 nt, Yersinia pestis
aggauggcgcggcucgag

SEQ ID NO: 2278209 - RNA, 14 nt, Yersinia pestis
aggauggcccaagc

SEQ ID NO: 2278210 - RNA, 15 nt, Yersinia pestis
aggaugaugaauacc

SEQ ID NO: 2278211 - RNA, 23 nt, Yersinia pestis
aggcaaccuuggugaagaucaau

SEQ ID NO: 2278212 - RNA, 14 nt, Yersinia pestis
aggcaacgaaggca

SEQ ID NO: 2278213 - RNA, 14 nt, Yersinia pestis
aggcaacauuuguu

SEQ ID NO: 2278214 - RNA, 15 nt, Yersinia pestis
aggcaaccaucagga

SEQ ID NO: 2278215 - RNA, 18 nt, Yersinia pestis
aggcaaauucucaaugau

SEQ ID NO: 2278216 - RNA, 20 nt, Yersinia pestis
aggcaauacaccgccaguau

SEQ ID NO: 2278217 - RNA, 14 nt, Yersinia pestis
aggcagaaauaaua

SEQ ID NO: 2278218 - RNA, 18 nt, Yersinia pestis
aggcagaaauaauaucaa

SEQ ID NO: 2278219 - RNA, 18 nt, Yersinia pestis
aggcacuaacugcgccua

SEQ ID NO: 2278220 - RNA, 18 nt, Yersinia pestis
aggcaccguugaggugcc

SEQ ID NO: 2278221 - RNA, 23 nt, Yersinia pestis
aggcacaucuccagaauauaaaa

SEQ ID NO: 2278222 - RNA, 11 nt, Yersinia pestis
aggcaccagcg

SEQ ID NO: 2278223 - RNA, 13 nt, Yersinia pestis
aggcaccaccaug

SEQ ID NO: 2278224 - RNA, 16 nt, Yersinia pestis
aggcaccaccaugaug

SEQ ID NO: 2278225 - RNA, 14 nt, Yersinia pestis
aggccagcaaugac

SEQ ID NO: 2278226 - RNA, 17 nt, Yersinia pestis
aggccagcgccccauca

SEQ ID NO: 2278227 - RNA, 16 nt, Yersinia pestis
aggccaccucuuccuc

SEQ ID NO: 2278228 - RNA, 15 nt, Yersinia pestis
aggccacuugggcug

SEQ ID NO: 2278229 - RNA, 14 nt, Yersinia pestis
aggcccacugcaac

SEQ ID NO: 2278230 - RNA, 22 nt, Yersinia pestis
aggccauagcaaccggauacaa

SEQ ID NO: 2278231 - RNA, 16 nt, Yersinia pestis
aggccagcuucccugc

SEQ ID NO: 2278232 - RNA, 20 nt, Yersinia pestis
aggccccuuaaauaugaugu

SEQ ID NO: 2278233 - RNA, 14 nt, Yersinia pestis
aggccccucggggc

SEQ ID NO: 2278234 - RNA, 19 nt, Yersinia pestis
aggcccgcuaucacuagcg

SEQ ID NO: 2278235 - RNA, 16 nt, Yersinia pestis
aggcccgcuucccuac

SEQ ID NO: 2278236 - RNA, 22 nt, Yersinia pestis
aggcccgcuucccuacauaaaa

SEQ ID NO: 2278237 - RNA, 17 nt, Yersinia pestis
aggccgaguaacuccau

SEQ ID NO: 2278238 - RNA, 17 nt, Yersinia pestis
aggcaucucugaagccu

SEQ ID NO: 2278239 - RNA, 18 nt, Yersinia pestis
aggccaauagcccaaaua

SEQ ID NO: 2278240 - RNA, 11 nt, Yersinia pestis
aggccaaugga

SEQ ID NO: 2278241 - RNA, 21 nt, Yersinia pestis
aggccaccaaucacacugggu

SEQ ID NO: 2278242 - RNA, 22 nt, Yersinia pestis
aggcauuggcgcucagguggcu

SEQ ID NO: 2278243 - RNA, 15 nt, Yersinia pestis
aggcaugguaagaau

SEQ ID NO: 2278244 - RNA, 18 nt, Yersinia pestis
aggcaugauaagcaggaa

SEQ ID NO: 2278245 - RNA, 22 nt, Yersinia pestis
aggcaucugccacacugaauuu

SEQ ID NO: 2278246 - RNA, 17 nt, Yersinia pestis
auaagacuaacagaaua

SEQ ID NO: 2278247 - RNA, 21 nt, Yersinia pestis
auaagagcgacucaauaauau

SEQ ID NO: 2278248 - RNA, 23 nt, Yersinia pestis
auaagauugagggcgucucuacg

SEQ ID NO: 2278249 - RNA, 15 nt, Yersinia pestis
auaagcagcaccaau

SEQ ID NO: 2278250 - RNA, 16 nt, Yersinia pestis
auaagcacuccacugg

SEQ ID NO: 2278251 - RNA, 23 nt, Yersinia pestis
auaagcgcucaaauacgguagca

SEQ ID NO: 2278252 - RNA, 19 nt, Yersinia pestis
auaagccgcaggcaaacaa

SEQ ID NO: 2278253 - RNA, 22 nt, Yersinia pestis
auaagccgcaggcaaacaaugu

SEQ ID NO: 2278254 - RNA, 21 nt, Yersinia pestis
auaagcgggguuaaucccccg

SEQ ID NO: 2278255 - RNA, 20 nt, Yersinia pestis
auaagcgguuucauggcugg

SEQ ID NO: 2278256 - RNA, 13 nt, Yersinia pestis
auaaggaauaacu

SEQ ID NO: 2278257 - RNA, 14 nt, Yersinia pestis
auaaggaauauacu

SEQ ID NO: 2278258 - RNA, 18 nt, Yersinia pestis
auaagucagugcuauuca

SEQ ID NO: 2278259 - RNA, 21 nt, Yersinia pestis
auaagucaaugcauuguaaaa

SEQ ID NO: 2278260 - RNA, 22 nt, Yersinia pestis
auaagucacuuuccuuugcuuc

SEQ ID NO: 2278261 - RNA, 19 nt, Yersinia pestis
auaaguaggcaucugccac

SEQ ID NO: 2278262 - RNA, 17 nt, Yersinia pestis
auaaguaacauuuguau

SEQ ID NO: 2278263 - RNA, 14 nt, Yersinia pestis
auaaguaagugauu

SEQ ID NO: 2278264 - RNA, 23 nt, Yersinia pestis
auaagguccgcgauaaauuagau

SEQ ID NO: 2278265 - RNA, 20 nt, Yersinia pestis
auaaggcuagaucguuacau

SEQ ID NO: 2278266 - RNA, 13 nt, Yersinia pestis
auaagggccacca

SEQ ID NO: 2278267 - RNA, 18 nt, Yersinia pestis
auaagggccauuuugcug

SEQ ID NO: 2278268 - RNA, 21 nt, Yersinia pestis
auaaggggauugcugccaacg

SEQ ID NO: 2278269 - RNA, 18 nt, Yersinia pestis
auaaggccuuuuucugua

SEQ ID NO: 2278270 - RNA, 16 nt, Yersinia pestis
auaaggcgaauaugau

SEQ ID NO: 2278271 - RNA, 15 nt, Yersinia pestis
auaauaaauauccuc

SEQ ID NO: 2278272 - RNA, 12 nt, Yersinia pestis
auaauaaaaaaa

SEQ ID NO: 2278273 - RNA, 13 nt, Yersinia pestis
auaauaaaaaaaa

SEQ ID NO: 2278274 - RNA, 23 nt, Yersinia pestis
auaaguuccggcagauaugaugc

SEQ ID NO: 2278275 - RNA, 21 nt, Yersinia pestis
auaagugcaaacuuaaaaauc

SEQ ID NO: 2278276 - RNA, 22 nt, Yersinia pestis
auaagugcaaacuuaaaaauca

SEQ ID NO: 2278277 - RNA, 19 nt, Yersinia pestis
auaagugaaacaaauacac

SEQ ID NO: 2278278 - RNA, 21 nt, Yersinia pestis
auaagugaaacaaauacaccu

SEQ ID NO: 2278279 - RNA, 20 nt, Yersinia pestis
auaaguucagguugaaauaa

SEQ ID NO: 2278280 - RNA, 22 nt, Yersinia pestis
auaaguuagcgugagaauaaua

SEQ ID NO: 2278281 - RNA, 23 nt, Yersinia pestis
auaaguuagcgugagaauaauaa

SEQ ID NO: 2278282 - RNA, 13 nt, Yersinia pestis
auaauauuggccg

SEQ ID NO: 2278283 - RNA, 12 nt, Yersinia pestis
auaaucaaugac

SEQ ID NO: 2278284 - RNA, 18 nt, Yersinia pestis
auaaucaacggcaccaca

SEQ ID NO: 2278285 - RNA, 15 nt, Yersinia pestis
auaauauagcugaau

SEQ ID NO: 2278286 - RNA, 14 nt, Yersinia pestis
auaauaucaaugau

SEQ ID NO: 2278287 - RNA, 15 nt, Yersinia pestis
auaauaucgacaauc

SEQ ID NO: 2278288 - RNA, 23 nt, Yersinia pestis
auaauaucucggugugacuuuca

SEQ ID NO: 2278289 - RNA, 13 nt, Yersinia pestis
auaauaucugucu

SEQ ID NO: 2278290 - RNA, 15 nt, Yersinia pestis
auaauacgaaauacu

SEQ ID NO: 2278291 - RNA, 16 nt, Yersinia pestis
auaauacuuaagucaa

SEQ ID NO: 2278292 - RNA, 14 nt, Yersinia pestis
auaauagauaguac

SEQ ID NO: 2278293 - RNA, 20 nt, Yersinia pestis
auaauagauaacaaacuacu

SEQ ID NO: 2278294 - RNA, 10 nt, Yersinia pestis
auaauaaugg

SEQ ID NO: 2278295 - RNA, 11 nt, Yersinia pestis
auaauaauggc

SEQ ID NO: 2278296 - RNA, 16 nt, Yersinia pestis
auaauaauccauaacu

SEQ ID NO: 2278297 - RNA, 14 nt, Yersinia pestis
auaauaauauugau

SEQ ID NO: 2278298 - RNA, 19 nt, Yersinia pestis
auaauaacgaauuucauuu

SEQ ID NO: 2278299 - RNA, 17 nt, Yersinia pestis
auaauaaccauuuauau

SEQ ID NO: 2278300 - RNA, 18 nt, Yersinia pestis
auaauaaauuaucugaau

SEQ ID NO: 2278301 - RNA, 20 nt, Yersinia pestis
auaauaacgucgccaguugc

SEQ ID NO: 2278302 - RNA, 22 nt, Yersinia pestis
auaauguggcauguucagcauu

SEQ ID NO: 2278303 - RNA, 13 nt, Yersinia pestis
auaauuaaauauu

SEQ ID NO: 2278304 - RNA, 14 nt, Yersinia pestis
auaauuaacuauuu

SEQ ID NO: 2278305 - RNA, 12 nt, Yersinia pestis
auaauuaacuau

SEQ ID NO: 2278306 - RNA, 12 nt, Yersinia pestis
auaauuaaauau

SEQ ID NO: 2278307 - RNA, 15 nt, Yersinia pestis
auaauggacgaacag

SEQ ID NO: 2278308 - RNA, 14 nt, Yersinia pestis
auaaugcuuuggua

SEQ ID NO: 2278309 - RNA, 23 nt, Yersinia pestis
auaaugcggcucucuuucuccaa

SEQ ID NO: 2278310 - RNA, 13 nt, Yersinia pestis
auaaugaauuauu

SEQ ID NO: 2278311 - RNA, 14 nt, Yersinia pestis
auaaugaauuauua

SEQ ID NO: 2278312 - RNA, 15 nt, Yersinia pestis
auaaucuaaauuaau

SEQ ID NO: 2278313 - RNA, 14 nt, Yersinia pestis
auaaucacguucaa

SEQ ID NO: 2278314 - RNA, 21 nt, Yersinia pestis
auaaucaccagacaaccaaua

SEQ ID NO: 2278315 - RNA, 16 nt, Yersinia pestis
auaaaucuuauuuaau

SEQ ID NO: 2278316 - RNA, 23 nt, Yersinia pestis
auaaauauuuuaugcccccuauu

SEQ ID NO: 2278317 - RNA, 15 nt, Yersinia pestis
auaaauccugaacau

SEQ ID NO: 2278318 - RNA, 19 nt, Yersinia pestis
auaaaucccgagacacuca

SEQ ID NO: 2278319 - RNA, 21 nt, Yersinia pestis
auaaaucccgagacacucauc

SEQ ID NO: 2278320 - RNA, 15 nt, Yersinia pestis
auaaaucgcauuuuu

SEQ ID NO: 2278321 - RNA, 15 nt, Yersinia pestis
auaaauaauaucaau

SEQ ID NO: 2278322 - RNA, 17 nt, Yersinia pestis
auaaauaauaucaauga

SEQ ID NO: 2278323 - RNA, 14 nt, Yersinia pestis
auaaauaaaauaau

SEQ ID NO: 2278324 - RNA, 14 nt, Yersinia pestis
auaaauaaguucag

SEQ ID NO: 2278325 - RNA, 14 nt, Yersinia pestis
auaaauaaauuuaa

SEQ ID NO: 2278326 - RNA, 14 nt, Yersinia pestis
auaaauaaccgagc

SEQ ID NO: 2278327 - RNA, 21 nt, Yersinia pestis
auaaauaaccgagcgugaaga

SEQ ID NO: 2278328 - RNA, 20 nt, Yersinia pestis
auaaauaucauuaacaaacu

SEQ ID NO: 2278329 - RNA, 17 nt, Yersinia pestis
auaaauauucauuaaaa

SEQ ID NO: 2278330 - RNA, 18 nt, Yersinia pestis
auaaauauucauuaaaaa

SEQ ID NO: 2278331 - RNA, 18 nt, Yersinia pestis
auaaagccauuucaguaa

SEQ ID NO: 2278332 - RNA, 22 nt, Yersinia pestis
auaaagccgagcaagugaauaa

SEQ ID NO: 2278333 - RNA, 21 nt, Yersinia pestis
auaaagcauuuaucauauuaa

SEQ ID NO: 2278334 - RNA, 15 nt, Yersinia pestis
auaaagcaucagacu

SEQ ID NO: 2278335 - RNA, 22 nt, Yersinia pestis
auaaaggcaaaagcaucaccaa

SEQ ID NO: 2278336 - RNA, 17 nt, Yersinia pestis
auaaaggcaaaagcauc

SEQ ID NO: 2278337 - RNA, 21 nt, Yersinia pestis
auaaaggcaaaagcaucacca

SEQ ID NO: 2278338 - RNA, 13 nt, Yersinia pestis
auaaauaaaauaa

SEQ ID NO: 2278339 - RNA, 17 nt, Yersinia pestis
auaaaaauaaucaauga

SEQ ID NO: 2278340 - RNA, 13 nt, Yersinia pestis
auaaaaauacaua

SEQ ID NO: 2278341 - RNA, 14 nt, Yersinia pestis
auaaaaauacauau

SEQ ID NO: 2278342 - RNA, 11 nt, Yersinia pestis
auaaaaaguca

SEQ ID NO: 2278343 - RNA, 21 nt, Yersinia pestis
auaaaccaacugaaacuggag

SEQ ID NO: 2278344 - RNA, 16 nt, Yersinia pestis
auaaacaauaaacaga

SEQ ID NO: 2278345 - RNA, 21 nt, Yersinia pestis
auaaacugugcccuugagcua

SEQ ID NO: 2278346 - RNA, 19 nt, Yersinia pestis
auaaacuuaucgguuuuuu

SEQ ID NO: 2278347 - RNA, 19 nt, Yersinia pestis
auaaacugacucacgucag

SEQ ID NO: 2278348 - RNA, 16 nt, Yersinia pestis
auaaacugaaguuaaa

SEQ ID NO: 2278349 - RNA, 18 nt, Yersinia pestis
auaaacugaaguuaaaaa

SEQ ID NO: 2278350 - RNA, 13 nt, Yersinia pestis
auaaagagugaaa

SEQ ID NO: 2278351 - RNA, 14 nt, Yersinia pestis
auaaacuucacaau

SEQ ID NO: 2278352 - RNA, 13 nt, Yersinia pestis
auaaacuucgaua

SEQ ID NO: 2278353 - RNA, 15 nt, Yersinia pestis
auaaagagugaaaua

SEQ ID NO: 2278354 - RNA, 14 nt, Yersinia pestis
auaaagaugcaagc

SEQ ID NO: 2278355 - RNA, 12 nt, Yersinia pestis
auaaacucauac

SEQ ID NO: 2278356 - RNA, 21 nt, Yersinia pestis
auaaacuccguaaucuguucg

SEQ ID NO: 2278357 - RNA, 17 nt, Yersinia pestis
auaaaccgcuauaucau

SEQ ID NO: 2278358 - RNA, 19 nt, Yersinia pestis
auaacugagguauaucgug

SEQ ID NO: 2278359 - RNA, 15 nt, Yersinia pestis
auaacuggagaauuu

SEQ ID NO: 2278360 - RNA, 14 nt, Yersinia pestis
auaacugccagggc

SEQ ID NO: 2278361 - RNA, 14 nt, Yersinia pestis
auaacugccauaca

SEQ ID NO: 2278362 - RNA, 15 nt, Yersinia pestis
auaacugguccaacu

SEQ ID NO: 2278363 - RNA, 12 nt, Yersinia pestis
auaacucaucag

SEQ ID NO: 2278364 - RNA, 13 nt, Yersinia pestis
auaacucaucagu

SEQ ID NO: 2278365 - RNA, 14 nt, Yersinia pestis
auaacuauuuuuga

SEQ ID NO: 2278366 - RNA, 20 nt, Yersinia pestis
auaacuaagagucacagcau

SEQ ID NO: 2278367 - RNA, 22 nt, Yersinia pestis
auaacguuuaccgcugcagggc

SEQ ID NO: 2278368 - RNA, 16 nt, Yersinia pestis
auaaccucaaaaggau

SEQ ID NO: 2278369 - RNA, 17 nt, Yersinia pestis
auaaccgucaccaaaau

SEQ ID NO: 2278370 - RNA, 14 nt, Yersinia pestis
auaaccucagccuc

SEQ ID NO: 2278371 - RNA, 15 nt, Yersinia pestis
auaaccucagccuca

SEQ ID NO: 2278372 - RNA, 17 nt, Yersinia pestis
auaaccucagggcgucu

SEQ ID NO: 2278373 - RNA, 22 nt, Yersinia pestis
auaaccucagggcgucucuacg

SEQ ID NO: 2278374 - RNA, 23 nt, Yersinia pestis
auaaauuucugguuugaauccag

SEQ ID NO: 2278375 - RNA, 22 nt, Yersinia pestis
auaaauuacucguauaaaaaau

SEQ ID NO: 2278376 - RNA, 12 nt, Yersinia pestis
auaaauuaaaac

SEQ ID NO: 2278377 - RNA, 21 nt, Yersinia pestis
auaaaugucgcuaauaggccu

SEQ ID NO: 2278378 - RNA, 14 nt, Yersinia pestis
auaaaugucacuug

SEQ ID NO: 2278379 - RNA, 18 nt, Yersinia pestis
auaacaccaauugcaggc

SEQ ID NO: 2278380 - RNA, 22 nt, Yersinia pestis
auaaauuuuaaguuaauguuua

SEQ ID NO: 2278381 - RNA, 22 nt, Yersinia pestis
auaaccgcagcaggcagagcaa

SEQ ID NO: 2278382 - RNA, 19 nt, Yersinia pestis
auaaccgcgaagaggguuu

SEQ ID NO: 2278383 - RNA, 20 nt, Yersinia pestis
auaaccgcuaaggccaaugg

SEQ ID NO: 2278384 - RNA, 21 nt, Yersinia pestis
auaaccgcuaaggccaaugga

SEQ ID NO: 2278385 - RNA, 13 nt, Yersinia pestis
auaacccuugcca

SEQ ID NO: 2278386 - RNA, 16 nt, Yersinia pestis
auaaccgaguuuuuug

SEQ ID NO: 2278387 - RNA, 14 nt, Yersinia pestis
auaacccaguugcg

SEQ ID NO: 2278388 - RNA, 19 nt, Yersinia pestis
auaacccgccuagcaucau

SEQ ID NO: 2278389 - RNA, 13 nt, Yersinia pestis
auaacauuuuuuc

SEQ ID NO: 2278390 - RNA, 14 nt, Yersinia pestis
auaaccaaaucacc

SEQ ID NO: 2278391 - RNA, 17 nt, Yersinia pestis
auaacacggcuuuuauc

SEQ ID NO: 2278392 - RNA, 20 nt, Yersinia pestis
auaacacuuaauugguuuau

SEQ ID NO: 2278393 - RNA, 15 nt, Yersinia pestis
agucugaagccuacg

SEQ ID NO: 2278394 - RNA, 22 nt, Yersinia pestis
agucugaaacgccagccucugc

SEQ ID NO: 2278395 - RNA, 14 nt, Yersinia pestis
agucugaaaugauc

SEQ ID NO: 2278396 - RNA, 17 nt, Yersinia pestis
agucugagguggccauu

SEQ ID NO: 2278397 - RNA, 23 nt, Yersinia pestis
agucugacaccggggauccauag

SEQ ID NO: 2278398 - RNA, 15 nt, Yersinia pestis
agucugaggagccau

SEQ ID NO: 2278399 - RNA, 15 nt, Yersinia pestis
agucugaggcccgcu

SEQ ID NO: 2278400 - RNA, 18 nt, Yersinia pestis
agucugagccucaugaau

SEQ ID NO: 2278401 - RNA, 23 nt, Yersinia pestis
agucugagccucaugaaugaggc

SEQ ID NO: 2278402 - RNA, 13 nt, Yersinia pestis
agucuguuucauu

SEQ ID NO: 2278403 - RNA, 15 nt, Yersinia pestis
agucuguuucauucu

SEQ ID NO: 2278404 - RNA, 18 nt, Yersinia pestis
agucuguuucauucuggu

SEQ ID NO: 2278405 - RNA, 20 nt, Yersinia pestis
agucuguuaugcccaacugc

SEQ ID NO: 2278406 - RNA, 20 nt, Yersinia pestis
agucuuccaugacaaaauac

SEQ ID NO: 2278407 - RNA, 14 nt, Yersinia pestis
agucuuagacguca

SEQ ID NO: 2278408 - RNA, 14 nt, Yersinia pestis
agugacgcagugac

SEQ ID NO: 2278409 - RNA, 20 nt, Yersinia pestis
agucuugguagagaucagag

SEQ ID NO: 2278410 - RNA, 13 nt, Yersinia pestis
agucuacgcucua

SEQ ID NO: 2278411 - RNA, 17 nt, Yersinia pestis
agucuacgcucuacauu

SEQ ID NO: 2278412 - RNA, 19 nt, Yersinia pestis
agucgacaguguaaaaagc

SEQ ID NO: 2278413 - RNA, 23 nt, Yersinia pestis
agucgcgauaaaauucagccacu

SEQ ID NO: 2278414 - RNA, 20 nt, Yersinia pestis
agucgcgaugcgcugcucuu

SEQ ID NO: 2278415 - RNA, 12 nt, Yersinia pestis
agucgccuuaaa

SEQ ID NO: 2278416 - RNA, 13 nt, Yersinia pestis
agucgcgaaauaa

SEQ ID NO: 2278417 - RNA, 19 nt, Yersinia pestis
agucgcgaaauaagaauaa

SEQ ID NO: 2278418 - RNA, 15 nt, Yersinia pestis
aguccuuaaaaaccc

SEQ ID NO: 2278419 - RNA, 17 nt, Yersinia pestis
agucgacaguguaaaaa

SEQ ID NO: 2278420 - RNA, 17 nt, Yersinia pestis
aguguacuguuaacuca

SEQ ID NO: 2278421 - RNA, 19 nt, Yersinia pestis
aguguacuguuaacucaug

SEQ ID NO: 2278422 - RNA, 12 nt, Yersinia pestis
aguguaaaaccu

SEQ ID NO: 2278423 - RNA, 20 nt, Yersinia pestis
aguguaucaauaggauuuuc

SEQ ID NO: 2278424 - RNA, 20 nt, Yersinia pestis
aguguauucgcaucuuccaa

SEQ ID NO: 2278425 - RNA, 18 nt, Yersinia pestis
aguguaugaguaucaaua

SEQ ID NO: 2278426 - RNA, 23 nt, Yersinia pestis
agugucgaaagacgcaaacgggu

SEQ ID NO: 2278427 - RNA, 16 nt, Yersinia pestis
agugucaugcgcagaa

SEQ ID NO: 2278428 - RNA, 20 nt, Yersinia pestis
agugguagauguauuaguuu

SEQ ID NO: 2278429 - RNA, 14 nt, Yersinia pestis
aguguaaaaagcag

SEQ ID NO: 2278430 - RNA, 21 nt, Yersinia pestis
aguguaaaaagcagugcugaa

SEQ ID NO: 2278431 - RNA, 22 nt, Yersinia pestis
aguguaaaaaccaucugaugca

SEQ ID NO: 2278432 - RNA, 19 nt, Yersinia pestis
agugggcagggcgcaaugg

SEQ ID NO: 2278433 - RNA, 16 nt, Yersinia pestis
aguggcacaaauaaaa

SEQ ID NO: 2278434 - RNA, 22 nt, Yersinia pestis
agugagaaggguauugaagaua

SEQ ID NO: 2278435 - RNA, 17 nt, Yersinia pestis
agugagcgcggguaaug

SEQ ID NO: 2278436 - RNA, 17 nt, Yersinia pestis
agugagcgcgggucaug

SEQ ID NO: 2278437 - RNA, 18 nt, Yersinia pestis
agugcagcaaaagguauc

SEQ ID NO: 2278438 - RNA, 22 nt, Yersinia pestis
agugcauccagcguaaacagua

SEQ ID NO: 2278439 - RNA, 15 nt, Yersinia pestis
agugcaugcagguca

SEQ ID NO: 2278440 - RNA, 21 nt, Yersinia pestis
agugccugcaacggagagaac

SEQ ID NO: 2278441 - RNA, 21 nt, Yersinia pestis
agugccgucaauuaucaaaaa

SEQ ID NO: 2278442 - RNA, 22 nt, Yersinia pestis
agugccgucaauuaucaaaaaa

SEQ ID NO: 2278443 - RNA, 13 nt, Yersinia pestis
agugccaacagcg

SEQ ID NO: 2278444 - RNA, 20 nt, Yersinia pestis
agugccgucaauuaucaaaa

SEQ ID NO: 2278445 - RNA, 17 nt, Yersinia pestis
agugcguuuuauucaag

SEQ ID NO: 2278446 - RNA, 17 nt, Yersinia pestis
agugcgacgauaaaggc

SEQ ID NO: 2278447 - RNA, 19 nt, Yersinia pestis
agugcugaacguaaaacaa

SEQ ID NO: 2278448 - RNA, 16 nt, Yersinia pestis
aguggacgaacagcuc

SEQ ID NO: 2278449 - RNA, 19 nt, Yersinia pestis
aguggacgauaaauucaaa

SEQ ID NO: 2278450 - RNA, 16 nt, Yersinia pestis
aguucgacaccuucaa

SEQ ID NO: 2278451 - RNA, 21 nt, Yersinia pestis
aguucgacaccuucaaucauu

SEQ ID NO: 2278452 - RNA, 14 nt, Yersinia pestis
aguucggcuuucga

SEQ ID NO: 2278453 - RNA, 19 nt, Yersinia pestis
aguucggucuauaaaaccg

SEQ ID NO: 2278454 - RNA, 16 nt, Yersinia pestis
aguucggucuauaaaa

SEQ ID NO: 2278455 - RNA, 22 nt, Yersinia pestis
aguucuggaucggcauacucca

SEQ ID NO: 2278456 - RNA, 14 nt, Yersinia pestis
aguucugcgccccc

SEQ ID NO: 2278457 - RNA, 23 nt, Yersinia pestis
aguucugcgguaauauccacauu

SEQ ID NO: 2278458 - RNA, 21 nt, Yersinia pestis
aguuccagccccaaacacuua

SEQ ID NO: 2278459 - RNA, 14 nt, Yersinia pestis
aguucaacaguauc

SEQ ID NO: 2278460 - RNA, 18 nt, Yersinia pestis
aguuauacccauacaaau

SEQ ID NO: 2278461 - RNA, 14 nt, Yersinia pestis
aguguuuucuccac

SEQ ID NO: 2278462 - RNA, 17 nt, Yersinia pestis
aguuaaaaccaguaacu

SEQ ID NO: 2278463 - RNA, 22 nt, Yersinia pestis
aguuaaacgguaaccauccaua

SEQ ID NO: 2278464 - RNA, 21 nt, Yersinia pestis
aguuacgucaggaauaaagua

SEQ ID NO: 2278465 - RNA, 18 nt, Yersinia pestis
aguuacgucagaaauaaa

SEQ ID NO: 2278466 - RNA, 16 nt, Yersinia pestis
aguuagcaggcagcac

SEQ ID NO: 2278467 - RNA, 19 nt, Yersinia pestis
aguuagacccaauugcagg

SEQ ID NO: 2278468 - RNA, 14 nt, Yersinia pestis
aguuacucagcauc

SEQ ID NO: 2278469 - RNA, 22 nt, Yersinia pestis
aguguucggggguugucagcag

SEQ ID NO: 2278470 - RNA, 15 nt, Yersinia pestis
aguguucauaaauua

SEQ ID NO: 2278471 - RNA, 18 nt, Yersinia pestis
aguguucauaaauuaaaa

SEQ ID NO: 2278472 - RNA, 16 nt, Yersinia pestis
aguguguguauuuaaa

SEQ ID NO: 2278473 - RNA, 22 nt, Yersinia pestis
agugugccuuggucucagaaca

SEQ ID NO: 2278474 - RNA, 16 nt, Yersinia pestis
agugugcgcaucagcc

SEQ ID NO: 2278475 - RNA, 17 nt, Yersinia pestis
agugugcaggauagaga

SEQ ID NO: 2278476 - RNA, 14 nt, Yersinia pestis
agugugcaaauaaa

SEQ ID NO: 2278477 - RNA, 23 nt, Yersinia pestis
aguuuuuuguuuuucugacaaaa

SEQ ID NO: 2278478 - RNA, 18 nt, Yersinia pestis
aguuuucuggcaauuucu

SEQ ID NO: 2278479 - RNA, 18 nt, Yersinia pestis
aguuuuagcccaaaauag

SEQ ID NO: 2278480 - RNA, 17 nt, Yersinia pestis
aguuugaucgcuaaucg

SEQ ID NO: 2278481 - RNA, 15 nt, Yersinia pestis
aguuucccuuuucca

SEQ ID NO: 2278482 - RNA, 21 nt, Yersinia pestis
aguuuacgcacguugagugau

SEQ ID NO: 2278483 - RNA, 20 nt, Yersinia pestis
aguuuaacuaggcgagccgc

SEQ ID NO: 2278484 - RNA, 21 nt, Yersinia pestis
aguuuaaugccguuuugcaga

SEQ ID NO: 2278485 - RNA, 14 nt, Yersinia pestis
aguuuaagucugcc

SEQ ID NO: 2278486 - RNA, 16 nt, Yersinia pestis
aguuggcauucuaguu

SEQ ID NO: 2278487 - RNA, 12 nt, Yersinia pestis
aguuggcagaga

SEQ ID NO: 2278488 - RNA, 21 nt, Yersinia pestis
aguugcuggaauccaaguuca

SEQ ID NO: 2278489 - RNA, 22 nt, Yersinia pestis
aguugcuuaaguugaauaagau

SEQ ID NO: 2278490 - RNA, 14 nt, Yersinia pestis
aguugaaccauaaa

SEQ ID NO: 2278491 - RNA, 19 nt, Yersinia pestis
aguugaauaagaucccaga

SEQ ID NO: 2278492 - RNA, 16 nt, Yersinia pestis
aguugcaguucaucaa

SEQ ID NO: 2278493 - RNA, 12 nt, Yersinia pestis
aucaccaaacag

SEQ ID NO: 2278494 - RNA, 20 nt, Yersinia pestis
aucaccaacaccaccaucac

SEQ ID NO: 2278495 - RNA, 14 nt, Yersinia pestis
aucacauuucaaau

SEQ ID NO: 2278496 - RNA, 13 nt, Yersinia pestis
aucacaugcucag

SEQ ID NO: 2278497 - RNA, 13 nt, Yersinia pestis
aucacaucuugca

SEQ ID NO: 2278498 - RNA, 17 nt, Yersinia pestis
aucaccagacaaccaau

SEQ ID NO: 2278499 - RNA, 18 nt, Yersinia pestis
aucaccaccgcauuuuca

SEQ ID NO: 2278500 - RNA, 17 nt, Yersinia pestis
aucacagcucucugagc

SEQ ID NO: 2278501 - RNA, 22 nt, Yersinia pestis
aucaccggucuggacuuuggcc

SEQ ID NO: 2278502 - RNA, 14 nt, Yersinia pestis
aucaccauauucau

SEQ ID NO: 2278503 - RNA, 13 nt, Yersinia pestis
aucaccaugccuu

SEQ ID NO: 2278504 - RNA, 15 nt, Yersinia pestis
aucaccgaaagaaga

SEQ ID NO: 2278505 - RNA, 17 nt, Yersinia pestis
aucacccgccucuaaau

SEQ ID NO: 2278506 - RNA, 12 nt, Yersinia pestis
aucaccccccug

SEQ ID NO: 2278507 - RNA, 15 nt, Yersinia pestis
aucacccagcaaaau

SEQ ID NO: 2278508 - RNA, 18 nt, Yersinia pestis
aucacucgggauaugacu

SEQ ID NO: 2278509 - RNA, 15 nt, Yersinia pestis
aucacuauuucaggc

SEQ ID NO: 2278510 - RNA, 22 nt, Yersinia pestis
aucacuauuucaggcauaucac

SEQ ID NO: 2278511 - RNA, 14 nt, Yersinia pestis
aucacuauuucaga

SEQ ID NO: 2278512 - RNA, 15 nt, Yersinia pestis
aucacugauucagaa

SEQ ID NO: 2278513 - RNA, 16 nt, Yersinia pestis
aucacugauucagaaa

SEQ ID NO: 2278514 - RNA, 22 nt, Yersinia pestis
aucacugauucagaaagguaug

SEQ ID NO: 2278515 - RNA, 17 nt, Yersinia pestis
aucacucugcuacugcg

SEQ ID NO: 2278516 - RNA, 20 nt, Yersinia pestis
aucacguauugccucggcaa

SEQ ID NO: 2278517 - RNA, 18 nt, Yersinia pestis
aucacuagcgggccucag

SEQ ID NO: 2278518 - RNA, 13 nt, Yersinia pestis
aucacuauaauua

SEQ ID NO: 2278519 - RNA, 23 nt, Yersinia pestis
aucacuauauacccgucauacuu

SEQ ID NO: 2278520 - RNA, 20 nt, Yersinia pestis
aucacuauaauuauuucucu

SEQ ID NO: 2278521 - RNA, 14 nt, Yersinia pestis
aucacuagcgggcc

SEQ ID NO: 2278522 - RNA, 22 nt, Yersinia pestis
aucacgauacgacuucuuauua

SEQ ID NO: 2278523 - RNA, 19 nt, Yersinia pestis
aucacgcagcuuuuucuca

SEQ ID NO: 2278524 - RNA, 20 nt, Yersinia pestis
aucacgcagcuuuuucucac

SEQ ID NO: 2278525 - RNA, 20 nt, Yersinia pestis
aucaccuuggaaaacagcaa

SEQ ID NO: 2278526 - RNA, 15 nt, Yersinia pestis
aucaccuuccaaacu

SEQ ID NO: 2278527 - RNA, 22 nt, Yersinia pestis
aucaccuuccaaacuuugugga

SEQ ID NO: 2278528 - RNA, 16 nt, Yersinia pestis
aucacggaaaucugcg

SEQ ID NO: 2278529 - RNA, 21 nt, Yersinia pestis
aucagcaguggcuuggcaacc

SEQ ID NO: 2278530 - RNA, 16 nt, Yersinia pestis
aucagcaucaauaaaa

SEQ ID NO: 2278531 - RNA, 13 nt, Yersinia pestis
aucagccagcgaa

SEQ ID NO: 2278532 - RNA, 14 nt, Yersinia pestis
aucagcagagagcg

SEQ ID NO: 2278533 - RNA, 22 nt, Yersinia pestis
aucagcagagagcgacucacga

SEQ ID NO: 2278534 - RNA, 14 nt, Yersinia pestis
aucagcaaauuuug

SEQ ID NO: 2278535 - RNA, 19 nt, Yersinia pestis
aucagcaaaaacaaauaau

SEQ ID NO: 2278536 - RNA, 17 nt, Yersinia pestis
aucagcacauccaugcc

SEQ ID NO: 2278537 - RNA, 16 nt, Yersinia pestis
aucagcgcuggcuuuu

SEQ ID NO: 2278538 - RNA, 22 nt, Yersinia pestis
aucagcgguugggcuaaccagu

SEQ ID NO: 2278539 - RNA, 21 nt, Yersinia pestis
aucagcguauagcgccgccag

SEQ ID NO: 2278540 - RNA, 18 nt, Yersinia pestis
aucagcgcccuacugcau

SEQ ID NO: 2278541 - RNA, 23 nt, Yersinia pestis
aucagcgccuuugccccgauuug

SEQ ID NO: 2278542 - RNA, 20 nt, Yersinia pestis
aucagccagccacugggcua

SEQ ID NO: 2278543 - RNA, 23 nt, Yersinia pestis
aucagccauauguugccaccagc

SEQ ID NO: 2278544 - RNA, 18 nt, Yersinia pestis
aucagccccuuugaacug

SEQ ID NO: 2278545 - RNA, 24 nt, Yersinia pestis
aucagcgaccaaauggacgaacag

SEQ ID NO: 2278546 - RNA, 15 nt, Yersinia pestis
aucagcgauagcugc

SEQ ID NO: 2278547 - RNA, 16 nt, Yersinia pestis
aucacugucaaaaagc

SEQ ID NO: 2278548 - RNA, 21 nt, Yersinia pestis
aucacuggcgggccguuuacu

SEQ ID NO: 2278549 - RNA, 22 nt, Yersinia pestis
aucacuggaggcguuuuuauug

SEQ ID NO: 2278550 - RNA, 23 nt, Yersinia pestis
aucacuucaauguuuuuauccaa

SEQ ID NO: 2278551 - RNA, 23 nt, Yersinia pestis
aucacuuauuggaaguacuuauu

SEQ ID NO: 2278552 - RNA, 20 nt, Yersinia pestis
aucacuugccagagcaauaa

SEQ ID NO: 2278553 - RNA, 19 nt, Yersinia pestis
aucacuuuuaugacggcau

SEQ ID NO: 2278554 - RNA, 14 nt, Yersinia pestis
aucagaaacagcag

SEQ ID NO: 2278555 - RNA, 22 nt, Yersinia pestis
aucagaaacaauaaauauccuc

SEQ ID NO: 2278556 - RNA, 23 nt, Yersinia pestis
aucagauuguuuauaaauuaaaa

SEQ ID NO: 2278557 - RNA, 14 nt, Yersinia pestis
aucagacugcucuu

SEQ ID NO: 2278558 - RNA, 20 nt, Yersinia pestis
aucagacugcucuuucccuu

SEQ ID NO: 2278559 - RNA, 15 nt, Yersinia pestis
aucagaccuuuagga

SEQ ID NO: 2278560 - RNA, 21 nt, Yersinia pestis
aucagaccuuuacaggacuga

SEQ ID NO: 2278561 - RNA, 17 nt, Yersinia pestis
aucagacacguaaaaca

SEQ ID NO: 2278562 - RNA, 15 nt, Yersinia pestis
aucagacauuuuucu

SEQ ID NO: 2278563 - RNA, 20 nt, Yersinia pestis
aucaaugaccacuaaauuaa

SEQ ID NO: 2278564 - RNA, 12 nt, Yersinia pestis
aucaaugaaaau

SEQ ID NO: 2278565 - RNA, 14 nt, Yersinia pestis
aucaaugcaacugg

SEQ ID NO: 2278566 - RNA, 17 nt, Yersinia pestis
aucaauguuaucgccaa

SEQ ID NO: 2278567 - RNA, 23 nt, Yersinia pestis
aucaauguuaucgccaacacuau

SEQ ID NO: 2278568 - RNA, 22 nt, Yersinia pestis
aucaauggccagcgggaaucaa

SEQ ID NO: 2278569 - RNA, 20 nt, Yersinia pestis
aucaauaggauuuucaugau

SEQ ID NO: 2278570 - RNA, 17 nt, Yersinia pestis
aucaauaggauuuucau

SEQ ID NO: 2278571 - RNA, 18 nt, Yersinia pestis
aucaaguugaaugaagcg

SEQ ID NO: 2278572 - RNA, 17 nt, Yersinia pestis
aucaauagguguugccg

SEQ ID NO: 2278573 - RNA, 16 nt, Yersinia pestis
aucaauauaagagaaa

SEQ ID NO: 2278574 - RNA, 21 nt, Yersinia pestis
aucaauaucccgagaaacaaa

SEQ ID NO: 2278575 - RNA, 15 nt, Yersinia pestis
aucaauugcuggcua

SEQ ID NO: 2278576 - RNA, 22 nt, Yersinia pestis
aucaauuuauacccguuauauu

SEQ ID NO: 2278577 - RNA, 13 nt, Yersinia pestis
aucacacuggugc

SEQ ID NO: 2278578 - RNA, 19 nt, Yersinia pestis
aucacaccgcgaucacaau

SEQ ID NO: 2278579 - RNA, 17 nt, Yersinia pestis
aucacaauacagcaaau

SEQ ID NO: 2278580 - RNA, 13 nt, Yersinia pestis
aucacaacccccc

SEQ ID NO: 2278581 - RNA, 22 nt, Yersinia pestis
aucaaggacgaaggguaaaaua

SEQ ID NO: 2278582 - RNA, 14 nt, Yersinia pestis
aucaagcuacaugu

SEQ ID NO: 2278583 - RNA, 16 nt, Yersinia pestis
aucaaguacuucaauu

SEQ ID NO: 2278584 - RNA, 18 nt, Yersinia pestis
aucaaggcuuuaauaucu

SEQ ID NO: 2278585 - RNA, 17 nt, Yersinia pestis
aucaaggcggcagagcc

SEQ ID NO: 2278586 - RNA, 14 nt, Yersinia pestis
aucaagcaauaauu

SEQ ID NO: 2278587 - RNA, 19 nt, Yersinia pestis
aucaagcccgcaauuuuaa

SEQ ID NO: 2278588 - RNA, 16 nt, Yersinia pestis
aucaacggcaccacag

SEQ ID NO: 2278589 - RNA, 16 nt, Yersinia pestis
aucaaccugaucauca

SEQ ID NO: 2278590 - RNA, 14 nt, Yersinia pestis
aucaacccgcagac

SEQ ID NO: 2278591 - RNA, 22 nt, Yersinia pestis
aucaacccgcagacugaaauaa

SEQ ID NO: 2278592 - RNA, 16 nt, Yersinia pestis
aucaaccucagccuca

SEQ ID NO: 2278593 - RNA, 17 nt, Yersinia pestis
aucaaccucagccucau

SEQ ID NO: 2278594 - RNA, 22 nt, Yersinia pestis
aucaaccucagccucauucaug

SEQ ID NO: 2278595 - RNA, 14 nt, Yersinia pestis
aucaaccucagccu

SEQ ID NO: 2278596 - RNA, 15 nt, Yersinia pestis
aucaaccucagccuc

SEQ ID NO: 2278597 - RNA, 22 nt, Yersinia pestis
aucaacccccuguggaaacucu

SEQ ID NO: 2278598 - RNA, 18 nt, Yersinia pestis
aucaacauuuuuagcuuc

SEQ ID NO: 2278599 - RNA, 23 nt, Yersinia pestis
aucaaccacgguuuaaucaaugu

SEQ ID NO: 2278600 - RNA, 20 nt, Yersinia pestis
aucaacauuccauaccugaa

SEQ ID NO: 2278601 - RNA, 16 nt, Yersinia pestis
aucaaaccagagaaag

SEQ ID NO: 2278602 - RNA, 22 nt, Yersinia pestis
aucaaacaaaucuuaaauugaa

SEQ ID NO: 2278603 - RNA, 20 nt, Yersinia pestis
aucaacaugguccacaguca

SEQ ID NO: 2278604 - RNA, 20 nt, Yersinia pestis
aucaaacggcuuuuuaaacu

SEQ ID NO: 2278605 - RNA, 16 nt, Yersinia pestis
aucaaacggcaacuuc

SEQ ID NO: 2278606 - RNA, 18 nt, Yersinia pestis
aucaaacggcuuuuuaaa

SEQ ID NO: 2278607 - RNA, 20 nt, Yersinia pestis
aucaaacucaccauuauguu

SEQ ID NO: 2278608 - RNA, 23 nt, Yersinia pestis
auauugauaaaaguaauuuauca

SEQ ID NO: 2278609 - RNA, 20 nt, Yersinia pestis
auauugauccaaauggcugc

SEQ ID NO: 2278610 - RNA, 15 nt, Yersinia pestis
auauucucauugccc

SEQ ID NO: 2278611 - RNA, 13 nt, Yersinia pestis
auauucucaauau

SEQ ID NO: 2278612 - RNA, 15 nt, Yersinia pestis
auauucgugaucaaa

SEQ ID NO: 2278613 - RNA, 14 nt, Yersinia pestis
auauucguacuacc

SEQ ID NO: 2278614 - RNA, 21 nt, Yersinia pestis
auauucgccagauugccaauc

SEQ ID NO: 2278615 - RNA, 23 nt, Yersinia pestis
auaugauucgguuauucuucuau

SEQ ID NO: 2278616 - RNA, 24 nt, Yersinia pestis
auauuauuuaauuaaauguauaaa

SEQ ID NO: 2278617 - RNA, 17 nt, Yersinia pestis
auaugauaauaguucau

SEQ ID NO: 2278618 - RNA, 21 nt, Yersinia pestis
auauuauugacgguuacagcg

SEQ ID NO: 2278619 - RNA, 22 nt, Yersinia pestis
auauucaccguuuccagaauca

SEQ ID NO: 2278620 - RNA, 12 nt, Yersinia pestis
auauucaccaca

SEQ ID NO: 2278621 - RNA, 20 nt, Yersinia pestis
auauucaccacacauaccac

SEQ ID NO: 2278622 - RNA, 13 nt, Yersinia pestis
aucaaaaaauaaa

SEQ ID NO: 2278623 - RNA, 20 nt, Yersinia pestis
auauuuugaauauuuuuaau

SEQ ID NO: 2278624 - RNA, 18 nt, Yersinia pestis
auauuuuuaauuuagcca

SEQ ID NO: 2278625 - RNA, 17 nt, Yersinia pestis
auauuguuuugacuaaa

SEQ ID NO: 2278626 - RNA, 13 nt, Yersinia pestis
auauuuuagcaau

SEQ ID NO: 2278627 - RNA, 21 nt, Yersinia pestis
auauuugcugccugcaccagu

SEQ ID NO: 2278628 - RNA, 15 nt, Yersinia pestis
auacucauugcaccu

SEQ ID NO: 2278629 - RNA, 18 nt, Yersinia pestis
auacucauccagauuauu

SEQ ID NO: 2278630 - RNA, 15 nt, Yersinia pestis
auacguuggcggcuc

SEQ ID NO: 2278631 - RNA, 16 nt, Yersinia pestis
auacguugaauuaaaa

SEQ ID NO: 2278632 - RNA, 22 nt, Yersinia pestis
auacuucgaugauuauuuugug

SEQ ID NO: 2278633 - RNA, 21 nt, Yersinia pestis
auacuggguuuaaagguggcu

SEQ ID NO: 2278634 - RNA, 17 nt, Yersinia pestis
auacugccaaucgcucu

SEQ ID NO: 2278635 - RNA, 23 nt, Yersinia pestis
auacugcacguuuaauuucacuu

SEQ ID NO: 2278636 - RNA, 15 nt, Yersinia pestis
auacugccaucauca

SEQ ID NO: 2278637 - RNA, 21 nt, Yersinia pestis
auacugaaauauacacaaguc

SEQ ID NO: 2278638 - RNA, 14 nt, Yersinia pestis
auacugauacaaca

SEQ ID NO: 2278639 - RNA, 21 nt, Yersinia pestis
auacugacggggaguuuuuau

SEQ ID NO: 2278640 - RNA, 22 nt, Yersinia pestis
auacggcuucaccgcuuuucug

SEQ ID NO: 2278641 - RNA, 16 nt, Yersinia pestis
auacggcgaaauauaa

SEQ ID NO: 2278642 - RNA, 20 nt, Yersinia pestis
auacgguccagcaucgcuga

SEQ ID NO: 2278643 - RNA, 14 nt, Yersinia pestis
auacggucaaaagc

SEQ ID NO: 2278644 - RNA, 17 nt, Yersinia pestis
auacgaucaucugguga

SEQ ID NO: 2278645 - RNA, 18 nt, Yersinia pestis
auaccggcggcacacugg

SEQ ID NO: 2278646 - RNA, 18 nt, Yersinia pestis
auaccugauguuuugcug

SEQ ID NO: 2278647 - RNA, 22 nt, Yersinia pestis
auaccugcaccaaugacuaauu

SEQ ID NO: 2278648 - RNA, 18 nt, Yersinia pestis
auaccuguacuuugauuc

SEQ ID NO: 2278649 - RNA, 18 nt, Yersinia pestis
auaccuggcgggucuccc

SEQ ID NO: 2278650 - RNA, 15 nt, Yersinia pestis
auaauuagauugaca

SEQ ID NO: 2278651 - RNA, 20 nt, Yersinia pestis
auaccgcugcuaccagcagu

SEQ ID NO: 2278652 - RNA, 13 nt, Yersinia pestis
auaauuaauuauu

SEQ ID NO: 2278653 - RNA, 15 nt, Yersinia pestis
auaauuaauuauuca

SEQ ID NO: 2278654 - RNA, 22 nt, Yersinia pestis
auagcaaugucacuauucccau

SEQ ID NO: 2278655 - RNA, 12 nt, Yersinia pestis
auagcagagaag

SEQ ID NO: 2278656 - RNA, 21 nt, Yersinia pestis
auagcaccgagcaugcuaacu

SEQ ID NO: 2278657 - RNA, 21 nt, Yersinia pestis
auagcaaugaccuuacaguga

SEQ ID NO: 2278658 - RNA, 22 nt, Yersinia pestis
auagcaaugaccuuacagugau

SEQ ID NO: 2278659 - RNA, 16 nt, Yersinia pestis
auagauggcuuuggug

SEQ ID NO: 2278660 - RNA, 18 nt, Yersinia pestis
auagagugcaauuuuauu

SEQ ID NO: 2278661 - RNA, 17 nt, Yersinia pestis
auagagucacagaggaa

SEQ ID NO: 2278662 - RNA, 17 nt, Yersinia pestis
auagaggaaauaaauga

SEQ ID NO: 2278663 - RNA, 16 nt, Yersinia pestis
auacuugaaacagcag

SEQ ID NO: 2278664 - RNA, 12 nt, Yersinia pestis
auagagaacucc

SEQ ID NO: 2278665 - RNA, 22 nt, Yersinia pestis
auagacuguuuuauuauauauu

SEQ ID NO: 2278666 - RNA, 20 nt, Yersinia pestis
auagcugcugcuuucagugu

SEQ ID NO: 2278667 - RNA, 20 nt, Yersinia pestis
auagcuaucuugccuguuga

SEQ ID NO: 2278668 - RNA, 21 nt, Yersinia pestis
auagcucauuuuaaauaugau

SEQ ID NO: 2278669 - RNA, 15 nt, Yersinia pestis
auagcuaucuugccu

SEQ ID NO: 2278670 - RNA, 20 nt, Yersinia pestis
auagcuaccccuucagucag

SEQ ID NO: 2278671 - RNA, 17 nt, Yersinia pestis
auagcuaaccuuaacug

SEQ ID NO: 2278672 - RNA, 20 nt, Yersinia pestis
auagcugucagcgaaaaaaa

SEQ ID NO: 2278673 - RNA, 20 nt, Yersinia pestis
auagcuggcuucaaaaucac

SEQ ID NO: 2278674 - RNA, 22 nt, Yersinia pestis
auagcuggcggauaaaaaugca

SEQ ID NO: 2278675 - RNA, 18 nt, Yersinia pestis
auagcuuaaucaucauca

SEQ ID NO: 2278676 - RNA, 11 nt, Yersinia pestis
auagcuucccu

SEQ ID NO: 2278677 - RNA, 13 nt, Yersinia pestis
auagcuucccugg

SEQ ID NO: 2278678 - RNA, 15 nt, Yersinia pestis
auagccagugggcag

SEQ ID NO: 2278679 - RNA, 17 nt, Yersinia pestis
auagccauggcuucugc

SEQ ID NO: 2278680 - RNA, 22 nt, Yersinia pestis
auagcgggccuuugcuuuucug

SEQ ID NO: 2278681 - RNA, 21 nt, Yersinia pestis
auagcggaauauuuaaccaga

SEQ ID NO: 2278682 - RNA, 15 nt, Yersinia pestis
auagcgcuucaguga

SEQ ID NO: 2278683 - RNA, 16 nt, Yersinia pestis
auagcgcugcaucagc

SEQ ID NO: 2278684 - RNA, 15 nt, Yersinia pestis
auagcccucccuggg

SEQ ID NO: 2278685 - RNA, 15 nt, Yersinia pestis
auaugaaaaaccucc

SEQ ID NO: 2278686 - RNA, 14 nt, Yersinia pestis
auaugacuaaacug

SEQ ID NO: 2278687 - RNA, 19 nt, Yersinia pestis
auaugaaaaaucugacucu

SEQ ID NO: 2278688 - RNA, 21 nt, Yersinia pestis
auaucuugaaccaauuuuucu

SEQ ID NO: 2278689 - RNA, 20 nt, Yersinia pestis
auaucuagcaacacaucggu

SEQ ID NO: 2278690 - RNA, 20 nt, Yersinia pestis
auaucugcggugaucaccag

SEQ ID NO: 2278691 - RNA, 14 nt, Yersinia pestis
auaucuucaaucag

SEQ ID NO: 2278692 - RNA, 17 nt, Yersinia pestis
auauccaauuguuuuac

SEQ ID NO: 2278693 - RNA, 14 nt, Yersinia pestis
auauccacauugga

SEQ ID NO: 2278694 - RNA, 13 nt, Yersinia pestis
auauccaaaauaa

SEQ ID NO: 2278695 - RNA, 19 nt, Yersinia pestis
auaucgccacggauaaggu

SEQ ID NO: 2278696 - RNA, 18 nt, Yersinia pestis
auaucuaaguccaagaca

SEQ ID NO: 2278697 - RNA, 15 nt, Yersinia pestis
auaucuaacugaugu

SEQ ID NO: 2278698 - RNA, 14 nt, Yersinia pestis
auauacaaggcaca

SEQ ID NO: 2278699 - RNA, 17 nt, Yersinia pestis
auauacaaggcacaucu

SEQ ID NO: 2278700 - RNA, 14 nt, Yersinia pestis
auauauugcauuua

SEQ ID NO: 2278701 - RNA, 13 nt, Yersinia pestis
auauauuuuuaau

SEQ ID NO: 2278702 - RNA, 18 nt, Yersinia pestis
auaucagcauuaauaccg

SEQ ID NO: 2278703 - RNA, 13 nt, Yersinia pestis
auaucauuauuuu

SEQ ID NO: 2278704 - RNA, 17 nt, Yersinia pestis
auaucacuauaauuauu

SEQ ID NO: 2278705 - RNA, 12 nt, Yersinia pestis
auaucacuauuu

SEQ ID NO: 2278706 - RNA, 20 nt, Yersinia pestis
auaucacaguuaaaaauaga

SEQ ID NO: 2278707 - RNA, 13 nt, Yersinia pestis
auaucaccagguu

SEQ ID NO: 2278708 - RNA, 19 nt, Yersinia pestis
auauauuuuuucauauccg

SEQ ID NO: 2278709 - RNA, 21 nt, Yersinia pestis
auaucaaaauaaaaauucaca

SEQ ID NO: 2278710 - RNA, 14 nt, Yersinia pestis
auaucaaauuugca

SEQ ID NO: 2278711 - RNA, 15 nt, Yersinia pestis
auaucaaugaaaaaa

SEQ ID NO: 2278712 - RNA, 19 nt, Yersinia pestis
auaucaagucuugaagagu

SEQ ID NO: 2278713 - RNA, 20 nt, Yersinia pestis
auaucaauaagugcaaacuu

SEQ ID NO: 2278714 - RNA, 15 nt, Yersinia pestis
auaguaacaccagca

SEQ ID NO: 2278715 - RNA, 13 nt, Yersinia pestis
auaguacuuagca

SEQ ID NO: 2278716 - RNA, 17 nt, Yersinia pestis
auaguacuuagcaauaa

SEQ ID NO: 2278717 - RNA, 20 nt, Yersinia pestis
auaguacuugccacaacuga

SEQ ID NO: 2278718 - RNA, 21 nt, Yersinia pestis
auaguacgauaaccuucuuca

SEQ ID NO: 2278719 - RNA, 15 nt, Yersinia pestis
auaggugaugccccg

SEQ ID NO: 2278720 - RNA, 16 nt, Yersinia pestis
auaggucagugguuuu

SEQ ID NO: 2278721 - RNA, 17 nt, Yersinia pestis
auaggucagugguuuua

SEQ ID NO: 2278722 - RNA, 14 nt, Yersinia pestis
auaggguaauacca

SEQ ID NO: 2278723 - RNA, 20 nt, Yersinia pestis
auagggcugaagacccaagg

SEQ ID NO: 2278724 - RNA, 14 nt, Yersinia pestis
auagggaaaaguua

SEQ ID NO: 2278725 - RNA, 19 nt, Yersinia pestis
auaggcuuggguagaacuu

SEQ ID NO: 2278726 - RNA, 15 nt, Yersinia pestis
auaggcgaaaggcgc

SEQ ID NO: 2278727 - RNA, 21 nt, Yersinia pestis
auaggccuaaaccccacagcg

SEQ ID NO: 2278728 - RNA, 19 nt, Yersinia pestis
auaggcagaaaagcaaagg

SEQ ID NO: 2278729 - RNA, 17 nt, Yersinia pestis
auaggcagaauagucac

SEQ ID NO: 2278730 - RNA, 12 nt, Yersinia pestis
auagugaguaug

SEQ ID NO: 2278731 - RNA, 22 nt, Yersinia pestis
auagugauuuucaauccgggca

SEQ ID NO: 2278732 - RNA, 16 nt, Yersinia pestis
auaguguaaaaaccau

SEQ ID NO: 2278733 - RNA, 19 nt, Yersinia pestis
auaguguguguauuuaaaa

SEQ ID NO: 2278734 - RNA, 14 nt, Yersinia pestis
auaguguugcuaag

SEQ ID NO: 2278735 - RNA, 18 nt, Yersinia pestis
auaguguuguaagauuuc

SEQ ID NO: 2278736 - RNA, 14 nt, Yersinia pestis
auaguggguaaacc

SEQ ID NO: 2278737 - RNA, 20 nt, Yersinia pestis
auauaagagaugaaauuuua

SEQ ID NO: 2278738 - RNA, 13 nt, Yersinia pestis
auauaagagaaau

SEQ ID NO: 2278739 - RNA, 14 nt, Yersinia pestis
auauaagagaaauu

SEQ ID NO: 2278740 - RNA, 13 nt, Yersinia pestis
auauaauucaaua

SEQ ID NO: 2278741 - RNA, 14 nt, Yersinia pestis
auauaauucaauau

SEQ ID NO: 2278742 - RNA, 16 nt, Yersinia pestis
auauaauugaagauuu

SEQ ID NO: 2278743 - RNA, 13 nt, Yersinia pestis
auauaacagccau

SEQ ID NO: 2278744 - RNA, 18 nt, Yersinia pestis
auauaacugcgaccaaaa

SEQ ID NO: 2278745 - RNA, 24 nt, Yersinia pestis
auauaaccaucaaauacacauaac

SEQ ID NO: 2278746 - RNA, 22 nt, Yersinia pestis
auauaaaagcacagacaaacaa

SEQ ID NO: 2278747 - RNA, 15 nt, Yersinia pestis
auuaucaaguuaaau

SEQ ID NO: 2278748 - RNA, 12 nt, Yersinia pestis
auuaucauguaa

SEQ ID NO: 2278749 - RNA, 16 nt, Yersinia pestis
auuaucaucaauagcg

SEQ ID NO: 2278750 - RNA, 22 nt, Yersinia pestis
auuaucagcccaucuuugauuu

SEQ ID NO: 2278751 - RNA, 23 nt, Yersinia pestis
auuauccacgggcgcaauggaag

SEQ ID NO: 2278752 - RNA, 15 nt, Yersinia pestis
auuaucccaguuuuu

SEQ ID NO: 2278753 - RNA, 19 nt, Yersinia pestis
auuaucccguucaauaaua

SEQ ID NO: 2278754 - RNA, 21 nt, Yersinia pestis
auuaucccguucaauaauagu

SEQ ID NO: 2278755 - RNA, 22 nt, Yersinia pestis
auuaucgguagcgguaauuaau

SEQ ID NO: 2278756 - RNA, 16 nt, Yersinia pestis
auuaucgcuuuuaugg

SEQ ID NO: 2278757 - RNA, 17 nt, Yersinia pestis
auuaucgccuggcuuga

SEQ ID NO: 2278758 - RNA, 19 nt, Yersinia pestis
auuaugaaaguaagagucu

SEQ ID NO: 2278759 - RNA, 18 nt, Yersinia pestis
auuauugccggguaugaa

SEQ ID NO: 2278760 - RNA, 15 nt, Yersinia pestis
auuauuuauuuuaua

SEQ ID NO: 2278761 - RNA, 17 nt, Yersinia pestis
auuauuuauuuuauaau

SEQ ID NO: 2278762 - RNA, 19 nt, Yersinia pestis
auuauuuaaacaaugaaau

SEQ ID NO: 2278763 - RNA, 14 nt, Yersinia pestis
auuauuuaaacaau

SEQ ID NO: 2278764 - RNA, 16 nt, Yersinia pestis
auuauuuaaacaauga

SEQ ID NO: 2278765 - RNA, 15 nt, Yersinia pestis
auuauuauuuacaaa

SEQ ID NO: 2278766 - RNA, 13 nt, Yersinia pestis
auuauuauuacua

SEQ ID NO: 2278767 - RNA, 13 nt, Yersinia pestis
auuauucuuuuac

SEQ ID NO: 2278768 - RNA, 12 nt, Yersinia pestis
auuauucugcuc

SEQ ID NO: 2278769 - RNA, 19 nt, Yersinia pestis
auuauugauugcaucguca

SEQ ID NO: 2278770 - RNA, 18 nt, Yersinia pestis
auuauugauguuauuaau

SEQ ID NO: 2278771 - RNA, 15 nt, Yersinia pestis
auuauuaaagaugau

SEQ ID NO: 2278772 - RNA, 16 nt, Yersinia pestis
auuauuaaacuauuaa

SEQ ID NO: 2278773 - RNA, 20 nt, Yersinia pestis
auuauuaaacuauuaacucu

SEQ ID NO: 2278774 - RNA, 22 nt, Yersinia pestis
auuauuacucagcacauuuuua

SEQ ID NO: 2278775 - RNA, 13 nt, Yersinia pestis
auuauuaaugaaa

SEQ ID NO: 2278776 - RNA, 15 nt, Yersinia pestis
auuauuaaugaaauu

SEQ ID NO: 2278777 - RNA, 17 nt, Yersinia pestis
auuauuaauguacaccu

SEQ ID NO: 2278778 - RNA, 22 nt, Yersinia pestis
auuaugggugguuagcagauaa

SEQ ID NO: 2278779 - RNA, 24 nt, Yersinia pestis
auucaacgugacucacuacauucu

SEQ ID NO: 2278780 - RNA, 17 nt, Yersinia pestis
auucaacguguuguuuu

SEQ ID NO: 2278781 - RNA, 20 nt, Yersinia pestis
auucaacguguuguuuucau

SEQ ID NO: 2278782 - RNA, 21 nt, Yersinia pestis
auucaacguguuguuuucaug

SEQ ID NO: 2278783 - RNA, 21 nt, Yersinia pestis
auucaacccacuguuggaggc

SEQ ID NO: 2278784 - RNA, 16 nt, Yersinia pestis
auucaauaucacugau

SEQ ID NO: 2278785 - RNA, 19 nt, Yersinia pestis
auucaauaggguaauacca

SEQ ID NO: 2278786 - RNA, 22 nt, Yersinia pestis
auucaaugacuccugaaauaaa

SEQ ID NO: 2278787 - RNA, 23 nt, Yersinia pestis
auucaaggcuacccaauaacccc

SEQ ID NO: 2278788 - RNA, 16 nt, Yersinia pestis
auucaagguauuuggg

SEQ ID NO: 2278789 - RNA, 23 nt, Yersinia pestis
auuauuuuggguauauaguuuau

SEQ ID NO: 2278790 - RNA, 12 nt, Yersinia pestis
auuauuuuaugg

SEQ ID NO: 2278791 - RNA, 18 nt, Yersinia pestis
auuauuuucaaccaguua

SEQ ID NO: 2278792 - RNA, 16 nt, Yersinia pestis
auuauuucucugauga

SEQ ID NO: 2278793 - RNA, 23 nt, Yersinia pestis
auuauuugggguauaacgaucag

SEQ ID NO: 2278794 - RNA, 14 nt, Yersinia pestis
auuauuugauauag

SEQ ID NO: 2278795 - RNA, 17 nt, Yersinia pestis
auuauuugauauagaca

SEQ ID NO: 2278796 - RNA, 18 nt, Yersinia pestis
auucaaacacuuaugauc

SEQ ID NO: 2278797 - RNA, 13 nt, Yersinia pestis
auucaaaaugcca

SEQ ID NO: 2278798 - RNA, 14 nt, Yersinia pestis
auucaaaaugccag

SEQ ID NO: 2278799 - RNA, 15 nt, Yersinia pestis
auucaaaaauuaaau

SEQ ID NO: 2278800 - RNA, 16 nt, Yersinia pestis
auucacugaguugaga

SEQ ID NO: 2278801 - RNA, 22 nt, Yersinia pestis
auucacuauuuauuaaucuauu

SEQ ID NO: 2278802 - RNA, 14 nt, Yersinia pestis
auucacguuuuucc

SEQ ID NO: 2278803 - RNA, 15 nt, Yersinia pestis
auucacguuuuucca

SEQ ID NO: 2278804 - RNA, 19 nt, Yersinia pestis
auucacguccucuuauuaa

SEQ ID NO: 2278805 - RNA, 16 nt, Yersinia pestis
auucacgcaaggccag

SEQ ID NO: 2278806 - RNA, 20 nt, Yersinia pestis
auucaccuugauuaauaaca

SEQ ID NO: 2278807 - RNA, 19 nt, Yersinia pestis
auucagacccgauuucaac

SEQ ID NO: 2278808 - RNA, 16 nt, Yersinia pestis
auucagacgacgugca

SEQ ID NO: 2278809 - RNA, 18 nt, Yersinia pestis
auucagaugcugaacuug

SEQ ID NO: 2278810 - RNA, 12 nt, Yersinia pestis
auucagcaauau

SEQ ID NO: 2278811 - RNA, 12 nt, Yersinia pestis
auucacuuuccc

SEQ ID NO: 2278812 - RNA, 15 nt, Yersinia pestis
auucaauugugcaaa

SEQ ID NO: 2278813 - RNA, 12 nt, Yersinia pestis
auucacaacagu

SEQ ID NO: 2278814 - RNA, 20 nt, Yersinia pestis
auucacaacagugcaacauu

SEQ ID NO: 2278815 - RNA, 23 nt, Yersinia pestis
auucaaugacuccugaaauaaag

SEQ ID NO: 2278816 - RNA, 14 nt, Yersinia pestis
auucaccacacaua

SEQ ID NO: 2278817 - RNA, 14 nt, Yersinia pestis
auucacagcagaac

SEQ ID NO: 2278818 - RNA, 22 nt, Yersinia pestis
auucacaacauagguuuuuuca

SEQ ID NO: 2278819 - RNA, 23 nt, Yersinia pestis
auucaccagauggcgaucaaggu

SEQ ID NO: 2278820 - RNA, 18 nt, Yersinia pestis
auuacaccuuaaaacagc

SEQ ID NO: 2278821 - RNA, 14 nt, Yersinia pestis
auuacacugaauug

SEQ ID NO: 2278822 - RNA, 22 nt, Yersinia pestis
auuacacuuucuuugaugcaua

SEQ ID NO: 2278823 - RNA, 22 nt, Yersinia pestis
auuacacccaacuuuuuuacca

SEQ ID NO: 2278824 - RNA, 13 nt, Yersinia pestis
auuacacagcauc

SEQ ID NO: 2278825 - RNA, 18 nt, Yersinia pestis
auuacaguucuuuaucca

SEQ ID NO: 2278826 - RNA, 18 nt, Yersinia pestis
auuacaggccccaaucca

SEQ ID NO: 2278827 - RNA, 17 nt, Yersinia pestis
auuacagacaaaucaca

SEQ ID NO: 2278828 - RNA, 22 nt, Yersinia pestis
auuaauuuauuuucauuagucc

SEQ ID NO: 2278829 - RNA, 20 nt, Yersinia pestis
auuaauuccacgcugaaacu

SEQ ID NO: 2278830 - RNA, 22 nt, Yersinia pestis
auuaauuccacgcugaaacuuu

SEQ ID NO: 2278831 - RNA, 14 nt, Yersinia pestis
auuaauuauuuuau

SEQ ID NO: 2278832 - RNA, 17 nt, Yersinia pestis
auuaauucuuuuugcca

SEQ ID NO: 2278833 - RNA, 13 nt, Yersinia pestis
auuaauuaacacc

SEQ ID NO: 2278834 - RNA, 13 nt, Yersinia pestis
auuaauuaaugaa

SEQ ID NO: 2278835 - RNA, 11 nt, Yersinia pestis
auuaauuacuu

SEQ ID NO: 2278836 - RNA, 14 nt, Yersinia pestis
auuaauguacaccu

SEQ ID NO: 2278837 - RNA, 22 nt, Yersinia pestis
auuaaugucgccauaacgcaca

SEQ ID NO: 2278838 - RNA, 13 nt, Yersinia pestis
auuacgccaccug

SEQ ID NO: 2278839 - RNA, 18 nt, Yersinia pestis
auuacgccaccugagguu

SEQ ID NO: 2278840 - RNA, 23 nt, Yersinia pestis
auuacgguuuaccaccuuaaaau

SEQ ID NO: 2278841 - RNA, 20 nt, Yersinia pestis
auuacguagacauaaauuua

SEQ ID NO: 2278842 - RNA, 18 nt, Yersinia pestis
auuacgggucagcucacc

SEQ ID NO: 2278843 - RNA, 23 nt, Yersinia pestis
auuacucacacagccagccuuaa

SEQ ID NO: 2278844 - RNA, 20 nt, Yersinia pestis
auuacucagcacauuuuuau

SEQ ID NO: 2278845 - RNA, 15 nt, Yersinia pestis
auuacucaggaacaa

SEQ ID NO: 2278846 - RNA, 22 nt, Yersinia pestis
auuacucaggaacaagacuuuc

SEQ ID NO: 2278847 - RNA, 13 nt, Yersinia pestis
auuacuccacacg

SEQ ID NO: 2278848 - RNA, 17 nt, Yersinia pestis
auuacucguauaaaaaa

SEQ ID NO: 2278849 - RNA, 18 nt, Yersinia pestis
auuaccguuugguagcuc

SEQ ID NO: 2278850 - RNA, 16 nt, Yersinia pestis
auuaccuaauuuaucc

SEQ ID NO: 2278851 - RNA, 23 nt, Yersinia pestis
auuaccugagagagguugaggau

SEQ ID NO: 2278852 - RNA, 14 nt, Yersinia pestis
auuaccguuaucaa

SEQ ID NO: 2278853 - RNA, 17 nt, Yersinia pestis
auuaccgucagggacaa

SEQ ID NO: 2278854 - RNA, 20 nt, Yersinia pestis
auuaccuuacuucaaaacua

SEQ ID NO: 2278855 - RNA, 13 nt, Yersinia pestis
auuacccauaacu

SEQ ID NO: 2278856 - RNA, 21 nt, Yersinia pestis
auuacccacgccgaaaacaau

SEQ ID NO: 2278857 - RNA, 22 nt, Yersinia pestis
auuaccaccaccuccacaggag

SEQ ID NO: 2278858 - RNA, 20 nt, Yersinia pestis
auuaccacgccgucuggcua

SEQ ID NO: 2278859 - RNA, 23 nt, Yersinia pestis
auuaccaccgucaagacaacaaa

SEQ ID NO: 2278860 - RNA, 18 nt, Yersinia pestis
auuaggguugguuggugg

SEQ ID NO: 2278861 - RNA, 22 nt, Yersinia pestis
auuaggguugguugguggcuuu

SEQ ID NO: 2278862 - RNA, 14 nt, Yersinia pestis
auuaggcuuuaacc

SEQ ID NO: 2278863 - RNA, 14 nt, Yersinia pestis
auuaggcaggugaa

SEQ ID NO: 2278864 - RNA, 15 nt, Yersinia pestis
auuaggcaugauaag

SEQ ID NO: 2278865 - RNA, 13 nt, Yersinia pestis
auuauauagauuu

SEQ ID NO: 2278866 - RNA, 18 nt, Yersinia pestis
auuauauagauuuauuca

SEQ ID NO: 2278867 - RNA, 13 nt, Yersinia pestis
auuauauuuaauu

SEQ ID NO: 2278868 - RNA, 18 nt, Yersinia pestis
auuauaauccacugaaau

SEQ ID NO: 2278869 - RNA, 19 nt, Yersinia pestis
auuauaauccacugaaaua

SEQ ID NO: 2278870 - RNA, 17 nt, Yersinia pestis
auuagcgcuuuuuaaag

SEQ ID NO: 2278871 - RNA, 18 nt, Yersinia pestis
auuagcguuacagcuaaa

SEQ ID NO: 2278872 - RNA, 21 nt, Yersinia pestis
auuagcuugugugcuuacauu

SEQ ID NO: 2278873 - RNA, 14 nt, Yersinia pestis
auuagccagcagaa

SEQ ID NO: 2278874 - RNA, 17 nt, Yersinia pestis
auuagccccaaaugcca

SEQ ID NO: 2278875 - RNA, 13 nt, Yersinia pestis
auuagcaguaacg

SEQ ID NO: 2278876 - RNA, 17 nt, Yersinia pestis
auuagcaguauuagcuu

SEQ ID NO: 2278877 - RNA, 19 nt, Yersinia pestis
auuagaugagugguuuaua

SEQ ID NO: 2278878 - RNA, 19 nt, Yersinia pestis
auuagaauguguaguugaa

SEQ ID NO: 2278879 - RNA, 13 nt, Yersinia pestis
auuagaaucaauc

SEQ ID NO: 2278880 - RNA, 15 nt, Yersinia pestis
auuagaaaacaaguu

SEQ ID NO: 2278881 - RNA, 15 nt, Yersinia pestis
auuacuuuauuuaaa

SEQ ID NO: 2278882 - RNA, 18 nt, Yersinia pestis
auuacuuuauuuaaaauu

SEQ ID NO: 2278883 - RNA, 23 nt, Yersinia pestis
auuacucuuauaaagauuuuaag

SEQ ID NO: 2278884 - RNA, 23 nt, Yersinia pestis
auuacugucauuuccuccgcuuu

SEQ ID NO: 2278885 - RNA, 14 nt, Yersinia pestis
auuacuggucucaa

SEQ ID NO: 2278886 - RNA, 17 nt, Yersinia pestis
auguuuauauugauaaa

SEQ ID NO: 2278887 - RNA, 19 nt, Yersinia pestis
auguuucuuuaauaagccu

SEQ ID NO: 2278888 - RNA, 23 nt, Yersinia pestis
auguuucgcgguauuuggcauuc

SEQ ID NO: 2278889 - RNA, 22 nt, Yersinia pestis
auguuucuauccgaaaaauauu

SEQ ID NO: 2278890 - RNA, 17 nt, Yersinia pestis
auguuuguugauguaag

SEQ ID NO: 2278891 - RNA, 13 nt, Yersinia pestis
auguuugauuaag

SEQ ID NO: 2278892 - RNA, 20 nt, Yersinia pestis
auguuuaaacacuuagccag

SEQ ID NO: 2278893 - RNA, 15 nt, Yersinia pestis
auuaaaacauauuaa

SEQ ID NO: 2278894 - RNA, 13 nt, Yersinia pestis
auuaaaauaacaa

SEQ ID NO: 2278895 - RNA, 12 nt, Yersinia pestis
auuaaaaacccu

SEQ ID NO: 2278896 - RNA, 12 nt, Yersinia pestis
auuaaaaauaca

SEQ ID NO: 2278897 - RNA, 22 nt, Yersinia pestis
auguuuuuauccaaacaaacac

SEQ ID NO: 2278898 - RNA, 14 nt, Yersinia pestis
auguuuuuaacaaa

SEQ ID NO: 2278899 - RNA, 16 nt, Yersinia pestis
auguuuuuaacaaaau

SEQ ID NO: 2278900 - RNA, 12 nt, Yersinia pestis
auuaaauagggc

SEQ ID NO: 2278901 - RNA, 18 nt, Yersinia pestis
auuaaaguuuagcaaagc

SEQ ID NO: 2278902 - RNA, 12 nt, Yersinia pestis
auuaaauaagaa

SEQ ID NO: 2278903 - RNA, 20 nt, Yersinia pestis
auuaaacgucucuuuuucau

SEQ ID NO: 2278904 - RNA, 19 nt, Yersinia pestis
auuaaacuauuaacucuuu

SEQ ID NO: 2278905 - RNA, 17 nt, Yersinia pestis
auuaaacgcucaucaac

SEQ ID NO: 2278906 - RNA, 13 nt, Yersinia pestis
auuaaacgcucau

SEQ ID NO: 2278907 - RNA, 22 nt, Yersinia pestis
auuaaacagucuuauuacucau

SEQ ID NO: 2278908 - RNA, 11 nt, Yersinia pestis
auuaaggccac

SEQ ID NO: 2278909 - RNA, 22 nt, Yersinia pestis
auuaaguuuuucauaaucaccu

SEQ ID NO: 2278910 - RNA, 19 nt, Yersinia pestis
auuaauaaccauaaaauaa

SEQ ID NO: 2278911 - RNA, 15 nt, Yersinia pestis
auuaauaaaaccuuu

SEQ ID NO: 2278912 - RNA, 15 nt, Yersinia pestis
auuaauacaucauca

SEQ ID NO: 2278913 - RNA, 14 nt, Yersinia pestis
auuaauauccaauu

SEQ ID NO: 2278914 - RNA, 20 nt, Yersinia pestis
auuaauaugccgacaaccaa

SEQ ID NO: 2278915 - RNA, 16 nt, Yersinia pestis
auuaauaucaaaacug

SEQ ID NO: 2278916 - RNA, 19 nt, Yersinia pestis
auuaauauauaaaauaaau

SEQ ID NO: 2278917 - RNA, 21 nt, Yersinia pestis
auuaauaguguuguaagauuu

SEQ ID NO: 2278918 - RNA, 18 nt, Yersinia pestis
auuaauccccaggugcuu

SEQ ID NO: 2278919 - RNA, 23 nt, Yersinia pestis
auuaauccccggucacuuaaaua

SEQ ID NO: 2278920 - RNA, 20 nt, Yersinia pestis
auuaaucaacagauaugcau

SEQ ID NO: 2278921 - RNA, 23 nt, Yersinia pestis
auuaaucaagauauuacuucuuu

SEQ ID NO: 2278922 - RNA, 13 nt, Yersinia pestis
auuaaucaauuaa

SEQ ID NO: 2278923 - RNA, 14 nt, Yersinia pestis
auuaaucaauuaaa

SEQ ID NO: 2278924 - RNA, 15 nt, Yersinia pestis
auuaaucaauuaaau

SEQ ID NO: 2278925 - RNA, 23 nt, Yersinia pestis
auuaauggcagcauacauaucau

SEQ ID NO: 2278926 - RNA, 14 nt, Yersinia pestis
auuaaugcaccuac

SEQ ID NO: 2278927 - RNA, 23 nt, Yersinia pestis
auuaaucuaauuucaaaugaacu

SEQ ID NO: 2278928 - RNA, 22 nt, Yersinia pestis
auuaaucuauuaauaucgaggu

SEQ ID NO: 2278929 - RNA, 18 nt, Yersinia pestis
auuaaugaaauuaguuaa

SEQ ID NO: 2278930 - RNA, 17 nt, Yersinia pestis
auuaaccuuaucaccaa

SEQ ID NO: 2278931 - RNA, 17 nt, Yersinia pestis
auuaaccuguaaaagca

SEQ ID NO: 2278932 - RNA, 18 nt, Yersinia pestis
auuaaccuguaaaagcag

SEQ ID NO: 2278933 - RNA, 18 nt, Yersinia pestis
auuaaccgcuccaggcug

SEQ ID NO: 2278934 - RNA, 23 nt, Yersinia pestis
auuaaccgcuccaggcuggccac

SEQ ID NO: 2278935 - RNA, 18 nt, Yersinia pestis
auuaacuauuugaugcua

SEQ ID NO: 2278936 - RNA, 22 nt, Yersinia pestis
auuaacucuucuguugcccccu

SEQ ID NO: 2278937 - RNA, 21 nt, Yersinia pestis
auuaagauaauagcuaaacau

SEQ ID NO: 2278938 - RNA, 21 nt, Yersinia pestis
auuaagacaaggaaaaggcag

SEQ ID NO: 2278939 - RNA, 17 nt, Yersinia pestis
auuaacuucuuccgcaa

SEQ ID NO: 2278940 - RNA, 14 nt, Yersinia pestis
auuaagaaaccagc

SEQ ID NO: 2278941 - RNA, 23 nt, Yersinia pestis
auuaacaagcgaccaucaugaau

SEQ ID NO: 2278942 - RNA, 14 nt, Yersinia pestis
auuaacaauauuau

SEQ ID NO: 2278943 - RNA, 22 nt, Yersinia pestis
auuaacaauguuauauuucuua

SEQ ID NO: 2278944 - RNA, 22 nt, Yersinia pestis
auuaacaauuacuuuggcauuu

SEQ ID NO: 2278945 - RNA, 22 nt, Yersinia pestis
auuaacacccaauaauaaaaaa

SEQ ID NO: 2278946 - RNA, 13 nt, Yersinia pestis
auuaacauccauu

SEQ ID NO: 2278947 - RNA, 21 nt, Yersinia pestis
auuaaauucuaccuggcucaa

SEQ ID NO: 2278948 - RNA, 14 nt, Yersinia pestis
auuaaauuuuauga

SEQ ID NO: 2278949 - RNA, 19 nt, Yersinia pestis
auuaaauggugguuuucuu

SEQ ID NO: 2278950 - RNA, 17 nt, Yersinia pestis
auuaaauuaauauuuaa

SEQ ID NO: 2278951 - RNA, 12 nt, Yersinia pestis
auguauccaucu

SEQ ID NO: 2278952 - RNA, 22 nt, Yersinia pestis
auguauuagcgcugcucaauca

SEQ ID NO: 2278953 - RNA, 23 nt, Yersinia pestis
auguauauguugggaaauaacca

SEQ ID NO: 2278954 - RNA, 21 nt, Yersinia pestis
auguaguuaaucuacccgagu

SEQ ID NO: 2278955 - RNA, 14 nt, Yersinia pestis
auguaguucagucg

SEQ ID NO: 2278956 - RNA, 12 nt, Yersinia pestis
auguauaaaaaa

SEQ ID NO: 2278957 - RNA, 13 nt, Yersinia pestis
auguauaaaaaag

SEQ ID NO: 2278958 - RNA, 14 nt, Yersinia pestis
auguauaaaaaaga

SEQ ID NO: 2278959 - RNA, 23 nt, Yersinia pestis
auguauaaaaaagauaauaaaac

SEQ ID NO: 2278960 - RNA, 13 nt, Yersinia pestis
augucaugauaaa

SEQ ID NO: 2278961 - RNA, 16 nt, Yersinia pestis
augucaugguuaaacu

SEQ ID NO: 2278962 - RNA, 15 nt, Yersinia pestis
auguauuaguuucaa

SEQ ID NO: 2278963 - RNA, 14 nt, Yersinia pestis
auguccaguuauca

SEQ ID NO: 2278964 - RNA, 12 nt, Yersinia pestis
augguuuugugu

SEQ ID NO: 2278965 - RNA, 20 nt, Yersinia pestis
augguuuuuauuguuauuuu

SEQ ID NO: 2278966 - RNA, 22 nt, Yersinia pestis
augguuuccagcccaccagcag

SEQ ID NO: 2278967 - RNA, 23 nt, Yersinia pestis
augguuuccuucaccaaaaaaac

SEQ ID NO: 2278968 - RNA, 16 nt, Yersinia pestis
auguaggcaauacacc

SEQ ID NO: 2278969 - RNA, 22 nt, Yersinia pestis
augucgaaagauagcaaaagaa

SEQ ID NO: 2278970 - RNA, 23 nt, Yersinia pestis
auguccucaccauuuauugccac

SEQ ID NO: 2278971 - RNA, 16 nt, Yersinia pestis
auguccucaccauuua

SEQ ID NO: 2278972 - RNA, 14 nt, Yersinia pestis
augugauaccuaaa

SEQ ID NO: 2278973 - RNA, 18 nt, Yersinia pestis
augugaaaagcagucgac

SEQ ID NO: 2278974 - RNA, 14 nt, Yersinia pestis
augugaaacauaau

SEQ ID NO: 2278975 - RNA, 18 nt, Yersinia pestis
augugaaacauaauuaaa

SEQ ID NO: 2278976 - RNA, 19 nt, Yersinia pestis
augugaaacauaauuaaau

SEQ ID NO: 2278977 - RNA, 14 nt, Yersinia pestis
auguguuuuucuua

SEQ ID NO: 2278978 - RNA, 18 nt, Yersinia pestis
augugcuucuuuaaucac

SEQ ID NO: 2278979 - RNA, 19 nt, Yersinia pestis
augugcuucuuugaagcgc

SEQ ID NO: 2278980 - RNA, 16 nt, Yersinia pestis
auguggcauguucagc

SEQ ID NO: 2278981 - RNA, 24 nt, Yersinia pestis
augguagcaaggcguacaucucuu

SEQ ID NO: 2278982 - RNA, 17 nt, Yersinia pestis
auggucgucauguuuaa

SEQ ID NO: 2278983 - RNA, 19 nt, Yersinia pestis
augguuaaucuacccgaau

SEQ ID NO: 2278984 - RNA, 20 nt, Yersinia pestis
augguguguagucuucauca

SEQ ID NO: 2278985 - RNA, 15 nt, Yersinia pestis
auggugaaccagaua

SEQ ID NO: 2278986 - RNA, 16 nt, Yersinia pestis
auggugucuuuacugg

SEQ ID NO: 2278987 - RNA, 17 nt, Yersinia pestis
augguguaaaugcccgu

SEQ ID NO: 2278988 - RNA, 24 nt, Yersinia pestis
auggggaaaagcaguaagcaugaa

SEQ ID NO: 2278989 - RNA, 20 nt, Yersinia pestis
augggcgccgcuuuaccugu

SEQ ID NO: 2278990 - RNA, 21 nt, Yersinia pestis
augggcgccgcuuuaccuguu

SEQ ID NO: 2278991 - RNA, 13 nt, Yersinia pestis
augggaugcccac

SEQ ID NO: 2278992 - RNA, 13 nt, Yersinia pestis
augggcagaagag

SEQ ID NO: 2278993 - RNA, 22 nt, Yersinia pestis
auggcuuuuuuacgcgccugcu

SEQ ID NO: 2278994 - RNA, 12 nt, Yersinia pestis
augccuuuucuu

SEQ ID NO: 2278995 - RNA, 15 nt, Yersinia pestis
augcgcaccagcuca

SEQ ID NO: 2278996 - RNA, 17 nt, Yersinia pestis
auggcagguaucaauac

SEQ ID NO: 2278997 - RNA, 20 nt, Yersinia pestis
auggcacuugugaugucuga

SEQ ID NO: 2278998 - RNA, 19 nt, Yersinia pestis
auggccaugaaucaaauua

SEQ ID NO: 2278999 - RNA, 18 nt, Yersinia pestis
auggcccaagccauccuu

SEQ ID NO: 2279000 - RNA, 14 nt, Yersinia pestis
auggcgcggcucga

SEQ ID NO: 2279001 - RNA, 16 nt, Yersinia pestis
auggcggcuugguugc

SEQ ID NO: 2279002 - RNA, 14 nt, Yersinia pestis
aucugcauuaaaau

SEQ ID NO: 2279003 - RNA, 22 nt, Yersinia pestis
aucugcauaccuggaucacgau

SEQ ID NO: 2279004 - RNA, 12 nt, Yersinia pestis
aucugcccagcc

SEQ ID NO: 2279005 - RNA, 18 nt, Yersinia pestis
aucugccaccgcacaguu

SEQ ID NO: 2279006 - RNA, 14 nt, Yersinia pestis
aucugccaccgcuc

SEQ ID NO: 2279007 - RNA, 22 nt, Yersinia pestis
aucugcccagccugguuuuuua

SEQ ID NO: 2279008 - RNA, 22 nt, Yersinia pestis
aucugcggauuuacucgccuuu

SEQ ID NO: 2279009 - RNA, 19 nt, Yersinia pestis
aucugaauagcgcugcauc

SEQ ID NO: 2279010 - RNA, 20 nt, Yersinia pestis
aucugaauaggggaauuuuu

SEQ ID NO: 2279011 - RNA, 19 nt, Yersinia pestis
aucugaaacggugaggaua

SEQ ID NO: 2279012 - RNA, 21 nt, Yersinia pestis
aucugaaacggugaggauagg

SEQ ID NO: 2279013 - RNA, 15 nt, Yersinia pestis
aucugagccuucaac

SEQ ID NO: 2279014 - RNA, 17 nt, Yersinia pestis
aucugagcgaacugaau

SEQ ID NO: 2279015 - RNA, 13 nt, Yersinia pestis
aucugaccaaaca

SEQ ID NO: 2279016 - RNA, 14 nt, Yersinia pestis
aucugauauuauug

SEQ ID NO: 2279017 - RNA, 15 nt, Yersinia pestis
aucugauaucucuuu

SEQ ID NO: 2279018 - RNA, 13 nt, Yersinia pestis
aucugcaauggcu

SEQ ID NO: 2279019 - RNA, 21 nt, Yersinia pestis
aucugcaauggcuggcaaggc

SEQ ID NO: 2279020 - RNA, 21 nt, Yersinia pestis
aucugauuugggaacaacagc

SEQ ID NO: 2279021 - RNA, 16 nt, Yersinia pestis
aucucggcuuucaggu

SEQ ID NO: 2279022 - RNA, 14 nt, Yersinia pestis
aucucguugcccug

SEQ ID NO: 2279023 - RNA, 14 nt, Yersinia pestis
aucucuaacaggga

SEQ ID NO: 2279024 - RNA, 20 nt, Yersinia pestis
aucucuccagugcaaauuua

SEQ ID NO: 2279025 - RNA, 14 nt, Yersinia pestis
aucucuccagccug

SEQ ID NO: 2279026 - RNA, 13 nt, Yersinia pestis
aucucucacagcg

SEQ ID NO: 2279027 - RNA, 18 nt, Yersinia pestis
aucucuaucaauauauac

SEQ ID NO: 2279028 - RNA, 16 nt, Yersinia pestis
aucucugggugcugcu

SEQ ID NO: 2279029 - RNA, 23 nt, Yersinia pestis
aucucuggccguggucuugguca

SEQ ID NO: 2279030 - RNA, 16 nt, Yersinia pestis
aucucuuaccccuuuc

SEQ ID NO: 2279031 - RNA, 16 nt, Yersinia pestis
aucucugcaguacaga

SEQ ID NO: 2279032 - RNA, 21 nt, Yersinia pestis
aucucuugauagguuuuuccc

SEQ ID NO: 2279033 - RNA, 17 nt, Yersinia pestis
aucucuuccgacaggcu

SEQ ID NO: 2279034 - RNA, 20 nt, Yersinia pestis
aucucuucagcaauuuuuag

SEQ ID NO: 2279035 - RNA, 15 nt, Yersinia pestis
aucucagaauuuuuu

SEQ ID NO: 2279036 - RNA, 16 nt, Yersinia pestis
aucucaccacgcccac

SEQ ID NO: 2279037 - RNA, 15 nt, Yersinia pestis
aucucacgguaguga

SEQ ID NO: 2279038 - RNA, 22 nt, Yersinia pestis
aucucacgguagugacucauca

SEQ ID NO: 2279039 - RNA, 15 nt, Yersinia pestis
aucucacgcugaaua

SEQ ID NO: 2279040 - RNA, 16 nt, Yersinia pestis
aucucacgcugaauaa

SEQ ID NO: 2279041 - RNA, 13 nt, Yersinia pestis
aucuccagaagca

SEQ ID NO: 2279042 - RNA, 16 nt, Yersinia pestis
aucuccagaauauaaa

SEQ ID NO: 2279043 - RNA, 20 nt, Yersinia pestis
aucucaucuuaaucacgaua

SEQ ID NO: 2279044 - RNA, 18 nt, Yersinia pestis
aucuccauugauucacga

SEQ ID NO: 2279045 - RNA, 19 nt, Yersinia pestis
aucuccaguugcacaccau

SEQ ID NO: 2279046 - RNA, 17 nt, Yersinia pestis
aucucccgcuacacgca

SEQ ID NO: 2279047 - RNA, 18 nt, Yersinia pestis
aucuccuccagaauaucu

SEQ ID NO: 2279048 - RNA, 21 nt, Yersinia pestis
aucuccuccagaauaucuuca

SEQ ID NO: 2279049 - RNA, 19 nt, Yersinia pestis
aucuccuccggagaggaga

SEQ ID NO: 2279050 - RNA, 18 nt, Yersinia pestis
aucucgacaaauccuuuu

SEQ ID NO: 2279051 - RNA, 18 nt, Yersinia pestis
aucuacuucuauuacccu

SEQ ID NO: 2279052 - RNA, 17 nt, Yersinia pestis
aucuauaaacuucacga

SEQ ID NO: 2279053 - RNA, 13 nt, Yersinia pestis
aucuagcagugau

SEQ ID NO: 2279054 - RNA, 20 nt, Yersinia pestis
aucuagcagugauuucagug

SEQ ID NO: 2279055 - RNA, 16 nt, Yersinia pestis
aucuaggccugggugu

SEQ ID NO: 2279056 - RNA, 15 nt, Yersinia pestis
aucuaggugcaguaa

SEQ ID NO: 2279057 - RNA, 13 nt, Yersinia pestis
aucuauuaauauc

SEQ ID NO: 2279058 - RNA, 17 nt, Yersinia pestis
aucuauuugaguuuuag

SEQ ID NO: 2279059 - RNA, 21 nt, Yersinia pestis
aucuauugauugcuuaccacu

SEQ ID NO: 2279060 - RNA, 17 nt, Yersinia pestis
aucuauugugucaauac

SEQ ID NO: 2279061 - RNA, 15 nt, Yersinia pestis
aucuauuuuuuugaa

SEQ ID NO: 2279062 - RNA, 17 nt, Yersinia pestis
aucucaagacacuauuc

SEQ ID NO: 2279063 - RNA, 15 nt, Yersinia pestis
aucguugcaggauaa

SEQ ID NO: 2279064 - RNA, 16 nt, Yersinia pestis
aucguuauaauauuaa

SEQ ID NO: 2279065 - RNA, 21 nt, Yersinia pestis
aucguuaaacccggcaucaac

SEQ ID NO: 2279066 - RNA, 20 nt, Yersinia pestis
aucguuaaaguuaucaccaa

SEQ ID NO: 2279067 - RNA, 14 nt, Yersinia pestis
aucguuacucgauu

SEQ ID NO: 2279068 - RNA, 17 nt, Yersinia pestis
aucgugcuccgcuucca

SEQ ID NO: 2279069 - RNA, 19 nt, Yersinia pestis
aucgugcaguaauggaaau

SEQ ID NO: 2279070 - RNA, 15 nt, Yersinia pestis
aucguccggucugaa

SEQ ID NO: 2279071 - RNA, 12 nt, Yersinia pestis
aucguccagcag

SEQ ID NO: 2279072 - RNA, 14 nt, Yersinia pestis
aucguccagcagca

SEQ ID NO: 2279073 - RNA, 15 nt, Yersinia pestis
aucgguaaaaaauca

SEQ ID NO: 2279074 - RNA, 23 nt, Yersinia pestis
aucgggguuugucagcagucuga

SEQ ID NO: 2279075 - RNA, 22 nt, Yersinia pestis
aucgggcuuuacagucgcugcu

SEQ ID NO: 2279076 - RNA, 17 nt, Yersinia pestis
aucgggcaauugaaaau

SEQ ID NO: 2279077 - RNA, 14 nt, Yersinia pestis
aucggcccugccau

SEQ ID NO: 2279078 - RNA, 19 nt, Yersinia pestis
aucgcuaacccucaguaaa

SEQ ID NO: 2279079 - RNA, 13 nt, Yersinia pestis
aucgcuaaaaagc

SEQ ID NO: 2279080 - RNA, 14 nt, Yersinia pestis
aucgcgucuuuacg

SEQ ID NO: 2279081 - RNA, 19 nt, Yersinia pestis
aucggcaaaccgaauacca

SEQ ID NO: 2279082 - RNA, 16 nt, Yersinia pestis
aucggccagugcgccg

SEQ ID NO: 2279083 - RNA, 16 nt, Yersinia pestis
aucgcaauuaauacaa

SEQ ID NO: 2279084 - RNA, 14 nt, Yersinia pestis
aucgcaauuucaga

SEQ ID NO: 2279085 - RNA, 13 nt, Yersinia pestis
aucgauaaaaaga

SEQ ID NO: 2279086 - RNA, 15 nt, Yersinia pestis
aucgauacggcaccg

SEQ ID NO: 2279087 - RNA, 14 nt, Yersinia pestis
aucgaucaaccauu

SEQ ID NO: 2279088 - RNA, 17 nt, Yersinia pestis
aucgaguggaguuaagu

SEQ ID NO: 2279089 - RNA, 19 nt, Yersinia pestis
auccuuuuuauuuaagcag

SEQ ID NO: 2279090 - RNA, 11 nt, Yersinia pestis
aucgaaacacc

SEQ ID NO: 2279091 - RNA, 17 nt, Yersinia pestis
aucagcuucauuaagga

SEQ ID NO: 2279092 - RNA, 15 nt, Yersinia pestis
aucagcugauaugaa

SEQ ID NO: 2279093 - RNA, 17 nt, Yersinia pestis
aucagcguagauuuucu

SEQ ID NO: 2279094 - RNA, 17 nt, Yersinia pestis
aucagcguauggggaaa

SEQ ID NO: 2279095 - RNA, 12 nt, Yersinia pestis
aucgcaguuaaa

SEQ ID NO: 2279096 - RNA, 22 nt, Yersinia pestis
aucgcacugaguucugcugcca

SEQ ID NO: 2279097 - RNA, 23 nt, Yersinia pestis
aucgcauuggguaauaucaccau

SEQ ID NO: 2279098 - RNA, 15 nt, Yersinia pestis
aucgcccugcucuuc

SEQ ID NO: 2279099 - RNA, 18 nt, Yersinia pestis
aucgccguacuuggucac

SEQ ID NO: 2279100 - RNA, 15 nt, Yersinia pestis
aucgcgaugcgccug

SEQ ID NO: 2279101 - RNA, 18 nt, Yersinia pestis
aucgcgcauuucuucucu

SEQ ID NO: 2279102 - RNA, 19 nt, Yersinia pestis
aucgcgcccauccgcagga

SEQ ID NO: 2279103 - RNA, 19 nt, Yersinia pestis
aucgcgccuaccugccugc

SEQ ID NO: 2279104 - RNA, 15 nt, Yersinia pestis
augaaaauagccaac

SEQ ID NO: 2279105 - RNA, 17 nt, Yersinia pestis
augaaaggcuccacaua

SEQ ID NO: 2279106 - RNA, 15 nt, Yersinia pestis
aucuuuuauuuauga

SEQ ID NO: 2279107 - RNA, 15 nt, Yersinia pestis
augaaaucaguguau

SEQ ID NO: 2279108 - RNA, 22 nt, Yersinia pestis
augaaauauggugauaacugcc

SEQ ID NO: 2279109 - RNA, 13 nt, Yersinia pestis
augaacugucuug

SEQ ID NO: 2279110 - RNA, 19 nt, Yersinia pestis
augaagcacaaaaagaguc

SEQ ID NO: 2279111 - RNA, 17 nt, Yersinia pestis
augaagcauuaaacaga

SEQ ID NO: 2279112 - RNA, 18 nt, Yersinia pestis
augaagcauuaaacagau

SEQ ID NO: 2279113 - RNA, 15 nt, Yersinia pestis
augaagcucauuaau

SEQ ID NO: 2279114 - RNA, 14 nt, Yersinia pestis
aucuucugccagcc

SEQ ID NO: 2279115 - RNA, 16 nt, Yersinia pestis
aucugggguauaacgc

SEQ ID NO: 2279116 - RNA, 14 nt, Yersinia pestis
aucuggcugaaaua

SEQ ID NO: 2279117 - RNA, 21 nt, Yersinia pestis
aucuggcguagguaguggcug

SEQ ID NO: 2279118 - RNA, 19 nt, Yersinia pestis
aucuggcuuucucaacagc

SEQ ID NO: 2279119 - RNA, 15 nt, Yersinia pestis
aucuggcuggcauau

SEQ ID NO: 2279120 - RNA, 22 nt, Yersinia pestis
aucuggcuggcauauuucucuu

SEQ ID NO: 2279121 - RNA, 22 nt, Yersinia pestis
aucuuuaacaacaaccaagcuu

SEQ ID NO: 2279122 - RNA, 15 nt, Yersinia pestis
aucuuuaauuuuucc

SEQ ID NO: 2279123 - RNA, 16 nt, Yersinia pestis
aucuuuaauaauagau

SEQ ID NO: 2279124 - RNA, 16 nt, Yersinia pestis
aucuuuaauuuuuccc

SEQ ID NO: 2279125 - RNA, 14 nt, Yersinia pestis
aucuuuaccagccc

SEQ ID NO: 2279126 - RNA, 18 nt, Yersinia pestis
aucuugaauaauauucaa

SEQ ID NO: 2279127 - RNA, 19 nt, Yersinia pestis
aucuugaacggugaggaua

SEQ ID NO: 2279128 - RNA, 17 nt, Yersinia pestis
aucuugaaccaauuuuu

SEQ ID NO: 2279129 - RNA, 22 nt, Yersinia pestis
aucuugauaaacaugccacuuc

SEQ ID NO: 2279130 - RNA, 15 nt, Yersinia pestis
aucuuuaacaacaac

SEQ ID NO: 2279131 - RNA, 16 nt, Yersinia pestis
augacuuuuuuuaugg

SEQ ID NO: 2279132 - RNA, 13 nt, Yersinia pestis
augagaagugaga

SEQ ID NO: 2279133 - RNA, 21 nt, Yersinia pestis
augagaagugagaagugaaaa

SEQ ID NO: 2279134 - RNA, 14 nt, Yersinia pestis
augacuggcuauua

SEQ ID NO: 2279135 - RNA, 18 nt, Yersinia pestis
augacuuaacugaaagcc

SEQ ID NO: 2279136 - RNA, 18 nt, Yersinia pestis
augacgaaaaacaccuau

SEQ ID NO: 2279137 - RNA, 17 nt, Yersinia pestis
augacgcgccauacugc

SEQ ID NO: 2279138 - RNA, 23 nt, Yersinia pestis
augacgcuaaccaccgucaccaa

SEQ ID NO: 2279139 - RNA, 19 nt, Yersinia pestis
augacgccaacuucaagcc

SEQ ID NO: 2279140 - RNA, 19 nt, Yersinia pestis
augacgcccgcagcggcua

SEQ ID NO: 2279141 - RNA, 22 nt, Yersinia pestis
augagguaauacucauccagau

SEQ ID NO: 2279142 - RNA, 17 nt, Yersinia pestis
augagauucaggagaua

SEQ ID NO: 2279143 - RNA, 21 nt, Yersinia pestis
augagugauauccgccaaaga

SEQ ID NO: 2279144 - RNA, 21 nt, Yersinia pestis
augagugaucauauuaggcag

SEQ ID NO: 2279145 - RNA, 14 nt, Yersinia pestis
augaguaucaauau

SEQ ID NO: 2279146 - RNA, 14 nt, Yersinia pestis
augagucagucugu

SEQ ID NO: 2279147 - RNA, 13 nt, Yersinia pestis
augaguaaacaga

SEQ ID NO: 2279148 - RNA, 14 nt, Yersinia pestis
augaguaaacagag

SEQ ID NO: 2279149 - RNA, 15 nt, Yersinia pestis
augagacaagagcaa

SEQ ID NO: 2279150 - RNA, 20 nt, Yersinia pestis
augagaaugccgaacugaua

SEQ ID NO: 2279151 - RNA, 14 nt, Yersinia pestis
augagaauguaaau

SEQ ID NO: 2279152 - RNA, 16 nt, Yersinia pestis
augagaauguaaauuu

SEQ ID NO: 2279153 - RNA, 14 nt, Yersinia pestis
augagaaugugacu

SEQ ID NO: 2279154 - RNA, 15 nt, Yersinia pestis
augaauauaugauac

SEQ ID NO: 2279155 - RNA, 13 nt, Yersinia pestis
augaauauaugau

SEQ ID NO: 2279156 - RNA, 23 nt, Yersinia pestis
augaauaggauagacaguaacua

SEQ ID NO: 2279157 - RNA, 14 nt, Yersinia pestis
augaauauuauuca

SEQ ID NO: 2279158 - RNA, 16 nt, Yersinia pestis
augaauauucaccacc

SEQ ID NO: 2279159 - RNA, 18 nt, Yersinia pestis
augaauaucuugcauaca

SEQ ID NO: 2279160 - RNA, 14 nt, Yersinia pestis
augaauaugcuuca

SEQ ID NO: 2279161 - RNA, 22 nt, Yersinia pestis
augaagggggcuuauucuaauu

SEQ ID NO: 2279162 - RNA, 18 nt, Yersinia pestis
augaaguugucagugauu

SEQ ID NO: 2279163 - RNA, 16 nt, Yersinia pestis
augaaugcgaacuacg

SEQ ID NO: 2279164 - RNA, 11 nt, Yersinia pestis
augaauuauua

SEQ ID NO: 2279165 - RNA, 19 nt, Yersinia pestis
augacauugcgaauauugc

SEQ ID NO: 2279166 - RNA, 15 nt, Yersinia pestis
augccaagaauaauu

SEQ ID NO: 2279167 - RNA, 14 nt, Yersinia pestis
augccaagaauaau

SEQ ID NO: 2279168 - RNA, 18 nt, Yersinia pestis
augccaauuccauauuua

SEQ ID NO: 2279169 - RNA, 15 nt, Yersinia pestis
augcaguuuauccaa

SEQ ID NO: 2279170 - RNA, 13 nt, Yersinia pestis
augccacccccag

SEQ ID NO: 2279171 - RNA, 17 nt, Yersinia pestis
augccagcaauauauug

SEQ ID NO: 2279172 - RNA, 19 nt, Yersinia pestis
augccagcaauauauugcu

SEQ ID NO: 2279173 - RNA, 20 nt, Yersinia pestis
augcaggggaaauggugucu

SEQ ID NO: 2279174 - RNA, 18 nt, Yersinia pestis
augcagggagguuauauu

SEQ ID NO: 2279175 - RNA, 17 nt, Yersinia pestis
augcagcucaaucacau

SEQ ID NO: 2279176 - RNA, 17 nt, Yersinia pestis
augcacaguaggcugaa

SEQ ID NO: 2279177 - RNA, 15 nt, Yersinia pestis
augcagcauuucagg

SEQ ID NO: 2279178 - RNA, 16 nt, Yersinia pestis
augcagcauuucagga

SEQ ID NO: 2279179 - RNA, 15 nt, Yersinia pestis
augcaaaugucagau

SEQ ID NO: 2279180 - RNA, 21 nt, Yersinia pestis
augcaaaugucagaucgcgau

SEQ ID NO: 2279181 - RNA, 21 nt, Yersinia pestis
augaugucgcgacucaagccu

SEQ ID NO: 2279182 - RNA, 17 nt, Yersinia pestis
augaguuuuguccugag

SEQ ID NO: 2279183 - RNA, 13 nt, Yersinia pestis
augauaaaauccu

SEQ ID NO: 2279184 - RNA, 14 nt, Yersinia pestis
augauaaauaaccg

SEQ ID NO: 2279185 - RNA, 11 nt, Yersinia pestis
augaugacaau

SEQ ID NO: 2279186 - RNA, 17 nt, Yersinia pestis
augaugacuuuuauuau

SEQ ID NO: 2279187 - RNA, 21 nt, Yersinia pestis
augaugagcgcauugcacagg

SEQ ID NO: 2279188 - RNA, 13 nt, Yersinia pestis
augcccauuagua

SEQ ID NO: 2279189 - RNA, 16 nt, Yersinia pestis
augccccgcuauugcc

SEQ ID NO: 2279190 - RNA, 15 nt, Yersinia pestis
augccauuuacccug

SEQ ID NO: 2279191 - RNA, 20 nt, Yersinia pestis
augccauggcgaaaauccuu

SEQ ID NO: 2279192 - RNA, 14 nt, Yersinia pestis
augccaucccccuu

SEQ ID NO: 2279193 - RNA, 19 nt, Yersinia pestis
augccaucccccuuuggcc

SEQ ID NO: 2279194 - RNA, 13 nt, Yersinia pestis
augccaguagccg

SEQ ID NO: 2279195 - RNA, 15 nt, Yersinia pestis
augccagucaaugac

SEQ ID NO: 2279196 - RNA, 21 nt, Yersinia pestis
augccaguacagugaaaaugg

SEQ ID NO: 2279197 - RNA, 16 nt, Yersinia pestis
augcccugagauuauu

SEQ ID NO: 2279198 - RNA, 21 nt, Yersinia pestis
augccuauuugcagaaaguaa

SEQ ID NO: 2279199 - RNA, 14 nt, Yersinia pestis
augccuuacgggag

SEQ ID NO: 2279200 - RNA, 20 nt, Yersinia pestis
augccuguuauaaggcuaac

SEQ ID NO: 2279201 - RNA, 15 nt, Yersinia pestis
augccuuguuucugg

SEQ ID NO: 2279202 - RNA, 17 nt, Yersinia pestis
augccuuggcaaagaga

SEQ ID NO: 2279203 - RNA, 18 nt, Yersinia pestis
augccuuggcaaagagac

SEQ ID NO: 2279204 - RNA, 21 nt, Yersinia pestis
augccuuggcauguucagggu

SEQ ID NO: 2279205 - RNA, 20 nt, Yersinia pestis
augccguuaauugugaucag

SEQ ID NO: 2279206 - RNA, 15 nt, Yersinia pestis
augccgcuccagcac

SEQ ID NO: 2279207 - RNA, 17 nt, Yersinia pestis
augccgcuaacaaccgu

SEQ ID NO: 2279208 - RNA, 16 nt, Yersinia pestis
augccgcuccagcacu

SEQ ID NO: 2279209 - RNA, 22 nt, Yersinia pestis
augccgccugacugcccgccug

SEQ ID NO: 2279210 - RNA, 13 nt, Yersinia pestis
auucugucagagc

SEQ ID NO: 2279211 - RNA, 20 nt, Yersinia pestis
auucugucagagcuauguuc

SEQ ID NO: 2279212 - RNA, 21 nt, Yersinia pestis
auucuguagaguaaaacugau

SEQ ID NO: 2279213 - RNA, 16 nt, Yersinia pestis
auucugcuuuuugcuu

SEQ ID NO: 2279214 - RNA, 17 nt, Yersinia pestis
auucugcuuuuugcuuu

SEQ ID NO: 2279215 - RNA, 21 nt, Yersinia pestis
auucucuacucgcucaccacu

SEQ ID NO: 2279216 - RNA, 13 nt, Yersinia pestis
auucagccacuca

SEQ ID NO: 2279217 - RNA, 22 nt, Yersinia pestis
auucagcaucaaauuauuuuuc

SEQ ID NO: 2279218 - RNA, 23 nt, Yersinia pestis
auucagcaucaaauuauuuuucc

SEQ ID NO: 2279219 - RNA, 20 nt, Yersinia pestis
auucagcaaacucagccaau

SEQ ID NO: 2279220 - RNA, 17 nt, Yersinia pestis
auucagcagcauuucuc

SEQ ID NO: 2279221 - RNA, 23 nt, Yersinia pestis
auucagcguauugugauucauac

SEQ ID NO: 2279222 - RNA, 15 nt, Yersinia pestis
auucucccauuuauu

SEQ ID NO: 2279223 - RNA, 18 nt, Yersinia pestis
auucuuuuuguuaaaaua

SEQ ID NO: 2279224 - RNA, 21 nt, Yersinia pestis
auucuuuuuguuaaaauagug

SEQ ID NO: 2279225 - RNA, 14 nt, Yersinia pestis
auugaaaccgcuga

SEQ ID NO: 2279226 - RNA, 19 nt, Yersinia pestis
auugaagauuuaaauaaca

SEQ ID NO: 2279227 - RNA, 15 nt, Yersinia pestis
auugaagugauauag

SEQ ID NO: 2279228 - RNA, 20 nt, Yersinia pestis
auucuuaucaaucaaaaaau

SEQ ID NO: 2279229 - RNA, 17 nt, Yersinia pestis
auucuuaggucaucguc

SEQ ID NO: 2279230 - RNA, 13 nt, Yersinia pestis
auugacuuuaaaa

SEQ ID NO: 2279231 - RNA, 16 nt, Yersinia pestis
auugacuuuaaaaaaa

SEQ ID NO: 2279232 - RNA, 19 nt, Yersinia pestis
auugagaucauauuguuaa

SEQ ID NO: 2279233 - RNA, 17 nt, Yersinia pestis
auugagagaccagggca

SEQ ID NO: 2279234 - RNA, 16 nt, Yersinia pestis
auugagcauauucagu

SEQ ID NO: 2279235 - RNA, 21 nt, Yersinia pestis
auugagcaggcucuucucuga

SEQ ID NO: 2279236 - RNA, 16 nt, Yersinia pestis
auugacgaauuaaaac

SEQ ID NO: 2279237 - RNA, 22 nt, Yersinia pestis
auugacgguuacagcgcaauaa

SEQ ID NO: 2279238 - RNA, 17 nt, Yersinia pestis
auugagucguuauaaca

SEQ ID NO: 2279239 - RNA, 18 nt, Yersinia pestis
auugagugcggccacacg

SEQ ID NO: 2279240 - RNA, 17 nt, Yersinia pestis
auugaguaacugauuaa

SEQ ID NO: 2279241 - RNA, 16 nt, Yersinia pestis
auugccggaaauuuau

SEQ ID NO: 2279242 - RNA, 20 nt, Yersinia pestis
auugcccccucccgauacuc

SEQ ID NO: 2279243 - RNA, 23 nt, Yersinia pestis
auugccccccaauauuggauaau

SEQ ID NO: 2279244 - RNA, 20 nt, Yersinia pestis
auugcacgguauagcuauca

SEQ ID NO: 2279245 - RNA, 20 nt, Yersinia pestis
auugcacuggcuaauaccau

SEQ ID NO: 2279246 - RNA, 18 nt, Yersinia pestis
auuggguaauaucaccau

SEQ ID NO: 2279247 - RNA, 23 nt, Yersinia pestis
auugggcucuucgccaguucauu

SEQ ID NO: 2279248 - RNA, 20 nt, Yersinia pestis
auuggcucauaacacuuaau

SEQ ID NO: 2279249 - RNA, 14 nt, Yersinia pestis
auuggcuucaacuu

SEQ ID NO: 2279250 - RNA, 16 nt, Yersinia pestis
auuggcugauucaaca

SEQ ID NO: 2279251 - RNA, 22 nt, Yersinia pestis
auuggcaacaacagauaaagcu

SEQ ID NO: 2279252 - RNA, 16 nt, Yersinia pestis
auuggcaaaggccagc

SEQ ID NO: 2279253 - RNA, 20 nt, Yersinia pestis
auugcuaaguacuaucuauu

SEQ ID NO: 2279254 - RNA, 20 nt, Yersinia pestis
auugcucacgcguaaaugga

SEQ ID NO: 2279255 - RNA, 22 nt, Yersinia pestis
auugcucaaacucagcaucacc

SEQ ID NO: 2279256 - RNA, 19 nt, Yersinia pestis
auugcuccuuacuauuuuc

SEQ ID NO: 2279257 - RNA, 22 nt, Yersinia pestis
auugcgagucucaucaaggaaa

SEQ ID NO: 2279258 - RNA, 11 nt, Yersinia pestis
auugcguucaa

SEQ ID NO: 2279259 - RNA, 15 nt, Yersinia pestis
auugcguucaauaca

SEQ ID NO: 2279260 - RNA, 21 nt, Yersinia pestis
auugccugauuuuuaucauca

SEQ ID NO: 2279261 - RNA, 16 nt, Yersinia pestis
auugccuucuccuuuc

SEQ ID NO: 2279262 - RNA, 17 nt, Yersinia pestis
auuucaagcaauucaga

SEQ ID NO: 2279263 - RNA, 20 nt, Yersinia pestis
auuucaacgucaaucaucca

SEQ ID NO: 2279264 - RNA, 22 nt, Yersinia pestis
auuucaacgcaccauccagcaa

SEQ ID NO: 2279265 - RNA, 21 nt, Yersinia pestis
auuucaacgcaccauccagca

SEQ ID NO: 2279266 - RNA, 18 nt, Yersinia pestis
auuucaaaguaaaauaaa

SEQ ID NO: 2279267 - RNA, 14 nt, Yersinia pestis
auuucagacauaca

SEQ ID NO: 2279268 - RNA, 18 nt, Yersinia pestis
auuucagacugcugacaa

SEQ ID NO: 2279269 - RNA, 13 nt, Yersinia pestis
auuucagcagcac

SEQ ID NO: 2279270 - RNA, 19 nt, Yersinia pestis
auuuaucugcauuaaaaua

SEQ ID NO: 2279271 - RNA, 21 nt, Yersinia pestis
auuuaucugcauuaaaauaac

SEQ ID NO: 2279272 - RNA, 13 nt, Yersinia pestis
auuuauuccucuc

SEQ ID NO: 2279273 - RNA, 16 nt, Yersinia pestis
auuuauuuacucuuuu

SEQ ID NO: 2279274 - RNA, 20 nt, Yersinia pestis
auuuauuuacucuuuuuuau

SEQ ID NO: 2279275 - RNA, 18 nt, Yersinia pestis
auuuauuggucaauaaaa

SEQ ID NO: 2279276 - RNA, 23 nt, Yersinia pestis
auuuauugccaacguuaaacccc

SEQ ID NO: 2279277 - RNA, 23 nt, Yersinia pestis
auuuauuccucucugaaucacua

SEQ ID NO: 2279278 - RNA, 19 nt, Yersinia pestis
auuuauuggucaauaaaau

SEQ ID NO: 2279279 - RNA, 20 nt, Yersinia pestis
auuuauuuccgaauuaaaaa

SEQ ID NO: 2279280 - RNA, 19 nt, Yersinia pestis
auuuauuuccgcugacuua

SEQ ID NO: 2279281 - RNA, 23 nt, Yersinia pestis
auuuauuuccgcugacuuaaggc

SEQ ID NO: 2279282 - RNA, 16 nt, Yersinia pestis
auuuauuuccagauca

SEQ ID NO: 2279283 - RNA, 13 nt, Yersinia pestis
auuuauuucugca

SEQ ID NO: 2279284 - RNA, 17 nt, Yersinia pestis
auuuauuuuacccuucg

SEQ ID NO: 2279285 - RNA, 13 nt, Yersinia pestis
auuuauuugauaa

SEQ ID NO: 2279286 - RNA, 22 nt, Yersinia pestis
auuuauuuuuaugguuuuuaac

SEQ ID NO: 2279287 - RNA, 22 nt, Yersinia pestis
auuuauaaaaccacugaccuau

SEQ ID NO: 2279288 - RNA, 12 nt, Yersinia pestis
auuuauagaaua

SEQ ID NO: 2279289 - RNA, 14 nt, Yersinia pestis
auuuauagaauaca

SEQ ID NO: 2279290 - RNA, 13 nt, Yersinia pestis
auuuauaaaacca

SEQ ID NO: 2279291 - RNA, 14 nt, Yersinia pestis
auuuauaaacaauc

SEQ ID NO: 2279292 - RNA, 15 nt, Yersinia pestis
auuuauaaaaccacu

SEQ ID NO: 2279293 - RNA, 20 nt, Yersinia pestis
auuuaucgccaagccaguaa

SEQ ID NO: 2279294 - RNA, 20 nt, Yersinia pestis
auuuauagaccuucucucua

SEQ ID NO: 2279295 - RNA, 19 nt, Yersinia pestis
auuuauagguauacaccuc

SEQ ID NO: 2279296 - RNA, 22 nt, Yersinia pestis
auuuagaagccucgucuuuuga

SEQ ID NO: 2279297 - RNA, 23 nt, Yersinia pestis
auuuaaauuacagacaaaucaca

SEQ ID NO: 2279298 - RNA, 22 nt, Yersinia pestis
auuguuucugauaucuaaaaaa

SEQ ID NO: 2279299 - RNA, 18 nt, Yersinia pestis
auuguuugcuaucaauug

SEQ ID NO: 2279300 - RNA, 19 nt, Yersinia pestis
auuguuugcuuucagauaa

SEQ ID NO: 2279301 - RNA, 20 nt, Yersinia pestis
auuguuuggucgguaagcug

SEQ ID NO: 2279302 - RNA, 22 nt, Yersinia pestis
auuguuuuaccgucgucucuau

SEQ ID NO: 2279303 - RNA, 11 nt, Yersinia pestis
auuuaaacucu

SEQ ID NO: 2279304 - RNA, 12 nt, Yersinia pestis
auuuaaaguaaa

SEQ ID NO: 2279305 - RNA, 16 nt, Yersinia pestis
auuuaaauaacagcua

SEQ ID NO: 2279306 - RNA, 19 nt, Yersinia pestis
auuuaaaguuuuuuauuua

SEQ ID NO: 2279307 - RNA, 17 nt, Yersinia pestis
auuguugcucaacauau

SEQ ID NO: 2279308 - RNA, 14 nt, Yersinia pestis
auuguuauuuuuau

SEQ ID NO: 2279309 - RNA, 20 nt, Yersinia pestis
auuguuauuaucaugaagaa

SEQ ID NO: 2279310 - RNA, 21 nt, Yersinia pestis
auuguuaccuaaccaaacauu

SEQ ID NO: 2279311 - RNA, 16 nt, Yersinia pestis
auuguaacucuuguua

SEQ ID NO: 2279312 - RNA, 13 nt, Yersinia pestis
auugucacagacg

SEQ ID NO: 2279313 - RNA, 15 nt, Yersinia pestis
auuguauugcucagg

SEQ ID NO: 2279314 - RNA, 16 nt, Yersinia pestis
auuguccaaaggaagg

SEQ ID NO: 2279315 - RNA, 15 nt, Yersinia pestis
auugucuccaucccu

SEQ ID NO: 2279316 - RNA, 17 nt, Yersinia pestis
auuguggcuaaacccaa

SEQ ID NO: 2279317 - RNA, 15 nt, Yersinia pestis
auugucuuuaauaaa

SEQ ID NO: 2279318 - RNA, 17 nt, Yersinia pestis
auugucuuuaauaaaau

SEQ ID NO: 2279319 - RNA, 21 nt, Yersinia pestis
auugugaguuaaaaauaaauu

SEQ ID NO: 2279320 - RNA, 14 nt, Yersinia pestis
auugugcagcauca

SEQ ID NO: 2279321 - RNA, 21 nt, Yersinia pestis
auuuuaugcccccuauuaugc

SEQ ID NO: 2279322 - RNA, 19 nt, Yersinia pestis
auuuuauugauuggcucau

SEQ ID NO: 2279323 - RNA, 23 nt, Yersinia pestis
auuuuauugcguuaguccaccca

SEQ ID NO: 2279324 - RNA, 14 nt, Yersinia pestis
auuuuauuggaugc

SEQ ID NO: 2279325 - RNA, 22 nt, Yersinia pestis
auuuuauuguuuucguuuaaaa

SEQ ID NO: 2279326 - RNA, 22 nt, Yersinia pestis
auuuucagacugaaaugacauu

SEQ ID NO: 2279327 - RNA, 14 nt, Yersinia pestis
auuuuacugaugaa

SEQ ID NO: 2279328 - RNA, 18 nt, Yersinia pestis
auuuuaagccgcaaggau

SEQ ID NO: 2279329 - RNA, 16 nt, Yersinia pestis
auuuucaucugaccaa

SEQ ID NO: 2279330 - RNA, 14 nt, Yersinia pestis
auuuucauuauuuu

SEQ ID NO: 2279331 - RNA, 22 nt, Yersinia pestis
auuuucgaacuuaacuacugca

SEQ ID NO: 2279332 - RNA, 16 nt, Yersinia pestis
auuuuccugcacauca

SEQ ID NO: 2279333 - RNA, 13 nt, Yersinia pestis
auuuuccugcaua

SEQ ID NO: 2279334 - RNA, 22 nt, Yersinia pestis
auuuuccugcauauuauuuugc

SEQ ID NO: 2279335 - RNA, 23 nt, Yersinia pestis
auuuuccugcauauuauuuugca

SEQ ID NO: 2279336 - RNA, 23 nt, Yersinia pestis
auuuucugugauuacgucugcau

SEQ ID NO: 2279337 - RNA, 18 nt, Yersinia pestis
auuuucugccaacgagaa

SEQ ID NO: 2279338 - RNA, 20 nt, Yersinia pestis
auuuugucgaccgcucuuca

SEQ ID NO: 2279339 - RNA, 20 nt, Yersinia pestis
auuuuguaucaguguugcaa

SEQ ID NO: 2279340 - RNA, 20 nt, Yersinia pestis
auuuugugggaaugcccuuu

SEQ ID NO: 2279341 - RNA, 18 nt, Yersinia pestis
auuuuguacaacuucuuc

SEQ ID NO: 2279342 - RNA, 22 nt, Yersinia pestis
auuuugagaugcgagauauaaa

SEQ ID NO: 2279343 - RNA, 20 nt, Yersinia pestis
auuucaugauucucuauucu

SEQ ID NO: 2279344 - RNA, 18 nt, Yersinia pestis
auuucaucggcaaaaaca

SEQ ID NO: 2279345 - RNA, 19 nt, Yersinia pestis
auuucaucggcaaaaacag

SEQ ID NO: 2279346 - RNA, 20 nt, Yersinia pestis
auuucaucggcaaaaacagu

SEQ ID NO: 2279347 - RNA, 13 nt, Yersinia pestis
auuucuugauguc

SEQ ID NO: 2279348 - RNA, 14 nt, Yersinia pestis
auuucuuuuuaugu

SEQ ID NO: 2279349 - RNA, 22 nt, Yersinia pestis
auuucuucuagcucuuccagca

SEQ ID NO: 2279350 - RNA, 23 nt, Yersinia pestis
auuucuucuagcucuuccagcaa

SEQ ID NO: 2279351 - RNA, 20 nt, Yersinia pestis
auuugaagacaacucuucua

SEQ ID NO: 2279352 - RNA, 21 nt, Yersinia pestis
auuugaacgugccccaaugau

SEQ ID NO: 2279353 - RNA, 17 nt, Yersinia pestis
auuucuuuuuauguuaa

SEQ ID NO: 2279354 - RNA, 18 nt, Yersinia pestis
auuuguauucucaucauc

SEQ ID NO: 2279355 - RNA, 10 nt, Yersinia pestis
auuuguauuc

SEQ ID NO: 2279356 - RNA, 15 nt, Yersinia pestis
auuuguaguuuuuca

SEQ ID NO: 2279357 - RNA, 18 nt, Yersinia pestis
auuuguagugaaugacag

SEQ ID NO: 2279358 - RNA, 14 nt, Yersinia pestis
auuugcgcccgcgc

SEQ ID NO: 2279359 - RNA, 14 nt, Yersinia pestis
auuugccguauuca

SEQ ID NO: 2279360 - RNA, 15 nt, Yersinia pestis
auuugaucaccaauc

SEQ ID NO: 2279361 - RNA, 13 nt, Yersinia pestis
auuugcuaucugg

SEQ ID NO: 2279362 - RNA, 22 nt, Yersinia pestis
caaaaccgaugagugaaaucuc

SEQ ID NO: 2279363 - RNA, 20 nt, Yersinia pestis
caaaaccgugacuaaaacaa

SEQ ID NO: 2279364 - RNA, 18 nt, Yersinia pestis
caaaacgacgggcugcug

SEQ ID NO: 2279365 - RNA, 14 nt, Yersinia pestis
caaaacgaacaaaa

SEQ ID NO: 2279366 - RNA, 14 nt, Yersinia pestis
caaaacgcgcgcca

SEQ ID NO: 2279367 - RNA, 13 nt, Yersinia pestis
caaaacugaagca

SEQ ID NO: 2279368 - RNA, 18 nt, Yersinia pestis
caaaacucacaaaauaac

SEQ ID NO: 2279369 - RNA, 14 nt, Yersinia pestis
caaaacucagguga

SEQ ID NO: 2279370 - RNA, 16 nt, Yersinia pestis
caaaacuccaucaaaa

SEQ ID NO: 2279371 - RNA, 19 nt, Yersinia pestis
caaaacucaggugaguaaa

SEQ ID NO: 2279372 - RNA, 19 nt, Yersinia pestis
caaaacgaguaaauagcaa

SEQ ID NO: 2279373 - RNA, 13 nt, Yersinia pestis
caaaagaaucagu

SEQ ID NO: 2279374 - RNA, 13 nt, Yersinia pestis
caaaagaagacaa

SEQ ID NO: 2279375 - RNA, 16 nt, Yersinia pestis
caaaagcaucaccaaa

SEQ ID NO: 2279376 - RNA, 17 nt, Yersinia pestis
caaaagcaucaccaaag

SEQ ID NO: 2279377 - RNA, 20 nt, Yersinia pestis
caaaagcaucaccaaagaua

SEQ ID NO: 2279378 - RNA, 18 nt, Yersinia pestis
caaaaacccauuaaaaac

SEQ ID NO: 2279379 - RNA, 19 nt, Yersinia pestis
caaaaacccauuaaaaaca

SEQ ID NO: 2279380 - RNA, 21 nt, Yersinia pestis
caaaaacccauuaaaaacaaa

SEQ ID NO: 2279381 - RNA, 19 nt, Yersinia pestis
caaaaacacagguucucca

SEQ ID NO: 2279382 - RNA, 21 nt, Yersinia pestis
caaaaauaaacgggcuuccau

SEQ ID NO: 2279383 - RNA, 20 nt, Yersinia pestis
caaaaauaaacgggcuucca

SEQ ID NO: 2279384 - RNA, 15 nt, Yersinia pestis
caaaaaguuaaauau

SEQ ID NO: 2279385 - RNA, 19 nt, Yersinia pestis
caaaaaugauauugugaua

SEQ ID NO: 2279386 - RNA, 17 nt, Yersinia pestis
auuuuuuucaugguaaa

SEQ ID NO: 2279387 - RNA, 17 nt, Yersinia pestis
auuuuuuucacccaugu

SEQ ID NO: 2279388 - RNA, 17 nt, Yersinia pestis
auuuuuuaucuuguaaa

SEQ ID NO: 2279389 - RNA, 12 nt, Yersinia pestis
caaaaaacaaac

SEQ ID NO: 2279390 - RNA, 13 nt, Yersinia pestis
caaaaaacaaacc

SEQ ID NO: 2279391 - RNA, 15 nt, Yersinia pestis
auuuuuuugaugcau

SEQ ID NO: 2279392 - RNA, 18 nt, Yersinia pestis
auuuuuuugaugcauccu

SEQ ID NO: 2279393 - RNA, 13 nt, Yersinia pestis
auuuuuuugcuuu

SEQ ID NO: 2279394 - RNA, 21 nt, Yersinia pestis
auuuuuuuuccuauaaaccaa

SEQ ID NO: 2279395 - RNA, 22 nt, Yersinia pestis
auuuuuuuuccuauaaaccaac

SEQ ID NO: 2279396 - RNA, 15 nt, Yersinia pestis
auuuuucccugcuga

SEQ ID NO: 2279397 - RNA, 22 nt, Yersinia pestis
auuuuucccugcugaucgccaa

SEQ ID NO: 2279398 - RNA, 14 nt, Yersinia pestis
auuuuucgcaguaa

SEQ ID NO: 2279399 - RNA, 20 nt, Yersinia pestis
auuuuucuguaucgaauuga

SEQ ID NO: 2279400 - RNA, 21 nt, Yersinia pestis
auuuuucuguaucgaauugau

SEQ ID NO: 2279401 - RNA, 15 nt, Yersinia pestis
auuuuguuuucucuu

SEQ ID NO: 2279402 - RNA, 15 nt, Yersinia pestis
auuuuucauucuauu

SEQ ID NO: 2279403 - RNA, 12 nt, Yersinia pestis
auuuuuguugaa

SEQ ID NO: 2279404 - RNA, 22 nt, Yersinia pestis
auuuuuggggucugaauauaaa

SEQ ID NO: 2279405 - RNA, 20 nt, Yersinia pestis
auuuuugacuuuaauuaaaa

SEQ ID NO: 2279406 - RNA, 13 nt, Yersinia pestis
auuuuucuuucuc

SEQ ID NO: 2279407 - RNA, 20 nt, Yersinia pestis
auuuuucuguucagauuuac

SEQ ID NO: 2279408 - RNA, 17 nt, Yersinia pestis
caaucgggaaaacaggc

SEQ ID NO: 2279409 - RNA, 22 nt, Yersinia pestis
caaucgcucugcguuuuucccu

SEQ ID NO: 2279410 - RNA, 23 nt, Yersinia pestis
caaucgcucugcguuuuucccug

SEQ ID NO: 2279411 - RNA, 14 nt, Yersinia pestis
caaucgcucuucac

SEQ ID NO: 2279412 - RNA, 15 nt, Yersinia pestis
caaucgcucuucacg

SEQ ID NO: 2279413 - RNA, 21 nt, Yersinia pestis
caaucgcuuccaggacaucca

SEQ ID NO: 2279414 - RNA, 21 nt, Yersinia pestis
caaucucugcaguacagauaa

SEQ ID NO: 2279415 - RNA, 20 nt, Yersinia pestis
caaucucguuaucagccaca

SEQ ID NO: 2279416 - RNA, 21 nt, Yersinia pestis
caaucucugggugcugcuccc

SEQ ID NO: 2279417 - RNA, 18 nt, Yersinia pestis
caaucucuugauagguuu

SEQ ID NO: 2279418 - RNA, 13 nt, Yersinia pestis
caaucucaucaau

SEQ ID NO: 2279419 - RNA, 19 nt, Yersinia pestis
caaucuccaaugaccccgc

SEQ ID NO: 2279420 - RNA, 16 nt, Yersinia pestis
caaucuccaguaaauc

SEQ ID NO: 2279421 - RNA, 21 nt, Yersinia pestis
caaucuccaguaaaucuacuu

SEQ ID NO: 2279422 - RNA, 12 nt, Yersinia pestis
caaucaucaucc

SEQ ID NO: 2279423 - RNA, 23 nt, Yersinia pestis
caaucaucaucccagucgucuuc

SEQ ID NO: 2279424 - RNA, 16 nt, Yersinia pestis
caaucaucguggcuuu

SEQ ID NO: 2279425 - RNA, 20 nt, Yersinia pestis
caaucaaaagggaucaccag

SEQ ID NO: 2279426 - RNA, 16 nt, Yersinia pestis
caaucaaaaaauaaau

SEQ ID NO: 2279427 - RNA, 18 nt, Yersinia pestis
caaucaaaagggaucacc

SEQ ID NO: 2279428 - RNA, 17 nt, Yersinia pestis
caauauuauauucucug

SEQ ID NO: 2279429 - RNA, 22 nt, Yersinia pestis
caauauucgcagccaaaauaau

SEQ ID NO: 2279430 - RNA, 22 nt, Yersinia pestis
caauauugccuucacccaggcu

SEQ ID NO: 2279431 - RNA, 14 nt, Yersinia pestis
caauauuggauaau

SEQ ID NO: 2279432 - RNA, 17 nt, Yersinia pestis
caauccggcacaggcuc

SEQ ID NO: 2279433 - RNA, 14 nt, Yersinia pestis
caauccgaacaaaa

SEQ ID NO: 2279434 - RNA, 21 nt, Yersinia pestis
caaucccggccauuugcucug

SEQ ID NO: 2279435 - RNA, 13 nt, Yersinia pestis
caauccaugccag

SEQ ID NO: 2279436 - RNA, 19 nt, Yersinia pestis
caauccagcgccuguucca

SEQ ID NO: 2279437 - RNA, 15 nt, Yersinia pestis
caaucauuuuuuuau

SEQ ID NO: 2279438 - RNA, 20 nt, Yersinia pestis
caaucauugagaucaguuca

SEQ ID NO: 2279439 - RNA, 19 nt, Yersinia pestis
caaucauugagaucaguuc

SEQ ID NO: 2279440 - RNA, 15 nt, Yersinia pestis
caaucauuacaucau

SEQ ID NO: 2279441 - RNA, 19 nt, Yersinia pestis
caaucauuacaucaucuuc

SEQ ID NO: 2279442 - RNA, 21 nt, Yersinia pestis
caaucuguuccugauuccaaa

SEQ ID NO: 2279443 - RNA, 23 nt, Yersinia pestis
caaugaaucaacagaugaugauu

SEQ ID NO: 2279444 - RNA, 19 nt, Yersinia pestis
caaugacuccugaaauaaa

SEQ ID NO: 2279445 - RNA, 20 nt, Yersinia pestis
caaugacuccugaaauaaag

SEQ ID NO: 2279446 - RNA, 13 nt, Yersinia pestis
caaugacuuaacu

SEQ ID NO: 2279447 - RNA, 15 nt, Yersinia pestis
caaugacuuaacuga

SEQ ID NO: 2279448 - RNA, 19 nt, Yersinia pestis
caaugacuuaacugaaagc

SEQ ID NO: 2279449 - RNA, 16 nt, Yersinia pestis
caaugauuuuuuucau

SEQ ID NO: 2279450 - RNA, 18 nt, Yersinia pestis
caaugcauuguaaaauaa

SEQ ID NO: 2279451 - RNA, 14 nt, Yersinia pestis
caaugcaguaaaga

SEQ ID NO: 2279452 - RNA, 17 nt, Yersinia pestis
caaugguucaucauuuu

SEQ ID NO: 2279453 - RNA, 21 nt, Yersinia pestis
caaugggucauugcgugcaau

SEQ ID NO: 2279454 - RNA, 18 nt, Yersinia pestis
caaugucaccugaaccug

SEQ ID NO: 2279455 - RNA, 15 nt, Yersinia pestis
caauggcaaaacaga

SEQ ID NO: 2279456 - RNA, 18 nt, Yersinia pestis
caauggauuugugcaaau

SEQ ID NO: 2279457 - RNA, 14 nt, Yersinia pestis
caauggcgaugaga

SEQ ID NO: 2279458 - RNA, 16 nt, Yersinia pestis
caaugggaugcccaca

SEQ ID NO: 2279459 - RNA, 19 nt, Yersinia pestis
caauggcugcauuggccga

SEQ ID NO: 2279460 - RNA, 23 nt, Yersinia pestis
caaugcuuuuguacgaaauugau

SEQ ID NO: 2279461 - RNA, 13 nt, Yersinia pestis
caaugcuuauuuc

SEQ ID NO: 2279462 - RNA, 15 nt, Yersinia pestis
caaugcgaaaaaaua

SEQ ID NO: 2279463 - RNA, 15 nt, Yersinia pestis
caaugccucuucaau

SEQ ID NO: 2279464 - RNA, 24 nt, Yersinia pestis
caauaagugcaaacuuaaaaauca

SEQ ID NO: 2279465 - RNA, 15 nt, Yersinia pestis
caauaauaagccgca

SEQ ID NO: 2279466 - RNA, 14 nt, Yersinia pestis
caauaauaaaaaaa

SEQ ID NO: 2279467 - RNA, 22 nt, Yersinia pestis
caauaacaccgucuuugaccga

SEQ ID NO: 2279468 - RNA, 22 nt, Yersinia pestis
caauaaagccauuucaguaacu

SEQ ID NO: 2279469 - RNA, 14 nt, Yersinia pestis
caauaaaucgccac

SEQ ID NO: 2279470 - RNA, 15 nt, Yersinia pestis
caauaacaauauuca

SEQ ID NO: 2279471 - RNA, 24 nt, Yersinia pestis
caagguucgaaaaaacaucacacu

SEQ ID NO: 2279472 - RNA, 14 nt, Yersinia pestis
caaguaugcagggu

SEQ ID NO: 2279473 - RNA, 15 nt, Yersinia pestis
caagucaugguacaa

SEQ ID NO: 2279474 - RNA, 15 nt, Yersinia pestis
caagucauuggaguc

SEQ ID NO: 2279475 - RNA, 19 nt, Yersinia pestis
caaguuugcagucgcuuca

SEQ ID NO: 2279476 - RNA, 14 nt, Yersinia pestis
caauacaauuauuu

SEQ ID NO: 2279477 - RNA, 13 nt, Yersinia pestis
caauacaccagac

SEQ ID NO: 2279478 - RNA, 19 nt, Yersinia pestis
caauacaccagacucugcu

SEQ ID NO: 2279479 - RNA, 21 nt, Yersinia pestis
caauaauuuuuaauugccgcc

SEQ ID NO: 2279480 - RNA, 18 nt, Yersinia pestis
caauaauucagaugagaa

SEQ ID NO: 2279481 - RNA, 22 nt, Yersinia pestis
caauagcggaauauuuaaccag

SEQ ID NO: 2279482 - RNA, 20 nt, Yersinia pestis
caauagccaagaucacauga

SEQ ID NO: 2279483 - RNA, 18 nt, Yersinia pestis
caauacuguuaucacuga

SEQ ID NO: 2279484 - RNA, 14 nt, Yersinia pestis
caauacuacuuucu

SEQ ID NO: 2279485 - RNA, 22 nt, Yersinia pestis
caauacguugaauuaaaaaccc

SEQ ID NO: 2279486 - RNA, 14 nt, Yersinia pestis
caauacggcacuca

SEQ ID NO: 2279487 - RNA, 21 nt, Yersinia pestis
caauagcguuaacgauauaau

SEQ ID NO: 2279488 - RNA, 22 nt, Yersinia pestis
caauagcuaauaauuguucaua

SEQ ID NO: 2279489 - RNA, 14 nt, Yersinia pestis
caauaggcuauuuu

SEQ ID NO: 2279490 - RNA, 16 nt, Yersinia pestis
caauaggcuauuuuac

SEQ ID NO: 2279491 - RNA, 19 nt, Yersinia pestis
caauaggcuauuuuacuug

SEQ ID NO: 2279492 - RNA, 14 nt, Yersinia pestis
caauaggucagugg

SEQ ID NO: 2279493 - RNA, 15 nt, Yersinia pestis
caauaggucaguggu

SEQ ID NO: 2279494 - RNA, 21 nt, Yersinia pestis
caauauaaagccauuggucaa

SEQ ID NO: 2279495 - RNA, 14 nt, Yersinia pestis
caauaguguugcua

SEQ ID NO: 2279496 - RNA, 23 nt, Yersinia pestis
caauaguguugcuaaggugugau

SEQ ID NO: 2279497 - RNA, 13 nt, Yersinia pestis
caauauccauauu

SEQ ID NO: 2279498 - RNA, 17 nt, Yersinia pestis
caauaucugccaauuca

SEQ ID NO: 2279499 - RNA, 13 nt, Yersinia pestis
caauauuaccaau

SEQ ID NO: 2279500 - RNA, 20 nt, Yersinia pestis
caagcguuaugacgccaacu

SEQ ID NO: 2279501 - RNA, 24 nt, Yersinia pestis
caagcguucgaggauaucacucug

SEQ ID NO: 2279502 - RNA, 14 nt, Yersinia pestis
caagcgcuguuaac

SEQ ID NO: 2279503 - RNA, 22 nt, Yersinia pestis
caagccuaacaaacugaaugga

SEQ ID NO: 2279504 - RNA, 23 nt, Yersinia pestis
caagccucuagcuaacagugacc

SEQ ID NO: 2279505 - RNA, 11 nt, Yersinia pestis
caagccucuag

SEQ ID NO: 2279506 - RNA, 18 nt, Yersinia pestis
caagccguggauauccac

SEQ ID NO: 2279507 - RNA, 23 nt, Yersinia pestis
caagcggccagcuugcaagugua

SEQ ID NO: 2279508 - RNA, 14 nt, Yersinia pestis
caagcgggccaagg

SEQ ID NO: 2279509 - RNA, 16 nt, Yersinia pestis
caaggaaggcuauuuu

SEQ ID NO: 2279510 - RNA, 18 nt, Yersinia pestis
caaggaaaaggcagagag

SEQ ID NO: 2279511 - RNA, 17 nt, Yersinia pestis
caaggacgaaggguaaa

SEQ ID NO: 2279512 - RNA, 23 nt, Yersinia pestis
caaggagaucgcucucacccugc

SEQ ID NO: 2279513 - RNA, 21 nt, Yersinia pestis
caaggauaagcaguucuggcu

SEQ ID NO: 2279514 - RNA, 20 nt, Yersinia pestis
caaggccgaucaacaggcca

SEQ ID NO: 2279515 - RNA, 15 nt, Yersinia pestis
caaggccgaucaaca

SEQ ID NO: 2279516 - RNA, 18 nt, Yersinia pestis
caaggucuuucgcccaca

SEQ ID NO: 2279517 - RNA, 20 nt, Yersinia pestis
caaggucgccauauuauugu

SEQ ID NO: 2279518 - RNA, 20 nt, Yersinia pestis
caaggugccauaaauaccaa

SEQ ID NO: 2279519 - RNA, 21 nt, Yersinia pestis
caaggugccauaaauaccaau

SEQ ID NO: 2279520 - RNA, 15 nt, Yersinia pestis
caagguacugauaau

SEQ ID NO: 2279521 - RNA, 16 nt, Yersinia pestis
caagguaaugguaaaa

SEQ ID NO: 2279522 - RNA, 17 nt, Yersinia pestis
caagggucaucaacaaa

SEQ ID NO: 2279523 - RNA, 18 nt, Yersinia pestis
caaggggagccacacacu

SEQ ID NO: 2279524 - RNA, 17 nt, Yersinia pestis
caaggcguacaucucuu

SEQ ID NO: 2279525 - RNA, 17 nt, Yersinia pestis
caaggcggaauagagga

SEQ ID NO: 2279526 - RNA, 12 nt, Yersinia pestis
caaggcggaugu

SEQ ID NO: 2279527 - RNA, 21 nt, Yersinia pestis
caaggccgaucaacaggccac

SEQ ID NO: 2279528 - RNA, 18 nt, Yersinia pestis
caagcaugugauguggcu

SEQ ID NO: 2279529 - RNA, 12 nt, Yersinia pestis
caagcauagaag

SEQ ID NO: 2279530 - RNA, 13 nt, Yersinia pestis
caagcauagaaga

SEQ ID NO: 2279531 - RNA, 18 nt, Yersinia pestis
caagcaucggaauccauu

SEQ ID NO: 2279532 - RNA, 14 nt, Yersinia pestis
caagccaccaccac

SEQ ID NO: 2279533 - RNA, 14 nt, Yersinia pestis
caagccaguaacua

SEQ ID NO: 2279534 - RNA, 22 nt, Yersinia pestis
caagccgauaaucccugccaga

SEQ ID NO: 2279535 - RNA, 18 nt, Yersinia pestis
caagccgcguuccaaucu

SEQ ID NO: 2279536 - RNA, 16 nt, Yersinia pestis
caagcccgauugccug

SEQ ID NO: 2279537 - RNA, 14 nt, Yersinia pestis
caacuucuccugua

SEQ ID NO: 2279538 - RNA, 13 nt, Yersinia pestis
caagcacacuggu

SEQ ID NO: 2279539 - RNA, 14 nt, Yersinia pestis
caacuucuacauag

SEQ ID NO: 2279540 - RNA, 19 nt, Yersinia pestis
caacuucaauaccaaauuu

SEQ ID NO: 2279541 - RNA, 16 nt, Yersinia pestis
caacuuccacacaaac

SEQ ID NO: 2279542 - RNA, 13 nt, Yersinia pestis
caaauacacauaa

SEQ ID NO: 2279543 - RNA, 17 nt, Yersinia pestis
caaauaauucagacggc

SEQ ID NO: 2279544 - RNA, 20 nt, Yersinia pestis
caaauaauucagacggcaga

SEQ ID NO: 2279545 - RNA, 23 nt, Yersinia pestis
caaauacauauaaccaucaaaua

SEQ ID NO: 2279546 - RNA, 15 nt, Yersinia pestis
caaauagauuuaacu

SEQ ID NO: 2279547 - RNA, 21 nt, Yersinia pestis
caaauagcaagccaaaacagc

SEQ ID NO: 2279548 - RNA, 20 nt, Yersinia pestis
caaauagcuggcauccucag

SEQ ID NO: 2279549 - RNA, 22 nt, Yersinia pestis
caaauagcgcugcagcaucaag

SEQ ID NO: 2279550 - RNA, 16 nt, Yersinia pestis
caaauaguaauaauua

SEQ ID NO: 2279551 - RNA, 18 nt, Yersinia pestis
caaauaaguguuucaaau

SEQ ID NO: 2279552 - RNA, 14 nt, Yersinia pestis
caaauaauuacgua

SEQ ID NO: 2279553 - RNA, 15 nt, Yersinia pestis
caaauaaaacagaac

SEQ ID NO: 2279554 - RNA, 16 nt, Yersinia pestis
caaauaaaaccaagaa

SEQ ID NO: 2279555 - RNA, 21 nt, Yersinia pestis
caaagguuucacaugugcaau

SEQ ID NO: 2279556 - RNA, 17 nt, Yersinia pestis
caaaguaugggaaagua

SEQ ID NO: 2279557 - RNA, 13 nt, Yersinia pestis
caaaguaguacga

SEQ ID NO: 2279558 - RNA, 22 nt, Yersinia pestis
caaagucaucgggguugcaguu

SEQ ID NO: 2279559 - RNA, 22 nt, Yersinia pestis
caaagugcccgcgacggagaga

SEQ ID NO: 2279560 - RNA, 13 nt, Yersinia pestis
caaaguugaguau

SEQ ID NO: 2279561 - RNA, 20 nt, Yersinia pestis
caaagugcugcaaggcauua

SEQ ID NO: 2279562 - RNA, 22 nt, Yersinia pestis
caaagugcuuaacccaccaaua

SEQ ID NO: 2279563 - RNA, 20 nt, Yersinia pestis
caaaguggcauaaccaauca

SEQ ID NO: 2279564 - RNA, 20 nt, Yersinia pestis
caaaagccucuugcgcucca

SEQ ID NO: 2279565 - RNA, 18 nt, Yersinia pestis
caaaaggauggcccaagc

SEQ ID NO: 2279566 - RNA, 22 nt, Yersinia pestis
caaaaggauggcccaagccauc

SEQ ID NO: 2279567 - RNA, 16 nt, Yersinia pestis
caaagaauguuauugc

SEQ ID NO: 2279568 - RNA, 22 nt, Yersinia pestis
caaagaagacaucuggcuggca

SEQ ID NO: 2279569 - RNA, 13 nt, Yersinia pestis
caaagcccaaaaa

SEQ ID NO: 2279570 - RNA, 17 nt, Yersinia pestis
caaagcagcguuuuuag

SEQ ID NO: 2279571 - RNA, 16 nt, Yersinia pestis
caaagccgcugcucac

SEQ ID NO: 2279572 - RNA, 20 nt, Yersinia pestis
caaagcccggaaacguccag

SEQ ID NO: 2279573 - RNA, 14 nt, Yersinia pestis
caaagccgucaguu

SEQ ID NO: 2279574 - RNA, 16 nt, Yersinia pestis
caaagccuacgagaga

SEQ ID NO: 2279575 - RNA, 16 nt, Yersinia pestis
caaagauuggcagcgu

SEQ ID NO: 2279576 - RNA, 21 nt, Yersinia pestis
caaagaauugagguaaaccaa

SEQ ID NO: 2279577 - RNA, 22 nt, Yersinia pestis
caaagaauugagguaaaccaag

SEQ ID NO: 2279578 - RNA, 23 nt, Yersinia pestis
caaagauuucaucggcaaaaaca

SEQ ID NO: 2279579 - RNA, 21 nt, Yersinia pestis
caaauucucaaugauaaaauc

SEQ ID NO: 2279580 - RNA, 18 nt, Yersinia pestis
caaauucuuucaacgcau

SEQ ID NO: 2279581 - RNA, 22 nt, Yersinia pestis
caaauuacggcucaguugaugc

SEQ ID NO: 2279582 - RNA, 14 nt, Yersinia pestis
caaauuacuuuaaa

SEQ ID NO: 2279583 - RNA, 13 nt, Yersinia pestis
caaauuagcaggg

SEQ ID NO: 2279584 - RNA, 15 nt, Yersinia pestis
caaaugccaguaagg

SEQ ID NO: 2279585 - RNA, 14 nt, Yersinia pestis
caaauuaaccugcu

SEQ ID NO: 2279586 - RNA, 19 nt, Yersinia pestis
caaauuaccaccaccucca

SEQ ID NO: 2279587 - RNA, 14 nt, Yersinia pestis
caaauuaacacauc

SEQ ID NO: 2279588 - RNA, 20 nt, Yersinia pestis
caaaucauacgcagccugaa

SEQ ID NO: 2279589 - RNA, 21 nt, Yersinia pestis
caaaucagcaagcugcucaau

SEQ ID NO: 2279590 - RNA, 20 nt, Yersinia pestis
caaaucaccugacaccaaga

SEQ ID NO: 2279591 - RNA, 16 nt, Yersinia pestis
caaauauagcauguac

SEQ ID NO: 2279592 - RNA, 16 nt, Yersinia pestis
caaauauaaugcugaa

SEQ ID NO: 2279593 - RNA, 14 nt, Yersinia pestis
caaaugacacuuuu

SEQ ID NO: 2279594 - RNA, 21 nt, Yersinia pestis
caaaucaguaccaccaccaca

SEQ ID NO: 2279595 - RNA, 19 nt, Yersinia pestis
caaaucaucaucuugaaaa

SEQ ID NO: 2279596 - RNA, 20 nt, Yersinia pestis
caaaucgccaaacugcucau

SEQ ID NO: 2279597 - RNA, 19 nt, Yersinia pestis
caaaucgccaaacugcuca

SEQ ID NO: 2279598 - RNA, 18 nt, Yersinia pestis
caaauuguggaaauaacg

SEQ ID NO: 2279599 - RNA, 21 nt, Yersinia pestis
caaauugugaguuaaaaauaa

SEQ ID NO: 2279600 - RNA, 19 nt, Yersinia pestis
caaauugcugaaaaaaaac

SEQ ID NO: 2279601 - RNA, 19 nt, Yersinia pestis
caacacacuuagcuaagcu

SEQ ID NO: 2279602 - RNA, 13 nt, Yersinia pestis
caacaggccaccu

SEQ ID NO: 2279603 - RNA, 23 nt, Yersinia pestis
caacacuccucuuucuuaauaau

SEQ ID NO: 2279604 - RNA, 14 nt, Yersinia pestis
caacacuagcugcc

SEQ ID NO: 2279605 - RNA, 19 nt, Yersinia pestis
caacugauaauucaguguc

SEQ ID NO: 2279606 - RNA, 22 nt, Yersinia pestis
caacugagucgcuugauucuca

SEQ ID NO: 2279607 - RNA, 11 nt, Yersinia pestis
caacugauaaa

SEQ ID NO: 2279608 - RNA, 20 nt, Yersinia pestis
caacugaggcaacauuuguu

SEQ ID NO: 2279609 - RNA, 20 nt, Yersinia pestis
caacugacaacaucaaauga

SEQ ID NO: 2279610 - RNA, 16 nt, Yersinia pestis
caacugacugaaguua

SEQ ID NO: 2279611 - RNA, 23 nt, Yersinia pestis
caacugaaaauacuacucaaaaa

SEQ ID NO: 2279612 - RNA, 17 nt, Yersinia pestis
caacucuucuuuacugc

SEQ ID NO: 2279613 - RNA, 14 nt, Yersinia pestis
caacugaaacugga

SEQ ID NO: 2279614 - RNA, 17 nt, Yersinia pestis
caacuaauauuaagucu

SEQ ID NO: 2279615 - RNA, 15 nt, Yersinia pestis
caacucugaugaaau

SEQ ID NO: 2279616 - RNA, 18 nt, Yersinia pestis
caacuagcccacucagcc

SEQ ID NO: 2279617 - RNA, 20 nt, Yersinia pestis
caacuuagcccuucagcggu

SEQ ID NO: 2279618 - RNA, 14 nt, Yersinia pestis
caacuguaaugccc

SEQ ID NO: 2279619 - RNA, 20 nt, Yersinia pestis
caacugccgccaugcuggau

SEQ ID NO: 2279620 - RNA, 19 nt, Yersinia pestis
caacugcucaacgccccgu

SEQ ID NO: 2279621 - RNA, 15 nt, Yersinia pestis
caacugcucaacugc

SEQ ID NO: 2279622 - RNA, 14 nt, Yersinia pestis
caacgccaauaccg

SEQ ID NO: 2279623 - RNA, 15 nt, Yersinia pestis
caacgccagauaacg

SEQ ID NO: 2279624 - RNA, 22 nt, Yersinia pestis
caacgcccagcuuuuuacgcaa

SEQ ID NO: 2279625 - RNA, 22 nt, Yersinia pestis
caacgcccgcggccaauagcaa

SEQ ID NO: 2279626 - RNA, 12 nt, Yersinia pestis
caaccucagccu

SEQ ID NO: 2279627 - RNA, 14 nt, Yersinia pestis
caaccucagccuca

SEQ ID NO: 2279628 - RNA, 18 nt, Yersinia pestis
caaccucagccucauuca

SEQ ID NO: 2279629 - RNA, 23 nt, Yersinia pestis
caaccguuguguaucagcaacuu

SEQ ID NO: 2279630 - RNA, 21 nt, Yersinia pestis
caacggagcguacacgcagua

SEQ ID NO: 2279631 - RNA, 20 nt, Yersinia pestis
caacgucaucgccacacgca

SEQ ID NO: 2279632 - RNA, 15 nt, Yersinia pestis
caacggaguaacaaa

SEQ ID NO: 2279633 - RNA, 15 nt, Yersinia pestis
caacggcacauccca

SEQ ID NO: 2279634 - RNA, 18 nt, Yersinia pestis
caacgcucuaacgucaga

SEQ ID NO: 2279635 - RNA, 22 nt, Yersinia pestis
caacgcuguuggguugugguau

SEQ ID NO: 2279636 - RNA, 19 nt, Yersinia pestis
caacgcuccgguuuucacc

SEQ ID NO: 2279637 - RNA, 16 nt, Yersinia pestis
caaccggcgcuccagu

SEQ ID NO: 2279638 - RNA, 14 nt, Yersinia pestis
caaccgagaagucg

SEQ ID NO: 2279639 - RNA, 15 nt, Yersinia pestis
caacccgcacguuca

SEQ ID NO: 2279640 - RNA, 12 nt, Yersinia pestis
caaccccagccg

SEQ ID NO: 2279641 - RNA, 17 nt, Yersinia pestis
caaccccaucagcauau

SEQ ID NO: 2279642 - RNA, 23 nt, Yersinia pestis
caaccccuaauccagcagccucu

SEQ ID NO: 2279643 - RNA, 17 nt, Yersinia pestis
caaccauuguggcuaaa

SEQ ID NO: 2279644 - RNA, 13 nt, Yersinia pestis
caaccaucaccau

SEQ ID NO: 2279645 - RNA, 15 nt, Yersinia pestis
caaccauaucgccau

SEQ ID NO: 2279646 - RNA, 15 nt, Yersinia pestis
caacaugguccacag

SEQ ID NO: 2279647 - RNA, 18 nt, Yersinia pestis
caacauuuauuuaucgcc

SEQ ID NO: 2279648 - RNA, 20 nt, Yersinia pestis
caacauugcucggcugacga

SEQ ID NO: 2279649 - RNA, 14 nt, Yersinia pestis
caacauuuuuagcu

SEQ ID NO: 2279650 - RNA, 15 nt, Yersinia pestis
caacauuuguugcaa

SEQ ID NO: 2279651 - RNA, 23 nt, Yersinia pestis
caacauuaaaaauacaaccaaca

SEQ ID NO: 2279652 - RNA, 14 nt, Yersinia pestis
caacauuaaaaaua

SEQ ID NO: 2279653 - RNA, 15 nt, Yersinia pestis
caacauuaaaaauac

SEQ ID NO: 2279654 - RNA, 17 nt, Yersinia pestis
caacauuaaaaauacaa

SEQ ID NO: 2279655 - RNA, 22 nt, Yersinia pestis
caacauuagggccaccagacug

SEQ ID NO: 2279656 - RNA, 13 nt, Yersinia pestis
caacauuccauac

SEQ ID NO: 2279657 - RNA, 13 nt, Yersinia pestis
caaccaacaccaa

SEQ ID NO: 2279658 - RNA, 17 nt, Yersinia pestis
caaccaacacuccucuu

SEQ ID NO: 2279659 - RNA, 18 nt, Yersinia pestis
caaccaaucguugcuggu

SEQ ID NO: 2279660 - RNA, 18 nt, Yersinia pestis
caaccacgguaauagcuu

SEQ ID NO: 2279661 - RNA, 16 nt, Yersinia pestis
caaccacuuauccagc

SEQ ID NO: 2279662 - RNA, 19 nt, Yersinia pestis
caaccacuuauccagcuca

SEQ ID NO: 2279663 - RNA, 19 nt, Yersinia pestis
caaccacuaaaccacauaa

SEQ ID NO: 2279664 - RNA, 20 nt, Yersinia pestis
caaccacgaagagcgccuca

SEQ ID NO: 2279665 - RNA, 21 nt, Yersinia pestis
caaccacgguaauagcuuaau

SEQ ID NO: 2279666 - RNA, 14 nt, Yersinia pestis
caaccaggccgcca

SEQ ID NO: 2279667 - RNA, 17 nt, Yersinia pestis
caaccagacguuaugaa

SEQ ID NO: 2279668 - RNA, 17 nt, Yersinia pestis
cagcaguugucagcccu

SEQ ID NO: 2279669 - RNA, 15 nt, Yersinia pestis
cagcagucugaagcc

SEQ ID NO: 2279670 - RNA, 21 nt, Yersinia pestis
cagcagucugacagauacuuu

SEQ ID NO: 2279671 - RNA, 21 nt, Yersinia pestis
cagcagucugagccucaugaa

SEQ ID NO: 2279672 - RNA, 17 nt, Yersinia pestis
cagcagucugaggggcg

SEQ ID NO: 2279673 - RNA, 17 nt, Yersinia pestis
cagcaguggcuuggcaa

SEQ ID NO: 2279674 - RNA, 12 nt, Yersinia pestis
cagcagucugaa

SEQ ID NO: 2279675 - RNA, 23 nt, Yersinia pestis
cagcagggauucugucagagcua

SEQ ID NO: 2279676 - RNA, 22 nt, Yersinia pestis
cagcaggggcaaccucuucuuc

SEQ ID NO: 2279677 - RNA, 16 nt, Yersinia pestis
cagcagggcgguuaau

SEQ ID NO: 2279678 - RNA, 14 nt, Yersinia pestis
cagcagcaguauua

SEQ ID NO: 2279679 - RNA, 12 nt, Yersinia pestis
cagcagcgcgcu

SEQ ID NO: 2279680 - RNA, 18 nt, Yersinia pestis
cagcacgaaccugagcga

SEQ ID NO: 2279681 - RNA, 15 nt, Yersinia pestis
cagcacgccaguguu

SEQ ID NO: 2279682 - RNA, 12 nt, Yersinia pestis
cagcacgccagu

SEQ ID NO: 2279683 - RNA, 19 nt, Yersinia pestis
cagcagaacaaaacaagcc

SEQ ID NO: 2279684 - RNA, 19 nt, Yersinia pestis
cagcagagucgcaaaaaau

SEQ ID NO: 2279685 - RNA, 15 nt, Yersinia pestis
cagcacuccccgccc

SEQ ID NO: 2279686 - RNA, 17 nt, Yersinia pestis
cagcacuccccgcccgu

SEQ ID NO: 2279687 - RNA, 16 nt, Yersinia pestis
cagcacgguaaccuuu

SEQ ID NO: 2279688 - RNA, 19 nt, Yersinia pestis
cagcacggauaucuggguu

SEQ ID NO: 2279689 - RNA, 24 nt, Yersinia pestis
cagccauauccaaagauaucuuug

SEQ ID NO: 2279690 - RNA, 22 nt, Yersinia pestis
cagccauauguugccaccagcg

SEQ ID NO: 2279691 - RNA, 15 nt, Yersinia pestis
cagccaucggucauu

SEQ ID NO: 2279692 - RNA, 19 nt, Yersinia pestis
cagccaucggucauuuuac

SEQ ID NO: 2279693 - RNA, 17 nt, Yersinia pestis
cagccaugggcugaagu

SEQ ID NO: 2279694 - RNA, 15 nt, Yersinia pestis
cagccaugccugcga

SEQ ID NO: 2279695 - RNA, 23 nt, Yersinia pestis
cagccaucuugggccgacucugc

SEQ ID NO: 2279696 - RNA, 14 nt, Yersinia pestis
cagcccagauggca

SEQ ID NO: 2279697 - RNA, 20 nt, Yersinia pestis
cagccccaaucaccggcugg

SEQ ID NO: 2279698 - RNA, 20 nt, Yersinia pestis
cagccccaaacacuuagcac

SEQ ID NO: 2279699 - RNA, 13 nt, Yersinia pestis
cagcccauccugu

SEQ ID NO: 2279700 - RNA, 20 nt, Yersinia pestis
cagcccagucucuuugccaa

SEQ ID NO: 2279701 - RNA, 18 nt, Yersinia pestis
cagccccuaacagcagug

SEQ ID NO: 2279702 - RNA, 15 nt, Yersinia pestis
cagccacucaauggc

SEQ ID NO: 2279703 - RNA, 18 nt, Yersinia pestis
cagccacucacauaagaa

SEQ ID NO: 2279704 - RNA, 17 nt, Yersinia pestis
cagccacguaauaccac

SEQ ID NO: 2279705 - RNA, 18 nt, Yersinia pestis
cagccacgauuaucucuu

SEQ ID NO: 2279706 - RNA, 15 nt, Yersinia pestis
cagccagagaauuau

SEQ ID NO: 2279707 - RNA, 20 nt, Yersinia pestis
cagccagugcuggcaacagc

SEQ ID NO: 2279708 - RNA, 19 nt, Yersinia pestis
cagccagcgggcgcagcca

SEQ ID NO: 2279709 - RNA, 21 nt, Yersinia pestis
cagcauaucccuguuuucuag

SEQ ID NO: 2279710 - RNA, 16 nt, Yersinia pestis
cagcauacgugccaaa

SEQ ID NO: 2279711 - RNA, 20 nt, Yersinia pestis
cagcauaacgguuguauaca

SEQ ID NO: 2279712 - RNA, 14 nt, Yersinia pestis
cagcauaaccagug

SEQ ID NO: 2279713 - RNA, 18 nt, Yersinia pestis
cagcaucacccguuuucc

SEQ ID NO: 2279714 - RNA, 14 nt, Yersinia pestis
cagcaucacugucu

SEQ ID NO: 2279715 - RNA, 19 nt, Yersinia pestis
cagcaucaguaacuucucu

SEQ ID NO: 2279716 - RNA, 16 nt, Yersinia pestis
cagcaucccagccacc

SEQ ID NO: 2279717 - RNA, 17 nt, Yersinia pestis
cagcaucccagccacca

SEQ ID NO: 2279718 - RNA, 15 nt, Yersinia pestis
cagcaucccaaugaa

SEQ ID NO: 2279719 - RNA, 19 nt, Yersinia pestis
cagcaucuucaaucaacug

SEQ ID NO: 2279720 - RNA, 17 nt, Yersinia pestis
cagcaucugcaauggcu

SEQ ID NO: 2279721 - RNA, 15 nt, Yersinia pestis
cagcaucuagcagug

SEQ ID NO: 2279722 - RNA, 17 nt, Yersinia pestis
cagcauccugaacuucc

SEQ ID NO: 2279723 - RNA, 15 nt, Yersinia pestis
cagccaagucaggga

SEQ ID NO: 2279724 - RNA, 12 nt, Yersinia pestis
cagccaaccauc

SEQ ID NO: 2279725 - RNA, 13 nt, Yersinia pestis
cagccaauggcca

SEQ ID NO: 2279726 - RNA, 20 nt, Yersinia pestis
cagccaauggccaccauuaa

SEQ ID NO: 2279727 - RNA, 11 nt, Yersinia pestis
cagccaccauu

SEQ ID NO: 2279728 - RNA, 16 nt, Yersinia pestis
cagcauuaacccauau

SEQ ID NO: 2279729 - RNA, 14 nt, Yersinia pestis
cagcauuucaggau

SEQ ID NO: 2279730 - RNA, 15 nt, Yersinia pestis
cagcauucaggcuuu

SEQ ID NO: 2279731 - RNA, 18 nt, Yersinia pestis
cagcauucucacuuacua

SEQ ID NO: 2279732 - RNA, 13 nt, Yersinia pestis
cagcauucugcuu

SEQ ID NO: 2279733 - RNA, 15 nt, Yersinia pestis
cagcccuuugaccau

SEQ ID NO: 2279734 - RNA, 22 nt, Yersinia pestis
cagcccugccuggcaggaagcc

SEQ ID NO: 2279735 - RNA, 20 nt, Yersinia pestis
cagcccugaucgcugugcaa

SEQ ID NO: 2279736 - RNA, 15 nt, Yersinia pestis
cagcccgauggcaaa

SEQ ID NO: 2279737 - RNA, 22 nt, Yersinia pestis
cagccgggaugaucaacaguga

SEQ ID NO: 2279738 - RNA, 20 nt, Yersinia pestis
cagccuuaacugcauagcua

SEQ ID NO: 2279739 - RNA, 13 nt, Yersinia pestis
cagccuuuaucca

SEQ ID NO: 2279740 - RNA, 23 nt, Yersinia pestis
cagccuuuuuugcuuaaaacagg

SEQ ID NO: 2279741 - RNA, 17 nt, Yersinia pestis
cagccuguuggucauau

SEQ ID NO: 2279742 - RNA, 12 nt, Yersinia pestis
cagccuguuaau

SEQ ID NO: 2279743 - RNA, 19 nt, Yersinia pestis
cagccuguacuuuaacuuu

SEQ ID NO: 2279744 - RNA, 18 nt, Yersinia pestis
cagccucuaacacucuuu

SEQ ID NO: 2279745 - RNA, 16 nt, Yersinia pestis
cagccugaauuuccug

SEQ ID NO: 2279746 - RNA, 14 nt, Yersinia pestis
cagccucauucaug

SEQ ID NO: 2279747 - RNA, 18 nt, Yersinia pestis
cagccuaaaaugaauaac

SEQ ID NO: 2279748 - RNA, 17 nt, Yersinia pestis
cagccguaucuucugcc

SEQ ID NO: 2279749 - RNA, 14 nt, Yersinia pestis
cagcgaaauguaag

SEQ ID NO: 2279750 - RNA, 23 nt, Yersinia pestis
cagcgaaauguaagcuacuaaug

SEQ ID NO: 2279751 - RNA, 20 nt, Yersinia pestis
cagcgacauggcgcaauggc

SEQ ID NO: 2279752 - RNA, 16 nt, Yersinia pestis
cagcgaauaguaucua

SEQ ID NO: 2279753 - RNA, 17 nt, Yersinia pestis
cagcgaauaguaucuac

SEQ ID NO: 2279754 - RNA, 13 nt, Yersinia pestis
cagcgacaaccug

SEQ ID NO: 2279755 - RNA, 15 nt, Yersinia pestis
cagcgacaaccugua

SEQ ID NO: 2279756 - RNA, 16 nt, Yersinia pestis
cagcgacgcuaaacac

SEQ ID NO: 2279757 - RNA, 15 nt, Yersinia pestis
cagcgaggcuucuca

SEQ ID NO: 2279758 - RNA, 17 nt, Yersinia pestis
cagcgagacgauuaucu

SEQ ID NO: 2279759 - RNA, 17 nt, Yersinia pestis
cagcgauuaaaauaaag

SEQ ID NO: 2279760 - RNA, 15 nt, Yersinia pestis
cagcgauuaaaauaa

SEQ ID NO: 2279761 - RNA, 17 nt, Yersinia pestis
cagcgaucuauucucug

SEQ ID NO: 2279762 - RNA, 17 nt, Yersinia pestis
cagcgauacaaccggcu

SEQ ID NO: 2279763 - RNA, 20 nt, Yersinia pestis
cagcgcagguggauccguca

SEQ ID NO: 2279764 - RNA, 20 nt, Yersinia pestis
cagcgccgauauacacccca

SEQ ID NO: 2279765 - RNA, 22 nt, Yersinia pestis
cagcgcccuugccagugcaauc

SEQ ID NO: 2279766 - RNA, 18 nt, Yersinia pestis
cagcgcuggcuauccuga

SEQ ID NO: 2279767 - RNA, 17 nt, Yersinia pestis
cagagcucgcuagucau

SEQ ID NO: 2279768 - RNA, 15 nt, Yersinia pestis
cagaggaguaaagcg

SEQ ID NO: 2279769 - RNA, 12 nt, Yersinia pestis
cagagccuuaua

SEQ ID NO: 2279770 - RNA, 24 nt, Yersinia pestis
cagagccuuauaggcgcauaugaa

SEQ ID NO: 2279771 - RNA, 20 nt, Yersinia pestis
cagagcguuucaguauugua

SEQ ID NO: 2279772 - RNA, 14 nt, Yersinia pestis
cagagcggguuuuu

SEQ ID NO: 2279773 - RNA, 17 nt, Yersinia pestis
cagaguauccagcguca

SEQ ID NO: 2279774 - RNA, 16 nt, Yersinia pestis
cagaguccucucacca

SEQ ID NO: 2279775 - RNA, 15 nt, Yersinia pestis
cagaguccucucacc

SEQ ID NO: 2279776 - RNA, 17 nt, Yersinia pestis
cagagucgcaaaaaaua

SEQ ID NO: 2279777 - RNA, 16 nt, Yersinia pestis
cagauaaagaaaaacc

SEQ ID NO: 2279778 - RNA, 19 nt, Yersinia pestis
cagauaaagaaaaacccgu

SEQ ID NO: 2279779 - RNA, 14 nt, Yersinia pestis
cagagugugaaauc

SEQ ID NO: 2279780 - RNA, 22 nt, Yersinia pestis
cagauccgcacugggaucugau

SEQ ID NO: 2279781 - RNA, 21 nt, Yersinia pestis
cagaucagcgugacguuaucu

SEQ ID NO: 2279782 - RNA, 17 nt, Yersinia pestis
cagaucaccgaugauaa

SEQ ID NO: 2279783 - RNA, 23 nt, Yersinia pestis
cagauaucacucagcgucacgga

SEQ ID NO: 2279784 - RNA, 16 nt, Yersinia pestis
cagauaucagccagug

SEQ ID NO: 2279785 - RNA, 19 nt, Yersinia pestis
cagauaggcgaaauugacu

SEQ ID NO: 2279786 - RNA, 13 nt, Yersinia pestis
cagauagucaucu

SEQ ID NO: 2279787 - RNA, 15 nt, Yersinia pestis
cagauaucugcucau

SEQ ID NO: 2279788 - RNA, 14 nt, Yersinia pestis
cagauaugcauuau

SEQ ID NO: 2279789 - RNA, 18 nt, Yersinia pestis
cagauaugccaggcauca

SEQ ID NO: 2279790 - RNA, 21 nt, Yersinia pestis
cagauaugccaggcaucaucu

SEQ ID NO: 2279791 - RNA, 17 nt, Yersinia pestis
cagauauuacgcagcca

SEQ ID NO: 2279792 - RNA, 16 nt, Yersinia pestis
cagauaccacaucaaa

SEQ ID NO: 2279793 - RNA, 19 nt, Yersinia pestis
cagauagcgaaucacauca

SEQ ID NO: 2279794 - RNA, 22 nt, Yersinia pestis
cagauaaauaaaauaauaaugg

SEQ ID NO: 2279795 - RNA, 17 nt, Yersinia pestis
cagauaacauacaccau

SEQ ID NO: 2279796 - RNA, 15 nt, Yersinia pestis
cagagcagaaagcag

SEQ ID NO: 2279797 - RNA, 16 nt, Yersinia pestis
cagagcagaaagcagc

SEQ ID NO: 2279798 - RNA, 17 nt, Yersinia pestis
cagagcagaaagcagca

SEQ ID NO: 2279799 - RNA, 13 nt, Yersinia pestis
cagagcacgcaga

SEQ ID NO: 2279800 - RNA, 19 nt, Yersinia pestis
cagagcacgcagagaugaa

SEQ ID NO: 2279801 - RNA, 21 nt, Yersinia pestis
cagagauuguuuuccacaugg

SEQ ID NO: 2279802 - RNA, 20 nt, Yersinia pestis
cagagcaagggucuccacac

SEQ ID NO: 2279803 - RNA, 15 nt, Yersinia pestis
cagagaggagaauua

SEQ ID NO: 2279804 - RNA, 22 nt, Yersinia pestis
cagagauaacggcguucuaaau

SEQ ID NO: 2279805 - RNA, 22 nt, Yersinia pestis
cagagauaauagauaacaaacu

SEQ ID NO: 2279806 - RNA, 19 nt, Yersinia pestis
cagagaucauguaguacuu

SEQ ID NO: 2279807 - RNA, 16 nt, Yersinia pestis
cagacugacaaccacu

SEQ ID NO: 2279808 - RNA, 14 nt, Yersinia pestis
cagacugacgcaga

SEQ ID NO: 2279809 - RNA, 19 nt, Yersinia pestis
cagacugaaauaaugguuu

SEQ ID NO: 2279810 - RNA, 18 nt, Yersinia pestis
cagacucuuauauaaauc

SEQ ID NO: 2279811 - RNA, 22 nt, Yersinia pestis
cagacugaaaugacauugcgaa

SEQ ID NO: 2279812 - RNA, 12 nt, Yersinia pestis
cagacugcugac

SEQ ID NO: 2279813 - RNA, 20 nt, Yersinia pestis
cagacugacgcagagcuaaa

SEQ ID NO: 2279814 - RNA, 13 nt, Yersinia pestis
cagacugcugaca

SEQ ID NO: 2279815 - RNA, 18 nt, Yersinia pestis
cagacugcugacaaaccc

SEQ ID NO: 2279816 - RNA, 17 nt, Yersinia pestis
cagacugcugacaaccc

SEQ ID NO: 2279817 - RNA, 21 nt, Yersinia pestis
cagagaccacagauaaauaaa

SEQ ID NO: 2279818 - RNA, 16 nt, Yersinia pestis
cagagaaugaguaaag

SEQ ID NO: 2279819 - RNA, 18 nt, Yersinia pestis
cagacucugcuaccagga

SEQ ID NO: 2279820 - RNA, 16 nt, Yersinia pestis
cagacugaaaguagaa

SEQ ID NO: 2279821 - RNA, 16 nt, Yersinia pestis
cagacuaaaaaccgcc

SEQ ID NO: 2279822 - RNA, 17 nt, Yersinia pestis
cagacuaaaaaccgcca

SEQ ID NO: 2279823 - RNA, 19 nt, Yersinia pestis
cagacguacauauaucacu

SEQ ID NO: 2279824 - RNA, 18 nt, Yersinia pestis
cagacgaguauuccccac

SEQ ID NO: 2279825 - RNA, 16 nt, Yersinia pestis
cagacgaaagauaauu

SEQ ID NO: 2279826 - RNA, 18 nt, Yersinia pestis
cagacgacgugcagcgcg

SEQ ID NO: 2279827 - RNA, 21 nt, Yersinia pestis
cagauucgcaaagcgggccag

SEQ ID NO: 2279828 - RNA, 17 nt, Yersinia pestis
cagauucccgcgccgcg

SEQ ID NO: 2279829 - RNA, 17 nt, Yersinia pestis
cagauucaccaguagcc

SEQ ID NO: 2279830 - RNA, 15 nt, Yersinia pestis
cagauuauuggcaug

SEQ ID NO: 2279831 - RNA, 18 nt, Yersinia pestis
cagauuauuguuauccac

SEQ ID NO: 2279832 - RNA, 18 nt, Yersinia pestis
cagauguuaacuggcucc

SEQ ID NO: 2279833 - RNA, 14 nt, Yersinia pestis
cagaugggaagaca

SEQ ID NO: 2279834 - RNA, 15 nt, Yersinia pestis
cagauguaaccaccc

SEQ ID NO: 2279835 - RNA, 17 nt, Yersinia pestis
cagauguaaccacccac

SEQ ID NO: 2279836 - RNA, 17 nt, Yersinia pestis
cagauggugcgccauua

SEQ ID NO: 2279837 - RNA, 19 nt, Yersinia pestis
cagauuguuuauaaauuaa

SEQ ID NO: 2279838 - RNA, 14 nt, Yersinia pestis
cagauuuaaaucau

SEQ ID NO: 2279839 - RNA, 23 nt, Yersinia pestis
cagauuuacuccccaaagccuac

SEQ ID NO: 2279840 - RNA, 12 nt, Yersinia pestis
cagauuuaccau

SEQ ID NO: 2279841 - RNA, 13 nt, Yersinia pestis
cagauuuacuccc

SEQ ID NO: 2279842 - RNA, 21 nt, Yersinia pestis
cagauuuggccacgcugccug

SEQ ID NO: 2279843 - RNA, 17 nt, Yersinia pestis
cagauuuuccauccccu

SEQ ID NO: 2279844 - RNA, 12 nt, Yersinia pestis
cagauuugguau

SEQ ID NO: 2279845 - RNA, 17 nt, Yersinia pestis
cagcaaacaucgguaaa

SEQ ID NO: 2279846 - RNA, 22 nt, Yersinia pestis
cagcaaaagccucuugcgcucc

SEQ ID NO: 2279847 - RNA, 23 nt, Yersinia pestis
cagaucguuaaaguuaucaccaa

SEQ ID NO: 2279848 - RNA, 23 nt, Yersinia pestis
cagauccguaccaccacgaaaau

SEQ ID NO: 2279849 - RNA, 18 nt, Yersinia pestis
cagauggcaaucugcaag

SEQ ID NO: 2279850 - RNA, 17 nt, Yersinia pestis
cagaugcuggcuuuuuu

SEQ ID NO: 2279851 - RNA, 22 nt, Yersinia pestis
cagaugaugaugagaaguaaaa

SEQ ID NO: 2279852 - RNA, 22 nt, Yersinia pestis
cagaugaauccagccaugcgac

SEQ ID NO: 2279853 - RNA, 17 nt, Yersinia pestis
cagcaaggcagcaagca

SEQ ID NO: 2279854 - RNA, 18 nt, Yersinia pestis
cagcaaggcagcaagcaa

SEQ ID NO: 2279855 - RNA, 17 nt, Yersinia pestis
cagcaauaaaccacugg

SEQ ID NO: 2279856 - RNA, 21 nt, Yersinia pestis
cagcaaguuagcgauaucugc

SEQ ID NO: 2279857 - RNA, 17 nt, Yersinia pestis
cagcaacucaagccacu

SEQ ID NO: 2279858 - RNA, 23 nt, Yersinia pestis
cagcaagaaacucccuucaauca

SEQ ID NO: 2279859 - RNA, 13 nt, Yersinia pestis
cagcaacuguuuu

SEQ ID NO: 2279860 - RNA, 14 nt, Yersinia pestis
cagcaaaguauuua

SEQ ID NO: 2279861 - RNA, 19 nt, Yersinia pestis
cagcaaagccaaaaccauu

SEQ ID NO: 2279862 - RNA, 14 nt, Yersinia pestis
cagcaacacaaaag

SEQ ID NO: 2279863 - RNA, 14 nt, Yersinia pestis
cagcaaauugcuga

SEQ ID NO: 2279864 - RNA, 20 nt, Yersinia pestis
cagcaaauugcugaaaaaaa

SEQ ID NO: 2279865 - RNA, 21 nt, Yersinia pestis
cagcaaccuggcggcccgaga

SEQ ID NO: 2279866 - RNA, 15 nt, Yersinia pestis
cagcaacgaauaaaa

SEQ ID NO: 2279867 - RNA, 17 nt, Yersinia pestis
cagcaacgaauaaaaaa

SEQ ID NO: 2279868 - RNA, 19 nt, Yersinia pestis
cagcaacgcgaugcauuaa

SEQ ID NO: 2279869 - RNA, 14 nt, Yersinia pestis
cagcaaguuaucaa

SEQ ID NO: 2279870 - RNA, 17 nt, Yersinia pestis
cagcaauacgccccuga

SEQ ID NO: 2279871 - RNA, 18 nt, Yersinia pestis
cagcacaaacagcuuuuu

SEQ ID NO: 2279872 - RNA, 16 nt, Yersinia pestis
cagcacauuuuuauag

SEQ ID NO: 2279873 - RNA, 17 nt, Yersinia pestis
cagcacagagcacaacg

SEQ ID NO: 2279874 - RNA, 16 nt, Yersinia pestis
cagcacauaaagcgca

SEQ ID NO: 2279875 - RNA, 16 nt, Yersinia pestis
cagcaccaacaauaac

SEQ ID NO: 2279876 - RNA, 11 nt, Yersinia pestis
cagcaccaccg

SEQ ID NO: 2279877 - RNA, 14 nt, Yersinia pestis
cagcaccaccgaug

SEQ ID NO: 2279878 - RNA, 13 nt, Yersinia pestis
cagcaccacuaag

SEQ ID NO: 2279879 - RNA, 18 nt, Yersinia pestis
cagaaauaaauucaucuc

SEQ ID NO: 2279880 - RNA, 19 nt, Yersinia pestis
cagaaauaaauauccuccg

SEQ ID NO: 2279881 - RNA, 14 nt, Yersinia pestis
cagaaauaaauuca

SEQ ID NO: 2279882 - RNA, 20 nt, Yersinia pestis
cagaaaucagccauaucaaa

SEQ ID NO: 2279883 - RNA, 14 nt, Yersinia pestis
cagaaauauugugc

SEQ ID NO: 2279884 - RNA, 23 nt, Yersinia pestis
cagaacaccaacaccacacugag

SEQ ID NO: 2279885 - RNA, 16 nt, Yersinia pestis
cagaacaaaacaagcc

SEQ ID NO: 2279886 - RNA, 21 nt, Yersinia pestis
cagaaaguuguucaacgccau

SEQ ID NO: 2279887 - RNA, 22 nt, Yersinia pestis
cagaaaggacaguaauauuuuc

SEQ ID NO: 2279888 - RNA, 19 nt, Yersinia pestis
cagaaacagcccagauggc

SEQ ID NO: 2279889 - RNA, 16 nt, Yersinia pestis
cagaacugauuucagg

SEQ ID NO: 2279890 - RNA, 21 nt, Yersinia pestis
cagaacuagcgccgcaucaaa

SEQ ID NO: 2279891 - RNA, 22 nt, Yersinia pestis
cagaacccccgcgaacagcaga

SEQ ID NO: 2279892 - RNA, 21 nt, Yersinia pestis
cagaacccccgcgaacagcag

SEQ ID NO: 2279893 - RNA, 14 nt, Yersinia pestis
cagaagcauaugga

SEQ ID NO: 2279894 - RNA, 17 nt, Yersinia pestis
cagaagcauauggaugu

SEQ ID NO: 2279895 - RNA, 20 nt, Yersinia pestis
cagaagggcggccagcaaga

SEQ ID NO: 2279896 - RNA, 21 nt, Yersinia pestis
cagaauaaaagcgguaugacc

SEQ ID NO: 2279897 - RNA, 16 nt, Yersinia pestis
cagaaguugaauuuga

SEQ ID NO: 2279898 - RNA, 14 nt, Yersinia pestis
cagacaaacaaccu

SEQ ID NO: 2279899 - RNA, 19 nt, Yersinia pestis
cagacaacagucacaccaa

SEQ ID NO: 2279900 - RNA, 23 nt, Yersinia pestis
cagaauuuuuuuagauaucagaa

SEQ ID NO: 2279901 - RNA, 18 nt, Yersinia pestis
cagacacaagauaaauac

SEQ ID NO: 2279902 - RNA, 21 nt, Yersinia pestis
cagacaaccaauacacagcac

SEQ ID NO: 2279903 - RNA, 15 nt, Yersinia pestis
cagacaacugacaac

SEQ ID NO: 2279904 - RNA, 18 nt, Yersinia pestis
cagacaagaaugccugcc

SEQ ID NO: 2279905 - RNA, 11 nt, Yersinia pestis
cagaauuucau

SEQ ID NO: 2279906 - RNA, 17 nt, Yersinia pestis
cagaauggcaaagcaca

SEQ ID NO: 2279907 - RNA, 20 nt, Yersinia pestis
cagaauaauaagccgugccu

SEQ ID NO: 2279908 - RNA, 15 nt, Yersinia pestis
cagaauauaaaagca

SEQ ID NO: 2279909 - RNA, 21 nt, Yersinia pestis
cagaaucacuggcagaaguug

SEQ ID NO: 2279910 - RNA, 14 nt, Yersinia pestis
cagaaucaccaaca

SEQ ID NO: 2279911 - RNA, 12 nt, Yersinia pestis
cagaaugaaagg

SEQ ID NO: 2279912 - RNA, 21 nt, Yersinia pestis
cagaaugaaaggcggugaaca

SEQ ID NO: 2279913 - RNA, 18 nt, Yersinia pestis
cagaaucgccguagauuu

SEQ ID NO: 2279914 - RNA, 18 nt, Yersinia pestis
cagaaucgccugcacacg

SEQ ID NO: 2279915 - RNA, 15 nt, Yersinia pestis
cagacacguaaaaca

SEQ ID NO: 2279916 - RNA, 11 nt, Yersinia pestis
cagacagccau

SEQ ID NO: 2279917 - RNA, 20 nt, Yersinia pestis
cagacaguaaauccugauga

SEQ ID NO: 2279918 - RNA, 23 nt, Yersinia pestis
cagacauauuggucauuuuuccc

SEQ ID NO: 2279919 - RNA, 14 nt, Yersinia pestis
cagacauuuuucua

SEQ ID NO: 2279920 - RNA, 20 nt, Yersinia pestis
cagacauuuuucuauuucug

SEQ ID NO: 2279921 - RNA, 15 nt, Yersinia pestis
cagacccugcaccac

SEQ ID NO: 2279922 - RNA, 14 nt, Yersinia pestis
cagacccgugaaca

SEQ ID NO: 2279923 - RNA, 12 nt, Yersinia pestis
caauuaaaaacg

SEQ ID NO: 2279924 - RNA, 16 nt, Yersinia pestis
caauguuggcccaaga

SEQ ID NO: 2279925 - RNA, 18 nt, Yersinia pestis
caauguugcugaauaaau

SEQ ID NO: 2279926 - RNA, 19 nt, Yersinia pestis
caauguugcugaauaaaua

SEQ ID NO: 2279927 - RNA, 16 nt, Yersinia pestis
caauguugagaaauau

SEQ ID NO: 2279928 - RNA, 16 nt, Yersinia pestis
caauguuauauuucuu

SEQ ID NO: 2279929 - RNA, 18 nt, Yersinia pestis
caaugugccgcgcaacca

SEQ ID NO: 2279930 - RNA, 21 nt, Yersinia pestis
caaugugcggaaauaaacauc

SEQ ID NO: 2279931 - RNA, 16 nt, Yersinia pestis
caaugucaugcaauua

SEQ ID NO: 2279932 - RNA, 19 nt, Yersinia pestis
caaugucaugcaauuacug

SEQ ID NO: 2279933 - RNA, 13 nt, Yersinia pestis
cacugccaucuca

SEQ ID NO: 2279934 - RNA, 20 nt, Yersinia pestis
cacugccugcucucugcugc

SEQ ID NO: 2279935 - RNA, 12 nt, Yersinia pestis
cacugccugcuc

SEQ ID NO: 2279936 - RNA, 23 nt, Yersinia pestis
cacugcgggagggauuucuucau

SEQ ID NO: 2279937 - RNA, 23 nt, Yersinia pestis
cacugcgggcagguaaauagcca

SEQ ID NO: 2279938 - RNA, 23 nt, Yersinia pestis
cacugcgcgaucccagaauggca

SEQ ID NO: 2279939 - RNA, 14 nt, Yersinia pestis
cacuuaaacauaaa

SEQ ID NO: 2279940 - RNA, 18 nt, Yersinia pestis
cacuuaaacccuuucucg

SEQ ID NO: 2279941 - RNA, 20 nt, Yersinia pestis
cacuguugcgggcaucagcc

SEQ ID NO: 2279942 - RNA, 12 nt, Yersinia pestis
cacuuaauaaug

SEQ ID NO: 2279943 - RNA, 14 nt, Yersinia pestis
cacugucuauuuuu

SEQ ID NO: 2279944 - RNA, 22 nt, Yersinia pestis
cacugucgggguagaucagcgu

SEQ ID NO: 2279945 - RNA, 20 nt, Yersinia pestis
cacugugagcggcauccagu

SEQ ID NO: 2279946 - RNA, 15 nt, Yersinia pestis
cacugucaucacugc

SEQ ID NO: 2279947 - RNA, 13 nt, Yersinia pestis
cacugcuuuuuac

SEQ ID NO: 2279948 - RNA, 15 nt, Yersinia pestis
cacuggaaaaagugu

SEQ ID NO: 2279949 - RNA, 13 nt, Yersinia pestis
cacuggaaacaaa

SEQ ID NO: 2279950 - RNA, 23 nt, Yersinia pestis
cacugcucuaucucccgcuacac

SEQ ID NO: 2279951 - RNA, 17 nt, Yersinia pestis
cacuggcaccgcuucug

SEQ ID NO: 2279952 - RNA, 15 nt, Yersinia pestis
cacuggcaccgcuuc

SEQ ID NO: 2279953 - RNA, 18 nt, Yersinia pestis
cacugggucaucacccag

SEQ ID NO: 2279954 - RNA, 13 nt, Yersinia pestis
cacuggucaguau

SEQ ID NO: 2279955 - RNA, 12 nt, Yersinia pestis
cacugguagcau

SEQ ID NO: 2279956 - RNA, 16 nt, Yersinia pestis
cacugggaucugauca

SEQ ID NO: 2279957 - RNA, 16 nt, Yersinia pestis
cacuggccgcaggcgc

SEQ ID NO: 2279958 - RNA, 16 nt, Yersinia pestis
cacuggccuauuaaga

SEQ ID NO: 2279959 - RNA, 18 nt, Yersinia pestis
cacuggccuguugcaauu

SEQ ID NO: 2279960 - RNA, 14 nt, Yersinia pestis
cacuuccagcgccc

SEQ ID NO: 2279961 - RNA, 18 nt, Yersinia pestis
cacuucacuugcaugccu

SEQ ID NO: 2279962 - RNA, 23 nt, Yersinia pestis
cacuuauuggaaguacuuauuug

SEQ ID NO: 2279963 - RNA, 12 nt, Yersinia pestis
cacuuauuugaa

SEQ ID NO: 2279964 - RNA, 15 nt, Yersinia pestis
cacuucaagcagcau

SEQ ID NO: 2279965 - RNA, 15 nt, Yersinia pestis
cacuuaguggcauug

SEQ ID NO: 2279966 - RNA, 15 nt, Yersinia pestis
cacuuagugcuggcc

SEQ ID NO: 2279967 - RNA, 15 nt, Yersinia pestis
cacuuauuauaaagc

SEQ ID NO: 2279968 - RNA, 18 nt, Yersinia pestis
cacuucuggccgcucuuu

SEQ ID NO: 2279969 - RNA, 20 nt, Yersinia pestis
cacuucguagggcacuuuca

SEQ ID NO: 2279970 - RNA, 11 nt, Yersinia pestis
cacuugaccuu

SEQ ID NO: 2279971 - RNA, 14 nt, Yersinia pestis
cacuugagagaaac

SEQ ID NO: 2279972 - RNA, 14 nt, Yersinia pestis
cacuucuuucacua

SEQ ID NO: 2279973 - RNA, 19 nt, Yersinia pestis
cacuucgccuuaucagcga

SEQ ID NO: 2279974 - RNA, 16 nt, Yersinia pestis
cacuucgguggcccuu

SEQ ID NO: 2279975 - RNA, 16 nt, Yersinia pestis
cacuuccgccgccaac

SEQ ID NO: 2279976 - RNA, 15 nt, Yersinia pestis
cacuuccucauucau

SEQ ID NO: 2279977 - RNA, 16 nt, Yersinia pestis
cagaaaacccccugcu

SEQ ID NO: 2279978 - RNA, 14 nt, Yersinia pestis
cagaaaagcgaagg

SEQ ID NO: 2279979 - RNA, 21 nt, Yersinia pestis
cagaaaagagguguucuugaa

SEQ ID NO: 2279980 - RNA, 16 nt, Yersinia pestis
cagaaaagcaaaggcc

SEQ ID NO: 2279981 - RNA, 20 nt, Yersinia pestis
cacuuuugcuggugucacaa

SEQ ID NO: 2279982 - RNA, 18 nt, Yersinia pestis
cacuuuugucgcucaagc

SEQ ID NO: 2279983 - RNA, 18 nt, Yersinia pestis
cacuuucaacuauugcau

SEQ ID NO: 2279984 - RNA, 19 nt, Yersinia pestis
cacuuuaaauacccagcuu

SEQ ID NO: 2279985 - RNA, 20 nt, Yersinia pestis
cacuuucaucgccgucagcu

SEQ ID NO: 2279986 - RNA, 11 nt, Yersinia pestis
cacuugcuacc

SEQ ID NO: 2279987 - RNA, 19 nt, Yersinia pestis
cacuuguaccugugccagu

SEQ ID NO: 2279988 - RNA, 20 nt, Yersinia pestis
cacuuguagguuaaauucac

SEQ ID NO: 2279989 - RNA, 16 nt, Yersinia pestis
cacuugcucuaccacg

SEQ ID NO: 2279990 - RNA, 20 nt, Yersinia pestis
cacuugcuggcggcuuuuau

SEQ ID NO: 2279991 - RNA, 21 nt, Yersinia pestis
caggauugcgccggaauaaag

SEQ ID NO: 2279992 - RNA, 15 nt, Yersinia pestis
caggcacugcagaaa

SEQ ID NO: 2279993 - RNA, 16 nt, Yersinia pestis
caggcagagcaagggu

SEQ ID NO: 2279994 - RNA, 13 nt, Yersinia pestis
caggcagaaauaa

SEQ ID NO: 2279995 - RNA, 19 nt, Yersinia pestis
caggcacuuugucaauaac

SEQ ID NO: 2279996 - RNA, 13 nt, Yersinia pestis
caggaucuuauuu

SEQ ID NO: 2279997 - RNA, 12 nt, Yersinia pestis
caggaucuggau

SEQ ID NO: 2279998 - RNA, 21 nt, Yersinia pestis
caggaucgaucuggauauauu

SEQ ID NO: 2279999 - RNA, 17 nt, Yersinia pestis
caggaguugguggcaca

SEQ ID NO: 2280000 - RNA, 22 nt, Yersinia pestis
caggagauagccucaccgccag

SEQ ID NO: 2280001 - RNA, 13 nt, Yersinia pestis
caggaagcggcca

SEQ ID NO: 2280002 - RNA, 16 nt, Yersinia pestis
caggaagcggccaggu

SEQ ID NO: 2280003 - RNA, 19 nt, Yersinia pestis
caggaagcggccagguuca

SEQ ID NO: 2280004 - RNA, 21 nt, Yersinia pestis
caggaagcggccagguucaau

SEQ ID NO: 2280005 - RNA, 22 nt, Yersinia pestis
caggaagguaccugaucagcau

SEQ ID NO: 2280006 - RNA, 23 nt, Yersinia pestis
caggaagcccgucagacugcuga

SEQ ID NO: 2280007 - RNA, 20 nt, Yersinia pestis
cagcuugcaacucggccgcu

SEQ ID NO: 2280008 - RNA, 14 nt, Yersinia pestis
caggaacguucaau

SEQ ID NO: 2280009 - RNA, 16 nt, Yersinia pestis
cagcugcuuuaucgua

SEQ ID NO: 2280010 - RNA, 20 nt, Yersinia pestis
cagcuuccagcaccccuuca

SEQ ID NO: 2280011 - RNA, 17 nt, Yersinia pestis
cagcuucuuuuaaagaa

SEQ ID NO: 2280012 - RNA, 15 nt, Yersinia pestis
cagcuucuuuuaaag

SEQ ID NO: 2280013 - RNA, 16 nt, Yersinia pestis
cagcucaucaccaaaa

SEQ ID NO: 2280014 - RNA, 15 nt, Yersinia pestis
cagcuagccugcccc

SEQ ID NO: 2280015 - RNA, 22 nt, Yersinia pestis
cagcuauguacgcaaguaucuu

SEQ ID NO: 2280016 - RNA, 18 nt, Yersinia pestis
cagcucaaagaccacauc

SEQ ID NO: 2280017 - RNA, 17 nt, Yersinia pestis
cagggcuaagcaggaag

SEQ ID NO: 2280018 - RNA, 19 nt, Yersinia pestis
cagggcguauaaacagagc

SEQ ID NO: 2280019 - RNA, 19 nt, Yersinia pestis
caggggaguauugcugagu

SEQ ID NO: 2280020 - RNA, 20 nt, Yersinia pestis
caggggcaauuugccgccuu

SEQ ID NO: 2280021 - RNA, 14 nt, Yersinia pestis
cagggugaaagccc

SEQ ID NO: 2280022 - RNA, 24 nt, Yersinia pestis
cagggugaaagcccaacugacuga

SEQ ID NO: 2280023 - RNA, 15 nt, Yersinia pestis
caggguaauaaccga

SEQ ID NO: 2280024 - RNA, 18 nt, Yersinia pestis
caggguauuccacccgca

SEQ ID NO: 2280025 - RNA, 19 nt, Yersinia pestis
cagggaacgaaucaggcag

SEQ ID NO: 2280026 - RNA, 14 nt, Yersinia pestis
caggcucaucaccu

SEQ ID NO: 2280027 - RNA, 17 nt, Yersinia pestis
caggcucaucaccuucc

SEQ ID NO: 2280028 - RNA, 18 nt, Yersinia pestis
caggcucauucaguggcg

SEQ ID NO: 2280029 - RNA, 18 nt, Yersinia pestis
cagggaauucaccggcaa

SEQ ID NO: 2280030 - RNA, 16 nt, Yersinia pestis
cagggcagcaucguca

SEQ ID NO: 2280031 - RNA, 12 nt, Yersinia pestis
cagggagccgcc

SEQ ID NO: 2280032 - RNA, 15 nt, Yersinia pestis
cagggagccgcccug

SEQ ID NO: 2280033 - RNA, 17 nt, Yersinia pestis
caggcguucuguagcug

SEQ ID NO: 2280034 - RNA, 17 nt, Yersinia pestis
caggcuaauacaugcug

SEQ ID NO: 2280035 - RNA, 15 nt, Yersinia pestis
caggcggguaacugu

SEQ ID NO: 2280036 - RNA, 11 nt, Yersinia pestis
caggccgccuu

SEQ ID NO: 2280037 - RNA, 20 nt, Yersinia pestis
caggcaggagcacaauagga

SEQ ID NO: 2280038 - RNA, 22 nt, Yersinia pestis
cagucugaggggcguuuaaugc

SEQ ID NO: 2280039 - RNA, 13 nt, Yersinia pestis
cagucuuccauga

SEQ ID NO: 2280040 - RNA, 22 nt, Yersinia pestis
cagucugguugugagguuagaa

SEQ ID NO: 2280041 - RNA, 22 nt, Yersinia pestis
cagucugaaacgccagccucug

SEQ ID NO: 2280042 - RNA, 24 nt, Yersinia pestis
cagucugaauugaugucaauuaaa

SEQ ID NO: 2280043 - RNA, 23 nt, Yersinia pestis
cagucugagccucaugaaugagg

SEQ ID NO: 2280044 - RNA, 14 nt, Yersinia pestis
cagucgcuucaucc

SEQ ID NO: 2280045 - RNA, 19 nt, Yersinia pestis
cagucgcuucauccgcgcu

SEQ ID NO: 2280046 - RNA, 18 nt, Yersinia pestis
cagucgcgaugcgcugcu

SEQ ID NO: 2280047 - RNA, 13 nt, Yersinia pestis
cagucaguaggcu

SEQ ID NO: 2280048 - RNA, 16 nt, Yersinia pestis
cagucacuaaaccauu

SEQ ID NO: 2280049 - RNA, 17 nt, Yersinia pestis
cagucacuaauaccuga

SEQ ID NO: 2280050 - RNA, 17 nt, Yersinia pestis
cagucgcacugauagca

SEQ ID NO: 2280051 - RNA, 15 nt, Yersinia pestis
cagucgacaguguaa

SEQ ID NO: 2280052 - RNA, 20 nt, Yersinia pestis
cagucgacaguguaaaaagc

SEQ ID NO: 2280053 - RNA, 18 nt, Yersinia pestis
cagugccaauccccacca

SEQ ID NO: 2280054 - RNA, 13 nt, Yersinia pestis
cagugcucgcaaa

SEQ ID NO: 2280055 - RNA, 19 nt, Yersinia pestis
cagugccaauugaguaacu

SEQ ID NO: 2280056 - RNA, 17 nt, Yersinia pestis
cagugcauccccacuga

SEQ ID NO: 2280057 - RNA, 21 nt, Yersinia pestis
cagugcauccccacugacauc

SEQ ID NO: 2280058 - RNA, 17 nt, Yersinia pestis
caguguaucaauaggau

SEQ ID NO: 2280059 - RNA, 20 nt, Yersinia pestis
cagugucaucccguaggcuu

SEQ ID NO: 2280060 - RNA, 21 nt, Yersinia pestis
cagugucagguaaaaagguaa

SEQ ID NO: 2280061 - RNA, 18 nt, Yersinia pestis
cagugucacuuccgccgc

SEQ ID NO: 2280062 - RNA, 14 nt, Yersinia pestis
cagugucaguucga

SEQ ID NO: 2280063 - RNA, 13 nt, Yersinia pestis
caguggcaucaau

SEQ ID NO: 2280064 - RNA, 15 nt, Yersinia pestis
caguguaaaaagcga

SEQ ID NO: 2280065 - RNA, 15 nt, Yersinia pestis
cagugaaaucaucac

SEQ ID NO: 2280066 - RNA, 14 nt, Yersinia pestis
cagugaagagauaa

SEQ ID NO: 2280067 - RNA, 20 nt, Yersinia pestis
cagugaagagauaaccguua

SEQ ID NO: 2280068 - RNA, 14 nt, Yersinia pestis
cagugacgcaguga

SEQ ID NO: 2280069 - RNA, 19 nt, Yersinia pestis
cagugacgcagugacgcag

SEQ ID NO: 2280070 - RNA, 15 nt, Yersinia pestis
cagugauauuauuua

SEQ ID NO: 2280071 - RNA, 21 nt, Yersinia pestis
cagugauaaggccuuuuucug

SEQ ID NO: 2280072 - RNA, 18 nt, Yersinia pestis
cagugauaaucacguuca

SEQ ID NO: 2280073 - RNA, 22 nt, Yersinia pestis
cagugauaaucacguucaacuu

SEQ ID NO: 2280074 - RNA, 13 nt, Yersinia pestis
cagugagcaaauu

SEQ ID NO: 2280075 - RNA, 16 nt, Yersinia pestis
cagugaguccuuuacu

SEQ ID NO: 2280076 - RNA, 13 nt, Yersinia pestis
cagugagguuauu

SEQ ID NO: 2280077 - RNA, 22 nt, Yersinia pestis
caguauagaaagugacacauug

SEQ ID NO: 2280078 - RNA, 13 nt, Yersinia pestis
caguaucaaccac

SEQ ID NO: 2280079 - RNA, 17 nt, Yersinia pestis
caguaucaccagaugcc

SEQ ID NO: 2280080 - RNA, 15 nt, Yersinia pestis
caguaucaaccaccg

SEQ ID NO: 2280081 - RNA, 14 nt, Yersinia pestis
cagucaauauaccu

SEQ ID NO: 2280082 - RNA, 23 nt, Yersinia pestis
cagucaauauaccuuuguaucca

SEQ ID NO: 2280083 - RNA, 14 nt, Yersinia pestis
cagucaauaaacau

SEQ ID NO: 2280084 - RNA, 22 nt, Yersinia pestis
caguagucaauacaauuauuuu

SEQ ID NO: 2280085 - RNA, 20 nt, Yersinia pestis
caguagcauucgauguaacg

SEQ ID NO: 2280086 - RNA, 20 nt, Yersinia pestis
caguagcagggccgcccaga

SEQ ID NO: 2280087 - RNA, 15 nt, Yersinia pestis
caguagcaggcgcac

SEQ ID NO: 2280088 - RNA, 13 nt, Yersinia pestis
caguaagaucuuc

SEQ ID NO: 2280089 - RNA, 16 nt, Yersinia pestis
caguaacugaucaaua

SEQ ID NO: 2280090 - RNA, 19 nt, Yersinia pestis
caguaaacugcgcuuccag

SEQ ID NO: 2280091 - RNA, 16 nt, Yersinia pestis
caguaacuacuauaua

SEQ ID NO: 2280092 - RNA, 17 nt, Yersinia pestis
caguacaucacgcagug

SEQ ID NO: 2280093 - RNA, 19 nt, Yersinia pestis
caguaccgacaccaauacc

SEQ ID NO: 2280094 - RNA, 23 nt, Yersinia pestis
cagguuggcguuucguaaugacc

SEQ ID NO: 2280095 - RNA, 13 nt, Yersinia pestis
caguaaaaaaaua

SEQ ID NO: 2280096 - RNA, 16 nt, Yersinia pestis
caguaaaaucaucagc

SEQ ID NO: 2280097 - RNA, 17 nt, Yersinia pestis
caguaaacgccaaucac

SEQ ID NO: 2280098 - RNA, 16 nt, Yersinia pestis
cagguggguacugaua

SEQ ID NO: 2280099 - RNA, 18 nt, Yersinia pestis
cagguggguacugauaaa

SEQ ID NO: 2280100 - RNA, 18 nt, Yersinia pestis
caggugcgauuaaccuua

SEQ ID NO: 2280101 - RNA, 21 nt, Yersinia pestis
caggugcuuauuuauuuuuaa

SEQ ID NO: 2280102 - RNA, 15 nt, Yersinia pestis
caggugcuugacuaa

SEQ ID NO: 2280103 - RNA, 14 nt, Yersinia pestis
cagguaaaacauuu

SEQ ID NO: 2280104 - RNA, 16 nt, Yersinia pestis
caggguuuugaaauca

SEQ ID NO: 2280105 - RNA, 14 nt, Yersinia pestis
cauaacauccuaaa

SEQ ID NO: 2280106 - RNA, 15 nt, Yersinia pestis
cauaacauccuaaaa

SEQ ID NO: 2280107 - RNA, 17 nt, Yersinia pestis
cauaacauccuaaaaag

SEQ ID NO: 2280108 - RNA, 16 nt, Yersinia pestis
cauaacaccaauugca

SEQ ID NO: 2280109 - RNA, 14 nt, Yersinia pestis
cauaacaauggccg

SEQ ID NO: 2280110 - RNA, 14 nt, Yersinia pestis
cauaacaauuaauu

SEQ ID NO: 2280111 - RNA, 17 nt, Yersinia pestis
cauaaccgcuaaggcca

SEQ ID NO: 2280112 - RNA, 18 nt, Yersinia pestis
cauaaccgcuaaggccaa

SEQ ID NO: 2280113 - RNA, 18 nt, Yersinia pestis
cauaaauucuagcaacau

SEQ ID NO: 2280114 - RNA, 12 nt, Yersinia pestis
cauaaauuuauc

SEQ ID NO: 2280115 - RNA, 23 nt, Yersinia pestis
cauaaaucaguacuauucacgag

SEQ ID NO: 2280116 - RNA, 17 nt, Yersinia pestis
cauaaauauugguacau

SEQ ID NO: 2280117 - RNA, 19 nt, Yersinia pestis
cauaaaaauacauaucaac

SEQ ID NO: 2280118 - RNA, 16 nt, Yersinia pestis
cauaaaaagaaaaaaa

SEQ ID NO: 2280119 - RNA, 17 nt, Yersinia pestis
cauaaaaagaaaaaaac

SEQ ID NO: 2280120 - RNA, 15 nt, Yersinia pestis
cauaaaaauacauau

SEQ ID NO: 2280121 - RNA, 13 nt, Yersinia pestis
cauaaaaauacau

SEQ ID NO: 2280122 - RNA, 22 nt, Yersinia pestis
cauaaaaacuaaggggccaaua

SEQ ID NO: 2280123 - RNA, 15 nt, Yersinia pestis
cauaaacugaaguua

SEQ ID NO: 2280124 - RNA, 19 nt, Yersinia pestis
cauaaagauagccacuaac

SEQ ID NO: 2280125 - RNA, 18 nt, Yersinia pestis
cauaaacacgcaaucaga

SEQ ID NO: 2280126 - RNA, 21 nt, Yersinia pestis
cauaaaccaacgguucauauu

SEQ ID NO: 2280127 - RNA, 15 nt, Yersinia pestis
caguguuuucuccac

SEQ ID NO: 2280128 - RNA, 18 nt, Yersinia pestis
caguuaaaaauagacagc

SEQ ID NO: 2280129 - RNA, 19 nt, Yersinia pestis
caguuaaaaauagacagca

SEQ ID NO: 2280130 - RNA, 13 nt, Yersinia pestis
caguguugccaug

SEQ ID NO: 2280131 - RNA, 20 nt, Yersinia pestis
caguguuaccaagagagaau

SEQ ID NO: 2280132 - RNA, 20 nt, Yersinia pestis
cagugugugugcgcugagug

SEQ ID NO: 2280133 - RNA, 18 nt, Yersinia pestis
caguugaugaaucaauga

SEQ ID NO: 2280134 - RNA, 22 nt, Yersinia pestis
caguugccaaacaaacgcuuga

SEQ ID NO: 2280135 - RNA, 15 nt, Yersinia pestis
caguugcacaccauc

SEQ ID NO: 2280136 - RNA, 14 nt, Yersinia pestis
caguugaugcaaaa

SEQ ID NO: 2280137 - RNA, 24 nt, Yersinia pestis
caguuggcgcacguucccaggcca

SEQ ID NO: 2280138 - RNA, 20 nt, Yersinia pestis
caguuggguaucuuugcuuc

SEQ ID NO: 2280139 - RNA, 16 nt, Yersinia pestis
cauaacgcuuuuucau

SEQ ID NO: 2280140 - RNA, 20 nt, Yersinia pestis
cauaaccgguaccggcuggg

SEQ ID NO: 2280141 - RNA, 15 nt, Yersinia pestis
cauaaucuuuacugc

SEQ ID NO: 2280142 - RNA, 16 nt, Yersinia pestis
cauaaucuuuacugca

SEQ ID NO: 2280143 - RNA, 13 nt, Yersinia pestis
cauacacggucug

SEQ ID NO: 2280144 - RNA, 17 nt, Yersinia pestis
cauaaucgcguucagag

SEQ ID NO: 2280145 - RNA, 21 nt, Yersinia pestis
cauacccgcugcuggaaugca

SEQ ID NO: 2280146 - RNA, 17 nt, Yersinia pestis
cauacccgcuguacugc

SEQ ID NO: 2280147 - RNA, 15 nt, Yersinia pestis
cauacauaucaucau

SEQ ID NO: 2280148 - RNA, 24 nt, Yersinia pestis
cauacaucgcuggacgcaucagau

SEQ ID NO: 2280149 - RNA, 11 nt, Yersinia pestis
cauacauuggc

SEQ ID NO: 2280150 - RNA, 17 nt, Yersinia pestis
cauacauuggcuccccu

SEQ ID NO: 2280151 - RNA, 19 nt, Yersinia pestis
cauacauuggcuccccuuu

SEQ ID NO: 2280152 - RNA, 22 nt, Yersinia pestis
cauacucccccauuuccugugu

SEQ ID NO: 2280153 - RNA, 21 nt, Yersinia pestis
cauacuccuuaaucguccggu

SEQ ID NO: 2280154 - RNA, 23 nt, Yersinia pestis
cauacucagucaucgcuaacccu

SEQ ID NO: 2280155 - RNA, 23 nt, Yersinia pestis
cauacuccauuuuuuugaugcau

SEQ ID NO: 2280156 - RNA, 13 nt, Yersinia pestis
cauacgguccuga

SEQ ID NO: 2280157 - RNA, 20 nt, Yersinia pestis
cauacuucgaugauuauuuu

SEQ ID NO: 2280158 - RNA, 13 nt, Yersinia pestis
cauacugcagaau

SEQ ID NO: 2280159 - RNA, 12 nt, Yersinia pestis
cauaccuuaauu

SEQ ID NO: 2280160 - RNA, 20 nt, Yersinia pestis
cauacgcuuaaccagcacuu

SEQ ID NO: 2280161 - RNA, 15 nt, Yersinia pestis
cauggacggcauaua

SEQ ID NO: 2280162 - RNA, 17 nt, Yersinia pestis
cauggagagcagggccc

SEQ ID NO: 2280163 - RNA, 20 nt, Yersinia pestis
caugcuugucguauuuccag

SEQ ID NO: 2280164 - RNA, 14 nt, Yersinia pestis
caugcuaauaccac

SEQ ID NO: 2280165 - RNA, 19 nt, Yersinia pestis
caugcuaacuuguucagaa

SEQ ID NO: 2280166 - RNA, 24 nt, Yersinia pestis
caugcggcgugggcaaucuccagu

SEQ ID NO: 2280167 - RNA, 20 nt, Yersinia pestis
caugcggauugaacugcgcu

SEQ ID NO: 2280168 - RNA, 22 nt, Yersinia pestis
cauggcaaccccuaauccagca

SEQ ID NO: 2280169 - RNA, 20 nt, Yersinia pestis
cauggauggucauaaaaucg

SEQ ID NO: 2280170 - RNA, 15 nt, Yersinia pestis
cauggauguauuuac

SEQ ID NO: 2280171 - RNA, 18 nt, Yersinia pestis
cauggauguauuuacggc

SEQ ID NO: 2280172 - RNA, 14 nt, Yersinia pestis
cauggcugggaagg

SEQ ID NO: 2280173 - RNA, 13 nt, Yersinia pestis
caugggaaaucaa

SEQ ID NO: 2280174 - RNA, 15 nt, Yersinia pestis
cauggcuuuuugccc

SEQ ID NO: 2280175 - RNA, 20 nt, Yersinia pestis
cauggcuuuuugcccgcgcu

SEQ ID NO: 2280176 - RNA, 15 nt, Yersinia pestis
caugguaagaauaaa

SEQ ID NO: 2280177 - RNA, 22 nt, Yersinia pestis
caugggguuuauugguuauuuu

SEQ ID NO: 2280178 - RNA, 22 nt, Yersinia pestis
caugggcaagcucugggcugau

SEQ ID NO: 2280179 - RNA, 20 nt, Yersinia pestis
caugauuuguugaugaauga

SEQ ID NO: 2280180 - RNA, 11 nt, Yersinia pestis
caugcaacaga

SEQ ID NO: 2280181 - RNA, 19 nt, Yersinia pestis
caucuuuuucugccugagu

SEQ ID NO: 2280182 - RNA, 17 nt, Yersinia pestis
caucuuuucauggguuu

SEQ ID NO: 2280183 - RNA, 12 nt, Yersinia pestis
caucuuuugcua

SEQ ID NO: 2280184 - RNA, 15 nt, Yersinia pestis
caugcgaauacuuug

SEQ ID NO: 2280185 - RNA, 14 nt, Yersinia pestis
caugcgauacgccc

SEQ ID NO: 2280186 - RNA, 17 nt, Yersinia pestis
caugccuugaaacucaa

SEQ ID NO: 2280187 - RNA, 17 nt, Yersinia pestis
caugcccauacacaguc

SEQ ID NO: 2280188 - RNA, 23 nt, Yersinia pestis
caugccucguuggaucaucggga

SEQ ID NO: 2280189 - RNA, 16 nt, Yersinia pestis
cauguugaguuuacgc

SEQ ID NO: 2280190 - RNA, 23 nt, Yersinia pestis
cauguugaaaucuauuguauaua

SEQ ID NO: 2280191 - RNA, 13 nt, Yersinia pestis
cauguugcaacau

SEQ ID NO: 2280192 - RNA, 20 nt, Yersinia pestis
cauguuguugguggaacggu

SEQ ID NO: 2280193 - RNA, 16 nt, Yersinia pestis
cauguugcgcaggguu

SEQ ID NO: 2280194 - RNA, 21 nt, Yersinia pestis
cauuaaagauuucaucauuca

SEQ ID NO: 2280195 - RNA, 15 nt, Yersinia pestis
cauuaaacuguucuu

SEQ ID NO: 2280196 - RNA, 12 nt, Yersinia pestis
cauuaaaaacaa

SEQ ID NO: 2280197 - RNA, 14 nt, Yersinia pestis
cauuaaaagcaugc

SEQ ID NO: 2280198 - RNA, 19 nt, Yersinia pestis
cauggucaucgcuucacac

SEQ ID NO: 2280199 - RNA, 20 nt, Yersinia pestis
caugucucgguuaaagacau

SEQ ID NO: 2280200 - RNA, 15 nt, Yersinia pestis
caugugcauugacua

SEQ ID NO: 2280201 - RNA, 12 nt, Yersinia pestis
caugugcaauua

SEQ ID NO: 2280202 - RNA, 21 nt, Yersinia pestis
cauguucucuccuaaaaucua

SEQ ID NO: 2280203 - RNA, 22 nt, Yersinia pestis
cauuaagauaauagcuaaacau

SEQ ID NO: 2280204 - RNA, 12 nt, Yersinia pestis
cauuaagaugca

SEQ ID NO: 2280205 - RNA, 16 nt, Yersinia pestis
cauuaacucauuacag

SEQ ID NO: 2280206 - RNA, 13 nt, Yersinia pestis
cauuaacaaacug

SEQ ID NO: 2280207 - RNA, 14 nt, Yersinia pestis
cauuaacaauauua

SEQ ID NO: 2280208 - RNA, 17 nt, Yersinia pestis
cauuaaaugcuuuuugc

SEQ ID NO: 2280209 - RNA, 20 nt, Yersinia pestis
cauuaauccucucuugaaau

SEQ ID NO: 2280210 - RNA, 17 nt, Yersinia pestis
cauuaauagaaucugcu

SEQ ID NO: 2280211 - RNA, 17 nt, Yersinia pestis
cauuacuuugaauagca

SEQ ID NO: 2280212 - RNA, 21 nt, Yersinia pestis
cauuacuguccuuuaacucaa

SEQ ID NO: 2280213 - RNA, 18 nt, Yersinia pestis
cauuacccgaaucacuga

SEQ ID NO: 2280214 - RNA, 20 nt, Yersinia pestis
cauuacccgaaucacugacu

SEQ ID NO: 2280215 - RNA, 20 nt, Yersinia pestis
cauuacaagugccaaaugga

SEQ ID NO: 2280216 - RNA, 23 nt, Yersinia pestis
cauuacaggccccaauccaccac

SEQ ID NO: 2280217 - RNA, 18 nt, Yersinia pestis
cauuaccaaggaaaccac

SEQ ID NO: 2280218 - RNA, 13 nt, Yersinia pestis
cauuacaucaucu

SEQ ID NO: 2280219 - RNA, 17 nt, Yersinia pestis
cauuuuuuaccauuacc

SEQ ID NO: 2280220 - RNA, 19 nt, Yersinia pestis
cauuuuucucggggcaagg

SEQ ID NO: 2280221 - RNA, 21 nt, Yersinia pestis
cauuuuuauuuuaucuacuuc

SEQ ID NO: 2280222 - RNA, 13 nt, Yersinia pestis
cauuuugcugcca

SEQ ID NO: 2280223 - RNA, 12 nt, Yersinia pestis
cauuuugaccag

SEQ ID NO: 2280224 - RNA, 23 nt, Yersinia pestis
cauuuuggguuugagcagugcgc

SEQ ID NO: 2280225 - RNA, 19 nt, Yersinia pestis
cauuuugggcuugagcagu

SEQ ID NO: 2280226 - RNA, 23 nt, Yersinia pestis
cauuuugggcuugagcagugcgc

SEQ ID NO: 2280227 - RNA, 12 nt, Yersinia pestis
cauuuucaucac

SEQ ID NO: 2280228 - RNA, 17 nt, Yersinia pestis
cauuuuccaguuucauc

SEQ ID NO: 2280229 - RNA, 20 nt, Yersinia pestis
cauuuucccgaggagagaaa

SEQ ID NO: 2280230 - RNA, 14 nt, Yersinia pestis
cauuuucaauacca

SEQ ID NO: 2280231 - RNA, 21 nt, Yersinia pestis
cauuuuccugcauauuauuuu

SEQ ID NO: 2280232 - RNA, 19 nt, Yersinia pestis
cauuuuaaucucuccauga

SEQ ID NO: 2280233 - RNA, 12 nt, Yersinia pestis
cauuuuacgccu

SEQ ID NO: 2280234 - RNA, 20 nt, Yersinia pestis
cauuuuaacaacccauuucc

SEQ ID NO: 2280235 - RNA, 18 nt, Yersinia pestis
cauuuuaaucucuccaug

SEQ ID NO: 2280236 - RNA, 18 nt, Yersinia pestis
cauuuuauuagacauaga

SEQ ID NO: 2280237 - RNA, 21 nt, Yersinia pestis
cauuuuauuagacauagagau

SEQ ID NO: 2280238 - RNA, 14 nt, Yersinia pestis
cauuuuauccucuu

SEQ ID NO: 2280239 - RNA, 15 nt, Yersinia pestis
cauuuuauccucuuc

SEQ ID NO: 2280240 - RNA, 16 nt, Yersinia pestis
cauuuuauccucuucc

SEQ ID NO: 2280241 - RNA, 17 nt, Yersinia pestis
cauuuuauccucuucca

SEQ ID NO: 2280242 - RNA, 19 nt, Yersinia pestis
cauuuuaucgugaauaaaa

SEQ ID NO: 2280243 - RNA, 19 nt, Yersinia pestis
cauuugggugagggcaauu

SEQ ID NO: 2280244 - RNA, 14 nt, Yersinia pestis
cauuuuaaaaaaau

SEQ ID NO: 2280245 - RNA, 13 nt, Yersinia pestis
cauuuguuucuga

SEQ ID NO: 2280246 - RNA, 17 nt, Yersinia pestis
cauuuguuaaucgcuga

SEQ ID NO: 2280247 - RNA, 13 nt, Yersinia pestis
cauuugcaucuau

SEQ ID NO: 2280248 - RNA, 13 nt, Yersinia pestis
cauuuaauuaaau

SEQ ID NO: 2280249 - RNA, 15 nt, Yersinia pestis
cauuucuuagaccac

SEQ ID NO: 2280250 - RNA, 23 nt, Yersinia pestis
cauuucuuuuucaacucagcggc

SEQ ID NO: 2280251 - RNA, 14 nt, Yersinia pestis
cauuugaaaugcau

SEQ ID NO: 2280252 - RNA, 21 nt, Yersinia pestis
cauuucuugcucgaucagcgu

SEQ ID NO: 2280253 - RNA, 23 nt, Yersinia pestis
cauuugaccuccguaggccaacc

SEQ ID NO: 2280254 - RNA, 21 nt, Yersinia pestis
cauuugagcagguguaaauuu

SEQ ID NO: 2280255 - RNA, 23 nt, Yersinia pestis
cauugauuggcuccuauagcuca

SEQ ID NO: 2280256 - RNA, 22 nt, Yersinia pestis
cauugauaaucuccauugauuc

SEQ ID NO: 2280257 - RNA, 14 nt, Yersinia pestis
cauugauccucguu

SEQ ID NO: 2280258 - RNA, 18 nt, Yersinia pestis
cauugauccucguuaguc

SEQ ID NO: 2280259 - RNA, 14 nt, Yersinia pestis
cauugcagacugcu

SEQ ID NO: 2280260 - RNA, 20 nt, Yersinia pestis
cauugcuguuguuauuacug

SEQ ID NO: 2280261 - RNA, 20 nt, Yersinia pestis
cauugcugcuguuauuacug

SEQ ID NO: 2280262 - RNA, 16 nt, Yersinia pestis
cauugcugcuguuauu

SEQ ID NO: 2280263 - RNA, 16 nt, Yersinia pestis
cauugcgcuaacagcg

SEQ ID NO: 2280264 - RNA, 13 nt, Yersinia pestis
cauuuaaacacuc

SEQ ID NO: 2280265 - RNA, 13 nt, Yersinia pestis
cauuguucuuacu

SEQ ID NO: 2280266 - RNA, 20 nt, Yersinia pestis
cauuggauaauuugccuggc

SEQ ID NO: 2280267 - RNA, 19 nt, Yersinia pestis
cauuggagauccguuuuuu

SEQ ID NO: 2280268 - RNA, 21 nt, Yersinia pestis
cauugugcuuuuuggcaaacu

SEQ ID NO: 2280269 - RNA, 14 nt, Yersinia pestis
cauugugcuuuuug

SEQ ID NO: 2280270 - RNA, 19 nt, Yersinia pestis
cauuaucgccagcaacuau

SEQ ID NO: 2280271 - RNA, 21 nt, Yersinia pestis
cauuaucuaaacaauugccuu

SEQ ID NO: 2280272 - RNA, 23 nt, Yersinia pestis
cauuaucuuccauagauacacuc

SEQ ID NO: 2280273 - RNA, 18 nt, Yersinia pestis
cauuaucuuuaauuuuuc

SEQ ID NO: 2280274 - RNA, 16 nt, Yersinia pestis
cauucugagcaccaca

SEQ ID NO: 2280275 - RNA, 19 nt, Yersinia pestis
cauucugauagugauuuuu

SEQ ID NO: 2280276 - RNA, 20 nt, Yersinia pestis
cauucuaguuugugcugcua

SEQ ID NO: 2280277 - RNA, 22 nt, Yersinia pestis
cauugaauggugcuguauuuaa

SEQ ID NO: 2280278 - RNA, 13 nt, Yersinia pestis
cauugaccaaagc

SEQ ID NO: 2280279 - RNA, 15 nt, Yersinia pestis
cauucugucaucaag

SEQ ID NO: 2280280 - RNA, 13 nt, Yersinia pestis
cauugagaucaga

SEQ ID NO: 2280281 - RNA, 22 nt, Yersinia pestis
cauugagcgccacaucggcguu

SEQ ID NO: 2280282 - RNA, 20 nt, Yersinia pestis
cauugaggguugucagcagu

SEQ ID NO: 2280283 - RNA, 23 nt, Yersinia pestis
cauugaggguugucagcagucug

SEQ ID NO: 2280284 - RNA, 19 nt, Yersinia pestis
cauugaggguugucagcag

SEQ ID NO: 2280285 - RNA, 23 nt, Yersinia pestis
cauugagucacggauggaucccc

SEQ ID NO: 2280286 - RNA, 15 nt, Yersinia pestis
cauugaggugguaaa

SEQ ID NO: 2280287 - RNA, 23 nt, Yersinia pestis
cauugaguucugaucauuauuau

SEQ ID NO: 2280288 - RNA, 16 nt, Yersinia pestis
caucaagccaccgcug

SEQ ID NO: 2280289 - RNA, 17 nt, Yersinia pestis
caucaaggacuucauca

SEQ ID NO: 2280290 - RNA, 15 nt, Yersinia pestis
caucaaggugccaua

SEQ ID NO: 2280291 - RNA, 12 nt, Yersinia pestis
caucaaccugau

SEQ ID NO: 2280292 - RNA, 13 nt, Yersinia pestis
caucacccagcaa

SEQ ID NO: 2280293 - RNA, 20 nt, Yersinia pestis
caucacccagcaaaauagca

SEQ ID NO: 2280294 - RNA, 17 nt, Yersinia pestis
caucaaguacuucaauu

SEQ ID NO: 2280295 - RNA, 22 nt, Yersinia pestis
caucaauaaauagagugaagua

SEQ ID NO: 2280296 - RNA, 12 nt, Yersinia pestis
caucaauaccaa

SEQ ID NO: 2280297 - RNA, 13 nt, Yersinia pestis
caucaauaacggu

SEQ ID NO: 2280298 - RNA, 12 nt, Yersinia pestis
caucaauaauaa

SEQ ID NO: 2280299 - RNA, 12 nt, Yersinia pestis
caucaaaacaau

SEQ ID NO: 2280300 - RNA, 14 nt, Yersinia pestis
caucaaaauugaug

SEQ ID NO: 2280301 - RNA, 17 nt, Yersinia pestis
caucaaacccccacagc

SEQ ID NO: 2280302 - RNA, 17 nt, Yersinia pestis
caucaaacggcaacuuc

SEQ ID NO: 2280303 - RNA, 19 nt, Yersinia pestis
caucaaacggcaacuucua

SEQ ID NO: 2280304 - RNA, 23 nt, Yersinia pestis
caucaaacggcaacuucuacaua

SEQ ID NO: 2280305 - RNA, 20 nt, Yersinia pestis
caucaacaugggcaagcucu

SEQ ID NO: 2280306 - RNA, 12 nt, Yersinia pestis
cauauucagccg

SEQ ID NO: 2280307 - RNA, 20 nt, Yersinia pestis
cauauucaccacacauacca

SEQ ID NO: 2280308 - RNA, 13 nt, Yersinia pestis
cauauuauuuaca

SEQ ID NO: 2280309 - RNA, 14 nt, Yersinia pestis
cauauucaaccgcc

SEQ ID NO: 2280310 - RNA, 16 nt, Yersinia pestis
cauaugaguuucaaau

SEQ ID NO: 2280311 - RNA, 20 nt, Yersinia pestis
cauaucuuuaccuguuucaa

SEQ ID NO: 2280312 - RNA, 20 nt, Yersinia pestis
cauaucuugaaccaauuuuu

SEQ ID NO: 2280313 - RNA, 15 nt, Yersinia pestis
cauaucuugaaccaa

SEQ ID NO: 2280314 - RNA, 13 nt, Yersinia pestis
cauaugaaaaacc

SEQ ID NO: 2280315 - RNA, 14 nt, Yersinia pestis
cauaugaaaaaccu

SEQ ID NO: 2280316 - RNA, 17 nt, Yersinia pestis
cauaugaacaucaaacc

SEQ ID NO: 2280317 - RNA, 11 nt, Yersinia pestis
cauaugacaaa

SEQ ID NO: 2280318 - RNA, 13 nt, Yersinia pestis
cauaucguccaaa

SEQ ID NO: 2280319 - RNA, 21 nt, Yersinia pestis
cauauuaacauaucaauaagu

SEQ ID NO: 2280320 - RNA, 13 nt, Yersinia pestis
cauauuacccagu

SEQ ID NO: 2280321 - RNA, 19 nt, Yersinia pestis
cauaugcgccuauaaggcu

SEQ ID NO: 2280322 - RNA, 16 nt, Yersinia pestis
cauaucaacacugccu

SEQ ID NO: 2280323 - RNA, 14 nt, Yersinia pestis
cauaucaaaauaaa

SEQ ID NO: 2280324 - RNA, 22 nt, Yersinia pestis
cauaucacaguuaaaaauagac

SEQ ID NO: 2280325 - RNA, 17 nt, Yersinia pestis
cauauaucacuauuuca

SEQ ID NO: 2280326 - RNA, 19 nt, Yersinia pestis
cauauaucacuauuucagg

SEQ ID NO: 2280327 - RNA, 19 nt, Yersinia pestis
cauauaaccaugcgauacg

SEQ ID NO: 2280328 - RNA, 14 nt, Yersinia pestis
cauauaaucauacu

SEQ ID NO: 2280329 - RNA, 14 nt, Yersinia pestis
cauauaaaccagcc

SEQ ID NO: 2280330 - RNA, 12 nt, Yersinia pestis
caucaucaaaac

SEQ ID NO: 2280331 - RNA, 17 nt, Yersinia pestis
caucaucaaaaccgaug

SEQ ID NO: 2280332 - RNA, 22 nt, Yersinia pestis
caucaucaaaaccgaugaguga

SEQ ID NO: 2280333 - RNA, 16 nt, Yersinia pestis
caucaucacaaauaac

SEQ ID NO: 2280334 - RNA, 20 nt, Yersinia pestis
caucauccagcucaacgacc

SEQ ID NO: 2280335 - RNA, 20 nt, Yersinia pestis
caucaucccagucgucuuca

SEQ ID NO: 2280336 - RNA, 23 nt, Yersinia pestis
caucaucgccacuugaaacauuc

SEQ ID NO: 2280337 - RNA, 12 nt, Yersinia pestis
cauccacaucuu

SEQ ID NO: 2280338 - RNA, 19 nt, Yersinia pestis
cauccacaucuugcgccga

SEQ ID NO: 2280339 - RNA, 16 nt, Yersinia pestis
caucauuguuuacuau

SEQ ID NO: 2280340 - RNA, 17 nt, Yersinia pestis
caucaugaguaaaagau

SEQ ID NO: 2280341 - RNA, 14 nt, Yersinia pestis
caucaucuucuuca

SEQ ID NO: 2280342 - RNA, 15 nt, Yersinia pestis
caucaucuucuucau

SEQ ID NO: 2280343 - RNA, 13 nt, Yersinia pestis
caucaucuugaaa

SEQ ID NO: 2280344 - RNA, 13 nt, Yersinia pestis
caucaugacaaaa

SEQ ID NO: 2280345 - RNA, 21 nt, Yersinia pestis
caucaucuuuuuguaagccag

SEQ ID NO: 2280346 - RNA, 16 nt, Yersinia pestis
caucaggcuuauauuu

SEQ ID NO: 2280347 - RNA, 19 nt, Yersinia pestis
caucagggaauucaccggc

SEQ ID NO: 2280348 - RNA, 20 nt, Yersinia pestis
caucagggaauucaccggca

SEQ ID NO: 2280349 - RNA, 21 nt, Yersinia pestis
caucagggugaccgcacugcc

SEQ ID NO: 2280350 - RNA, 18 nt, Yersinia pestis
caucagguuguauuuugc

SEQ ID NO: 2280351 - RNA, 18 nt, Yersinia pestis
caucaggcgcuuuucuau

SEQ ID NO: 2280352 - RNA, 18 nt, Yersinia pestis
caucaggcggguaacugu

SEQ ID NO: 2280353 - RNA, 18 nt, Yersinia pestis
caucaggccuucuuuucu

SEQ ID NO: 2280354 - RNA, 22 nt, Yersinia pestis
caucauaaaaauacauaucaac

SEQ ID NO: 2280355 - RNA, 22 nt, Yersinia pestis
caucauaaaggcuaaaccggca

SEQ ID NO: 2280356 - RNA, 12 nt, Yersinia pestis
caucaguucacu

SEQ ID NO: 2280357 - RNA, 14 nt, Yersinia pestis
caucagugggauag

SEQ ID NO: 2280358 - RNA, 19 nt, Yersinia pestis
caucagguuguauuuugca

SEQ ID NO: 2280359 - RNA, 19 nt, Yersinia pestis
caucaguaauuuuuuguag

SEQ ID NO: 2280360 - RNA, 16 nt, Yersinia pestis
caucaccgcuaucacu

SEQ ID NO: 2280361 - RNA, 15 nt, Yersinia pestis
caucagccucuaaca

SEQ ID NO: 2280362 - RNA, 17 nt, Yersinia pestis
caucagcccauugcugu

SEQ ID NO: 2280363 - RNA, 19 nt, Yersinia pestis
caucgacuugaugaaguua

SEQ ID NO: 2280364 - RNA, 13 nt, Yersinia pestis
caucgccagcggg

SEQ ID NO: 2280365 - RNA, 21 nt, Yersinia pestis
caucgcgccuaccugccugcu

SEQ ID NO: 2280366 - RNA, 22 nt, Yersinia pestis
caucgcgccuaccugccugcug

SEQ ID NO: 2280367 - RNA, 20 nt, Yersinia pestis
caucgcggaugcgcgcguca

SEQ ID NO: 2280368 - RNA, 22 nt, Yersinia pestis
caucgcggaugcgcgcgucacu

SEQ ID NO: 2280369 - RNA, 15 nt, Yersinia pestis
caucggcguucggua

SEQ ID NO: 2280370 - RNA, 15 nt, Yersinia pestis
caucgcucaucgcca

SEQ ID NO: 2280371 - RNA, 23 nt, Yersinia pestis
cauccuccugaucuucauugccu

SEQ ID NO: 2280372 - RNA, 14 nt, Yersinia pestis
cauccugcaaauuu

SEQ ID NO: 2280373 - RNA, 16 nt, Yersinia pestis
cauccuguucaaaagg

SEQ ID NO: 2280374 - RNA, 16 nt, Yersinia pestis
cauccuuuacuccccu

SEQ ID NO: 2280375 - RNA, 18 nt, Yersinia pestis
cauccuuuacuccccugc

SEQ ID NO: 2280376 - RNA, 16 nt, Yersinia pestis
cauccuaaagauaauu

SEQ ID NO: 2280377 - RNA, 19 nt, Yersinia pestis
cauccguccaaugaauauc

SEQ ID NO: 2280378 - RNA, 15 nt, Yersinia pestis
cauccguauuauuug

SEQ ID NO: 2280379 - RNA, 14 nt, Yersinia pestis
cauccggcgggcaa

SEQ ID NO: 2280380 - RNA, 16 nt, Yersinia pestis
cauccgcuugcagcaa

SEQ ID NO: 2280381 - RNA, 20 nt, Yersinia pestis
caucuugcgccgaaauaaaa

SEQ ID NO: 2280382 - RNA, 15 nt, Yersinia pestis
caucuuccgucaguu

SEQ ID NO: 2280383 - RNA, 20 nt, Yersinia pestis
caucuugucgucacccauuu

SEQ ID NO: 2280384 - RNA, 22 nt, Yersinia pestis
caucuuuaccccauugcaccaa

SEQ ID NO: 2280385 - RNA, 22 nt, Yersinia pestis
caucuuucaguuuuauuguaua

SEQ ID NO: 2280386 - RNA, 20 nt, Yersinia pestis
caucugggggcgcucggcag

SEQ ID NO: 2280387 - RNA, 23 nt, Yersinia pestis
caucugaccagugagccaugugu

SEQ ID NO: 2280388 - RNA, 21 nt, Yersinia pestis
caucugcuuuacugcuuuucu

SEQ ID NO: 2280389 - RNA, 17 nt, Yersinia pestis
caucuauggauuacuua

SEQ ID NO: 2280390 - RNA, 15 nt, Yersinia pestis
caucuauugugucaa

SEQ ID NO: 2280391 - RNA, 18 nt, Yersinia pestis
caucuagcagugauuuca

SEQ ID NO: 2280392 - RNA, 21 nt, Yersinia pestis
caucuagcucaagggcacagu

SEQ ID NO: 2280393 - RNA, 23 nt, Yersinia pestis
caucgguaaaucgcccaauguca

SEQ ID NO: 2280394 - RNA, 14 nt, Yersinia pestis
caucgggaugcgcu

SEQ ID NO: 2280395 - RNA, 23 nt, Yersinia pestis
ccguuuugggcuugagcagugcg

SEQ ID NO: 2280396 - RNA, 11 nt, Yersinia pestis
ccuaaaaaaaa

SEQ ID NO: 2280397 - RNA, 19 nt, Yersinia pestis
ccguuggccggccaacauc

SEQ ID NO: 2280398 - RNA, 21 nt, Yersinia pestis
ccguucuugccacucugcucc

SEQ ID NO: 2280399 - RNA, 20 nt, Yersinia pestis
ccguugugaguaauucgcag

SEQ ID NO: 2280400 - RNA, 15 nt, Yersinia pestis
ccuaauuuaucccga

SEQ ID NO: 2280401 - RNA, 22 nt, Yersinia pestis
ccuaauuuaucccgagcuaacg

SEQ ID NO: 2280402 - RNA, 21 nt, Yersinia pestis
ccuacaaccuaucccccuucc

SEQ ID NO: 2280403 - RNA, 21 nt, Yersinia pestis
ccuaagguucacccugagugu

SEQ ID NO: 2280404 - RNA, 14 nt, Yersinia pestis
ccuaauaaauaauu

SEQ ID NO: 2280405 - RNA, 21 nt, Yersinia pestis
ccuaauaaauaauuuguauuc

SEQ ID NO: 2280406 - RNA, 13 nt, Yersinia pestis
ccuaaauccugca

SEQ ID NO: 2280407 - RNA, 21 nt, Yersinia pestis
ccuaagccggucuuuuuacaa

SEQ ID NO: 2280408 - RNA, 18 nt, Yersinia pestis
ccuaaagccaucgccauc

SEQ ID NO: 2280409 - RNA, 17 nt, Yersinia pestis
ccguuaacccaaagccc

SEQ ID NO: 2280410 - RNA, 17 nt, Yersinia pestis
ccguuaacccaaagcca

SEQ ID NO: 2280411 - RNA, 18 nt, Yersinia pestis
ccguuacaaccgccgccg

SEQ ID NO: 2280412 - RNA, 22 nt, Yersinia pestis
ccguuagcaccggauggucacc

SEQ ID NO: 2280413 - RNA, 17 nt, Yersinia pestis
ccguucggucacacugg

SEQ ID NO: 2280414 - RNA, 22 nt, Yersinia pestis
ccguggcauaaucaacgcucaa

SEQ ID NO: 2280415 - RNA, 21 nt, Yersinia pestis
ccguggcgacagcuauuuauu

SEQ ID NO: 2280416 - RNA, 17 nt, Yersinia pestis
ccgugcauagcgugauu

SEQ ID NO: 2280417 - RNA, 22 nt, Yersinia pestis
ccgugcauagcgugauuuuuau

SEQ ID NO: 2280418 - RNA, 19 nt, Yersinia pestis
ccguggcauaaucaacgcu

SEQ ID NO: 2280419 - RNA, 19 nt, Yersinia pestis
ccucaaaaggauggcccaa

SEQ ID NO: 2280420 - RNA, 23 nt, Yersinia pestis
ccucaaaaggauggcccaagcca

SEQ ID NO: 2280421 - RNA, 12 nt, Yersinia pestis
ccucaaaaggau

SEQ ID NO: 2280422 - RNA, 14 nt, Yersinia pestis
ccucaacgcacccc

SEQ ID NO: 2280423 - RNA, 18 nt, Yersinia pestis
ccuauggcgguuccaaag

SEQ ID NO: 2280424 - RNA, 20 nt, Yersinia pestis
ccuauuaucccaguuuuuaa

SEQ ID NO: 2280425 - RNA, 23 nt, Yersinia pestis
ccuauuagauguguuuaaaucuu

SEQ ID NO: 2280426 - RNA, 15 nt, Yersinia pestis
ccuauugauaaaacc

SEQ ID NO: 2280427 - RNA, 16 nt, Yersinia pestis
ccuauugaauaacagc

SEQ ID NO: 2280428 - RNA, 21 nt, Yersinia pestis
ccucagagacaucuuuaccag

SEQ ID NO: 2280429 - RNA, 16 nt, Yersinia pestis
ccucagagacaucuuu

SEQ ID NO: 2280430 - RNA, 13 nt, Yersinia pestis
ccucacucuguga

SEQ ID NO: 2280431 - RNA, 19 nt, Yersinia pestis
ccucacugaaacgcuuaau

SEQ ID NO: 2280432 - RNA, 21 nt, Yersinia pestis
ccucaaugcagaugccaauga

SEQ ID NO: 2280433 - RNA, 15 nt, Yersinia pestis
ccucacaagccacgc

SEQ ID NO: 2280434 - RNA, 17 nt, Yersinia pestis
ccucacacgauuuuuac

SEQ ID NO: 2280435 - RNA, 12 nt, Yersinia pestis
ccucaccgccag

SEQ ID NO: 2280436 - RNA, 21 nt, Yersinia pestis
ccuauagcaauauaauaaucu

SEQ ID NO: 2280437 - RNA, 13 nt, Yersinia pestis
ccuauaaauuuua

SEQ ID NO: 2280438 - RNA, 23 nt, Yersinia pestis
ccuauaauuaacagcaucacugu

SEQ ID NO: 2280439 - RNA, 21 nt, Yersinia pestis
ccuaguaaaggcgaugauuug

SEQ ID NO: 2280440 - RNA, 18 nt, Yersinia pestis
ccuaggcuauugacaaag

SEQ ID NO: 2280441 - RNA, 14 nt, Yersinia pestis
ccuauccucaccgu

SEQ ID NO: 2280442 - RNA, 17 nt, Yersinia pestis
ccuauccacugugauug

SEQ ID NO: 2280443 - RNA, 18 nt, Yersinia pestis
ccuaucauucaacacucu

SEQ ID NO: 2280444 - RNA, 12 nt, Yersinia pestis
ccuacuaccaaa

SEQ ID NO: 2280445 - RNA, 17 nt, Yersinia pestis
ccuacugacauuucuua

SEQ ID NO: 2280446 - RNA, 16 nt, Yersinia pestis
ccuacuggcugaaguu

SEQ ID NO: 2280447 - RNA, 16 nt, Yersinia pestis
ccuacguucaggcccc

SEQ ID NO: 2280448 - RNA, 17 nt, Yersinia pestis
ccuagcaucauaaauac

SEQ ID NO: 2280449 - RNA, 17 nt, Yersinia pestis
ccguaaucaugguugga

SEQ ID NO: 2280450 - RNA, 19 nt, Yersinia pestis
ccgguguuuuugacacggg

SEQ ID NO: 2280451 - RNA, 16 nt, Yersinia pestis
ccgguucuugcgcgcu

SEQ ID NO: 2280452 - RNA, 20 nt, Yersinia pestis
ccguaucauggaagaccaga

SEQ ID NO: 2280453 - RNA, 18 nt, Yersinia pestis
ccguaucaccgguuuuug

SEQ ID NO: 2280454 - RNA, 13 nt, Yersinia pestis
ccguaucagcccc

SEQ ID NO: 2280455 - RNA, 19 nt, Yersinia pestis
ccguaucuuguaguaacca

SEQ ID NO: 2280456 - RNA, 15 nt, Yersinia pestis
ccguaccaguugucu

SEQ ID NO: 2280457 - RNA, 12 nt, Yersinia pestis
ccguacaaauau

SEQ ID NO: 2280458 - RNA, 14 nt, Yersinia pestis
ccguacaaauauaa

SEQ ID NO: 2280459 - RNA, 12 nt, Yersinia pestis
ccguauaaucag

SEQ ID NO: 2280460 - RNA, 18 nt, Yersinia pestis
ccguauagauuauuuucu

SEQ ID NO: 2280461 - RNA, 15 nt, Yersinia pestis
ccgucaaugccuguu

SEQ ID NO: 2280462 - RNA, 21 nt, Yersinia pestis
ccgucaauaucaucaucuuua

SEQ ID NO: 2280463 - RNA, 21 nt, Yersinia pestis
ccgucaccucaucagugacua

SEQ ID NO: 2280464 - RNA, 16 nt, Yersinia pestis
ccguccagcccaccau

SEQ ID NO: 2280465 - RNA, 12 nt, Yersinia pestis
ccggucaugguu

SEQ ID NO: 2280466 - RNA, 22 nt, Yersinia pestis
ccggucauacauuggcuccccu

SEQ ID NO: 2280467 - RNA, 14 nt, Yersinia pestis
ccgggugcagcgcc

SEQ ID NO: 2280468 - RNA, 19 nt, Yersinia pestis
ccgggaucuaucagaccuu

SEQ ID NO: 2280469 - RNA, 20 nt, Yersinia pestis
ccgggcaaacgccagugcaa

SEQ ID NO: 2280470 - RNA, 19 nt, Yersinia pestis
ccgggcaaacgccagugca

SEQ ID NO: 2280471 - RNA, 21 nt, Yersinia pestis
ccuuaaccccguagcacacac

SEQ ID NO: 2280472 - RNA, 16 nt, Yersinia pestis
ccuuaacgccccgccc

SEQ ID NO: 2280473 - RNA, 18 nt, Yersinia pestis
ccuuaacgccccgccccu

SEQ ID NO: 2280474 - RNA, 14 nt, Yersinia pestis
ccuuaacugcauag

SEQ ID NO: 2280475 - RNA, 21 nt, Yersinia pestis
ccuuaauuaacucuucuguug

SEQ ID NO: 2280476 - RNA, 18 nt, Yersinia pestis
ccuuacagugauaaucac

SEQ ID NO: 2280477 - RNA, 16 nt, Yersinia pestis
ccuguuuacguaaaua

SEQ ID NO: 2280478 - RNA, 18 nt, Yersinia pestis
ccuguuuacguaaauaga

SEQ ID NO: 2280479 - RNA, 16 nt, Yersinia pestis
ccuguugaucuucuug

SEQ ID NO: 2280480 - RNA, 13 nt, Yersinia pestis
ccuguugcaauug

SEQ ID NO: 2280481 - RNA, 22 nt, Yersinia pestis
ccugucuaggguuauuuuauug

SEQ ID NO: 2280482 - RNA, 22 nt, Yersinia pestis
ccuguaaaagcagccgugcuug

SEQ ID NO: 2280483 - RNA, 22 nt, Yersinia pestis
ccuguugagguacggcucuauu

SEQ ID NO: 2280484 - RNA, 15 nt, Yersinia pestis
ccugugaugauggcg

SEQ ID NO: 2280485 - RNA, 22 nt, Yersinia pestis
ccuuagcacguuuuucagcuuc

SEQ ID NO: 2280486 - RNA, 14 nt, Yersinia pestis
ccuuacuauuuuuc

SEQ ID NO: 2280487 - RNA, 20 nt, Yersinia pestis
ccuuacuucaaaacuaauau

SEQ ID NO: 2280488 - RNA, 17 nt, Yersinia pestis
ccuuacuuccaauaagu

SEQ ID NO: 2280489 - RNA, 14 nt, Yersinia pestis
ccuuacuaucuuua

SEQ ID NO: 2280490 - RNA, 16 nt, Yersinia pestis
ccuuacuaucuuuauu

SEQ ID NO: 2280491 - RNA, 20 nt, Yersinia pestis
ccuuacuaucuuuauugcuc

SEQ ID NO: 2280492 - RNA, 15 nt, Yersinia pestis
ccuuacgcugauuaa

SEQ ID NO: 2280493 - RNA, 13 nt, Yersinia pestis
ccuuaucuacugg

SEQ ID NO: 2280494 - RNA, 14 nt, Yersinia pestis
ccuuauucuuauuu

SEQ ID NO: 2280495 - RNA, 19 nt, Yersinia pestis
ccuuauccguuaacccaaa

SEQ ID NO: 2280496 - RNA, 14 nt, Yersinia pestis
ccuuaucagcgaaa

SEQ ID NO: 2280497 - RNA, 20 nt, Yersinia pestis
ccuuauaggcgcauaugaaa

SEQ ID NO: 2280498 - RNA, 14 nt, Yersinia pestis
ccuucaggaauaaa

SEQ ID NO: 2280499 - RNA, 17 nt, Yersinia pestis
ccuucaggaauaaacag

SEQ ID NO: 2280500 - RNA, 22 nt, Yersinia pestis
ccuucagaugaauccagccaug

SEQ ID NO: 2280501 - RNA, 15 nt, Yersinia pestis
ccuucacuuacucuc

SEQ ID NO: 2280502 - RNA, 17 nt, Yersinia pestis
ccuucacgguaguaaua

SEQ ID NO: 2280503 - RNA, 19 nt, Yersinia pestis
ccuucacgguaguaauaau

SEQ ID NO: 2280504 - RNA, 20 nt, Yersinia pestis
ccuucacgguaguaauaauu

SEQ ID NO: 2280505 - RNA, 12 nt, Yersinia pestis
ccuucaaccacg

SEQ ID NO: 2280506 - RNA, 14 nt, Yersinia pestis
ccuucaacuaauau

SEQ ID NO: 2280507 - RNA, 15 nt, Yersinia pestis
ccuucaacuaauauu

SEQ ID NO: 2280508 - RNA, 16 nt, Yersinia pestis
ccuucaacuaauauua

SEQ ID NO: 2280509 - RNA, 21 nt, Yersinia pestis
ccuucaaacgggugauguuua

SEQ ID NO: 2280510 - RNA, 16 nt, Yersinia pestis
ccuucaaagccgcuuu

SEQ ID NO: 2280511 - RNA, 13 nt, Yersinia pestis
ccuucaaucagca

SEQ ID NO: 2280512 - RNA, 16 nt, Yersinia pestis
ccuucacauuuucucc

SEQ ID NO: 2280513 - RNA, 21 nt, Yersinia pestis
ccugcugggggcgguugcgcu

SEQ ID NO: 2280514 - RNA, 16 nt, Yersinia pestis
ccugcuugaaagcacc

SEQ ID NO: 2280515 - RNA, 19 nt, Yersinia pestis
ccugcuccaaagcuuccaa

SEQ ID NO: 2280516 - RNA, 12 nt, Yersinia pestis
ccugcucagcua

SEQ ID NO: 2280517 - RNA, 19 nt, Yersinia pestis
ccugccagaaucagcccca

SEQ ID NO: 2280518 - RNA, 14 nt, Yersinia pestis
ccuggcucaaauuu

SEQ ID NO: 2280519 - RNA, 16 nt, Yersinia pestis
ccugguggcaaguauc

SEQ ID NO: 2280520 - RNA, 18 nt, Yersinia pestis
ccuggccccguugucccg

SEQ ID NO: 2280521 - RNA, 19 nt, Yersinia pestis
ccuggcccuuggcugguga

SEQ ID NO: 2280522 - RNA, 20 nt, Yersinia pestis
ccuggccguguuuuucccua

SEQ ID NO: 2280523 - RNA, 19 nt, Yersinia pestis
ccugauucgcgaccagcag

SEQ ID NO: 2280524 - RNA, 21 nt, Yersinia pestis
ccugaugugguuguuuuuucc

SEQ ID NO: 2280525 - RNA, 15 nt, Yersinia pestis
ccugaugaugaagca

SEQ ID NO: 2280526 - RNA, 14 nt, Yersinia pestis
ccugaugauaagca

SEQ ID NO: 2280527 - RNA, 16 nt, Yersinia pestis
ccugauuuaguuuauu

SEQ ID NO: 2280528 - RNA, 20 nt, Yersinia pestis
ccugauucgcgaccagcaga

SEQ ID NO: 2280529 - RNA, 14 nt, Yersinia pestis
ccugauuguuuuua

SEQ ID NO: 2280530 - RNA, 14 nt, Yersinia pestis
ccugccaauaucca

SEQ ID NO: 2280531 - RNA, 18 nt, Yersinia pestis
ccugauaaggagagaggc

SEQ ID NO: 2280532 - RNA, 14 nt, Yersinia pestis
ccugauacaccauu

SEQ ID NO: 2280533 - RNA, 17 nt, Yersinia pestis
ccugaguaauauuauuc

SEQ ID NO: 2280534 - RNA, 13 nt, Yersinia pestis
ccugagugggggc

SEQ ID NO: 2280535 - RNA, 16 nt, Yersinia pestis
ccugagccgccaguug

SEQ ID NO: 2280536 - RNA, 23 nt, Yersinia pestis
ccugagggugaugacaaugcguu

SEQ ID NO: 2280537 - RNA, 22 nt, Yersinia pestis
ccugagguuccacucucugcuu

SEQ ID NO: 2280538 - RNA, 18 nt, Yersinia pestis
ccugagguucccaacggc

SEQ ID NO: 2280539 - RNA, 18 nt, Yersinia pestis
ccucuuccgguuguucua

SEQ ID NO: 2280540 - RNA, 17 nt, Yersinia pestis
ccugacccccaauuuca

SEQ ID NO: 2280541 - RNA, 19 nt, Yersinia pestis
ccugacucacagggcuguu

SEQ ID NO: 2280542 - RNA, 16 nt, Yersinia pestis
ccugacuguuuugcua

SEQ ID NO: 2280543 - RNA, 18 nt, Yersinia pestis
ccugacuguggcugcucu

SEQ ID NO: 2280544 - RNA, 21 nt, Yersinia pestis
ccugacgcggugacaaugaau

SEQ ID NO: 2280545 - RNA, 21 nt, Yersinia pestis
ccugacgaugauaaaucagca

SEQ ID NO: 2280546 - RNA, 23 nt, Yersinia pestis
ccucuggcggugacguuccuugg

SEQ ID NO: 2280547 - RNA, 20 nt, Yersinia pestis
ccucugcugcugcccgcgaa

SEQ ID NO: 2280548 - RNA, 20 nt, Yersinia pestis
ccucuggauaaacaauaauc

SEQ ID NO: 2280549 - RNA, 20 nt, Yersinia pestis
ccucugcgcuggcguuuuug

SEQ ID NO: 2280550 - RNA, 20 nt, Yersinia pestis
ccucugccgauuuaaacccu

SEQ ID NO: 2280551 - RNA, 16 nt, Yersinia pestis
ccucugcgaagccgcu

SEQ ID NO: 2280552 - RNA, 13 nt, Yersinia pestis
ccucuuaaugucu

SEQ ID NO: 2280553 - RNA, 21 nt, Yersinia pestis
ccucuuauuaaauggagggca

SEQ ID NO: 2280554 - RNA, 15 nt, Yersinia pestis
ccucuaaucuccucu

SEQ ID NO: 2280555 - RNA, 21 nt, Yersinia pestis
ccucuacgucaaucucaccgc

SEQ ID NO: 2280556 - RNA, 16 nt, Yersinia pestis
ccucugccuauccuca

SEQ ID NO: 2280557 - RNA, 22 nt, Yersinia pestis
ccucagccuuuuuugcuuaaaa

SEQ ID NO: 2280558 - RNA, 13 nt, Yersinia pestis
ccucagccucauu

SEQ ID NO: 2280559 - RNA, 20 nt, Yersinia pestis
ccucaguucuuggaacccgu

SEQ ID NO: 2280560 - RNA, 18 nt, Yersinia pestis
ccucagggcgucucuacg

SEQ ID NO: 2280561 - RNA, 16 nt, Yersinia pestis
ccucaggggccaacag

SEQ ID NO: 2280562 - RNA, 22 nt, Yersinia pestis
ccucaggugcauccacauauau

SEQ ID NO: 2280563 - RNA, 15 nt, Yersinia pestis
ccucgcuucugcgag

SEQ ID NO: 2280564 - RNA, 19 nt, Yersinia pestis
ccucgcaauggugauaaac

SEQ ID NO: 2280565 - RNA, 22 nt, Yersinia pestis
ccucgcccuucgggucaacgcu

SEQ ID NO: 2280566 - RNA, 17 nt, Yersinia pestis
ccgccaaauccaagcca

SEQ ID NO: 2280567 - RNA, 20 nt, Yersinia pestis
ccgcauuuucaaagguacgc

SEQ ID NO: 2280568 - RNA, 13 nt, Yersinia pestis
ccgcauccggcgg

SEQ ID NO: 2280569 - RNA, 19 nt, Yersinia pestis
ccgcagcggcuagcagcag

SEQ ID NO: 2280570 - RNA, 14 nt, Yersinia pestis
ccgcaucuaaaccg

SEQ ID NO: 2280571 - RNA, 20 nt, Yersinia pestis
ccgcauugaccgcuguuuga

SEQ ID NO: 2280572 - RNA, 13 nt, Yersinia pestis
ccgcauuccagcg

SEQ ID NO: 2280573 - RNA, 18 nt, Yersinia pestis
ccgcauucaccaccauau

SEQ ID NO: 2280574 - RNA, 19 nt, Yersinia pestis
ccgcaccaacucuucuuua

SEQ ID NO: 2280575 - RNA, 14 nt, Yersinia pestis
ccgccauccuucaa

SEQ ID NO: 2280576 - RNA, 22 nt, Yersinia pestis
ccgccagugccaccguaaaaaa

SEQ ID NO: 2280577 - RNA, 14 nt, Yersinia pestis
ccgccaguugcuca

SEQ ID NO: 2280578 - RNA, 16 nt, Yersinia pestis
ccgccagaauaaacga

SEQ ID NO: 2280579 - RNA, 21 nt, Yersinia pestis
ccgccagguuuacuggcgggc

SEQ ID NO: 2280580 - RNA, 16 nt, Yersinia pestis
ccgaugcuacaccauc

SEQ ID NO: 2280581 - RNA, 14 nt, Yersinia pestis
ccgauaaucaauuu

SEQ ID NO: 2280582 - RNA, 20 nt, Yersinia pestis
ccgauaauaaauauccuccg

SEQ ID NO: 2280583 - RNA, 16 nt, Yersinia pestis
ccgauaaucaauuugu

SEQ ID NO: 2280584 - RNA, 18 nt, Yersinia pestis
ccgauacaggcucugaaa

SEQ ID NO: 2280585 - RNA, 16 nt, Yersinia pestis
ccgagcgucaagccaa

SEQ ID NO: 2280586 - RNA, 16 nt, Yersinia pestis
ccgaggugaagacacc

SEQ ID NO: 2280587 - RNA, 18 nt, Yersinia pestis
ccgagguuaucagccucu

SEQ ID NO: 2280588 - RNA, 12 nt, Yersinia pestis
ccgauaagcccu

SEQ ID NO: 2280589 - RNA, 19 nt, Yersinia pestis
ccgacugagauuauuauua

SEQ ID NO: 2280590 - RNA, 22 nt, Yersinia pestis
cccucgcggcgguaaccccggc

SEQ ID NO: 2280591 - RNA, 21 nt, Yersinia pestis
cccuuuaaaucuagcccuuca

SEQ ID NO: 2280592 - RNA, 21 nt, Yersinia pestis
cccuuucaccaaccaaccauc

SEQ ID NO: 2280593 - RNA, 23 nt, Yersinia pestis
cccuuucaccaaccaaccaucac

SEQ ID NO: 2280594 - RNA, 17 nt, Yersinia pestis
cccuuucagcgcuuuuu

SEQ ID NO: 2280595 - RNA, 16 nt, Yersinia pestis
cccuuucgcagcccaa

SEQ ID NO: 2280596 - RNA, 15 nt, Yersinia pestis
cccuuuggguggugg

SEQ ID NO: 2280597 - RNA, 18 nt, Yersinia pestis
cccuuuggguuguuucaa

SEQ ID NO: 2280598 - RNA, 17 nt, Yersinia pestis
cccuuuuucaaucacuu

SEQ ID NO: 2280599 - RNA, 14 nt, Yersinia pestis
cccuuugacagcau

SEQ ID NO: 2280600 - RNA, 16 nt, Yersinia pestis
cccuuugacauacagu

SEQ ID NO: 2280601 - RNA, 13 nt, Yersinia pestis
cccuuuuaccgaa

SEQ ID NO: 2280602 - RNA, 19 nt, Yersinia pestis
cccuuuuccgucagcccaa

SEQ ID NO: 2280603 - RNA, 18 nt, Yersinia pestis
ccgaaauggaaaggcggg

SEQ ID NO: 2280604 - RNA, 19 nt, Yersinia pestis
ccgaaauaaauauccuccg

SEQ ID NO: 2280605 - RNA, 14 nt, Yersinia pestis
ccgaccaaaggcca

SEQ ID NO: 2280606 - RNA, 14 nt, Yersinia pestis
ccgacccacgcccc

SEQ ID NO: 2280607 - RNA, 17 nt, Yersinia pestis
ccgaauuaauaaaaccu

SEQ ID NO: 2280608 - RNA, 23 nt, Yersinia pestis
ccgacaauaacgcugaauacacu

SEQ ID NO: 2280609 - RNA, 23 nt, Yersinia pestis
ccgacaagauugccaccuucacc

SEQ ID NO: 2280610 - RNA, 14 nt, Yersinia pestis
ccgacacccagcca

SEQ ID NO: 2280611 - RNA, 15 nt, Yersinia pestis
ccgacacccagccag

SEQ ID NO: 2280612 - RNA, 22 nt, Yersinia pestis
ccgcgaauuccaaccagagauu

SEQ ID NO: 2280613 - RNA, 23 nt, Yersinia pestis
ccgcgaugccaucgcuuuggcuu

SEQ ID NO: 2280614 - RNA, 13 nt, Yersinia pestis
ccgcgaaaaacca

SEQ ID NO: 2280615 - RNA, 19 nt, Yersinia pestis
ccgccuguauccagcagcg

SEQ ID NO: 2280616 - RNA, 13 nt, Yersinia pestis
ccgcgccagggag

SEQ ID NO: 2280617 - RNA, 20 nt, Yersinia pestis
ccgcuguagcgccaaugaca

SEQ ID NO: 2280618 - RNA, 18 nt, Yersinia pestis
ccgcuguaggugucacca

SEQ ID NO: 2280619 - RNA, 17 nt, Yersinia pestis
ccgcuggugcugcgggc

SEQ ID NO: 2280620 - RNA, 14 nt, Yersinia pestis
ccgcugucauucca

SEQ ID NO: 2280621 - RNA, 23 nt, Yersinia pestis
ccgcugucauuccaaccuuguaa

SEQ ID NO: 2280622 - RNA, 14 nt, Yersinia pestis
ccgcugcaacuccu

SEQ ID NO: 2280623 - RNA, 17 nt, Yersinia pestis
ccgcugaucaggaaggu

SEQ ID NO: 2280624 - RNA, 14 nt, Yersinia pestis
ccgcucggcccgcc

SEQ ID NO: 2280625 - RNA, 20 nt, Yersinia pestis
ccgcuaucacuagcgggccu

SEQ ID NO: 2280626 - RNA, 18 nt, Yersinia pestis
ccgcuaucacuagcgggc

SEQ ID NO: 2280627 - RNA, 19 nt, Yersinia pestis
ccgcuagugauagcgggcc

SEQ ID NO: 2280628 - RNA, 20 nt, Yersinia pestis
ccgcuagugauagcgggccu

SEQ ID NO: 2280629 - RNA, 12 nt, Yersinia pestis
ccgcuacccgcc

SEQ ID NO: 2280630 - RNA, 22 nt, Yersinia pestis
ccgcuaccgguuaaacuucuuu

SEQ ID NO: 2280631 - RNA, 17 nt, Yersinia pestis
ccgcuaccaagcccagu

SEQ ID NO: 2280632 - RNA, 14 nt, Yersinia pestis
ccgcgucgccgcuu

SEQ ID NO: 2280633 - RNA, 18 nt, Yersinia pestis
ccggcaaaaacgccauca

SEQ ID NO: 2280634 - RNA, 12 nt, Yersinia pestis
ccgcuucugggc

SEQ ID NO: 2280635 - RNA, 17 nt, Yersinia pestis
ccgcuugcauacgcuua

SEQ ID NO: 2280636 - RNA, 16 nt, Yersinia pestis
ccggagcaagggcgca

SEQ ID NO: 2280637 - RNA, 20 nt, Yersinia pestis
ccggaggauauuuauuauuc

SEQ ID NO: 2280638 - RNA, 21 nt, Yersinia pestis
ccggaggauauuuauuuacuc

SEQ ID NO: 2280639 - RNA, 20 nt, Yersinia pestis
ccggcacaggcgcuggcaac

SEQ ID NO: 2280640 - RNA, 22 nt, Yersinia pestis
ccggcaaccaguuauagcggug

SEQ ID NO: 2280641 - RNA, 17 nt, Yersinia pestis
ccggcaucccaccuuca

SEQ ID NO: 2280642 - RNA, 21 nt, Yersinia pestis
ccggcgaagggcgcagccccc

SEQ ID NO: 2280643 - RNA, 11 nt, Yersinia pestis
cauuuuuucuu

SEQ ID NO: 2280644 - RNA, 13 nt, Yersinia pestis
cauuuuuugggau

SEQ ID NO: 2280645 - RNA, 18 nt, Yersinia pestis
cauuuuuuuauuaaguuu

SEQ ID NO: 2280646 - RNA, 20 nt, Yersinia pestis
cauuuuuuuauuaaguuuuu

SEQ ID NO: 2280647 - RNA, 12 nt, Yersinia pestis
ccaccgcacacu

SEQ ID NO: 2280648 - RNA, 21 nt, Yersinia pestis
ccaccgagguuaucagccucu

SEQ ID NO: 2280649 - RNA, 21 nt, Yersinia pestis
ccaccuuaaguaaguuuaaac

SEQ ID NO: 2280650 - RNA, 16 nt, Yersinia pestis
ccacgcauuccaucag

SEQ ID NO: 2280651 - RNA, 17 nt, Yersinia pestis
ccacgccaauugauuug

SEQ ID NO: 2280652 - RNA, 17 nt, Yersinia pestis
ccacgccaacccucuuc

SEQ ID NO: 2280653 - RNA, 13 nt, Yersinia pestis
ccacgcauuccau

SEQ ID NO: 2280654 - RNA, 16 nt, Yersinia pestis
ccacgaugugaagcaa

SEQ ID NO: 2280655 - RNA, 18 nt, Yersinia pestis
ccacgauuacguuuucuu

SEQ ID NO: 2280656 - RNA, 16 nt, Yersinia pestis
ccacgcaauggagaac

SEQ ID NO: 2280657 - RNA, 21 nt, Yersinia pestis
ccacgauuguuugggauaaag

SEQ ID NO: 2280658 - RNA, 19 nt, Yersinia pestis
ccacugcguacucacccca

SEQ ID NO: 2280659 - RNA, 14 nt, Yersinia pestis
ccacuggccugaga

SEQ ID NO: 2280660 - RNA, 16 nt, Yersinia pestis
ccacuggccugagaac

SEQ ID NO: 2280661 - RNA, 21 nt, Yersinia pestis
ccacuuaacacgaaccuucuc

SEQ ID NO: 2280662 - RNA, 14 nt, Yersinia pestis
ccacuguuuuucau

SEQ ID NO: 2280663 - RNA, 14 nt, Yersinia pestis
ccacugguugaaag

SEQ ID NO: 2280664 - RNA, 20 nt, Yersinia pestis
ccacuggguuacauccugaa

SEQ ID NO: 2280665 - RNA, 16 nt, Yersinia pestis
ccacuuccugauggcc

SEQ ID NO: 2280666 - RNA, 17 nt, Yersinia pestis
ccacuuggcccacuguu

SEQ ID NO: 2280667 - RNA, 20 nt, Yersinia pestis
ccagaaccucaacauucuuu

SEQ ID NO: 2280668 - RNA, 12 nt, Yersinia pestis
ccagaaauauug

SEQ ID NO: 2280669 - RNA, 13 nt, Yersinia pestis
ccagaacaccaac

SEQ ID NO: 2280670 - RNA, 15 nt, Yersinia pestis
ccacguagaucaaca

SEQ ID NO: 2280671 - RNA, 15 nt, Yersinia pestis
ccacgcuccuggcga

SEQ ID NO: 2280672 - RNA, 20 nt, Yersinia pestis
ccacuacugaacgucauaau

SEQ ID NO: 2280673 - RNA, 13 nt, Yersinia pestis
ccacguuuguagc

SEQ ID NO: 2280674 - RNA, 20 nt, Yersinia pestis
ccacguuuguagcaaaccca

SEQ ID NO: 2280675 - RNA, 16 nt, Yersinia pestis
ccacucguucucaacc

SEQ ID NO: 2280676 - RNA, 13 nt, Yersinia pestis
ccacucucccuca

SEQ ID NO: 2280677 - RNA, 14 nt, Yersinia pestis
ccacucucccucag

SEQ ID NO: 2280678 - RNA, 16 nt, Yersinia pestis
ccacucgccccacaau

SEQ ID NO: 2280679 - RNA, 18 nt, Yersinia pestis
ccacucggccaaacaaag

SEQ ID NO: 2280680 - RNA, 20 nt, Yersinia pestis
ccacugacaaaaacagcacu

SEQ ID NO: 2280681 - RNA, 17 nt, Yersinia pestis
ccacucucccucaguga

SEQ ID NO: 2280682 - RNA, 23 nt, Yersinia pestis
ccacugaccuauugauaaaacca

SEQ ID NO: 2280683 - RNA, 23 nt, Yersinia pestis
ccacugaccuauugauaaaaccg

SEQ ID NO: 2280684 - RNA, 14 nt, Yersinia pestis
ccacugaccgggaa

SEQ ID NO: 2280685 - RNA, 19 nt, Yersinia pestis
ccacugacgguaauuguuc

SEQ ID NO: 2280686 - RNA, 22 nt, Yersinia pestis
ccacuaugcccaguuuaccauc

SEQ ID NO: 2280687 - RNA, 16 nt, Yersinia pestis
ccacuaguuaaaacca

SEQ ID NO: 2280688 - RNA, 14 nt, Yersinia pestis
ccacuagcagagca

SEQ ID NO: 2280689 - RNA, 19 nt, Yersinia pestis
ccacucaccuaaaucaaua

SEQ ID NO: 2280690 - RNA, 12 nt, Yersinia pestis
ccagauggccag

SEQ ID NO: 2280691 - RNA, 20 nt, Yersinia pestis
ccagauggccagauucacca

SEQ ID NO: 2280692 - RNA, 15 nt, Yersinia pestis
ccagauggucacccu

SEQ ID NO: 2280693 - RNA, 16 nt, Yersinia pestis
ccagauuauuggcaug

SEQ ID NO: 2280694 - RNA, 18 nt, Yersinia pestis
ccagauugacauucauau

SEQ ID NO: 2280695 - RNA, 20 nt, Yersinia pestis
ccagauucaccaguagccca

SEQ ID NO: 2280696 - RNA, 20 nt, Yersinia pestis
ccagauugccaaucagaacu

SEQ ID NO: 2280697 - RNA, 18 nt, Yersinia pestis
ccagauugugcggcuggc

SEQ ID NO: 2280698 - RNA, 16 nt, Yersinia pestis
ccagauugucaaucac

SEQ ID NO: 2280699 - RNA, 14 nt, Yersinia pestis
ccagauuggcgugu

SEQ ID NO: 2280700 - RNA, 22 nt, Yersinia pestis
ccagcaaacgcauuugaguaaa

SEQ ID NO: 2280701 - RNA, 17 nt, Yersinia pestis
ccagcaaaauagcacag

SEQ ID NO: 2280702 - RNA, 18 nt, Yersinia pestis
ccagauaugaucaaaaau

SEQ ID NO: 2280703 - RNA, 18 nt, Yersinia pestis
ccagaucagcacggaacc

SEQ ID NO: 2280704 - RNA, 16 nt, Yersinia pestis
ccagaauauaaaagca

SEQ ID NO: 2280705 - RNA, 9 nt, Yersinia pestis
ccagcagca

SEQ ID NO: 2280706 - RNA, 15 nt, Yersinia pestis
ccagcauaguaagcu

SEQ ID NO: 2280707 - RNA, 19 nt, Yersinia pestis
ccagccccaaucaccggcu

SEQ ID NO: 2280708 - RNA, 20 nt, Yersinia pestis
ccagccgauaauccaccuga

SEQ ID NO: 2280709 - RNA, 19 nt, Yersinia pestis
ccagccuuaacugcauagc

SEQ ID NO: 2280710 - RNA, 21 nt, Yersinia pestis
ccagccuguuaauaauucagg

SEQ ID NO: 2280711 - RNA, 13 nt, Yersinia pestis
ccagccuggaagc

SEQ ID NO: 2280712 - RNA, 20 nt, Yersinia pestis
ccagccuguuaauaauucag

SEQ ID NO: 2280713 - RNA, 23 nt, Yersinia pestis
ccaguugccacucauauucaaaa

SEQ ID NO: 2280714 - RNA, 14 nt, Yersinia pestis
ccaguugucuauuu

SEQ ID NO: 2280715 - RNA, 12 nt, Yersinia pestis
ccauaaccgaug

SEQ ID NO: 2280716 - RNA, 18 nt, Yersinia pestis
ccagugagccauguguuu

SEQ ID NO: 2280717 - RNA, 15 nt, Yersinia pestis
ccagugaguccuuua

SEQ ID NO: 2280718 - RNA, 19 nt, Yersinia pestis
ccagugcaaaaugcucuuc

SEQ ID NO: 2280719 - RNA, 17 nt, Yersinia pestis
ccagugcaaauuuaugc

SEQ ID NO: 2280720 - RNA, 15 nt, Yersinia pestis
ccagugccaauugag

SEQ ID NO: 2280721 - RNA, 19 nt, Yersinia pestis
ccagugccgcggcggccag

SEQ ID NO: 2280722 - RNA, 16 nt, Yersinia pestis
ccagugcuauucauaa

SEQ ID NO: 2280723 - RNA, 18 nt, Yersinia pestis
ccagugcgggagccgcac

SEQ ID NO: 2280724 - RNA, 18 nt, Yersinia pestis
ccagucuaaacgccgcgu

SEQ ID NO: 2280725 - RNA, 18 nt, Yersinia pestis
ccaguauugcagagcaaa

SEQ ID NO: 2280726 - RNA, 15 nt, Yersinia pestis
ccagucauaaauauc

SEQ ID NO: 2280727 - RNA, 20 nt, Yersinia pestis
ccagucacuuacugaucaau

SEQ ID NO: 2280728 - RNA, 21 nt, Yersinia pestis
ccaguagccguuacaaucugc

SEQ ID NO: 2280729 - RNA, 14 nt, Yersinia pestis
ccaguagcccagcc

SEQ ID NO: 2280730 - RNA, 23 nt, Yersinia pestis
ccaucaggcgcuuuucuauugga

SEQ ID NO: 2280731 - RNA, 23 nt, Yersinia pestis
ccaucaggcuacggcugaucugc

SEQ ID NO: 2280732 - RNA, 15 nt, Yersinia pestis
ccaucaguucacuga

SEQ ID NO: 2280733 - RNA, 16 nt, Yersinia pestis
ccaucauaaaggcuaa

SEQ ID NO: 2280734 - RNA, 17 nt, Yersinia pestis
ccaucaugccagcaaua

SEQ ID NO: 2280735 - RNA, 20 nt, Yersinia pestis
ccaucccccauggggccacc

SEQ ID NO: 2280736 - RNA, 14 nt, Yersinia pestis
ccaucauucccgau

SEQ ID NO: 2280737 - RNA, 16 nt, Yersinia pestis
ccauccgcaggaagca

SEQ ID NO: 2280738 - RNA, 20 nt, Yersinia pestis
ccaucgacuaauuaaacaag

SEQ ID NO: 2280739 - RNA, 19 nt, Yersinia pestis
ccaucuugucgucacccau

SEQ ID NO: 2280740 - RNA, 15 nt, Yersinia pestis
ccaucguauauccac

SEQ ID NO: 2280741 - RNA, 15 nt, Yersinia pestis
ccaucuuccagcauc

SEQ ID NO: 2280742 - RNA, 15 nt, Yersinia pestis
ccaucgucagccccu

SEQ ID NO: 2280743 - RNA, 13 nt, Yersinia pestis
ccaucgcaccaaa

SEQ ID NO: 2280744 - RNA, 13 nt, Yersinia pestis
ccaucgccccaaa

SEQ ID NO: 2280745 - RNA, 16 nt, Yersinia pestis
ccaucgccgacaaaau

SEQ ID NO: 2280746 - RNA, 22 nt, Yersinia pestis
ccaucgccgacaaaauccccca

SEQ ID NO: 2280747 - RNA, 18 nt, Yersinia pestis
ccauauguugccaccagc

SEQ ID NO: 2280748 - RNA, 16 nt, Yersinia pestis
ccauauuauuguuauu

SEQ ID NO: 2280749 - RNA, 22 nt, Yersinia pestis
ccauauccuggcgguaauaaau

SEQ ID NO: 2280750 - RNA, 17 nt, Yersinia pestis
ccauauccucaagaccg

SEQ ID NO: 2280751 - RNA, 16 nt, Yersinia pestis
ccauauccucaagacc

SEQ ID NO: 2280752 - RNA, 14 nt, Yersinia pestis
ccauacccaaacca

SEQ ID NO: 2280753 - RNA, 22 nt, Yersinia pestis
ccauaauucugccgacuaauau

SEQ ID NO: 2280754 - RNA, 12 nt, Yersinia pestis
ccauaauuccac

SEQ ID NO: 2280755 - RNA, 20 nt, Yersinia pestis
ccauacaaauaguaauaauu

SEQ ID NO: 2280756 - RNA, 21 nt, Yersinia pestis
ccaucaauaccaauaaaaccu

SEQ ID NO: 2280757 - RNA, 13 nt, Yersinia pestis
ccaucaauaccaa

SEQ ID NO: 2280758 - RNA, 13 nt, Yersinia pestis
ccaucacucugcu

SEQ ID NO: 2280759 - RNA, 11 nt, Yersinia pestis
ccaucaggaag

SEQ ID NO: 2280760 - RNA, 20 nt, Yersinia pestis
ccaggcugaacgcacaaugg

SEQ ID NO: 2280761 - RNA, 12 nt, Yersinia pestis
ccaggcuggcca

SEQ ID NO: 2280762 - RNA, 18 nt, Yersinia pestis
ccaggcuggccacuucca

SEQ ID NO: 2280763 - RNA, 20 nt, Yersinia pestis
ccaggggucgacguucauau

SEQ ID NO: 2280764 - RNA, 17 nt, Yersinia pestis
ccaggucaaucaauucu

SEQ ID NO: 2280765 - RNA, 16 nt, Yersinia pestis
ccaggacauccagcgg

SEQ ID NO: 2280766 - RNA, 17 nt, Yersinia pestis
ccaggccacuugggcug

SEQ ID NO: 2280767 - RNA, 18 nt, Yersinia pestis
ccaggcauuaaaaucacc

SEQ ID NO: 2280768 - RNA, 13 nt, Yersinia pestis
ccaggcaucaucu

SEQ ID NO: 2280769 - RNA, 20 nt, Yersinia pestis
ccagcgucgccguaaauugc

SEQ ID NO: 2280770 - RNA, 19 nt, Yersinia pestis
ccagcgucuucaguggcug

SEQ ID NO: 2280771 - RNA, 15 nt, Yersinia pestis
ccagcggcaccgccg

SEQ ID NO: 2280772 - RNA, 15 nt, Yersinia pestis
ccagcgggcgcagcc

SEQ ID NO: 2280773 - RNA, 16 nt, Yersinia pestis
ccagcgggcgcagcca

SEQ ID NO: 2280774 - RNA, 15 nt, Yersinia pestis
ccagcggcuuauucc

SEQ ID NO: 2280775 - RNA, 17 nt, Yersinia pestis
ccagcgccgauauacac

SEQ ID NO: 2280776 - RNA, 11 nt, Yersinia pestis
ccagcgcccgg

SEQ ID NO: 2280777 - RNA, 14 nt, Yersinia pestis
ccagcgccuguucc

SEQ ID NO: 2280778 - RNA, 21 nt, Yersinia pestis
ccccaauucacgcaaggccag

SEQ ID NO: 2280779 - RNA, 21 nt, Yersinia pestis
ccccacaaccugcgccaccca

SEQ ID NO: 2280780 - RNA, 14 nt, Yersinia pestis
ccccacggccagag

SEQ ID NO: 2280781 - RNA, 22 nt, Yersinia pestis
ccccaaauaaucagcucauuaa

SEQ ID NO: 2280782 - RNA, 18 nt, Yersinia pestis
ccccaauaagggccaccc

SEQ ID NO: 2280783 - RNA, 20 nt, Yersinia pestis
ccccaauucacgcaaggcca

SEQ ID NO: 2280784 - RNA, 12 nt, Yersinia pestis
ccccaaucaagc

SEQ ID NO: 2280785 - RNA, 23 nt, Yersinia pestis
cccauggcugaaauaacuuauua

SEQ ID NO: 2280786 - RNA, 14 nt, Yersinia pestis
cccauggggccacc

SEQ ID NO: 2280787 - RNA, 18 nt, Yersinia pestis
cccauuugucgcgccuga

SEQ ID NO: 2280788 - RNA, 13 nt, Yersinia pestis
cccauuuuauccu

SEQ ID NO: 2280789 - RNA, 22 nt, Yersinia pestis
cccauucaucaaacucugcauc

SEQ ID NO: 2280790 - RNA, 15 nt, Yersinia pestis
cccauguuaaugggg

SEQ ID NO: 2280791 - RNA, 18 nt, Yersinia pestis
cccauuccguuuaaacuc

SEQ ID NO: 2280792 - RNA, 13 nt, Yersinia pestis
ccccagagcgcaa

SEQ ID NO: 2280793 - RNA, 14 nt, Yersinia pestis
ccccagaugaaugg

SEQ ID NO: 2280794 - RNA, 14 nt, Yersinia pestis
ccccagcaaagcca

SEQ ID NO: 2280795 - RNA, 20 nt, Yersinia pestis
ccccagcaaagccaaaacca

SEQ ID NO: 2280796 - RNA, 21 nt, Yersinia pestis
cccccagccagaaugaacuga

SEQ ID NO: 2280797 - RNA, 19 nt, Yersinia pestis
cccccacucgccccacaau

SEQ ID NO: 2280798 - RNA, 15 nt, Yersinia pestis
cccccacucgcccca

SEQ ID NO: 2280799 - RNA, 12 nt, Yersinia pestis
ccccagccagaa

SEQ ID NO: 2280800 - RNA, 14 nt, Yersinia pestis
ccccccaagagaaa

SEQ ID NO: 2280801 - RNA, 20 nt, Yersinia pestis
cccccaucaacgacaacauc

SEQ ID NO: 2280802 - RNA, 19 nt, Yersinia pestis
cccccaguagcacaaugcc

SEQ ID NO: 2280803 - RNA, 15 nt, Yersinia pestis
ccccuuucaccaacc

SEQ ID NO: 2280804 - RNA, 13 nt, Yersinia pestis
ccccuucuucacc

SEQ ID NO: 2280805 - RNA, 19 nt, Yersinia pestis
ccccugccguuggcauaug

SEQ ID NO: 2280806 - RNA, 18 nt, Yersinia pestis
ccccgcuaccaagcccag

SEQ ID NO: 2280807 - RNA, 15 nt, Yersinia pestis
ccccgcguugucagc

SEQ ID NO: 2280808 - RNA, 21 nt, Yersinia pestis
ccccgcuucguccagaugcca

SEQ ID NO: 2280809 - RNA, 24 nt, Yersinia pestis
ccccucgaaaauaaccaccucgga

SEQ ID NO: 2280810 - RNA, 16 nt, Yersinia pestis
ccccuuuuauuuuuac

SEQ ID NO: 2280811 - RNA, 11 nt, Yersinia pestis
cccgaaucaag

SEQ ID NO: 2280812 - RNA, 19 nt, Yersinia pestis
cccgaaucacugacugaug

SEQ ID NO: 2280813 - RNA, 18 nt, Yersinia pestis
cccgaagcucaagcuggc

SEQ ID NO: 2280814 - RNA, 18 nt, Yersinia pestis
cccgcaaccugacugcug

SEQ ID NO: 2280815 - RNA, 16 nt, Yersinia pestis
cccgauuucaacgcac

SEQ ID NO: 2280816 - RNA, 20 nt, Yersinia pestis
cccgauuucaacgcaccauc

SEQ ID NO: 2280817 - RNA, 20 nt, Yersinia pestis
cccgauuauugugccgccuu

SEQ ID NO: 2280818 - RNA, 17 nt, Yersinia pestis
cccgaugauugcaucau

SEQ ID NO: 2280819 - RNA, 12 nt, Yersinia pestis
cccgcaauuuua

SEQ ID NO: 2280820 - RNA, 22 nt, Yersinia pestis
cccgaugaacugacacacacca

SEQ ID NO: 2280821 - RNA, 22 nt, Yersinia pestis
cccgaucugagccauuaucguu

SEQ ID NO: 2280822 - RNA, 19 nt, Yersinia pestis
cccgaucaggugaugucag

SEQ ID NO: 2280823 - RNA, 18 nt, Yersinia pestis
cccaaaaucaaauacugu

SEQ ID NO: 2280824 - RNA, 15 nt, Yersinia pestis
cccaaaccaacaaua

SEQ ID NO: 2280825 - RNA, 11 nt, Yersinia pestis
ccauuuugcug

SEQ ID NO: 2280826 - RNA, 12 nt, Yersinia pestis
ccauuucucuga

SEQ ID NO: 2280827 - RNA, 22 nt, Yersinia pestis
ccauuucuuagaccaccgccau

SEQ ID NO: 2280828 - RNA, 21 nt, Yersinia pestis
ccauuucugguugugcuucag

SEQ ID NO: 2280829 - RNA, 14 nt, Yersinia pestis
ccauuugcucuggc

SEQ ID NO: 2280830 - RNA, 23 nt, Yersinia pestis
ccauuuggugauaagcugcguga

SEQ ID NO: 2280831 - RNA, 20 nt, Yersinia pestis
ccauuuuaaucucuccauga

SEQ ID NO: 2280832 - RNA, 12 nt, Yersinia pestis
ccauuuuauccu

SEQ ID NO: 2280833 - RNA, 14 nt, Yersinia pestis
ccauuuccaauacc

SEQ ID NO: 2280834 - RNA, 13 nt, Yersinia pestis
ccauuuauuucca

SEQ ID NO: 2280835 - RNA, 23 nt, Yersinia pestis
ccauuguugaauaccaagccaaa

SEQ ID NO: 2280836 - RNA, 22 nt, Yersinia pestis
ccaucuuugauuuaaauauuau

SEQ ID NO: 2280837 - RNA, 16 nt, Yersinia pestis
ccauugcaccaauaac

SEQ ID NO: 2280838 - RNA, 18 nt, Yersinia pestis
ccauugcaccaauaacug

SEQ ID NO: 2280839 - RNA, 22 nt, Yersinia pestis
ccauugauggccuugaaucaaa

SEQ ID NO: 2280840 - RNA, 18 nt, Yersinia pestis
ccauugaugcaguacuca

SEQ ID NO: 2280841 - RNA, 18 nt, Yersinia pestis
cccaccaagggucaucaa

SEQ ID NO: 2280842 - RNA, 14 nt, Yersinia pestis
cccaccaaaccauu

SEQ ID NO: 2280843 - RNA, 17 nt, Yersinia pestis
cccaaccaucuccggcu

SEQ ID NO: 2280844 - RNA, 21 nt, Yersinia pestis
cccaacaacgcuccagguuca

SEQ ID NO: 2280845 - RNA, 21 nt, Yersinia pestis
cccaaagcgcagugcucauua

SEQ ID NO: 2280846 - RNA, 17 nt, Yersinia pestis
cccaaaugagcagcaau

SEQ ID NO: 2280847 - RNA, 21 nt, Yersinia pestis
cccaaauagcuggcauccuca

SEQ ID NO: 2280848 - RNA, 18 nt, Yersinia pestis
cccacuauucuccaacaa

SEQ ID NO: 2280849 - RNA, 16 nt, Yersinia pestis
cccacguucccccgcc

SEQ ID NO: 2280850 - RNA, 21 nt, Yersinia pestis
cccacguuuugacgcguagag

SEQ ID NO: 2280851 - RNA, 12 nt, Yersinia pestis
cccagccucugg

SEQ ID NO: 2280852 - RNA, 20 nt, Yersinia pestis
cccaggcaaucucuccccaa

SEQ ID NO: 2280853 - RNA, 22 nt, Yersinia pestis
cccaggcaaucucuccccaagc

SEQ ID NO: 2280854 - RNA, 13 nt, Yersinia pestis
cccgugcggcagu

SEQ ID NO: 2280855 - RNA, 22 nt, Yersinia pestis
cccguucacuuacugccaaaga

SEQ ID NO: 2280856 - RNA, 16 nt, Yersinia pestis
cccguugcauuuuucu

SEQ ID NO: 2280857 - RNA, 16 nt, Yersinia pestis
cccguuugcagcucaa

SEQ ID NO: 2280858 - RNA, 20 nt, Yersinia pestis
cccguuugcagcucaaagac

SEQ ID NO: 2280859 - RNA, 21 nt, Yersinia pestis
cccgucauccuucaaguuguc

SEQ ID NO: 2280860 - RNA, 22 nt, Yersinia pestis
cccuacgggaaauaacugguga

SEQ ID NO: 2280861 - RNA, 18 nt, Yersinia pestis
cccuaccguaucaacgua

SEQ ID NO: 2280862 - RNA, 12 nt, Yersinia pestis
cccuacagaaaa

SEQ ID NO: 2280863 - RNA, 23 nt, Yersinia pestis
cccuacauaaaaauagcuucccu

SEQ ID NO: 2280864 - RNA, 19 nt, Yersinia pestis
cccuaaugcgcucaccaag

SEQ ID NO: 2280865 - RNA, 18 nt, Yersinia pestis
cccuaacucuuuggaugg

SEQ ID NO: 2280866 - RNA, 19 nt, Yersinia pestis
cccucaauagcuaauaauu

SEQ ID NO: 2280867 - RNA, 16 nt, Yersinia pestis
cccuagcgaaguauua

SEQ ID NO: 2280868 - RNA, 13 nt, Yersinia pestis
cccuacuggcuga

SEQ ID NO: 2280869 - RNA, 24 nt, Yersinia pestis
cccuacuggcugaaguuaaugaca

SEQ ID NO: 2280870 - RNA, 13 nt, Yersinia pestis
cccucccuucgca

SEQ ID NO: 2280871 - RNA, 14 nt, Yersinia pestis
cccuccgccagcaa

SEQ ID NO: 2280872 - RNA, 17 nt, Yersinia pestis
cccuccggcgcccuucc

SEQ ID NO: 2280873 - RNA, 22 nt, Yersinia pestis
cccucacaagccacgccauuca

SEQ ID NO: 2280874 - RNA, 23 nt, Yersinia pestis
cccucacaagccacgccauucau

SEQ ID NO: 2280875 - RNA, 12 nt, Yersinia pestis
cccucagccaaa

SEQ ID NO: 2280876 - RNA, 16 nt, Yersinia pestis
cccgggaggagcugcg

SEQ ID NO: 2280877 - RNA, 15 nt, Yersinia pestis
cccggugacccgugc

SEQ ID NO: 2280878 - RNA, 22 nt, Yersinia pestis
cccgguaaagugacucugcccu

SEQ ID NO: 2280879 - RNA, 19 nt, Yersinia pestis
cccggcuaggaggccagga

SEQ ID NO: 2280880 - RNA, 23 nt, Yersinia pestis
cccggcugaccuguuguaacacu

SEQ ID NO: 2280881 - RNA, 22 nt, Yersinia pestis
cccggccuugcccaucaaccac

SEQ ID NO: 2280882 - RNA, 21 nt, Yersinia pestis
cccggccgccauugagucguu

SEQ ID NO: 2280883 - RNA, 16 nt, Yersinia pestis
cccgcuugucuugaaa

SEQ ID NO: 2280884 - RNA, 15 nt, Yersinia pestis
cccggaucacuggcu

SEQ ID NO: 2280885 - RNA, 14 nt, Yersinia pestis
cccggcaaguugau

SEQ ID NO: 2280886 - RNA, 16 nt, Yersinia pestis
cccgcgcuuccaggcu

SEQ ID NO: 2280887 - RNA, 15 nt, Yersinia pestis
cccgcguugucagcc

SEQ ID NO: 2280888 - RNA, 13 nt, Yersinia pestis
cccgcuaacaugc

SEQ ID NO: 2280889 - RNA, 22 nt, Yersinia pestis
cccgcuggaagucugcuuuauu

SEQ ID NO: 2280890 - RNA, 12 nt, Yersinia pestis
cccgcucuguca

SEQ ID NO: 2280891 - RNA, 13 nt, Yersinia pestis
cccgcuaucacua

SEQ ID NO: 2280892 - RNA, 14 nt, Yersinia pestis
cccgcuaucacuag

SEQ ID NO: 2280893 - RNA, 11 nt, Yersinia pestis
cccgccucuga

SEQ ID NO: 2280894 - RNA, 15 nt, Yersinia pestis
cccgcgacggagaga

SEQ ID NO: 2280895 - RNA, 20 nt, Yersinia pestis
cccgccuguauccagcagcg

SEQ ID NO: 2280896 - RNA, 16 nt, Yersinia pestis
cccgcccgguaccgcc

SEQ ID NO: 2280897 - RNA, 18 nt, Yersinia pestis
cccgccauggcaugccau

SEQ ID NO: 2280898 - RNA, 18 nt, Yersinia pestis
cccgcagcggcuagcagc

SEQ ID NO: 2280899 - RNA, 11 nt, Yersinia pestis
cccgcaggcgg

SEQ ID NO: 2280900 - RNA, 19 nt, Yersinia pestis
cgucaagacaacaaacagu

SEQ ID NO: 2280901 - RNA, 14 nt, Yersinia pestis
cgucaaguucauau

SEQ ID NO: 2280902 - RNA, 12 nt, Yersinia pestis
cgucacuuccau

SEQ ID NO: 2280903 - RNA, 21 nt, Yersinia pestis
cgucacgguauuggagcugaa

SEQ ID NO: 2280904 - RNA, 12 nt, Yersinia pestis
cgucacguacug

SEQ ID NO: 2280905 - RNA, 17 nt, Yersinia pestis
cgucacuaaauccaaau

SEQ ID NO: 2280906 - RNA, 14 nt, Yersinia pestis
cgucacgauagcaa

SEQ ID NO: 2280907 - RNA, 12 nt, Yersinia pestis
cgucaccuuucu

SEQ ID NO: 2280908 - RNA, 23 nt, Yersinia pestis
cgucaccagaucuggguuagaaa

SEQ ID NO: 2280909 - RNA, 14 nt, Yersinia pestis
cgucauaaauaaag

SEQ ID NO: 2280910 - RNA, 16 nt, Yersinia pestis
cgucauaaauaaagau

SEQ ID NO: 2280911 - RNA, 21 nt, Yersinia pestis
cgucauaccauucucugucuu

SEQ ID NO: 2280912 - RNA, 21 nt, Yersinia pestis
cgucagucuugcugccaacgc

SEQ ID NO: 2280913 - RNA, 21 nt, Yersinia pestis
cgucaucgggguuugucagcc

SEQ ID NO: 2280914 - RNA, 18 nt, Yersinia pestis
cgucaugcugaaucugua

SEQ ID NO: 2280915 - RNA, 16 nt, Yersinia pestis
cgucaucaucuucuuc

SEQ ID NO: 2280916 - RNA, 12 nt, Yersinia pestis
cgucagauuagu

SEQ ID NO: 2280917 - RNA, 13 nt, Yersinia pestis
cgucagaugcuga

SEQ ID NO: 2280918 - RNA, 18 nt, Yersinia pestis
cgucagaucgcgcccauc

SEQ ID NO: 2280919 - RNA, 15 nt, Yersinia pestis
cgucagccccugcca

SEQ ID NO: 2280920 - RNA, 19 nt, Yersinia pestis
cgucaggggguucacgccu

SEQ ID NO: 2280921 - RNA, 16 nt, Yersinia pestis
cguaacucaccgucug

SEQ ID NO: 2280922 - RNA, 18 nt, Yersinia pestis
cguagaacgucaccgcca

SEQ ID NO: 2280923 - RNA, 17 nt, Yersinia pestis
cguagcacacgacugag

SEQ ID NO: 2280924 - RNA, 15 nt, Yersinia pestis
cguagccuucaaggu

SEQ ID NO: 2280925 - RNA, 15 nt, Yersinia pestis
cguaggcaaacaugg

SEQ ID NO: 2280926 - RNA, 19 nt, Yersinia pestis
cguagguaguggcugauac

SEQ ID NO: 2280927 - RNA, 19 nt, Yersinia pestis
cguauugccucggcaaguu

SEQ ID NO: 2280928 - RNA, 18 nt, Yersinia pestis
cguauucggaucacgccc

SEQ ID NO: 2280929 - RNA, 20 nt, Yersinia pestis
cguaucuuguaguaaccaca

SEQ ID NO: 2280930 - RNA, 19 nt, Yersinia pestis
cguauguuuuuaacaaaau

SEQ ID NO: 2280931 - RNA, 15 nt, Yersinia pestis
cguauggggaaaagc

SEQ ID NO: 2280932 - RNA, 15 nt, Yersinia pestis
cguauauuggccugc

SEQ ID NO: 2280933 - RNA, 15 nt, Yersinia pestis
cguauagauuauuuu

SEQ ID NO: 2280934 - RNA, 23 nt, Yersinia pestis
cguaucacccgccucuaaaucug

SEQ ID NO: 2280935 - RNA, 16 nt, Yersinia pestis
cguaucaucagugcua

SEQ ID NO: 2280936 - RNA, 13 nt, Yersinia pestis
cguaucagccccu

SEQ ID NO: 2280937 - RNA, 21 nt, Yersinia pestis
cguaucagccccuaaauccug

SEQ ID NO: 2280938 - RNA, 14 nt, Yersinia pestis
cguauaaaacugug

SEQ ID NO: 2280939 - RNA, 23 nt, Yersinia pestis
cguagugagucaggaaacuggcc

SEQ ID NO: 2280940 - RNA, 15 nt, Yersinia pestis
cguaaagaaaaaaug

SEQ ID NO: 2280941 - RNA, 18 nt, Yersinia pestis
cguaaacugccguaaaca

SEQ ID NO: 2280942 - RNA, 14 nt, Yersinia pestis
cguaaagacgccgu

SEQ ID NO: 2280943 - RNA, 23 nt, Yersinia pestis
cguaaacauggcucucuuuuuuc

SEQ ID NO: 2280944 - RNA, 18 nt, Yersinia pestis
cguaaacguucugccaau

SEQ ID NO: 2280945 - RNA, 14 nt, Yersinia pestis
cguaaagacgccgg

SEQ ID NO: 2280946 - RNA, 19 nt, Yersinia pestis
cguaacccccagccagaau

SEQ ID NO: 2280947 - RNA, 17 nt, Yersinia pestis
cguaacgaauucagcag

SEQ ID NO: 2280948 - RNA, 20 nt, Yersinia pestis
cguaacgaauucagcagcgc

SEQ ID NO: 2280949 - RNA, 20 nt, Yersinia pestis
cguaaacaaugaccaucuuc

SEQ ID NO: 2280950 - RNA, 15 nt, Yersinia pestis
cgguuugagcuugcu

SEQ ID NO: 2280951 - RNA, 19 nt, Yersinia pestis
cgguuugagcuugcugcug

SEQ ID NO: 2280952 - RNA, 16 nt, Yersinia pestis
cgguuuccggcucuua

SEQ ID NO: 2280953 - RNA, 23 nt, Yersinia pestis
cgguuucacgaaacgcauaucca

SEQ ID NO: 2280954 - RNA, 16 nt, Yersinia pestis
cgguuuaaucaaugug

SEQ ID NO: 2280955 - RNA, 15 nt, Yersinia pestis
cgguuucaacaucca

SEQ ID NO: 2280956 - RNA, 21 nt, Yersinia pestis
cgguuucaaccccuucuucac

SEQ ID NO: 2280957 - RNA, 23 nt, Yersinia pestis
cgguuuaccggggcgaucccuga

SEQ ID NO: 2280958 - RNA, 16 nt, Yersinia pestis
cgguuuauauuuuugg

SEQ ID NO: 2280959 - RNA, 12 nt, Yersinia pestis
cgguuauuuucu

SEQ ID NO: 2280960 - RNA, 15 nt, Yersinia pestis
cgguuaucuggaauu

SEQ ID NO: 2280961 - RNA, 19 nt, Yersinia pestis
cgguugcuuuuaacuccuu

SEQ ID NO: 2280962 - RNA, 20 nt, Yersinia pestis
cgguugcuguaaugccuggu

SEQ ID NO: 2280963 - RNA, 18 nt, Yersinia pestis
cgguuaaacuucuuuauc

SEQ ID NO: 2280964 - RNA, 19 nt, Yersinia pestis
cgguuaaacuucuuuaucu

SEQ ID NO: 2280965 - RNA, 22 nt, Yersinia pestis
cgguuaaagacauaucacaguu

SEQ ID NO: 2280966 - RNA, 16 nt, Yersinia pestis
cgguuacuuccauaaa

SEQ ID NO: 2280967 - RNA, 19 nt, Yersinia pestis
cgguuauaaaacagccacg

SEQ ID NO: 2280968 - RNA, 14 nt, Yersinia pestis
cgguuaucacauca

SEQ ID NO: 2280969 - RNA, 15 nt, Yersinia pestis
cgguuaaaacaguaa

SEQ ID NO: 2280970 - RNA, 21 nt, Yersinia pestis
cgguggcaugccaauuauucu

SEQ ID NO: 2280971 - RNA, 21 nt, Yersinia pestis
cggucuccacguagaucaaca

SEQ ID NO: 2280972 - RNA, 18 nt, Yersinia pestis
cggucgccaaggaugccu

SEQ ID NO: 2280973 - RNA, 14 nt, Yersinia pestis
cggucaucagcccu

SEQ ID NO: 2280974 - RNA, 18 nt, Yersinia pestis
cggucacaccagacagaa

SEQ ID NO: 2280975 - RNA, 20 nt, Yersinia pestis
cggucauuguagauggccau

SEQ ID NO: 2280976 - RNA, 16 nt, Yersinia pestis
cggccuucaauaccuu

SEQ ID NO: 2280977 - RNA, 16 nt, Yersinia pestis
cggcggagagaaauag

SEQ ID NO: 2280978 - RNA, 15 nt, Yersinia pestis
cggcggcgcuggcgu

SEQ ID NO: 2280979 - RNA, 14 nt, Yersinia pestis
cggcguaaauaaaa

SEQ ID NO: 2280980 - RNA, 14 nt, Yersinia pestis
cggcuucagcaccu

SEQ ID NO: 2280981 - RNA, 22 nt, Yersinia pestis
cggcuuaccgccgccagccuug

SEQ ID NO: 2280982 - RNA, 22 nt, Yersinia pestis
cggcuuaaccaacaacuccacu

SEQ ID NO: 2280983 - RNA, 14 nt, Yersinia pestis
cggcuuucaauaaa

SEQ ID NO: 2280984 - RNA, 16 nt, Yersinia pestis
cggcuuuauaguccuu

SEQ ID NO: 2280985 - RNA, 16 nt, Yersinia pestis
cggcuuuuaucuucca

SEQ ID NO: 2280986 - RNA, 18 nt, Yersinia pestis
cggcugguaacagagccu

SEQ ID NO: 2280987 - RNA, 13 nt, Yersinia pestis
cggcugcaauaag

SEQ ID NO: 2280988 - RNA, 12 nt, Yersinia pestis
cggcuccugccg

SEQ ID NO: 2280989 - RNA, 18 nt, Yersinia pestis
cggcucgcccacggcaca

SEQ ID NO: 2280990 - RNA, 20 nt, Yersinia pestis
cggcucacacacuaauaaua

SEQ ID NO: 2280991 - RNA, 15 nt, Yersinia pestis
cggcguucagcaaua

SEQ ID NO: 2280992 - RNA, 18 nt, Yersinia pestis
cggcguuaaugccacccc

SEQ ID NO: 2280993 - RNA, 13 nt, Yersinia pestis
cgggcaccaugcc

SEQ ID NO: 2280994 - RNA, 15 nt, Yersinia pestis
cgggaauaaucaauu

SEQ ID NO: 2280995 - RNA, 17 nt, Yersinia pestis
cgggccgcauucaccac

SEQ ID NO: 2280996 - RNA, 22 nt, Yersinia pestis
cgggccuuugcuuuucugccua

SEQ ID NO: 2280997 - RNA, 17 nt, Yersinia pestis
cgggcgaacagaaauca

SEQ ID NO: 2280998 - RNA, 22 nt, Yersinia pestis
cgggcgcagccacaugauuacc

SEQ ID NO: 2280999 - RNA, 19 nt, Yersinia pestis
cgggcgcuuaaauaaaaca

SEQ ID NO: 2281000 - RNA, 20 nt, Yersinia pestis
cgggcgcugagcgggcggca

SEQ ID NO: 2281001 - RNA, 21 nt, Yersinia pestis
cgggcuaucaucaaaggcaau

SEQ ID NO: 2281002 - RNA, 22 nt, Yersinia pestis
cgggcuaucaucaaaggcaaua

SEQ ID NO: 2281003 - RNA, 19 nt, Yersinia pestis
cggggucuuuucgguaaua

SEQ ID NO: 2281004 - RNA, 14 nt, Yersinia pestis
cggguauaucacuu

SEQ ID NO: 2281005 - RNA, 15 nt, Yersinia pestis
cgggcuucaccaucu

SEQ ID NO: 2281006 - RNA, 17 nt, Yersinia pestis
cgggcuuccaucaggaa

SEQ ID NO: 2281007 - RNA, 21 nt, Yersinia pestis
cgggcugucggcgaugaaaaa

SEQ ID NO: 2281008 - RNA, 16 nt, Yersinia pestis
cgggcuugcugcaacc

SEQ ID NO: 2281009 - RNA, 20 nt, Yersinia pestis
cgggcuuuacagucgcugcu

SEQ ID NO: 2281010 - RNA, 22 nt, Yersinia pestis
cgggcuuuuuuucggcaucuua

SEQ ID NO: 2281011 - RNA, 22 nt, Yersinia pestis
cggggguugucagcagucugau

SEQ ID NO: 2281012 - RNA, 22 nt, Yersinia pestis
cggggguuaaggggcucacccg

SEQ ID NO: 2281013 - RNA, 21 nt, Yersinia pestis
cgcucuaacgucagauaaaaa

SEQ ID NO: 2281014 - RNA, 23 nt, Yersinia pestis
cgcucggcucgaaccugaacgca

SEQ ID NO: 2281015 - RNA, 23 nt, Yersinia pestis
cgcugagguucuccaacaaccgu

SEQ ID NO: 2281016 - RNA, 17 nt, Yersinia pestis
cgcugauaaccagcagc

SEQ ID NO: 2281017 - RNA, 16 nt, Yersinia pestis
cgcugaucaucaucaa

SEQ ID NO: 2281018 - RNA, 18 nt, Yersinia pestis
cgcugcgcaagcgcugcu

SEQ ID NO: 2281019 - RNA, 17 nt, Yersinia pestis
cgcugcucaaucaccga

SEQ ID NO: 2281020 - RNA, 19 nt, Yersinia pestis
cgcugguuaucacagcaaa

SEQ ID NO: 2281021 - RNA, 19 nt, Yersinia pestis
cgcugguggcuugaugaua

SEQ ID NO: 2281022 - RNA, 18 nt, Yersinia pestis
cgcuguucaucgcaauuc

SEQ ID NO: 2281023 - RNA, 18 nt, Yersinia pestis
cgcuguaggugucaccaa

SEQ ID NO: 2281024 - RNA, 21 nt, Yersinia pestis
cgcuguacaacaagaucccaa

SEQ ID NO: 2281025 - RNA, 14 nt, Yersinia pestis
cgcuuuuuacccag

SEQ ID NO: 2281026 - RNA, 16 nt, Yersinia pestis
cgcuuuuaccgaugca

SEQ ID NO: 2281027 - RNA, 19 nt, Yersinia pestis
cggaaacaccuucacugaa

SEQ ID NO: 2281028 - RNA, 15 nt, Yersinia pestis
cggaaacguccaggg

SEQ ID NO: 2281029 - RNA, 20 nt, Yersinia pestis
cggaaacguucaggcuuucg

SEQ ID NO: 2281030 - RNA, 22 nt, Yersinia pestis
cgcuuuagugacuaauuguuug

SEQ ID NO: 2281031 - RNA, 19 nt, Yersinia pestis
cgcuuuacuccucugccua

SEQ ID NO: 2281032 - RNA, 17 nt, Yersinia pestis
cgcuugugcucacguca

SEQ ID NO: 2281033 - RNA, 17 nt, Yersinia pestis
cgcuuagcaggcccuuu

SEQ ID NO: 2281034 - RNA, 22 nt, Yersinia pestis
cgcuuaccaaaacgccaccagc

SEQ ID NO: 2281035 - RNA, 15 nt, Yersinia pestis
cgcggcaaagucugg

SEQ ID NO: 2281036 - RNA, 17 nt, Yersinia pestis
cgcggaugcgcgcguca

SEQ ID NO: 2281037 - RNA, 17 nt, Yersinia pestis
cgcgccggauucaaggc

SEQ ID NO: 2281038 - RNA, 20 nt, Yersinia pestis
cgcggcugguaacagagccu

SEQ ID NO: 2281039 - RNA, 17 nt, Yersinia pestis
cgcuaugcucagcaacc

SEQ ID NO: 2281040 - RNA, 23 nt, Yersinia pestis
cgcuaucugcugaccauuacgua

SEQ ID NO: 2281041 - RNA, 16 nt, Yersinia pestis
cgcuacucccggcagc

SEQ ID NO: 2281042 - RNA, 19 nt, Yersinia pestis
cgcuauuuguaucaaugaa

SEQ ID NO: 2281043 - RNA, 24 nt, Yersinia pestis
cgcuauuucaaugggaugcccaca

SEQ ID NO: 2281044 - RNA, 14 nt, Yersinia pestis
cgcuauuucucucu

SEQ ID NO: 2281045 - RNA, 14 nt, Yersinia pestis
cgcuaacaugccac

SEQ ID NO: 2281046 - RNA, 13 nt, Yersinia pestis
cgcuaaccuuaac

SEQ ID NO: 2281047 - RNA, 16 nt, Yersinia pestis
cgcgguucgcagcuuc

SEQ ID NO: 2281048 - RNA, 17 nt, Yersinia pestis
cgcgguucgcagcuucc

SEQ ID NO: 2281049 - RNA, 14 nt, Yersinia pestis
cgcgguuacaccaa

SEQ ID NO: 2281050 - RNA, 18 nt, Yersinia pestis
cgcgguauuuggcauuca

SEQ ID NO: 2281051 - RNA, 17 nt, Yersinia pestis
cggaggauauuuauuau

SEQ ID NO: 2281052 - RNA, 22 nt, Yersinia pestis
cggaggauauuuauuuccgaau

SEQ ID NO: 2281053 - RNA, 20 nt, Yersinia pestis
cggauaaccgcauucccugc

SEQ ID NO: 2281054 - RNA, 22 nt, Yersinia pestis
cggauaaccgcgaagaggguuu

SEQ ID NO: 2281055 - RNA, 18 nt, Yersinia pestis
cggauaacggcggcaaua

SEQ ID NO: 2281056 - RNA, 15 nt, Yersinia pestis
cggaaauaaggcgca

SEQ ID NO: 2281057 - RNA, 14 nt, Yersinia pestis
cggaaccgccgccu

SEQ ID NO: 2281058 - RNA, 22 nt, Yersinia pestis
cggaaaugccgauaaaaacuau

SEQ ID NO: 2281059 - RNA, 16 nt, Yersinia pestis
cggaacucagacuucu

SEQ ID NO: 2281060 - RNA, 17 nt, Yersinia pestis
cggaacucaucuuucuc

SEQ ID NO: 2281061 - RNA, 18 nt, Yersinia pestis
cggcaaaagaacgugcug

SEQ ID NO: 2281062 - RNA, 13 nt, Yersinia pestis
cggauucacccau

SEQ ID NO: 2281063 - RNA, 16 nt, Yersinia pestis
cggauugcaaauccgu

SEQ ID NO: 2281064 - RNA, 21 nt, Yersinia pestis
cggaugauauccacuaacccc

SEQ ID NO: 2281065 - RNA, 17 nt, Yersinia pestis
cggaugcaucgggcaua

SEQ ID NO: 2281066 - RNA, 20 nt, Yersinia pestis
cggauggcgcgguucuagua

SEQ ID NO: 2281067 - RNA, 17 nt, Yersinia pestis
cggcagcgagcacugcc

SEQ ID NO: 2281068 - RNA, 12 nt, Yersinia pestis
cggcauaacagg

SEQ ID NO: 2281069 - RNA, 17 nt, Yersinia pestis
cggcauaacaggugcag

SEQ ID NO: 2281070 - RNA, 18 nt, Yersinia pestis
cggcauaauuucaggucg

SEQ ID NO: 2281071 - RNA, 12 nt, Yersinia pestis
cggcaucaccaa

SEQ ID NO: 2281072 - RNA, 13 nt, Yersinia pestis
cggcaucaccaaa

SEQ ID NO: 2281073 - RNA, 20 nt, Yersinia pestis
cggcagggcgguaacgcaga

SEQ ID NO: 2281074 - RNA, 16 nt, Yersinia pestis
cggcaccaaccauuga

SEQ ID NO: 2281075 - RNA, 14 nt, Yersinia pestis
cggcaacagcgccu

SEQ ID NO: 2281076 - RNA, 14 nt, Yersinia pestis
cggccgggcugaca

SEQ ID NO: 2281077 - RNA, 22 nt, Yersinia pestis
cggcccugagguugcucagcgg

SEQ ID NO: 2281078 - RNA, 16 nt, Yersinia pestis
cggcccggccaggcuc

SEQ ID NO: 2281079 - RNA, 22 nt, Yersinia pestis
cggcaucgaguccguuaaaaaa

SEQ ID NO: 2281080 - RNA, 18 nt, Yersinia pestis
cggccaguguuuucucca

SEQ ID NO: 2281081 - RNA, 19 nt, Yersinia pestis
cgccaguaaacagccagca

SEQ ID NO: 2281082 - RNA, 23 nt, Yersinia pestis
cgccagguaagaaagagaugacc

SEQ ID NO: 2281083 - RNA, 22 nt, Yersinia pestis
cgccagggguaagauccaccac

SEQ ID NO: 2281084 - RNA, 20 nt, Yersinia pestis
cgccauaaugcggcucucuu

SEQ ID NO: 2281085 - RNA, 14 nt, Yersinia pestis
cgccauauccaacu

SEQ ID NO: 2281086 - RNA, 12 nt, Yersinia pestis
cgccaucaauaa

SEQ ID NO: 2281087 - RNA, 14 nt, Yersinia pestis
cgccaucaauaauu

SEQ ID NO: 2281088 - RNA, 17 nt, Yersinia pestis
cgccaguggcaucaaua

SEQ ID NO: 2281089 - RNA, 19 nt, Yersinia pestis
cgccaguguugccauggcc

SEQ ID NO: 2281090 - RNA, 13 nt, Yersinia pestis
cgcauaagacacc

SEQ ID NO: 2281091 - RNA, 13 nt, Yersinia pestis
cgccaauucacgc

SEQ ID NO: 2281092 - RNA, 14 nt, Yersinia pestis
cgccaauuuuguag

SEQ ID NO: 2281093 - RNA, 22 nt, Yersinia pestis
cgccaauggggccauaagugca

SEQ ID NO: 2281094 - RNA, 20 nt, Yersinia pestis
cgccaccaaugcauccaagc

SEQ ID NO: 2281095 - RNA, 22 nt, Yersinia pestis
cgccacacaauacauagaagcu

SEQ ID NO: 2281096 - RNA, 23 nt, Yersinia pestis
cgccacagcaacaggguaauaac

SEQ ID NO: 2281097 - RNA, 19 nt, Yersinia pestis
cgccagccccgcuaccaag

SEQ ID NO: 2281098 - RNA, 16 nt, Yersinia pestis
cgcccagacgccggcc

SEQ ID NO: 2281099 - RNA, 20 nt, Yersinia pestis
cgccaugcucagaaaccugu

SEQ ID NO: 2281100 - RNA, 18 nt, Yersinia pestis
cgccaugauaaccacaac

SEQ ID NO: 2281101 - RNA, 18 nt, Yersinia pestis
cgcccaagcuuggccccu

SEQ ID NO: 2281102 - RNA, 16 nt, Yersinia pestis
cgcccaacucuuuagc

SEQ ID NO: 2281103 - RNA, 21 nt, Yersinia pestis
cgccaugagaaccaguucugg

SEQ ID NO: 2281104 - RNA, 22 nt, Yersinia pestis
cgccauccuuuacuccccugcc

SEQ ID NO: 2281105 - RNA, 21 nt, Yersinia pestis
cgccaucagcgccgccucuuc

SEQ ID NO: 2281106 - RNA, 13 nt, Yersinia pestis
cgcccggcugacc

SEQ ID NO: 2281107 - RNA, 17 nt, Yersinia pestis
cgcccgcggccaauagc

SEQ ID NO: 2281108 - RNA, 17 nt, Yersinia pestis
cgcccgcgccagauguu

SEQ ID NO: 2281109 - RNA, 13 nt, Yersinia pestis
cgcccgcgccaga

SEQ ID NO: 2281110 - RNA, 20 nt, Yersinia pestis
cgccccuuagcgcacgggga

SEQ ID NO: 2281111 - RNA, 18 nt, Yersinia pestis
cgccccugcgaucugccu

SEQ ID NO: 2281112 - RNA, 13 nt, Yersinia pestis
cgccccgccccug

SEQ ID NO: 2281113 - RNA, 21 nt, Yersinia pestis
cgcccccaauaagggccaccc

SEQ ID NO: 2281114 - RNA, 23 nt, Yersinia pestis
cgcccccgugguuguaucacaaa

SEQ ID NO: 2281115 - RNA, 14 nt, Yersinia pestis
cgccccgauaaaug

SEQ ID NO: 2281116 - RNA, 19 nt, Yersinia pestis
cgccccacaaugucccguc

SEQ ID NO: 2281117 - RNA, 22 nt, Yersinia pestis
cgauuaaacgucucuuuuucau

SEQ ID NO: 2281118 - RNA, 16 nt, Yersinia pestis
cgauuacccaccaccu

SEQ ID NO: 2281119 - RNA, 19 nt, Yersinia pestis
cgcaaacggguggccgccg

SEQ ID NO: 2281120 - RNA, 14 nt, Yersinia pestis
cgcaaaucaccuug

SEQ ID NO: 2281121 - RNA, 23 nt, Yersinia pestis
cgcaaagagaacgggcaaccugu

SEQ ID NO: 2281122 - RNA, 20 nt, Yersinia pestis
cgcaaagcgggccagcaacc

SEQ ID NO: 2281123 - RNA, 15 nt, Yersinia pestis
cgcaauaucaaaacu

SEQ ID NO: 2281124 - RNA, 13 nt, Yersinia pestis
cgcacggcuacug

SEQ ID NO: 2281125 - RNA, 12 nt, Yersinia pestis
cgcaccagauuu

SEQ ID NO: 2281126 - RNA, 14 nt, Yersinia pestis
cgcaccacugucag

SEQ ID NO: 2281127 - RNA, 17 nt, Yersinia pestis
cgcacccgcuacgguag

SEQ ID NO: 2281128 - RNA, 13 nt, Yersinia pestis
cgcaccagcucaa

SEQ ID NO: 2281129 - RNA, 20 nt, Yersinia pestis
cgcaccauccagcaaaucau

SEQ ID NO: 2281130 - RNA, 22 nt, Yersinia pestis
cgcacugggucaucacccagca

SEQ ID NO: 2281131 - RNA, 17 nt, Yersinia pestis
cgcacuggucaguauaa

SEQ ID NO: 2281132 - RNA, 22 nt, Yersinia pestis
cgcacuuaaugccgcugaucag

SEQ ID NO: 2281133 - RNA, 22 nt, Yersinia pestis
cgcacuugaucaggggacaacc

SEQ ID NO: 2281134 - RNA, 21 nt, Yersinia pestis
cgcacugagagcauaacccca

SEQ ID NO: 2281135 - RNA, 23 nt, Yersinia pestis
cgcacugagggugauaucgucag

SEQ ID NO: 2281136 - RNA, 22 nt, Yersinia pestis
cgcagccaacggagcguacacg

SEQ ID NO: 2281137 - RNA, 23 nt, Yersinia pestis
cgcaggaacgaaguuagacccaa

SEQ ID NO: 2281138 - RNA, 11 nt, Yersinia pestis
cgcagcuucca

SEQ ID NO: 2281139 - RNA, 14 nt, Yersinia pestis
cgcagguuaucuga

SEQ ID NO: 2281140 - RNA, 19 nt, Yersinia pestis
cgcagguuaugcagcucaa

SEQ ID NO: 2281141 - RNA, 14 nt, Yersinia pestis
cgcaguugccaaac

SEQ ID NO: 2281142 - RNA, 20 nt, Yersinia pestis
cgcaguacgugacggcagcg

SEQ ID NO: 2281143 - RNA, 24 nt, Yersinia pestis
cgcaguacgugacggcggcgagca

SEQ ID NO: 2281144 - RNA, 15 nt, Yersinia pestis
cgauggcacuuguga

SEQ ID NO: 2281145 - RNA, 16 nt, Yersinia pestis
cgauggcaaccccugc

SEQ ID NO: 2281146 - RNA, 21 nt, Yersinia pestis
cgaugcagcguauucaguaaa

SEQ ID NO: 2281147 - RNA, 19 nt, Yersinia pestis
cgaugaggcucuucugggc

SEQ ID NO: 2281148 - RNA, 18 nt, Yersinia pestis
cgaugacgcgaucuugaa

SEQ ID NO: 2281149 - RNA, 16 nt, Yersinia pestis
cgaugacgcgaucuug

SEQ ID NO: 2281150 - RNA, 22 nt, Yersinia pestis
cgaucugggcugcgcuuaccaa

SEQ ID NO: 2281151 - RNA, 22 nt, Yersinia pestis
cgaucuggcaaaaucccagcag

SEQ ID NO: 2281152 - RNA, 16 nt, Yersinia pestis
cgaucuauucucugua

SEQ ID NO: 2281153 - RNA, 15 nt, Yersinia pestis
cgaucuccuccagaa

SEQ ID NO: 2281154 - RNA, 16 nt, Yersinia pestis
cgaucugaaacgguga

SEQ ID NO: 2281155 - RNA, 17 nt, Yersinia pestis
cgaucugccuguucucu

SEQ ID NO: 2281156 - RNA, 20 nt, Yersinia pestis
cgaucugccuguucucuccc

SEQ ID NO: 2281157 - RNA, 14 nt, Yersinia pestis
cgaucgcuuuuuac

SEQ ID NO: 2281158 - RNA, 19 nt, Yersinia pestis
cgauaaaagauuuccuuuc

SEQ ID NO: 2281159 - RNA, 21 nt, Yersinia pestis
cgauaaaccaacugaaacugg

SEQ ID NO: 2281160 - RNA, 14 nt, Yersinia pestis
ccuucaguucuuua

SEQ ID NO: 2281161 - RNA, 21 nt, Yersinia pestis
ccuucaguuuauuuaagcuga

SEQ ID NO: 2281162 - RNA, 16 nt, Yersinia pestis
ccuucaucuuucaagu

SEQ ID NO: 2281163 - RNA, 19 nt, Yersinia pestis
ccuucaucgacaauggcug

SEQ ID NO: 2281164 - RNA, 16 nt, Yersinia pestis
cgauacgacuucuuau

SEQ ID NO: 2281165 - RNA, 20 nt, Yersinia pestis
cgauaacggcgguaccaguc

SEQ ID NO: 2281166 - RNA, 16 nt, Yersinia pestis
cgauacgaucaucugg

SEQ ID NO: 2281167 - RNA, 15 nt, Yersinia pestis
cgauaacauuuuuuc

SEQ ID NO: 2281168 - RNA, 14 nt, Yersinia pestis
cgauaaccaaauca

SEQ ID NO: 2281169 - RNA, 16 nt, Yersinia pestis
cgauaaccaaaucacc

SEQ ID NO: 2281170 - RNA, 13 nt, Yersinia pestis
cgauauaaauaaa

SEQ ID NO: 2281171 - RNA, 18 nt, Yersinia pestis
cgauacguugcaggucaa

SEQ ID NO: 2281172 - RNA, 16 nt, Yersinia pestis
cgaucauaaaucacaa

SEQ ID NO: 2281173 - RNA, 18 nt, Yersinia pestis
cgaucagcguauaaaacu

SEQ ID NO: 2281174 - RNA, 17 nt, Yersinia pestis
cgaucagaacuaacacu

SEQ ID NO: 2281175 - RNA, 14 nt, Yersinia pestis
cgauccagugaaau

SEQ ID NO: 2281176 - RNA, 19 nt, Yersinia pestis
cgauccgauaauaauucca

SEQ ID NO: 2281177 - RNA, 12 nt, Yersinia pestis
cgccuagcauca

SEQ ID NO: 2281178 - RNA, 14 nt, Yersinia pestis
cgccuaccugccug

SEQ ID NO: 2281179 - RNA, 15 nt, Yersinia pestis
cgccuaccugccugc

SEQ ID NO: 2281180 - RNA, 23 nt, Yersinia pestis
cgccuaaagcgccuuccuuuuau

SEQ ID NO: 2281181 - RNA, 18 nt, Yersinia pestis
cgccuaucugaaugaauu

SEQ ID NO: 2281182 - RNA, 12 nt, Yersinia pestis
cgccucucuggc

SEQ ID NO: 2281183 - RNA, 22 nt, Yersinia pestis
cgccugauaaaauuaccgcccc

SEQ ID NO: 2281184 - RNA, 22 nt, Yersinia pestis
cgccugacugcccgccugcuug

SEQ ID NO: 2281185 - RNA, 15 nt, Yersinia pestis
cgccucugcuccggu

SEQ ID NO: 2281186 - RNA, 19 nt, Yersinia pestis
cgccucaucguaaccccca

SEQ ID NO: 2281187 - RNA, 17 nt, Yersinia pestis
cgccuccagucccccuc

SEQ ID NO: 2281188 - RNA, 15 nt, Yersinia pestis
cgccugcgcuaauac

SEQ ID NO: 2281189 - RNA, 16 nt, Yersinia pestis
cgccuuaccgcaauuu

SEQ ID NO: 2281190 - RNA, 21 nt, Yersinia pestis
cgccuguuucggcaggcagaa

SEQ ID NO: 2281191 - RNA, 17 nt, Yersinia pestis
cgccuguauccagcagc

SEQ ID NO: 2281192 - RNA, 22 nt, Yersinia pestis
cgccuguauccagcagcgcugg

SEQ ID NO: 2281193 - RNA, 12 nt, Yersinia pestis
cgccugggaucc

SEQ ID NO: 2281194 - RNA, 16 nt, Yersinia pestis
cgccuuucccgcuagc

SEQ ID NO: 2281195 - RNA, 19 nt, Yersinia pestis
cgccuuuuuuauaauaaug

SEQ ID NO: 2281196 - RNA, 17 nt, Yersinia pestis
cgcgacggagagaacag

SEQ ID NO: 2281197 - RNA, 17 nt, Yersinia pestis
cgcgaucagacauuuuu

SEQ ID NO: 2281198 - RNA, 16 nt, Yersinia pestis
cgcgagucacauuuuu

SEQ ID NO: 2281199 - RNA, 18 nt, Yersinia pestis
cgcgaugacacaauuccc

SEQ ID NO: 2281200 - RNA, 14 nt, Yersinia pestis
cgcgaugcgccugu

SEQ ID NO: 2281201 - RNA, 15 nt, Yersinia pestis
cgcgccauccuugcc

SEQ ID NO: 2281202 - RNA, 16 nt, Yersinia pestis
cgcgccauccuugccu

SEQ ID NO: 2281203 - RNA, 15 nt, Yersinia pestis
cgcgccgacugcuga

SEQ ID NO: 2281204 - RNA, 15 nt, Yersinia pestis
cgcgccgacuguucg

SEQ ID NO: 2281205 - RNA, 16 nt, Yersinia pestis
cgcgccaaccaucgga

SEQ ID NO: 2281206 - RNA, 15 nt, Yersinia pestis
cgccguagcauucau

SEQ ID NO: 2281207 - RNA, 17 nt, Yersinia pestis
cgccguauuuguauuua

SEQ ID NO: 2281208 - RNA, 21 nt, Yersinia pestis
cgccgucaaacucuucagcca

SEQ ID NO: 2281209 - RNA, 20 nt, Yersinia pestis
cgccgguuaucaccugauga

SEQ ID NO: 2281210 - RNA, 13 nt, Yersinia pestis
cgccguaaacugc

SEQ ID NO: 2281211 - RNA, 13 nt, Yersinia pestis
cgccggguuuugc

SEQ ID NO: 2281212 - RNA, 22 nt, Yersinia pestis
cgccgcucaauuaaccugagcg

SEQ ID NO: 2281213 - RNA, 17 nt, Yersinia pestis
cgccgcuaaaucaucaa

SEQ ID NO: 2281214 - RNA, 13 nt, Yersinia pestis
cgccgcucaauua

SEQ ID NO: 2281215 - RNA, 23 nt, Yersinia pestis
cgccggaauaaagcucucgcggc

SEQ ID NO: 2281216 - RNA, 13 nt, Yersinia pestis
cgcccuguuucaa

SEQ ID NO: 2281217 - RNA, 18 nt, Yersinia pestis
cgcccucuugcugaguga

SEQ ID NO: 2281218 - RNA, 21 nt, Yersinia pestis
cgcccguuggccggccaacau

SEQ ID NO: 2281219 - RNA, 16 nt, Yersinia pestis
cgcccguuggccggcc

SEQ ID NO: 2281220 - RNA, 13 nt, Yersinia pestis
cgcccguugccca

SEQ ID NO: 2281221 - RNA, 23 nt, Yersinia pestis
cgccgaacgacaaauuuuuccuu

SEQ ID NO: 2281222 - RNA, 15 nt, Yersinia pestis
cuugaaucaaaauac

SEQ ID NO: 2281223 - RNA, 15 nt, Yersinia pestis
cuugaauagccagaa

SEQ ID NO: 2281224 - RNA, 17 nt, Yersinia pestis
cuugaaucaaaauaccc

SEQ ID NO: 2281225 - RNA, 15 nt, Yersinia pestis
cuugaccaaccuguu

SEQ ID NO: 2281226 - RNA, 21 nt, Yersinia pestis
cuugacgacaauauaauaaug

SEQ ID NO: 2281227 - RNA, 12 nt, Yersinia pestis
cuucuuuuguau

SEQ ID NO: 2281228 - RNA, 13 nt, Yersinia pestis
cuucuuuuaaaga

SEQ ID NO: 2281229 - RNA, 21 nt, Yersinia pestis
cuugaaguacggugccagcag

SEQ ID NO: 2281230 - RNA, 17 nt, Yersinia pestis
cuugaacggugaggaua

SEQ ID NO: 2281231 - RNA, 21 nt, Yersinia pestis
cuugacugaccauaaaaggau

SEQ ID NO: 2281232 - RNA, 20 nt, Yersinia pestis
cuugacgguucgaaaauaau

SEQ ID NO: 2281233 - RNA, 15 nt, Yersinia pestis
cuugacucuucagcg

SEQ ID NO: 2281234 - RNA, 19 nt, Yersinia pestis
cuugacucuucagcgggaa

SEQ ID NO: 2281235 - RNA, 22 nt, Yersinia pestis
cuugauaucuucggcggcuaaa

SEQ ID NO: 2281236 - RNA, 23 nt, Yersinia pestis
cuugagagaacguucaaccaacu

SEQ ID NO: 2281237 - RNA, 21 nt, Yersinia pestis
cuugaucggauaguuaucugg

SEQ ID NO: 2281238 - RNA, 20 nt, Yersinia pestis
cuugcaauucauguugccaa

SEQ ID NO: 2281239 - RNA, 20 nt, Yersinia pestis
cuugcaagguauuuuguauc

SEQ ID NO: 2281240 - RNA, 17 nt, Yersinia pestis
cuugcaacucggccgcu

SEQ ID NO: 2281241 - RNA, 19 nt, Yersinia pestis
cuugccacgccaguaaaca

SEQ ID NO: 2281242 - RNA, 21 nt, Yersinia pestis
cuugccacgccaguaaacagc

SEQ ID NO: 2281243 - RNA, 17 nt, Yersinia pestis
cuugcccuuuuuugugu

SEQ ID NO: 2281244 - RNA, 20 nt, Yersinia pestis
cuugguuacgggcuugcugc

SEQ ID NO: 2281245 - RNA, 16 nt, Yersinia pestis
cuugguugcaaguauu

SEQ ID NO: 2281246 - RNA, 22 nt, Yersinia pestis
cuuguagguuaaauucacuuuc

SEQ ID NO: 2281247 - RNA, 17 nt, Yersinia pestis
cuugucaccugaguaau

SEQ ID NO: 2281248 - RNA, 11 nt, Yersinia pestis
cuuguauuuaa

SEQ ID NO: 2281249 - RNA, 18 nt, Yersinia pestis
cuugguggugucaugguc

SEQ ID NO: 2281250 - RNA, 18 nt, Yersinia pestis
cuugguggagccuguaca

SEQ ID NO: 2281251 - RNA, 15 nt, Yersinia pestis
cuuggugaugcugcu

SEQ ID NO: 2281252 - RNA, 20 nt, Yersinia pestis
cuugggagucagaugccgcu

SEQ ID NO: 2281253 - RNA, 23 nt, Yersinia pestis
cuugggaucagccaucagcgccc

SEQ ID NO: 2281254 - RNA, 18 nt, Yersinia pestis
cuuggcucuggagcucuc

SEQ ID NO: 2281255 - RNA, 15 nt, Yersinia pestis
cuuggcguaacugca

SEQ ID NO: 2281256 - RNA, 23 nt, Yersinia pestis
cuugggucaguuuuauuaccaua

SEQ ID NO: 2281257 - RNA, 16 nt, Yersinia pestis
cuuggguggucagcau

SEQ ID NO: 2281258 - RNA, 21 nt, Yersinia pestis
cuugguaaugcgcaccagcuc

SEQ ID NO: 2281259 - RNA, 23 nt, Yersinia pestis
cuugguaaugcgcaccagcucaa

SEQ ID NO: 2281260 - RNA, 16 nt, Yersinia pestis
cuuggggccucacucu

SEQ ID NO: 2281261 - RNA, 14 nt, Yersinia pestis
cuugggcagcgaca

SEQ ID NO: 2281262 - RNA, 18 nt, Yersinia pestis
cuugcuggaggcuggcag

SEQ ID NO: 2281263 - RNA, 21 nt, Yersinia pestis
cuugcugguauucaucagcaa

SEQ ID NO: 2281264 - RNA, 14 nt, Yersinia pestis
cuugcugccugccu

SEQ ID NO: 2281265 - RNA, 17 nt, Yersinia pestis
cuuggcauguucagggu

SEQ ID NO: 2281266 - RNA, 16 nt, Yersinia pestis
cuuggcauugucugcu

SEQ ID NO: 2281267 - RNA, 18 nt, Yersinia pestis
cuuggccggucguauuca

SEQ ID NO: 2281268 - RNA, 18 nt, Yersinia pestis
cuuggcacucgaucaauc

SEQ ID NO: 2281269 - RNA, 16 nt, Yersinia pestis
cuuggcaaagagacug

SEQ ID NO: 2281270 - RNA, 22 nt, Yersinia pestis
cuuucaacaaauucaccagcaa

SEQ ID NO: 2281271 - RNA, 20 nt, Yersinia pestis
cuuucaaguccugcuucaaa

SEQ ID NO: 2281272 - RNA, 21 nt, Yersinia pestis
cuuucaggagugaauuucuuc

SEQ ID NO: 2281273 - RNA, 17 nt, Yersinia pestis
cuuucagcucuucaauu

SEQ ID NO: 2281274 - RNA, 20 nt, Yersinia pestis
cuuucagauaaugccuaagc

SEQ ID NO: 2281275 - RNA, 15 nt, Yersinia pestis
cuuuauucuucuuca

SEQ ID NO: 2281276 - RNA, 14 nt, Yersinia pestis
cuuuauugcuccuu

SEQ ID NO: 2281277 - RNA, 19 nt, Yersinia pestis
cuuuauugcuccuuacuau

SEQ ID NO: 2281278 - RNA, 21 nt, Yersinia pestis
cuuuaucuaaaauaucuuuca

SEQ ID NO: 2281279 - RNA, 15 nt, Yersinia pestis
cuuuagcuauuacua

SEQ ID NO: 2281280 - RNA, 14 nt, Yersinia pestis
cuuuacucuucaau

SEQ ID NO: 2281281 - RNA, 18 nt, Yersinia pestis
cuuuacugguuugaauuc

SEQ ID NO: 2281282 - RNA, 18 nt, Yersinia pestis
cuuuacuccccugccuau

SEQ ID NO: 2281283 - RNA, 15 nt, Yersinia pestis
cuuuacuccucugcc

SEQ ID NO: 2281284 - RNA, 20 nt, Yersinia pestis
cuuuacgcagcuuguugaua

SEQ ID NO: 2281285 - RNA, 23 nt, Yersinia pestis
cuuuacggccgcuaguuugacgc

SEQ ID NO: 2281286 - RNA, 15 nt, Yersinia pestis
cuuuaauuuuucccu

SEQ ID NO: 2281287 - RNA, 15 nt, Yersinia pestis
cuugucaggauuuac

SEQ ID NO: 2281288 - RNA, 22 nt, Yersinia pestis
cuuuaacuuccaauuucucaaa

SEQ ID NO: 2281289 - RNA, 24 nt, Yersinia pestis
cuuuaagauccaguucaguccagc

SEQ ID NO: 2281290 - RNA, 23 nt, Yersinia pestis
cuuuaagauccaguucaguccag

SEQ ID NO: 2281291 - RNA, 15 nt, Yersinia pestis
cuuuaauuaaaaaua

SEQ ID NO: 2281292 - RNA, 14 nt, Yersinia pestis
cuuugaugccuaau

SEQ ID NO: 2281293 - RNA, 21 nt, Yersinia pestis
cuuuggcaaucacaacccccc

SEQ ID NO: 2281294 - RNA, 18 nt, Yersinia pestis
cuuuggccguuuuaccaa

SEQ ID NO: 2281295 - RNA, 19 nt, Yersinia pestis
cuuuggcgcggucuucuga

SEQ ID NO: 2281296 - RNA, 17 nt, Yersinia pestis
cuuugcuuuucugccua

SEQ ID NO: 2281297 - RNA, 14 nt, Yersinia pestis
cuuuggaaccgcca

SEQ ID NO: 2281298 - RNA, 15 nt, Yersinia pestis
cuuuggacagucugg

SEQ ID NO: 2281299 - RNA, 21 nt, Yersinia pestis
cuuugcugccaucagccggag

SEQ ID NO: 2281300 - RNA, 22 nt, Yersinia pestis
cuuugcugcaacgcagacauga

SEQ ID NO: 2281301 - RNA, 16 nt, Yersinia pestis
cuuugcuuuucugccu

SEQ ID NO: 2281302 - RNA, 14 nt, Yersinia pestis
cuuugcguaauagg

SEQ ID NO: 2281303 - RNA, 12 nt, Yersinia pestis
cuuugcgugaca

SEQ ID NO: 2281304 - RNA, 17 nt, Yersinia pestis
cuuugcgugacauacuu

SEQ ID NO: 2281305 - RNA, 17 nt, Yersinia pestis
cuuugcgcugauaacuu

SEQ ID NO: 2281306 - RNA, 17 nt, Yersinia pestis
cuuugaccgaaccaccg

SEQ ID NO: 2281307 - RNA, 21 nt, Yersinia pestis
cuuugaguugcguuaacugcg

SEQ ID NO: 2281308 - RNA, 22 nt, Yersinia pestis
cuuugacuaauacugcgguccu

SEQ ID NO: 2281309 - RNA, 21 nt, Yersinia pestis
cuuugagaaaggauuugaaga

SEQ ID NO: 2281310 - RNA, 19 nt, Yersinia pestis
cuuucuuaauaauaucaaa

SEQ ID NO: 2281311 - RNA, 14 nt, Yersinia pestis
cuuucuucagcggu

SEQ ID NO: 2281312 - RNA, 17 nt, Yersinia pestis
cuuucgggcaaaaaaau

SEQ ID NO: 2281313 - RNA, 20 nt, Yersinia pestis
cuuuccagcgguuuuuucuu

SEQ ID NO: 2281314 - RNA, 12 nt, Yersinia pestis
cuuuccagcaaa

SEQ ID NO: 2281315 - RNA, 20 nt, Yersinia pestis
cuuuccacgcccaacucuuu

SEQ ID NO: 2281316 - RNA, 20 nt, Yersinia pestis
cuuucguuucugucugaguc

SEQ ID NO: 2281317 - RNA, 14 nt, Yersinia pestis
cuuucugcaauagc

SEQ ID NO: 2281318 - RNA, 16 nt, Yersinia pestis
cuuucuguucaucaau

SEQ ID NO: 2281319 - RNA, 17 nt, Yersinia pestis
cuucguagggcacuuuc

SEQ ID NO: 2281320 - RNA, 21 nt, Yersinia pestis
cuucgguuugagcuugcugcu

SEQ ID NO: 2281321 - RNA, 16 nt, Yersinia pestis
cuucggucucuggaug

SEQ ID NO: 2281322 - RNA, 19 nt, Yersinia pestis
cuucggucucuuugaccag

SEQ ID NO: 2281323 - RNA, 22 nt, Yersinia pestis
cuucgguauauuucccguugau

SEQ ID NO: 2281324 - RNA, 21 nt, Yersinia pestis
cuucgggauagggaaaaguua

SEQ ID NO: 2281325 - RNA, 16 nt, Yersinia pestis
cuucgaaagaaauaaa

SEQ ID NO: 2281326 - RNA, 14 nt, Yersinia pestis
cuuccuuuuauuua

SEQ ID NO: 2281327 - RNA, 17 nt, Yersinia pestis
cuucgacaggcaauuau

SEQ ID NO: 2281328 - RNA, 18 nt, Yersinia pestis
cuucgcuccggucaacgu

SEQ ID NO: 2281329 - RNA, 14 nt, Yersinia pestis
cuucgcugacauuu

SEQ ID NO: 2281330 - RNA, 14 nt, Yersinia pestis
cuuccuucaauaau

SEQ ID NO: 2281331 - RNA, 13 nt, Yersinia pestis
cuuccugcccagc

SEQ ID NO: 2281332 - RNA, 16 nt, Yersinia pestis
cuuccuaacaauauua

SEQ ID NO: 2281333 - RNA, 13 nt, Yersinia pestis
cuuccgucccaag

SEQ ID NO: 2281334 - RNA, 23 nt, Yersinia pestis
cuuccaggauauucacguuuuuc

SEQ ID NO: 2281335 - RNA, 12 nt, Yersinia pestis
cuucccauccua

SEQ ID NO: 2281336 - RNA, 23 nt, Yersinia pestis
cuuccaauguugccgcuucauau

SEQ ID NO: 2281337 - RNA, 17 nt, Yersinia pestis
cuuccagcaacaugcca

SEQ ID NO: 2281338 - RNA, 15 nt, Yersinia pestis
cuuccagcagggcca

SEQ ID NO: 2281339 - RNA, 13 nt, Yersinia pestis
cuucagacugaaa

SEQ ID NO: 2281340 - RNA, 23 nt, Yersinia pestis
cuucagacugaaaguagaaauaa

SEQ ID NO: 2281341 - RNA, 14 nt, Yersinia pestis
cuucacuuuuaaaa

SEQ ID NO: 2281342 - RNA, 13 nt, Yersinia pestis
cuuccaaaggaag

SEQ ID NO: 2281343 - RNA, 15 nt, Yersinia pestis
cuuccaaaggaaggg

SEQ ID NO: 2281344 - RNA, 15 nt, Yersinia pestis
cuuccaacuugccgc

SEQ ID NO: 2281345 - RNA, 16 nt, Yersinia pestis
cuuccaauaagugauu

SEQ ID NO: 2281346 - RNA, 14 nt, Yersinia pestis
cuuccaauagcagu

SEQ ID NO: 2281347 - RNA, 20 nt, Yersinia pestis
cuuagcuguaaaggcaaaga

SEQ ID NO: 2281348 - RNA, 18 nt, Yersinia pestis
cuuagcucaguugguuag

SEQ ID NO: 2281349 - RNA, 15 nt, Yersinia pestis
cuuagaccaccgcca

SEQ ID NO: 2281350 - RNA, 16 nt, Yersinia pestis
cuuagucauuaagaau

SEQ ID NO: 2281351 - RNA, 19 nt, Yersinia pestis
cuuaaucuuauuuguaaau

SEQ ID NO: 2281352 - RNA, 16 nt, Yersinia pestis
cuuaaucuuuaauuca

SEQ ID NO: 2281353 - RNA, 22 nt, Yersinia pestis
cuuacauucgagcaacuuuuac

SEQ ID NO: 2281354 - RNA, 20 nt, Yersinia pestis
cuuaauggcuuuuugcugau

SEQ ID NO: 2281355 - RNA, 15 nt, Yersinia pestis
cuuacagugauaauc

SEQ ID NO: 2281356 - RNA, 14 nt, Yersinia pestis
cuuacuguucaccg

SEQ ID NO: 2281357 - RNA, 22 nt, Yersinia pestis
cuuacuguuuucauuauuuuca

SEQ ID NO: 2281358 - RNA, 20 nt, Yersinia pestis
cuuacugguaccaaucucca

SEQ ID NO: 2281359 - RNA, 16 nt, Yersinia pestis
cuuacugguuuucugc

SEQ ID NO: 2281360 - RNA, 19 nt, Yersinia pestis
cuuacccgaaucacugacu

SEQ ID NO: 2281361 - RNA, 19 nt, Yersinia pestis
cuuaccggccucuuucccc

SEQ ID NO: 2281362 - RNA, 18 nt, Yersinia pestis
cuuaaguugaauaagauc

SEQ ID NO: 2281363 - RNA, 13 nt, Yersinia pestis
cuuaauaccuaaa

SEQ ID NO: 2281364 - RNA, 14 nt, Yersinia pestis
cuuaauaauaucaa

SEQ ID NO: 2281365 - RNA, 19 nt, Yersinia pestis
cuuaauaauaucaaauguc

SEQ ID NO: 2281366 - RNA, 18 nt, Yersinia pestis
cuuaacguugcaaaugcu

SEQ ID NO: 2281367 - RNA, 18 nt, Yersinia pestis
cuuaacucgccacucaca

SEQ ID NO: 2281368 - RNA, 15 nt, Yersinia pestis
cuuaacugcauagcu

SEQ ID NO: 2281369 - RNA, 20 nt, Yersinia pestis
cuuaagacguaucgcaguua

SEQ ID NO: 2281370 - RNA, 16 nt, Yersinia pestis
cuuaagagagaugcaa

SEQ ID NO: 2281371 - RNA, 16 nt, Yersinia pestis
cuuaacaaucagugca

SEQ ID NO: 2281372 - RNA, 15 nt, Yersinia pestis
cuuaacgccccgccc

SEQ ID NO: 2281373 - RNA, 18 nt, Yersinia pestis
cuuaacgccccgccccug

SEQ ID NO: 2281374 - RNA, 19 nt, Yersinia pestis
cuuauggucgguuuccgcc

SEQ ID NO: 2281375 - RNA, 13 nt, Yersinia pestis
cuuauggcuaauc

SEQ ID NO: 2281376 - RNA, 13 nt, Yersinia pestis
cuuaugcgaaaac

SEQ ID NO: 2281377 - RNA, 18 nt, Yersinia pestis
cuuauuggaaguacuuau

SEQ ID NO: 2281378 - RNA, 17 nt, Yersinia pestis
cuuauucuaauugauau

SEQ ID NO: 2281379 - RNA, 21 nt, Yersinia pestis
cuuaugaucuugaauaauauu

SEQ ID NO: 2281380 - RNA, 12 nt, Yersinia pestis
cuuauuuuagcu

SEQ ID NO: 2281381 - RNA, 14 nt, Yersinia pestis
cuuauuguuuuuac

SEQ ID NO: 2281382 - RNA, 16 nt, Yersinia pestis
cuuauuuaucacauuu

SEQ ID NO: 2281383 - RNA, 23 nt, Yersinia pestis
cuuauuucacgcuaauuauuuua

SEQ ID NO: 2281384 - RNA, 13 nt, Yersinia pestis
cuuauuugaaaca

SEQ ID NO: 2281385 - RNA, 13 nt, Yersinia pestis
cuucacucagcgc

SEQ ID NO: 2281386 - RNA, 19 nt, Yersinia pestis
cuucacucagcgcuggcga

SEQ ID NO: 2281387 - RNA, 21 nt, Yersinia pestis
cuucaauguuuuuauccaaac

SEQ ID NO: 2281388 - RNA, 22 nt, Yersinia pestis
cuucaauacguucguagccacg

SEQ ID NO: 2281389 - RNA, 13 nt, Yersinia pestis
cuucaacuuuuuu

SEQ ID NO: 2281390 - RNA, 14 nt, Yersinia pestis
cuucaacuuuuuuc

SEQ ID NO: 2281391 - RNA, 13 nt, Yersinia pestis
cuucaagaugcag

SEQ ID NO: 2281392 - RNA, 14 nt, Yersinia pestis
cugcugcuguggca

SEQ ID NO: 2281393 - RNA, 19 nt, Yersinia pestis
cugcugcuuggguggucag

SEQ ID NO: 2281394 - RNA, 24 nt, Yersinia pestis
cugcuggaaugcagugccacggau

SEQ ID NO: 2281395 - RNA, 20 nt, Yersinia pestis
cugcuggcggaacaguugcu

SEQ ID NO: 2281396 - RNA, 16 nt, Yersinia pestis
cugcugguuuuacuga

SEQ ID NO: 2281397 - RNA, 15 nt, Yersinia pestis
cugcugucgcugugg

SEQ ID NO: 2281398 - RNA, 14 nt, Yersinia pestis
cugcucgcauuguu

SEQ ID NO: 2281399 - RNA, 13 nt, Yersinia pestis
cugcucgcccaag

SEQ ID NO: 2281400 - RNA, 22 nt, Yersinia pestis
cugcucccguaaacguucugcc

SEQ ID NO: 2281401 - RNA, 17 nt, Yersinia pestis
cugcuccaaagcuucca

SEQ ID NO: 2281402 - RNA, 22 nt, Yersinia pestis
cugcucugucaacgcuucagua

SEQ ID NO: 2281403 - RNA, 12 nt, Yersinia pestis
cugcucugcccc

SEQ ID NO: 2281404 - RNA, 15 nt, Yersinia pestis
cugcucuugcucagu

SEQ ID NO: 2281405 - RNA, 14 nt, Yersinia pestis
cugcucuaucucuu

SEQ ID NO: 2281406 - RNA, 15 nt, Yersinia pestis
cugcucuuucccuuc

SEQ ID NO: 2281407 - RNA, 20 nt, Yersinia pestis
cugcugaaaaaugagucauu

SEQ ID NO: 2281408 - RNA, 12 nt, Yersinia pestis
cugcugacaaac

SEQ ID NO: 2281409 - RNA, 18 nt, Yersinia pestis
cugccgcgccagauucua

SEQ ID NO: 2281410 - RNA, 18 nt, Yersinia pestis
cugcgauaccuuuugcug

SEQ ID NO: 2281411 - RNA, 13 nt, Yersinia pestis
cugcgaucugccu

SEQ ID NO: 2281412 - RNA, 17 nt, Yersinia pestis
cugcgcaagcgcugcuu

SEQ ID NO: 2281413 - RNA, 19 nt, Yersinia pestis
cugcgcuaaacggcccugu

SEQ ID NO: 2281414 - RNA, 21 nt, Yersinia pestis
cugcgcuaauacggcuugcaa

SEQ ID NO: 2281415 - RNA, 19 nt, Yersinia pestis
cugcgcuguucaucgcaau

SEQ ID NO: 2281416 - RNA, 13 nt, Yersinia pestis
cugcgcuuaccaa

SEQ ID NO: 2281417 - RNA, 16 nt, Yersinia pestis
cugcggcaagcugugc

SEQ ID NO: 2281418 - RNA, 22 nt, Yersinia pestis
cugcggcacugacacuccccug

SEQ ID NO: 2281419 - RNA, 21 nt, Yersinia pestis
cugcguauggggauuuuauua

SEQ ID NO: 2281420 - RNA, 15 nt, Yersinia pestis
cugaugcuuuucuuu

SEQ ID NO: 2281421 - RNA, 14 nt, Yersinia pestis
cugaugagagggag

SEQ ID NO: 2281422 - RNA, 23 nt, Yersinia pestis
cugaugagagggaguuauucuga

SEQ ID NO: 2281423 - RNA, 16 nt, Yersinia pestis
cugaugagcuggcaaa

SEQ ID NO: 2281424 - RNA, 18 nt, Yersinia pestis
cugaugaauagaggacua

SEQ ID NO: 2281425 - RNA, 17 nt, Yersinia pestis
cugaugucaucaaguga

SEQ ID NO: 2281426 - RNA, 15 nt, Yersinia pestis
cugauugaccaucaa

SEQ ID NO: 2281427 - RNA, 18 nt, Yersinia pestis
cugcaccucaucaacgac

SEQ ID NO: 2281428 - RNA, 17 nt, Yersinia pestis
cugcacgccuacggcuu

SEQ ID NO: 2281429 - RNA, 15 nt, Yersinia pestis
cugcaacccacgccc

SEQ ID NO: 2281430 - RNA, 22 nt, Yersinia pestis
cugcaaauuagcggauuaauaa

SEQ ID NO: 2281431 - RNA, 19 nt, Yersinia pestis
cugcaaauuuauccaaucu

SEQ ID NO: 2281432 - RNA, 17 nt, Yersinia pestis
cugcacaucauuuauuu

SEQ ID NO: 2281433 - RNA, 23 nt, Yersinia pestis
cugcaccaaucauuacaucaucu

SEQ ID NO: 2281434 - RNA, 16 nt, Yersinia pestis
cugccagccauaucca

SEQ ID NO: 2281435 - RNA, 13 nt, Yersinia pestis
cugccagccugau

SEQ ID NO: 2281436 - RNA, 16 nt, Yersinia pestis
cugccagcccacgagg

SEQ ID NO: 2281437 - RNA, 17 nt, Yersinia pestis
cugccaauuccuuagcg

SEQ ID NO: 2281438 - RNA, 15 nt, Yersinia pestis
cugccaccaaaugcu

SEQ ID NO: 2281439 - RNA, 17 nt, Yersinia pestis
cugccaccaaaugcuca

SEQ ID NO: 2281440 - RNA, 12 nt, Yersinia pestis
cugcccccgacg

SEQ ID NO: 2281441 - RNA, 19 nt, Yersinia pestis
cugccagcguugcagaguu

SEQ ID NO: 2281442 - RNA, 19 nt, Yersinia pestis
cugcccuaauaccaauacc

SEQ ID NO: 2281443 - RNA, 17 nt, Yersinia pestis
cugcauauccucccgcu

SEQ ID NO: 2281444 - RNA, 23 nt, Yersinia pestis
cugcaggaucuggauuuuccaga

SEQ ID NO: 2281445 - RNA, 13 nt, Yersinia pestis
cugcaucaucaca

SEQ ID NO: 2281446 - RNA, 17 nt, Yersinia pestis
cugcagcgauauacauc

SEQ ID NO: 2281447 - RNA, 16 nt, Yersinia pestis
cugcauuucaacaaaa

SEQ ID NO: 2281448 - RNA, 17 nt, Yersinia pestis
cugcauuucaacaaaac

SEQ ID NO: 2281449 - RNA, 22 nt, Yersinia pestis
cugccaaauauugcacaauagc

SEQ ID NO: 2281450 - RNA, 13 nt, Yersinia pestis
cugccaauaucca

SEQ ID NO: 2281451 - RNA, 20 nt, Yersinia pestis
cugccaauauccauauuaaa

SEQ ID NO: 2281452 - RNA, 17 nt, Yersinia pestis
cugcauugauuaaauca

SEQ ID NO: 2281453 - RNA, 23 nt, Yersinia pestis
cugcauuaaaauaacaauucacu

SEQ ID NO: 2281454 - RNA, 23 nt, Yersinia pestis
cuggcuuuuuuguuuuuauauca

SEQ ID NO: 2281455 - RNA, 23 nt, Yersinia pestis
cuggcuuuuucacacgcccaggc

SEQ ID NO: 2281456 - RNA, 17 nt, Yersinia pestis
cuggcuuucucccauuc

SEQ ID NO: 2281457 - RNA, 23 nt, Yersinia pestis
cugggacccaucgccguuuugcc

SEQ ID NO: 2281458 - RNA, 21 nt, Yersinia pestis
cuggguaauucauuauuacuc

SEQ ID NO: 2281459 - RNA, 15 nt, Yersinia pestis
cugggguuucuguca

SEQ ID NO: 2281460 - RNA, 23 nt, Yersinia pestis
cugggggugagcaagggcagcua

SEQ ID NO: 2281461 - RNA, 22 nt, Yersinia pestis
cugggggcuagccgcgccaucc

SEQ ID NO: 2281462 - RNA, 16 nt, Yersinia pestis
cugggcugauggucau

SEQ ID NO: 2281463 - RNA, 15 nt, Yersinia pestis
cugggcugcauagcg

SEQ ID NO: 2281464 - RNA, 19 nt, Yersinia pestis
cugggcugaacgugccugu

SEQ ID NO: 2281465 - RNA, 22 nt, Yersinia pestis
cuggcuuagaucuuuggccccg

SEQ ID NO: 2281466 - RNA, 22 nt, Yersinia pestis
cuggcuggcuuuggaacgcuca

SEQ ID NO: 2281467 - RNA, 21 nt, Yersinia pestis
cuggcuggcauauuucucuuu

SEQ ID NO: 2281468 - RNA, 15 nt, Yersinia pestis
cuggcucaaauuugg

SEQ ID NO: 2281469 - RNA, 15 nt, Yersinia pestis
cuggcucggcgcgcu

SEQ ID NO: 2281470 - RNA, 18 nt, Yersinia pestis
cuggcgugcgggcaaaac

SEQ ID NO: 2281471 - RNA, 20 nt, Yersinia pestis
cuggcguuauucuuuauuua

SEQ ID NO: 2281472 - RNA, 19 nt, Yersinia pestis
cuggcgcauccccacuugu

SEQ ID NO: 2281473 - RNA, 18 nt, Yersinia pestis
cuggcacugccaucaauc

SEQ ID NO: 2281474 - RNA, 13 nt, Yersinia pestis
cuggccgcaggcg

SEQ ID NO: 2281475 - RNA, 16 nt, Yersinia pestis
cugcuuaccuuguuug

SEQ ID NO: 2281476 - RNA, 14 nt, Yersinia pestis
cugcuuaaccgauu

SEQ ID NO: 2281477 - RNA, 13 nt, Yersinia pestis
cuggauauuuucc

SEQ ID NO: 2281478 - RNA, 21 nt, Yersinia pestis
cugcuucugaaccaccguaaa

SEQ ID NO: 2281479 - RNA, 14 nt, Yersinia pestis
cuggauuugagaau

SEQ ID NO: 2281480 - RNA, 23 nt, Yersinia pestis
cuggcaaacgcugcacaucauuu

SEQ ID NO: 2281481 - RNA, 18 nt, Yersinia pestis
cuggcaaaaucccagcag

SEQ ID NO: 2281482 - RNA, 15 nt, Yersinia pestis
cuggaucuuuuagcu

SEQ ID NO: 2281483 - RNA, 18 nt, Yersinia pestis
cuguccaagaagccaaga

SEQ ID NO: 2281484 - RNA, 15 nt, Yersinia pestis
cuguccaagaagcca

SEQ ID NO: 2281485 - RNA, 13 nt, Yersinia pestis
cugucauugcugu

SEQ ID NO: 2281486 - RNA, 17 nt, Yersinia pestis
cuguccaguugcuggaa

SEQ ID NO: 2281487 - RNA, 20 nt, Yersinia pestis
cugucauuacacuuucuuug

SEQ ID NO: 2281488 - RNA, 17 nt, Yersinia pestis
cuguagcuuuuuaaaua

SEQ ID NO: 2281489 - RNA, 14 nt, Yersinia pestis
cuguagcuuuuuaa

SEQ ID NO: 2281490 - RNA, 14 nt, Yersinia pestis
cuguauccagcagc

SEQ ID NO: 2281491 - RNA, 15 nt, Yersinia pestis
cuguauccagcagcg

SEQ ID NO: 2281492 - RNA, 16 nt, Yersinia pestis
cuguacugggaugaag

SEQ ID NO: 2281493 - RNA, 14 nt, Yersinia pestis
cuguagaacaccug

SEQ ID NO: 2281494 - RNA, 18 nt, Yersinia pestis
cuguagaacaccugccuu

SEQ ID NO: 2281495 - RNA, 23 nt, Yersinia pestis
cuguagccgcaggcgaugcaagg

SEQ ID NO: 2281496 - RNA, 14 nt, Yersinia pestis
cuguaaggccaaac

SEQ ID NO: 2281497 - RNA, 15 nt, Yersinia pestis
cuguaacuuuauuga

SEQ ID NO: 2281498 - RNA, 19 nt, Yersinia pestis
cuguaacucaaauuauuuu

SEQ ID NO: 2281499 - RNA, 19 nt, Yersinia pestis
cuguaaugccccacuucac

SEQ ID NO: 2281500 - RNA, 15 nt, Yersinia pestis
cuguaaugggugaua

SEQ ID NO: 2281501 - RNA, 13 nt, Yersinia pestis
cuguacucacuca

SEQ ID NO: 2281502 - RNA, 17 nt, Yersinia pestis
cuggguuugaguaacaa

SEQ ID NO: 2281503 - RNA, 22 nt, Yersinia pestis
cuggguuuuauugcaacugggc

SEQ ID NO: 2281504 - RNA, 18 nt, Yersinia pestis
cugguaaaaacaccauau

SEQ ID NO: 2281505 - RNA, 22 nt, Yersinia pestis
cugguaacagagccuuauaggc

SEQ ID NO: 2281506 - RNA, 19 nt, Yersinia pestis
cugguggcuugggcuucac

SEQ ID NO: 2281507 - RNA, 13 nt, Yersinia pestis
cugguugaaaccu

SEQ ID NO: 2281508 - RNA, 18 nt, Yersinia pestis
cugguuauuggcccaucu

SEQ ID NO: 2281509 - RNA, 17 nt, Yersinia pestis
cugugaaucuuuuugcu

SEQ ID NO: 2281510 - RNA, 16 nt, Yersinia pestis
cugugacacgagaagg

SEQ ID NO: 2281511 - RNA, 14 nt, Yersinia pestis
cugugagcgcagac

SEQ ID NO: 2281512 - RNA, 18 nt, Yersinia pestis
cugugagcggcauccagu

SEQ ID NO: 2281513 - RNA, 23 nt, Yersinia pestis
cugugauaaccaacaguuauuuu

SEQ ID NO: 2281514 - RNA, 20 nt, Yersinia pestis
cugugaucgcugccgcaaga

SEQ ID NO: 2281515 - RNA, 21 nt, Yersinia pestis
cugucuuaggugacaggcaaa

SEQ ID NO: 2281516 - RNA, 15 nt, Yersinia pestis
cugucuuauuuuuug

SEQ ID NO: 2281517 - RNA, 15 nt, Yersinia pestis
cuguccuuuaacuca

SEQ ID NO: 2281518 - RNA, 15 nt, Yersinia pestis
cugugcuaaauccca

SEQ ID NO: 2281519 - RNA, 15 nt, Yersinia pestis
cuguuaguucagacg

SEQ ID NO: 2281520 - RNA, 16 nt, Yersinia pestis
cuguuauuacugucau

SEQ ID NO: 2281521 - RNA, 15 nt, Yersinia pestis
cuguucagauuuacc

SEQ ID NO: 2281522 - RNA, 11 nt, Yersinia pestis
cuguucaucag

SEQ ID NO: 2281523 - RNA, 20 nt, Yersinia pestis
cuguuaauccuaaugaacac

SEQ ID NO: 2281524 - RNA, 15 nt, Yersinia pestis
cuguuaccagaaaac

SEQ ID NO: 2281525 - RNA, 18 nt, Yersinia pestis
cuguuacaucagagcuca

SEQ ID NO: 2281526 - RNA, 21 nt, Yersinia pestis
cuguuaacuaacgucccauuc

SEQ ID NO: 2281527 - RNA, 16 nt, Yersinia pestis
cuguguuuugagcauc

SEQ ID NO: 2281528 - RNA, 21 nt, Yersinia pestis
cuguguuugauuaaugccucu

SEQ ID NO: 2281529 - RNA, 13 nt, Yersinia pestis
cuguguuuauacc

SEQ ID NO: 2281530 - RNA, 17 nt, Yersinia pestis
cuguguuuauaccaaag

SEQ ID NO: 2281531 - RNA, 22 nt, Yersinia pestis
cuguggcuaauaaugcaccaau

SEQ ID NO: 2281532 - RNA, 23 nt, Yersinia pestis
cuguggcggcaagaacaccguca

SEQ ID NO: 2281533 - RNA, 15 nt, Yersinia pestis
cuguggcaugacuga

SEQ ID NO: 2281534 - RNA, 20 nt, Yersinia pestis
cuguggaaucggccuucaau

SEQ ID NO: 2281535 - RNA, 23 nt, Yersinia pestis
cugugugggcacucgcaagacga

SEQ ID NO: 2281536 - RNA, 15 nt, Yersinia pestis
cuguguaacugccac

SEQ ID NO: 2281537 - RNA, 22 nt, Yersinia pestis
cuccuugaauagccagaagcca

SEQ ID NO: 2281538 - RNA, 19 nt, Yersinia pestis
cuccuuuguuauuucuggg

SEQ ID NO: 2281539 - RNA, 12 nt, Yersinia pestis
cucgaaaauaac

SEQ ID NO: 2281540 - RNA, 18 nt, Yersinia pestis
cuccuuauacuaaagaaa

SEQ ID NO: 2281541 - RNA, 21 nt, Yersinia pestis
cuccuuaccacugcucacuuu

SEQ ID NO: 2281542 - RNA, 18 nt, Yersinia pestis
cuccuggcgauccaguga

SEQ ID NO: 2281543 - RNA, 15 nt, Yersinia pestis
cuccuggcaugcauu

SEQ ID NO: 2281544 - RNA, 21 nt, Yersinia pestis
cucgaaaucauccgcggcaaa

SEQ ID NO: 2281545 - RNA, 21 nt, Yersinia pestis
cucgaacgcuuguggaaauag

SEQ ID NO: 2281546 - RNA, 17 nt, Yersinia pestis
cucgaauaaacggauuu

SEQ ID NO: 2281547 - RNA, 19 nt, Yersinia pestis
cucgaauuauuugggguau

SEQ ID NO: 2281548 - RNA, 19 nt, Yersinia pestis
cucgagccuacauggaugu

SEQ ID NO: 2281549 - RNA, 22 nt, Yersinia pestis
cucgagccuacuacauggaugu

SEQ ID NO: 2281550 - RNA, 18 nt, Yersinia pestis
cucgcaauggugauaaac

SEQ ID NO: 2281551 - RNA, 19 nt, Yersinia pestis
cucgccguggcauaaucaa

SEQ ID NO: 2281552 - RNA, 17 nt, Yersinia pestis
cuccucagccuuuuuug

SEQ ID NO: 2281553 - RNA, 23 nt, Yersinia pestis
cuccucuuuauacauauguugag

SEQ ID NO: 2281554 - RNA, 15 nt, Yersinia pestis
cuccucuuucuuaau

SEQ ID NO: 2281555 - RNA, 13 nt, Yersinia pestis
cuccucugccuau

SEQ ID NO: 2281556 - RNA, 20 nt, Yersinia pestis
cuccugaaauaaagaacuga

SEQ ID NO: 2281557 - RNA, 18 nt, Yersinia pestis
cuccgcgccuuuaauccc

SEQ ID NO: 2281558 - RNA, 22 nt, Yersinia pestis
cuccgguucuugcgcgcuggga

SEQ ID NO: 2281559 - RNA, 15 nt, Yersinia pestis
cuccgucgcgggcac

SEQ ID NO: 2281560 - RNA, 19 nt, Yersinia pestis
cuccguguaguuauugauu

SEQ ID NO: 2281561 - RNA, 16 nt, Yersinia pestis
cuccguugcaggcacu

SEQ ID NO: 2281562 - RNA, 14 nt, Yersinia pestis
cucccggcaggcag

SEQ ID NO: 2281563 - RNA, 18 nt, Yersinia pestis
cuccacaccuccgcccuc

SEQ ID NO: 2281564 - RNA, 20 nt, Yersinia pestis
cuccacacguguacucauau

SEQ ID NO: 2281565 - RNA, 21 nt, Yersinia pestis
cuccaccaacggcccaauauu

SEQ ID NO: 2281566 - RNA, 16 nt, Yersinia pestis
cucccguagcaaauaa

SEQ ID NO: 2281567 - RNA, 22 nt, Yersinia pestis
cucccuauaaugcgccuccacu

SEQ ID NO: 2281568 - RNA, 14 nt, Yersinia pestis
cucuagcuaacagu

SEQ ID NO: 2281569 - RNA, 13 nt, Yersinia pestis
cucguauuacccu

SEQ ID NO: 2281570 - RNA, 18 nt, Yersinia pestis
cucgucauucaccaccac

SEQ ID NO: 2281571 - RNA, 21 nt, Yersinia pestis
cucggcagcugugagaucccc

SEQ ID NO: 2281572 - RNA, 21 nt, Yersinia pestis
cucggcgguuugagccaccgc

SEQ ID NO: 2281573 - RNA, 20 nt, Yersinia pestis
cucgguauguacacauuauu

SEQ ID NO: 2281574 - RNA, 23 nt, Yersinia pestis
cucggcgggauaucgauggcaac

SEQ ID NO: 2281575 - RNA, 16 nt, Yersinia pestis
cucucauauccccccc

SEQ ID NO: 2281576 - RNA, 23 nt, Yersinia pestis
cucuccagccugcgauagcccca

SEQ ID NO: 2281577 - RNA, 12 nt, Yersinia pestis
cucucauauccc

SEQ ID NO: 2281578 - RNA, 14 nt, Yersinia pestis
cucuccgcaaugcc

SEQ ID NO: 2281579 - RNA, 17 nt, Yersinia pestis
cucuccccaagcggcag

SEQ ID NO: 2281580 - RNA, 17 nt, Yersinia pestis
cucuccagugcaaauuu

SEQ ID NO: 2281581 - RNA, 13 nt, Yersinia pestis
cucucacccugcg

SEQ ID NO: 2281582 - RNA, 14 nt, Yersinia pestis
cucucuuuccagca

SEQ ID NO: 2281583 - RNA, 17 nt, Yersinia pestis
cucuccuaaaaucuauc

SEQ ID NO: 2281584 - RNA, 18 nt, Yersinia pestis
cucuccuauaucucaguu

SEQ ID NO: 2281585 - RNA, 19 nt, Yersinia pestis
cucuccgucgcgggcacuu

SEQ ID NO: 2281586 - RNA, 16 nt, Yersinia pestis
cucugggacgugcaua

SEQ ID NO: 2281587 - RNA, 20 nt, Yersinia pestis
cucuggccagcgucuucagu

SEQ ID NO: 2281588 - RNA, 22 nt, Yersinia pestis
cucuggcaacggcacaucccaa

SEQ ID NO: 2281589 - RNA, 16 nt, Yersinia pestis
cucuggcacuggcaau

SEQ ID NO: 2281590 - RNA, 19 nt, Yersinia pestis
cucuggacguuugcugcuu

SEQ ID NO: 2281591 - RNA, 16 nt, Yersinia pestis
cucuggagcuucuggc

SEQ ID NO: 2281592 - RNA, 17 nt, Yersinia pestis
cucugcuuacucuucca

SEQ ID NO: 2281593 - RNA, 13 nt, Yersinia pestis
cucugcguagcca

SEQ ID NO: 2281594 - RNA, 12 nt, Yersinia pestis
cucugcuaacaa

SEQ ID NO: 2281595 - RNA, 19 nt, Yersinia pestis
cucugcuaauacgcuauca

SEQ ID NO: 2281596 - RNA, 17 nt, Yersinia pestis
cucugcgcucauacuca

SEQ ID NO: 2281597 - RNA, 15 nt, Yersinia pestis
cucugccuauccuca

SEQ ID NO: 2281598 - RNA, 14 nt, Yersinia pestis
cucucuuuuuucuc

SEQ ID NO: 2281599 - RNA, 23 nt, Yersinia pestis
cucucuugaaaugauaacaauaa

SEQ ID NO: 2281600 - RNA, 17 nt, Yersinia pestis
cucugaauaaaaaauua

SEQ ID NO: 2281601 - RNA, 22 nt, Yersinia pestis
cucugacuacugaaaccugacc

SEQ ID NO: 2281602 - RNA, 18 nt, Yersinia pestis
cucugauaguauuagaug

SEQ ID NO: 2281603 - RNA, 18 nt, Yersinia pestis
cucugaugguaucagaaa

SEQ ID NO: 2281604 - RNA, 18 nt, Yersinia pestis
cucugcaguacagauaau

SEQ ID NO: 2281605 - RNA, 14 nt, Yersinia pestis
cucugcagcuugca

SEQ ID NO: 2281606 - RNA, 17 nt, Yersinia pestis
cugaauuuuuuaccuag

SEQ ID NO: 2281607 - RNA, 12 nt, Yersinia pestis
cugacaaacccc

SEQ ID NO: 2281608 - RNA, 20 nt, Yersinia pestis
cugacacaacacauuacugc

SEQ ID NO: 2281609 - RNA, 14 nt, Yersinia pestis
cugacacacaccag

SEQ ID NO: 2281610 - RNA, 16 nt, Yersinia pestis
cugacacacaccagug

SEQ ID NO: 2281611 - RNA, 16 nt, Yersinia pestis
cugacagagcggguuu

SEQ ID NO: 2281612 - RNA, 14 nt, Yersinia pestis
cugacagccugugc

SEQ ID NO: 2281613 - RNA, 23 nt, Yersinia pestis
cugacauuauuggcguaacugcu

SEQ ID NO: 2281614 - RNA, 23 nt, Yersinia pestis
cugacauuugcaucuauggauua

SEQ ID NO: 2281615 - RNA, 14 nt, Yersinia pestis
cugacaucaucacc

SEQ ID NO: 2281616 - RNA, 20 nt, Yersinia pestis
cugaccgauugaaucaaggc

SEQ ID NO: 2281617 - RNA, 15 nt, Yersinia pestis
cugacccaagguacu

SEQ ID NO: 2281618 - RNA, 21 nt, Yersinia pestis
cugacccccaauuucauuuac

SEQ ID NO: 2281619 - RNA, 17 nt, Yersinia pestis
cugaccacaaaaacagu

SEQ ID NO: 2281620 - RNA, 20 nt, Yersinia pestis
cugaaguuuaccgcaugaau

SEQ ID NO: 2281621 - RNA, 13 nt, Yersinia pestis
cugaaguuaaaaa

SEQ ID NO: 2281622 - RNA, 16 nt, Yersinia pestis
cugaaggcugauuaau

SEQ ID NO: 2281623 - RNA, 19 nt, Yersinia pestis
cugaauaucaucuuuuucu

SEQ ID NO: 2281624 - RNA, 20 nt, Yersinia pestis
cugaauaucaucuuuuucug

SEQ ID NO: 2281625 - RNA, 18 nt, Yersinia pestis
cugaauaccggccugauu

SEQ ID NO: 2281626 - RNA, 18 nt, Yersinia pestis
cugaauaggggaauuuuu

SEQ ID NO: 2281627 - RNA, 20 nt, Yersinia pestis
cugaauaggggaauuuuuag

SEQ ID NO: 2281628 - RNA, 19 nt, Yersinia pestis
cugaauaaaaaauuauuaa

SEQ ID NO: 2281629 - RNA, 22 nt, Yersinia pestis
cugaauaaaaaauuauuaaaua

SEQ ID NO: 2281630 - RNA, 15 nt, Yersinia pestis
cugaauaauacuguc

SEQ ID NO: 2281631 - RNA, 11 nt, Yersinia pestis
cugaauaccau

SEQ ID NO: 2281632 - RNA, 19 nt, Yersinia pestis
cugaaucccagaaccucaa

SEQ ID NO: 2281633 - RNA, 17 nt, Yersinia pestis
cugaaucgccgaaaucu

SEQ ID NO: 2281634 - RNA, 19 nt, Yersinia pestis
cugaaucgccgaaaucuca

SEQ ID NO: 2281635 - RNA, 23 nt, Yersinia pestis
cugaaucccagaaccucaacauu

SEQ ID NO: 2281636 - RNA, 16 nt, Yersinia pestis
cugaauccccucaaaa

SEQ ID NO: 2281637 - RNA, 23 nt, Yersinia pestis
cugaaugcacgauaccaccacca

SEQ ID NO: 2281638 - RNA, 15 nt, Yersinia pestis
cugaauggaaaaauu

SEQ ID NO: 2281639 - RNA, 22 nt, Yersinia pestis
cugaauggaucacaucacagug

SEQ ID NO: 2281640 - RNA, 22 nt, Yersinia pestis
cugaauggauugaaaccgcuga

SEQ ID NO: 2281641 - RNA, 20 nt, Yersinia pestis
cugaauggcaacgcgcagug

SEQ ID NO: 2281642 - RNA, 15 nt, Yersinia pestis
cugaaugugaagagc

SEQ ID NO: 2281643 - RNA, 18 nt, Yersinia pestis
cugaauugaugcacagua

SEQ ID NO: 2281644 - RNA, 12 nt, Yersinia pestis
cugaauuucaau

SEQ ID NO: 2281645 - RNA, 15 nt, Yersinia pestis
cugaauuucaauaac

SEQ ID NO: 2281646 - RNA, 21 nt, Yersinia pestis
cugaauugcuuauccagccgc

SEQ ID NO: 2281647 - RNA, 16 nt, Yersinia pestis
cugaauuggaagagcc

SEQ ID NO: 2281648 - RNA, 17 nt, Yersinia pestis
cugagcaccgcaggaac

SEQ ID NO: 2281649 - RNA, 16 nt, Yersinia pestis
cugagcagcaacuguu

SEQ ID NO: 2281650 - RNA, 19 nt, Yersinia pestis
cugagcgaacugaaugcgu

SEQ ID NO: 2281651 - RNA, 12 nt, Yersinia pestis
cugagccuucaa

SEQ ID NO: 2281652 - RNA, 22 nt, Yersinia pestis
cugagccucaugaaugaggcug

SEQ ID NO: 2281653 - RNA, 23 nt, Yersinia pestis
cugagccucaugaaugaggcuga

SEQ ID NO: 2281654 - RNA, 21 nt, Yersinia pestis
cugagccgccaguugggaauc

SEQ ID NO: 2281655 - RNA, 19 nt, Yersinia pestis
cugagagccgcuauaaccu

SEQ ID NO: 2281656 - RNA, 21 nt, Yersinia pestis
cugagacguccauaaucugga

SEQ ID NO: 2281657 - RNA, 14 nt, Yersinia pestis
cugacugcuggcag

SEQ ID NO: 2281658 - RNA, 20 nt, Yersinia pestis
cugacugccauaauccagaa

SEQ ID NO: 2281659 - RNA, 19 nt, Yersinia pestis
cugacugagcguugaccuu

SEQ ID NO: 2281660 - RNA, 15 nt, Yersinia pestis
cugacuguuuugcua

SEQ ID NO: 2281661 - RNA, 21 nt, Yersinia pestis
cugacuuguuguugaccucaa

SEQ ID NO: 2281662 - RNA, 18 nt, Yersinia pestis
cugacgccaugcucagaa

SEQ ID NO: 2281663 - RNA, 12 nt, Yersinia pestis
cugacgccacca

SEQ ID NO: 2281664 - RNA, 16 nt, Yersinia pestis
cugacgaugauaaauc

SEQ ID NO: 2281665 - RNA, 16 nt, Yersinia pestis
cugacgccaugcucag

SEQ ID NO: 2281666 - RNA, 15 nt, Yersinia pestis
cugacgauaacuuuu

SEQ ID NO: 2281667 - RNA, 19 nt, Yersinia pestis
cugacgcacagcacgguaa

SEQ ID NO: 2281668 - RNA, 22 nt, Yersinia pestis
cugaccuauugauaaaaccacu

SEQ ID NO: 2281669 - RNA, 21 nt, Yersinia pestis
cugaccuguuguaacacuuga

SEQ ID NO: 2281670 - RNA, 16 nt, Yersinia pestis
cugacgguuucaacau

SEQ ID NO: 2281671 - RNA, 17 nt, Yersinia pestis
cugacugaagaauucag

SEQ ID NO: 2281672 - RNA, 16 nt, Yersinia pestis
cugacucccugacucc

SEQ ID NO: 2281673 - RNA, 18 nt, Yersinia pestis
cugacucccugacucccu

SEQ ID NO: 2281674 - RNA, 22 nt, Yersinia pestis
cugacguaauaccggcaccaau

SEQ ID NO: 2281675 - RNA, 16 nt, Yersinia pestis
cucuuuuuccacaccc

SEQ ID NO: 2281676 - RNA, 17 nt, Yersinia pestis
cugaaacggugaggaua

SEQ ID NO: 2281677 - RNA, 22 nt, Yersinia pestis
cugaaauacggaacgcagaacu

SEQ ID NO: 2281678 - RNA, 19 nt, Yersinia pestis
cugaaaguguauuucucaa

SEQ ID NO: 2281679 - RNA, 16 nt, Yersinia pestis
cugaaaguguauuucu

SEQ ID NO: 2281680 - RNA, 16 nt, Yersinia pestis
cugaaagugcccccug

SEQ ID NO: 2281681 - RNA, 18 nt, Yersinia pestis
cugaaacuucaaaaucaa

SEQ ID NO: 2281682 - RNA, 13 nt, Yersinia pestis
cugaaagcaaaca

SEQ ID NO: 2281683 - RNA, 19 nt, Yersinia pestis
cugaacuucugggaucauc

SEQ ID NO: 2281684 - RNA, 20 nt, Yersinia pestis
cugaagagaaauaacccaua

SEQ ID NO: 2281685 - RNA, 14 nt, Yersinia pestis
cugaagacccaagg

SEQ ID NO: 2281686 - RNA, 21 nt, Yersinia pestis
cugaacucaucagcgcccccu

SEQ ID NO: 2281687 - RNA, 23 nt, Yersinia pestis
cugaacguaaaacaaucaccacc

SEQ ID NO: 2281688 - RNA, 17 nt, Yersinia pestis
cugaagccuacgagaga

SEQ ID NO: 2281689 - RNA, 20 nt, Yersinia pestis
cugaagaugccaaucaaaaa

SEQ ID NO: 2281690 - RNA, 15 nt, Yersinia pestis
cugaagaugccaauc

SEQ ID NO: 2281691 - RNA, 14 nt, Yersinia pestis
cugaaccauuuuuu

SEQ ID NO: 2281692 - RNA, 15 nt, Yersinia pestis
cugaacgaccagaau

SEQ ID NO: 2281693 - RNA, 18 nt, Yersinia pestis
cugaacgaggacuuccug

SEQ ID NO: 2281694 - RNA, 20 nt, Yersinia pestis
cugaacgaggacuuccugcc

SEQ ID NO: 2281695 - RNA, 21 nt, Yersinia pestis
cugaacaaaauagucaguggg

SEQ ID NO: 2281696 - RNA, 14 nt, Yersinia pestis
cugaaauuuuuuaa

SEQ ID NO: 2281697 - RNA, 18 nt, Yersinia pestis
cucuucugccuauccuca

SEQ ID NO: 2281698 - RNA, 20 nt, Yersinia pestis
cucuucuaaaaucgcacuga

SEQ ID NO: 2281699 - RNA, 13 nt, Yersinia pestis
cucuugagaaaug

SEQ ID NO: 2281700 - RNA, 15 nt, Yersinia pestis
cucuugagaaaugaa

SEQ ID NO: 2281701 - RNA, 22 nt, Yersinia pestis
cucuugagaaaugaauauuagg

SEQ ID NO: 2281702 - RNA, 17 nt, Yersinia pestis
cucuugcgcuccacgcc

SEQ ID NO: 2281703 - RNA, 19 nt, Yersinia pestis
cucuugcgcuccacgcccc

SEQ ID NO: 2281704 - RNA, 11 nt, Yersinia pestis
cucuucuuuua

SEQ ID NO: 2281705 - RNA, 15 nt, Yersinia pestis
cucuugaacggugag

SEQ ID NO: 2281706 - RNA, 17 nt, Yersinia pestis
cucuugaacggugagga

SEQ ID NO: 2281707 - RNA, 18 nt, Yersinia pestis
cucuuguguaauuauauu

SEQ ID NO: 2281708 - RNA, 13 nt, Yersinia pestis
cucuuguaaacca

SEQ ID NO: 2281709 - RNA, 18 nt, Yersinia pestis
cucuuguuuugcaaugcu

SEQ ID NO: 2281710 - RNA, 20 nt, Yersinia pestis
cucuuuaacaauuuaucaga

SEQ ID NO: 2281711 - RNA, 17 nt, Yersinia pestis
cucuuucagcucuucaa

SEQ ID NO: 2281712 - RNA, 18 nt, Yersinia pestis
cucuuucagcucuucaau

SEQ ID NO: 2281713 - RNA, 16 nt, Yersinia pestis
cucuuuccagcaaaag

SEQ ID NO: 2281714 - RNA, 21 nt, Yersinia pestis
cucuuuccaacaguagcuuga

SEQ ID NO: 2281715 - RNA, 16 nt, Yersinia pestis
cucuuucccuucaggu

SEQ ID NO: 2281716 - RNA, 12 nt, Yersinia pestis
cucuuucccuuc

SEQ ID NO: 2281717 - RNA, 18 nt, Yersinia pestis
cucuuuccccauuuuuuu

SEQ ID NO: 2281718 - RNA, 21 nt, Yersinia pestis
cucuuuauacauauguugagu

SEQ ID NO: 2281719 - RNA, 12 nt, Yersinia pestis
cucuuauauaaa

SEQ ID NO: 2281720 - RNA, 20 nt, Yersinia pestis
cucuuauauaaauccagccc

SEQ ID NO: 2281721 - RNA, 17 nt, Yersinia pestis
cucuuaaugucuuuacu

SEQ ID NO: 2281722 - RNA, 18 nt, Yersinia pestis
cucuuacauaaagaccca

SEQ ID NO: 2281723 - RNA, 19 nt, Yersinia pestis
cucugucaacgcuucagua

SEQ ID NO: 2281724 - RNA, 16 nt, Yersinia pestis
cucuguuuuaaaaaaa

SEQ ID NO: 2281725 - RNA, 22 nt, Yersinia pestis
cucuuaaagaaaauuuacccug

SEQ ID NO: 2281726 - RNA, 23 nt, Yersinia pestis
cucugucagcccuaauauccuca

SEQ ID NO: 2281727 - RNA, 11 nt, Yersinia pestis
cucuuccugua

SEQ ID NO: 2281728 - RNA, 17 nt, Yersinia pestis
cucuucagcaauuuuua

SEQ ID NO: 2281729 - RNA, 11 nt, Yersinia pestis
cucuucaccaa

SEQ ID NO: 2281730 - RNA, 14 nt, Yersinia pestis
cucuucaauuucca

SEQ ID NO: 2281731 - RNA, 15 nt, Yersinia pestis
cucuucaauuuccau

SEQ ID NO: 2281732 - RNA, 17 nt, Yersinia pestis
cucuucaauuuccaucu

SEQ ID NO: 2281733 - RNA, 23 nt, Yersinia pestis
cucuucauaagccagugcuauuc

SEQ ID NO: 2281734 - RNA, 17 nt, Yersinia pestis
cucuucagccuauccuc

SEQ ID NO: 2281735 - RNA, 21 nt, Yersinia pestis
cucuucaucuacagacuccaa

SEQ ID NO: 2281736 - RNA, 22 nt, Yersinia pestis
cucuuccagcaacaugccauug

SEQ ID NO: 2281737 - RNA, 18 nt, Yersinia pestis
cuagacaguaaccgggcu

SEQ ID NO: 2281738 - RNA, 12 nt, Yersinia pestis
cuacuuauuucc

SEQ ID NO: 2281739 - RNA, 22 nt, Yersinia pestis
cuacugauuggauaaaauauua

SEQ ID NO: 2281740 - RNA, 14 nt, Yersinia pestis
cuacuggcugaagu

SEQ ID NO: 2281741 - RNA, 15 nt, Yersinia pestis
cuacuggcugaaguu

SEQ ID NO: 2281742 - RNA, 21 nt, Yersinia pestis
cuacucguaacgacgaaauag

SEQ ID NO: 2281743 - RNA, 17 nt, Yersinia pestis
cuagggcuacugaccug

SEQ ID NO: 2281744 - RNA, 17 nt, Yersinia pestis
cuagggauuuuaagcag

SEQ ID NO: 2281745 - RNA, 22 nt, Yersinia pestis
cuagggauuuuaagcagccgcc

SEQ ID NO: 2281746 - RNA, 20 nt, Yersinia pestis
cuagugcgcugugcccuacu

SEQ ID NO: 2281747 - RNA, 14 nt, Yersinia pestis
cuagugccacaaca

SEQ ID NO: 2281748 - RNA, 19 nt, Yersinia pestis
cuagugagugaauagauaa

SEQ ID NO: 2281749 - RNA, 14 nt, Yersinia pestis
cuagcugcugcaag

SEQ ID NO: 2281750 - RNA, 18 nt, Yersinia pestis
cuagcucaagggcacagu

SEQ ID NO: 2281751 - RNA, 19 nt, Yersinia pestis
cuagcuguuguuguugauu

SEQ ID NO: 2281752 - RNA, 16 nt, Yersinia pestis
cuaggcuauugacaaa

SEQ ID NO: 2281753 - RNA, 19 nt, Yersinia pestis
cuaggcucagcauggaaga

SEQ ID NO: 2281754 - RNA, 15 nt, Yersinia pestis
cuagcgguuucacga

SEQ ID NO: 2281755 - RNA, 15 nt, Yersinia pestis
cuagauuuucuuuca

SEQ ID NO: 2281756 - RNA, 14 nt, Yersinia pestis
cuagauuuucuuuc

SEQ ID NO: 2281757 - RNA, 22 nt, Yersinia pestis
cuagaucacagacguuuaaaua

SEQ ID NO: 2281758 - RNA, 15 nt, Yersinia pestis
cuagauggaaaucac

SEQ ID NO: 2281759 - RNA, 18 nt, Yersinia pestis
cuagaugcggcaacuuuu

SEQ ID NO: 2281760 - RNA, 12 nt, Yersinia pestis
cuagaugcggca

SEQ ID NO: 2281761 - RNA, 21 nt, Yersinia pestis
cuagauuaaccuuaucaccaa

SEQ ID NO: 2281762 - RNA, 13 nt, Yersinia pestis
cuauuaggcuuua

SEQ ID NO: 2281763 - RNA, 20 nt, Yersinia pestis
cuauuaggcuuuaaccugca

SEQ ID NO: 2281764 - RNA, 17 nt, Yersinia pestis
cuauguuggcaaauaau

SEQ ID NO: 2281765 - RNA, 12 nt, Yersinia pestis
cuauuccaguuu

SEQ ID NO: 2281766 - RNA, 14 nt, Yersinia pestis
cuauucauaaauca

SEQ ID NO: 2281767 - RNA, 18 nt, Yersinia pestis
cuauucccugcaauugca

SEQ ID NO: 2281768 - RNA, 15 nt, Yersinia pestis
cuauucccuuguuug

SEQ ID NO: 2281769 - RNA, 19 nt, Yersinia pestis
cuauucucgaaaaagagau

SEQ ID NO: 2281770 - RNA, 15 nt, Yersinia pestis
cuaucgccuucaucg

SEQ ID NO: 2281771 - RNA, 22 nt, Yersinia pestis
cuaucgcgaaaaugaagcgaug

SEQ ID NO: 2281772 - RNA, 18 nt, Yersinia pestis
cuaucgguaucucccgca

SEQ ID NO: 2281773 - RNA, 16 nt, Yersinia pestis
cuaucucaucuuaauc

SEQ ID NO: 2281774 - RNA, 19 nt, Yersinia pestis
cuaucuauuuuuauuucuc

SEQ ID NO: 2281775 - RNA, 18 nt, Yersinia pestis
cuaugcacccauagcuca

SEQ ID NO: 2281776 - RNA, 20 nt, Yersinia pestis
cuaugccggaggauauuuau

SEQ ID NO: 2281777 - RNA, 23 nt, Yersinia pestis
cuaugccggaggauauuuauuuc

SEQ ID NO: 2281778 - RNA, 14 nt, Yersinia pestis
cuauagugccuaau

SEQ ID NO: 2281779 - RNA, 17 nt, Yersinia pestis
cuauagugccuaauaaa

SEQ ID NO: 2281780 - RNA, 17 nt, Yersinia pestis
cuauauucucauugccc

SEQ ID NO: 2281781 - RNA, 13 nt, Yersinia pestis
cuaucaucaccau

SEQ ID NO: 2281782 - RNA, 15 nt, Yersinia pestis
cuauccacaaacuca

SEQ ID NO: 2281783 - RNA, 18 nt, Yersinia pestis
cuaucaggcucauucagu

SEQ ID NO: 2281784 - RNA, 14 nt, Yersinia pestis
cuaucauuaaaugg

SEQ ID NO: 2281785 - RNA, 22 nt, Yersinia pestis
cuauccgaaaaauauucucaau

SEQ ID NO: 2281786 - RNA, 15 nt, Yersinia pestis
cuauccgaaaaauau

SEQ ID NO: 2281787 - RNA, 17 nt, Yersinia pestis
cuaucaccggcccaacu

SEQ ID NO: 2281788 - RNA, 16 nt, Yersinia pestis
cuaucacuagcgggcc

SEQ ID NO: 2281789 - RNA, 23 nt, Yersinia pestis
cuaucagcgcccuacugcaucag

SEQ ID NO: 2281790 - RNA, 20 nt, Yersinia pestis
cuaucaauugcuggcuauca

SEQ ID NO: 2281791 - RNA, 18 nt, Yersinia pestis
cuaucaacuuugaucccc

SEQ ID NO: 2281792 - RNA, 15 nt, Yersinia pestis
cucaaaauuaucuaa

SEQ ID NO: 2281793 - RNA, 13 nt, Yersinia pestis
cucaaaauacaua

SEQ ID NO: 2281794 - RNA, 14 nt, Yersinia pestis
cucaaaauacauaa

SEQ ID NO: 2281795 - RNA, 19 nt, Yersinia pestis
cucaaaaggauggcccaag

SEQ ID NO: 2281796 - RNA, 23 nt, Yersinia pestis
cucaaaacaauuucgaaaacuca

SEQ ID NO: 2281797 - RNA, 15 nt, Yersinia pestis
cuauugauaaaacca

SEQ ID NO: 2281798 - RNA, 15 nt, Yersinia pestis
cuauugacaaaguac

SEQ ID NO: 2281799 - RNA, 19 nt, Yersinia pestis
cuauugaccuguacgugaa

SEQ ID NO: 2281800 - RNA, 22 nt, Yersinia pestis
cuauugauaaaaccacugaccu

SEQ ID NO: 2281801 - RNA, 13 nt, Yersinia pestis
cuauugcgacggu

SEQ ID NO: 2281802 - RNA, 19 nt, Yersinia pestis
cuauugcccaucaugccag

SEQ ID NO: 2281803 - RNA, 15 nt, Yersinia pestis
cuauugugucaauac

SEQ ID NO: 2281804 - RNA, 14 nt, Yersinia pestis
cucaagaaauuuaa

SEQ ID NO: 2281805 - RNA, 21 nt, Yersinia pestis
cucaacugcucaacugcucaa

SEQ ID NO: 2281806 - RNA, 18 nt, Yersinia pestis
cucaacugcucaacugcu

SEQ ID NO: 2281807 - RNA, 16 nt, Yersinia pestis
cucaacucaaaacaau

SEQ ID NO: 2281808 - RNA, 12 nt, Yersinia pestis
cucaagaccugc

SEQ ID NO: 2281809 - RNA, 15 nt, Yersinia pestis
cucaagccucuagga

SEQ ID NO: 2281810 - RNA, 14 nt, Yersinia pestis
cucaauauuaauaa

SEQ ID NO: 2281811 - RNA, 16 nt, Yersinia pestis
cucaauauuaauaaug

SEQ ID NO: 2281812 - RNA, 17 nt, Yersinia pestis
cucaauauuaauaaugc

SEQ ID NO: 2281813 - RNA, 17 nt, Yersinia pestis
cucaauagcuaauaauu

SEQ ID NO: 2281814 - RNA, 20 nt, Yersinia pestis
cucaagcguacaucagggug

SEQ ID NO: 2281815 - RNA, 19 nt, Yersinia pestis
cucaauaaauccaucaaua

SEQ ID NO: 2281816 - RNA, 17 nt, Yersinia pestis
cucacaaaauaacuggg

SEQ ID NO: 2281817 - RNA, 17 nt, Yersinia pestis
cucaccccacuuuccac

SEQ ID NO: 2281818 - RNA, 14 nt, Yersinia pestis
cucacuccauucgu

SEQ ID NO: 2281819 - RNA, 17 nt, Yersinia pestis
cucacuacccuuaggua

SEQ ID NO: 2281820 - RNA, 17 nt, Yersinia pestis
cucacuaaaccaggugu

SEQ ID NO: 2281821 - RNA, 17 nt, Yersinia pestis
cucacguaccaaaucag

SEQ ID NO: 2281822 - RNA, 16 nt, Yersinia pestis
cucacguauuuucauu

SEQ ID NO: 2281823 - RNA, 14 nt, Yersinia pestis
cucacguauuuuca

SEQ ID NO: 2281824 - RNA, 14 nt, Yersinia pestis
cucaccgagcauau

SEQ ID NO: 2281825 - RNA, 20 nt, Yersinia pestis
cucaccgagcauauuuuuua

SEQ ID NO: 2281826 - RNA, 19 nt, Yersinia pestis
cucaccccuauuagggaac

SEQ ID NO: 2281827 - RNA, 20 nt, Yersinia pestis
cucaguuggguaucuuugcu

SEQ ID NO: 2281828 - RNA, 15 nt, Yersinia pestis
cucaguugaugcaaa

SEQ ID NO: 2281829 - RNA, 16 nt, Yersinia pestis
cucaguguggaauaca

SEQ ID NO: 2281830 - RNA, 13 nt, Yersinia pestis
cucauauaaucau

SEQ ID NO: 2281831 - RNA, 18 nt, Yersinia pestis
cucauaccgaauaauaaa

SEQ ID NO: 2281832 - RNA, 13 nt, Yersinia pestis
cucauacucaguc

SEQ ID NO: 2281833 - RNA, 22 nt, Yersinia pestis
cucacuggcuuuauuauaugau

SEQ ID NO: 2281834 - RNA, 22 nt, Yersinia pestis
cucacugucgggguagaucagc

SEQ ID NO: 2281835 - RNA, 19 nt, Yersinia pestis
cucagcgccauauccaacu

SEQ ID NO: 2281836 - RNA, 20 nt, Yersinia pestis
cucagcgggcuaaaugcucg

SEQ ID NO: 2281837 - RNA, 13 nt, Yersinia pestis
cucaggcccgcua

SEQ ID NO: 2281838 - RNA, 16 nt, Yersinia pestis
cucaggggagccgaag

SEQ ID NO: 2281839 - RNA, 15 nt, Yersinia pestis
cucaggcucaucacc

SEQ ID NO: 2281840 - RNA, 22 nt, Yersinia pestis
cuccaaaugaacuaucgccugg

SEQ ID NO: 2281841 - RNA, 13 nt, Yersinia pestis
cuccaacaaccau

SEQ ID NO: 2281842 - RNA, 22 nt, Yersinia pestis
cuccaagcacacugguugaaac

SEQ ID NO: 2281843 - RNA, 20 nt, Yersinia pestis
cuccaagcacacugguugaa

SEQ ID NO: 2281844 - RNA, 15 nt, Yersinia pestis
cucauuuaucuaaaa

SEQ ID NO: 2281845 - RNA, 13 nt, Yersinia pestis
cucauuuaaaaua

SEQ ID NO: 2281846 - RNA, 22 nt, Yersinia pestis
cuccaaagcuuccaauauugag

SEQ ID NO: 2281847 - RNA, 16 nt, Yersinia pestis
cucauucaugaggcuu

SEQ ID NO: 2281848 - RNA, 19 nt, Yersinia pestis
cucauuggcaaauugcugg

SEQ ID NO: 2281849 - RNA, 19 nt, Yersinia pestis
cucauugccuggcccaucu

SEQ ID NO: 2281850 - RNA, 14 nt, Yersinia pestis
cucauucaugaggc

SEQ ID NO: 2281851 - RNA, 16 nt, Yersinia pestis
cucauuauggauaauu

SEQ ID NO: 2281852 - RNA, 13 nt, Yersinia pestis
cucauucaugagg

SEQ ID NO: 2281853 - RNA, 14 nt, Yersinia pestis
cucaugaaugaggc

SEQ ID NO: 2281854 - RNA, 16 nt, Yersinia pestis
cucaugaaugaggcug

SEQ ID NO: 2281855 - RNA, 17 nt, Yersinia pestis
cucaugaaugaggcuga

SEQ ID NO: 2281856 - RNA, 20 nt, Yersinia pestis
cucaugaaugaggcugaggu

SEQ ID NO: 2281857 - RNA, 12 nt, Yersinia pestis
cucaugacaaaa

SEQ ID NO: 2281858 - RNA, 13 nt, Yersinia pestis
cucaugaaugagg

SEQ ID NO: 2281859 - RNA, 13 nt, Yersinia pestis
cucaugccccaau

SEQ ID NO: 2281860 - RNA, 18 nt, Yersinia pestis
cucaugcucuucauaagc

SEQ ID NO: 2281861 - RNA, 20 nt, Yersinia pestis
cucauauucaaaaucugaua

SEQ ID NO: 2281862 - RNA, 16 nt, Yersinia pestis
cucauauuguccaaag

SEQ ID NO: 2281863 - RNA, 22 nt, Yersinia pestis
cucaucaguaacgccugauuca

SEQ ID NO: 2281864 - RNA, 15 nt, Yersinia pestis
cucaucauaaaaaua

SEQ ID NO: 2281865 - RNA, 19 nt, Yersinia pestis
cucauccaacguaaacauu

SEQ ID NO: 2281866 - RNA, 17 nt, Yersinia pestis
cucauccagcaacucaa

SEQ ID NO: 2281867 - RNA, 12 nt, Yersinia pestis
cucauccagauu

SEQ ID NO: 2281868 - RNA, 23 nt, Yersinia pestis
cuacaucgguuagcguuuuagca

SEQ ID NO: 2281869 - RNA, 21 nt, Yersinia pestis
cuacaggcgcaacugccaugg

SEQ ID NO: 2281870 - RNA, 22 nt, Yersinia pestis
cuacauuuggcgcucauuuccc

SEQ ID NO: 2281871 - RNA, 19 nt, Yersinia pestis
cuaccaaccgcuuuaucgc

SEQ ID NO: 2281872 - RNA, 15 nt, Yersinia pestis
cuaccaccuacaacc

SEQ ID NO: 2281873 - RNA, 16 nt, Yersinia pestis
cuaccaccuacaaccu

SEQ ID NO: 2281874 - RNA, 22 nt, Yersinia pestis
cuaccaccuacaaccuaccacc

SEQ ID NO: 2281875 - RNA, 15 nt, Yersinia pestis
cuaccaccuaccacc

SEQ ID NO: 2281876 - RNA, 16 nt, Yersinia pestis
cuaccaccuaccaccu

SEQ ID NO: 2281877 - RNA, 13 nt, Yersinia pestis
cuaccagcaauac

SEQ ID NO: 2281878 - RNA, 18 nt, Yersinia pestis
cuaccagcagugcagcca

SEQ ID NO: 2281879 - RNA, 19 nt, Yersinia pestis
cuaccaugagugaaaauau

SEQ ID NO: 2281880 - RNA, 21 nt, Yersinia pestis
cuaccaugagugaaaauaugu

SEQ ID NO: 2281881 - RNA, 17 nt, Yersinia pestis
cuaauuguuauuauuaa

SEQ ID NO: 2281882 - RNA, 15 nt, Yersinia pestis
cuaauuugacgccgc

SEQ ID NO: 2281883 - RNA, 20 nt, Yersinia pestis
cuaauuucaucucaauaacu

SEQ ID NO: 2281884 - RNA, 22 nt, Yersinia pestis
cuaauuucaucucaauaacuau

SEQ ID NO: 2281885 - RNA, 14 nt, Yersinia pestis
cuaauuuucccugu

SEQ ID NO: 2281886 - RNA, 13 nt, Yersinia pestis
cuacacacagcaa

SEQ ID NO: 2281887 - RNA, 14 nt, Yersinia pestis
cuacacacagcaau

SEQ ID NO: 2281888 - RNA, 16 nt, Yersinia pestis
cuacaaccuaccaccu

SEQ ID NO: 2281889 - RNA, 13 nt, Yersinia pestis
cuaauauuaaguc

SEQ ID NO: 2281890 - RNA, 13 nt, Yersinia pestis
cuaaucauaucca

SEQ ID NO: 2281891 - RNA, 11 nt, Yersinia pestis
cuaauccaagg

SEQ ID NO: 2281892 - RNA, 12 nt, Yersinia pestis
cuaauccaaggc

SEQ ID NO: 2281893 - RNA, 13 nt, Yersinia pestis
cuaaucggcuggc

SEQ ID NO: 2281894 - RNA, 17 nt, Yersinia pestis
cuaaugcggaaacaccu

SEQ ID NO: 2281895 - RNA, 15 nt, Yersinia pestis
cuaauguaauaaucu

SEQ ID NO: 2281896 - RNA, 17 nt, Yersinia pestis
cuaauggugcuauuucu

SEQ ID NO: 2281897 - RNA, 18 nt, Yersinia pestis
cuaauggugcuauuucug

SEQ ID NO: 2281898 - RNA, 20 nt, Yersinia pestis
cuaauggccagacacugaca

SEQ ID NO: 2281899 - RNA, 18 nt, Yersinia pestis
cuaaugucauuuccugua

SEQ ID NO: 2281900 - RNA, 21 nt, Yersinia pestis
cuaaugucauuuccuguauuu

SEQ ID NO: 2281901 - RNA, 13 nt, Yersinia pestis
cuaauuaauuuaa

SEQ ID NO: 2281902 - RNA, 20 nt, Yersinia pestis
cuaauucaggcaaauucuca

SEQ ID NO: 2281903 - RNA, 23 nt, Yersinia pestis
cuaauuauuuuauuuaaaauuaa

SEQ ID NO: 2281904 - RNA, 15 nt, Yersinia pestis
cuaauucuuaggaua

SEQ ID NO: 2281905 - RNA, 20 nt, Yersinia pestis
cuaauucuccuuucuuuucg

SEQ ID NO: 2281906 - RNA, 12 nt, Yersinia pestis
cuaauucuccuu

SEQ ID NO: 2281907 - RNA, 19 nt, Yersinia pestis
cuaauucuccuuucuuuuc

SEQ ID NO: 2281908 - RNA, 22 nt, Yersinia pestis
cuaagaguccuuaaaaacccau

SEQ ID NO: 2281909 - RNA, 17 nt, Yersinia pestis
cuaagagucacagcauu

SEQ ID NO: 2281910 - RNA, 23 nt, Yersinia pestis
cuaacuaauaauaaucuuaagua

SEQ ID NO: 2281911 - RNA, 16 nt, Yersinia pestis
cuaacugaugcugaca

SEQ ID NO: 2281912 - RNA, 23 nt, Yersinia pestis
cuaaauccuuguaaggugcuagu

SEQ ID NO: 2281913 - RNA, 18 nt, Yersinia pestis
cuaaauccugcaaauuaa

SEQ ID NO: 2281914 - RNA, 18 nt, Yersinia pestis
cuaacguccccugagcga

SEQ ID NO: 2281915 - RNA, 17 nt, Yersinia pestis
cuaacgucgcuguuacu

SEQ ID NO: 2281916 - RNA, 20 nt, Yersinia pestis
cuaacgucgcuguuacucag

SEQ ID NO: 2281917 - RNA, 22 nt, Yersinia pestis
cuaauaauaauuaaucuuaaug

SEQ ID NO: 2281918 - RNA, 15 nt, Yersinia pestis
cuaauaauuuauaca

SEQ ID NO: 2281919 - RNA, 15 nt, Yersinia pestis
cuaauaauuguucau

SEQ ID NO: 2281920 - RNA, 16 nt, Yersinia pestis
cuaaggccaucaauaa

SEQ ID NO: 2281921 - RNA, 16 nt, Yersinia pestis
cguuucaucuucauca

SEQ ID NO: 2281922 - RNA, 13 nt, Yersinia pestis
cguuguauuuucc

SEQ ID NO: 2281923 - RNA, 19 nt, Yersinia pestis
cguuguuaucaucaccacc

SEQ ID NO: 2281924 - RNA, 20 nt, Yersinia pestis
cguuguuaucaucaccaccc

SEQ ID NO: 2281925 - RNA, 14 nt, Yersinia pestis
cguuguucaagcac

SEQ ID NO: 2281926 - RNA, 13 nt, Yersinia pestis
cguuuugccauua

SEQ ID NO: 2281927 - RNA, 18 nt, Yersinia pestis
cguuuugcagaucaaucg

SEQ ID NO: 2281928 - RNA, 15 nt, Yersinia pestis
cguuuuugaaauacc

SEQ ID NO: 2281929 - RNA, 19 nt, Yersinia pestis
cuaaaauaucacuauaauu

SEQ ID NO: 2281930 - RNA, 22 nt, Yersinia pestis
cuaaaauggcacaauccaauuu

SEQ ID NO: 2281931 - RNA, 21 nt, Yersinia pestis
cuaaacgccgcgucaauaaca

SEQ ID NO: 2281932 - RNA, 18 nt, Yersinia pestis
cuaaacguaaugcgaagc

SEQ ID NO: 2281933 - RNA, 22 nt, Yersinia pestis
cuaaacggcccugugaaucuuu

SEQ ID NO: 2281934 - RNA, 16 nt, Yersinia pestis
cuaaacgcucaaacaa

SEQ ID NO: 2281935 - RNA, 12 nt, Yersinia pestis
cuaaacacggcg

SEQ ID NO: 2281936 - RNA, 21 nt, Yersinia pestis
cuaaacagggcagaaaauacc

SEQ ID NO: 2281937 - RNA, 16 nt, Yersinia pestis
cuaaacagggcagaaa

SEQ ID NO: 2281938 - RNA, 13 nt, Yersinia pestis
cuaaaauuuuaag

SEQ ID NO: 2281939 - RNA, 18 nt, Yersinia pestis
cuaaacucuggcacuggc

SEQ ID NO: 2281940 - RNA, 20 nt, Yersinia pestis
cuaaacucuggcacuggcaa

SEQ ID NO: 2281941 - RNA, 22 nt, Yersinia pestis
cuaaagcgccuuccuuuuauuu

SEQ ID NO: 2281942 - RNA, 14 nt, Yersinia pestis
cuaaagcguggcgc

SEQ ID NO: 2281943 - RNA, 22 nt, Yersinia pestis
cuaaagcggaauuugccucugc

SEQ ID NO: 2281944 - RNA, 18 nt, Yersinia pestis
cguuaucggcgcaggcag

SEQ ID NO: 2281945 - RNA, 19 nt, Yersinia pestis
cguuaucgcgccuuuugga

SEQ ID NO: 2281946 - RNA, 14 nt, Yersinia pestis
cguuaucagccaca

SEQ ID NO: 2281947 - RNA, 15 nt, Yersinia pestis
cguuauaccucaagc

SEQ ID NO: 2281948 - RNA, 12 nt, Yersinia pestis
cguuaucaauaa

SEQ ID NO: 2281949 - RNA, 21 nt, Yersinia pestis
cgucauugguguuacagcaag

SEQ ID NO: 2281950 - RNA, 22 nt, Yersinia pestis
cgucauuuccguuaacccaaag

SEQ ID NO: 2281951 - RNA, 13 nt, Yersinia pestis
cgucauucaccac

SEQ ID NO: 2281952 - RNA, 15 nt, Yersinia pestis
cguuccuuggcugcc

SEQ ID NO: 2281953 - RNA, 20 nt, Yersinia pestis
cguugccacggaaacguuca

SEQ ID NO: 2281954 - RNA, 20 nt, Yersinia pestis
cguucuaucaaugccuuggc

SEQ ID NO: 2281955 - RNA, 15 nt, Yersinia pestis
cguucuaaaacgucu

SEQ ID NO: 2281956 - RNA, 17 nt, Yersinia pestis
cguucucgauagagaac

SEQ ID NO: 2281957 - RNA, 20 nt, Yersinia pestis
cguugagcaaaaauauaccc

SEQ ID NO: 2281958 - RNA, 15 nt, Yersinia pestis
aaaaaaagacacuaa

SEQ ID NO: 2281959 - RNA, 12 nt, Yersinia pestis
aaaaaaaauaaa

SEQ ID NO: 2281960 - RNA, 10 nt, Yersinia pestis
aaaaaacagc

SEQ ID NO: 2281961 - RNA, 20 nt, Yersinia pestis
aaaaaaccuuauuuuugcau

SEQ ID NO: 2281962 - RNA, 18 nt, Yersinia pestis
aaaaaauacuaucaucau

SEQ ID NO: 2281963 - RNA, 17 nt, Yersinia pestis
aaaaaaccaccaaaaua

SEQ ID NO: 2281964 - RNA, 13 nt, Yersinia pestis
aaaaaaauuaaaa

SEQ ID NO: 2281965 - RNA, 12 nt, Yersinia pestis
aaaaaauccagu

SEQ ID NO: 2281966 - RNA, 16 nt, Yersinia pestis
aaaaaagucacuuaaa

SEQ ID NO: 2281967 - RNA, 13 nt, Yersinia pestis
aaaaaauacgcuu

SEQ ID NO: 2281968 - RNA, 16 nt, Yersinia pestis
aaaaacagacuaaaaa

SEQ ID NO: 2281969 - RNA, 14 nt, Yersinia pestis
aaaaaauuauuaaa

SEQ ID NO: 2281970 - RNA, 20 nt, Yersinia pestis
aaaaaccaauggaaaauaca

SEQ ID NO: 2281971 - RNA, 13 nt, Yersinia pestis
aaaaacaaauaau

SEQ ID NO: 2281972 - RNA, 17 nt, Yersinia pestis
aaaaacacgguugaaaa

SEQ ID NO: 2281973 - RNA, 17 nt, Yersinia pestis
aaaaacagacuaaaaac

SEQ ID NO: 2281974 - RNA, 19 nt, Yersinia pestis
aaaaacagcgaucuauucu

SEQ ID NO: 2281975 - RNA, 19 nt, Yersinia pestis
aaaauuccgcuucacauuu

SEQ ID NO: 2281976 - RNA, 20 nt, Yersinia pestis
aaaauucgugcucaucaacc

SEQ ID NO: 2281977 - RNA, 15 nt, Yersinia pestis
aaaauuguuugacuu

SEQ ID NO: 2281978 - RNA, 13 nt, Yersinia pestis
aaaauucacaaca

SEQ ID NO: 2281979 - RNA, 18 nt, Yersinia pestis
aaaauuugcuucguuucc

SEQ ID NO: 2281980 - RNA, 12 nt, Yersinia pestis
aaaauuucucuu

SEQ ID NO: 2281981 - RNA, 23 nt, Yersinia pestis
aaacaaaaccuaacgccaaaaug

SEQ ID NO: 2281982 - RNA, 12 nt, Yersinia pestis
aaacaaauacac

SEQ ID NO: 2281983 - RNA, 21 nt, Yersinia pestis
aaacaaaucuuaaauugaaga

SEQ ID NO: 2281984 - RNA, 13 nt, Yersinia pestis
aaacaaauguuua

SEQ ID NO: 2281985 - RNA, 19 nt, Yersinia pestis
aaacaacgccgcucaauua

SEQ ID NO: 2281986 - RNA, 17 nt, Yersinia pestis
aaaaugccguacaacaa

SEQ ID NO: 2281987 - RNA, 18 nt, Yersinia pestis
aaaaugccaacaacuggg

SEQ ID NO: 2281988 - RNA, 16 nt, Yersinia pestis
aaaaugccagucaaug

SEQ ID NO: 2281989 - RNA, 19 nt, Yersinia pestis
aaaaucgauagucaacuuu

SEQ ID NO: 2281990 - RNA, 17 nt, Yersinia pestis
aaaaucgauagucaacu

SEQ ID NO: 2281991 - RNA, 18 nt, Yersinia pestis
aaaaucguauaacauaau

SEQ ID NO: 2281992 - RNA, 13 nt, Yersinia pestis
aaaaucgcacuga

SEQ ID NO: 2281993 - RNA, 20 nt, Yersinia pestis
aaaaugauuaauaauaguuu

SEQ ID NO: 2281994 - RNA, 16 nt, Yersinia pestis
aaaaugauuuuuuugc

SEQ ID NO: 2281995 - RNA, 12 nt, Yersinia pestis
aaaaugauuuuu

SEQ ID NO: 2281996 - RNA, 19 nt, Yersinia pestis
aaaaucguauaacauaaua

SEQ ID NO: 2281997 - RNA, 19 nt, Yersinia pestis
aaaauccgguaauggccaa

SEQ ID NO: 2281998 - RNA, 15 nt, Yersinia pestis
aaaaucccaaaauau

SEQ ID NO: 2281999 - RNA, 23 nt, Yersinia pestis
aaaaucccgggaauaaucaauua

SEQ ID NO: 2282000 - RNA, 19 nt, Yersinia pestis
aaaaucaccucaaacugac

SEQ ID NO: 2282001 - RNA, 18 nt, Yersinia pestis
aaaauacucauuuuuaag

SEQ ID NO: 2282002 - RNA, 16 nt, Yersinia pestis
aaaauacuacucaaaa

SEQ ID NO: 2282003 - RNA, 18 nt, Yersinia pestis
aaaauacuacucaaaaaa

SEQ ID NO: 2282004 - RNA, 15 nt, Yersinia pestis
aaaauagacucaaca

SEQ ID NO: 2282005 - RNA, 15 nt, Yersinia pestis
aaaauagcuucccug

SEQ ID NO: 2282006 - RNA, 10 nt, Yersinia pestis
aaaauaauga

SEQ ID NO: 2282007 - RNA, 19 nt, Yersinia pestis
aaaauaauaauucugcuau

SEQ ID NO: 2282008 - RNA, 12 nt, Yersinia pestis
aaaauaaaaauu

SEQ ID NO: 2282009 - RNA, 19 nt, Yersinia pestis
aaaagccugaauucuguag

SEQ ID NO: 2282010 - RNA, 23 nt, Yersinia pestis
aaaagcccguucguugccaaaac

SEQ ID NO: 2282011 - RNA, 19 nt, Yersinia pestis
aaaagcaugcccagccucu

SEQ ID NO: 2282012 - RNA, 13 nt, Yersinia pestis
aaaagcaugccca

SEQ ID NO: 2282013 - RNA, 17 nt, Yersinia pestis
aaaagcccaucgccuga

SEQ ID NO: 2282014 - RNA, 16 nt, Yersinia pestis
aaaagcgaucagcaau

SEQ ID NO: 2282015 - RNA, 13 nt, Yersinia pestis
aaaagaaaaaaac

SEQ ID NO: 2282016 - RNA, 16 nt, Yersinia pestis
aaaagaaaaaaacaga

SEQ ID NO: 2282017 - RNA, 16 nt, Yersinia pestis
aaaacuuuggcugagg

SEQ ID NO: 2282018 - RNA, 18 nt, Yersinia pestis
aaaacugugcaaauggcu

SEQ ID NO: 2282019 - RNA, 16 nt, Yersinia pestis
aaaacugugccugaau

SEQ ID NO: 2282020 - RNA, 16 nt, Yersinia pestis
aaaacuuaucuaaaaa

SEQ ID NO: 2282021 - RNA, 21 nt, Yersinia pestis
aaaacugaugguuuccugaau

SEQ ID NO: 2282022 - RNA, 16 nt, Yersinia pestis
aaaacugauuaauagu

SEQ ID NO: 2282023 - RNA, 22 nt, Yersinia pestis
aaaacugacugccauaauccag

SEQ ID NO: 2282024 - RNA, 14 nt, Yersinia pestis
aaaacucaaacuga

SEQ ID NO: 2282025 - RNA, 15 nt, Yersinia pestis
aaaacucaaagauuu

SEQ ID NO: 2282026 - RNA, 22 nt, Yersinia pestis
aaaacucaggugaguaaacacc

SEQ ID NO: 2282027 - RNA, 17 nt, Yersinia pestis
aaaacugaagcaucaau

SEQ ID NO: 2282028 - RNA, 17 nt, Yersinia pestis
aaaacguuaacugcagu

SEQ ID NO: 2282029 - RNA, 15 nt, Yersinia pestis
aaaacuaaggggcca

SEQ ID NO: 2282030 - RNA, 15 nt, Yersinia pestis
aaaacuauucugcuu

SEQ ID NO: 2282031 - RNA, 22 nt, Yersinia pestis
aaaacggcuuaaaguuauguuu

SEQ ID NO: 2282032 - RNA, 15 nt, Yersinia pestis
aaaacgugaaagcac

SEQ ID NO: 2282033 - RNA, 15 nt, Yersinia pestis
aaaagaagaaaaaua

SEQ ID NO: 2282034 - RNA, 19 nt, Yersinia pestis
aaaagaauuaauaaauauc

SEQ ID NO: 2282035 - RNA, 20 nt, Yersinia pestis
aaaagaauaaguagcuuaug

SEQ ID NO: 2282036 - RNA, 24 nt, Yersinia pestis
aaaagaaugcgaagaaaaacacuu

SEQ ID NO: 2282037 - RNA, 21 nt, Yersinia pestis
aaaagacgccuuccggcaucu

SEQ ID NO: 2282038 - RNA, 15 nt, Yersinia pestis
aaaagauaauaaaac

SEQ ID NO: 2282039 - RNA, 18 nt, Yersinia pestis
aaaagauaauaaaacucu

SEQ ID NO: 2282040 - RNA, 17 nt, Yersinia pestis
aaaagagucgaugaaac

SEQ ID NO: 2282041 - RNA, 13 nt, Yersinia pestis
aaaagcaacuugg

SEQ ID NO: 2282042 - RNA, 13 nt, Yersinia pestis
aaaagcacagaca

SEQ ID NO: 2282043 - RNA, 17 nt, Yersinia pestis
aaaagcacagacaaaca

SEQ ID NO: 2282044 - RNA, 18 nt, Yersinia pestis
aaaagcacagacaaacaa

SEQ ID NO: 2282045 - RNA, 20 nt, Yersinia pestis
aaaagcacagacaaacaacc

SEQ ID NO: 2282046 - RNA, 14 nt, Yersinia pestis
aaaacagacuaaaa

SEQ ID NO: 2282047 - RNA, 14 nt, Yersinia pestis
aaaacaccucuaag

SEQ ID NO: 2282048 - RNA, 16 nt, Yersinia pestis
aaaacaaucuggcagc

SEQ ID NO: 2282049 - RNA, 12 nt, Yersinia pestis
aaaacaauuucg

SEQ ID NO: 2282050 - RNA, 15 nt, Yersinia pestis
aaaacacaauuuuua

SEQ ID NO: 2282051 - RNA, 22 nt, Yersinia pestis
aaaacacagucugucguacuuu

SEQ ID NO: 2282052 - RNA, 18 nt, Yersinia pestis
aaaacaauaaaaagaucu

SEQ ID NO: 2282053 - RNA, 15 nt, Yersinia pestis
aaaacaauaaaaaga

SEQ ID NO: 2282054 - RNA, 13 nt, Yersinia pestis
aaaaauuaaaaua

SEQ ID NO: 2282055 - RNA, 12 nt, Yersinia pestis
aaaaauuaaauu

SEQ ID NO: 2282056 - RNA, 12 nt, Yersinia pestis
aaaaauuaucau

SEQ ID NO: 2282057 - RNA, 14 nt, Yersinia pestis
aaaaauuaucauca

SEQ ID NO: 2282058 - RNA, 13 nt, Yersinia pestis
aaaacaauaaaaa

SEQ ID NO: 2282059 - RNA, 18 nt, Yersinia pestis
aaaaauuauuaaauaaga

SEQ ID NO: 2282060 - RNA, 21 nt, Yersinia pestis
aaaaauccauaacauccuaaa

SEQ ID NO: 2282061 - RNA, 14 nt, Yersinia pestis
aaaaauaucuauuu

SEQ ID NO: 2282062 - RNA, 15 nt, Yersinia pestis
aaaaauaucuauuuc

SEQ ID NO: 2282063 - RNA, 18 nt, Yersinia pestis
aaaaauaucuauuuccau

SEQ ID NO: 2282064 - RNA, 18 nt, Yersinia pestis
aaaaauacaaccaacaaa

SEQ ID NO: 2282065 - RNA, 14 nt, Yersinia pestis
aaaaauacauauca

SEQ ID NO: 2282066 - RNA, 12 nt, Yersinia pestis
aaaaauacaacc

SEQ ID NO: 2282067 - RNA, 17 nt, Yersinia pestis
aaaaauagauuaaaagu

SEQ ID NO: 2282068 - RNA, 14 nt, Yersinia pestis
aaaaauaaauuaga

SEQ ID NO: 2282069 - RNA, 22 nt, Yersinia pestis
aaaaaccgcagcagacaacuga

SEQ ID NO: 2282070 - RNA, 18 nt, Yersinia pestis
aaaaacccucucauccug

SEQ ID NO: 2282071 - RNA, 19 nt, Yersinia pestis
aaaaacagucauuaacaca

SEQ ID NO: 2282072 - RNA, 21 nt, Yersinia pestis
aaaaacagucauuaacacauc

SEQ ID NO: 2282073 - RNA, 15 nt, Yersinia pestis
aaaaacagucauuaa

SEQ ID NO: 2282074 - RNA, 21 nt, Yersinia pestis
aaaaaccaucugaugcagguu

SEQ ID NO: 2282075 - RNA, 15 nt, Yersinia pestis
aaaaaccaugagaau

SEQ ID NO: 2282076 - RNA, 21 nt, Yersinia pestis
aaaaaccaugagaauacuuca

SEQ ID NO: 2282077 - RNA, 21 nt, Yersinia pestis
aaaaacccauuaaaaacaaau

SEQ ID NO: 2282078 - RNA, 12 nt, Yersinia pestis
aaacgugaaagc

SEQ ID NO: 2282079 - RNA, 16 nt, Yersinia pestis
aaacuaacgcgugaag

SEQ ID NO: 2282080 - RNA, 21 nt, Yersinia pestis
aaacuaagaguccuuaaaaac

SEQ ID NO: 2282081 - RNA, 23 nt, Yersinia pestis
aaacgucacuucgccuuaucagc

SEQ ID NO: 2282082 - RNA, 13 nt, Yersinia pestis
aaacgguugcugu

SEQ ID NO: 2282083 - RNA, 14 nt, Yersinia pestis
aaacguaaugcgaa

SEQ ID NO: 2282084 - RNA, 14 nt, Yersinia pestis
aaacgcuaaaccau

SEQ ID NO: 2282085 - RNA, 14 nt, Yersinia pestis
aaacgcucaucaac

SEQ ID NO: 2282086 - RNA, 14 nt, Yersinia pestis
aaacgcugggcgau

SEQ ID NO: 2282087 - RNA, 22 nt, Yersinia pestis
aaacggcacaugggucucgccg

SEQ ID NO: 2282088 - RNA, 19 nt, Yersinia pestis
aaacgcuuuuaacugugca

SEQ ID NO: 2282089 - RNA, 20 nt, Yersinia pestis
aaacgggccgcgcagauuau

SEQ ID NO: 2282090 - RNA, 17 nt, Yersinia pestis
aaacggcgguuaaucgg

SEQ ID NO: 2282091 - RNA, 15 nt, Yersinia pestis
aaacggcuuuuuaaa

SEQ ID NO: 2282092 - RNA, 14 nt, Yersinia pestis
aaacgcacaacaaa

SEQ ID NO: 2282093 - RNA, 13 nt, Yersinia pestis
aaacgccugaucc

SEQ ID NO: 2282094 - RNA, 18 nt, Yersinia pestis
aaacgccuccucuuggau

SEQ ID NO: 2282095 - RNA, 17 nt, Yersinia pestis
aaacgccaucaauaauu

SEQ ID NO: 2282096 - RNA, 18 nt, Yersinia pestis
aaacgccagugcaaaaug

SEQ ID NO: 2282097 - RNA, 14 nt, Yersinia pestis
aaacgccccgauaa

SEQ ID NO: 2282098 - RNA, 20 nt, Yersinia pestis
aaacgccccgauaaaccaac

SEQ ID NO: 2282099 - RNA, 22 nt, Yersinia pestis
aaacgccccgauaaaccaacug

SEQ ID NO: 2282100 - RNA, 16 nt, Yersinia pestis
aaacgcccuugccaua

SEQ ID NO: 2282101 - RNA, 21 nt, Yersinia pestis
aaacgaccaauuucaauaauu

SEQ ID NO: 2282102 - RNA, 18 nt, Yersinia pestis
aaacgacgggcugcugca

SEQ ID NO: 2282103 - RNA, 19 nt, Yersinia pestis
aaaccugugugaccuccgu

SEQ ID NO: 2282104 - RNA, 17 nt, Yersinia pestis
aaaccugcuugaaagca

SEQ ID NO: 2282105 - RNA, 22 nt, Yersinia pestis
aaacuauucaucccuaaaauca

SEQ ID NO: 2282106 - RNA, 14 nt, Yersinia pestis
aaacuauucugcuu

SEQ ID NO: 2282107 - RNA, 16 nt, Yersinia pestis
aaacucacaaaauaac

SEQ ID NO: 2282108 - RNA, 14 nt, Yersinia pestis
aaacuauuaacucu

SEQ ID NO: 2282109 - RNA, 13 nt, Yersinia pestis
aaacucuaagggu

SEQ ID NO: 2282110 - RNA, 13 nt, Yersinia pestis
aaacucuggaugg

SEQ ID NO: 2282111 - RNA, 14 nt, Yersinia pestis
aaacucuggauggg

SEQ ID NO: 2282112 - RNA, 15 nt, Yersinia pestis
aaacugaaguuaaaa

SEQ ID NO: 2282113 - RNA, 20 nt, Yersinia pestis
aaacugaccgauaaacgcca

SEQ ID NO: 2282114 - RNA, 15 nt, Yersinia pestis
aaacugaaaaaggca

SEQ ID NO: 2282115 - RNA, 21 nt, Yersinia pestis
aaacucccuucaaucaaugaa

SEQ ID NO: 2282116 - RNA, 21 nt, Yersinia pestis
aaacucacgguuucuaaaaaa

SEQ ID NO: 2282117 - RNA, 13 nt, Yersinia pestis
aaacuuaauuuca

SEQ ID NO: 2282118 - RNA, 14 nt, Yersinia pestis
aaacuucaaaauca

SEQ ID NO: 2282119 - RNA, 17 nt, Yersinia pestis
aaacuucacaaugcaca

SEQ ID NO: 2282120 - RNA, 16 nt, Yersinia pestis
aaacuucaaaaucaag

SEQ ID NO: 2282121 - RNA, 16 nt, Yersinia pestis
aaacuuuccugacccg

SEQ ID NO: 2282122 - RNA, 18 nt, Yersinia pestis
aaacuugauucaccagau

SEQ ID NO: 2282123 - RNA, 19 nt, Yersinia pestis
aaacugauuaauaguguug

SEQ ID NO: 2282124 - RNA, 14 nt, Yersinia pestis
aaacugccuauuua

SEQ ID NO: 2282125 - RNA, 16 nt, Yersinia pestis
aaacugcgcuuccagc

SEQ ID NO: 2282126 - RNA, 18 nt, Yersinia pestis
aaacuggcccagcuuuau

SEQ ID NO: 2282127 - RNA, 15 nt, Yersinia pestis
aaacugugcaaaugg

SEQ ID NO: 2282128 - RNA, 15 nt, Yersinia pestis
aaacuguucuuauug

SEQ ID NO: 2282129 - RNA, 14 nt, Yersinia pestis
aaacuuaaaaauca

SEQ ID NO: 2282130 - RNA, 22 nt, Yersinia pestis
aaacuguuuuuuaaagaaaaaa

SEQ ID NO: 2282131 - RNA, 20 nt, Yersinia pestis
aaagacuuuauucacagcag

SEQ ID NO: 2282132 - RNA, 19 nt, Yersinia pestis
aaagagauccguuuaauca

SEQ ID NO: 2282133 - RNA, 15 nt, Yersinia pestis
aaagauaauaaaacu

SEQ ID NO: 2282134 - RNA, 22 nt, Yersinia pestis
aaagagcgcucuggcgcucuug

SEQ ID NO: 2282135 - RNA, 19 nt, Yersinia pestis
aaagacgccggcuucccug

SEQ ID NO: 2282136 - RNA, 23 nt, Yersinia pestis
aaagacgccuuccggcaucuuuu

SEQ ID NO: 2282137 - RNA, 16 nt, Yersinia pestis
aaagacgucauaaaua

SEQ ID NO: 2282138 - RNA, 13 nt, Yersinia pestis
aaacuuuucaguu

SEQ ID NO: 2282139 - RNA, 22 nt, Yersinia pestis
aaacuuuucaguuuuaauuuau

SEQ ID NO: 2282140 - RNA, 18 nt, Yersinia pestis
aaacuuugccguuggcaa

SEQ ID NO: 2282141 - RNA, 21 nt, Yersinia pestis
aaagaauaacuggagaauuua

SEQ ID NO: 2282142 - RNA, 14 nt, Yersinia pestis
aaagcauuuaucau

SEQ ID NO: 2282143 - RNA, 22 nt, Yersinia pestis
aaagcauuuaucauauuaacau

SEQ ID NO: 2282144 - RNA, 12 nt, Yersinia pestis
aaagcagcaguu

SEQ ID NO: 2282145 - RNA, 17 nt, Yersinia pestis
aaagcacgauaaaugua

SEQ ID NO: 2282146 - RNA, 20 nt, Yersinia pestis
aaagcagacuugaacuucga

SEQ ID NO: 2282147 - RNA, 17 nt, Yersinia pestis
aaagcagagaaugagua

SEQ ID NO: 2282148 - RNA, 14 nt, Yersinia pestis
aaagauagcaaaag

SEQ ID NO: 2282149 - RNA, 16 nt, Yersinia pestis
aaagauagcaaaagaa

SEQ ID NO: 2282150 - RNA, 15 nt, Yersinia pestis
aaagauagccacuaa

SEQ ID NO: 2282151 - RNA, 18 nt, Yersinia pestis
aaagauagccacuaacua

SEQ ID NO: 2282152 - RNA, 17 nt, Yersinia pestis
aaagauagcaaaagaau

SEQ ID NO: 2282153 - RNA, 23 nt, Yersinia pestis
aaagcaaacaauuagucacuaaa

SEQ ID NO: 2282154 - RNA, 22 nt, Yersinia pestis
aaagcaaacgccgcucuucagc

SEQ ID NO: 2282155 - RNA, 22 nt, Yersinia pestis
aaagauuucaucggcaaaaaca

SEQ ID NO: 2282156 - RNA, 20 nt, Yersinia pestis
aaagauuuccuuucgcacuu

SEQ ID NO: 2282157 - RNA, 22 nt, Yersinia pestis
aaagauuucaucauucaauacc

SEQ ID NO: 2282158 - RNA, 13 nt, Yersinia pestis
aaagcuguaucga

SEQ ID NO: 2282159 - RNA, 17 nt, Yersinia pestis
aaaggcaagauuucucu

SEQ ID NO: 2282160 - RNA, 12 nt, Yersinia pestis
aaaggcaaagaa

SEQ ID NO: 2282161 - RNA, 17 nt, Yersinia pestis
aaaggcaaaagcaucac

SEQ ID NO: 2282162 - RNA, 19 nt, Yersinia pestis
aaaggaauaucugugauaa

SEQ ID NO: 2282163 - RNA, 18 nt, Yersinia pestis
aaaggacacgauuuuuac

SEQ ID NO: 2282164 - RNA, 24 nt, Yersinia pestis
aaagcgugacgcugaacagccugu

SEQ ID NO: 2282165 - RNA, 16 nt, Yersinia pestis
aaagcguuaauuauag

SEQ ID NO: 2282166 - RNA, 16 nt, Yersinia pestis
aaagcuaauauucucu

SEQ ID NO: 2282167 - RNA, 15 nt, Yersinia pestis
aaagccgagcaagug

SEQ ID NO: 2282168 - RNA, 15 nt, Yersinia pestis
aaagccgccgccuuc

SEQ ID NO: 2282169 - RNA, 15 nt, Yersinia pestis
aaagcccgcuucaaa

SEQ ID NO: 2282170 - RNA, 22 nt, Yersinia pestis
aaagccccauccguccaaugaa

SEQ ID NO: 2282171 - RNA, 17 nt, Yersinia pestis
aaagcccauagccaugg

SEQ ID NO: 2282172 - RNA, 21 nt, Yersinia pestis
aaaggccggauguaaaacacg

SEQ ID NO: 2282173 - RNA, 20 nt, Yersinia pestis
aaaggcagagaggagaauua

SEQ ID NO: 2282174 - RNA, 16 nt, Yersinia pestis
aaaggcccgcuaguga

SEQ ID NO: 2282175 - RNA, 19 nt, Yersinia pestis
aaagggauuacgccaucca

SEQ ID NO: 2282176 - RNA, 15 nt, Yersinia pestis
aaagggcaacaauau

SEQ ID NO: 2282177 - RNA, 21 nt, Yersinia pestis
aaagguuucugccuuaucaau

SEQ ID NO: 2282178 - RNA, 22 nt, Yersinia pestis
aaagguuucugccuuaucaauc

SEQ ID NO: 2282179 - RNA, 14 nt, Yersinia pestis
aaagguuaacugca

SEQ ID NO: 2282180 - RNA, 17 nt, Yersinia pestis
aaaguaaucuuugagca

SEQ ID NO: 2282181 - RNA, 15 nt, Yersinia pestis
aaaguauugcacuga

SEQ ID NO: 2282182 - RNA, 13 nt, Yersinia pestis
aaaguaucgcuau

SEQ ID NO: 2282183 - RNA, 15 nt, Yersinia pestis
aaaguaugggaaagu

SEQ ID NO: 2282184 - RNA, 10 nt, Yersinia pestis
aaaucaaaua

SEQ ID NO: 2282185 - RNA, 20 nt, Yersinia pestis
aaaucaaacaaaucuuaaau

SEQ ID NO: 2282186 - RNA, 13 nt, Yersinia pestis
aaaucaaaaauga

SEQ ID NO: 2282187 - RNA, 14 nt, Yersinia pestis
aaauauuguugcca

SEQ ID NO: 2282188 - RNA, 21 nt, Yersinia pestis
aaauauucucaauauuaauaa

SEQ ID NO: 2282189 - RNA, 18 nt, Yersinia pestis
aaauauuggcaacaacag

SEQ ID NO: 2282190 - RNA, 23 nt, Yersinia pestis
aaauaggcaggcccgcuucccua

SEQ ID NO: 2282191 - RNA, 13 nt, Yersinia pestis
aaauaggcgucag

SEQ ID NO: 2282192 - RNA, 18 nt, Yersinia pestis
aaauaggcguuaucggcg

SEQ ID NO: 2282193 - RNA, 21 nt, Yersinia pestis
aaauaggcguuaucggcgcag

SEQ ID NO: 2282194 - RNA, 16 nt, Yersinia pestis
aaauagggcugucagc

SEQ ID NO: 2282195 - RNA, 21 nt, Yersinia pestis
aaauaggggcaccguaaauga

SEQ ID NO: 2282196 - RNA, 23 nt, Yersinia pestis
aaauagugcuaucugcugcggua

SEQ ID NO: 2282197 - RNA, 15 nt, Yersinia pestis
aaauaguggcacaaa

SEQ ID NO: 2282198 - RNA, 14 nt, Yersinia pestis
aaauagucaguaaa

SEQ ID NO: 2282199 - RNA, 14 nt, Yersinia pestis
aaauaguaauaauu

SEQ ID NO: 2282200 - RNA, 17 nt, Yersinia pestis
aaauaugaucuugauaa

SEQ ID NO: 2282201 - RNA, 12 nt, Yersinia pestis
aaauauucauua

SEQ ID NO: 2282202 - RNA, 15 nt, Yersinia pestis
aaauauucauuaaaa

SEQ ID NO: 2282203 - RNA, 11 nt, Yersinia pestis
aaauauuauuu

SEQ ID NO: 2282204 - RNA, 19 nt, Yersinia pestis
aaauauuauuuaauuaaau

SEQ ID NO: 2282205 - RNA, 18 nt, Yersinia pestis
aaauaugcugaccacugc

SEQ ID NO: 2282206 - RNA, 16 nt, Yersinia pestis
aaaucaguguaucaau

SEQ ID NO: 2282207 - RNA, 16 nt, Yersinia pestis
aaaucauaagugcauu

SEQ ID NO: 2282208 - RNA, 19 nt, Yersinia pestis
aaaucacguuuccaaaacu

SEQ ID NO: 2282209 - RNA, 22 nt, Yersinia pestis
aaaucacguuuccaaaacucau

SEQ ID NO: 2282210 - RNA, 17 nt, Yersinia pestis
aaaucagacgagucuau

SEQ ID NO: 2282211 - RNA, 23 nt, Yersinia pestis
aaaucagacgagucuauugaaaa

SEQ ID NO: 2282212 - RNA, 12 nt, Yersinia pestis
aaaucagcaagc

SEQ ID NO: 2282213 - RNA, 20 nt, Yersinia pestis
aaaucacaugcggauugaac

SEQ ID NO: 2282214 - RNA, 15 nt, Yersinia pestis
aaaucaccuggccag

SEQ ID NO: 2282215 - RNA, 19 nt, Yersinia pestis
aaaucacccgcaagaauaa

SEQ ID NO: 2282216 - RNA, 22 nt, Yersinia pestis
aaaucacccgcaagaauaacug

SEQ ID NO: 2282217 - RNA, 17 nt, Yersinia pestis
aaaucacaauuucaccc

SEQ ID NO: 2282218 - RNA, 15 nt, Yersinia pestis
aaaucaaauacugug

SEQ ID NO: 2282219 - RNA, 18 nt, Yersinia pestis
aaaucaagggcgauggca

SEQ ID NO: 2282220 - RNA, 14 nt, Yersinia pestis
aaaucaaguacacu

SEQ ID NO: 2282221 - RNA, 15 nt, Yersinia pestis
aaaucaagcugcucg

SEQ ID NO: 2282222 - RNA, 13 nt, Yersinia pestis
aaauagccuguaa

SEQ ID NO: 2282223 - RNA, 18 nt, Yersinia pestis
aaauagcuuccauuaaaa

SEQ ID NO: 2282224 - RNA, 14 nt, Yersinia pestis
aaauagcuucccug

SEQ ID NO: 2282225 - RNA, 16 nt, Yersinia pestis
aaauagcggccaacau

SEQ ID NO: 2282226 - RNA, 18 nt, Yersinia pestis
aaauagcggccaacauaa

SEQ ID NO: 2282227 - RNA, 23 nt, Yersinia pestis
aaauaauccauagauuauuuuua

SEQ ID NO: 2282228 - RNA, 12 nt, Yersinia pestis
aaauaauauuaa

SEQ ID NO: 2282229 - RNA, 20 nt, Yersinia pestis
aaauaauaucugucugacgg

SEQ ID NO: 2282230 - RNA, 18 nt, Yersinia pestis
aaauaaucagcucauuaa

SEQ ID NO: 2282231 - RNA, 20 nt, Yersinia pestis
aaauaaucagcucauuaaac

SEQ ID NO: 2282232 - RNA, 22 nt, Yersinia pestis
aaauaauauaauucaauauaua

SEQ ID NO: 2282233 - RNA, 23 nt, Yersinia pestis
aaauaauaucaagucuugaagag

SEQ ID NO: 2282234 - RNA, 15 nt, Yersinia pestis
aaauaauaucaauga

SEQ ID NO: 2282235 - RNA, 21 nt, Yersinia pestis
aaauaaccgccaaaauaucgc

SEQ ID NO: 2282236 - RNA, 21 nt, Yersinia pestis
aaauaauaauggugaaccaga

SEQ ID NO: 2282237 - RNA, 16 nt, Yersinia pestis
aaauaagaauaagggu

SEQ ID NO: 2282238 - RNA, 14 nt, Yersinia pestis
aaauaagccagugc

SEQ ID NO: 2282239 - RNA, 22 nt, Yersinia pestis
aaauaaguacuuccaauaagug

SEQ ID NO: 2282240 - RNA, 14 nt, Yersinia pestis
aaauaaaauagcgu

SEQ ID NO: 2282241 - RNA, 12 nt, Yersinia pestis
aaauaaaauaau

SEQ ID NO: 2282242 - RNA, 14 nt, Yersinia pestis
aaauaaaauaauaa

SEQ ID NO: 2282243 - RNA, 22 nt, Yersinia pestis
aaauaacccgccuagcaucaua

SEQ ID NO: 2282244 - RNA, 14 nt, Yersinia pestis
aaauaaccgagcgu

SEQ ID NO: 2282245 - RNA, 17 nt, Yersinia pestis
aaauaaccgccaaaaua

SEQ ID NO: 2282246 - RNA, 19 nt, Yersinia pestis
aaauaaccgccaaaauauc

SEQ ID NO: 2282247 - RNA, 12 nt, Yersinia pestis
aaauaaccagag

SEQ ID NO: 2282248 - RNA, 18 nt, Yersinia pestis
aaauaaccagagacagca

SEQ ID NO: 2282249 - RNA, 14 nt, Yersinia pestis
aaauaacaauucac

SEQ ID NO: 2282250 - RNA, 20 nt, Yersinia pestis
aaauaacaauucacucauaa

SEQ ID NO: 2282251 - RNA, 12 nt, Yersinia pestis
aaauaacagcua

SEQ ID NO: 2282252 - RNA, 12 nt, Yersinia pestis
aaauaaauuuaa

SEQ ID NO: 2282253 - RNA, 14 nt, Yersinia pestis
aaauaaacaucaau

SEQ ID NO: 2282254 - RNA, 20 nt, Yersinia pestis
aaauuauugaguaacauuaa

SEQ ID NO: 2282255 - RNA, 19 nt, Yersinia pestis
aaauuauugccgcagauaa

SEQ ID NO: 2282256 - RNA, 12 nt, Yersinia pestis
aaauuaucuaau

SEQ ID NO: 2282257 - RNA, 19 nt, Yersinia pestis
aaauuaugccagucuucca

SEQ ID NO: 2282258 - RNA, 18 nt, Yersinia pestis
aaauuaucgcaauuucag

SEQ ID NO: 2282259 - RNA, 16 nt, Yersinia pestis
aaauuacgguuuacca

SEQ ID NO: 2282260 - RNA, 11 nt, Yersinia pestis
aaauucaauuc

SEQ ID NO: 2282261 - RNA, 14 nt, Yersinia pestis
aaauucacagcgcg

SEQ ID NO: 2282262 - RNA, 15 nt, Yersinia pestis
aaauucacguuuacu

SEQ ID NO: 2282263 - RNA, 17 nt, Yersinia pestis
aaauuccuauaaauuuu

SEQ ID NO: 2282264 - RNA, 18 nt, Yersinia pestis
aaauuccuauaaauuuua

SEQ ID NO: 2282265 - RNA, 16 nt, Yersinia pestis
aaauuccgcuucacau

SEQ ID NO: 2282266 - RNA, 21 nt, Yersinia pestis
aaauuccuggcggcaacacua

SEQ ID NO: 2282267 - RNA, 16 nt, Yersinia pestis
aaauucgggcuuuaau

SEQ ID NO: 2282268 - RNA, 18 nt, Yersinia pestis
aaauucggcuuguugaau

SEQ ID NO: 2282269 - RNA, 23 nt, Yersinia pestis
aaauucguuucucuaaaauuuua

SEQ ID NO: 2282270 - RNA, 22 nt, Yersinia pestis
aaauucguuugggcuaagacua

SEQ ID NO: 2282271 - RNA, 18 nt, Yersinia pestis
aaauucgugcucaucaac

SEQ ID NO: 2282272 - RNA, 23 nt, Yersinia pestis
aaauucucaaugauaaaauccug

SEQ ID NO: 2282273 - RNA, 17 nt, Yersinia pestis
aaauucucaaugauaaa

SEQ ID NO: 2282274 - RNA, 14 nt, Yersinia pestis
aaauucuaucuggu

SEQ ID NO: 2282275 - RNA, 22 nt, Yersinia pestis
aaauucucaaugauaaaauccu

SEQ ID NO: 2282276 - RNA, 18 nt, Yersinia pestis
aaauucuauccggauuaa

SEQ ID NO: 2282277 - RNA, 14 nt, Yersinia pestis
aaauucuaccuggc

SEQ ID NO: 2282278 - RNA, 15 nt, Yersinia pestis
aaaaagcgaucgacc

SEQ ID NO: 2282279 - RNA, 16 nt, Yersinia pestis
aaaaagcguuucagag

SEQ ID NO: 2282280 - RNA, 22 nt, Yersinia pestis
aaaaagcgcgacgguacugauc

SEQ ID NO: 2282281 - RNA, 19 nt, Yersinia pestis
aaauuaauuacuuuauuua

SEQ ID NO: 2282282 - RNA, 20 nt, Yersinia pestis
aaaaaggacacgauuuuuac

SEQ ID NO: 2282283 - RNA, 16 nt, Yersinia pestis
aaaaaggcaccagcgc

SEQ ID NO: 2282284 - RNA, 20 nt, Yersinia pestis
aaauuacagacaaaucacaa

SEQ ID NO: 2282285 - RNA, 12 nt, Yersinia pestis
aaauuaccacca

SEQ ID NO: 2282286 - RNA, 18 nt, Yersinia pestis
aaauggaauaaaaaguca

SEQ ID NO: 2282287 - RNA, 14 nt, Yersinia pestis
aaauuaaauuaaua

SEQ ID NO: 2282288 - RNA, 15 nt, Yersinia pestis
aaauuaaauuucugu

SEQ ID NO: 2282289 - RNA, 13 nt, Yersinia pestis
aaaucuucauaaa

SEQ ID NO: 2282290 - RNA, 21 nt, Yersinia pestis
aaaucuuccuuuccauuuuca

SEQ ID NO: 2282291 - RNA, 13 nt, Yersinia pestis
aaaugaaacacua

SEQ ID NO: 2282292 - RNA, 21 nt, Yersinia pestis
aaaugcucucgagaaauaaau

SEQ ID NO: 2282293 - RNA, 17 nt, Yersinia pestis
aaaugccgauaaaaacu

SEQ ID NO: 2282294 - RNA, 20 nt, Yersinia pestis
aaaucuagcccuucagcaaa

SEQ ID NO: 2282295 - RNA, 18 nt, Yersinia pestis
aaaucuccuccggagagg

SEQ ID NO: 2282296 - RNA, 16 nt, Yersinia pestis
aaaucucaucggcaua

SEQ ID NO: 2282297 - RNA, 17 nt, Yersinia pestis
aaaucauugacguuaca

SEQ ID NO: 2282298 - RNA, 24 nt, Yersinia pestis
aaaucgcacugaguucugcugcca

SEQ ID NO: 2282299 - RNA, 13 nt, Yersinia pestis
aaaucaucagcau

SEQ ID NO: 2282300 - RNA, 17 nt, Yersinia pestis
aaaucaucaucuugaaa

SEQ ID NO: 2282301 - RNA, 15 nt, Yersinia pestis
aaaucaugaaauuuu

SEQ ID NO: 2282302 - RNA, 22 nt, Yersinia pestis
aaaucaugcaguuaaugacaua

SEQ ID NO: 2282303 - RNA, 16 nt, Yersinia pestis
aaguuuucuggcaauu

SEQ ID NO: 2282304 - RNA, 22 nt, Yersinia pestis
aauaaaaaugauaauaaaaaaa

SEQ ID NO: 2282305 - RNA, 13 nt, Yersinia pestis
aauaaaaaaaaau

SEQ ID NO: 2282306 - RNA, 14 nt, Yersinia pestis
aauaaaaaaaaaua

SEQ ID NO: 2282307 - RNA, 18 nt, Yersinia pestis
aauaaaaaauuauuaaau

SEQ ID NO: 2282308 - RNA, 14 nt, Yersinia pestis
aauaaacaaccuuc

SEQ ID NO: 2282309 - RNA, 16 nt, Yersinia pestis
aauaaaaccuuuacaa

SEQ ID NO: 2282310 - RNA, 13 nt, Yersinia pestis
aauaaaacacccu

SEQ ID NO: 2282311 - RNA, 14 nt, Yersinia pestis
aauaaagaggccag

SEQ ID NO: 2282312 - RNA, 15 nt, Yersinia pestis
aauaaaccagcaagc

SEQ ID NO: 2282313 - RNA, 16 nt, Yersinia pestis
aauaaaccgaaaugau

SEQ ID NO: 2282314 - RNA, 19 nt, Yersinia pestis
aauaaacgggcuuccauca

SEQ ID NO: 2282315 - RNA, 16 nt, Yersinia pestis
aauaaaggggguuuuc

SEQ ID NO: 2282316 - RNA, 21 nt, Yersinia pestis
aauaaagccauuucaguaacu

SEQ ID NO: 2282317 - RNA, 18 nt, Yersinia pestis
aauaaagcgauaaauacu

SEQ ID NO: 2282318 - RNA, 13 nt, Yersinia pestis
aauaaauaauugg

SEQ ID NO: 2282319 - RNA, 14 nt, Yersinia pestis
aauaaauaaguuca

SEQ ID NO: 2282320 - RNA, 20 nt, Yersinia pestis
aauaaauagagugaaguauc

SEQ ID NO: 2282321 - RNA, 12 nt, Yersinia pestis
aauaaauacccu

SEQ ID NO: 2282322 - RNA, 19 nt, Yersinia pestis
aauaaauacccugcaccau

SEQ ID NO: 2282323 - RNA, 21 nt, Yersinia pestis
aauaaccuacuccaacaacca

SEQ ID NO: 2282324 - RNA, 21 nt, Yersinia pestis
aauaaccucacacgauuuuua

SEQ ID NO: 2282325 - RNA, 15 nt, Yersinia pestis
aauaacagcuaauca

SEQ ID NO: 2282326 - RNA, 16 nt, Yersinia pestis
aauaacaccagcaggu

SEQ ID NO: 2282327 - RNA, 19 nt, Yersinia pestis
aauaacacggccuauugaa

SEQ ID NO: 2282328 - RNA, 23 nt, Yersinia pestis
aauaacacggccuauugaauaac

SEQ ID NO: 2282329 - RNA, 18 nt, Yersinia pestis
aauaacaauauucauuuu

SEQ ID NO: 2282330 - RNA, 11 nt, Yersinia pestis
aauaacaaaca

SEQ ID NO: 2282331 - RNA, 19 nt, Yersinia pestis
aauaaauauccuccggcau

SEQ ID NO: 2282332 - RNA, 17 nt, Yersinia pestis
aauaaauaauuuguaaa

SEQ ID NO: 2282333 - RNA, 21 nt, Yersinia pestis
aauaaauuuaauaaguuaaua

SEQ ID NO: 2282334 - RNA, 21 nt, Yersinia pestis
aagucuugaagagugaccaaa

SEQ ID NO: 2282335 - RNA, 21 nt, Yersinia pestis
aagugauucgggugagugagc

SEQ ID NO: 2282336 - RNA, 22 nt, Yersinia pestis
aagugcaaacuuaaaaaucaaa

SEQ ID NO: 2282337 - RNA, 20 nt, Yersinia pestis
aagugcaaacuuaaaaauca

SEQ ID NO: 2282338 - RNA, 19 nt, Yersinia pestis
aagugauucgggugaguga

SEQ ID NO: 2282339 - RNA, 17 nt, Yersinia pestis
aagugauccacauuacc

SEQ ID NO: 2282340 - RNA, 19 nt, Yersinia pestis
aagugcugcaaggcauuaa

SEQ ID NO: 2282341 - RNA, 21 nt, Yersinia pestis
aagugguagccggacucaaaa

SEQ ID NO: 2282342 - RNA, 23 nt, Yersinia pestis
aagugguagccggacucaaaaua

SEQ ID NO: 2282343 - RNA, 19 nt, Yersinia pestis
aaguggccacucaccucag

SEQ ID NO: 2282344 - RNA, 23 nt, Yersinia pestis
aaguggccacucaccucagucau

SEQ ID NO: 2282345 - RNA, 18 nt, Yersinia pestis
aagucuugaagagugacc

SEQ ID NO: 2282346 - RNA, 18 nt, Yersinia pestis
aagucuuauaaugcaggg

SEQ ID NO: 2282347 - RNA, 23 nt, Yersinia pestis
aaguaacauuuguauuuuuucuu

SEQ ID NO: 2282348 - RNA, 20 nt, Yersinia pestis
aaguaaauuccguggcuuag

SEQ ID NO: 2282349 - RNA, 12 nt, Yersinia pestis
aaguaauaaaaa

SEQ ID NO: 2282350 - RNA, 12 nt, Yersinia pestis
aaguaaggugcc

SEQ ID NO: 2282351 - RNA, 16 nt, Yersinia pestis
aaguaaggagcaaaag

SEQ ID NO: 2282352 - RNA, 16 nt, Yersinia pestis
aaguuuauuuaacaca

SEQ ID NO: 2282353 - RNA, 22 nt, Yersinia pestis
aaguuuaccgcaugaauauuca

SEQ ID NO: 2282354 - RNA, 19 nt, Yersinia pestis
aaguugccggacgccccac

SEQ ID NO: 2282355 - RNA, 22 nt, Yersinia pestis
aaguuaggguucaguaaaacca

SEQ ID NO: 2282356 - RNA, 17 nt, Yersinia pestis
aaguuagucgcaaagcg

SEQ ID NO: 2282357 - RNA, 19 nt, Yersinia pestis
aaguuagugguguuaucca

SEQ ID NO: 2282358 - RNA, 22 nt, Yersinia pestis
aaguuagugguguuauccacuu

SEQ ID NO: 2282359 - RNA, 15 nt, Yersinia pestis
aaguguaaaagauag

SEQ ID NO: 2282360 - RNA, 22 nt, Yersinia pestis
aauacaggguaaauuauuuuag

SEQ ID NO: 2282361 - RNA, 20 nt, Yersinia pestis
aauacaaccaacaaacaauc

SEQ ID NO: 2282362 - RNA, 16 nt, Yersinia pestis
aauacaauuauuuuua

SEQ ID NO: 2282363 - RNA, 17 nt, Yersinia pestis
aauacaauuauuuuuac

SEQ ID NO: 2282364 - RNA, 18 nt, Yersinia pestis
aauacaauuauuuuuaca

SEQ ID NO: 2282365 - RNA, 18 nt, Yersinia pestis
aauacaaccaacaaacaa

SEQ ID NO: 2282366 - RNA, 20 nt, Yersinia pestis
aauaauuuauacauaucaga

SEQ ID NO: 2282367 - RNA, 23 nt, Yersinia pestis
aauaauucauaugacaaauaagg

SEQ ID NO: 2282368 - RNA, 13 nt, Yersinia pestis
aauaauuuauaca

SEQ ID NO: 2282369 - RNA, 20 nt, Yersinia pestis
aauaaucgggaaauugugau

SEQ ID NO: 2282370 - RNA, 19 nt, Yersinia pestis
aauaaucacaucaucuuuu

SEQ ID NO: 2282371 - RNA, 20 nt, Yersinia pestis
aauaauuauaccuacccuuu

SEQ ID NO: 2282372 - RNA, 22 nt, Yersinia pestis
aauaauucauaugacaaauaag

SEQ ID NO: 2282373 - RNA, 18 nt, Yersinia pestis
aauaaucuuaaguaaauu

SEQ ID NO: 2282374 - RNA, 20 nt, Yersinia pestis
aauaauguggcauguucagc

SEQ ID NO: 2282375 - RNA, 16 nt, Yersinia pestis
aauaauuaaucuuaau

SEQ ID NO: 2282376 - RNA, 15 nt, Yersinia pestis
aauaauuacagcugg

SEQ ID NO: 2282377 - RNA, 23 nt, Yersinia pestis
aaaaauauuaacugcagugaaaa

SEQ ID NO: 2282378 - RNA, 12 nt, Yersinia pestis
aaaaauauuaau

SEQ ID NO: 2282379 - RNA, 14 nt, Yersinia pestis
aaaaaucaaguaca

SEQ ID NO: 2282380 - RNA, 22 nt, Yersinia pestis
aaaaaucaauaaacucuuucau

SEQ ID NO: 2282381 - RNA, 17 nt, Yersinia pestis
aaaaauacuaucaucau

SEQ ID NO: 2282382 - RNA, 14 nt, Yersinia pestis
aauaauaucaauga

SEQ ID NO: 2282383 - RNA, 21 nt, Yersinia pestis
aaaaauacaggugucaucaag

SEQ ID NO: 2282384 - RNA, 13 nt, Yersinia pestis
aaaaauacaacca

SEQ ID NO: 2282385 - RNA, 13 nt, Yersinia pestis
aaaaauaaucaau

SEQ ID NO: 2282386 - RNA, 15 nt, Yersinia pestis
aaaaauaaucaauga

SEQ ID NO: 2282387 - RNA, 16 nt, Yersinia pestis
aauaacucagggcuuu

SEQ ID NO: 2282388 - RNA, 14 nt, Yersinia pestis
aauaacucagggcu

SEQ ID NO: 2282389 - RNA, 18 nt, Yersinia pestis
aauaacuauuuuugacuu

SEQ ID NO: 2282390 - RNA, 21 nt, Yersinia pestis
aauaacuauuuuugacuuuaa

SEQ ID NO: 2282391 - RNA, 15 nt, Yersinia pestis
aauaacgcuggauaa

SEQ ID NO: 2282392 - RNA, 14 nt, Yersinia pestis
aauaacgcggccag

SEQ ID NO: 2282393 - RNA, 17 nt, Yersinia pestis
aauaacgguuuuaacau

SEQ ID NO: 2282394 - RNA, 15 nt, Yersinia pestis
aauaaccucaaaagg

SEQ ID NO: 2282395 - RNA, 18 nt, Yersinia pestis
aauaacgaauuucauuuu

SEQ ID NO: 2282396 - RNA, 22 nt, Yersinia pestis
aauaacgccguuaaaaugagca

SEQ ID NO: 2282397 - RNA, 18 nt, Yersinia pestis
aauacccgguuuccaguu

SEQ ID NO: 2282398 - RNA, 15 nt, Yersinia pestis
aauacgaaauacuua

SEQ ID NO: 2282399 - RNA, 18 nt, Yersinia pestis
aauaccgccacacaauac

SEQ ID NO: 2282400 - RNA, 16 nt, Yersinia pestis
aauacccgguuuccag

SEQ ID NO: 2282401 - RNA, 22 nt, Yersinia pestis
aauacauagaagcucauaugca

SEQ ID NO: 2282402 - RNA, 15 nt, Yersinia pestis
aauacauaucaacac

SEQ ID NO: 2282403 - RNA, 19 nt, Yersinia pestis
aauacauauaaccaucaaa

SEQ ID NO: 2282404 - RNA, 18 nt, Yersinia pestis
aauacauauaaccaucaa

SEQ ID NO: 2282405 - RNA, 17 nt, Yersinia pestis
aauacgccccugaucau

SEQ ID NO: 2282406 - RNA, 16 nt, Yersinia pestis
aauacgaccgucacca

SEQ ID NO: 2282407 - RNA, 23 nt, Yersinia pestis
aauacgauccgcuauuuucucug

SEQ ID NO: 2282408 - RNA, 22 nt, Yersinia pestis
aauacggcacucaaauagauag

SEQ ID NO: 2282409 - RNA, 16 nt, Yersinia pestis
aauacggcacucaaau

SEQ ID NO: 2282410 - RNA, 19 nt, Yersinia pestis
aauacgguagcaauaccuu

SEQ ID NO: 2282411 - RNA, 17 nt, Yersinia pestis
aauacguuccaacgcac

SEQ ID NO: 2282412 - RNA, 22 nt, Yersinia pestis
aauacguugaauuaaaaacccu

SEQ ID NO: 2282413 - RNA, 17 nt, Yersinia pestis
aauagaaccggaauaaa

SEQ ID NO: 2282414 - RNA, 16 nt, Yersinia pestis
aauagaaccggcugac

SEQ ID NO: 2282415 - RNA, 14 nt, Yersinia pestis
aauagagucacaga

SEQ ID NO: 2282416 - RNA, 21 nt, Yersinia pestis
aauagagugaaguaucaccac

SEQ ID NO: 2282417 - RNA, 21 nt, Yersinia pestis
aauagagccucuauuaccuca

SEQ ID NO: 2282418 - RNA, 15 nt, Yersinia pestis
aauagaggaaauaaa

SEQ ID NO: 2282419 - RNA, 22 nt, Yersinia pestis
aauagagacggaaagagccagc

SEQ ID NO: 2282420 - RNA, 12 nt, Yersinia pestis
aauagaaaaaca

SEQ ID NO: 2282421 - RNA, 23 nt, Yersinia pestis
aauagaaaaacacuggcagccau

SEQ ID NO: 2282422 - RNA, 19 nt, Yersinia pestis
aauacuccuugaauagcca

SEQ ID NO: 2282423 - RNA, 15 nt, Yersinia pestis
aauacucauuuuuaa

SEQ ID NO: 2282424 - RNA, 13 nt, Yersinia pestis
aauacucauuuuu

SEQ ID NO: 2282425 - RNA, 17 nt, Yersinia pestis
aauacugcacguuuaau

SEQ ID NO: 2282426 - RNA, 21 nt, Yersinia pestis
aauacugcacguuuaauuuca

SEQ ID NO: 2282427 - RNA, 18 nt, Yersinia pestis
aauacucuguuaccaaug

SEQ ID NO: 2282428 - RNA, 14 nt, Yersinia pestis
aauacuuaucuguu

SEQ ID NO: 2282429 - RNA, 21 nt, Yersinia pestis
aauacuuaagucaaauuuaaa

SEQ ID NO: 2282430 - RNA, 14 nt, Yersinia pestis
aagauuacaucagu

SEQ ID NO: 2282431 - RNA, 12 nt, Yersinia pestis
aagauucaacca

SEQ ID NO: 2282432 - RNA, 18 nt, Yersinia pestis
aagaugccuauuugcaga

SEQ ID NO: 2282433 - RNA, 22 nt, Yersinia pestis
aagaaugucaugguuaaacuga

SEQ ID NO: 2282434 - RNA, 15 nt, Yersinia pestis
aagaugaccaccaau

SEQ ID NO: 2282435 - RNA, 12 nt, Yersinia pestis
aagaugcauauu

SEQ ID NO: 2282436 - RNA, 12 nt, Yersinia pestis
aagaugcagggc

SEQ ID NO: 2282437 - RNA, 13 nt, Yersinia pestis
aagaucugcauug

SEQ ID NO: 2282438 - RNA, 13 nt, Yersinia pestis
aagcaagaaacug

SEQ ID NO: 2282439 - RNA, 19 nt, Yersinia pestis
aagcaagcggcagcgcugg

SEQ ID NO: 2282440 - RNA, 19 nt, Yersinia pestis
aagcaagaccgguggcuuu

SEQ ID NO: 2282441 - RNA, 20 nt, Yersinia pestis
aagcaauaccgacaucaaca

SEQ ID NO: 2282442 - RNA, 20 nt, Yersinia pestis
aagcaauucggccaaguuug

SEQ ID NO: 2282443 - RNA, 21 nt, Yersinia pestis
aagcaauuugaucaccaaucg

SEQ ID NO: 2282444 - RNA, 13 nt, Yersinia pestis
aagcacagucgcc

SEQ ID NO: 2282445 - RNA, 13 nt, Yersinia pestis
aagauuuaaauaa

SEQ ID NO: 2282446 - RNA, 15 nt, Yersinia pestis
aagauuuaaauaaca

SEQ ID NO: 2282447 - RNA, 20 nt, Yersinia pestis
aagauuucucuuaggcaacc

SEQ ID NO: 2282448 - RNA, 21 nt, Yersinia pestis
aagauuucaucggcaaaaaca

SEQ ID NO: 2282449 - RNA, 16 nt, Yersinia pestis
aagauuuuguagccca

SEQ ID NO: 2282450 - RNA, 19 nt, Yersinia pestis
aagcaaaggcccgcuauca

SEQ ID NO: 2282451 - RNA, 23 nt, Yersinia pestis
aagcaaccgcaaugccgcuaggg

SEQ ID NO: 2282452 - RNA, 21 nt, Yersinia pestis
aagcagugucagggcaauaac

SEQ ID NO: 2282453 - RNA, 22 nt, Yersinia pestis
aagcaguucacucuguuuuaaa

SEQ ID NO: 2282454 - RNA, 23 nt, Yersinia pestis
aagcauaaccgguaccggcuggg

SEQ ID NO: 2282455 - RNA, 22 nt, Yersinia pestis
aagcaggggaucgggcugauaa

SEQ ID NO: 2282456 - RNA, 16 nt, Yersinia pestis
aagcaggaaugcgguu

SEQ ID NO: 2282457 - RNA, 14 nt, Yersinia pestis
aagcaugaaacaca

SEQ ID NO: 2282458 - RNA, 17 nt, Yersinia pestis
aagcauauggaugugau

SEQ ID NO: 2282459 - RNA, 17 nt, Yersinia pestis
aagcaucaccaaagaua

SEQ ID NO: 2282460 - RNA, 21 nt, Yersinia pestis
aagcauacguugccagccauc

SEQ ID NO: 2282461 - RNA, 15 nt, Yersinia pestis
aagcagauaaagaaa

SEQ ID NO: 2282462 - RNA, 16 nt, Yersinia pestis
aagcagauaaagaaaa

SEQ ID NO: 2282463 - RNA, 20 nt, Yersinia pestis
aagcagcguucaaaucugcu

SEQ ID NO: 2282464 - RNA, 17 nt, Yersinia pestis
aagcagcgucucgugua

SEQ ID NO: 2282465 - RNA, 19 nt, Yersinia pestis
aagcagcaccaauaucaau

SEQ ID NO: 2282466 - RNA, 22 nt, Yersinia pestis
aagcauuuuaucgugaauaaaa

SEQ ID NO: 2282467 - RNA, 18 nt, Yersinia pestis
aagccaaaaccauuggaa

SEQ ID NO: 2282468 - RNA, 14 nt, Yersinia pestis
aagccaacccccau

SEQ ID NO: 2282469 - RNA, 22 nt, Yersinia pestis
aagcaugcccagccucuggaua

SEQ ID NO: 2282470 - RNA, 22 nt, Yersinia pestis
aagcaugugauguggcuugcaa

SEQ ID NO: 2282471 - RNA, 21 nt, Yersinia pestis
aagccaccaccacggccagaa

SEQ ID NO: 2282472 - RNA, 20 nt, Yersinia pestis
aagccacgaguuuucccugc

SEQ ID NO: 2282473 - RNA, 12 nt, Yersinia pestis
aagccaaucucu

SEQ ID NO: 2282474 - RNA, 18 nt, Yersinia pestis
aagcccuugucaggauuu

SEQ ID NO: 2282475 - RNA, 18 nt, Yersinia pestis
aagccgaccauuaagccg

SEQ ID NO: 2282476 - RNA, 13 nt, Yersinia pestis
aagccccacagua

SEQ ID NO: 2282477 - RNA, 17 nt, Yersinia pestis
aagcccccuuuuucaua

SEQ ID NO: 2282478 - RNA, 13 nt, Yersinia pestis
aagccagucaggg

SEQ ID NO: 2282479 - RNA, 14 nt, Yersinia pestis
aagccagugcuauu

SEQ ID NO: 2282480 - RNA, 22 nt, Yersinia pestis
aagccaucgacuaauuaaacaa

SEQ ID NO: 2282481 - RNA, 16 nt, Yersinia pestis
aagccauuagcaguau

SEQ ID NO: 2282482 - RNA, 19 nt, Yersinia pestis
aagccauucagcagcaaga

SEQ ID NO: 2282483 - RNA, 18 nt, Yersinia pestis
aagcccauagccauggcu

SEQ ID NO: 2282484 - RNA, 18 nt, Yersinia pestis
aaggugaugaaugacugg

SEQ ID NO: 2282485 - RNA, 15 nt, Yersinia pestis
aagguagucccucaa

SEQ ID NO: 2282486 - RNA, 21 nt, Yersinia pestis
aagguagucccucaagaccug

SEQ ID NO: 2282487 - RNA, 20 nt, Yersinia pestis
aagguauagcgauagaguug

SEQ ID NO: 2282488 - RNA, 22 nt, Yersinia pestis
aagguagaucggggacaggcug

SEQ ID NO: 2282489 - RNA, 18 nt, Yersinia pestis
aagguaaugcgaaaaaag

SEQ ID NO: 2282490 - RNA, 22 nt, Yersinia pestis
aagguaaagggccguaacaagg

SEQ ID NO: 2282491 - RNA, 22 nt, Yersinia pestis
aaggucaacgacaagucaguga

SEQ ID NO: 2282492 - RNA, 14 nt, Yersinia pestis
aagguaucgcagug

SEQ ID NO: 2282493 - RNA, 20 nt, Yersinia pestis
aagguguaguggaagugauc

SEQ ID NO: 2282494 - RNA, 13 nt, Yersinia pestis
aagguuaacugca

SEQ ID NO: 2282495 - RNA, 15 nt, Yersinia pestis
aaggugcuagugcug

SEQ ID NO: 2282496 - RNA, 13 nt, Yersinia pestis
aagguuagcuaug

SEQ ID NO: 2282497 - RNA, 19 nt, Yersinia pestis
aagguuagcuaugcaguua

SEQ ID NO: 2282498 - RNA, 19 nt, Yersinia pestis
aagguucacccugaguguu

SEQ ID NO: 2282499 - RNA, 20 nt, Yersinia pestis
aagggccauuuugcugccag

SEQ ID NO: 2282500 - RNA, 23 nt, Yersinia pestis
aaggguaaaauaaauauccuccg

SEQ ID NO: 2282501 - RNA, 14 nt, Yersinia pestis
aaggguacagucua

SEQ ID NO: 2282502 - RNA, 18 nt, Yersinia pestis
aaggguaauagaagauaa

SEQ ID NO: 2282503 - RNA, 18 nt, Yersinia pestis
aagggucaucaacaaagu

SEQ ID NO: 2282504 - RNA, 15 nt, Yersinia pestis
aaggguauugaagau

SEQ ID NO: 2282505 - RNA, 15 nt, Yersinia pestis
aaggguauaacucau

SEQ ID NO: 2282506 - RNA, 16 nt, Yersinia pestis
aaggguauaacucauc

SEQ ID NO: 2282507 - RNA, 17 nt, Yersinia pestis
aagguaaacagacacag

SEQ ID NO: 2282508 - RNA, 11 nt, Yersinia pestis
aagguaaaaaa

SEQ ID NO: 2282509 - RNA, 18 nt, Yersinia pestis
aagguaaaaaagaaugcg

SEQ ID NO: 2282510 - RNA, 11 nt, Yersinia pestis
aagggagccau

SEQ ID NO: 2282511 - RNA, 14 nt, Yersinia pestis
aaggcggugaacag

SEQ ID NO: 2282512 - RNA, 21 nt, Yersinia pestis
aaggcaaaaauugacgaaagu

SEQ ID NO: 2282513 - RNA, 20 nt, Yersinia pestis
aaggauuugaagacaacucu

SEQ ID NO: 2282514 - RNA, 18 nt, Yersinia pestis
aaggauuuggaaugaguu

SEQ ID NO: 2282515 - RNA, 13 nt, Yersinia pestis
aaggcaaagaaga

SEQ ID NO: 2282516 - RNA, 13 nt, Yersinia pestis
aaggcaauaccaa

SEQ ID NO: 2282517 - RNA, 15 nt, Yersinia pestis
aaggcaauaccaaua

SEQ ID NO: 2282518 - RNA, 23 nt, Yersinia pestis
aaggcggagaauguuaaaccccc

SEQ ID NO: 2282519 - RNA, 16 nt, Yersinia pestis
aaggcggcagagccaa

SEQ ID NO: 2282520 - RNA, 17 nt, Yersinia pestis
aaggcggcaagcaagca

SEQ ID NO: 2282521 - RNA, 15 nt, Yersinia pestis
aaggcgagucagcac

SEQ ID NO: 2282522 - RNA, 19 nt, Yersinia pestis
aaggcgaugauuugucaau

SEQ ID NO: 2282523 - RNA, 22 nt, Yersinia pestis
aagcgcuauguuggcaaauaau

SEQ ID NO: 2282524 - RNA, 12 nt, Yersinia pestis
aagcgcucaaau

SEQ ID NO: 2282525 - RNA, 15 nt, Yersinia pestis
aagcguaaagcaccc

SEQ ID NO: 2282526 - RNA, 19 nt, Yersinia pestis
aagcguauuuugucaugaa

SEQ ID NO: 2282527 - RNA, 21 nt, Yersinia pestis
aagcgugacgcugaacagccu

SEQ ID NO: 2282528 - RNA, 18 nt, Yersinia pestis
aagcgcggucauauccua

SEQ ID NO: 2282529 - RNA, 18 nt, Yersinia pestis
aagcgcguaucguccagc

SEQ ID NO: 2282530 - RNA, 21 nt, Yersinia pestis
aagcgcguaucguccagcagc

SEQ ID NO: 2282531 - RNA, 17 nt, Yersinia pestis
aagccgcaccgagccac

SEQ ID NO: 2282532 - RNA, 22 nt, Yersinia pestis
aagcucugggacgugcauaaaa

SEQ ID NO: 2282533 - RNA, 13 nt, Yersinia pestis
aagcugaaauuuu

SEQ ID NO: 2282534 - RNA, 15 nt, Yersinia pestis
aagcucuacuaauau

SEQ ID NO: 2282535 - RNA, 13 nt, Yersinia pestis
aaggacuuggcgu

SEQ ID NO: 2282536 - RNA, 16 nt, Yersinia pestis
aaggauaagcaguucu

SEQ ID NO: 2282537 - RNA, 15 nt, Yersinia pestis
aaggauugaccaaua

SEQ ID NO: 2282538 - RNA, 14 nt, Yersinia pestis
aagcuucaacuuaa

SEQ ID NO: 2282539 - RNA, 21 nt, Yersinia pestis
aagcuucaacuuccagugcca

SEQ ID NO: 2282540 - RNA, 23 nt, Yersinia pestis
aaggaaaaguagccaauagacaa

SEQ ID NO: 2282541 - RNA, 14 nt, Yersinia pestis
aaggaaacucauga

SEQ ID NO: 2282542 - RNA, 22 nt, Yersinia pestis
aagcugcggcuugggagucaga

SEQ ID NO: 2282543 - RNA, 21 nt, Yersinia pestis
aacgaucagaacuaacacuau

SEQ ID NO: 2282544 - RNA, 19 nt, Yersinia pestis
aaccggcguaaauaaaagc

SEQ ID NO: 2282545 - RNA, 18 nt, Yersinia pestis
aaccggcuggaaauucau

SEQ ID NO: 2282546 - RNA, 14 nt, Yersinia pestis
aaccggauaaaaca

SEQ ID NO: 2282547 - RNA, 14 nt, Yersinia pestis
aacgccgaugaagg

SEQ ID NO: 2282548 - RNA, 19 nt, Yersinia pestis
aacgccgaucauaaaucac

SEQ ID NO: 2282549 - RNA, 14 nt, Yersinia pestis
aacgcacgaaaaca

SEQ ID NO: 2282550 - RNA, 23 nt, Yersinia pestis
aacgcaccccacaaccugcgcca

SEQ ID NO: 2282551 - RNA, 16 nt, Yersinia pestis
aacgcaauaggcuauu

SEQ ID NO: 2282552 - RNA, 20 nt, Yersinia pestis
aacgcaauucaauauagggu

SEQ ID NO: 2282553 - RNA, 15 nt, Yersinia pestis
aacgcaauuuuaugg

SEQ ID NO: 2282554 - RNA, 16 nt, Yersinia pestis
aacgcccaaaucugcc

SEQ ID NO: 2282555 - RNA, 13 nt, Yersinia pestis
aacggugaacaga

SEQ ID NO: 2282556 - RNA, 17 nt, Yersinia pestis
aacggugaggauaggca

SEQ ID NO: 2282557 - RNA, 17 nt, Yersinia pestis
aacggugcgacaaugcc

SEQ ID NO: 2282558 - RNA, 13 nt, Yersinia pestis
aacggagaugauu

SEQ ID NO: 2282559 - RNA, 15 nt, Yersinia pestis
aacgguaaccaggcg

SEQ ID NO: 2282560 - RNA, 16 nt, Yersinia pestis
aacgguaacccgauaa

SEQ ID NO: 2282561 - RNA, 13 nt, Yersinia pestis
aacgcugcuugcc

SEQ ID NO: 2282562 - RNA, 14 nt, Yersinia pestis
aacgcuucaguaaa

SEQ ID NO: 2282563 - RNA, 19 nt, Yersinia pestis
aacgcuuuuaacugugcag

SEQ ID NO: 2282564 - RNA, 23 nt, Yersinia pestis
aacgcuuuacuccucugccuauc

SEQ ID NO: 2282565 - RNA, 14 nt, Yersinia pestis
aacguuaacugcag

SEQ ID NO: 2282566 - RNA, 20 nt, Yersinia pestis
aacguguuagguaauaccaa

SEQ ID NO: 2282567 - RNA, 13 nt, Yersinia pestis
aacguuagagcac

SEQ ID NO: 2282568 - RNA, 15 nt, Yersinia pestis
aacguucaauugauc

SEQ ID NO: 2282569 - RNA, 14 nt, Yersinia pestis
aacguucugccaau

SEQ ID NO: 2282570 - RNA, 22 nt, Yersinia pestis
aacguuucuggaaugagaugaa

SEQ ID NO: 2282571 - RNA, 15 nt, Yersinia pestis
aacguagcugaauug

SEQ ID NO: 2282572 - RNA, 16 nt, Yersinia pestis
aacgugacucuuuguu

SEQ ID NO: 2282573 - RNA, 21 nt, Yersinia pestis
aacgucauugguguuacagca

SEQ ID NO: 2282574 - RNA, 18 nt, Yersinia pestis
aacgucauaauugccaaa

SEQ ID NO: 2282575 - RNA, 23 nt, Yersinia pestis
aacgucauaauugccaaacgaua

SEQ ID NO: 2282576 - RNA, 21 nt, Yersinia pestis
aacuauuggucaaucuagagg

SEQ ID NO: 2282577 - RNA, 22 nt, Yersinia pestis
aacuacuccauccccaacucuu

SEQ ID NO: 2282578 - RNA, 23 nt, Yersinia pestis
aacuacuccauccccaacucuuu

SEQ ID NO: 2282579 - RNA, 23 nt, Yersinia pestis
aacuacgauguaaucugaauagg

SEQ ID NO: 2282580 - RNA, 15 nt, Yersinia pestis
aacuaagaguccuua

SEQ ID NO: 2282581 - RNA, 21 nt, Yersinia pestis
aacuaacguuuuguaaucaac

SEQ ID NO: 2282582 - RNA, 22 nt, Yersinia pestis
aacuaauguuuguuucucugcc

SEQ ID NO: 2282583 - RNA, 15 nt, Yersinia pestis
aacugcaguaaaaau

SEQ ID NO: 2282584 - RNA, 17 nt, Yersinia pestis
aacugcauagcuaaccu

SEQ ID NO: 2282585 - RNA, 19 nt, Yersinia pestis
aacugcauagcuaaccuua

SEQ ID NO: 2282586 - RNA, 14 nt, Yersinia pestis
aacugcggcauuaa

SEQ ID NO: 2282587 - RNA, 15 nt, Yersinia pestis
aacugcucaacugcu

SEQ ID NO: 2282588 - RNA, 17 nt, Yersinia pestis
aacugcucaacugcuca

SEQ ID NO: 2282589 - RNA, 18 nt, Yersinia pestis
aacugcucaacugcucaa

SEQ ID NO: 2282590 - RNA, 16 nt, Yersinia pestis
aacugcucuaccaacu

SEQ ID NO: 2282591 - RNA, 17 nt, Yersinia pestis
aacugcugauuuuguag

SEQ ID NO: 2282592 - RNA, 20 nt, Yersinia pestis
aacugcugauuuuguagaau

SEQ ID NO: 2282593 - RNA, 21 nt, Yersinia pestis
aacugcuggccaacugcgccu

SEQ ID NO: 2282594 - RNA, 13 nt, Yersinia pestis
aacugcugggcug

SEQ ID NO: 2282595 - RNA, 15 nt, Yersinia pestis
aacuggaauaugggu

SEQ ID NO: 2282596 - RNA, 15 nt, Yersinia pestis
aacuggcggggcaaa

SEQ ID NO: 2282597 - RNA, 23 nt, Yersinia pestis
aacuggcgcuggaccuuaucauc

SEQ ID NO: 2282598 - RNA, 15 nt, Yersinia pestis
aacuauuuggugguu

SEQ ID NO: 2282599 - RNA, 19 nt, Yersinia pestis
aacuauuuuugacuuuaau

SEQ ID NO: 2282600 - RNA, 12 nt, Yersinia pestis
aacucaaauuau

SEQ ID NO: 2282601 - RNA, 13 nt, Yersinia pestis
aacucaaauuauu

SEQ ID NO: 2282602 - RNA, 13 nt, Yersinia pestis
aacucaaagauuu

SEQ ID NO: 2282603 - RNA, 20 nt, Yersinia pestis
aacugaaaauacuacucaaa

SEQ ID NO: 2282604 - RNA, 18 nt, Yersinia pestis
aacucuuuuuaaacuauu

SEQ ID NO: 2282605 - RNA, 13 nt, Yersinia pestis
aacugaaugcguu

SEQ ID NO: 2282606 - RNA, 17 nt, Yersinia pestis
aacugaauggauugaaa

SEQ ID NO: 2282607 - RNA, 17 nt, Yersinia pestis
aacugcaccuaacaaac

SEQ ID NO: 2282608 - RNA, 20 nt, Yersinia pestis
aacuguuuuuuaaagaaaaa

SEQ ID NO: 2282609 - RNA, 12 nt, Yersinia pestis
aacuuacaggcu

SEQ ID NO: 2282610 - RNA, 20 nt, Yersinia pestis
aacuuaagauagccggauua

SEQ ID NO: 2282611 - RNA, 18 nt, Yersinia pestis
aacuuauagcucaucggu

SEQ ID NO: 2282612 - RNA, 13 nt, Yersinia pestis
aacuuacucccuu

SEQ ID NO: 2282613 - RNA, 15 nt, Yersinia pestis
aacuuacucccuugu

SEQ ID NO: 2282614 - RNA, 15 nt, Yersinia pestis
aacuucaagccgaua

SEQ ID NO: 2282615 - RNA, 21 nt, Yersinia pestis
aacuucaaaucgccaaacugc

SEQ ID NO: 2282616 - RNA, 14 nt, Yersinia pestis
aacuucaaaaucaa

SEQ ID NO: 2282617 - RNA, 20 nt, Yersinia pestis
aacuucaaaaucaaguugau

SEQ ID NO: 2282618 - RNA, 24 nt, Yersinia pestis
aacuuaucgaccaacuggcaauca

SEQ ID NO: 2282619 - RNA, 14 nt, Yersinia pestis
aacuucuuuaucua

SEQ ID NO: 2282620 - RNA, 13 nt, Yersinia pestis
aagaaagaaaaau

SEQ ID NO: 2282621 - RNA, 23 nt, Yersinia pestis
aagaaacuucauuucagguaaaa

SEQ ID NO: 2282622 - RNA, 16 nt, Yersinia pestis
aagaaacucccuucaa

SEQ ID NO: 2282623 - RNA, 12 nt, Yersinia pestis
aagaaaagcacc

SEQ ID NO: 2282624 - RNA, 19 nt, Yersinia pestis
aagaaaacccauaccacug

SEQ ID NO: 2282625 - RNA, 18 nt, Yersinia pestis
aacuugguaccagucuaa

SEQ ID NO: 2282626 - RNA, 19 nt, Yersinia pestis
aagaaccccccaccaucaa

SEQ ID NO: 2282627 - RNA, 22 nt, Yersinia pestis
aagaaccccccaccaucaacau

SEQ ID NO: 2282628 - RNA, 22 nt, Yersinia pestis
aagaacgcgccaaccaucggaa

SEQ ID NO: 2282629 - RNA, 13 nt, Yersinia pestis
aagaauaaauaau

SEQ ID NO: 2282630 - RNA, 16 nt, Yersinia pestis
aagaauaaaugucacu

SEQ ID NO: 2282631 - RNA, 14 nt, Yersinia pestis
aagaauaaauaaua

SEQ ID NO: 2282632 - RNA, 13 nt, Yersinia pestis
aagaauauaauac

SEQ ID NO: 2282633 - RNA, 18 nt, Yersinia pestis
aagaaucaccgaaagaag

SEQ ID NO: 2282634 - RNA, 23 nt, Yersinia pestis
aagaacuggcuggaucagcagac

SEQ ID NO: 2282635 - RNA, 16 nt, Yersinia pestis
aagaagccucaugaau

SEQ ID NO: 2282636 - RNA, 12 nt, Yersinia pestis
aagaagccucau

SEQ ID NO: 2282637 - RNA, 13 nt, Yersinia pestis
aagaagcauagaa

SEQ ID NO: 2282638 - RNA, 14 nt, Yersinia pestis
aagaagccaagaug

SEQ ID NO: 2282639 - RNA, 20 nt, Yersinia pestis
aagaagacgaguaaugaaau

SEQ ID NO: 2282640 - RNA, 16 nt, Yersinia pestis
aaccaaggugguaucu

SEQ ID NO: 2282641 - RNA, 15 nt, Yersinia pestis
aaccaacugaaacug

SEQ ID NO: 2282642 - RNA, 16 nt, Yersinia pestis
aaccaauacacagcac

SEQ ID NO: 2282643 - RNA, 20 nt, Yersinia pestis
aaccaauagaccguagaaac

SEQ ID NO: 2282644 - RNA, 22 nt, Yersinia pestis
aaccaauagauuucacuuuccc

SEQ ID NO: 2282645 - RNA, 15 nt, Yersinia pestis
aaccaauccaugcca

SEQ ID NO: 2282646 - RNA, 20 nt, Yersinia pestis
aaccaacaauauucgcagcc

SEQ ID NO: 2282647 - RNA, 16 nt, Yersinia pestis
aaccaacguuauugac

SEQ ID NO: 2282648 - RNA, 23 nt, Yersinia pestis
aacauuguuaccuaaccaaacau

SEQ ID NO: 2282649 - RNA, 21 nt, Yersinia pestis
aacauuaauccucucuugaaa

SEQ ID NO: 2282650 - RNA, 13 nt, Yersinia pestis
aacauuaacucau

SEQ ID NO: 2282651 - RNA, 12 nt, Yersinia pestis
aacauuaaaaau

SEQ ID NO: 2282652 - RNA, 16 nt, Yersinia pestis
aacauauuaaguuaau

SEQ ID NO: 2282653 - RNA, 10 nt, Yersinia pestis
aacauaugaa

SEQ ID NO: 2282654 - RNA, 13 nt, Yersinia pestis
aacauacugauac

SEQ ID NO: 2282655 - RNA, 16 nt, Yersinia pestis
aacauacugauacaac

SEQ ID NO: 2282656 - RNA, 18 nt, Yersinia pestis
aacauacugauacaacaa

SEQ ID NO: 2282657 - RNA, 14 nt, Yersinia pestis
aacauaauuaaaua

SEQ ID NO: 2282658 - RNA, 16 nt, Yersinia pestis
aacauaauuaaauauu

SEQ ID NO: 2282659 - RNA, 22 nt, Yersinia pestis
aacauaauuaaauauuaacauu

SEQ ID NO: 2282660 - RNA, 15 nt, Yersinia pestis
aacagcccccugccu

SEQ ID NO: 2282661 - RNA, 12 nt, Yersinia pestis
aacagccauuua

SEQ ID NO: 2282662 - RNA, 16 nt, Yersinia pestis
aacagccggccauuca

SEQ ID NO: 2282663 - RNA, 17 nt, Yersinia pestis
aacagccggccauucag

SEQ ID NO: 2282664 - RNA, 17 nt, Yersinia pestis
aacagccguauaucuua

SEQ ID NO: 2282665 - RNA, 21 nt, Yersinia pestis
aacagccuaaggccaucaaua

SEQ ID NO: 2282666 - RNA, 15 nt, Yersinia pestis
aacaugagccacaca

SEQ ID NO: 2282667 - RNA, 23 nt, Yersinia pestis
aacaucugccaggcgacaugguc

SEQ ID NO: 2282668 - RNA, 17 nt, Yersinia pestis
aacaucuggcgauuuug

SEQ ID NO: 2282669 - RNA, 17 nt, Yersinia pestis
aacauccuaaaaagcgc

SEQ ID NO: 2282670 - RNA, 11 nt, Yersinia pestis
aacauccggcu

SEQ ID NO: 2282671 - RNA, 17 nt, Yersinia pestis
aacauccgaauuuuuac

SEQ ID NO: 2282672 - RNA, 13 nt, Yersinia pestis
aacaucaugacaa

SEQ ID NO: 2282673 - RNA, 16 nt, Yersinia pestis
aacaucauauauuaaa

SEQ ID NO: 2282674 - RNA, 11 nt, Yersinia pestis
aaccauuuacc

SEQ ID NO: 2282675 - RNA, 16 nt, Yersinia pestis
aacccacaucccggca

SEQ ID NO: 2282676 - RNA, 13 nt, Yersinia pestis
aacccauagcaaa

SEQ ID NO: 2282677 - RNA, 17 nt, Yersinia pestis
aacccauauuacucaca

SEQ ID NO: 2282678 - RNA, 17 nt, Yersinia pestis
aacccauaaguccuuaa

SEQ ID NO: 2282679 - RNA, 12 nt, Yersinia pestis
aacccauucauc

SEQ ID NO: 2282680 - RNA, 20 nt, Yersinia pestis
aacccgcuuaaucauauuuu

SEQ ID NO: 2282681 - RNA, 23 nt, Yersinia pestis
aacccagccccuaacagcagugc

SEQ ID NO: 2282682 - RNA, 19 nt, Yersinia pestis
aacccggcgcaucuuucga

SEQ ID NO: 2282683 - RNA, 14 nt, Yersinia pestis
aacccggcuguuaa

SEQ ID NO: 2282684 - RNA, 16 nt, Yersinia pestis
aacccggcuguuaaau

SEQ ID NO: 2282685 - RNA, 17 nt, Yersinia pestis
aacccguuuagcucuca

SEQ ID NO: 2282686 - RNA, 22 nt, Yersinia pestis
aaccacugguuaaaucaccgac

SEQ ID NO: 2282687 - RNA, 18 nt, Yersinia pestis
aaccacugaccuauugau

SEQ ID NO: 2282688 - RNA, 13 nt, Yersinia pestis
aaccacugaccua

SEQ ID NO: 2282689 - RNA, 14 nt, Yersinia pestis
aaccacugaccuau

SEQ ID NO: 2282690 - RNA, 21 nt, Yersinia pestis
aaccacgucuacgcucuccuc

SEQ ID NO: 2282691 - RNA, 17 nt, Yersinia pestis
aaccacuaaaccacaua

SEQ ID NO: 2282692 - RNA, 15 nt, Yersinia pestis
aaccacucucccuca

SEQ ID NO: 2282693 - RNA, 15 nt, Yersinia pestis
aaccauggcacucuc

SEQ ID NO: 2282694 - RNA, 17 nt, Yersinia pestis
aaccauggcacucucuu

SEQ ID NO: 2282695 - RNA, 12 nt, Yersinia pestis
aaccaugggggc

SEQ ID NO: 2282696 - RNA, 15 nt, Yersinia pestis
aaccaucugaugcag

SEQ ID NO: 2282697 - RNA, 20 nt, Yersinia pestis
aaccauccccagaacagcua

SEQ ID NO: 2282698 - RNA, 13 nt, Yersinia pestis
aaccauccauauu

SEQ ID NO: 2282699 - RNA, 21 nt, Yersinia pestis
aaccgcuauaucaucagcaga

SEQ ID NO: 2282700 - RNA, 20 nt, Yersinia pestis
aaccgcgaagaggguuuuuu

SEQ ID NO: 2282701 - RNA, 16 nt, Yersinia pestis
aaccgcccucuugaac

SEQ ID NO: 2282702 - RNA, 18 nt, Yersinia pestis
aaccgcccucuugaacgg

SEQ ID NO: 2282703 - RNA, 12 nt, Yersinia pestis
aaccgccacagc

SEQ ID NO: 2282704 - RNA, 23 nt, Yersinia pestis
aaccgcaucauuguuuacuauuu

SEQ ID NO: 2282705 - RNA, 13 nt, Yersinia pestis
aaccgccaaaaua

SEQ ID NO: 2282706 - RNA, 15 nt, Yersinia pestis
aaccgcauucccugc

SEQ ID NO: 2282707 - RNA, 18 nt, Yersinia pestis
aaccgcagcaggcagagc

SEQ ID NO: 2282708 - RNA, 16 nt, Yersinia pestis
aaccgcagacauaucu

SEQ ID NO: 2282709 - RNA, 19 nt, Yersinia pestis
aacccuuucagcgcuuuuu

SEQ ID NO: 2282710 - RNA, 13 nt, Yersinia pestis
aacccucaguaaa

SEQ ID NO: 2282711 - RNA, 16 nt, Yersinia pestis
aacccucaguaaaagc

SEQ ID NO: 2282712 - RNA, 22 nt, Yersinia pestis
aaccgaauaauauuaaagccau

SEQ ID NO: 2282713 - RNA, 20 nt, Yersinia pestis
aaccgaguaacaaaugguca

SEQ ID NO: 2282714 - RNA, 13 nt, Yersinia pestis
aaccgagaagucg

SEQ ID NO: 2282715 - RNA, 22 nt, Yersinia pestis
aacaauaacgccguuaaaauga

SEQ ID NO: 2282716 - RNA, 21 nt, Yersinia pestis
aaauucugagaucuaaaaaau

SEQ ID NO: 2282717 - RNA, 19 nt, Yersinia pestis
aacaaucagugcaauaaau

SEQ ID NO: 2282718 - RNA, 23 nt, Yersinia pestis
aacaauugcuccaguugauacag

SEQ ID NO: 2282719 - RNA, 20 nt, Yersinia pestis
aacaauuuaucagacaaucu

SEQ ID NO: 2282720 - RNA, 17 nt, Yersinia pestis
aacaauuuaucagacaa

SEQ ID NO: 2282721 - RNA, 18 nt, Yersinia pestis
aacaauuucgaaaacuca

SEQ ID NO: 2282722 - RNA, 18 nt, Yersinia pestis
aacaaugguucaucauuu

SEQ ID NO: 2282723 - RNA, 18 nt, Yersinia pestis
aacacaucuuccaguaca

SEQ ID NO: 2282724 - RNA, 20 nt, Yersinia pestis
aacacaucuauuuuuuugaa

SEQ ID NO: 2282725 - RNA, 12 nt, Yersinia pestis
aacacauccagg

SEQ ID NO: 2282726 - RNA, 14 nt, Yersinia pestis
aacacauauuucau

SEQ ID NO: 2282727 - RNA, 14 nt, Yersinia pestis
aacacaucacgcuu

SEQ ID NO: 2282728 - RNA, 17 nt, Yersinia pestis
aacacauaaaaucagca

SEQ ID NO: 2282729 - RNA, 15 nt, Yersinia pestis
aacacauacaaauau

SEQ ID NO: 2282730 - RNA, 14 nt, Yersinia pestis
aacacaguggaacc

SEQ ID NO: 2282731 - RNA, 20 nt, Yersinia pestis
aacaauuuuauuguuuucgu

SEQ ID NO: 2282732 - RNA, 14 nt, Yersinia pestis
aacacacagcagac

SEQ ID NO: 2282733 - RNA, 14 nt, Yersinia pestis
aacacaauuuuuag

SEQ ID NO: 2282734 - RNA, 19 nt, Yersinia pestis
aacacacuucgccagguca

SEQ ID NO: 2282735 - RNA, 21 nt, Yersinia pestis
aacacauggcucacuggucag

SEQ ID NO: 2282736 - RNA, 20 nt, Yersinia pestis
aacacauuccaguaaaaaaa

SEQ ID NO: 2282737 - RNA, 22 nt, Yersinia pestis
aacacauuccaguaaaaaaaua

SEQ ID NO: 2282738 - RNA, 21 nt, Yersinia pestis
aacaccagagaugauagcaau

SEQ ID NO: 2282739 - RNA, 16 nt, Yersinia pestis
aacaccaacaccacac

SEQ ID NO: 2282740 - RNA, 13 nt, Yersinia pestis
aacaccaacacca

SEQ ID NO: 2282741 - RNA, 14 nt, Yersinia pestis
aacaccaucaacau

SEQ ID NO: 2282742 - RNA, 14 nt, Yersinia pestis
aacagcauuuaugc

SEQ ID NO: 2282743 - RNA, 15 nt, Yersinia pestis
aacagcaucaucaaa

SEQ ID NO: 2282744 - RNA, 21 nt, Yersinia pestis
aacagcauuaccaaggaaacc

SEQ ID NO: 2282745 - RNA, 15 nt, Yersinia pestis
aacagccagcaucac

SEQ ID NO: 2282746 - RNA, 22 nt, Yersinia pestis
aacagcaucacugucuauuuuu

SEQ ID NO: 2282747 - RNA, 16 nt, Yersinia pestis
aacagcaucacugucu

SEQ ID NO: 2282748 - RNA, 19 nt, Yersinia pestis
aacagaugaugauuuuuac

SEQ ID NO: 2282749 - RNA, 15 nt, Yersinia pestis
aacagauuuuccauc

SEQ ID NO: 2282750 - RNA, 19 nt, Yersinia pestis
aacacuuugcgcuuuuuaa

SEQ ID NO: 2282751 - RNA, 18 nt, Yersinia pestis
aacagaagaguacgaaca

SEQ ID NO: 2282752 - RNA, 20 nt, Yersinia pestis
aacagauaauuggcaauaau

SEQ ID NO: 2282753 - RNA, 18 nt, Yersinia pestis
aacagauauuacgcagcc

SEQ ID NO: 2282754 - RNA, 20 nt, Yersinia pestis
aacagaucacccgcaaaacu

SEQ ID NO: 2282755 - RNA, 17 nt, Yersinia pestis
aacagagcagaaagcag

SEQ ID NO: 2282756 - RNA, 19 nt, Yersinia pestis
aacagagcagaaagcagca

SEQ ID NO: 2282757 - RNA, 20 nt, Yersinia pestis
aacagagcagaaagcagcag

SEQ ID NO: 2282758 - RNA, 22 nt, Yersinia pestis
aacagacgccccgaaccauuua

SEQ ID NO: 2282759 - RNA, 23 nt, Yersinia pestis
aacacuccucuuucuuaauaaua

SEQ ID NO: 2282760 - RNA, 14 nt, Yersinia pestis
aacacuugaccaac

SEQ ID NO: 2282761 - RNA, 14 nt, Yersinia pestis
aacacuuaauucca

SEQ ID NO: 2282762 - RNA, 19 nt, Yersinia pestis
aacacuuaugaucuugaau

SEQ ID NO: 2282763 - RNA, 18 nt, Yersinia pestis
aacacuucagacugaaag

SEQ ID NO: 2282764 - RNA, 18 nt, Yersinia pestis
aacacuggcuuagaucuu

SEQ ID NO: 2282765 - RNA, 12 nt, Yersinia pestis
aacacugcaaac

SEQ ID NO: 2282766 - RNA, 20 nt, Yersinia pestis
aacacguucggcgucgccac

SEQ ID NO: 2282767 - RNA, 23 nt, Yersinia pestis
aacacguucggcgucgccacccc

SEQ ID NO: 2282768 - RNA, 20 nt, Yersinia pestis
aacacguggguauccagugu

SEQ ID NO: 2282769 - RNA, 19 nt, Yersinia pestis
aacaccuaacuuccuaaca

SEQ ID NO: 2282770 - RNA, 22 nt, Yersinia pestis
aacaccgugcuggguaauucau

SEQ ID NO: 2282771 - RNA, 20 nt, Yersinia pestis
aacaccguaacgcccuccug

SEQ ID NO: 2282772 - RNA, 14 nt, Yersinia pestis
aacacccauuugcc

SEQ ID NO: 2282773 - RNA, 15 nt, Yersinia pestis
aacacccuuccuuuu

SEQ ID NO: 2282774 - RNA, 18 nt, Yersinia pestis
aacaccuucacugaauac

SEQ ID NO: 2282775 - RNA, 18 nt, Yersinia pestis
aacaccuauuuuauccca

SEQ ID NO: 2282776 - RNA, 16 nt, Yersinia pestis
aacacgaaaagcagca

SEQ ID NO: 2282777 - RNA, 19 nt, Yersinia pestis
aaugcuuauuucacacugu

SEQ ID NO: 2282778 - RNA, 16 nt, Yersinia pestis
aaugcgcucaccaaga

SEQ ID NO: 2282779 - RNA, 18 nt, Yersinia pestis
aauguacagucauuuacu

SEQ ID NO: 2282780 - RNA, 16 nt, Yersinia pestis
aauggccggacucauu

SEQ ID NO: 2282781 - RNA, 22 nt, Yersinia pestis
aauggcgaaaggaacaaaagag

SEQ ID NO: 2282782 - RNA, 19 nt, Yersinia pestis
aauggccagcgggaaucaa

SEQ ID NO: 2282783 - RNA, 22 nt, Yersinia pestis
aauggccgccauuuuuauguuu

SEQ ID NO: 2282784 - RNA, 14 nt, Yersinia pestis
aaugccacccccag

SEQ ID NO: 2282785 - RNA, 13 nt, Yersinia pestis
aaugcagaugcca

SEQ ID NO: 2282786 - RNA, 14 nt, Yersinia pestis
aaugcagcauccca

SEQ ID NO: 2282787 - RNA, 16 nt, Yersinia pestis
aaugccaguacaguga

SEQ ID NO: 2282788 - RNA, 21 nt, Yersinia pestis
aaugccagacacaagauaaau

SEQ ID NO: 2282789 - RNA, 14 nt, Yersinia pestis
aaugccagcgaaaa

SEQ ID NO: 2282790 - RNA, 15 nt, Yersinia pestis
aaugcgaaaaaauau

SEQ ID NO: 2282791 - RNA, 16 nt, Yersinia pestis
aaugcgaaaaaauaua

SEQ ID NO: 2282792 - RNA, 18 nt, Yersinia pestis
aaugcgaaaaaauauauu

SEQ ID NO: 2282793 - RNA, 18 nt, Yersinia pestis
aaugccuuagguaaguca

SEQ ID NO: 2282794 - RNA, 20 nt, Yersinia pestis
aaugcgauggucuauaugcc

SEQ ID NO: 2282795 - RNA, 21 nt, Yersinia pestis
aaugauuugcggcaugauaga

SEQ ID NO: 2282796 - RNA, 17 nt, Yersinia pestis
aaucuugauccugcaau

SEQ ID NO: 2282797 - RNA, 18 nt, Yersinia pestis
aaugcaaccaguuaaaga

SEQ ID NO: 2282798 - RNA, 14 nt, Yersinia pestis
aaugcaauuuuugc

SEQ ID NO: 2282799 - RNA, 12 nt, Yersinia pestis
aaugcaccaauc

SEQ ID NO: 2282800 - RNA, 17 nt, Yersinia pestis
aaugcaccaaucaacau

SEQ ID NO: 2282801 - RNA, 16 nt, Yersinia pestis
aaugcacugaacaaug

SEQ ID NO: 2282802 - RNA, 15 nt, Yersinia pestis
aaugcagauaaccgu

SEQ ID NO: 2282803 - RNA, 16 nt, Yersinia pestis
aaugugaaaagcaguc

SEQ ID NO: 2282804 - RNA, 17 nt, Yersinia pestis
aaugucuauuuagucau

SEQ ID NO: 2282805 - RNA, 15 nt, Yersinia pestis
aaugucaccacggcu

SEQ ID NO: 2282806 - RNA, 16 nt, Yersinia pestis
aaugucacgcuuuaaa

SEQ ID NO: 2282807 - RNA, 21 nt, Yersinia pestis
aauguucucuggguaagaaca

SEQ ID NO: 2282808 - RNA, 19 nt, Yersinia pestis
aauguucugcggaagucau

SEQ ID NO: 2282809 - RNA, 22 nt, Yersinia pestis
aauguuccggacuucauaaaua

SEQ ID NO: 2282810 - RNA, 20 nt, Yersinia pestis
aauguuauauuucuuagaga

SEQ ID NO: 2282811 - RNA, 15 nt, Yersinia pestis
aauguguugaauauc

SEQ ID NO: 2282812 - RNA, 21 nt, Yersinia pestis
aauguguugauuaacauccau

SEQ ID NO: 2282813 - RNA, 23 nt, Yersinia pestis
aauguguuuuugucauuuaauua

SEQ ID NO: 2282814 - RNA, 14 nt, Yersinia pestis
aauuaaaauaauga

SEQ ID NO: 2282815 - RNA, 17 nt, Yersinia pestis
aauuaaaacugaaaagu

SEQ ID NO: 2282816 - RNA, 19 nt, Yersinia pestis
aauuaaaacugaaaaguuu

SEQ ID NO: 2282817 - RNA, 18 nt, Yersinia pestis
aauuaaauuaauauuuaa

SEQ ID NO: 2282818 - RNA, 13 nt, Yersinia pestis
aauuaaauauuaa

SEQ ID NO: 2282819 - RNA, 16 nt, Yersinia pestis
aauuaacagcaucacu

SEQ ID NO: 2282820 - RNA, 16 nt, Yersinia pestis
aauuaaaacauauuaa

SEQ ID NO: 2282821 - RNA, 15 nt, Yersinia pestis
aauuaaaaauuaauu

SEQ ID NO: 2282822 - RNA, 13 nt, Yersinia pestis
aauuaaaaauaga

SEQ ID NO: 2282823 - RNA, 15 nt, Yersinia pestis
aauuaaaaagagugu

SEQ ID NO: 2282824 - RNA, 14 nt, Yersinia pestis
aauuaaaaacccuc

SEQ ID NO: 2282825 - RNA, 20 nt, Yersinia pestis
aauuaaaaaagguggccauu

SEQ ID NO: 2282826 - RNA, 24 nt, Yersinia pestis
aauguugauacuccauuugaacug

SEQ ID NO: 2282827 - RNA, 16 nt, Yersinia pestis
aauguugcugaauaaa

SEQ ID NO: 2282828 - RNA, 19 nt, Yersinia pestis
aauguuggggcacaauaag

SEQ ID NO: 2282829 - RNA, 21 nt, Yersinia pestis
aauguuguuuaugaaaucuac

SEQ ID NO: 2282830 - RNA, 21 nt, Yersinia pestis
aauguuucuauccgaaaaaua

SEQ ID NO: 2282831 - RNA, 15 nt, Yersinia pestis
aauuccauauuuaau

SEQ ID NO: 2282832 - RNA, 22 nt, Yersinia pestis
aauuccaugcaaaauaugguag

SEQ ID NO: 2282833 - RNA, 23 nt, Yersinia pestis
aauuccacauaaaauagcccagu

SEQ ID NO: 2282834 - RNA, 23 nt, Yersinia pestis
aauuccacgcugaaacuuuucag

SEQ ID NO: 2282835 - RNA, 18 nt, Yersinia pestis
aauuccauaauaagugaa

SEQ ID NO: 2282836 - RNA, 15 nt, Yersinia pestis
aauucauguugccaa

SEQ ID NO: 2282837 - RNA, 16 nt, Yersinia pestis
aauucauguugccaau

SEQ ID NO: 2282838 - RNA, 14 nt, Yersinia pestis
aauucauuauuacu

SEQ ID NO: 2282839 - RNA, 15 nt, Yersinia pestis
aauucauuauuacuc

SEQ ID NO: 2282840 - RNA, 22 nt, Yersinia pestis
aauucauuauuacucagcacau

SEQ ID NO: 2282841 - RNA, 15 nt, Yersinia pestis
aauucauaugacaaa

SEQ ID NO: 2282842 - RNA, 15 nt, Yersinia pestis
aauucaucuuuaaca

SEQ ID NO: 2282843 - RNA, 16 nt, Yersinia pestis
aauucaucuuuaacaa

SEQ ID NO: 2282844 - RNA, 19 nt, Yersinia pestis
aauucaucuuuaacaacaa

SEQ ID NO: 2282845 - RNA, 18 nt, Yersinia pestis
aauucaugcuaauaccac

SEQ ID NO: 2282846 - RNA, 19 nt, Yersinia pestis
aauucaugcuaauaccaca

SEQ ID NO: 2282847 - RNA, 20 nt, Yersinia pestis
aauucaugcuaauaccacaa

SEQ ID NO: 2282848 - RNA, 22 nt, Yersinia pestis
aauucaugcuaauaccacaaca

SEQ ID NO: 2282849 - RNA, 22 nt, Yersinia pestis
aauuccuuagcggcaaaccacu

SEQ ID NO: 2282850 - RNA, 18 nt, Yersinia pestis
aauucuauccggauuaaa

SEQ ID NO: 2282851 - RNA, 19 nt, Yersinia pestis
aauucuaccuggcucaaau

SEQ ID NO: 2282852 - RNA, 19 nt, Yersinia pestis
aauucgauaaaaggcuauu

SEQ ID NO: 2282853 - RNA, 14 nt, Yersinia pestis
aauucucccauuua

SEQ ID NO: 2282854 - RNA, 18 nt, Yersinia pestis
aauucugccgacuaauau

SEQ ID NO: 2282855 - RNA, 16 nt, Yersinia pestis
aauucugagaucuaaa

SEQ ID NO: 2282856 - RNA, 17 nt, Yersinia pestis
aauuauugccgcagaua

SEQ ID NO: 2282857 - RNA, 13 nt, Yersinia pestis
aauuauuguggcu

SEQ ID NO: 2282858 - RNA, 15 nt, Yersinia pestis
aauucaccagcaaua

SEQ ID NO: 2282859 - RNA, 22 nt, Yersinia pestis
aauucaccggcaaucgcuucca

SEQ ID NO: 2282860 - RNA, 15 nt, Yersinia pestis
aauucacugcuuaau

SEQ ID NO: 2282861 - RNA, 22 nt, Yersinia pestis
aauucagacggcagauccugaa

SEQ ID NO: 2282862 - RNA, 13 nt, Yersinia pestis
aauucacuuuccc

SEQ ID NO: 2282863 - RNA, 19 nt, Yersinia pestis
aauucacgcaaggccaggu

SEQ ID NO: 2282864 - RNA, 15 nt, Yersinia pestis
aauucacgccuaucu

SEQ ID NO: 2282865 - RNA, 23 nt, Yersinia pestis
aauuaagaagccucaugaaugag

SEQ ID NO: 2282866 - RNA, 22 nt, Yersinia pestis
aauuaucuaauaaugagccaua

SEQ ID NO: 2282867 - RNA, 18 nt, Yersinia pestis
aauuaucgcaauuucaga

SEQ ID NO: 2282868 - RNA, 13 nt, Yersinia pestis
aauuauccguaaa

SEQ ID NO: 2282869 - RNA, 12 nt, Yersinia pestis
aauuauauuuaa

SEQ ID NO: 2282870 - RNA, 13 nt, Yersinia pestis
aauuauauuuaau

SEQ ID NO: 2282871 - RNA, 13 nt, Yersinia pestis
aauuaucaucaau

SEQ ID NO: 2282872 - RNA, 17 nt, Yersinia pestis
aauuuaggugaaaauaa

SEQ ID NO: 2282873 - RNA, 18 nt, Yersinia pestis
aauuuaggugaaaauaau

SEQ ID NO: 2282874 - RNA, 18 nt, Yersinia pestis
aauuuaauaaaaaccaau

SEQ ID NO: 2282875 - RNA, 14 nt, Yersinia pestis
aauuguuugcuauc

SEQ ID NO: 2282876 - RNA, 23 nt, Yersinia pestis
aauuguuugcuaucaauugcugg

SEQ ID NO: 2282877 - RNA, 15 nt, Yersinia pestis
aauuguggaaauaac

SEQ ID NO: 2282878 - RNA, 18 nt, Yersinia pestis
aauugugaguuaaaaaua

SEQ ID NO: 2282879 - RNA, 21 nt, Yersinia pestis
aauugaugucaauuaaaaacg

SEQ ID NO: 2282880 - RNA, 12 nt, Yersinia pestis
aaaacaagcuac

SEQ ID NO: 2282881 - RNA, 21 nt, Yersinia pestis
aauucuggguacaacacaaaa

SEQ ID NO: 2282882 - RNA, 17 nt, Yersinia pestis
aauugaagcagauaaag

SEQ ID NO: 2282883 - RNA, 22 nt, Yersinia pestis
aauugaagaguugauccgauaa

SEQ ID NO: 2282884 - RNA, 17 nt, Yersinia pestis
aauugaagauuuaaaua

SEQ ID NO: 2282885 - RNA, 17 nt, Yersinia pestis
aauuggaagagccugaa

SEQ ID NO: 2282886 - RNA, 21 nt, Yersinia pestis
aauugccgccacaggcgacua

SEQ ID NO: 2282887 - RNA, 13 nt, Yersinia pestis
aauugcugaaaaa

SEQ ID NO: 2282888 - RNA, 21 nt, Yersinia pestis
aauugcuggcggucacgcuga

SEQ ID NO: 2282889 - RNA, 20 nt, Yersinia pestis
aauugcuguuggaucucucc

SEQ ID NO: 2282890 - RNA, 18 nt, Yersinia pestis
aaucagacggaauaccac

SEQ ID NO: 2282891 - RNA, 22 nt, Yersinia pestis
aaucacuucacuugcaugccug

SEQ ID NO: 2282892 - RNA, 16 nt, Yersinia pestis
aaucacuggcaauaau

SEQ ID NO: 2282893 - RNA, 23 nt, Yersinia pestis
aaucacggagaauaaaaaugaua

SEQ ID NO: 2282894 - RNA, 22 nt, Yersinia pestis
aaucacguuuccaaaacucaug

SEQ ID NO: 2282895 - RNA, 13 nt, Yersinia pestis
aaucacugacuga

SEQ ID NO: 2282896 - RNA, 19 nt, Yersinia pestis
aaucacugacugauguaag

SEQ ID NO: 2282897 - RNA, 21 nt, Yersinia pestis
aaucacugacugauguaagcu

SEQ ID NO: 2282898 - RNA, 18 nt, Yersinia pestis
aaucacugauucagaaag

SEQ ID NO: 2282899 - RNA, 19 nt, Yersinia pestis
aaucaccucaaacugacuu

SEQ ID NO: 2282900 - RNA, 17 nt, Yersinia pestis
aaucaccuggccaggaa

SEQ ID NO: 2282901 - RNA, 18 nt, Yersinia pestis
aaucaccuuggaaaacag

SEQ ID NO: 2282902 - RNA, 19 nt, Yersinia pestis
aaucaccuuggaaaacagc

SEQ ID NO: 2282903 - RNA, 23 nt, Yersinia pestis
aaucaccuuggauggcgaaacaa

SEQ ID NO: 2282904 - RNA, 18 nt, Yersinia pestis
aaucacgauacgacuucu

SEQ ID NO: 2282905 - RNA, 12 nt, Yersinia pestis
aaucacaucauu

SEQ ID NO: 2282906 - RNA, 21 nt, Yersinia pestis
aaucacaucauucagcgucac

SEQ ID NO: 2282907 - RNA, 14 nt, Yersinia pestis
aaucacauacuggc

SEQ ID NO: 2282908 - RNA, 17 nt, Yersinia pestis
aaucaaaagggaucacc

SEQ ID NO: 2282909 - RNA, 14 nt, Yersinia pestis
aaucaaaauaccca

SEQ ID NO: 2282910 - RNA, 19 nt, Yersinia pestis
aaucaaaauacccauugag

SEQ ID NO: 2282911 - RNA, 13 nt, Yersinia pestis
aaucaacagauau

SEQ ID NO: 2282912 - RNA, 21 nt, Yersinia pestis
aaucaaccacgguaauagcuu

SEQ ID NO: 2282913 - RNA, 15 nt, Yersinia pestis
aaucaauugccccca

SEQ ID NO: 2282914 - RNA, 20 nt, Yersinia pestis
aaucaauugcccccaucacu

SEQ ID NO: 2282915 - RNA, 22 nt, Yersinia pestis
aaucaacgcuccgguuuucacc

SEQ ID NO: 2282916 - RNA, 12 nt, Yersinia pestis
aaucaagauauu

SEQ ID NO: 2282917 - RNA, 18 nt, Yersinia pestis
aaucaagauauuacuucu

SEQ ID NO: 2282918 - RNA, 19 nt, Yersinia pestis
aaucaagggcgauaccaua

SEQ ID NO: 2282919 - RNA, 14 nt, Yersinia pestis
aaucaaguugaaug

SEQ ID NO: 2282920 - RNA, 14 nt, Yersinia pestis
aaucaagcgccauu

SEQ ID NO: 2282921 - RNA, 13 nt, Yersinia pestis
aauauuauucagu

SEQ ID NO: 2282922 - RNA, 14 nt, Yersinia pestis
aauauuaauaaugc

SEQ ID NO: 2282923 - RNA, 22 nt, Yersinia pestis
aauauguaguuguaccccugaa

SEQ ID NO: 2282924 - RNA, 17 nt, Yersinia pestis
aauauggguuaaaaacu

SEQ ID NO: 2282925 - RNA, 20 nt, Yersinia pestis
aauaugguagaauuuaccuc

SEQ ID NO: 2282926 - RNA, 14 nt, Yersinia pestis
aauaugguauucaa

SEQ ID NO: 2282927 - RNA, 16 nt, Yersinia pestis
aauagcaguggccauu

SEQ ID NO: 2282928 - RNA, 13 nt, Yersinia pestis
aauagcauaaaua

SEQ ID NO: 2282929 - RNA, 14 nt, Yersinia pestis
aauagauaacaaac

SEQ ID NO: 2282930 - RNA, 13 nt, Yersinia pestis
aaucaaaaaauaa

SEQ ID NO: 2282931 - RNA, 14 nt, Yersinia pestis
aaucaaaaaauaaa

SEQ ID NO: 2282932 - RNA, 17 nt, Yersinia pestis
aauauuuuuaaucugcc

SEQ ID NO: 2282933 - RNA, 21 nt, Yersinia pestis
aauauuuaucugcauuaaaau

SEQ ID NO: 2282934 - RNA, 16 nt, Yersinia pestis
aauauuugagauauag

SEQ ID NO: 2282935 - RNA, 16 nt, Yersinia pestis
aauauuuaaagccucu

SEQ ID NO: 2282936 - RNA, 19 nt, Yersinia pestis
aauauuuacggugagaaua

SEQ ID NO: 2282937 - RNA, 15 nt, Yersinia pestis
aauauugauccaccg

SEQ ID NO: 2282938 - RNA, 19 nt, Yersinia pestis
aauauuggcgcacaacugc

SEQ ID NO: 2282939 - RNA, 12 nt, Yersinia pestis
aauauugccccc

SEQ ID NO: 2282940 - RNA, 22 nt, Yersinia pestis
aauauugugcacucguuguauu

SEQ ID NO: 2282941 - RNA, 19 nt, Yersinia pestis
aauauugucuuaugauaua

SEQ ID NO: 2282942 - RNA, 14 nt, Yersinia pestis
aauauuggauaaua

SEQ ID NO: 2282943 - RNA, 19 nt, Yersinia pestis
aauauucucaauauuaaua

SEQ ID NO: 2282944 - RNA, 24 nt, Yersinia pestis
aauauucuucacuggaucuuuuag

SEQ ID NO: 2282945 - RNA, 13 nt, Yersinia pestis
aauauucucuaug

SEQ ID NO: 2282946 - RNA, 23 nt, Yersinia pestis
aauauucugacgggacaaucugu

SEQ ID NO: 2282947 - RNA, 21 nt, Yersinia pestis
aauauuccccaccauugcaaa

SEQ ID NO: 2282948 - RNA, 20 nt, Yersinia pestis
aauauucaguaagguuuuac

SEQ ID NO: 2282949 - RNA, 13 nt, Yersinia pestis
aauauucauuaaa

SEQ ID NO: 2282950 - RNA, 13 nt, Yersinia pestis
aauauucaguaag

SEQ ID NO: 2282951 - RNA, 13 nt, Yersinia pestis
aauauuauuuaau

SEQ ID NO: 2282952 - RNA, 17 nt, Yersinia pestis
aauauuauuuaauuaaa

SEQ ID NO: 2282953 - RNA, 23 nt, Yersinia pestis
aaucuucauaaaccaacgguuca

SEQ ID NO: 2282954 - RNA, 11 nt, Yersinia pestis
aaucuuccuuu

SEQ ID NO: 2282955 - RNA, 13 nt, Yersinia pestis
aaucugucgcugu

SEQ ID NO: 2282956 - RNA, 14 nt, Yersinia pestis
aaucugucgcugug

SEQ ID NO: 2282957 - RNA, 21 nt, Yersinia pestis
aaucuguucgggcugauuaau

SEQ ID NO: 2282958 - RNA, 18 nt, Yersinia pestis
aaucuguuccugauucca

SEQ ID NO: 2282959 - RNA, 19 nt, Yersinia pestis
aaucugcggcauaaauucu

SEQ ID NO: 2282960 - RNA, 18 nt, Yersinia pestis
aaucugcaacgcaacccu

SEQ ID NO: 2282961 - RNA, 17 nt, Yersinia pestis
aaucugcaguuuccaac

SEQ ID NO: 2282962 - RNA, 19 nt, Yersinia pestis
aaucucuugauuaccaaua

SEQ ID NO: 2282963 - RNA, 18 nt, Yersinia pestis
aaucugaugaauuaaaga

SEQ ID NO: 2282964 - RNA, 22 nt, Yersinia pestis
aaucugaugaauuaaagauuaa

SEQ ID NO: 2282965 - RNA, 13 nt, Yersinia pestis
aaucugauacuga

SEQ ID NO: 2282966 - RNA, 21 nt, Yersinia pestis
aaucugacgguuauuuucuga

SEQ ID NO: 2282967 - RNA, 16 nt, Yersinia pestis
aaucugauacugaacg

SEQ ID NO: 2282968 - RNA, 12 nt, Yersinia pestis
aaucuagaacua

SEQ ID NO: 2282969 - RNA, 22 nt, Yersinia pestis
aaucucuggcaacggcacaucc

SEQ ID NO: 2282970 - RNA, 18 nt, Yersinia pestis
aaucucuccaugauauau

SEQ ID NO: 2282971 - RNA, 19 nt, Yersinia pestis
aaucucuccaugauauauc

SEQ ID NO: 2282972 - RNA, 14 nt, Yersinia pestis
aaucgcgcauuucu

SEQ ID NO: 2282973 - RNA, 19 nt, Yersinia pestis
aaaaauucugagaucuaaa

SEQ ID NO: 2282974 - RNA, 15 nt, Yersinia pestis
aaucgccaaacugcu

SEQ ID NO: 2282975 - RNA, 17 nt, Yersinia pestis
aaucgccaaacugcuca

SEQ ID NO: 2282976 - RNA, 17 nt, Yersinia pestis
aaucgcaucgucgcugu

SEQ ID NO: 2282977 - RNA, 19 nt, Yersinia pestis
aauccgcuaguuaacccua

SEQ ID NO: 2282978 - RNA, 15 nt, Yersinia pestis
aauccggugcaacca

SEQ ID NO: 2282979 - RNA, 15 nt, Yersinia pestis
aauccuuguaagacc

SEQ ID NO: 2282980 - RNA, 22 nt, Yersinia pestis
aaucgauacugccaucaucauu

SEQ ID NO: 2282981 - RNA, 15 nt, Yersinia pestis
aaucgauggaauaaa

SEQ ID NO: 2282982 - RNA, 20 nt, Yersinia pestis
aauccuauauacaaggcaca

SEQ ID NO: 2282983 - RNA, 19 nt, Yersinia pestis
aauccuacaauaucuuccc

SEQ ID NO: 2282984 - RNA, 14 nt, Yersinia pestis
aauccuacauucag

SEQ ID NO: 2282985 - RNA, 19 nt, Yersinia pestis
aauccuugcuaguuauaua

SEQ ID NO: 2282986 - RNA, 16 nt, Yersinia pestis
aauccacugaaauaaa

SEQ ID NO: 2282987 - RNA, 15 nt, Yersinia pestis
aauccagaagccauu

SEQ ID NO: 2282988 - RNA, 17 nt, Yersinia pestis
aauccaaaauaauauaa

SEQ ID NO: 2282989 - RNA, 22 nt, Yersinia pestis
aaucauuuuuuuauuaaguuuu

SEQ ID NO: 2282990 - RNA, 12 nt, Yersinia pestis
aaucaugauggu

SEQ ID NO: 2282991 - RNA, 13 nt, Yersinia pestis
aaucauuuauaua

SEQ ID NO: 2282992 - RNA, 15 nt, Yersinia pestis
aaucagcaagcugcu

SEQ ID NO: 2282993 - RNA, 14 nt, Yersinia pestis
aaucagaucaacag

SEQ ID NO: 2282994 - RNA, 17 nt, Yersinia pestis
acaaugcggccuuugcu

SEQ ID NO: 2282995 - RNA, 14 nt, Yersinia pestis
acaauuauuuuuac

SEQ ID NO: 2282996 - RNA, 14 nt, Yersinia pestis
acaaugcacagugc

SEQ ID NO: 2282997 - RNA, 15 nt, Yersinia pestis
acaaugccuaaaaug

SEQ ID NO: 2282998 - RNA, 20 nt, Yersinia pestis
acaauucccguuagguucaa

SEQ ID NO: 2282999 - RNA, 19 nt, Yersinia pestis
acaauugccugauuuuuau

SEQ ID NO: 2283000 - RNA, 21 nt, Yersinia pestis
acaauuuuauuguuuucguuu

SEQ ID NO: 2283001 - RNA, 19 nt, Yersinia pestis
acaauccaauuuaccacua

SEQ ID NO: 2283002 - RNA, 20 nt, Yersinia pestis
acaaucagcccgauggcaaa

SEQ ID NO: 2283003 - RNA, 17 nt, Yersinia pestis
acaaguuacauuuuuaa

SEQ ID NO: 2283004 - RNA, 15 nt, Yersinia pestis
acaaguugucuguaa

SEQ ID NO: 2283005 - RNA, 22 nt, Yersinia pestis
acaaguugucuguaauaauaau

SEQ ID NO: 2283006 - RNA, 13 nt, Yersinia pestis
acaauacauagaa

SEQ ID NO: 2283007 - RNA, 21 nt, Yersinia pestis
acaauaccgccacacaauaca

SEQ ID NO: 2283008 - RNA, 13 nt, Yersinia pestis
acaauauuauauu

SEQ ID NO: 2283009 - RNA, 15 nt, Yersinia pestis
acaauauuauauucu

SEQ ID NO: 2283010 - RNA, 23 nt, Yersinia pestis
acaauauucauuuugcuggaaaa

SEQ ID NO: 2283011 - RNA, 18 nt, Yersinia pestis
acaauauucgcagccaaa

SEQ ID NO: 2283012 - RNA, 15 nt, Yersinia pestis
acaaggaaaaggcag

SEQ ID NO: 2283013 - RNA, 14 nt, Yersinia pestis
acaacgagggcuca

SEQ ID NO: 2283014 - RNA, 18 nt, Yersinia pestis
acaccuaaaacauaccau

SEQ ID NO: 2283015 - RNA, 22 nt, Yersinia pestis
acaccucaacgugauaugccug

SEQ ID NO: 2283016 - RNA, 17 nt, Yersinia pestis
acaccggggauccauag

SEQ ID NO: 2283017 - RNA, 20 nt, Yersinia pestis
acaccggggauccauaggau

SEQ ID NO: 2283018 - RNA, 13 nt, Yersinia pestis
acaccuuaaaaca

SEQ ID NO: 2283019 - RNA, 14 nt, Yersinia pestis
acacgaaaagcagc

SEQ ID NO: 2283020 - RNA, 16 nt, Yersinia pestis
acacgaaaagcagcag

SEQ ID NO: 2283021 - RNA, 21 nt, Yersinia pestis
acaccuucgagagcuaaugcu

SEQ ID NO: 2283022 - RNA, 15 nt, Yersinia pestis
acaccuuaaaacagc

SEQ ID NO: 2283023 - RNA, 22 nt, Yersinia pestis
acacgccuucauguugcaacau

SEQ ID NO: 2283024 - RNA, 14 nt, Yersinia pestis
acacgguaggcuuc

SEQ ID NO: 2283025 - RNA, 21 nt, Yersinia pestis
acacgccguuuugagauuaau

SEQ ID NO: 2283026 - RNA, 13 nt, Yersinia pestis
acaccaacacuga

SEQ ID NO: 2283027 - RNA, 20 nt, Yersinia pestis
acacauuccaguaaaaaaau

SEQ ID NO: 2283028 - RNA, 22 nt, Yersinia pestis
acacaagggauuuaaaaucccu

SEQ ID NO: 2283029 - RNA, 20 nt, Yersinia pestis
acaccacaucacgcagcgcu

SEQ ID NO: 2283030 - RNA, 21 nt, Yersinia pestis
acaccaccgccgcaacaauaa

SEQ ID NO: 2283031 - RNA, 18 nt, Yersinia pestis
acacccaauaauaaaaaa

SEQ ID NO: 2283032 - RNA, 22 nt, Yersinia pestis
acacccaacuuuuuuaccacau

SEQ ID NO: 2283033 - RNA, 12 nt, Yersinia pestis
acacccagccag

SEQ ID NO: 2283034 - RNA, 22 nt, Yersinia pestis
acaccgccuaucgugaacaggc

SEQ ID NO: 2283035 - RNA, 15 nt, Yersinia pestis
acaaagcccaaaaaa

SEQ ID NO: 2283036 - RNA, 17 nt, Yersinia pestis
acaaagccgcuuaauuu

SEQ ID NO: 2283037 - RNA, 16 nt, Yersinia pestis
acaaacuugagucagc

SEQ ID NO: 2283038 - RNA, 20 nt, Yersinia pestis
acaaagauacagcccaagag

SEQ ID NO: 2283039 - RNA, 21 nt, Yersinia pestis
acaaagauacagcccaagaga

SEQ ID NO: 2283040 - RNA, 14 nt, Yersinia pestis
acaaacgcuugagc

SEQ ID NO: 2283041 - RNA, 18 nt, Yersinia pestis
acaaacucaugcucuuca

SEQ ID NO: 2283042 - RNA, 22 nt, Yersinia pestis
acaaacaaccuaaaaaaaacaa

SEQ ID NO: 2283043 - RNA, 14 nt, Yersinia pestis
acaaacacauggcu

SEQ ID NO: 2283044 - RNA, 14 nt, Yersinia pestis
acaaaaaauuaaug

SEQ ID NO: 2283045 - RNA, 22 nt, Yersinia pestis
acaaaaaagggggcccugaacu

SEQ ID NO: 2283046 - RNA, 17 nt, Yersinia pestis
acaaaaaguuaaauaug

SEQ ID NO: 2283047 - RNA, 18 nt, Yersinia pestis
acaaaaauaaacgggcuu

SEQ ID NO: 2283048 - RNA, 19 nt, Yersinia pestis
acaaaagugacgaaugagc

SEQ ID NO: 2283049 - RNA, 12 nt, Yersinia pestis
acaaaagugaaa

SEQ ID NO: 2283050 - RNA, 18 nt, Yersinia pestis
acaaaauggccuugccca

SEQ ID NO: 2283051 - RNA, 13 nt, Yersinia pestis
acaaaaugugaaa

SEQ ID NO: 2283052 - RNA, 12 nt, Yersinia pestis
acaaaaugugaa

SEQ ID NO: 2283053 - RNA, 14 nt, Yersinia pestis
acaaaaucccccac

SEQ ID NO: 2283054 - RNA, 15 nt, Yersinia pestis
acaaaaucccccacc

SEQ ID NO: 2283055 - RNA, 22 nt, Yersinia pestis
acaaauaauuaggauuuauuuu

SEQ ID NO: 2283056 - RNA, 22 nt, Yersinia pestis
acaaauagaucggguaaaccaa

SEQ ID NO: 2283057 - RNA, 14 nt, Yersinia pestis
acaaauagcgcugc

SEQ ID NO: 2283058 - RNA, 12 nt, Yersinia pestis
acaaaggucagc

SEQ ID NO: 2283059 - RNA, 16 nt, Yersinia pestis
acaaaguaccuauggc

SEQ ID NO: 2283060 - RNA, 14 nt, Yersinia pestis
acaaagugagggau

SEQ ID NO: 2283061 - RNA, 18 nt, Yersinia pestis
acaaaguuaaaugaagga

SEQ ID NO: 2283062 - RNA, 20 nt, Yersinia pestis
acaaaucaucaucuugaaaa

SEQ ID NO: 2283063 - RNA, 17 nt, Yersinia pestis
acaaaucuuaaauugaa

SEQ ID NO: 2283064 - RNA, 20 nt, Yersinia pestis
acaaaucuuaaauugaagag

SEQ ID NO: 2283065 - RNA, 22 nt, Yersinia pestis
acaaaucuuaaauugaagaguu

SEQ ID NO: 2283066 - RNA, 18 nt, Yersinia pestis
acaaaugcugugccaugu

SEQ ID NO: 2283067 - RNA, 17 nt, Yersinia pestis
acaaauucaccagcaau

SEQ ID NO: 2283068 - RNA, 15 nt, Yersinia pestis
acaaauuaaauuucu

SEQ ID NO: 2283069 - RNA, 18 nt, Yersinia pestis
acaaauuguggaaauaac

SEQ ID NO: 2283070 - RNA, 19 nt, Yersinia pestis
acaaauuuuuuauauucca

SEQ ID NO: 2283071 - RNA, 23 nt, Yersinia pestis
acaacagugcaacauuaaaaaua

SEQ ID NO: 2283072 - RNA, 21 nt, Yersinia pestis
acaacaagcggccagcuugca

SEQ ID NO: 2283073 - RNA, 12 nt, Yersinia pestis
acaacaauaaua

SEQ ID NO: 2283074 - RNA, 14 nt, Yersinia pestis
acaacaucauauau

SEQ ID NO: 2283075 - RNA, 18 nt, Yersinia pestis
acaacaucaaaugaaggg

SEQ ID NO: 2283076 - RNA, 22 nt, Yersinia pestis
acaacauugccaaauuauucau

SEQ ID NO: 2283077 - RNA, 23 nt, Yersinia pestis
acaacauugccaaauuauucauc

SEQ ID NO: 2283078 - RNA, 21 nt, Yersinia pestis
acaaccacccgacaucaagaa

SEQ ID NO: 2283079 - RNA, 18 nt, Yersinia pestis
acaaccacuaaaccacau

SEQ ID NO: 2283080 - RNA, 18 nt, Yersinia pestis
acaaccacugaacaccau

SEQ ID NO: 2283081 - RNA, 12 nt, Yersinia pestis
acaaccaauaca

SEQ ID NO: 2283082 - RNA, 15 nt, Yersinia pestis
acaaccaacaaacaa

SEQ ID NO: 2283083 - RNA, 19 nt, Yersinia pestis
acaaccaacaaacaauccu

SEQ ID NO: 2283084 - RNA, 23 nt, Yersinia pestis
acaacccccgaacacucgaucuu

SEQ ID NO: 2283085 - RNA, 22 nt, Yersinia pestis
acaacccgaauuaauaaaaccu

SEQ ID NO: 2283086 - RNA, 14 nt, Yersinia pestis
acaacccaauaaua

SEQ ID NO: 2283087 - RNA, 19 nt, Yersinia pestis
acaaccuaaaaaaaacaac

SEQ ID NO: 2283088 - RNA, 12 nt, Yersinia pestis
acaaccucucag

SEQ ID NO: 2283089 - RNA, 22 nt, Yersinia pestis
acaucaccuugcgcccuugugg

SEQ ID NO: 2283090 - RNA, 18 nt, Yersinia pestis
acaucaucuucuauuauu

SEQ ID NO: 2283091 - RNA, 15 nt, Yersinia pestis
acaucaaguacuuca

SEQ ID NO: 2283092 - RNA, 17 nt, Yersinia pestis
acaucaauguuggccca

SEQ ID NO: 2283093 - RNA, 13 nt, Yersinia pestis
acauaauuaaaua

SEQ ID NO: 2283094 - RNA, 21 nt, Yersinia pestis
acauaaucuuuacugcauuga

SEQ ID NO: 2283095 - RNA, 13 nt, Yersinia pestis
acauaaucaaucc

SEQ ID NO: 2283096 - RNA, 13 nt, Yersinia pestis
acauaagaugacc

SEQ ID NO: 2283097 - RNA, 17 nt, Yersinia pestis
acauaacguuauaacuc

SEQ ID NO: 2283098 - RNA, 12 nt, Yersinia pestis
acauccaauuca

SEQ ID NO: 2283099 - RNA, 19 nt, Yersinia pestis
acauccaauucaguacgac

SEQ ID NO: 2283100 - RNA, 20 nt, Yersinia pestis
acaucaugaguaaaagauuc

SEQ ID NO: 2283101 - RNA, 13 nt, Yersinia pestis
acauccuaaaaag

SEQ ID NO: 2283102 - RNA, 22 nt, Yersinia pestis
acaucgguaucggccaauucag

SEQ ID NO: 2283103 - RNA, 13 nt, Yersinia pestis
acauccuuauuuu

SEQ ID NO: 2283104 - RNA, 13 nt, Yersinia pestis
acauguacauuau

SEQ ID NO: 2283105 - RNA, 16 nt, Yersinia pestis
acaugcugaagccagc

SEQ ID NO: 2283106 - RNA, 14 nt, Yersinia pestis
acaugguucacccg

SEQ ID NO: 2283107 - RNA, 15 nt, Yersinia pestis
acaugcggauugaac

SEQ ID NO: 2283108 - RNA, 22 nt, Yersinia pestis
acaugagauucaggagauagcc

SEQ ID NO: 2283109 - RNA, 18 nt, Yersinia pestis
acaucuggcgauuuugcg

SEQ ID NO: 2283110 - RNA, 18 nt, Yersinia pestis
acaugaacucaacuuucu

SEQ ID NO: 2283111 - RNA, 16 nt, Yersinia pestis
acaucgguuagcguuu

SEQ ID NO: 2283112 - RNA, 19 nt, Yersinia pestis
acauuucuuauauuauuaa

SEQ ID NO: 2283113 - RNA, 17 nt, Yersinia pestis
acauuugcaucuaugga

SEQ ID NO: 2283114 - RNA, 15 nt, Yersinia pestis
acauuugagcaggug

SEQ ID NO: 2283115 - RNA, 14 nt, Yersinia pestis
acauuucuuuuuau

SEQ ID NO: 2283116 - RNA, 18 nt, Yersinia pestis
acauuucuuuuuauguua

SEQ ID NO: 2283117 - RNA, 15 nt, Yersinia pestis
acauuugaaaugcau

SEQ ID NO: 2283118 - RNA, 22 nt, Yersinia pestis
acauuuucaucugaccaaacau

SEQ ID NO: 2283119 - RNA, 18 nt, Yersinia pestis
acauuuggcgcucauuuc

SEQ ID NO: 2283120 - RNA, 20 nt, Yersinia pestis
acauuuguauuuuuucuuug

SEQ ID NO: 2283121 - RNA, 11 nt, Yersinia pestis
acauuuugguu

SEQ ID NO: 2283122 - RNA, 15 nt, Yersinia pestis
acauuuugugugagu

SEQ ID NO: 2283123 - RNA, 21 nt, Yersinia pestis
acauuuuuaauaauguguuug

SEQ ID NO: 2283124 - RNA, 21 nt, Yersinia pestis
acauuagggccaccagacuga

SEQ ID NO: 2283125 - RNA, 21 nt, Yersinia pestis
acauuagccgguuaggccagu

SEQ ID NO: 2283126 - RNA, 24 nt, Yersinia pestis
acauuaaucguuauaauauuaaaa

SEQ ID NO: 2283127 - RNA, 15 nt, Yersinia pestis
acauugaagugauau

SEQ ID NO: 2283128 - RNA, 20 nt, Yersinia pestis
acauucuuugguccucuuau

SEQ ID NO: 2283129 - RNA, 20 nt, Yersinia pestis
acauugcaguauuuuggccg

SEQ ID NO: 2283130 - RNA, 17 nt, Yersinia pestis
acauuuaaacacucaau

SEQ ID NO: 2283131 - RNA, 16 nt, Yersinia pestis
acauuguuauauuaac

SEQ ID NO: 2283132 - RNA, 16 nt, Yersinia pestis
acauuuuuuaaaacca

SEQ ID NO: 2283133 - RNA, 13 nt, Yersinia pestis
acauuuuucuauu

SEQ ID NO: 2283134 - RNA, 12 nt, Yersinia pestis
accaaaacuccc

SEQ ID NO: 2283135 - RNA, 15 nt, Yersinia pestis
accaaaaccggcauu

SEQ ID NO: 2283136 - RNA, 20 nt, Yersinia pestis
accaaaaccggcauuaagca

SEQ ID NO: 2283137 - RNA, 11 nt, Yersinia pestis
accaaaaccuu

SEQ ID NO: 2283138 - RNA, 21 nt, Yersinia pestis
accaaaacgccaccagcgcca

SEQ ID NO: 2283139 - RNA, 15 nt, Yersinia pestis
accaaaaaucuuguu

SEQ ID NO: 2283140 - RNA, 22 nt, Yersinia pestis
accaaaaaucuuguuaauuuaa

SEQ ID NO: 2283141 - RNA, 11 nt, Yersinia pestis
accaaagcagu

SEQ ID NO: 2283142 - RNA, 22 nt, Yersinia pestis
accaaacggaaugguuuggcca

SEQ ID NO: 2283143 - RNA, 13 nt, Yersinia pestis
accaaacauuguc

SEQ ID NO: 2283144 - RNA, 23 nt, Yersinia pestis
accaaaauagcggccaacauaau

SEQ ID NO: 2283145 - RNA, 14 nt, Yersinia pestis
accaaaaugacaau

SEQ ID NO: 2283146 - RNA, 11 nt, Yersinia pestis
accaaacagaa

SEQ ID NO: 2283147 - RNA, 15 nt, Yersinia pestis
accaaaucagcaagc

SEQ ID NO: 2283148 - RNA, 23 nt, Yersinia pestis
accaaauagcaagccaaaacagc

SEQ ID NO: 2283149 - RNA, 21 nt, Yersinia pestis
accaaaucugacgguuauuuu

SEQ ID NO: 2283150 - RNA, 18 nt, Yersinia pestis
accaaaggccaaccucuu

SEQ ID NO: 2283151 - RNA, 13 nt, Yersinia pestis
accaaauaaaaca

SEQ ID NO: 2283152 - RNA, 17 nt, Yersinia pestis
accaacaaacaauccua

SEQ ID NO: 2283153 - RNA, 18 nt, Yersinia pestis
accaaaugcucagccauc

SEQ ID NO: 2283154 - RNA, 11 nt, Yersinia pestis
accaaauucag

SEQ ID NO: 2283155 - RNA, 15 nt, Yersinia pestis
accaacaguuauuuu

SEQ ID NO: 2283156 - RNA, 17 nt, Yersinia pestis
accaacaguuugguaau

SEQ ID NO: 2283157 - RNA, 14 nt, Yersinia pestis
accaacaccaccau

SEQ ID NO: 2283158 - RNA, 13 nt, Yersinia pestis
accaacagacgcc

SEQ ID NO: 2283159 - RNA, 22 nt, Yersinia pestis
accaacaccacacugagcaccg

SEQ ID NO: 2283160 - RNA, 14 nt, Yersinia pestis
accaacaccaaugg

SEQ ID NO: 2283161 - RNA, 19 nt, Yersinia pestis
accaacaccacacugagca

SEQ ID NO: 2283162 - RNA, 16 nt, Yersinia pestis
acagccuaaccgcugu

SEQ ID NO: 2283163 - RNA, 17 nt, Yersinia pestis
acagccagccuuaacug

SEQ ID NO: 2283164 - RNA, 22 nt, Yersinia pestis
acagccagugcuggcaacagcg

SEQ ID NO: 2283165 - RNA, 20 nt, Yersinia pestis
acagccgcugaauuaacaua

SEQ ID NO: 2283166 - RNA, 19 nt, Yersinia pestis
acagcaguucaucuucgau

SEQ ID NO: 2283167 - RNA, 13 nt, Yersinia pestis
acagccaccagcc

SEQ ID NO: 2283168 - RNA, 23 nt, Yersinia pestis
acagccacgauuaucucuuacau

SEQ ID NO: 2283169 - RNA, 18 nt, Yersinia pestis
acagccacguaauaccac

SEQ ID NO: 2283170 - RNA, 21 nt, Yersinia pestis
acagcaaugcaccgacaaaga

SEQ ID NO: 2283171 - RNA, 19 nt, Yersinia pestis
acagcaacaggguaauaac

SEQ ID NO: 2283172 - RNA, 12 nt, Yersinia pestis
acagcaccaccg

SEQ ID NO: 2283173 - RNA, 16 nt, Yersinia pestis
acacguaaaacaggga

SEQ ID NO: 2283174 - RNA, 14 nt, Yersinia pestis
acacgguugaaaag

SEQ ID NO: 2283175 - RNA, 17 nt, Yersinia pestis
acacgguaggcuucugc

SEQ ID NO: 2283176 - RNA, 22 nt, Yersinia pestis
acacgugagaauugcugcuugc

SEQ ID NO: 2283177 - RNA, 18 nt, Yersinia pestis
acacguggguauccagug

SEQ ID NO: 2283178 - RNA, 19 nt, Yersinia pestis
acacguggguauccagugu

SEQ ID NO: 2283179 - RNA, 15 nt, Yersinia pestis
acagcaacaaacagc

SEQ ID NO: 2283180 - RNA, 14 nt, Yersinia pestis
acagcaacaacccc

SEQ ID NO: 2283181 - RNA, 13 nt, Yersinia pestis
acagcaacaccau

SEQ ID NO: 2283182 - RNA, 17 nt, Yersinia pestis
acagcuaacacuggcuu

SEQ ID NO: 2283183 - RNA, 12 nt, Yersinia pestis
acagcucacucg

SEQ ID NO: 2283184 - RNA, 15 nt, Yersinia pestis
acagcucaucaccaa

SEQ ID NO: 2283185 - RNA, 15 nt, Yersinia pestis
acagcguuggucagc

SEQ ID NO: 2283186 - RNA, 22 nt, Yersinia pestis
acagcguuggucagcaaaucuu

SEQ ID NO: 2283187 - RNA, 20 nt, Yersinia pestis
acagcgagauaaacugugcc

SEQ ID NO: 2283188 - RNA, 13 nt, Yersinia pestis
acagggcagaaaa

SEQ ID NO: 2283189 - RNA, 14 nt, Yersinia pestis
acagggcagaaaau

SEQ ID NO: 2283190 - RNA, 20 nt, Yersinia pestis
acaggcucagcacaaacaug

SEQ ID NO: 2283191 - RNA, 13 nt, Yersinia pestis
acaggcgcuucac

SEQ ID NO: 2283192 - RNA, 17 nt, Yersinia pestis
acagugccaaaagaccg

SEQ ID NO: 2283193 - RNA, 22 nt, Yersinia pestis
acaguucauaucgauaccgaua

SEQ ID NO: 2283194 - RNA, 22 nt, Yersinia pestis
acaguugugucagaccaaauag

SEQ ID NO: 2283195 - RNA, 13 nt, Yersinia pestis
acauaaacacgca

SEQ ID NO: 2283196 - RNA, 15 nt, Yersinia pestis
acauaaaaauagcuu

SEQ ID NO: 2283197 - RNA, 21 nt, Yersinia pestis
acauaaauuuaucucuaucaa

SEQ ID NO: 2283198 - RNA, 13 nt, Yersinia pestis
acauaaccaucaa

SEQ ID NO: 2283199 - RNA, 16 nt, Yersinia pestis
acauaaccaucaaaca

SEQ ID NO: 2283200 - RNA, 15 nt, Yersinia pestis
acauaaauaaguuca

SEQ ID NO: 2283201 - RNA, 16 nt, Yersinia pestis
acauaaauaggccgcc

SEQ ID NO: 2283202 - RNA, 16 nt, Yersinia pestis
acaguauucugcuucc

SEQ ID NO: 2283203 - RNA, 15 nt, Yersinia pestis
acagucaauugagaa

SEQ ID NO: 2283204 - RNA, 18 nt, Yersinia pestis
acagucaauugagaauaa

SEQ ID NO: 2283205 - RNA, 20 nt, Yersinia pestis
acagucuagugcgcugugcc

SEQ ID NO: 2283206 - RNA, 14 nt, Yersinia pestis
acagucccugugcg

SEQ ID NO: 2283207 - RNA, 22 nt, Yersinia pestis
acagucccugugcgcccacgcc

SEQ ID NO: 2283208 - RNA, 13 nt, Yersinia pestis
acaguaauauuuu

SEQ ID NO: 2283209 - RNA, 19 nt, Yersinia pestis
acaguaagguauugacaca

SEQ ID NO: 2283210 - RNA, 13 nt, Yersinia pestis
acaguaaagguug

SEQ ID NO: 2283211 - RNA, 17 nt, Yersinia pestis
acaguacaaaaaacaaa

SEQ ID NO: 2283212 - RNA, 21 nt, Yersinia pestis
acaguagugaguuaacgagug

SEQ ID NO: 2283213 - RNA, 22 nt, Yersinia pestis
acaggugcccuguggcggauuu

SEQ ID NO: 2283214 - RNA, 18 nt, Yersinia pestis
acagguggggcaguuaac

SEQ ID NO: 2283215 - RNA, 18 nt, Yersinia pestis
acagguauucuccaguug

SEQ ID NO: 2283216 - RNA, 19 nt, Yersinia pestis
acaggggcguuauugagaa

SEQ ID NO: 2283217 - RNA, 22 nt, Yersinia pestis
acagguaaaaccggagucaauc

SEQ ID NO: 2283218 - RNA, 16 nt, Yersinia pestis
acaggguaaauuauuu

SEQ ID NO: 2283219 - RNA, 15 nt, Yersinia pestis
agacugcugacaacc

SEQ ID NO: 2283220 - RNA, 16 nt, Yersinia pestis
agacuguuuuauuaua

SEQ ID NO: 2283221 - RNA, 20 nt, Yersinia pestis
agacugaaaguagaaauaaa

SEQ ID NO: 2283222 - RNA, 16 nt, Yersinia pestis
agacugaaauaauggu

SEQ ID NO: 2283223 - RNA, 20 nt, Yersinia pestis
agacugacgcagagcuaaau

SEQ ID NO: 2283224 - RNA, 22 nt, Yersinia pestis
agacugacgcagagcuaaaugu

SEQ ID NO: 2283225 - RNA, 13 nt, Yersinia pestis
agacugcugacaa

SEQ ID NO: 2283226 - RNA, 18 nt, Yersinia pestis
agacuacacacagcaaua

SEQ ID NO: 2283227 - RNA, 17 nt, Yersinia pestis
agacggcagcaacgaaa

SEQ ID NO: 2283228 - RNA, 15 nt, Yersinia pestis
agaccguagaaacca

SEQ ID NO: 2283229 - RNA, 21 nt, Yersinia pestis
agaccgguggcuuuuucaccc

SEQ ID NO: 2283230 - RNA, 16 nt, Yersinia pestis
agacccuaauaucaug

SEQ ID NO: 2283231 - RNA, 23 nt, Yersinia pestis
agacccauuucugcuucuacccu

SEQ ID NO: 2283232 - RNA, 13 nt, Yersinia pestis
agaauuucauugu

SEQ ID NO: 2283233 - RNA, 15 nt, Yersinia pestis
aaaacaucacacuug

SEQ ID NO: 2283234 - RNA, 17 nt, Yersinia pestis
agacgaguauuccccac

SEQ ID NO: 2283235 - RNA, 16 nt, Yersinia pestis
agacgagcguaauucc

SEQ ID NO: 2283236 - RNA, 16 nt, Yersinia pestis
agacgacuagccuaac

SEQ ID NO: 2283237 - RNA, 13 nt, Yersinia pestis
agacgaaggcacg

SEQ ID NO: 2283238 - RNA, 20 nt, Yersinia pestis
agacgccguaaauacaucca

SEQ ID NO: 2283239 - RNA, 18 nt, Yersinia pestis
agagaaaacagauauuuu

SEQ ID NO: 2283240 - RNA, 20 nt, Yersinia pestis
agacuuuauucacagcagaa

SEQ ID NO: 2283241 - RNA, 13 nt, Yersinia pestis
agagaaauaaccc

SEQ ID NO: 2283242 - RNA, 20 nt, Yersinia pestis
agagaaaugcucaucaagua

SEQ ID NO: 2283243 - RNA, 12 nt, Yersinia pestis
agagaaaucaaa

SEQ ID NO: 2283244 - RNA, 21 nt, Yersinia pestis
agagaacaggcagcaaauaaa

SEQ ID NO: 2283245 - RNA, 22 nt, Yersinia pestis
agagaacaggcagaucguaaag

SEQ ID NO: 2283246 - RNA, 17 nt, Yersinia pestis
agagaacgggcaaccug

SEQ ID NO: 2283247 - RNA, 18 nt, Yersinia pestis
agagaacgggcaaccugu

SEQ ID NO: 2283248 - RNA, 19 nt, Yersinia pestis
agagacggaaagagccagc

SEQ ID NO: 2283249 - RNA, 12 nt, Yersinia pestis
agagacuuugua

SEQ ID NO: 2283250 - RNA, 12 nt, Yersinia pestis
agagacggaaag

SEQ ID NO: 2283251 - RNA, 13 nt, Yersinia pestis
agagaccacagau

SEQ ID NO: 2283252 - RNA, 16 nt, Yersinia pestis
agagaauccauuuaau

SEQ ID NO: 2283253 - RNA, 18 nt, Yersinia pestis
agagaacuccacauuuug

SEQ ID NO: 2283254 - RNA, 13 nt, Yersinia pestis
agagccaccagaa

SEQ ID NO: 2283255 - RNA, 14 nt, Yersinia pestis
aaaaccaaauuacu

SEQ ID NO: 2283256 - RNA, 12 nt, Yersinia pestis
aaaaccaauuca

SEQ ID NO: 2283257 - RNA, 23 nt, Yersinia pestis
agagcguuucaguauuguauaca

SEQ ID NO: 2283258 - RNA, 17 nt, Yersinia pestis
agagcguccugauuuag

SEQ ID NO: 2283259 - RNA, 17 nt, Yersinia pestis
agagcgguuuauauuuu

SEQ ID NO: 2283260 - RNA, 20 nt, Yersinia pestis
agagcgcggcuucagcaccu

SEQ ID NO: 2283261 - RNA, 18 nt, Yersinia pestis
agagcggucgacaaaaug

SEQ ID NO: 2283262 - RNA, 22 nt, Yersinia pestis
agagcggucgacaaaaugugaa

SEQ ID NO: 2283263 - RNA, 19 nt, Yersinia pestis
agagauaaaucggcggcca

SEQ ID NO: 2283264 - RNA, 19 nt, Yersinia pestis
agagacuuuguaccgguuc

SEQ ID NO: 2283265 - RNA, 14 nt, Yersinia pestis
agagagagugaaga

SEQ ID NO: 2283266 - RNA, 14 nt, Yersinia pestis
agagagacuuugua

SEQ ID NO: 2283267 - RNA, 16 nt, Yersinia pestis
agagcaaaacugggcu

SEQ ID NO: 2283268 - RNA, 20 nt, Yersinia pestis
agagcaaaacugggcuugag

SEQ ID NO: 2283269 - RNA, 14 nt, Yersinia pestis
agagauacuuccuu

SEQ ID NO: 2283270 - RNA, 13 nt, Yersinia pestis
agagauaauaggu

SEQ ID NO: 2283271 - RNA, 14 nt, Yersinia pestis
agagaucagaguac

SEQ ID NO: 2283272 - RNA, 14 nt, Yersinia pestis
agaucuuuuucauu

SEQ ID NO: 2283273 - RNA, 16 nt, Yersinia pestis
agaugaaggucaccau

SEQ ID NO: 2283274 - RNA, 13 nt, Yersinia pestis
agaugauugaggc

SEQ ID NO: 2283275 - RNA, 18 nt, Yersinia pestis
agaugcaaaugucagauc

SEQ ID NO: 2283276 - RNA, 18 nt, Yersinia pestis
agaugcagagaugcagug

SEQ ID NO: 2283277 - RNA, 23 nt, Yersinia pestis
agauggucauaaauaggugcgcc

SEQ ID NO: 2283278 - RNA, 23 nt, Yersinia pestis
agauuaguuuuagacgucagauu

SEQ ID NO: 2283279 - RNA, 23 nt, Yersinia pestis
agaucugcccccccuuucaccaa

SEQ ID NO: 2283280 - RNA, 16 nt, Yersinia pestis
agaucucagaauuuuu

SEQ ID NO: 2283281 - RNA, 15 nt, Yersinia pestis
agaucgcucucaccc

SEQ ID NO: 2283282 - RNA, 13 nt, Yersinia pestis
agaucguaggcuu

SEQ ID NO: 2283283 - RNA, 12 nt, Yersinia pestis
agaucguaaaga

SEQ ID NO: 2283284 - RNA, 18 nt, Yersinia pestis
agaucccaagcaggaaac

SEQ ID NO: 2283285 - RNA, 20 nt, Yersinia pestis
agaucccgugugauuuccau

SEQ ID NO: 2283286 - RNA, 16 nt, Yersinia pestis
agaucccccugcugcc

SEQ ID NO: 2283287 - RNA, 22 nt, Yersinia pestis
agauccguuuuuuuuaucagcc

SEQ ID NO: 2283288 - RNA, 19 nt, Yersinia pestis
agaucgcgaugcgccuguu

SEQ ID NO: 2283289 - RNA, 14 nt, Yersinia pestis
agauaaaaauaauc

SEQ ID NO: 2283290 - RNA, 20 nt, Yersinia pestis
agauaaaaauaaucaaugac

SEQ ID NO: 2283291 - RNA, 20 nt, Yersinia pestis
agauaacuuuuuauuucuuu

SEQ ID NO: 2283292 - RNA, 15 nt, Yersinia pestis
agauaacauacacca

SEQ ID NO: 2283293 - RNA, 21 nt, Yersinia pestis
agauaaccggcuggaaauuca

SEQ ID NO: 2283294 - RNA, 21 nt, Yersinia pestis
agauaacgauaacuccagggu

SEQ ID NO: 2283295 - RNA, 13 nt, Yersinia pestis
agauaacaacaaa

SEQ ID NO: 2283296 - RNA, 13 nt, Yersinia pestis
agagucacagcau

SEQ ID NO: 2283297 - RNA, 16 nt, Yersinia pestis
agagucacagcauuca

SEQ ID NO: 2283298 - RNA, 14 nt, Yersinia pestis
agaguccagcacug

SEQ ID NO: 2283299 - RNA, 18 nt, Yersinia pestis
agagugaccaaagcagua

SEQ ID NO: 2283300 - RNA, 15 nt, Yersinia pestis
aaaaccaccaaaaua

SEQ ID NO: 2283301 - RNA, 13 nt, Yersinia pestis
aaaaccaccaaaa

SEQ ID NO: 2283302 - RNA, 14 nt, Yersinia pestis
aaaaccacugaccu

SEQ ID NO: 2283303 - RNA, 11 nt, Yersinia pestis
aaaaccacuga

SEQ ID NO: 2283304 - RNA, 15 nt, Yersinia pestis
agauaguacuuagca

SEQ ID NO: 2283305 - RNA, 21 nt, Yersinia pestis
agauaggcacuaacugcgccu

SEQ ID NO: 2283306 - RNA, 18 nt, Yersinia pestis
agauaggcgaaauugacu

SEQ ID NO: 2283307 - RNA, 15 nt, Yersinia pestis
agauagucauuuuau

SEQ ID NO: 2283308 - RNA, 13 nt, Yersinia pestis
agauaguuaccca

SEQ ID NO: 2283309 - RNA, 18 nt, Yersinia pestis
agauaguuaucucccauu

SEQ ID NO: 2283310 - RNA, 12 nt, Yersinia pestis
agauauaauggu

SEQ ID NO: 2283311 - RNA, 20 nt, Yersinia pestis
agaucaaaagcagagaauga

SEQ ID NO: 2283312 - RNA, 20 nt, Yersinia pestis
agaucaauguuaucgccaac

SEQ ID NO: 2283313 - RNA, 15 nt, Yersinia pestis
agaucaacauuccau

SEQ ID NO: 2283314 - RNA, 13 nt, Yersinia pestis
agauaccgccaau

SEQ ID NO: 2283315 - RNA, 18 nt, Yersinia pestis
agauacccuucucuuuau

SEQ ID NO: 2283316 - RNA, 17 nt, Yersinia pestis
agauaccgaguucucac

SEQ ID NO: 2283317 - RNA, 19 nt, Yersinia pestis
agauaccgaguucucacca

SEQ ID NO: 2283318 - RNA, 16 nt, Yersinia pestis
agauaccgcaaccauu

SEQ ID NO: 2283319 - RNA, 23 nt, Yersinia pestis
agauaauguucguuuuuuggguu

SEQ ID NO: 2283320 - RNA, 15 nt, Yersinia pestis
agauaauguugaucu

SEQ ID NO: 2283321 - RNA, 19 nt, Yersinia pestis
agauaauuauccauuuucu

SEQ ID NO: 2283322 - RNA, 14 nt, Yersinia pestis
agauaauuauccau

SEQ ID NO: 2283323 - RNA, 22 nt, Yersinia pestis
agauaauuggcaauaaugucac

SEQ ID NO: 2283324 - RNA, 15 nt, Yersinia pestis
agauaauuuagcaaa

SEQ ID NO: 2283325 - RNA, 19 nt, Yersinia pestis
aaaacacucuuuuugguuu

SEQ ID NO: 2283326 - RNA, 14 nt, Yersinia pestis
aaaacacucuuuuu

SEQ ID NO: 2283327 - RNA, 15 nt, Yersinia pestis
aaaacagacuaaaaa

SEQ ID NO: 2283328 - RNA, 20 nt, Yersinia pestis
agaaacuaagaguccuuaaa

SEQ ID NO: 2283329 - RNA, 23 nt, Yersinia pestis
agaaacuaagaguccuuaaaaac

SEQ ID NO: 2283330 - RNA, 14 nt, Yersinia pestis
aaaacacgcaacac

SEQ ID NO: 2283331 - RNA, 16 nt, Yersinia pestis
agaaacgauuacccac

SEQ ID NO: 2283332 - RNA, 18 nt, Yersinia pestis
agaaacgauuacccacca

SEQ ID NO: 2283333 - RNA, 20 nt, Yersinia pestis
agaaacgccccgauaaacca

SEQ ID NO: 2283334 - RNA, 14 nt, Yersinia pestis
agaaauuuuuagaa

SEQ ID NO: 2283335 - RNA, 15 nt, Yersinia pestis
agaaauuuuuagaaa

SEQ ID NO: 2283336 - RNA, 17 nt, Yersinia pestis
agaaauuuaaaaacccu

SEQ ID NO: 2283337 - RNA, 20 nt, Yersinia pestis
agaaaucgcuauaugacaua

SEQ ID NO: 2283338 - RNA, 20 nt, Yersinia pestis
agaagacaauaaaucgccac

SEQ ID NO: 2283339 - RNA, 21 nt, Yersinia pestis
agaagaauccacauaaaaaga

SEQ ID NO: 2283340 - RNA, 18 nt, Yersinia pestis
agaagacauaucuugaac

SEQ ID NO: 2283341 - RNA, 23 nt, Yersinia pestis
agaagacgaauagaaccggcuga

SEQ ID NO: 2283342 - RNA, 19 nt, Yersinia pestis
agaagacgaguaaugaaau

SEQ ID NO: 2283343 - RNA, 17 nt, Yersinia pestis
agaagagcgaacaaaug

SEQ ID NO: 2283344 - RNA, 14 nt, Yersinia pestis
agaagaauaucugc

SEQ ID NO: 2283345 - RNA, 21 nt, Yersinia pestis
agaagaauugcagauaccaca

SEQ ID NO: 2283346 - RNA, 14 nt, Yersinia pestis
agaagaaaaucacu

SEQ ID NO: 2283347 - RNA, 18 nt, Yersinia pestis
agaagaaaucauuuaggc

SEQ ID NO: 2283348 - RNA, 16 nt, Yersinia pestis
agaacgugcugcgcug

SEQ ID NO: 2283349 - RNA, 16 nt, Yersinia pestis
agaacgggcacagcau

SEQ ID NO: 2283350 - RNA, 13 nt, Yersinia pestis
agaacggagagaa

SEQ ID NO: 2283351 - RNA, 23 nt, Yersinia pestis
agaacgaacgaagcgugaaagca

SEQ ID NO: 2283352 - RNA, 17 nt, Yersinia pestis
agaaccuguuacaucag

SEQ ID NO: 2283353 - RNA, 21 nt, Yersinia pestis
agaaccaguucugguagcugc

SEQ ID NO: 2283354 - RNA, 21 nt, Yersinia pestis
agaacauuuccacaaucagcc

SEQ ID NO: 2283355 - RNA, 16 nt, Yersinia pestis
agaauauuuacgguga

SEQ ID NO: 2283356 - RNA, 17 nt, Yersinia pestis
agaaucaccgaaagaag

SEQ ID NO: 2283357 - RNA, 16 nt, Yersinia pestis
agaauaucuucaacug

SEQ ID NO: 2283358 - RNA, 17 nt, Yersinia pestis
agaaucaaccacgguaa

SEQ ID NO: 2283359 - RNA, 23 nt, Yersinia pestis
agaaucucuccagugcaaauuua

SEQ ID NO: 2283360 - RNA, 15 nt, Yersinia pestis
agaaugcgacauguu

SEQ ID NO: 2283361 - RNA, 18 nt, Yersinia pestis
agaagccucaugaaugag

SEQ ID NO: 2283362 - RNA, 19 nt, Yersinia pestis
agaagccucaugaaugagg

SEQ ID NO: 2283363 - RNA, 17 nt, Yersinia pestis
agaagccucaugaauga

SEQ ID NO: 2283364 - RNA, 22 nt, Yersinia pestis
agaagugaacgaacacaucuuu

SEQ ID NO: 2283365 - RNA, 14 nt, Yersinia pestis
agaaguccugauuc

SEQ ID NO: 2283366 - RNA, 17 nt, Yersinia pestis
agaauacuucaggccaa

SEQ ID NO: 2283367 - RNA, 23 nt, Yersinia pestis
agaauacggugcggguuagcggc

SEQ ID NO: 2283368 - RNA, 21 nt, Yersinia pestis
agaauaaauaauaucaaugau

SEQ ID NO: 2283369 - RNA, 23 nt, Yersinia pestis
agaauaaggguagguucaauaau

SEQ ID NO: 2283370 - RNA, 12 nt, Yersinia pestis
agaaacaaaacc

SEQ ID NO: 2283371 - RNA, 18 nt, Yersinia pestis
agaaaauuucucuuuuau

SEQ ID NO: 2283372 - RNA, 14 nt, Yersinia pestis
agaaaaaauaaaua

SEQ ID NO: 2283373 - RNA, 18 nt, Yersinia pestis
agaaaaacacuuuauuga

SEQ ID NO: 2283374 - RNA, 23 nt, Yersinia pestis
acuuuucaucgcauaggccaaua

SEQ ID NO: 2283375 - RNA, 20 nt, Yersinia pestis
acuuuuauaccgcagcauaa

SEQ ID NO: 2283376 - RNA, 12 nt, Yersinia pestis
acuuuuauuaua

SEQ ID NO: 2283377 - RNA, 23 nt, Yersinia pestis
acuuuuauauccgccauccuuca

SEQ ID NO: 2283378 - RNA, 16 nt, Yersinia pestis
acuuuuauuugauucg

SEQ ID NO: 2283379 - RNA, 16 nt, Yersinia pestis
acuuuucaguuuuaau

SEQ ID NO: 2283380 - RNA, 20 nt, Yersinia pestis
acuuuuuauuucuuuuaaau

SEQ ID NO: 2283381 - RNA, 21 nt, Yersinia pestis
acuuucccauagcuggcuuca

SEQ ID NO: 2283382 - RNA, 20 nt, Yersinia pestis
acuuugucacccgucaggau

SEQ ID NO: 2283383 - RNA, 20 nt, Yersinia pestis
acuuuguauuuugcacaaag

SEQ ID NO: 2283384 - RNA, 20 nt, Yersinia pestis
acuuuuacgggccuuuuaau

SEQ ID NO: 2283385 - RNA, 18 nt, Yersinia pestis
acuuugggucugaauacc

SEQ ID NO: 2283386 - RNA, 21 nt, Yersinia pestis
acuuugcuaaccuauagcaau

SEQ ID NO: 2283387 - RNA, 15 nt, Yersinia pestis
acuuuggcaaaguca

SEQ ID NO: 2283388 - RNA, 15 nt, Yersinia pestis
acuuuggguauauga

SEQ ID NO: 2283389 - RNA, 22 nt, Yersinia pestis
acuuucaccaaaccaucagcga

SEQ ID NO: 2283390 - RNA, 14 nt, Yersinia pestis
acuuuaucugccaa

SEQ ID NO: 2283391 - RNA, 18 nt, Yersinia pestis
acuuuauucacagcagaa

SEQ ID NO: 2283392 - RNA, 17 nt, Yersinia pestis
acuuuaaagccaaauug

SEQ ID NO: 2283393 - RNA, 12 nt, Yersinia pestis
acuuuaaauacc

SEQ ID NO: 2283394 - RNA, 15 nt, Yersinia pestis
acuuuaaauccaucg

SEQ ID NO: 2283395 - RNA, 15 nt, Yersinia pestis
acuuuaagcugcaga

SEQ ID NO: 2283396 - RNA, 17 nt, Yersinia pestis
acuuuaagcugcagagg

SEQ ID NO: 2283397 - RNA, 18 nt, Yersinia pestis
acuuuaacugcaccuaac

SEQ ID NO: 2283398 - RNA, 21 nt, Yersinia pestis
acuuuaacugcaccuaacaaa

SEQ ID NO: 2283399 - RNA, 23 nt, Yersinia pestis
acuuuaaaaaaauuaucaucaau

SEQ ID NO: 2283400 - RNA, 12 nt, Yersinia pestis
acuuuaauuaaa

SEQ ID NO: 2283401 - RNA, 16 nt, Yersinia pestis
acuuuaauuaaaaaua

SEQ ID NO: 2283402 - RNA, 14 nt, Yersinia pestis
acuuggacaucugc

SEQ ID NO: 2283403 - RNA, 14 nt, Yersinia pestis
acuugcuggaggcu

SEQ ID NO: 2283404 - RNA, 15 nt, Yersinia pestis
acuugcugaugccca

SEQ ID NO: 2283405 - RNA, 14 nt, Yersinia pestis
acuugccugaaauu

SEQ ID NO: 2283406 - RNA, 15 nt, Yersinia pestis
acuugcccaauggca

SEQ ID NO: 2283407 - RNA, 15 nt, Yersinia pestis
acuugccagagcaau

SEQ ID NO: 2283408 - RNA, 17 nt, Yersinia pestis
acuuauaucuccaccaa

SEQ ID NO: 2283409 - RNA, 13 nt, Yersinia pestis
acuuguggaacaa

SEQ ID NO: 2283410 - RNA, 23 nt, Yersinia pestis
acuuguagguuaaauucacuuuc

SEQ ID NO: 2283411 - RNA, 23 nt, Yersinia pestis
acuuggcuuuuucuuccagcagg

SEQ ID NO: 2283412 - RNA, 20 nt, Yersinia pestis
acuuggcuaauugucacaga

SEQ ID NO: 2283413 - RNA, 16 nt, Yersinia pestis
acuugguuuaaauucu

SEQ ID NO: 2283414 - RNA, 19 nt, Yersinia pestis
agccgcuauaaccuugucg

SEQ ID NO: 2283415 - RNA, 14 nt, Yersinia pestis
agccggagagucgg

SEQ ID NO: 2283416 - RNA, 13 nt, Yersinia pestis
agccgcgcccucc

SEQ ID NO: 2283417 - RNA, 14 nt, Yersinia pestis
agccgcgcccuccc

SEQ ID NO: 2283418 - RNA, 14 nt, Yersinia pestis
agccgccgcccuga

SEQ ID NO: 2283419 - RNA, 17 nt, Yersinia pestis
agccgcgaaaaaccaug

SEQ ID NO: 2283420 - RNA, 14 nt, Yersinia pestis
agcccugaucgcug

SEQ ID NO: 2283421 - RNA, 21 nt, Yersinia pestis
agcccuuugaccauuuguuuu

SEQ ID NO: 2283422 - RNA, 15 nt, Yersinia pestis
agccgaauaucccac

SEQ ID NO: 2283423 - RNA, 22 nt, Yersinia pestis
agccgauuaacggcuacggaag

SEQ ID NO: 2283424 - RNA, 20 nt, Yersinia pestis
agccgaugcuacaccaucca

SEQ ID NO: 2283425 - RNA, 16 nt, Yersinia pestis
agccgauuuagacaag

SEQ ID NO: 2283426 - RNA, 17 nt, Yersinia pestis
agcccuacuggcugaag

SEQ ID NO: 2283427 - RNA, 16 nt, Yersinia pestis
agcccggaaacgucca

SEQ ID NO: 2283428 - RNA, 23 nt, Yersinia pestis
agcccgcuuaaauacgguuaugu

SEQ ID NO: 2283429 - RNA, 22 nt, Yersinia pestis
agccuuauaggcgcauaugaaa

SEQ ID NO: 2283430 - RNA, 17 nt, Yersinia pestis
agccuucaacuaauauu

SEQ ID NO: 2283431 - RNA, 23 nt, Yersinia pestis
agccucuuguguaauuauauuua

SEQ ID NO: 2283432 - RNA, 16 nt, Yersinia pestis
agccucuugcgcucca

SEQ ID NO: 2283433 - RNA, 20 nt, Yersinia pestis
agccucgugagugaaggggu

SEQ ID NO: 2283434 - RNA, 19 nt, Yersinia pestis
agccuauggcgguuccaaa

SEQ ID NO: 2283435 - RNA, 23 nt, Yersinia pestis
agccucauacaagccgugaccaa

SEQ ID NO: 2283436 - RNA, 12 nt, Yersinia pestis
agccuucccugg

SEQ ID NO: 2283437 - RNA, 21 nt, Yersinia pestis
agccuuguugaaucagauacg

SEQ ID NO: 2283438 - RNA, 12 nt, Yersinia pestis
agccuacaugga

SEQ ID NO: 2283439 - RNA, 15 nt, Yersinia pestis
agccuaacaaacuga

SEQ ID NO: 2283440 - RNA, 20 nt, Yersinia pestis
agcgaccaggcauuggcgcu

SEQ ID NO: 2283441 - RNA, 17 nt, Yersinia pestis
agcgacauggcgcaaug

SEQ ID NO: 2283442 - RNA, 18 nt, Yersinia pestis
agcgacauuucggccacc

SEQ ID NO: 2283443 - RNA, 22 nt, Yersinia pestis
agcgaccaaauggacgaacagc

SEQ ID NO: 2283444 - RNA, 21 nt, Yersinia pestis
agcgcagguuaugcagcucaa

SEQ ID NO: 2283445 - RNA, 12 nt, Yersinia pestis
agcgcaggaaag

SEQ ID NO: 2283446 - RNA, 20 nt, Yersinia pestis
agcgccaugauaaccacaac

SEQ ID NO: 2283447 - RNA, 23 nt, Yersinia pestis
agcgccaugauaaccacaacgac

SEQ ID NO: 2283448 - RNA, 17 nt, Yersinia pestis
agcgccaugcgcuuuca

SEQ ID NO: 2283449 - RNA, 20 nt, Yersinia pestis
agcgcccggcugaccuguug

SEQ ID NO: 2283450 - RNA, 14 nt, Yersinia pestis
agcgcgguaacgaa

SEQ ID NO: 2283451 - RNA, 18 nt, Yersinia pestis
agcgcggcuucagcaccu

SEQ ID NO: 2283452 - RNA, 16 nt, Yersinia pestis
agcgcguaaugccugg

SEQ ID NO: 2283453 - RNA, 23 nt, Yersinia pestis
agcgcguaucguccagcagcagg

SEQ ID NO: 2283454 - RNA, 17 nt, Yersinia pestis
agcgcucauagcaaaac

SEQ ID NO: 2283455 - RNA, 14 nt, Yersinia pestis
agcgcgcuccagau

SEQ ID NO: 2283456 - RNA, 22 nt, Yersinia pestis
agcgccgugcauaauggacgaa

SEQ ID NO: 2283457 - RNA, 19 nt, Yersinia pestis
agcgcgacgguacugauca

SEQ ID NO: 2283458 - RNA, 18 nt, Yersinia pestis
agcguagccguuaaauau

SEQ ID NO: 2283459 - RNA, 21 nt, Yersinia pestis
agcguauuuugucaugaaaau

SEQ ID NO: 2283460 - RNA, 18 nt, Yersinia pestis
agcguauugccuucuccu

SEQ ID NO: 2283461 - RNA, 18 nt, Yersinia pestis
agcguauuaaaccagugc

SEQ ID NO: 2283462 - RNA, 14 nt, Yersinia pestis
agcgguggcgggaa

SEQ ID NO: 2283463 - RNA, 16 nt, Yersinia pestis
agcguacaucagggug

SEQ ID NO: 2283464 - RNA, 20 nt, Yersinia pestis
agcggcauccaguaagcugu

SEQ ID NO: 2283465 - RNA, 16 nt, Yersinia pestis
agcggccaacauaauc

SEQ ID NO: 2283466 - RNA, 14 nt, Yersinia pestis
agcggcgauuaucg

SEQ ID NO: 2283467 - RNA, 19 nt, Yersinia pestis
agcgcuuuuucgggaaaaa

SEQ ID NO: 2283468 - RNA, 21 nt, Yersinia pestis
agcgcuuuuucgggaaaaaau

SEQ ID NO: 2283469 - RNA, 19 nt, Yersinia pestis
agcgcuugcugguauucau

SEQ ID NO: 2283470 - RNA, 13 nt, Yersinia pestis
agcggcaauaaca

SEQ ID NO: 2283471 - RNA, 18 nt, Yersinia pestis
agcaguucuggcucugcg

SEQ ID NO: 2283472 - RNA, 20 nt, Yersinia pestis
agcauaacgguuguauacaa

SEQ ID NO: 2283473 - RNA, 14 nt, Yersinia pestis
agcauaaccagugc

SEQ ID NO: 2283474 - RNA, 16 nt, Yersinia pestis
agcaguucacucuguu

SEQ ID NO: 2283475 - RNA, 18 nt, Yersinia pestis
agcauauucaguaacaac

SEQ ID NO: 2283476 - RNA, 13 nt, Yersinia pestis
agcauauuaccca

SEQ ID NO: 2283477 - RNA, 18 nt, Yersinia pestis
agcauaaguaucagcggc

SEQ ID NO: 2283478 - RNA, 22 nt, Yersinia pestis
agcauaucaaugcaacuggcau

SEQ ID NO: 2283479 - RNA, 17 nt, Yersinia pestis
agcauauccaacgcuuu

SEQ ID NO: 2283480 - RNA, 22 nt, Yersinia pestis
agcaucaauaacgguaaggccg

SEQ ID NO: 2283481 - RNA, 17 nt, Yersinia pestis
agcauccaauaccacca

SEQ ID NO: 2283482 - RNA, 15 nt, Yersinia pestis
agcauccagcucaua

SEQ ID NO: 2283483 - RNA, 23 nt, Yersinia pestis
agcauccagcucauauaaucaua

SEQ ID NO: 2283484 - RNA, 19 nt, Yersinia pestis
agcauccaguucauggcca

SEQ ID NO: 2283485 - RNA, 13 nt, Yersinia pestis
agcaucccagcca

SEQ ID NO: 2283486 - RNA, 16 nt, Yersinia pestis
agcaucccagccacca

SEQ ID NO: 2283487 - RNA, 23 nt, Yersinia pestis
agcagagaagugaacgaacacau

SEQ ID NO: 2283488 - RNA, 18 nt, Yersinia pestis
agcagacuuacgcgaugc

SEQ ID NO: 2283489 - RNA, 22 nt, Yersinia pestis
aaaaccuuauuuuugcauauaa

SEQ ID NO: 2283490 - RNA, 15 nt, Yersinia pestis
aaaaccuaacgccaa

SEQ ID NO: 2283491 - RNA, 19 nt, Yersinia pestis
aaaaccgugacuaaaacaa

SEQ ID NO: 2283492 - RNA, 21 nt, Yersinia pestis
aaaaccuccgcgauaccaaua

SEQ ID NO: 2283493 - RNA, 21 nt, Yersinia pestis
agcaggaaacaugcugaagcc

SEQ ID NO: 2283494 - RNA, 13 nt, Yersinia pestis
agcagcgcacugg

SEQ ID NO: 2283495 - RNA, 23 nt, Yersinia pestis
agcaggggguuuucugaauacca

SEQ ID NO: 2283496 - RNA, 22 nt, Yersinia pestis
agcagggccgcccagauaaaga

SEQ ID NO: 2283497 - RNA, 16 nt, Yersinia pestis
agcaggggcaaccucu

SEQ ID NO: 2283498 - RNA, 13 nt, Yersinia pestis
agcauuaaacaga

SEQ ID NO: 2283499 - RNA, 23 nt, Yersinia pestis
agcauguuccuguugcuggccag

SEQ ID NO: 2283500 - RNA, 22 nt, Yersinia pestis
agcauggcuuuaugaccaauag

SEQ ID NO: 2283501 - RNA, 14 nt, Yersinia pestis
agcaugggcuugca

SEQ ID NO: 2283502 - RNA, 15 nt, Yersinia pestis
agcaucuucaaucaa

SEQ ID NO: 2283503 - RNA, 20 nt, Yersinia pestis
agcaucuccgcgaccacaug

SEQ ID NO: 2283504 - RNA, 16 nt, Yersinia pestis
agcaucuagcagugau

SEQ ID NO: 2283505 - RNA, 14 nt, Yersinia pestis
agccaaaacagccu

SEQ ID NO: 2283506 - RNA, 20 nt, Yersinia pestis
agcauuuugcggaucacaua

SEQ ID NO: 2283507 - RNA, 16 nt, Yersinia pestis
agccaaaccccgccuc

SEQ ID NO: 2283508 - RNA, 21 nt, Yersinia pestis
agccaaaccccgccucuucua

SEQ ID NO: 2283509 - RNA, 19 nt, Yersinia pestis
agccaaacaaaugaacccu

SEQ ID NO: 2283510 - RNA, 21 nt, Yersinia pestis
agccaaaauaaucaccagaca

SEQ ID NO: 2283511 - RNA, 14 nt, Yersinia pestis
agccaaaauaauua

SEQ ID NO: 2283512 - RNA, 15 nt, Yersinia pestis
agcauuuaucauauu

SEQ ID NO: 2283513 - RNA, 24 nt, Yersinia pestis
agcauugaguacgcuaagacauua

SEQ ID NO: 2283514 - RNA, 17 nt, Yersinia pestis
agcauugauggccuuga

SEQ ID NO: 2283515 - RNA, 21 nt, Yersinia pestis
agcauucgcgguuacaccaau

SEQ ID NO: 2283516 - RNA, 17 nt, Yersinia pestis
agcauucagcuuucucu

SEQ ID NO: 2283517 - RNA, 21 nt, Yersinia pestis
agcauucaggcuuuuuucuag

SEQ ID NO: 2283518 - RNA, 20 nt, Yersinia pestis
agccaauccagcaaacgcau

SEQ ID NO: 2283519 - RNA, 17 nt, Yersinia pestis
agccaauccccagaagc

SEQ ID NO: 2283520 - RNA, 13 nt, Yersinia pestis
agccaaucucuug

SEQ ID NO: 2283521 - RNA, 11 nt, Yersinia pestis
agccacacacu

SEQ ID NO: 2283522 - RNA, 23 nt, Yersinia pestis
agccacaaaaguucacaugauga

SEQ ID NO: 2283523 - RNA, 14 nt, Yersinia pestis
agccaaaguggcau

SEQ ID NO: 2283524 - RNA, 14 nt, Yersinia pestis
agccaauacacacg

SEQ ID NO: 2283525 - RNA, 21 nt, Yersinia pestis
agccaaauugugaguuaaaaa

SEQ ID NO: 2283526 - RNA, 11 nt, Yersinia pestis
agccaaaugag

SEQ ID NO: 2283527 - RNA, 21 nt, Yersinia pestis
agccaaaucaguaccaccacc

SEQ ID NO: 2283528 - RNA, 22 nt, Yersinia pestis
agccaaaucaguaccaccacca

SEQ ID NO: 2283529 - RNA, 15 nt, Yersinia pestis
agccacugggcuacc

SEQ ID NO: 2283530 - RNA, 16 nt, Yersinia pestis
agccagccaccgcaca

SEQ ID NO: 2283531 - RNA, 20 nt, Yersinia pestis
agccagccaccgcacacuga

SEQ ID NO: 2283532 - RNA, 18 nt, Yersinia pestis
agccacucggguucuaaa

SEQ ID NO: 2283533 - RNA, 15 nt, Yersinia pestis
agccacguaauacca

SEQ ID NO: 2283534 - RNA, 18 nt, Yersinia pestis
agccaccaguuuauuuuc

SEQ ID NO: 2283535 - RNA, 14 nt, Yersinia pestis
agccaccagaauca

SEQ ID NO: 2283536 - RNA, 18 nt, Yersinia pestis
agccaccaccacggccag

SEQ ID NO: 2283537 - RNA, 21 nt, Yersinia pestis
agcacugcuagguuuacuguu

SEQ ID NO: 2283538 - RNA, 21 nt, Yersinia pestis
agcacuguacugggaugaaga

SEQ ID NO: 2283539 - RNA, 12 nt, Yersinia pestis
agcacugccccg

SEQ ID NO: 2283540 - RNA, 21 nt, Yersinia pestis
agcacugccccgaagcucaag

SEQ ID NO: 2283541 - RNA, 11 nt, Yersinia pestis
agcacugcccc

SEQ ID NO: 2283542 - RNA, 16 nt, Yersinia pestis
agcagacaacugacaa

SEQ ID NO: 2283543 - RNA, 21 nt, Yersinia pestis
agcagacaacugacaacauca

SEQ ID NO: 2283544 - RNA, 13 nt, Yersinia pestis
agcagacagcgag

SEQ ID NO: 2283545 - RNA, 15 nt, Yersinia pestis
aaaaccgguuuuggu

SEQ ID NO: 2283546 - RNA, 22 nt, Yersinia pestis
agcacgcuugauggccacacug

SEQ ID NO: 2283547 - RNA, 16 nt, Yersinia pestis
agcacgcuuuccagcu

SEQ ID NO: 2283548 - RNA, 19 nt, Yersinia pestis
agcaccgcccccuccaaua

SEQ ID NO: 2283549 - RNA, 12 nt, Yersinia pestis
agcaccacaaug

SEQ ID NO: 2283550 - RNA, 16 nt, Yersinia pestis
agcaccacaauggcag

SEQ ID NO: 2283551 - RNA, 15 nt, Yersinia pestis
agcaccaauaucaau

SEQ ID NO: 2283552 - RNA, 14 nt, Yersinia pestis
agcaccaauauugc

SEQ ID NO: 2283553 - RNA, 16 nt, Yersinia pestis
agcacagacaaacaac

SEQ ID NO: 2283554 - RNA, 16 nt, Yersinia pestis
agcaccauucaaugua

SEQ ID NO: 2283555 - RNA, 22 nt, Yersinia pestis
agcaccauucaauguaaaacga

SEQ ID NO: 2283556 - RNA, 14 nt, Yersinia pestis
agcaccauuaucuu

SEQ ID NO: 2283557 - RNA, 16 nt, Yersinia pestis
agcaccauuaucuucc

SEQ ID NO: 2283558 - RNA, 16 nt, Yersinia pestis
agcacccacaccgcag

SEQ ID NO: 2283559 - RNA, 18 nt, Yersinia pestis
agcaccagaaaguuguuc

SEQ ID NO: 2283560 - RNA, 15 nt, Yersinia pestis
agcaccagcaccaac

SEQ ID NO: 2283561 - RNA, 14 nt, Yersinia pestis
agcaaggauucccc

SEQ ID NO: 2283562 - RNA, 16 nt, Yersinia pestis
agcaaggcagcaagca

SEQ ID NO: 2283563 - RNA, 21 nt, Yersinia pestis
agcaaguuagcgauaucugcg

SEQ ID NO: 2283564 - RNA, 17 nt, Yersinia pestis
agcaaguuaucaaucag

SEQ ID NO: 2283565 - RNA, 22 nt, Yersinia pestis
agcaacgguaucccggugauca

SEQ ID NO: 2283566 - RNA, 21 nt, Yersinia pestis
agcaacuaucuccggccugcc

SEQ ID NO: 2283567 - RNA, 15 nt, Yersinia pestis
agcaacucacugaau

SEQ ID NO: 2283568 - RNA, 14 nt, Yersinia pestis
agauuauuauuacu

SEQ ID NO: 2283569 - RNA, 13 nt, Yersinia pestis
agauuaucagccc

SEQ ID NO: 2283570 - RNA, 17 nt, Yersinia pestis
agauuaucagcccaucu

SEQ ID NO: 2283571 - RNA, 16 nt, Yersinia pestis
agauuauccagcccua

SEQ ID NO: 2283572 - RNA, 17 nt, Yersinia pestis
agcaauggcgaugagaa

SEQ ID NO: 2283573 - RNA, 15 nt, Yersinia pestis
agcacaauuguuaug

SEQ ID NO: 2283574 - RNA, 22 nt, Yersinia pestis
agcacaaugacuuaacugaaag

SEQ ID NO: 2283575 - RNA, 22 nt, Yersinia pestis
agcacaacgcucuaacgucaga

SEQ ID NO: 2283576 - RNA, 11 nt, Yersinia pestis
agcaaucuggc

SEQ ID NO: 2283577 - RNA, 23 nt, Yersinia pestis
agcaaugaccuuacagugauaau

SEQ ID NO: 2283578 - RNA, 22 nt, Yersinia pestis
agcaaucaaaagggaucaccag

SEQ ID NO: 2283579 - RNA, 14 nt, Yersinia pestis
agcaauauccuuaa

SEQ ID NO: 2283580 - RNA, 13 nt, Yersinia pestis
agcaauacgccag

SEQ ID NO: 2283581 - RNA, 17 nt, Yersinia pestis
acuaugggggauuaucg

SEQ ID NO: 2283582 - RNA, 17 nt, Yersinia pestis
acuaucuuuauugcucc

SEQ ID NO: 2283583 - RNA, 16 nt, Yersinia pestis
acucaaacugauaaag

SEQ ID NO: 2283584 - RNA, 15 nt, Yersinia pestis
acuauuaacucuuuu

SEQ ID NO: 2283585 - RNA, 19 nt, Yersinia pestis
acucaaguaugcaggguua

SEQ ID NO: 2283586 - RNA, 13 nt, Yersinia pestis
acucaagccucua

SEQ ID NO: 2283587 - RNA, 14 nt, Yersinia pestis
acucaaauuauuuu

SEQ ID NO: 2283588 - RNA, 19 nt, Yersinia pestis
acucaaauagauagcaauc

SEQ ID NO: 2283589 - RNA, 18 nt, Yersinia pestis
acucaaauaaaccaauau

SEQ ID NO: 2283590 - RNA, 23 nt, Yersinia pestis
acucaauguaagcaucuuuucau

SEQ ID NO: 2283591 - RNA, 23 nt, Yersinia pestis
acucaaugucaugcaauuacugc

SEQ ID NO: 2283592 - RNA, 18 nt, Yersinia pestis
acucaaugcuuaacagcc

SEQ ID NO: 2283593 - RNA, 18 nt, Yersinia pestis
acucacacagccagccuu

SEQ ID NO: 2283594 - RNA, 12 nt, Yersinia pestis
acucaccccacu

SEQ ID NO: 2283595 - RNA, 15 nt, Yersinia pestis
acucaccuaaaucaa

SEQ ID NO: 2283596 - RNA, 16 nt, Yersinia pestis
acucaccuaaaucaua

SEQ ID NO: 2283597 - RNA, 18 nt, Yersinia pestis
acucaccuucuugguuag

SEQ ID NO: 2283598 - RNA, 16 nt, Yersinia pestis
acucacguauuuucau

SEQ ID NO: 2283599 - RNA, 23 nt, Yersinia pestis
acucacucucaucugaacuauug

SEQ ID NO: 2283600 - RNA, 12 nt, Yersinia pestis
acucacugucgg

SEQ ID NO: 2283601 - RNA, 14 nt, Yersinia pestis
acuacuuauuuccg

SEQ ID NO: 2283602 - RNA, 16 nt, Yersinia pestis
acuaucuauuauuaaa

SEQ ID NO: 2283603 - RNA, 14 nt, Yersinia pestis
acuaucgaaacacc

SEQ ID NO: 2283604 - RNA, 22 nt, Yersinia pestis
acuacguuguuaucaucaccac

SEQ ID NO: 2283605 - RNA, 21 nt, Yersinia pestis
acuacugcaagccguaauuca

SEQ ID NO: 2283606 - RNA, 19 nt, Yersinia pestis
acucauuccgccuguuuuc

SEQ ID NO: 2283607 - RNA, 16 nt, Yersinia pestis
acucaugacaucccag

SEQ ID NO: 2283608 - RNA, 20 nt, Yersinia pestis
acucauccgaaucacaaacu

SEQ ID NO: 2283609 - RNA, 17 nt, Yersinia pestis
acuccacuuccucauuc

SEQ ID NO: 2283610 - RNA, 13 nt, Yersinia pestis
acucauuuuuaag

SEQ ID NO: 2283611 - RNA, 13 nt, Yersinia pestis
acucaucaaaaca

SEQ ID NO: 2283612 - RNA, 14 nt, Yersinia pestis
acucaucaaaacaa

SEQ ID NO: 2283613 - RNA, 15 nt, Yersinia pestis
acucaucaaaacaau

SEQ ID NO: 2283614 - RNA, 14 nt, Yersinia pestis
acucagucaucgcu

SEQ ID NO: 2283615 - RNA, 23 nt, Yersinia pestis
acucauaccgaauaauaaauauc

SEQ ID NO: 2283616 - RNA, 18 nt, Yersinia pestis
acucaggcccugagauuc

SEQ ID NO: 2283617 - RNA, 17 nt, Yersinia pestis
acucaggcgugucauuu

SEQ ID NO: 2283618 - RNA, 23 nt, Yersinia pestis
acucagaaaacagccaccagcca

SEQ ID NO: 2283619 - RNA, 21 nt, Yersinia pestis
acucagacuucuuccaucuua

SEQ ID NO: 2283620 - RNA, 17 nt, Yersinia pestis
acucagcacauuuuuau

SEQ ID NO: 2283621 - RNA, 15 nt, Yersinia pestis
acucagcauccuccu

SEQ ID NO: 2283622 - RNA, 20 nt, Yersinia pestis
acuccuuggaacuuacuccc

SEQ ID NO: 2283623 - RNA, 14 nt, Yersinia pestis
acucgaucuugaac

SEQ ID NO: 2283624 - RNA, 16 nt, Yersinia pestis
acucgaucuugaacgg

SEQ ID NO: 2283625 - RNA, 23 nt, Yersinia pestis
acuccuugaauagccagaagcca

SEQ ID NO: 2283626 - RNA, 21 nt, Yersinia pestis
acuccuuaccacugcucacuu

SEQ ID NO: 2283627 - RNA, 19 nt, Yersinia pestis
acucgggucagugaaaaau

SEQ ID NO: 2283628 - RNA, 20 nt, Yersinia pestis
acucgaugacguaauuuuaa

SEQ ID NO: 2283629 - RNA, 15 nt, Yersinia pestis
acuccauuaauuuau

SEQ ID NO: 2283630 - RNA, 16 nt, Yersinia pestis
acuccauuuuuuugau

SEQ ID NO: 2283631 - RNA, 18 nt, Yersinia pestis
acucccuucaaucaauga

SEQ ID NO: 2283632 - RNA, 18 nt, Yersinia pestis
acucccuuguugccuuuc

SEQ ID NO: 2283633 - RNA, 14 nt, Yersinia pestis
acugccauaaucca

SEQ ID NO: 2283634 - RNA, 13 nt, Yersinia pestis
acugccaucauca

SEQ ID NO: 2283635 - RNA, 15 nt, Yersinia pestis
acugccccgaagcuc

SEQ ID NO: 2283636 - RNA, 18 nt, Yersinia pestis
acugcaguaaaaauauua

SEQ ID NO: 2283637 - RNA, 22 nt, Yersinia pestis
acugcacaauuugguagaacug

SEQ ID NO: 2283638 - RNA, 13 nt, Yersinia pestis
acugauucagaaa

SEQ ID NO: 2283639 - RNA, 20 nt, Yersinia pestis
acugaugcgguagugaugca

SEQ ID NO: 2283640 - RNA, 18 nt, Yersinia pestis
acugccccuucaaagccg

SEQ ID NO: 2283641 - RNA, 19 nt, Yersinia pestis
acugcccagguucaaaaua

SEQ ID NO: 2283642 - RNA, 14 nt, Yersinia pestis
acugcucaacugcu

SEQ ID NO: 2283643 - RNA, 18 nt, Yersinia pestis
acugcuaauaccaccacc

SEQ ID NO: 2283644 - RNA, 12 nt, Yersinia pestis
acugcugugcau

SEQ ID NO: 2283645 - RNA, 20 nt, Yersinia pestis
acugcucaacugcucaacug

SEQ ID NO: 2283646 - RNA, 15 nt, Yersinia pestis
acugcucauaaagca

SEQ ID NO: 2283647 - RNA, 12 nt, Yersinia pestis
acugcucacugg

SEQ ID NO: 2283648 - RNA, 20 nt, Yersinia pestis
acugcucacuuuuauccagc

SEQ ID NO: 2283649 - RNA, 19 nt, Yersinia pestis
acucgucauucaccaccac

SEQ ID NO: 2283650 - RNA, 13 nt, Yersinia pestis
acucuaucagcgc

SEQ ID NO: 2283651 - RNA, 20 nt, Yersinia pestis
acucuaucagcgcccuacug

SEQ ID NO: 2283652 - RNA, 21 nt, Yersinia pestis
acucuaucagcgcccuacugc

SEQ ID NO: 2283653 - RNA, 18 nt, Yersinia pestis
acucuagcgccagcaauu

SEQ ID NO: 2283654 - RNA, 11 nt, Yersinia pestis
acugaauaucc

SEQ ID NO: 2283655 - RNA, 17 nt, Yersinia pestis
acugaacgccgaccuga

SEQ ID NO: 2283656 - RNA, 17 nt, Yersinia pestis
acugaaccgccauugca

SEQ ID NO: 2283657 - RNA, 16 nt, Yersinia pestis
acugacucacgucagu

SEQ ID NO: 2283658 - RNA, 13 nt, Yersinia pestis
acugacugaaguu

SEQ ID NO: 2283659 - RNA, 14 nt, Yersinia pestis
acugacugauguaa

SEQ ID NO: 2283660 - RNA, 18 nt, Yersinia pestis
acugacggcagacaacca

SEQ ID NO: 2283661 - RNA, 18 nt, Yersinia pestis
acugacguaguguauuca

SEQ ID NO: 2283662 - RNA, 21 nt, Yersinia pestis
acugacuuggggcaacucccc

SEQ ID NO: 2283663 - RNA, 22 nt, Yersinia pestis
acugacuuggggcaacucccca

SEQ ID NO: 2283664 - RNA, 20 nt, Yersinia pestis
acugagaccuuccauaacuc

SEQ ID NO: 2283665 - RNA, 16 nt, Yersinia pestis
acugaugagcuggcaa

SEQ ID NO: 2283666 - RNA, 21 nt, Yersinia pestis
acugaugacgcgccauacugc

SEQ ID NO: 2283667 - RNA, 22 nt, Yersinia pestis
acugaugacgccguacaaauau

SEQ ID NO: 2283668 - RNA, 19 nt, Yersinia pestis
acugacgauuguccaggcu

SEQ ID NO: 2283669 - RNA, 20 nt, Yersinia pestis
acugaccgggaacaacgaaa

SEQ ID NO: 2283670 - RNA, 12 nt, Yersinia pestis
acugaccuauug

SEQ ID NO: 2283671 - RNA, 12 nt, Yersinia pestis
acugaaugugaa

SEQ ID NO: 2283672 - RNA, 17 nt, Yersinia pestis
acugacaaguuuuuaag

SEQ ID NO: 2283673 - RNA, 18 nt, Yersinia pestis
acuggguggccaguaacg

SEQ ID NO: 2283674 - RNA, 18 nt, Yersinia pestis
acuggguuacauccugaa

SEQ ID NO: 2283675 - RNA, 17 nt, Yersinia pestis
acuggguuuaaaggugg

SEQ ID NO: 2283676 - RNA, 16 nt, Yersinia pestis
acuggguaaggcaaac

SEQ ID NO: 2283677 - RNA, 14 nt, Yersinia pestis
acuggggugaauca

SEQ ID NO: 2283678 - RNA, 23 nt, Yersinia pestis
acugguagcagccacaugguuuc

SEQ ID NO: 2283679 - RNA, 22 nt, Yersinia pestis
acuggugcugcccaaaaucaaa

SEQ ID NO: 2283680 - RNA, 20 nt, Yersinia pestis
acuggugugugucaguucau

SEQ ID NO: 2283681 - RNA, 13 nt, Yersinia pestis
acugguugaaacc

SEQ ID NO: 2283682 - RNA, 14 nt, Yersinia pestis
acugguugaaaccu

SEQ ID NO: 2283683 - RNA, 21 nt, Yersinia pestis
acuguaaacuuguuuauauua

SEQ ID NO: 2283684 - RNA, 21 nt, Yersinia pestis
acugcuugccaaauauagcau

SEQ ID NO: 2283685 - RNA, 21 nt, Yersinia pestis
acuggcgaccaguguuuguag

SEQ ID NO: 2283686 - RNA, 11 nt, Yersinia pestis
acuggccguuu

SEQ ID NO: 2283687 - RNA, 21 nt, Yersinia pestis
acuggcggggcaaauaggccg

SEQ ID NO: 2283688 - RNA, 13 nt, Yersinia pestis
acuggcugaaguu

SEQ ID NO: 2283689 - RNA, 14 nt, Yersinia pestis
acuggcugaaguua

SEQ ID NO: 2283690 - RNA, 17 nt, Yersinia pestis
acuuaacuacugcaagc

SEQ ID NO: 2283691 - RNA, 17 nt, Yersinia pestis
acuuaacugaaagccaa

SEQ ID NO: 2283692 - RNA, 23 nt, Yersinia pestis
acuguuuugguuuccgcugacau

SEQ ID NO: 2283693 - RNA, 17 nt, Yersinia pestis
acuguuuuauuauauau

SEQ ID NO: 2283694 - RNA, 14 nt, Yersinia pestis
acuguuuuauuaua

SEQ ID NO: 2283695 - RNA, 21 nt, Yersinia pestis
acuuaaucgccagugaguccu

SEQ ID NO: 2283696 - RNA, 20 nt, Yersinia pestis
acuuaaucuuauuuguaaau

SEQ ID NO: 2283697 - RNA, 18 nt, Yersinia pestis
acuuaaucgauagugcuu

SEQ ID NO: 2283698 - RNA, 14 nt, Yersinia pestis
acuuaaggcuagcc

SEQ ID NO: 2283699 - RNA, 20 nt, Yersinia pestis
acuguacugggaugaagaaa

SEQ ID NO: 2283700 - RNA, 17 nt, Yersinia pestis
acugucaaaaccaauag

SEQ ID NO: 2283701 - RNA, 14 nt, Yersinia pestis
acuguaucaauacc

SEQ ID NO: 2283702 - RNA, 17 nt, Yersinia pestis
acuguaucaauaccuua

SEQ ID NO: 2283703 - RNA, 21 nt, Yersinia pestis
acuguaucaauaccuuacugc

SEQ ID NO: 2283704 - RNA, 13 nt, Yersinia pestis
acugucgacugcu

SEQ ID NO: 2283705 - RNA, 14 nt, Yersinia pestis
acuguccuuuaacu

SEQ ID NO: 2283706 - RNA, 14 nt, Yersinia pestis
acuguccaagaagc

SEQ ID NO: 2283707 - RNA, 19 nt, Yersinia pestis
acuguggcugcucugcucc

SEQ ID NO: 2283708 - RNA, 22 nt, Yersinia pestis
acuguuaacucgccaacagagu

SEQ ID NO: 2283709 - RNA, 17 nt, Yersinia pestis
acgucuaauugcugccc

SEQ ID NO: 2283710 - RNA, 21 nt, Yersinia pestis
acgugagcguucaaaaucaaa

SEQ ID NO: 2283711 - RNA, 16 nt, Yersinia pestis
acgucuccauuucaac

SEQ ID NO: 2283712 - RNA, 22 nt, Yersinia pestis
acguguacucauauuguccaaa

SEQ ID NO: 2283713 - RNA, 13 nt, Yersinia pestis
acguguagccaaa

SEQ ID NO: 2283714 - RNA, 20 nt, Yersinia pestis
acgugucagacugcugacaa

SEQ ID NO: 2283715 - RNA, 13 nt, Yersinia pestis
acguguccuuuuu

SEQ ID NO: 2283716 - RNA, 14 nt, Yersinia pestis
acguguaaaaccuu

SEQ ID NO: 2283717 - RNA, 18 nt, Yersinia pestis
acguguuguuuucaugau

SEQ ID NO: 2283718 - RNA, 16 nt, Yersinia pestis
acguuaaguucaagaa

SEQ ID NO: 2283719 - RNA, 20 nt, Yersinia pestis
acguuacaacgagggcucaa

SEQ ID NO: 2283720 - RNA, 14 nt, Yersinia pestis
acguggucaagaau

SEQ ID NO: 2283721 - RNA, 20 nt, Yersinia pestis
acguggucaagaauauaaua

SEQ ID NO: 2283722 - RNA, 20 nt, Yersinia pestis
acgugcagcgcgcagccaac

SEQ ID NO: 2283723 - RNA, 15 nt, Yersinia pestis
acgucaccacgcagu

SEQ ID NO: 2283724 - RNA, 13 nt, Yersinia pestis
acguaucaucagu

SEQ ID NO: 2283725 - RNA, 16 nt, Yersinia pestis
acguaucgcaguuaaa

SEQ ID NO: 2283726 - RNA, 19 nt, Yersinia pestis
acguauuuucauuuuaaca

SEQ ID NO: 2283727 - RNA, 18 nt, Yersinia pestis
acguauucgucaccauca

SEQ ID NO: 2283728 - RNA, 21 nt, Yersinia pestis
acguauucgucaccaucaaua

SEQ ID NO: 2283729 - RNA, 19 nt, Yersinia pestis
acguauugccucggcaagu

SEQ ID NO: 2283730 - RNA, 17 nt, Yersinia pestis
acgguucccaugacgau

SEQ ID NO: 2283731 - RNA, 13 nt, Yersinia pestis
acggugaggauag

SEQ ID NO: 2283732 - RNA, 17 nt, Yersinia pestis
acggugguaaucguccc

SEQ ID NO: 2283733 - RNA, 11 nt, Yersinia pestis
acggugagaau

SEQ ID NO: 2283734 - RNA, 15 nt, Yersinia pestis
acggugugcaaugca

SEQ ID NO: 2283735 - RNA, 21 nt, Yersinia pestis
acgguguggcaccaugcugcu

SEQ ID NO: 2283736 - RNA, 14 nt, Yersinia pestis
acguccccugagcg

SEQ ID NO: 2283737 - RNA, 17 nt, Yersinia pestis
acguccauaaucuggaa

SEQ ID NO: 2283738 - RNA, 17 nt, Yersinia pestis
acgucaguaaugagggu

SEQ ID NO: 2283739 - RNA, 18 nt, Yersinia pestis
acgucagauaaacaaaca

SEQ ID NO: 2283740 - RNA, 19 nt, Yersinia pestis
acgggcuuccaucaggaag

SEQ ID NO: 2283741 - RNA, 21 nt, Yersinia pestis
acgggcuuccaucaggaaguc

SEQ ID NO: 2283742 - RNA, 13 nt, Yersinia pestis
acgggcuugcugc

SEQ ID NO: 2283743 - RNA, 21 nt, Yersinia pestis
acgggcuugcugcaaccacuu

SEQ ID NO: 2283744 - RNA, 19 nt, Yersinia pestis
acgggcuuuaaugaguaaa

SEQ ID NO: 2283745 - RNA, 22 nt, Yersinia pestis
acggcgguuaaucggaugguca

SEQ ID NO: 2283746 - RNA, 22 nt, Yersinia pestis
acggcggcuacugguagcagcc

SEQ ID NO: 2283747 - RNA, 19 nt, Yersinia pestis
acggcggcgagcacugccc

SEQ ID NO: 2283748 - RNA, 15 nt, Yersinia pestis
acggugaauaaaccc

SEQ ID NO: 2283749 - RNA, 13 nt, Yersinia pestis
acggugaacagau

SEQ ID NO: 2283750 - RNA, 17 nt, Yersinia pestis
acggucagagauauaaa

SEQ ID NO: 2283751 - RNA, 19 nt, Yersinia pestis
acggguauauugcccggua

SEQ ID NO: 2283752 - RNA, 18 nt, Yersinia pestis
acgguauuugaacuucaa

SEQ ID NO: 2283753 - RNA, 22 nt, Yersinia pestis
acgguauuggagcugaaaauag

SEQ ID NO: 2283754 - RNA, 20 nt, Yersinia pestis
acgguaggcgguuuggcuug

SEQ ID NO: 2283755 - RNA, 18 nt, Yersinia pestis
acggccaacugcuggcca

SEQ ID NO: 2283756 - RNA, 22 nt, Yersinia pestis
acggcaucgaguccguuaaaaa

SEQ ID NO: 2283757 - RNA, 17 nt, Yersinia pestis
acggcaucgcugcaaua

SEQ ID NO: 2283758 - RNA, 15 nt, Yersinia pestis
acggcauuagugaau

SEQ ID NO: 2283759 - RNA, 23 nt, Yersinia pestis
acggcagugaucgcacuucaacc

SEQ ID NO: 2283760 - RNA, 15 nt, Yersinia pestis
acggcagcaacgaaa

SEQ ID NO: 2283761 - RNA, 22 nt, Yersinia pestis
acggcaccggguauugaccacu

SEQ ID NO: 2283762 - RNA, 14 nt, Yersinia pestis
acggccagcaaccu

SEQ ID NO: 2283763 - RNA, 14 nt, Yersinia pestis
acggccaauuucag

SEQ ID NO: 2283764 - RNA, 12 nt, Yersinia pestis
acggccuucuuu

SEQ ID NO: 2283765 - RNA, 14 nt, Yersinia pestis
acggcgaacuucgc

SEQ ID NO: 2283766 - RNA, 17 nt, Yersinia pestis
acggccuguaccaccac

SEQ ID NO: 2283767 - RNA, 17 nt, Yersinia pestis
acgccuauccucaugau

SEQ ID NO: 2283768 - RNA, 19 nt, Yersinia pestis
acgccuucauguugcaaca

SEQ ID NO: 2283769 - RNA, 22 nt, Yersinia pestis
acgccuuggcguuucugaagau

SEQ ID NO: 2283770 - RNA, 15 nt, Yersinia pestis
acgccgcucaauuaa

SEQ ID NO: 2283771 - RNA, 20 nt, Yersinia pestis
acgccguaaauacauccaug

SEQ ID NO: 2283772 - RNA, 19 nt, Yersinia pestis
acgccguaaauacauccau

SEQ ID NO: 2283773 - RNA, 17 nt, Yersinia pestis
acgccggcgccauugcg

SEQ ID NO: 2283774 - RNA, 22 nt, Yersinia pestis
acgccgggguggauuaccggcg

SEQ ID NO: 2283775 - RNA, 14 nt, Yersinia pestis
acgauauuaccgag

SEQ ID NO: 2283776 - RNA, 15 nt, Yersinia pestis
acgaucaaccauggc

SEQ ID NO: 2283777 - RNA, 19 nt, Yersinia pestis
acgaucaacccccugugga

SEQ ID NO: 2283778 - RNA, 19 nt, Yersinia pestis
acgccauuguugaauacca

SEQ ID NO: 2283779 - RNA, 22 nt, Yersinia pestis
acgccaugcagcuaaaagaugc

SEQ ID NO: 2283780 - RNA, 14 nt, Yersinia pestis
acgccgaugaaggu

SEQ ID NO: 2283781 - RNA, 17 nt, Yersinia pestis
acgcccaggccauagca

SEQ ID NO: 2283782 - RNA, 17 nt, Yersinia pestis
acgcgccgcagcagugc

SEQ ID NO: 2283783 - RNA, 19 nt, Yersinia pestis
acgcggcguuccucuugag

SEQ ID NO: 2283784 - RNA, 17 nt, Yersinia pestis
acgcuggcacugccauc

SEQ ID NO: 2283785 - RNA, 23 nt, Yersinia pestis
acgcugggcgcuuacaugaugaa

SEQ ID NO: 2283786 - RNA, 13 nt, Yersinia pestis
acgcugggcgaua

SEQ ID NO: 2283787 - RNA, 15 nt, Yersinia pestis
acgcugggcgaucau

SEQ ID NO: 2283788 - RNA, 20 nt, Yersinia pestis
acgcugguuaucacagcaaa

SEQ ID NO: 2283789 - RNA, 20 nt, Yersinia pestis
acgcugcccgucaauaucau

SEQ ID NO: 2283790 - RNA, 11 nt, Yersinia pestis
acgcucccucc

SEQ ID NO: 2283791 - RNA, 13 nt, Yersinia pestis
acgcuccuggcga

SEQ ID NO: 2283792 - RNA, 22 nt, Yersinia pestis
acgcuccgguuuucacccccac

SEQ ID NO: 2283793 - RNA, 13 nt, Yersinia pestis
acgcuccacaccc

SEQ ID NO: 2283794 - RNA, 15 nt, Yersinia pestis
acgcuaaccaccguc

SEQ ID NO: 2283795 - RNA, 19 nt, Yersinia pestis
acgcgguugggcuucgguc

SEQ ID NO: 2283796 - RNA, 22 nt, Yersinia pestis
acgcgguuaacgacgcauuaau

SEQ ID NO: 2283797 - RNA, 14 nt, Yersinia pestis
acgcguaugcuggu

SEQ ID NO: 2283798 - RNA, 22 nt, Yersinia pestis
acccauuauauagauuuauuca

SEQ ID NO: 2283799 - RNA, 20 nt, Yersinia pestis
acccauuugcacagcauuua

SEQ ID NO: 2283800 - RNA, 16 nt, Yersinia pestis
acccauuaaaaacaaa

SEQ ID NO: 2283801 - RNA, 20 nt, Yersinia pestis
acccauuuuauccucuucca

SEQ ID NO: 2283802 - RNA, 18 nt, Yersinia pestis
accccguagcacacacag

SEQ ID NO: 2283803 - RNA, 13 nt, Yersinia pestis
acccgaaagccau

SEQ ID NO: 2283804 - RNA, 14 nt, Yersinia pestis
acccgacaucaaga

SEQ ID NO: 2283805 - RNA, 19 nt, Yersinia pestis
acccgaauuaauaaaaccu

SEQ ID NO: 2283806 - RNA, 14 nt, Yersinia pestis
acccgcaaccgggu

SEQ ID NO: 2283807 - RNA, 15 nt, Yersinia pestis
acccgauuuccacga

SEQ ID NO: 2283808 - RNA, 19 nt, Yersinia pestis
acccauaacuugagcacau

SEQ ID NO: 2283809 - RNA, 20 nt, Yersinia pestis
acccauacgaucagcaagau

SEQ ID NO: 2283810 - RNA, 17 nt, Yersinia pestis
acccauacaaauaguaa

SEQ ID NO: 2283811 - RNA, 23 nt, Yersinia pestis
acccauacaaauaguaauaauua

SEQ ID NO: 2283812 - RNA, 15 nt, Yersinia pestis
acccaguaacugagc

SEQ ID NO: 2283813 - RNA, 21 nt, Yersinia pestis
acccagcuucuuuuaaagaag

SEQ ID NO: 2283814 - RNA, 17 nt, Yersinia pestis
acccacgccgaaaacaa

SEQ ID NO: 2283815 - RNA, 18 nt, Yersinia pestis
acccacucggccaaacaa

SEQ ID NO: 2283816 - RNA, 22 nt, Yersinia pestis
acccagacaagaaugccugccg

SEQ ID NO: 2283817 - RNA, 14 nt, Yersinia pestis
accaucuuccagca

SEQ ID NO: 2283818 - RNA, 19 nt, Yersinia pestis
accaucuugucauuaccaa

SEQ ID NO: 2283819 - RNA, 22 nt, Yersinia pestis
accaucuugucauuaccaaugg

SEQ ID NO: 2283820 - RNA, 14 nt, Yersinia pestis
accgaauaaaaccu

SEQ ID NO: 2283821 - RNA, 16 nt, Yersinia pestis
accgacaccaaccggu

SEQ ID NO: 2283822 - RNA, 16 nt, Yersinia pestis
accgaaagaagacaua

SEQ ID NO: 2283823 - RNA, 24 nt, Yersinia pestis
acccuuugagaaaggauuugaaga

SEQ ID NO: 2283824 - RNA, 18 nt, Yersinia pestis
accgaggaugacgacaaa

SEQ ID NO: 2283825 - RNA, 17 nt, Yersinia pestis
accgagguuaucagccu

SEQ ID NO: 2283826 - RNA, 20 nt, Yersinia pestis
accgaggcgggucagaaaca

SEQ ID NO: 2283827 - RNA, 21 nt, Yersinia pestis
accgaggcucgacgggaacga

SEQ ID NO: 2283828 - RNA, 19 nt, Yersinia pestis
accgauaauaaauauccuc

SEQ ID NO: 2283829 - RNA, 17 nt, Yersinia pestis
accgaguguaaaaagca

SEQ ID NO: 2283830 - RNA, 20 nt, Yersinia pestis
accgauaagaaaucaucagc

SEQ ID NO: 2283831 - RNA, 16 nt, Yersinia pestis
accgaguguaaaaagc

SEQ ID NO: 2283832 - RNA, 17 nt, Yersinia pestis
accgacgagggcuucug

SEQ ID NO: 2283833 - RNA, 14 nt, Yersinia pestis
accgacgauaauca

SEQ ID NO: 2283834 - RNA, 22 nt, Yersinia pestis
acccuggucguuacguacuucu

SEQ ID NO: 2283835 - RNA, 16 nt, Yersinia pestis
acccuucucuuuauca

SEQ ID NO: 2283836 - RNA, 18 nt, Yersinia pestis
acccuugauuuuaccaac

SEQ ID NO: 2283837 - RNA, 19 nt, Yersinia pestis
acccugacgaaauuuaaga

SEQ ID NO: 2283838 - RNA, 22 nt, Yersinia pestis
acccucaggcucuggugucucu

SEQ ID NO: 2283839 - RNA, 18 nt, Yersinia pestis
acccucaacucaaaacaa

SEQ ID NO: 2283840 - RNA, 17 nt, Yersinia pestis
acccucaacucaaaaca

SEQ ID NO: 2283841 - RNA, 16 nt, Yersinia pestis
acccuaucgucacagc

SEQ ID NO: 2283842 - RNA, 18 nt, Yersinia pestis
acccuaucgucacagcaa

SEQ ID NO: 2283843 - RNA, 20 nt, Yersinia pestis
acccuaucgucacagcaauu

SEQ ID NO: 2283844 - RNA, 15 nt, Yersinia pestis
acccuaucugcucuu

SEQ ID NO: 2283845 - RNA, 20 nt, Yersinia pestis
acccguaggcccacaaucaa

SEQ ID NO: 2283846 - RNA, 18 nt, Yersinia pestis
acccgccaucaggcaaaa

SEQ ID NO: 2283847 - RNA, 14 nt, Yersinia pestis
accagagauuguuu

SEQ ID NO: 2283848 - RNA, 22 nt, Yersinia pestis
accagacucugcuaccaggaag

SEQ ID NO: 2283849 - RNA, 17 nt, Yersinia pestis
accagagacagcaacaa

SEQ ID NO: 2283850 - RNA, 21 nt, Yersinia pestis
accagauagcuguuagccaga

SEQ ID NO: 2283851 - RNA, 13 nt, Yersinia pestis
accagaucauuuu

SEQ ID NO: 2283852 - RNA, 17 nt, Yersinia pestis
accagcaaaggccacca

SEQ ID NO: 2283853 - RNA, 16 nt, Yersinia pestis
accagcaaaggccacc

SEQ ID NO: 2283854 - RNA, 21 nt, Yersinia pestis
accaacugauuuuuauggcag

SEQ ID NO: 2283855 - RNA, 22 nt, Yersinia pestis
accaacccgccccccaucaacg

SEQ ID NO: 2283856 - RNA, 11 nt, Yersinia pestis
accaaccccac

SEQ ID NO: 2283857 - RNA, 12 nt, Yersinia pestis
accaagaacgcc

SEQ ID NO: 2283858 - RNA, 13 nt, Yersinia pestis
accaagaaaaccc

SEQ ID NO: 2283859 - RNA, 21 nt, Yersinia pestis
accaagagcugcuaaucccuu

SEQ ID NO: 2283860 - RNA, 17 nt, Yersinia pestis
accaagaggaaaugccg

SEQ ID NO: 2283861 - RNA, 12 nt, Yersinia pestis
accaagaggcug

SEQ ID NO: 2283862 - RNA, 14 nt, Yersinia pestis
accaagccaaauua

SEQ ID NO: 2283863 - RNA, 12 nt, Yersinia pestis
accagacaacag

SEQ ID NO: 2283864 - RNA, 21 nt, Yersinia pestis
accaagcccaguaaagcaaau

SEQ ID NO: 2283865 - RNA, 16 nt, Yersinia pestis
accagcauacgugcca

SEQ ID NO: 2283866 - RNA, 21 nt, Yersinia pestis
accagcaguugcugcucuguc

SEQ ID NO: 2283867 - RNA, 17 nt, Yersinia pestis
accagcauccugcaaau

SEQ ID NO: 2283868 - RNA, 15 nt, Yersinia pestis
accagccaaccauca

SEQ ID NO: 2283869 - RNA, 16 nt, Yersinia pestis
accagcgcacugaaua

SEQ ID NO: 2283870 - RNA, 15 nt, Yersinia pestis
accaggugcagauaa

SEQ ID NO: 2283871 - RNA, 15 nt, Yersinia pestis
accaguaacugauca

SEQ ID NO: 2283872 - RNA, 12 nt, Yersinia pestis
accaggccgcca

SEQ ID NO: 2283873 - RNA, 15 nt, Yersinia pestis
accaggaagcggcca

SEQ ID NO: 2283874 - RNA, 17 nt, Yersinia pestis
accaggaagcggccagg

SEQ ID NO: 2283875 - RNA, 20 nt, Yersinia pestis
accagcucaauacgguaauc

SEQ ID NO: 2283876 - RNA, 21 nt, Yersinia pestis
accaguucugguagcugcuca

SEQ ID NO: 2283877 - RNA, 22 nt, Yersinia pestis
accaguugaugaaucaaugaaa

SEQ ID NO: 2283878 - RNA, 18 nt, Yersinia pestis
accaguuuauuuucccuu

SEQ ID NO: 2283879 - RNA, 19 nt, Yersinia pestis
accagugccaauccccacc

SEQ ID NO: 2283880 - RNA, 12 nt, Yersinia pestis
accagugccaug

SEQ ID NO: 2283881 - RNA, 23 nt, Yersinia pestis
accagugucuggcaauccagcgc

SEQ ID NO: 2283882 - RNA, 14 nt, Yersinia pestis
accaguguugggcu

SEQ ID NO: 2283883 - RNA, 14 nt, Yersinia pestis
accaguagcccagc

SEQ ID NO: 2283884 - RNA, 15 nt, Yersinia pestis
accagucagccuuaa

SEQ ID NO: 2283885 - RNA, 17 nt, Yersinia pestis
accagucauuuuauuag

SEQ ID NO: 2283886 - RNA, 19 nt, Yersinia pestis
accagugaauaaguucugc

SEQ ID NO: 2283887 - RNA, 21 nt, Yersinia pestis
accagugauucgggcaaaugg

SEQ ID NO: 2283888 - RNA, 17 nt, Yersinia pestis
accagugccaaucccca

SEQ ID NO: 2283889 - RNA, 17 nt, Yersinia pestis
accagugccgcccagcg

SEQ ID NO: 2283890 - RNA, 17 nt, Yersinia pestis
accauaaauucacagcg

SEQ ID NO: 2283891 - RNA, 18 nt, Yersinia pestis
accauaaacaaguugaac

SEQ ID NO: 2283892 - RNA, 20 nt, Yersinia pestis
accauaaaguuacugcgcuc

SEQ ID NO: 2283893 - RNA, 15 nt, Yersinia pestis
accauaguugaacuc

SEQ ID NO: 2283894 - RNA, 17 nt, Yersinia pestis
accaucgcucuccugcc

SEQ ID NO: 2283895 - RNA, 23 nt, Yersinia pestis
accaucgcgccuaccugccugcu

SEQ ID NO: 2283896 - RNA, 15 nt, Yersinia pestis
accuacugacauuuc

SEQ ID NO: 2283897 - RNA, 13 nt, Yersinia pestis
accuauugauaaa

SEQ ID NO: 2283898 - RNA, 15 nt, Yersinia pestis
accuauugauaaaac

SEQ ID NO: 2283899 - RNA, 17 nt, Yersinia pestis
accuauuaucccaguuu

SEQ ID NO: 2283900 - RNA, 14 nt, Yersinia pestis
accuacccuuuaga

SEQ ID NO: 2283901 - RNA, 14 nt, Yersinia pestis
accuaccaccuacc

SEQ ID NO: 2283902 - RNA, 19 nt, Yersinia pestis
accucaaaaggauggccca

SEQ ID NO: 2283903 - RNA, 14 nt, Yersinia pestis
accucaaaauacau

SEQ ID NO: 2283904 - RNA, 23 nt, Yersinia pestis
accucaaaauacauaagcuccug

SEQ ID NO: 2283905 - RNA, 17 nt, Yersinia pestis
accuauugauaaaacca

SEQ ID NO: 2283906 - RNA, 23 nt, Yersinia pestis
accucaucccaaaauagccagcc

SEQ ID NO: 2283907 - RNA, 19 nt, Yersinia pestis
accuacaaccuaccaccua

SEQ ID NO: 2283908 - RNA, 20 nt, Yersinia pestis
accuaauaacgcucaucacg

SEQ ID NO: 2283909 - RNA, 20 nt, Yersinia pestis
accuaacuuccuaacaauau

SEQ ID NO: 2283910 - RNA, 17 nt, Yersinia pestis
accuaauacagcaccac

SEQ ID NO: 2283911 - RNA, 18 nt, Yersinia pestis
accuaaugcaauggcucc

SEQ ID NO: 2283912 - RNA, 21 nt, Yersinia pestis
accuaaaaugacgaucacugc

SEQ ID NO: 2283913 - RNA, 16 nt, Yersinia pestis
accuaaaccuucacuu

SEQ ID NO: 2283914 - RNA, 21 nt, Yersinia pestis
accuaacacuuuaucgaccac

SEQ ID NO: 2283915 - RNA, 16 nt, Yersinia pestis
accuaaaaaaaacaac

SEQ ID NO: 2283916 - RNA, 18 nt, Yersinia pestis
accguuuuuacaauucgg

SEQ ID NO: 2283917 - RNA, 13 nt, Yersinia pestis
accgugugcuucc

SEQ ID NO: 2283918 - RNA, 14 nt, Yersinia pestis
accguggauaaaca

SEQ ID NO: 2283919 - RNA, 20 nt, Yersinia pestis
accguucaagaucgcgucau

SEQ ID NO: 2283920 - RNA, 18 nt, Yersinia pestis
accguuguauguggcugu

SEQ ID NO: 2283921 - RNA, 21 nt, Yersinia pestis
accgucaggggguucacgccu

SEQ ID NO: 2283922 - RNA, 16 nt, Yersinia pestis
accgucauccagcacu

SEQ ID NO: 2283923 - RNA, 16 nt, Yersinia pestis
accgucuuugaccgaa

SEQ ID NO: 2283924 - RNA, 16 nt, Yersinia pestis
accgugacauuuucac

SEQ ID NO: 2283925 - RNA, 15 nt, Yersinia pestis
accgcuauaucauca

SEQ ID NO: 2283926 - RNA, 22 nt, Yersinia pestis
accgcuagauucggugacuaaa

SEQ ID NO: 2283927 - RNA, 23 nt, Yersinia pestis
accgcuaugcuaaaaaacagccu

SEQ ID NO: 2283928 - RNA, 22 nt, Yersinia pestis
accgcgucgccgcuuuuuguaa

SEQ ID NO: 2283929 - RNA, 23 nt, Yersinia pestis
accgcuuacugaugucaucaagu

SEQ ID NO: 2283930 - RNA, 18 nt, Yersinia pestis
accgcuucagcaggggca

SEQ ID NO: 2283931 - RNA, 21 nt, Yersinia pestis
accgcucuucacauucaguca

SEQ ID NO: 2283932 - RNA, 17 nt, Yersinia pestis
accgcugaaguggcuga

SEQ ID NO: 2283933 - RNA, 17 nt, Yersinia pestis
accggaauaaaucagug

SEQ ID NO: 2283934 - RNA, 13 nt, Yersinia pestis
accguaucagccc

SEQ ID NO: 2283935 - RNA, 14 nt, Yersinia pestis
accguaucacccgc

SEQ ID NO: 2283936 - RNA, 20 nt, Yersinia pestis
accgucaagacaacaaacag

SEQ ID NO: 2283937 - RNA, 16 nt, Yersinia pestis
accgucaccuuuauga

SEQ ID NO: 2283938 - RNA, 22 nt, Yersinia pestis
accguacauuaaaugaauaccu

SEQ ID NO: 2283939 - RNA, 15 nt, Yersinia pestis
accguagauaauuca

SEQ ID NO: 2283940 - RNA, 15 nt, Yersinia pestis
accggcauggauaac

SEQ ID NO: 2283941 - RNA, 20 nt, Yersinia pestis
accggcaguucauuccccau

SEQ ID NO: 2283942 - RNA, 14 nt, Yersinia pestis
accggucacaccag

SEQ ID NO: 2283943 - RNA, 16 nt, Yersinia pestis
accgguacugaggcau

SEQ ID NO: 2283944 - RNA, 18 nt, Yersinia pestis
accgggauacgggaucga

SEQ ID NO: 2283945 - RNA, 20 nt, Yersinia pestis
accuuuguguugaacuuuau

SEQ ID NO: 2283946 - RNA, 18 nt, Yersinia pestis
acgaauaucuagcaacac

SEQ ID NO: 2283947 - RNA, 22 nt, Yersinia pestis
acgaaauacucgagcguauugc

SEQ ID NO: 2283948 - RNA, 21 nt, Yersinia pestis
acgaauagaaccggcugacau

SEQ ID NO: 2283949 - RNA, 17 nt, Yersinia pestis
acgaauaguaucugggg

SEQ ID NO: 2283950 - RNA, 20 nt, Yersinia pestis
acgaaagauaauuuagcaaa

SEQ ID NO: 2283951 - RNA, 19 nt, Yersinia pestis
acgaaagcagccaauacac

SEQ ID NO: 2283952 - RNA, 19 nt, Yersinia pestis
acgaaugaguuuuguccug

SEQ ID NO: 2283953 - RNA, 15 nt, Yersinia pestis
acgacaacaucaaug

SEQ ID NO: 2283954 - RNA, 16 nt, Yersinia pestis
acgacaaugaucguca

SEQ ID NO: 2283955 - RNA, 21 nt, Yersinia pestis
acgacagauuauuguuaucca

SEQ ID NO: 2283956 - RNA, 19 nt, Yersinia pestis
acgauaaaggcgagucagc

SEQ ID NO: 2283957 - RNA, 13 nt, Yersinia pestis
acgauaucaccag

SEQ ID NO: 2283958 - RNA, 22 nt, Yersinia pestis
acgauaacuuuuggcagcacca

SEQ ID NO: 2283959 - RNA, 12 nt, Yersinia pestis
acgauaaaucgc

SEQ ID NO: 2283960 - RNA, 16 nt, Yersinia pestis
acgagcgguauuacag

SEQ ID NO: 2283961 - RNA, 16 nt, Yersinia pestis
accuucacgcucuugc

SEQ ID NO: 2283962 - RNA, 20 nt, Yersinia pestis
accuucacgcucuugcucuu

SEQ ID NO: 2283963 - RNA, 21 nt, Yersinia pestis
accuucacuggggagaucagu

SEQ ID NO: 2283964 - RNA, 23 nt, Yersinia pestis
accuucaccgugaguuuucgcuu

SEQ ID NO: 2283965 - RNA, 14 nt, Yersinia pestis
accuguaaaagcag

SEQ ID NO: 2283966 - RNA, 23 nt, Yersinia pestis
accuguaaaagcagccgugcuug

SEQ ID NO: 2283967 - RNA, 16 nt, Yersinia pestis
accuguagcucauacu

SEQ ID NO: 2283968 - RNA, 17 nt, Yersinia pestis
accuguagcuuuuuaaa

SEQ ID NO: 2283969 - RNA, 18 nt, Yersinia pestis
accugucaccuaccaccu

SEQ ID NO: 2283970 - RNA, 20 nt, Yersinia pestis
accugucaccuaccaccuac

SEQ ID NO: 2283971 - RNA, 19 nt, Yersinia pestis
accugucaccugucaccug

SEQ ID NO: 2283972 - RNA, 20 nt, Yersinia pestis
accuuggauggcgaaacaau

SEQ ID NO: 2283973 - RNA, 20 nt, Yersinia pestis
accuucuacaaauuuuuuau

SEQ ID NO: 2283974 - RNA, 19 nt, Yersinia pestis
accuuccauaacucaccuu

SEQ ID NO: 2283975 - RNA, 16 nt, Yersinia pestis
accuucugauuuuuug

SEQ ID NO: 2283976 - RNA, 23 nt, Yersinia pestis
accuucuuauuuaucacauuucg

SEQ ID NO: 2283977 - RNA, 20 nt, Yersinia pestis
accuuucgguugcaucagaa

SEQ ID NO: 2283978 - RNA, 19 nt, Yersinia pestis
accuuucgguugcaucaga

SEQ ID NO: 2283979 - RNA, 23 nt, Yersinia pestis
accuugguaucuguuuuugccac

SEQ ID NO: 2283980 - RNA, 18 nt, Yersinia pestis
accuuguggcacaaauag

SEQ ID NO: 2283981 - RNA, 16 nt, Yersinia pestis
accuugugucaccaug

SEQ ID NO: 2283982 - RNA, 19 nt, Yersinia pestis
accugaugacccgguaaaa

SEQ ID NO: 2283983 - RNA, 20 nt, Yersinia pestis
accugauuuaccgucuuuuu

SEQ ID NO: 2283984 - RNA, 18 nt, Yersinia pestis
accugauguaacucagga

SEQ ID NO: 2283985 - RNA, 22 nt, Yersinia pestis
accugauguuuugcugccauuu

SEQ ID NO: 2283986 - RNA, 19 nt, Yersinia pestis
accugcaccaaucauuaca

SEQ ID NO: 2283987 - RNA, 18 nt, Yersinia pestis
accugcauccccggcauc

SEQ ID NO: 2283988 - RNA, 16 nt, Yersinia pestis
accugcccgucacuca

SEQ ID NO: 2283989 - RNA, 15 nt, Yersinia pestis
accugcucaacugcu

SEQ ID NO: 2283990 - RNA, 18 nt, Yersinia pestis
accugcucaacugcucaa

SEQ ID NO: 2283991 - RNA, 18 nt, Yersinia pestis
accugcuaucaugauaaa

SEQ ID NO: 2283992 - RNA, 13 nt, Yersinia pestis
accugcuaaccga

SEQ ID NO: 2283993 - RNA, 14 nt, Yersinia pestis
accugccugcugcu

SEQ ID NO: 2283994 - RNA, 15 nt, Yersinia pestis
accugccugcugcug

SEQ ID NO: 2283995 - RNA, 16 nt, Yersinia pestis
agcucuucaauuucca

SEQ ID NO: 2283996 - RNA, 22 nt, Yersinia pestis
agcucuucaauuuccaucugca

SEQ ID NO: 2283997 - RNA, 14 nt, Yersinia pestis
agcucuuccagcaa

SEQ ID NO: 2283998 - RNA, 15 nt, Yersinia pestis
agcugacgcacauua

SEQ ID NO: 2283999 - RNA, 14 nt, Yersinia pestis
agcucucgcggcgu

SEQ ID NO: 2284000 - RNA, 17 nt, Yersinia pestis
agcucucugagccaucc

SEQ ID NO: 2284001 - RNA, 18 nt, Yersinia pestis
agcucgugccauuuugcg

SEQ ID NO: 2284002 - RNA, 20 nt, Yersinia pestis
agcucccccacucgccccac

SEQ ID NO: 2284003 - RNA, 12 nt, Yersinia pestis
agcgucacccaa

SEQ ID NO: 2284004 - RNA, 16 nt, Yersinia pestis
agcgucacggaaagca

SEQ ID NO: 2284005 - RNA, 17 nt, Yersinia pestis
agcucgccaucgcacca

SEQ ID NO: 2284006 - RNA, 17 nt, Yersinia pestis
agcucgcuguggcuacc

SEQ ID NO: 2284007 - RNA, 19 nt, Yersinia pestis
agcucgcuguggcuaccau

SEQ ID NO: 2284008 - RNA, 14 nt, Yersinia pestis
agcuuuaagaucca

SEQ ID NO: 2284009 - RNA, 12 nt, Yersinia pestis
agcuugcugcug

SEQ ID NO: 2284010 - RNA, 15 nt, Yersinia pestis
agcuuucuccuuuga

SEQ ID NO: 2284011 - RNA, 20 nt, Yersinia pestis
agcuuucuccuuugauuuga

SEQ ID NO: 2284012 - RNA, 16 nt, Yersinia pestis
agcuucuucaaaagca

SEQ ID NO: 2284013 - RNA, 21 nt, Yersinia pestis
agcuuaacauccgaauuuuua

SEQ ID NO: 2284014 - RNA, 15 nt, Yersinia pestis
agcugcuaaucccuu

SEQ ID NO: 2284015 - RNA, 15 nt, Yersinia pestis
agcugcgauaauccg

SEQ ID NO: 2284016 - RNA, 21 nt, Yersinia pestis
agcugauaugaaaaaucugac

SEQ ID NO: 2284017 - RNA, 17 nt, Yersinia pestis
agcugaugauuggcuuc

SEQ ID NO: 2284018 - RNA, 16 nt, Yersinia pestis
agcuggcuucuuuuuc

SEQ ID NO: 2284019 - RNA, 17 nt, Yersinia pestis
agcuggcgcacucaucc

SEQ ID NO: 2284020 - RNA, 18 nt, Yersinia pestis
agcuggcaguucggcuuu

SEQ ID NO: 2284021 - RNA, 19 nt, Yersinia pestis
agcuguguuagcggcgcuu

SEQ ID NO: 2284022 - RNA, 23 nt, Yersinia pestis
aggaauaaacagcaguucaucuu

SEQ ID NO: 2284023 - RNA, 15 nt, Yersinia pestis
aggaauaagguuuuu

SEQ ID NO: 2284024 - RNA, 17 nt, Yersinia pestis
aggaaaauggaauagug

SEQ ID NO: 2284025 - RNA, 14 nt, Yersinia pestis
aggacggugccaug

SEQ ID NO: 2284026 - RNA, 17 nt, Yersinia pestis
aggacgacggguauauu

SEQ ID NO: 2284027 - RNA, 20 nt, Yersinia pestis
aggacgacggguauauugcc

SEQ ID NO: 2284028 - RNA, 22 nt, Yersinia pestis
aggacgaaggguaaaauaaaua

SEQ ID NO: 2284029 - RNA, 16 nt, Yersinia pestis
aggaauggcgugauau

SEQ ID NO: 2284030 - RNA, 17 nt, Yersinia pestis
aggaauggcgugauauc

SEQ ID NO: 2284031 - RNA, 19 nt, Yersinia pestis
aggaaugccgauaagcccu

SEQ ID NO: 2284032 - RNA, 15 nt, Yersinia pestis
aggaaugcgcccuuu

SEQ ID NO: 2284033 - RNA, 23 nt, Yersinia pestis
aggaaugcgcccuuuuccgucag

SEQ ID NO: 2284034 - RNA, 21 nt, Yersinia pestis
aggaguaaagcguccgcgcca

SEQ ID NO: 2284035 - RNA, 20 nt, Yersinia pestis
aggagguggugauuguuuua

SEQ ID NO: 2284036 - RNA, 11 nt, Yersinia pestis
aggauaaaaac

SEQ ID NO: 2284037 - RNA, 14 nt, Yersinia pestis
aggauaggcagagg

SEQ ID NO: 2284038 - RNA, 21 nt, Yersinia pestis
aggauaggcagaggaguaaag

SEQ ID NO: 2284039 - RNA, 12 nt, Yersinia pestis
aggaucuuccuc

SEQ ID NO: 2284040 - RNA, 13 nt, Yersinia pestis
aggaucuggauuu

SEQ ID NO: 2284041 - RNA, 15 nt, Yersinia pestis
aggcaaauucucaau

SEQ ID NO: 2284042 - RNA, 15 nt, Yersinia pestis
aggcaauaccaauau

SEQ ID NO: 2284043 - RNA, 15 nt, Yersinia pestis
aggcaguauuccaau

SEQ ID NO: 2284044 - RNA, 18 nt, Yersinia pestis
aggcaggcccgcuucccu

SEQ ID NO: 2284045 - RNA, 14 nt, Yersinia pestis
aggcagaggaagua

SEQ ID NO: 2284046 - RNA, 14 nt, Yersinia pestis
aggcaauuauccau

SEQ ID NO: 2284047 - RNA, 12 nt, Yersinia pestis
aggcauccgcca

SEQ ID NO: 2284048 - RNA, 19 nt, Yersinia pestis
aggcauccacaucuugcgc

SEQ ID NO: 2284049 - RNA, 15 nt, Yersinia pestis
aggcccgcuaucacu

SEQ ID NO: 2284050 - RNA, 11 nt, Yersinia pestis
aggccgcgaau

SEQ ID NO: 2284051 - RNA, 13 nt, Yersinia pestis
aggccgcuaucuc

SEQ ID NO: 2284052 - RNA, 19 nt, Yersinia pestis
aggcccgguugagugagac

SEQ ID NO: 2284053 - RNA, 12 nt, Yersinia pestis
aggcccuuucac

SEQ ID NO: 2284054 - RNA, 20 nt, Yersinia pestis
aggcccugagauucaaccca

SEQ ID NO: 2284055 - RNA, 19 nt, Yersinia pestis
aggcucaucaccuuccaaa

SEQ ID NO: 2284056 - RNA, 24 nt, Yersinia pestis
aggcucagcgguacuuuuugugau

SEQ ID NO: 2284057 - RNA, 18 nt, Yersinia pestis
aggcucccaaggguauaa

SEQ ID NO: 2284058 - RNA, 18 nt, Yersinia pestis
aggcucccagacuuugcu

SEQ ID NO: 2284059 - RNA, 21 nt, Yersinia pestis
aggcuaccgucauccagcacu

SEQ ID NO: 2284060 - RNA, 17 nt, Yersinia pestis
aggcucagcacaaacau

SEQ ID NO: 2284061 - RNA, 13 nt, Yersinia pestis
aggcucuguuacc

SEQ ID NO: 2284062 - RNA, 19 nt, Yersinia pestis
aggcugaaggcgcuccccu

SEQ ID NO: 2284063 - RNA, 20 nt, Yersinia pestis
aggcucgagccgcgccaucc

SEQ ID NO: 2284064 - RNA, 11 nt, Yersinia pestis
aggcuggcagg

SEQ ID NO: 2284065 - RNA, 13 nt, Yersinia pestis
aggcugucaggaa

SEQ ID NO: 2284066 - RNA, 16 nt, Yersinia pestis
aggcugagguugauga

SEQ ID NO: 2284067 - RNA, 20 nt, Yersinia pestis
aggcugcgcauuucacccuc

SEQ ID NO: 2284068 - RNA, 21 nt, Yersinia pestis
aggcugcgcauuucacccucu

SEQ ID NO: 2284069 - RNA, 23 nt, Yersinia pestis
aggcuaaagacuucagcccaugg

SEQ ID NO: 2284070 - RNA, 12 nt, Yersinia pestis
aggcuaccaagg

SEQ ID NO: 2284071 - RNA, 14 nt, Yersinia pestis
aggcuaccaaggcu

SEQ ID NO: 2284072 - RNA, 17 nt, Yersinia pestis
aggcguuuuuuugccag

SEQ ID NO: 2284073 - RNA, 15 nt, Yersinia pestis
aggcuaaaccggcac

SEQ ID NO: 2284074 - RNA, 18 nt, Yersinia pestis
aggcuaaagacuucagcc

SEQ ID NO: 2284075 - RNA, 18 nt, Yersinia pestis
aggcguuuccccuugcug

SEQ ID NO: 2284076 - RNA, 15 nt, Yersinia pestis
aggcgguuuggcuug

SEQ ID NO: 2284077 - RNA, 20 nt, Yersinia pestis
aggcggguaacugugcagga

SEQ ID NO: 2284078 - RNA, 22 nt, Yersinia pestis
aggcggcgauggaccaugccau

SEQ ID NO: 2284079 - RNA, 21 nt, Yersinia pestis
aggcuuauauuuaugcuugau

SEQ ID NO: 2284080 - RNA, 22 nt, Yersinia pestis
aggcuguugcguaccauaugga

SEQ ID NO: 2284081 - RNA, 17 nt, Yersinia pestis
aggcugugguggcgguc

SEQ ID NO: 2284082 - RNA, 19 nt, Yersinia pestis
agggauaugacagaaaaau

SEQ ID NO: 2284083 - RNA, 22 nt, Yersinia pestis
agggauaucucaccgccaauau

SEQ ID NO: 2284084 - RNA, 16 nt, Yersinia pestis
agggcagcuaaccccu

SEQ ID NO: 2284085 - RNA, 15 nt, Yersinia pestis
agggcagccaauuac

SEQ ID NO: 2284086 - RNA, 14 nt, Yersinia pestis
agggcgauggcaac

SEQ ID NO: 2284087 - RNA, 13 nt, Yersinia pestis
agggcgcagcccc

SEQ ID NO: 2284088 - RNA, 20 nt, Yersinia pestis
agggcgcgcuucgagccccc

SEQ ID NO: 2284089 - RNA, 14 nt, Yersinia pestis
agggcgcggcuggu

SEQ ID NO: 2284090 - RNA, 16 nt, Yersinia pestis
agggcgcggcugguaa

SEQ ID NO: 2284091 - RNA, 16 nt, Yersinia pestis
agggguacagcaggga

SEQ ID NO: 2284092 - RNA, 21 nt, Yersinia pestis
agggggcuguuaagcauugag

SEQ ID NO: 2284093 - RNA, 16 nt, Yersinia pestis
agggggcuuauucuaa

SEQ ID NO: 2284094 - RNA, 20 nt, Yersinia pestis
aggggaugacaccuuucaaa

SEQ ID NO: 2284095 - RNA, 14 nt, Yersinia pestis
aggggauagggggc

SEQ ID NO: 2284096 - RNA, 21 nt, Yersinia pestis
aggguucgaaucccucccuca

SEQ ID NO: 2284097 - RNA, 21 nt, Yersinia pestis
aggguugcgggccucuucuuu

SEQ ID NO: 2284098 - RNA, 14 nt, Yersinia pestis
aggguuuccaagcu

SEQ ID NO: 2284099 - RNA, 22 nt, Yersinia pestis
agggucagaauacguagcccuu

SEQ ID NO: 2284100 - RNA, 15 nt, Yersinia pestis
aggguauugaagaua

SEQ ID NO: 2284101 - RNA, 19 nt, Yersinia pestis
agggucaucaacaaaguaa

SEQ ID NO: 2284102 - RNA, 14 nt, Yersinia pestis
aggguccaacaugu

SEQ ID NO: 2284103 - RNA, 18 nt, Yersinia pestis
aguaagcaugaaacacag

SEQ ID NO: 2284104 - RNA, 22 nt, Yersinia pestis
aguaagcaugaaacacagugga

SEQ ID NO: 2284105 - RNA, 16 nt, Yersinia pestis
aguaacuguaaggcca

SEQ ID NO: 2284106 - RNA, 16 nt, Yersinia pestis
aguaacggaauucaga

SEQ ID NO: 2284107 - RNA, 23 nt, Yersinia pestis
aguaacuauuuacauaauaacca

SEQ ID NO: 2284108 - RNA, 14 nt, Yersinia pestis
aguaacucaaguau

SEQ ID NO: 2284109 - RNA, 19 nt, Yersinia pestis
aguaaaucuacuuuauuca

SEQ ID NO: 2284110 - RNA, 19 nt, Yersinia pestis
aguaacgccauaaucgcuu

SEQ ID NO: 2284111 - RNA, 11 nt, Yersinia pestis
aguaaccgggc

SEQ ID NO: 2284112 - RNA, 19 nt, Yersinia pestis
aguaaauccugaugaccag

SEQ ID NO: 2284113 - RNA, 15 nt, Yersinia pestis
aguaaaucaggccgg

SEQ ID NO: 2284114 - RNA, 14 nt, Yersinia pestis
aguaaauagcaaaa

SEQ ID NO: 2284115 - RNA, 19 nt, Yersinia pestis
agguuuucccuuagggcaa

SEQ ID NO: 2284116 - RNA, 18 nt, Yersinia pestis
agguuuuuucaccaacca

SEQ ID NO: 2284117 - RNA, 13 nt, Yersinia pestis
agguucaauuccc

SEQ ID NO: 2284118 - RNA, 14 nt, Yersinia pestis
agguugaaauaaau

SEQ ID NO: 2284119 - RNA, 15 nt, Yersinia pestis
aguacagaauuucau

SEQ ID NO: 2284120 - RNA, 18 nt, Yersinia pestis
aguacauaaaccgugugc

SEQ ID NO: 2284121 - RNA, 15 nt, Yersinia pestis
aguaaggagcaaaag

SEQ ID NO: 2284122 - RNA, 18 nt, Yersinia pestis
aguaaggccaauuggcuu

SEQ ID NO: 2284123 - RNA, 12 nt, Yersinia pestis
aguaaugaaauc

SEQ ID NO: 2284124 - RNA, 13 nt, Yersinia pestis
aguaaugggauca

SEQ ID NO: 2284125 - RNA, 12 nt, Yersinia pestis
aguaaugcccau

SEQ ID NO: 2284126 - RNA, 15 nt, Yersinia pestis
aguacuaucuauuau

SEQ ID NO: 2284127 - RNA, 23 nt, Yersinia pestis
aguacguaacgaauucagcagcg

SEQ ID NO: 2284128 - RNA, 22 nt, Yersinia pestis
aguacguagcgauaacagauau

SEQ ID NO: 2284129 - RNA, 20 nt, Yersinia pestis
aguacggugccagcagcaag

SEQ ID NO: 2284130 - RNA, 18 nt, Yersinia pestis
aguacggugccagcagca

SEQ ID NO: 2284131 - RNA, 15 nt, Yersinia pestis
agguuaacugcagug

SEQ ID NO: 2284132 - RNA, 13 nt, Yersinia pestis
agguuaacugcag

SEQ ID NO: 2284133 - RNA, 21 nt, Yersinia pestis
agguuaacagccccgucucaa

SEQ ID NO: 2284134 - RNA, 19 nt, Yersinia pestis
agguuaaauucacuuuccc

SEQ ID NO: 2284135 - RNA, 15 nt, Yersinia pestis
agguuaacagccccg

SEQ ID NO: 2284136 - RNA, 22 nt, Yersinia pestis
agguguucuugaaaaaauaaau

SEQ ID NO: 2284137 - RNA, 22 nt, Yersinia pestis
agguguuaacgcgccggaauua

SEQ ID NO: 2284138 - RNA, 23 nt, Yersinia pestis
aggugugcccaacaacgccgcac

SEQ ID NO: 2284139 - RNA, 21 nt, Yersinia pestis
agguuauugacaaagugccug

SEQ ID NO: 2284140 - RNA, 22 nt, Yersinia pestis
aggugcgccaguggcaucaaua

SEQ ID NO: 2284141 - RNA, 21 nt, Yersinia pestis
aggugcgggaugcaguuacug

SEQ ID NO: 2284142 - RNA, 17 nt, Yersinia pestis
agguguacucucccuuu

SEQ ID NO: 2284143 - RNA, 23 nt, Yersinia pestis
agguguaaauuucaaaaaagccc

SEQ ID NO: 2284144 - RNA, 23 nt, Yersinia pestis
aggugucaucaaggcaaccauca

SEQ ID NO: 2284145 - RNA, 20 nt, Yersinia pestis
agguaaacgcaauguccccc

SEQ ID NO: 2284146 - RNA, 12 nt, Yersinia pestis
agguaaauccag

SEQ ID NO: 2284147 - RNA, 21 nt, Yersinia pestis
aggucaauugcggccagccuu

SEQ ID NO: 2284148 - RNA, 20 nt, Yersinia pestis
aggucaggaagagaaaagca

SEQ ID NO: 2284149 - RNA, 11 nt, Yersinia pestis
aggucaggaag

SEQ ID NO: 2284150 - RNA, 16 nt, Yersinia pestis
aggugaagaaaagcuu

SEQ ID NO: 2284151 - RNA, 15 nt, Yersinia pestis
aggugaaaauaauaa

SEQ ID NO: 2284152 - RNA, 19 nt, Yersinia pestis
aggugacaggcaaagacua

SEQ ID NO: 2284153 - RNA, 22 nt, Yersinia pestis
aggugacaggcaaagacuacac

SEQ ID NO: 2284154 - RNA, 21 nt, Yersinia pestis
aggugaaguucuauaaaacgc

SEQ ID NO: 2284155 - RNA, 19 nt, Yersinia pestis
aggucagugguuuuaucaa

SEQ ID NO: 2284156 - RNA, 18 nt, Yersinia pestis
aggucgaucgacuucuua

SEQ ID NO: 2284157 - RNA, 18 nt, Yersinia pestis
agucaaugcauuguaaaa

SEQ ID NO: 2284158 - RNA, 19 nt, Yersinia pestis
agucaauguucucugggua

SEQ ID NO: 2284159 - RNA, 22 nt, Yersinia pestis
aguagacgacacaaaugcugug

SEQ ID NO: 2284160 - RNA, 20 nt, Yersinia pestis
aguagacgacacaaaugcug

SEQ ID NO: 2284161 - RNA, 15 nt, Yersinia pestis
aguacuucagguaau

SEQ ID NO: 2284162 - RNA, 18 nt, Yersinia pestis
aguacuuauuugaaacac

SEQ ID NO: 2284163 - RNA, 19 nt, Yersinia pestis
aguacuuauuugaaacacu

SEQ ID NO: 2284164 - RNA, 14 nt, Yersinia pestis
agucaauugagaau

SEQ ID NO: 2284165 - RNA, 15 nt, Yersinia pestis
agucacauuuuuaau

SEQ ID NO: 2284166 - RNA, 21 nt, Yersinia pestis
agucaccuuuuuagcgagugc

SEQ ID NO: 2284167 - RNA, 17 nt, Yersinia pestis
agucacgucuucaccaa

SEQ ID NO: 2284168 - RNA, 19 nt, Yersinia pestis
agucacgucuucaccaaug

SEQ ID NO: 2284169 - RNA, 17 nt, Yersinia pestis
agucagcuagccugccc

SEQ ID NO: 2284170 - RNA, 16 nt, Yersinia pestis
agucacuggccgcagg

SEQ ID NO: 2284171 - RNA, 23 nt, Yersinia pestis
agucacuggggugaaucaaaacc

SEQ ID NO: 2284172 - RNA, 20 nt, Yersinia pestis
agucacuaaaccauucagcc

SEQ ID NO: 2284173 - RNA, 20 nt, Yersinia pestis
agucacgucuucaccaauga

SEQ ID NO: 2284174 - RNA, 13 nt, Yersinia pestis
agucacuaaacca

SEQ ID NO: 2284175 - RNA, 15 nt, Yersinia pestis
agucacuaaaccauu

SEQ ID NO: 2284176 - RNA, 17 nt, Yersinia pestis
aguccaagaagauaacu

SEQ ID NO: 2284177 - RNA, 16 nt, Yersinia pestis
agucauuuacugauga

SEQ ID NO: 2284178 - RNA, 21 nt, Yersinia pestis
agucauugguguuacagcaag

SEQ ID NO: 2284179 - RNA, 17 nt, Yersinia pestis
agucauugggguaauuu

SEQ ID NO: 2284180 - RNA, 19 nt, Yersinia pestis
agucauugguguuacagca

SEQ ID NO: 2284181 - RNA, 15 nt, Yersinia pestis
agucagggagucagg

SEQ ID NO: 2284182 - RNA, 17 nt, Yersinia pestis
agucagggagucaggga

SEQ ID NO: 2284183 - RNA, 20 nt, Yersinia pestis
agucaguaauucacccuuua

SEQ ID NO: 2284184 - RNA, 22 nt, Yersinia pestis
agucaugguacaacugcggcgu

SEQ ID NO: 2284185 - RNA, 20 nt, Yersinia pestis
agucaucgcggguuuuuaac

SEQ ID NO: 2284186 - RNA, 16 nt, Yersinia pestis
agucuuaugaugcugg

SEQ ID NO: 2284187 - RNA, 21 nt, Yersinia pestis
agucuucaucauccauaaaga

SEQ ID NO: 2284188 - RNA, 21 nt, Yersinia pestis
agucuguuugucacggcggcc

SEQ ID NO: 2284189 - RNA, 19 nt, Yersinia pestis
agucugucguacuuuccuu

SEQ ID NO: 2284190 - RNA, 20 nt, Yersinia pestis
agucugucguacuuuccuuc

SEQ ID NO: 2284191 - RNA, 23 nt, Yersinia pestis
agucugucguacuuuccuuccuc

SEQ ID NO: 2284192 - RNA, 19 nt, Yersinia pestis
agugaaaaugguuuccagc

SEQ ID NO: 2284193 - RNA, 16 nt, Yersinia pestis
agugaaaagguuaacu

SEQ ID NO: 2284194 - RNA, 20 nt, Yersinia pestis
agugaaaagguuaacugcag

SEQ ID NO: 2284195 - RNA, 13 nt, Yersinia pestis
agugaaagggaag

SEQ ID NO: 2284196 - RNA, 15 nt, Yersinia pestis
agugaaccaucaagg

SEQ ID NO: 2284197 - RNA, 17 nt, Yersinia pestis
agugagaagugaaaaac

SEQ ID NO: 2284198 - RNA, 14 nt, Yersinia pestis
agugacugggguga

SEQ ID NO: 2284199 - RNA, 18 nt, Yersinia pestis
agugacucaucaaaacaa

SEQ ID NO: 2284200 - RNA, 13 nt, Yersinia pestis
agugacucugccc

SEQ ID NO: 2284201 - RNA, 16 nt, Yersinia pestis
agugacucugcccuuu

SEQ ID NO: 2284202 - RNA, 15 nt, Yersinia pestis
agugacguugauucu

SEQ ID NO: 2284203 - RNA, 20 nt, Yersinia pestis
agugacuaauuguuugcuuu

SEQ ID NO: 2284204 - RNA, 23 nt, Yersinia pestis
agugacguaaaaaggcagugaca

SEQ ID NO: 2284205 - RNA, 23 nt, Yersinia pestis
agugacaugcuuaauuauugcag

SEQ ID NO: 2284206 - RNA, 14 nt, Yersinia pestis
agugaccaaagcag

SEQ ID NO: 2284207 - RNA, 19 nt, Yersinia pestis
agugacccaagaugaccac

SEQ ID NO: 2284208 - RNA, 15 nt, Yersinia pestis
agugacgcagugacg

SEQ ID NO: 2284209 - RNA, 14 nt, Yersinia pestis
agugacgcagugau

SEQ ID NO: 2284210 - RNA, 15 nt, Yersinia pestis
agucucacaaaauaa

SEQ ID NO: 2284211 - RNA, 20 nt, Yersinia pestis
agucuacgcucuacauuugg

SEQ ID NO: 2284212 - RNA, 22 nt, Yersinia pestis
agucuaaacgccgcgucaauaa

SEQ ID NO: 2284213 - RNA, 17 nt, Yersinia pestis
agucgcauguaggcagc

SEQ ID NO: 2284214 - RNA, 17 nt, Yersinia pestis
agucgccuuaaaugcgu

SEQ ID NO: 2284215 - RNA, 21 nt, Yersinia pestis
agucccauugacgaauuaaaa

SEQ ID NO: 2284216 - RNA, 17 nt, Yersinia pestis
agucccucccuucgcac

SEQ ID NO: 2284217 - RNA, 16 nt, Yersinia pestis
aguccuuaaaaaccca

SEQ ID NO: 2284218 - RNA, 17 nt, Yersinia pestis
aguguuaccaagagaga

SEQ ID NO: 2284219 - RNA, 20 nt, Yersinia pestis
aguguuaguuuuaauaacuu

SEQ ID NO: 2284220 - RNA, 22 nt, Yersinia pestis
aguguucauaaauuaaaacuga

SEQ ID NO: 2284221 - RNA, 20 nt, Yersinia pestis
agugugugugcgcugaguga

SEQ ID NO: 2284222 - RNA, 21 nt, Yersinia pestis
aguguguuauuuuucucuuuc

SEQ ID NO: 2284223 - RNA, 20 nt, Yersinia pestis
agugugccuuggucucagaa

SEQ ID NO: 2284224 - RNA, 23 nt, Yersinia pestis
agugugccuuggucucagaacaa

SEQ ID NO: 2284225 - RNA, 20 nt, Yersinia pestis
aguguaaaaccugacuguuu

SEQ ID NO: 2284226 - RNA, 18 nt, Yersinia pestis
agugucuggcaauccagc

SEQ ID NO: 2284227 - RNA, 15 nt, Yersinia pestis
agugugcaaauaaac

SEQ ID NO: 2284228 - RNA, 15 nt, Yersinia pestis
aguuaaaaauagaca

SEQ ID NO: 2284229 - RNA, 18 nt, Yersinia pestis
aguuaaacaacgcugaaa

SEQ ID NO: 2284230 - RNA, 12 nt, Yersinia pestis
aguuaaaaccag

SEQ ID NO: 2284231 - RNA, 15 nt, Yersinia pestis
aguuaaaaauaaauu

SEQ ID NO: 2284232 - RNA, 20 nt, Yersinia pestis
aguuaaaaauaaauucuuua

SEQ ID NO: 2284233 - RNA, 13 nt, Yersinia pestis
aguguugccaugg

SEQ ID NO: 2284234 - RNA, 16 nt, Yersinia pestis
aguuaaagguaaaagg

SEQ ID NO: 2284235 - RNA, 22 nt, Yersinia pestis
aguuaaagguaaaaggcccgcu

SEQ ID NO: 2284236 - RNA, 14 nt, Yersinia pestis
aguuaaaugaagga

SEQ ID NO: 2284237 - RNA, 17 nt, Yersinia pestis
aguuaaaucccugugcu

SEQ ID NO: 2284238 - RNA, 13 nt, Yersinia pestis
aguggguaaaccu

SEQ ID NO: 2284239 - RNA, 16 nt, Yersinia pestis
aguggcuuaauugaag

SEQ ID NO: 2284240 - RNA, 14 nt, Yersinia pestis
agugggauaucugc

SEQ ID NO: 2284241 - RNA, 16 nt, Yersinia pestis
aguggcgguaucacuu

SEQ ID NO: 2284242 - RNA, 15 nt, Yersinia pestis
aguggaaaaacugaa

SEQ ID NO: 2284243 - RNA, 14 nt, Yersinia pestis
aguggacacgccgu

SEQ ID NO: 2284244 - RNA, 20 nt, Yersinia pestis
agugcucaccuaggcuuuca

SEQ ID NO: 2284245 - RNA, 15 nt, Yersinia pestis
agugcuauccucuua

SEQ ID NO: 2284246 - RNA, 15 nt, Yersinia pestis
agugcuauucauaaa

SEQ ID NO: 2284247 - RNA, 18 nt, Yersinia pestis
agugcuauucauaaguca

SEQ ID NO: 2284248 - RNA, 16 nt, Yersinia pestis
agugcuacagcagcag

SEQ ID NO: 2284249 - RNA, 15 nt, Yersinia pestis
agugcguuuuauuca

SEQ ID NO: 2284250 - RNA, 15 nt, Yersinia pestis
agugcguacgccaac

SEQ ID NO: 2284251 - RNA, 15 nt, Yersinia pestis
agugauaaggccuuu

SEQ ID NO: 2284252 - RNA, 15 nt, Yersinia pestis
agugauaacaacccu

SEQ ID NO: 2284253 - RNA, 13 nt, Yersinia pestis
agugaguaucuuc

SEQ ID NO: 2284254 - RNA, 15 nt, Yersinia pestis
agugagacaauuaac

SEQ ID NO: 2284255 - RNA, 16 nt, Yersinia pestis
agugagacaauuaaca

SEQ ID NO: 2284256 - RNA, 16 nt, Yersinia pestis
aguuggaaaugacaaa

SEQ ID NO: 2284257 - RNA, 23 nt, Yersinia pestis
aguugcugagauaucaaaugaac

SEQ ID NO: 2284258 - RNA, 19 nt, Yersinia pestis
aguugcucacccauuuuau

SEQ ID NO: 2284259 - RNA, 17 nt, Yersinia pestis
aguugaauaagauccca

SEQ ID NO: 2284260 - RNA, 19 nt, Yersinia pestis
aguucgauauuauucucua

SEQ ID NO: 2284261 - RNA, 14 nt, Yersinia pestis
aguucuuuauccac

SEQ ID NO: 2284262 - RNA, 20 nt, Yersinia pestis
aguucuuuauccacuuggcu

SEQ ID NO: 2284263 - RNA, 23 nt, Yersinia pestis
aguugaacucgccuucagguaau

SEQ ID NO: 2284264 - RNA, 14 nt, Yersinia pestis
aguucagcauccca

SEQ ID NO: 2284265 - RNA, 17 nt, Yersinia pestis
aguucagcaucccagcc

SEQ ID NO: 2284266 - RNA, 18 nt, Yersinia pestis
aguucagcaucccagcca

SEQ ID NO: 2284267 - RNA, 17 nt, Yersinia pestis
aguucagguugaaauaa

SEQ ID NO: 2284268 - RNA, 15 nt, Yersinia pestis
aguucaagcagguuc

SEQ ID NO: 2284269 - RNA, 19 nt, Yersinia pestis
aguuauuucagccaugggc

SEQ ID NO: 2284270 - RNA, 23 nt, Yersinia pestis
aguuagugguguuauccacuugc

SEQ ID NO: 2284271 - RNA, 16 nt, Yersinia pestis
aguuaguggcuuuaag

SEQ ID NO: 2284272 - RNA, 16 nt, Yersinia pestis
aguuaaguagucagca

SEQ ID NO: 2284273 - RNA, 22 nt, Yersinia pestis
aguuaaguagucagcaacgcga

SEQ ID NO: 2284274 - RNA, 12 nt, Yersinia pestis
aguuaaucaagc

SEQ ID NO: 2284275 - RNA, 19 nt, Yersinia pestis
aguuagcgugagaauaaua

SEQ ID NO: 2284276 - RNA, 17 nt, Yersinia pestis
auaaggcuuuauauugc

SEQ ID NO: 2284277 - RNA, 19 nt, Yersinia pestis
auaaggcuuuuagccccuu

SEQ ID NO: 2284278 - RNA, 15 nt, Yersinia pestis
auaaggcuaacaccu

SEQ ID NO: 2284279 - RNA, 16 nt, Yersinia pestis
auaaggcuaacaccuu

SEQ ID NO: 2284280 - RNA, 19 nt, Yersinia pestis
auaaggugccacacagaau

SEQ ID NO: 2284281 - RNA, 13 nt, Yersinia pestis
auaagggccaccc

SEQ ID NO: 2284282 - RNA, 17 nt, Yersinia pestis
auaagcgguuuuaucaa

SEQ ID NO: 2284283 - RNA, 18 nt, Yersinia pestis
auaagcgguuuuaucaau

SEQ ID NO: 2284284 - RNA, 13 nt, Yersinia pestis
auaagcugacacc

SEQ ID NO: 2284285 - RNA, 16 nt, Yersinia pestis
auaagcugacaccuuu

SEQ ID NO: 2284286 - RNA, 17 nt, Yersinia pestis
auaaggauaaccgccug

SEQ ID NO: 2284287 - RNA, 15 nt, Yersinia pestis
auaagauucagcugc

SEQ ID NO: 2284288 - RNA, 20 nt, Yersinia pestis
auaagauucagcugcccuug

SEQ ID NO: 2284289 - RNA, 22 nt, Yersinia pestis
auaagaugaccaccaauuucau

SEQ ID NO: 2284290 - RNA, 17 nt, Yersinia pestis
auaagauccagaacacc

SEQ ID NO: 2284291 - RNA, 18 nt, Yersinia pestis
auaagcacaacgcucuaa

SEQ ID NO: 2284292 - RNA, 15 nt, Yersinia pestis
auaagcgcucaaaua

SEQ ID NO: 2284293 - RNA, 20 nt, Yersinia pestis
auaagcacgaauuuuauuca

SEQ ID NO: 2284294 - RNA, 13 nt, Yersinia pestis
auaagccaaagua

SEQ ID NO: 2284295 - RNA, 15 nt, Yersinia pestis
auaagccagugcuau

SEQ ID NO: 2284296 - RNA, 14 nt, Yersinia pestis
auaacucaucagua

SEQ ID NO: 2284297 - RNA, 13 nt, Yersinia pestis
auaacuauuuuug

SEQ ID NO: 2284298 - RNA, 18 nt, Yersinia pestis
auaacuauuuuugacuuu

SEQ ID NO: 2284299 - RNA, 16 nt, Yersinia pestis
auaagacaccacauca

SEQ ID NO: 2284300 - RNA, 14 nt, Yersinia pestis
auaagacagggguu

SEQ ID NO: 2284301 - RNA, 22 nt, Yersinia pestis
auaaauugcuuugucaucaacc

SEQ ID NO: 2284302 - RNA, 15 nt, Yersinia pestis
auaaauuuaauaaaa

SEQ ID NO: 2284303 - RNA, 16 nt, Yersinia pestis
auaaauuuaauaaaaa

SEQ ID NO: 2284304 - RNA, 17 nt, Yersinia pestis
auaaauuuaauaaaaac

SEQ ID NO: 2284305 - RNA, 13 nt, Yersinia pestis
auaaauuuauuuu

SEQ ID NO: 2284306 - RNA, 15 nt, Yersinia pestis
auaaauuuauuuuuu

SEQ ID NO: 2284307 - RNA, 21 nt, Yersinia pestis
auaacgaauuucauuuuaaaa

SEQ ID NO: 2284308 - RNA, 16 nt, Yersinia pestis
auaacguuguuucuga

SEQ ID NO: 2284309 - RNA, 20 nt, Yersinia pestis
auaacuauauucucauugcc

SEQ ID NO: 2284310 - RNA, 13 nt, Yersinia pestis
auaaucucagcau

SEQ ID NO: 2284311 - RNA, 14 nt, Yersinia pestis
auaaucuaaauuaa

SEQ ID NO: 2284312 - RNA, 22 nt, Yersinia pestis
auaaucgcguucagagcagcau

SEQ ID NO: 2284313 - RNA, 23 nt, Yersinia pestis
auaaucgcguucagagcagcauu

SEQ ID NO: 2284314 - RNA, 19 nt, Yersinia pestis
auaauccgccaauagcugg

SEQ ID NO: 2284315 - RNA, 14 nt, Yersinia pestis
auaaugcaccaauc

SEQ ID NO: 2284316 - RNA, 18 nt, Yersinia pestis
auaaugcaccaaucaaca

SEQ ID NO: 2284317 - RNA, 15 nt, Yersinia pestis
auaaugcgauuaacc

SEQ ID NO: 2284318 - RNA, 21 nt, Yersinia pestis
auaaugcuaaaugagaucgcu

SEQ ID NO: 2284319 - RNA, 17 nt, Yersinia pestis
auaauuauaccuacccu

SEQ ID NO: 2284320 - RNA, 13 nt, Yersinia pestis
auaauuaugaaag

SEQ ID NO: 2284321 - RNA, 22 nt, Yersinia pestis
auaauuauccauuuucugccaa

SEQ ID NO: 2284322 - RNA, 13 nt, Yersinia pestis
auaauuaaucuaa

SEQ ID NO: 2284323 - RNA, 22 nt, Yersinia pestis
auaauguucguuuuuuggguuu

SEQ ID NO: 2284324 - RNA, 14 nt, Yersinia pestis
auaauuaaauauua

SEQ ID NO: 2284325 - RNA, 16 nt, Yersinia pestis
auaauuaacagcauca

SEQ ID NO: 2284326 - RNA, 13 nt, Yersinia pestis
auaauuaacuauu

SEQ ID NO: 2284327 - RNA, 14 nt, Yersinia pestis
auaaguaauaagua

SEQ ID NO: 2284328 - RNA, 15 nt, Yersinia pestis
auaauagauaguacu

SEQ ID NO: 2284329 - RNA, 21 nt, Yersinia pestis
auaauagcuggcggauaaaaa

SEQ ID NO: 2284330 - RNA, 23 nt, Yersinia pestis
auaauaucaagucuugaagagug

SEQ ID NO: 2284331 - RNA, 16 nt, Yersinia pestis
auaauauuaaagccau

SEQ ID NO: 2284332 - RNA, 19 nt, Yersinia pestis
auaauccaaaccgccuucu

SEQ ID NO: 2284333 - RNA, 13 nt, Yersinia pestis
auaaucaauuaau

SEQ ID NO: 2284334 - RNA, 15 nt, Yersinia pestis
auaaucaauccuaca

SEQ ID NO: 2284335 - RNA, 23 nt, Yersinia pestis
auaauccaccugacgaaaugccg

SEQ ID NO: 2284336 - RNA, 19 nt, Yersinia pestis
auaaaaaucccggcauauu

SEQ ID NO: 2284337 - RNA, 20 nt, Yersinia pestis
auaaaaaugcacugaacaau

SEQ ID NO: 2284338 - RNA, 16 nt, Yersinia pestis
auaaaaccacugaccu

SEQ ID NO: 2284339 - RNA, 11 nt, Yersinia pestis
auaaaacaaua

SEQ ID NO: 2284340 - RNA, 15 nt, Yersinia pestis
auaaaacagaacccc

SEQ ID NO: 2284341 - RNA, 12 nt, Yersinia pestis
auaaaaauagcu

SEQ ID NO: 2284342 - RNA, 15 nt, Yersinia pestis
auaaaaauaaucaau

SEQ ID NO: 2284343 - RNA, 11 nt, Yersinia pestis
auaaaaacccc

SEQ ID NO: 2284344 - RNA, 15 nt, Yersinia pestis
auaaaaacuucagag

SEQ ID NO: 2284345 - RNA, 21 nt, Yersinia pestis
auaaaagcacagacaaacaac

SEQ ID NO: 2284346 - RNA, 17 nt, Yersinia pestis
auaaaaggcuauuuaaa

SEQ ID NO: 2284347 - RNA, 23 nt, Yersinia pestis
auaaaaggauggcccaagccauc

SEQ ID NO: 2284348 - RNA, 20 nt, Yersinia pestis
auaaaagcuucggucucuuu

SEQ ID NO: 2284349 - RNA, 16 nt, Yersinia pestis
auaaaaggauggccca

SEQ ID NO: 2284350 - RNA, 20 nt, Yersinia pestis
auaaaaguacaacuacgaug

SEQ ID NO: 2284351 - RNA, 17 nt, Yersinia pestis
auaaaaccuuuacaauu

SEQ ID NO: 2284352 - RNA, 22 nt, Yersinia pestis
auaaaaccuuuauguaacacau

SEQ ID NO: 2284353 - RNA, 19 nt, Yersinia pestis
auaaaacugcucacuggag

SEQ ID NO: 2284354 - RNA, 14 nt, Yersinia pestis
auaaaaaacugacu

SEQ ID NO: 2284355 - RNA, 19 nt, Yersinia pestis
auaaaaaagauaauaaaac

SEQ ID NO: 2284356 - RNA, 21 nt, Yersinia pestis
aguuuuucauuauuugauaua

SEQ ID NO: 2284357 - RNA, 17 nt, Yersinia pestis
aguugguaaaauauuuu

SEQ ID NO: 2284358 - RNA, 17 nt, Yersinia pestis
aguuggugcuuuggaac

SEQ ID NO: 2284359 - RNA, 18 nt, Yersinia pestis
aguuguaaugaauucaga

SEQ ID NO: 2284360 - RNA, 19 nt, Yersinia pestis
auaaacuucacaaugcaca

SEQ ID NO: 2284361 - RNA, 17 nt, Yersinia pestis
auaaagaauaaugggua

SEQ ID NO: 2284362 - RNA, 20 nt, Yersinia pestis
auaaacugaaguuaaaaagc

SEQ ID NO: 2284363 - RNA, 17 nt, Yersinia pestis
auaaacugugcccuuga

SEQ ID NO: 2284364 - RNA, 16 nt, Yersinia pestis
auaaacuucacaaugc

SEQ ID NO: 2284365 - RNA, 16 nt, Yersinia pestis
auaaaggcaaaagcau

SEQ ID NO: 2284366 - RNA, 20 nt, Yersinia pestis
auaaacaucaugacaaaaau

SEQ ID NO: 2284367 - RNA, 15 nt, Yersinia pestis
auaaacagacuaaaa

SEQ ID NO: 2284368 - RNA, 18 nt, Yersinia pestis
auaaacgcgaguuaggaa

SEQ ID NO: 2284369 - RNA, 23 nt, Yersinia pestis
auaaacgggugcaguaacauaau

SEQ ID NO: 2284370 - RNA, 15 nt, Yersinia pestis
auaaacgccuccgau

SEQ ID NO: 2284371 - RNA, 20 nt, Yersinia pestis
auaaauauucauuaaaaaau

SEQ ID NO: 2284372 - RNA, 16 nt, Yersinia pestis
auaaaggcgagucagc

SEQ ID NO: 2284373 - RNA, 15 nt, Yersinia pestis
auaaaguuuuuccuc

SEQ ID NO: 2284374 - RNA, 16 nt, Yersinia pestis
auaaauaaaauaauaa

SEQ ID NO: 2284375 - RNA, 21 nt, Yersinia pestis
auaaauucuugcgcuucauca

SEQ ID NO: 2284376 - RNA, 22 nt, Yersinia pestis
auaaauugcccgcguaaucucu

SEQ ID NO: 2284377 - RNA, 20 nt, Yersinia pestis
auaaauucacagcgcgacaa

SEQ ID NO: 2284378 - RNA, 23 nt, Yersinia pestis
auaaauucaaauaucauuauuuu

SEQ ID NO: 2284379 - RNA, 22 nt, Yersinia pestis
auaaaugaccaacuguaaaauc

SEQ ID NO: 2284380 - RNA, 21 nt, Yersinia pestis
auaaaugacuaucccuucaau

SEQ ID NO: 2284381 - RNA, 15 nt, Yersinia pestis
auaaauggcauuuuu

SEQ ID NO: 2284382 - RNA, 13 nt, Yersinia pestis
auaaaugcucucg

SEQ ID NO: 2284383 - RNA, 19 nt, Yersinia pestis
auaaauuaaaacugaaaag

SEQ ID NO: 2284384 - RNA, 15 nt, Yersinia pestis
auaaauuaaaacuga

SEQ ID NO: 2284385 - RNA, 14 nt, Yersinia pestis
auaaauuaaaaaga

SEQ ID NO: 2284386 - RNA, 17 nt, Yersinia pestis
auaaauggucaguuuaa

SEQ ID NO: 2284387 - RNA, 18 nt, Yersinia pestis
auaaauggucaguuuaau

SEQ ID NO: 2284388 - RNA, 16 nt, Yersinia pestis
auaaaugucgcuaaua

SEQ ID NO: 2284389 - RNA, 15 nt, Yersinia pestis
aaaacucaaacugau

SEQ ID NO: 2284390 - RNA, 14 nt, Yersinia pestis
aaaacucaaagauu

SEQ ID NO: 2284391 - RNA, 15 nt, Yersinia pestis
aaaacucaaauagau

SEQ ID NO: 2284392 - RNA, 23 nt, Yersinia pestis
aaaacgugaaacgccuccucuug

SEQ ID NO: 2284393 - RNA, 16 nt, Yersinia pestis
aaaacgugaaagcacg

SEQ ID NO: 2284394 - RNA, 20 nt, Yersinia pestis
aucauaaugguaccggcacc

SEQ ID NO: 2284395 - RNA, 20 nt, Yersinia pestis
aucaugaauaggauagacag

SEQ ID NO: 2284396 - RNA, 22 nt, Yersinia pestis
aucaugaauaggauagacagua

SEQ ID NO: 2284397 - RNA, 22 nt, Yersinia pestis
aucaugaacggauacccagcac

SEQ ID NO: 2284398 - RNA, 18 nt, Yersinia pestis
aucaugaugaucaagaua

SEQ ID NO: 2284399 - RNA, 21 nt, Yersinia pestis
aucaugaguaaaagauucaua

SEQ ID NO: 2284400 - RNA, 21 nt, Yersinia pestis
aucaucugguuuuuuuauaaa

SEQ ID NO: 2284401 - RNA, 14 nt, Yersinia pestis
aucaucuacaacau

SEQ ID NO: 2284402 - RNA, 17 nt, Yersinia pestis
aucaucgguaccgccag

SEQ ID NO: 2284403 - RNA, 20 nt, Yersinia pestis
aucaucugcgguaaccaaua

SEQ ID NO: 2284404 - RNA, 18 nt, Yersinia pestis
aaaacucgcgccugaaau

SEQ ID NO: 2284405 - RNA, 23 nt, Yersinia pestis
aucauguaaggcaauaccaauau

SEQ ID NO: 2284406 - RNA, 13 nt, Yersinia pestis
aaaacugaaaagu

SEQ ID NO: 2284407 - RNA, 15 nt, Yersinia pestis
aaaacucucgaaaau

SEQ ID NO: 2284408 - RNA, 23 nt, Yersinia pestis
aaaacucgcgccugaaaucauuu

SEQ ID NO: 2284409 - RNA, 18 nt, Yersinia pestis
aaaacugaagcaucaaua

SEQ ID NO: 2284410 - RNA, 12 nt, Yersinia pestis
aaaacugagguc

SEQ ID NO: 2284411 - RNA, 20 nt, Yersinia pestis
aaaacugauauaaagcauuu

SEQ ID NO: 2284412 - RNA, 17 nt, Yersinia pestis
aucaugggccaauccaa

SEQ ID NO: 2284413 - RNA, 21 nt, Yersinia pestis
aucauggcuugugcagcaaua

SEQ ID NO: 2284414 - RNA, 14 nt, Yersinia pestis
aucaugggccaauc

SEQ ID NO: 2284415 - RNA, 15 nt, Yersinia pestis
aucaugcucugcuaa

SEQ ID NO: 2284416 - RNA, 22 nt, Yersinia pestis
aaaagaauaaaugucacuugcc

SEQ ID NO: 2284417 - RNA, 19 nt, Yersinia pestis
aucauugagaucaguucag

SEQ ID NO: 2284418 - RNA, 16 nt, Yersinia pestis
aucauucugucaucaa

SEQ ID NO: 2284419 - RNA, 23 nt, Yersinia pestis
aucccacccugaaggcugauuaa

SEQ ID NO: 2284420 - RNA, 16 nt, Yersinia pestis
aucccacgcagauacu

SEQ ID NO: 2284421 - RNA, 16 nt, Yersinia pestis
aucccauuaaugagua

SEQ ID NO: 2284422 - RNA, 15 nt, Yersinia pestis
auccccaccaacaca

SEQ ID NO: 2284423 - RNA, 19 nt, Yersinia pestis
auccccaaacgcugaccau

SEQ ID NO: 2284424 - RNA, 23 nt, Yersinia pestis
auccauguaggcucgagccgcgc

SEQ ID NO: 2284425 - RNA, 13 nt, Yersinia pestis
auccauguauauu

SEQ ID NO: 2284426 - RNA, 14 nt, Yersinia pestis
aucccaagagaacg

SEQ ID NO: 2284427 - RNA, 22 nt, Yersinia pestis
auccaucugaugaguguuuauu

SEQ ID NO: 2284428 - RNA, 23 nt, Yersinia pestis
auccaugccauggcgaaaauccu

SEQ ID NO: 2284429 - RNA, 21 nt, Yersinia pestis
auccauccccgccucaaugca

SEQ ID NO: 2284430 - RNA, 15 nt, Yersinia pestis
auccagugaaaucau

SEQ ID NO: 2284431 - RNA, 17 nt, Yersinia pestis
auccagugaaaucauca

SEQ ID NO: 2284432 - RNA, 14 nt, Yersinia pestis
auccagugccaacc

SEQ ID NO: 2284433 - RNA, 24 nt, Yersinia pestis
auccaguuucaguggcuucucuuc

SEQ ID NO: 2284434 - RNA, 18 nt, Yersinia pestis
auccauacgaauuuuucc

SEQ ID NO: 2284435 - RNA, 21 nt, Yersinia pestis
auccauagugauuauuuaaac

SEQ ID NO: 2284436 - RNA, 21 nt, Yersinia pestis
auccauauuuggcauguucac

SEQ ID NO: 2284437 - RNA, 22 nt, Yersinia pestis
auccauauuuggcauguucaca

SEQ ID NO: 2284438 - RNA, 10 nt, Yersinia pestis
auccagcagc

SEQ ID NO: 2284439 - RNA, 21 nt, Yersinia pestis
auccagcguaaacaguagcag

SEQ ID NO: 2284440 - RNA, 16 nt, Yersinia pestis
auccagcuacgcaggc

SEQ ID NO: 2284441 - RNA, 15 nt, Yersinia pestis
auccacucuugcacu

SEQ ID NO: 2284442 - RNA, 19 nt, Yersinia pestis
auccacuagcaucacccgc

SEQ ID NO: 2284443 - RNA, 14 nt, Yersinia pestis
auccaauucaguac

SEQ ID NO: 2284444 - RNA, 23 nt, Yersinia pestis
auccaacuuaccuugauccgcca

SEQ ID NO: 2284445 - RNA, 19 nt, Yersinia pestis
auccacacaguauucugcu

SEQ ID NO: 2284446 - RNA, 21 nt, Yersinia pestis
auccacacccucuaucucacc

SEQ ID NO: 2284447 - RNA, 12 nt, Yersinia pestis
auccacagcaug

SEQ ID NO: 2284448 - RNA, 23 nt, Yersinia pestis
auccacauauauagagaaaucua

SEQ ID NO: 2284449 - RNA, 14 nt, Yersinia pestis
auccacauaaaaag

SEQ ID NO: 2284450 - RNA, 16 nt, Yersinia pestis
auccaaagauaucuuu

SEQ ID NO: 2284451 - RNA, 15 nt, Yersinia pestis
aucauugcucuggau

SEQ ID NO: 2284452 - RNA, 14 nt, Yersinia pestis
auccaacucaccau

SEQ ID NO: 2284453 - RNA, 21 nt, Yersinia pestis
auccaacguaaacauuggcuu

SEQ ID NO: 2284454 - RNA, 15 nt, Yersinia pestis
auccaaaugacacuu

SEQ ID NO: 2284455 - RNA, 14 nt, Yersinia pestis
aucgaaaaaaauac

SEQ ID NO: 2284456 - RNA, 20 nt, Yersinia pestis
aucgaaaaaaauacuaucau

SEQ ID NO: 2284457 - RNA, 23 nt, Yersinia pestis
aucgagaguugcucacccauuuu

SEQ ID NO: 2284458 - RNA, 18 nt, Yersinia pestis
aucgagaguugcucaccc

SEQ ID NO: 2284459 - RNA, 23 nt, Yersinia pestis
aucgauuccgcgagcaauaccaa

SEQ ID NO: 2284460 - RNA, 20 nt, Yersinia pestis
aucgaucuggauauauuuac

SEQ ID NO: 2284461 - RNA, 22 nt, Yersinia pestis
aucgaugacagcauuauauuau

SEQ ID NO: 2284462 - RNA, 19 nt, Yersinia pestis
aucgcacuguacacacagu

SEQ ID NO: 2284463 - RNA, 17 nt, Yersinia pestis
aucgccagucuuucggc

SEQ ID NO: 2284464 - RNA, 16 nt, Yersinia pestis
aucgccaguguugcca

SEQ ID NO: 2284465 - RNA, 16 nt, Yersinia pestis
aucgcaguaauagaaa

SEQ ID NO: 2284466 - RNA, 19 nt, Yersinia pestis
aucgcgaugcgccuguuag

SEQ ID NO: 2284467 - RNA, 17 nt, Yersinia pestis
aucgcgacgaaaaccua

SEQ ID NO: 2284468 - RNA, 17 nt, Yersinia pestis
aucgcggguuuuuaacu

SEQ ID NO: 2284469 - RNA, 23 nt, Yersinia pestis
aucgcgguaaucccgauauaaau

SEQ ID NO: 2284470 - RNA, 17 nt, Yersinia pestis
aucgcgcauuucuucuc

SEQ ID NO: 2284471 - RNA, 19 nt, Yersinia pestis
aucgcguucagagcagcau

SEQ ID NO: 2284472 - RNA, 11 nt, Yersinia pestis
aucgcuguaug

SEQ ID NO: 2284473 - RNA, 15 nt, Yersinia pestis
aucgcuguaugguau

SEQ ID NO: 2284474 - RNA, 12 nt, Yersinia pestis
aucgcuaaaaag

SEQ ID NO: 2284475 - RNA, 22 nt, Yersinia pestis
aucgccugaucacguaaacaau

SEQ ID NO: 2284476 - RNA, 22 nt, Yersinia pestis
aucgccuggcuugaccuugccu

SEQ ID NO: 2284477 - RNA, 22 nt, Yersinia pestis
aucgccugggcgagaguuuuca

SEQ ID NO: 2284478 - RNA, 22 nt, Yersinia pestis
aucgccguagauuuaaccccaa

SEQ ID NO: 2284479 - RNA, 17 nt, Yersinia pestis
aucgccgccgccagccc

SEQ ID NO: 2284480 - RNA, 16 nt, Yersinia pestis
auccuuuacuccccug

SEQ ID NO: 2284481 - RNA, 23 nt, Yersinia pestis
auccuuuacuccccugccuauuc

SEQ ID NO: 2284482 - RNA, 16 nt, Yersinia pestis
auccugcaacccacgc

SEQ ID NO: 2284483 - RNA, 15 nt, Yersinia pestis
auccucgagauguau

SEQ ID NO: 2284484 - RNA, 21 nt, Yersinia pestis
auccuaucuuuacccacgggu

SEQ ID NO: 2284485 - RNA, 21 nt, Yersinia pestis
auccucagagcucgcuaguca

SEQ ID NO: 2284486 - RNA, 13 nt, Yersinia pestis
auccucaguaaaa

SEQ ID NO: 2284487 - RNA, 21 nt, Yersinia pestis
auccugaauaauacugucaaa

SEQ ID NO: 2284488 - RNA, 15 nt, Yersinia pestis
auccugaauccccgc

SEQ ID NO: 2284489 - RNA, 15 nt, Yersinia pestis
auccucuucuucuug

SEQ ID NO: 2284490 - RNA, 18 nt, Yersinia pestis
auccucuacguauuucgu

SEQ ID NO: 2284491 - RNA, 17 nt, Yersinia pestis
auccucugaauaaaaaa

SEQ ID NO: 2284492 - RNA, 18 nt, Yersinia pestis
auccucgucguaauauuu

SEQ ID NO: 2284493 - RNA, 19 nt, Yersinia pestis
auccucggguuuuauaccg

SEQ ID NO: 2284494 - RNA, 13 nt, Yersinia pestis
auccguagacauu

SEQ ID NO: 2284495 - RNA, 17 nt, Yersinia pestis
auccguguauuuaucaa

SEQ ID NO: 2284496 - RNA, 18 nt, Yersinia pestis
auccguguauuuaucaaa

SEQ ID NO: 2284497 - RNA, 15 nt, Yersinia pestis
auccguaaaaaaccu

SEQ ID NO: 2284498 - RNA, 17 nt, Yersinia pestis
auccuacaauaucuucc

SEQ ID NO: 2284499 - RNA, 18 nt, Yersinia pestis
auccuagcguuucuacaa

SEQ ID NO: 2284500 - RNA, 15 nt, Yersinia pestis
auccccuuucugcuc

SEQ ID NO: 2284501 - RNA, 20 nt, Yersinia pestis
auccccugccguuggcauau

SEQ ID NO: 2284502 - RNA, 21 nt, Yersinia pestis
auccccaggugcuuauuuauu

SEQ ID NO: 2284503 - RNA, 13 nt, Yersinia pestis
aucccgauauaaa

SEQ ID NO: 2284504 - RNA, 13 nt, Yersinia pestis
aucccgagacacu

SEQ ID NO: 2284505 - RNA, 17 nt, Yersinia pestis
auccgggaaaaaauacg

SEQ ID NO: 2284506 - RNA, 21 nt, Yersinia pestis
aucuaauagaauagaucccau

SEQ ID NO: 2284507 - RNA, 16 nt, Yersinia pestis
aucuaauuuauaaccu

SEQ ID NO: 2284508 - RNA, 11 nt, Yersinia pestis
aucuacgggca

SEQ ID NO: 2284509 - RNA, 18 nt, Yersinia pestis
aucuacuuuauucaauac

SEQ ID NO: 2284510 - RNA, 16 nt, Yersinia pestis
aucuauucucuguaau

SEQ ID NO: 2284511 - RNA, 23 nt, Yersinia pestis
aucuauuguauauaccugucaua

SEQ ID NO: 2284512 - RNA, 17 nt, Yersinia pestis
aucuauuaggcaguucc

SEQ ID NO: 2284513 - RNA, 12 nt, Yersinia pestis
aucguuuuaugg

SEQ ID NO: 2284514 - RNA, 17 nt, Yersinia pestis
aucuaaaauaucuuuca

SEQ ID NO: 2284515 - RNA, 17 nt, Yersinia pestis
aucuaaacaauugccuu

SEQ ID NO: 2284516 - RNA, 19 nt, Yersinia pestis
aucuaaacaauugccuuug

SEQ ID NO: 2284517 - RNA, 20 nt, Yersinia pestis
aucuaacuggcccucuuuuu

SEQ ID NO: 2284518 - RNA, 23 nt, Yersinia pestis
aucgugauugguaaacugccaau

SEQ ID NO: 2284519 - RNA, 16 nt, Yersinia pestis
aucgugaauaaaaaua

SEQ ID NO: 2284520 - RNA, 17 nt, Yersinia pestis
aucgugaauaaaaauaa

SEQ ID NO: 2284521 - RNA, 17 nt, Yersinia pestis
aucguuauaauauuaaa

SEQ ID NO: 2284522 - RNA, 18 nt, Yersinia pestis
aucguccggucugaagag

SEQ ID NO: 2284523 - RNA, 15 nt, Yersinia pestis
aucguccagcagcag

SEQ ID NO: 2284524 - RNA, 13 nt, Yersinia pestis
aucguccagcagc

SEQ ID NO: 2284525 - RNA, 16 nt, Yersinia pestis
aucgcuucugaacgua

SEQ ID NO: 2284526 - RNA, 15 nt, Yersinia pestis
aucggcaaaaacagu

SEQ ID NO: 2284527 - RNA, 23 nt, Yersinia pestis
aucggauggucauccacaaccag

SEQ ID NO: 2284528 - RNA, 20 nt, Yersinia pestis
aucggcaaaccgaauaccau

SEQ ID NO: 2284529 - RNA, 23 nt, Yersinia pestis
aucucggggccacgguuggccgu

SEQ ID NO: 2284530 - RNA, 20 nt, Yersinia pestis
aucucuaacagggaugaaua

SEQ ID NO: 2284531 - RNA, 14 nt, Yersinia pestis
aucucuucagcaau

SEQ ID NO: 2284532 - RNA, 19 nt, Yersinia pestis
aucucuucagcaauuuuua

SEQ ID NO: 2284533 - RNA, 20 nt, Yersinia pestis
aucucuacgcacuuaaugcc

SEQ ID NO: 2284534 - RNA, 16 nt, Yersinia pestis
aucucuaucaauauau

SEQ ID NO: 2284535 - RNA, 19 nt, Yersinia pestis
aucucuaucaauauauacc

SEQ ID NO: 2284536 - RNA, 20 nt, Yersinia pestis
aucucuaucguuuggcaauu

SEQ ID NO: 2284537 - RNA, 15 nt, Yersinia pestis
aucucuccagccugc

SEQ ID NO: 2284538 - RNA, 16 nt, Yersinia pestis
aucuauuuccaucaaa

SEQ ID NO: 2284539 - RNA, 17 nt, Yersinia pestis
aucuauuuccaucaaag

SEQ ID NO: 2284540 - RNA, 21 nt, Yersinia pestis
aucuauuuuuauuucuccuua

SEQ ID NO: 2284541 - RNA, 19 nt, Yersinia pestis
aucuauuuuuuugaaauuc

SEQ ID NO: 2284542 - RNA, 17 nt, Yersinia pestis
aucucccgcaaagccug

SEQ ID NO: 2284543 - RNA, 15 nt, Yersinia pestis
aucuccgcggguucu

SEQ ID NO: 2284544 - RNA, 15 nt, Yersinia pestis
aucuccauugauuca

SEQ ID NO: 2284545 - RNA, 16 nt, Yersinia pestis
aucuccaguaaaucua

SEQ ID NO: 2284546 - RNA, 21 nt, Yersinia pestis
aucucuugauuaccaauaauu

SEQ ID NO: 2284547 - RNA, 22 nt, Yersinia pestis
aucugacugcuugccaaauaua

SEQ ID NO: 2284548 - RNA, 14 nt, Yersinia pestis
aucugagccuucaa

SEQ ID NO: 2284549 - RNA, 16 nt, Yersinia pestis
aucugauaucucuuua

SEQ ID NO: 2284550 - RNA, 19 nt, Yersinia pestis
aucugauaucucuuuauca

SEQ ID NO: 2284551 - RNA, 18 nt, Yersinia pestis
aucugauaucucuuuauc

SEQ ID NO: 2284552 - RNA, 15 nt, Yersinia pestis
aucugauacugaacg

SEQ ID NO: 2284553 - RNA, 13 nt, Yersinia pestis
aucugaugagugu

SEQ ID NO: 2284554 - RNA, 14 nt, Yersinia pestis
aucugaucaaucuc

SEQ ID NO: 2284555 - RNA, 15 nt, Yersinia pestis
aucugcauuaaaaua

SEQ ID NO: 2284556 - RNA, 17 nt, Yersinia pestis
aucugcauuaaaauaac

SEQ ID NO: 2284557 - RNA, 18 nt, Yersinia pestis
aucugcauuaaaauaaca

SEQ ID NO: 2284558 - RNA, 13 nt, Yersinia pestis
aucuggaauuuau

SEQ ID NO: 2284559 - RNA, 21 nt, Yersinia pestis
aucugcuuuacugcuuuucua

SEQ ID NO: 2284560 - RNA, 19 nt, Yersinia pestis
aucugccaccgcuccuuuc

SEQ ID NO: 2284561 - RNA, 16 nt, Yersinia pestis
aucugcauugauuaaa

SEQ ID NO: 2284562 - RNA, 15 nt, Yersinia pestis
aucugcauugauuaa

SEQ ID NO: 2284563 - RNA, 20 nt, Yersinia pestis
augagauucaggagauagcc

SEQ ID NO: 2284564 - RNA, 16 nt, Yersinia pestis
augagaugaacacaga

SEQ ID NO: 2284565 - RNA, 13 nt, Yersinia pestis
augagaaguaaaa

SEQ ID NO: 2284566 - RNA, 17 nt, Yersinia pestis
augacgcgaucuugaac

SEQ ID NO: 2284567 - RNA, 16 nt, Yersinia pestis
augacaccuuucaaaa

SEQ ID NO: 2284568 - RNA, 22 nt, Yersinia pestis
augacacauauuucaggcuguu

SEQ ID NO: 2284569 - RNA, 23 nt, Yersinia pestis
augacaaguugucuguaauaaua

SEQ ID NO: 2284570 - RNA, 14 nt, Yersinia pestis
augacacaauuccc

SEQ ID NO: 2284571 - RNA, 19 nt, Yersinia pestis
augacaaguugucuguaau

SEQ ID NO: 2284572 - RNA, 20 nt, Yersinia pestis
augaccaacuguaaaaucuu

SEQ ID NO: 2284573 - RNA, 17 nt, Yersinia pestis
augaccaagguuauaca

SEQ ID NO: 2284574 - RNA, 20 nt, Yersinia pestis
augaccacuggugaaagaaa

SEQ ID NO: 2284575 - RNA, 15 nt, Yersinia pestis
augaccaauagucac

SEQ ID NO: 2284576 - RNA, 18 nt, Yersinia pestis
augaccgugacauuuuca

SEQ ID NO: 2284577 - RNA, 13 nt, Yersinia pestis
augaccaucaacu

SEQ ID NO: 2284578 - RNA, 17 nt, Yersinia pestis
augaccauuuauuucca

SEQ ID NO: 2284579 - RNA, 23 nt, Yersinia pestis
augaccccgcgugcgcaucaaug

SEQ ID NO: 2284580 - RNA, 19 nt, Yersinia pestis
augaaaaaccuccggcuau

SEQ ID NO: 2284581 - RNA, 16 nt, Yersinia pestis
augaaaaaaagaagaa

SEQ ID NO: 2284582 - RNA, 11 nt, Yersinia pestis
augaagaccug

SEQ ID NO: 2284583 - RNA, 12 nt, Yersinia pestis
augaagaaauac

SEQ ID NO: 2284584 - RNA, 20 nt, Yersinia pestis
augaaaggcggugaacagua

SEQ ID NO: 2284585 - RNA, 13 nt, Yersinia pestis
augaauuaaagau

SEQ ID NO: 2284586 - RNA, 12 nt, Yersinia pestis
augaauuaucaa

SEQ ID NO: 2284587 - RNA, 17 nt, Yersinia pestis
augaauaugcuucauca

SEQ ID NO: 2284588 - RNA, 15 nt, Yersinia pestis
augaauauuauucag

SEQ ID NO: 2284589 - RNA, 15 nt, Yersinia pestis
augaauaaagggggu

SEQ ID NO: 2284590 - RNA, 23 nt, Yersinia pestis
augaauaaaggggguuuuccccu

SEQ ID NO: 2284591 - RNA, 11 nt, Yersinia pestis
aucuuugcuuc

SEQ ID NO: 2284592 - RNA, 20 nt, Yersinia pestis
aucuuugauuuaaauauuau

SEQ ID NO: 2284593 - RNA, 21 nt, Yersinia pestis
aucuuucugacuaacucuucu

SEQ ID NO: 2284594 - RNA, 22 nt, Yersinia pestis
aucuuucuccaguaaaagaaua

SEQ ID NO: 2284595 - RNA, 13 nt, Yersinia pestis
aucuuuuuguaau

SEQ ID NO: 2284596 - RNA, 15 nt, Yersinia pestis
aucuuuaaauuauug

SEQ ID NO: 2284597 - RNA, 23 nt, Yersinia pestis
aucuugugaugcauauuauuaau

SEQ ID NO: 2284598 - RNA, 16 nt, Yersinia pestis
aucuuguuaauuuaaa

SEQ ID NO: 2284599 - RNA, 23 nt, Yersinia pestis
aucuuguucaccaauuugcaaag

SEQ ID NO: 2284600 - RNA, 23 nt, Yersinia pestis
aucuugucauuaccaaugguuuc

SEQ ID NO: 2284601 - RNA, 22 nt, Yersinia pestis
aucuugucgucacccauuuuac

SEQ ID NO: 2284602 - RNA, 19 nt, Yersinia pestis
aucuugggcgggaucucca

SEQ ID NO: 2284603 - RNA, 16 nt, Yersinia pestis
aucuuguaguaaccac

SEQ ID NO: 2284604 - RNA, 12 nt, Yersinia pestis
aucuucuacuua

SEQ ID NO: 2284605 - RNA, 19 nt, Yersinia pestis
aucuucuacuuacgagcua

SEQ ID NO: 2284606 - RNA, 20 nt, Yersinia pestis
aucuugcagcgaucacagau

SEQ ID NO: 2284607 - RNA, 22 nt, Yersinia pestis
aucuugauucguuuucggugca

SEQ ID NO: 2284608 - RNA, 18 nt, Yersinia pestis
aucuugaacggugaggau

SEQ ID NO: 2284609 - RNA, 19 nt, Yersinia pestis
aucuugaaccaauuuuucu

SEQ ID NO: 2284610 - RNA, 12 nt, Yersinia pestis
auacuaaaacag

SEQ ID NO: 2284611 - RNA, 13 nt, Yersinia pestis
auacuaaaacagc

SEQ ID NO: 2284612 - RNA, 13 nt, Yersinia pestis
auacguugcaggu

SEQ ID NO: 2284613 - RNA, 17 nt, Yersinia pestis
auacguucguagccacg

SEQ ID NO: 2284614 - RNA, 17 nt, Yersinia pestis
auacuaacgaaucccac

SEQ ID NO: 2284615 - RNA, 19 nt, Yersinia pestis
auacuaaagaaauaaucau

SEQ ID NO: 2284616 - RNA, 12 nt, Yersinia pestis
auacuaaagaaa

SEQ ID NO: 2284617 - RNA, 15 nt, Yersinia pestis
auaccgacaucaaca

SEQ ID NO: 2284618 - RNA, 13 nt, Yersinia pestis
auaccuacccuuu

SEQ ID NO: 2284619 - RNA, 15 nt, Yersinia pestis
auacgguagcaauac

SEQ ID NO: 2284620 - RNA, 18 nt, Yersinia pestis
auacgguucaaaucaguu

SEQ ID NO: 2284621 - RNA, 14 nt, Yersinia pestis
auacgguccagcau

SEQ ID NO: 2284622 - RNA, 15 nt, Yersinia pestis
auacggucaaaagcu

SEQ ID NO: 2284623 - RNA, 16 nt, Yersinia pestis
auacgucuccauuuca

SEQ ID NO: 2284624 - RNA, 21 nt, Yersinia pestis
auacgugccaaaaugccuacc

SEQ ID NO: 2284625 - RNA, 16 nt, Yersinia pestis
auacguguaaaaccuu

SEQ ID NO: 2284626 - RNA, 16 nt, Yersinia pestis
auagaaucugcugcaa

SEQ ID NO: 2284627 - RNA, 17 nt, Yersinia pestis
auagaauggcuuuaccg

SEQ ID NO: 2284628 - RNA, 15 nt, Yersinia pestis
auagaagagaggcaa

SEQ ID NO: 2284629 - RNA, 17 nt, Yersinia pestis
auagacauauuguccaa

SEQ ID NO: 2284630 - RNA, 14 nt, Yersinia pestis
auagaccccuucuu

SEQ ID NO: 2284631 - RNA, 15 nt, Yersinia pestis
auagacgaaggcacg

SEQ ID NO: 2284632 - RNA, 14 nt, Yersinia pestis
auagaccguagaaa

SEQ ID NO: 2284633 - RNA, 20 nt, Yersinia pestis
auacuuaagucaaauuuaaa

SEQ ID NO: 2284634 - RNA, 15 nt, Yersinia pestis
auacuuaacaaucag

SEQ ID NO: 2284635 - RNA, 23 nt, Yersinia pestis
auacuuaacaaucagugcaauaa

SEQ ID NO: 2284636 - RNA, 15 nt, Yersinia pestis
auaauucgugaaaac

SEQ ID NO: 2284637 - RNA, 22 nt, Yersinia pestis
auaauucgcaugguuaaaacuc

SEQ ID NO: 2284638 - RNA, 18 nt, Yersinia pestis
auacaggugucaucaagg

SEQ ID NO: 2284639 - RNA, 21 nt, Yersinia pestis
auacaggugucaucaaggcaa

SEQ ID NO: 2284640 - RNA, 15 nt, Yersinia pestis
auaauuccaugaaaa

SEQ ID NO: 2284641 - RNA, 20 nt, Yersinia pestis
auaauucaugcuaauaccac

SEQ ID NO: 2284642 - RNA, 12 nt, Yersinia pestis
auaauucauuuu

SEQ ID NO: 2284643 - RNA, 15 nt, Yersinia pestis
auaauucauaugaca

SEQ ID NO: 2284644 - RNA, 13 nt, Yersinia pestis
auaauucagcauc

SEQ ID NO: 2284645 - RNA, 20 nt, Yersinia pestis
auacagucaauugagaauaa

SEQ ID NO: 2284646 - RNA, 15 nt, Yersinia pestis
auacaguuccuguuu

SEQ ID NO: 2284647 - RNA, 17 nt, Yersinia pestis
auacauagaagcucaua

SEQ ID NO: 2284648 - RNA, 13 nt, Yersinia pestis
auacauuauuauu

SEQ ID NO: 2284649 - RNA, 17 nt, Yersinia pestis
auacauggcgaucacca

SEQ ID NO: 2284650 - RNA, 18 nt, Yersinia pestis
auacauggcgaucaccag

SEQ ID NO: 2284651 - RNA, 12 nt, Yersinia pestis
auacauuuccau

SEQ ID NO: 2284652 - RNA, 22 nt, Yersinia pestis
auacaugccucugcuaacaaca

SEQ ID NO: 2284653 - RNA, 20 nt, Yersinia pestis
auacaucaagcuacaugugc

SEQ ID NO: 2284654 - RNA, 13 nt, Yersinia pestis
auacaucacguua

SEQ ID NO: 2284655 - RNA, 19 nt, Yersinia pestis
auacauccauguaggcucg

SEQ ID NO: 2284656 - RNA, 15 nt, Yersinia pestis
auaccauaacgcugc

SEQ ID NO: 2284657 - RNA, 22 nt, Yersinia pestis
auaccauuucuuauaucuguuu

SEQ ID NO: 2284658 - RNA, 13 nt, Yersinia pestis
auaccauuuugcc

SEQ ID NO: 2284659 - RNA, 20 nt, Yersinia pestis
auacccagcuucuuuuaaag

SEQ ID NO: 2284660 - RNA, 24 nt, Yersinia pestis
auacccacuaauacucuguuacca

SEQ ID NO: 2284661 - RNA, 14 nt, Yersinia pestis
auacccaaaccaac

SEQ ID NO: 2284662 - RNA, 19 nt, Yersinia pestis
auacccuaucgacuucacg

SEQ ID NO: 2284663 - RNA, 16 nt, Yersinia pestis
auacccuucaucuuuc

SEQ ID NO: 2284664 - RNA, 23 nt, Yersinia pestis
auacccugguuuaccauccgacu

SEQ ID NO: 2284665 - RNA, 14 nt, Yersinia pestis
auacccguaauauu

SEQ ID NO: 2284666 - RNA, 15 nt, Yersinia pestis
auaccaaaaaucucu

SEQ ID NO: 2284667 - RNA, 19 nt, Yersinia pestis
auaccaacucugaaguaaa

SEQ ID NO: 2284668 - RNA, 17 nt, Yersinia pestis
auaccaauucuucaucu

SEQ ID NO: 2284669 - RNA, 22 nt, Yersinia pestis
auaccagagacgugcguuuuug

SEQ ID NO: 2284670 - RNA, 14 nt, Yersinia pestis
auaccagaugcaua

SEQ ID NO: 2284671 - RNA, 20 nt, Yersinia pestis
auaccacaucaaaccggcua

SEQ ID NO: 2284672 - RNA, 14 nt, Yersinia pestis
auaccaccaccaca

SEQ ID NO: 2284673 - RNA, 20 nt, Yersinia pestis
auagguaucauuuuccugca

SEQ ID NO: 2284674 - RNA, 14 nt, Yersinia pestis
auaggucauauaca

SEQ ID NO: 2284675 - RNA, 23 nt, Yersinia pestis
auaggugucucgcccacagucac

SEQ ID NO: 2284676 - RNA, 18 nt, Yersinia pestis
auagguuggggaugccau

SEQ ID NO: 2284677 - RNA, 13 nt, Yersinia pestis
auaggcuauuuua

SEQ ID NO: 2284678 - RNA, 16 nt, Yersinia pestis
auaggcucaaugcgaa

SEQ ID NO: 2284679 - RNA, 16 nt, Yersinia pestis
auaggcgaaaggcgca

SEQ ID NO: 2284680 - RNA, 15 nt, Yersinia pestis
auaggcgcauaugaa

SEQ ID NO: 2284681 - RNA, 17 nt, Yersinia pestis
auaggcgcauaugaaaa

SEQ ID NO: 2284682 - RNA, 22 nt, Yersinia pestis
auaggcgcauaugaaaaaccuc

SEQ ID NO: 2284683 - RNA, 17 nt, Yersinia pestis
auaguauaaauaccugu

SEQ ID NO: 2284684 - RNA, 13 nt, Yersinia pestis
auagucaucuuuc

SEQ ID NO: 2284685 - RNA, 18 nt, Yersinia pestis
auagucacgucuucacca

SEQ ID NO: 2284686 - RNA, 11 nt, Yersinia pestis
auaguaacccu

SEQ ID NO: 2284687 - RNA, 13 nt, Yersinia pestis
auaguaaaacagg

SEQ ID NO: 2284688 - RNA, 15 nt, Yersinia pestis
auaguagaucuauua

SEQ ID NO: 2284689 - RNA, 17 nt, Yersinia pestis
auaguacguagcgauaa

SEQ ID NO: 2284690 - RNA, 14 nt, Yersinia pestis
auagcuuucuccuu

SEQ ID NO: 2284691 - RNA, 17 nt, Yersinia pestis
auagcugucagcgaaaa

SEQ ID NO: 2284692 - RNA, 15 nt, Yersinia pestis
auagcuggcuuucgc

SEQ ID NO: 2284693 - RNA, 17 nt, Yersinia pestis
auagcgcugcaucagca

SEQ ID NO: 2284694 - RNA, 20 nt, Yersinia pestis
auagcggcguucagcaauau

SEQ ID NO: 2284695 - RNA, 22 nt, Yersinia pestis
auaggauaagggccauuuugcu

SEQ ID NO: 2284696 - RNA, 15 nt, Yersinia pestis
auaggcagaggaagu

SEQ ID NO: 2284697 - RNA, 13 nt, Yersinia pestis
auaggcagaggag

SEQ ID NO: 2284698 - RNA, 13 nt, Yersinia pestis
auaggauuuucau

SEQ ID NO: 2284699 - RNA, 16 nt, Yersinia pestis
auagccauauuuuaaa

SEQ ID NO: 2284700 - RNA, 23 nt, Yersinia pestis
auagccccauauaaaaaacuaau

SEQ ID NO: 2284701 - RNA, 17 nt, Yersinia pestis
auagcccaaagcaauaa

SEQ ID NO: 2284702 - RNA, 22 nt, Yersinia pestis
auagagcuucgcgaucagacau

SEQ ID NO: 2284703 - RNA, 20 nt, Yersinia pestis
auagagacggaaagagccag

SEQ ID NO: 2284704 - RNA, 23 nt, Yersinia pestis
auagagacggaaagagccagcac

SEQ ID NO: 2284705 - RNA, 16 nt, Yersinia pestis
auagagauacuuccuu

SEQ ID NO: 2284706 - RNA, 19 nt, Yersinia pestis
auagcccucguuguuguau

SEQ ID NO: 2284707 - RNA, 23 nt, Yersinia pestis
auagcccucguuguuguaugaca

SEQ ID NO: 2284708 - RNA, 19 nt, Yersinia pestis
auagcgcaauucagccuca

SEQ ID NO: 2284709 - RNA, 14 nt, Yersinia pestis
auagcgcaccaccg

SEQ ID NO: 2284710 - RNA, 23 nt, Yersinia pestis
auaucaauaagugcaaacuuaaa

SEQ ID NO: 2284711 - RNA, 16 nt, Yersinia pestis
auaucacaguuaaaaa

SEQ ID NO: 2284712 - RNA, 21 nt, Yersinia pestis
auaucagaaacaauaaauauc

SEQ ID NO: 2284713 - RNA, 17 nt, Yersinia pestis
auaucagaaacaauaaa

SEQ ID NO: 2284714 - RNA, 13 nt, Yersinia pestis
auaucacuucugc

SEQ ID NO: 2284715 - RNA, 15 nt, Yersinia pestis
auaucauguucuuug

SEQ ID NO: 2284716 - RNA, 10 nt, Yersinia pestis
auauccuccg

SEQ ID NO: 2284717 - RNA, 17 nt, Yersinia pestis
auauccgccaaagauua

SEQ ID NO: 2284718 - RNA, 14 nt, Yersinia pestis
auauccaaaauaau

SEQ ID NO: 2284719 - RNA, 20 nt, Yersinia pestis
auauccagcaacgaauaaaa

SEQ ID NO: 2284720 - RNA, 23 nt, Yersinia pestis
auauccagcaacgaauaaaaaag

SEQ ID NO: 2284721 - RNA, 22 nt, Yersinia pestis
auaucaagacucaguaaauaua

SEQ ID NO: 2284722 - RNA, 19 nt, Yersinia pestis
auauauucuguuguaacca

SEQ ID NO: 2284723 - RNA, 16 nt, Yersinia pestis
auaucaacacugccug

SEQ ID NO: 2284724 - RNA, 19 nt, Yersinia pestis
auauauuaaaugagaauaa

SEQ ID NO: 2284725 - RNA, 21 nt, Yersinia pestis
auauauacccguaauauuuca

SEQ ID NO: 2284726 - RNA, 12 nt, Yersinia pestis
auauaaauaaaa

SEQ ID NO: 2284727 - RNA, 14 nt, Yersinia pestis
auauaaauaaaaua

SEQ ID NO: 2284728 - RNA, 13 nt, Yersinia pestis
auauaaauccagc

SEQ ID NO: 2284729 - RNA, 17 nt, Yersinia pestis
auaguuaaucgcagcag

SEQ ID NO: 2284730 - RNA, 14 nt, Yersinia pestis
auauaaauuuaaua

SEQ ID NO: 2284731 - RNA, 20 nt, Yersinia pestis
auauaacaaguuacauuuuu

SEQ ID NO: 2284732 - RNA, 17 nt, Yersinia pestis
auauaacagccauuuau

SEQ ID NO: 2284733 - RNA, 14 nt, Yersinia pestis
auauaaccaucaaa

SEQ ID NO: 2284734 - RNA, 18 nt, Yersinia pestis
auagucuccaaauucauu

SEQ ID NO: 2284735 - RNA, 18 nt, Yersinia pestis
auaguguguguauuuaaa

SEQ ID NO: 2284736 - RNA, 20 nt, Yersinia pestis
auaguguguguauuuaaaag

SEQ ID NO: 2284737 - RNA, 14 nt, Yersinia pestis
auagugggcuaaaa

SEQ ID NO: 2284738 - RNA, 19 nt, Yersinia pestis
auagugggucguggaguag

SEQ ID NO: 2284739 - RNA, 13 nt, Yersinia pestis
auauagagcucag

SEQ ID NO: 2284740 - RNA, 17 nt, Yersinia pestis
auauacagucaauugag

SEQ ID NO: 2284741 - RNA, 17 nt, Yersinia pestis
auauagcaaucauuuau

SEQ ID NO: 2284742 - RNA, 22 nt, Yersinia pestis
auauagcggcguucagcaauau

SEQ ID NO: 2284743 - RNA, 23 nt, Yersinia pestis
auauaggccauguacuuaauacu

SEQ ID NO: 2284744 - RNA, 16 nt, Yersinia pestis
auauaggguauaugcc

SEQ ID NO: 2284745 - RNA, 14 nt, Yersinia pestis
aucaaaaaauaaau

SEQ ID NO: 2284746 - RNA, 17 nt, Yersinia pestis
auauuucuuagagagag

SEQ ID NO: 2284747 - RNA, 15 nt, Yersinia pestis
auauuugagauauag

SEQ ID NO: 2284748 - RNA, 23 nt, Yersinia pestis
auauuuuuggggucugaauauaa

SEQ ID NO: 2284749 - RNA, 13 nt, Yersinia pestis
auauuuuuaaucu

SEQ ID NO: 2284750 - RNA, 16 nt, Yersinia pestis
auauuuauuaauucuu

SEQ ID NO: 2284751 - RNA, 16 nt, Yersinia pestis
auauuuaauuuaaaua

SEQ ID NO: 2284752 - RNA, 14 nt, Yersinia pestis
auauuuauuaaaac

SEQ ID NO: 2284753 - RNA, 14 nt, Yersinia pestis
auauuuauaaaaaa

SEQ ID NO: 2284754 - RNA, 14 nt, Yersinia pestis
auauucuuguugua

SEQ ID NO: 2284755 - RNA, 16 nt, Yersinia pestis
aucaaaggagugcccg

SEQ ID NO: 2284756 - RNA, 22 nt, Yersinia pestis
aucaaagugcuuaacccaccaa

SEQ ID NO: 2284757 - RNA, 23 nt, Yersinia pestis
aucaacucgccacccgcuuucag

SEQ ID NO: 2284758 - RNA, 17 nt, Yersinia pestis
aucaacgcucaaucacg

SEQ ID NO: 2284759 - RNA, 18 nt, Yersinia pestis
aucaacccgcagacugaa

SEQ ID NO: 2284760 - RNA, 17 nt, Yersinia pestis
aucaaccauucauacug

SEQ ID NO: 2284761 - RNA, 20 nt, Yersinia pestis
aucaacguagcugaauugcu

SEQ ID NO: 2284762 - RNA, 18 nt, Yersinia pestis
aucaaccaagacauaaug

SEQ ID NO: 2284763 - RNA, 21 nt, Yersinia pestis
aucaaccacgguuuaaucaau

SEQ ID NO: 2284764 - RNA, 14 nt, Yersinia pestis
aucaacauuuuuag

SEQ ID NO: 2284765 - RNA, 15 nt, Yersinia pestis
aucaacauacugaua

SEQ ID NO: 2284766 - RNA, 20 nt, Yersinia pestis
auaugucagauagaccaaug

SEQ ID NO: 2284767 - RNA, 14 nt, Yersinia pestis
auaugucaccucca

SEQ ID NO: 2284768 - RNA, 20 nt, Yersinia pestis
auauguagggguacagcagg

SEQ ID NO: 2284769 - RNA, 15 nt, Yersinia pestis
auauggguuaaaaac

SEQ ID NO: 2284770 - RNA, 19 nt, Yersinia pestis
auauggcggcaucagcaaa

SEQ ID NO: 2284771 - RNA, 19 nt, Yersinia pestis
auauguugggaaauaacca

SEQ ID NO: 2284772 - RNA, 16 nt, Yersinia pestis
auauguucuuccugug

SEQ ID NO: 2284773 - RNA, 17 nt, Yersinia pestis
auauccugcucagcuaa

SEQ ID NO: 2284774 - RNA, 18 nt, Yersinia pestis
auauccuguggccuuaau

SEQ ID NO: 2284775 - RNA, 14 nt, Yersinia pestis
auaugccaggcauc

SEQ ID NO: 2284776 - RNA, 21 nt, Yersinia pestis
auaugcugauaaaauucguuu

SEQ ID NO: 2284777 - RNA, 17 nt, Yersinia pestis
auaugcgcgucaaucca

SEQ ID NO: 2284778 - RNA, 22 nt, Yersinia pestis
auauuaaaugcauuauaaggaa

SEQ ID NO: 2284779 - RNA, 15 nt, Yersinia pestis
auauuaaaugcauua

SEQ ID NO: 2284780 - RNA, 12 nt, Yersinia pestis
auauuaacauau

SEQ ID NO: 2284781 - RNA, 18 nt, Yersinia pestis
auauuaacauaucaauaa

SEQ ID NO: 2284782 - RNA, 21 nt, Yersinia pestis
auauuacggcccuccugacga

SEQ ID NO: 2284783 - RNA, 22 nt, Yersinia pestis
auauuacgcagccauacccaaa

SEQ ID NO: 2284784 - RNA, 18 nt, Yersinia pestis
auauuacggcccuccuga

SEQ ID NO: 2284785 - RNA, 16 nt, Yersinia pestis
auauuacgcagccaua

SEQ ID NO: 2284786 - RNA, 16 nt, Yersinia pestis
auauuacaguuuaauu

SEQ ID NO: 2284787 - RNA, 15 nt, Yersinia pestis
auauuauuaaugaaa

SEQ ID NO: 2284788 - RNA, 15 nt, Yersinia pestis
auauuauuagccaaa

SEQ ID NO: 2284789 - RNA, 22 nt, Yersinia pestis
auauuauuuaucaaucagcuga

SEQ ID NO: 2284790 - RNA, 13 nt, Yersinia pestis
auauuauuuauuu

SEQ ID NO: 2284791 - RNA, 13 nt, Yersinia pestis
auauuauuuaauu

SEQ ID NO: 2284792 - RNA, 21 nt, Yersinia pestis
auauuauuuacaaaccacauu

SEQ ID NO: 2284793 - RNA, 20 nt, Yersinia pestis
auauucgcagccaaaauaau

SEQ ID NO: 2284794 - RNA, 14 nt, Yersinia pestis
auauucgcagccaa

SEQ ID NO: 2284795 - RNA, 13 nt, Yersinia pestis
auauuauuuugca

SEQ ID NO: 2284796 - RNA, 16 nt, Yersinia pestis
aucagcguuuuauucg

SEQ ID NO: 2284797 - RNA, 20 nt, Yersinia pestis
aucagcguauagcgccgcca

SEQ ID NO: 2284798 - RNA, 19 nt, Yersinia pestis
aucagcguuuuaaucacau

SEQ ID NO: 2284799 - RNA, 21 nt, Yersinia pestis
aucagcgguugggcuaaccag

SEQ ID NO: 2284800 - RNA, 18 nt, Yersinia pestis
aucagcgguaucuagagc

SEQ ID NO: 2284801 - RNA, 22 nt, Yersinia pestis
aucagcggggcauucauuucuu

SEQ ID NO: 2284802 - RNA, 13 nt, Yersinia pestis
aucagcgaaaaau

SEQ ID NO: 2284803 - RNA, 20 nt, Yersinia pestis
aucagcgaccaaauggacga

SEQ ID NO: 2284804 - RNA, 20 nt, Yersinia pestis
aucagccgcggcgcuggcau

SEQ ID NO: 2284805 - RNA, 16 nt, Yersinia pestis
aucagcccauugcugu

SEQ ID NO: 2284806 - RNA, 23 nt, Yersinia pestis
aucagaauaaggcuuaccgccug

SEQ ID NO: 2284807 - RNA, 17 nt, Yersinia pestis
aucagaaacagcaggug

SEQ ID NO: 2284808 - RNA, 16 nt, Yersinia pestis
aucacuuauuggaagu

SEQ ID NO: 2284809 - RNA, 19 nt, Yersinia pestis
aucacugauucagaaaggu

SEQ ID NO: 2284810 - RNA, 20 nt, Yersinia pestis
aucacuggcaauaauucaga

SEQ ID NO: 2284811 - RNA, 19 nt, Yersinia pestis
aucagcccaucuuugauuu

SEQ ID NO: 2284812 - RNA, 23 nt, Yersinia pestis
aucagcccaucuuugauuuaaau

SEQ ID NO: 2284813 - RNA, 16 nt, Yersinia pestis
aucagcacuccccgcc

SEQ ID NO: 2284814 - RNA, 16 nt, Yersinia pestis
aaaacgaguaaauaca

SEQ ID NO: 2284815 - RNA, 16 nt, Yersinia pestis
aucaguucguucccug

SEQ ID NO: 2284816 - RNA, 19 nt, Yersinia pestis
aucaggcuuauauuuaugc

SEQ ID NO: 2284817 - RNA, 14 nt, Yersinia pestis
aucaguaccaccac

SEQ ID NO: 2284818 - RNA, 23 nt, Yersinia pestis
aucaguaccaccaccacaaacag

SEQ ID NO: 2284819 - RNA, 16 nt, Yersinia pestis
aucacucuguacguaa

SEQ ID NO: 2284820 - RNA, 16 nt, Yersinia pestis
aucacugacugagcgu

SEQ ID NO: 2284821 - RNA, 18 nt, Yersinia pestis
aucacugaugagcuggca

SEQ ID NO: 2284822 - RNA, 23 nt, Yersinia pestis
aucacuauuucguguauaucacu

SEQ ID NO: 2284823 - RNA, 14 nt, Yersinia pestis
aucacuauuucagg

SEQ ID NO: 2284824 - RNA, 16 nt, Yersinia pestis
aucacuauuucagaca

SEQ ID NO: 2284825 - RNA, 17 nt, Yersinia pestis
aucacuagggggcaauu

SEQ ID NO: 2284826 - RNA, 15 nt, Yersinia pestis
aucaccugucaccug

SEQ ID NO: 2284827 - RNA, 23 nt, Yersinia pestis
aucaccuuccgucccaagaaaag

SEQ ID NO: 2284828 - RNA, 18 nt, Yersinia pestis
aucaccuuggaaaacagc

SEQ ID NO: 2284829 - RNA, 14 nt, Yersinia pestis
aucaccagacaacc

SEQ ID NO: 2284830 - RNA, 18 nt, Yersinia pestis
aucaccauaacugcugcu

SEQ ID NO: 2284831 - RNA, 16 nt, Yersinia pestis
aucacccgccucuaaa

SEQ ID NO: 2284832 - RNA, 15 nt, Yersinia pestis
aucaccugacaccaa

SEQ ID NO: 2284833 - RNA, 23 nt, Yersinia pestis
aucacccggccaucuucagaaac

SEQ ID NO: 2284834 - RNA, 15 nt, Yersinia pestis
aucacccgcaaaacu

SEQ ID NO: 2284835 - RNA, 14 nt, Yersinia pestis
aucaccauugacca

SEQ ID NO: 2284836 - RNA, 12 nt, Yersinia pestis
aucacccagcaa

SEQ ID NO: 2284837 - RNA, 11 nt, Yersinia pestis
aucaccccuuc

SEQ ID NO: 2284838 - RNA, 14 nt, Yersinia pestis
aucaccccccugcc

SEQ ID NO: 2284839 - RNA, 16 nt, Yersinia pestis
aucacaauacagcaaa

SEQ ID NO: 2284840 - RNA, 14 nt, Yersinia pestis
aucacaaugcaaau

SEQ ID NO: 2284841 - RNA, 20 nt, Yersinia pestis
aucacaacguuggguaaucg

SEQ ID NO: 2284842 - RNA, 13 nt, Yersinia pestis
aucacaaaaguca

SEQ ID NO: 2284843 - RNA, 22 nt, Yersinia pestis
aucacaucucggcguaaacaau

SEQ ID NO: 2284844 - RNA, 22 nt, Yersinia pestis
aucacaucgcccugcucuucug

SEQ ID NO: 2284845 - RNA, 17 nt, Yersinia pestis
aucacaugacugaacau

SEQ ID NO: 2284846 - RNA, 16 nt, Yersinia pestis
aucacaugcggauuga

SEQ ID NO: 2284847 - RNA, 20 nt, Yersinia pestis
aucacauuucgguuugucau

SEQ ID NO: 2284848 - RNA, 15 nt, Yersinia pestis
aucacauaaauaagu

SEQ ID NO: 2284849 - RNA, 13 nt, Yersinia pestis
aucacauaaauaa

SEQ ID NO: 2284850 - RNA, 13 nt, Yersinia pestis
aucacagcaaauu

SEQ ID NO: 2284851 - RNA, 15 nt, Yersinia pestis
aucacaguuaaaaau

SEQ ID NO: 2284852 - RNA, 16 nt, Yersinia pestis
aucacaguuaaaaaua

SEQ ID NO: 2284853 - RNA, 20 nt, Yersinia pestis
aucacaccgcgaucacaaua

SEQ ID NO: 2284854 - RNA, 9 nt, Yersinia pestis
caagucccg

SEQ ID NO: 2284855 - RNA, 14 nt, Yersinia pestis
caagugaacgaggc

SEQ ID NO: 2284856 - RNA, 15 nt, Yersinia pestis
caagucuugaagagu

SEQ ID NO: 2284857 - RNA, 22 nt, Yersinia pestis
caaguguuaguuuuaauaacuu

SEQ ID NO: 2284858 - RNA, 15 nt, Yersinia pestis
caaguguaaaagaua

SEQ ID NO: 2284859 - RNA, 19 nt, Yersinia pestis
caaggcagcaagcaaacga

SEQ ID NO: 2284860 - RNA, 17 nt, Yersinia pestis
caagucagugauucggg

SEQ ID NO: 2284861 - RNA, 16 nt, Yersinia pestis
caagcuuggccccuua

SEQ ID NO: 2284862 - RNA, 22 nt, Yersinia pestis
caagcuuaguauccgcgccaga

SEQ ID NO: 2284863 - RNA, 23 nt, Yersinia pestis
caagcuuaguauccgcgccagac

SEQ ID NO: 2284864 - RNA, 13 nt, Yersinia pestis
caagcugcucaau

SEQ ID NO: 2284865 - RNA, 20 nt, Yersinia pestis
caauaauaaaaaaaaauaaa

SEQ ID NO: 2284866 - RNA, 19 nt, Yersinia pestis
caauaauaacgaauuucau

SEQ ID NO: 2284867 - RNA, 17 nt, Yersinia pestis
caauaauaaaaaaaaau

SEQ ID NO: 2284868 - RNA, 19 nt, Yersinia pestis
caauaauaaaaaaaaauaa

SEQ ID NO: 2284869 - RNA, 19 nt, Yersinia pestis
caauaagugaaacaaauac

SEQ ID NO: 2284870 - RNA, 22 nt, Yersinia pestis
caauaagugcaaacuuaaaaau

SEQ ID NO: 2284871 - RNA, 17 nt, Yersinia pestis
caauaaggugccacaca

SEQ ID NO: 2284872 - RNA, 12 nt, Yersinia pestis
caauacagcaaa

SEQ ID NO: 2284873 - RNA, 15 nt, Yersinia pestis
caauacagcaaauag

SEQ ID NO: 2284874 - RNA, 12 nt, Yersinia pestis
caaguuaaauac

SEQ ID NO: 2284875 - RNA, 23 nt, Yersinia pestis
caaguuaaauacugcacguuuaa

SEQ ID NO: 2284876 - RNA, 18 nt, Yersinia pestis
caaguucugccccugacu

SEQ ID NO: 2284877 - RNA, 20 nt, Yersinia pestis
caauaaacagacuaaaaacc

SEQ ID NO: 2284878 - RNA, 21 nt, Yersinia pestis
caauaaacagacuaaaaaccg

SEQ ID NO: 2284879 - RNA, 19 nt, Yersinia pestis
caauaaacagacuaaaaac

SEQ ID NO: 2284880 - RNA, 19 nt, Yersinia pestis
caauaaagcgauaaauacu

SEQ ID NO: 2284881 - RNA, 15 nt, Yersinia pestis
caauaaaauuaccca

SEQ ID NO: 2284882 - RNA, 21 nt, Yersinia pestis
caauaaaauuacccagcaucu

SEQ ID NO: 2284883 - RNA, 19 nt, Yersinia pestis
caauaaaaccuuuauguaa

SEQ ID NO: 2284884 - RNA, 14 nt, Yersinia pestis
caaucgauuccugu

SEQ ID NO: 2284885 - RNA, 18 nt, Yersinia pestis
caaucgucuucggucaua

SEQ ID NO: 2284886 - RNA, 15 nt, Yersinia pestis
caaucuagaacuauu

SEQ ID NO: 2284887 - RNA, 15 nt, Yersinia pestis
caaucuaacuaauaa

SEQ ID NO: 2284888 - RNA, 17 nt, Yersinia pestis
caaucagugcaauaaau

SEQ ID NO: 2284889 - RNA, 16 nt, Yersinia pestis
caauccaauuuaccac

SEQ ID NO: 2284890 - RNA, 20 nt, Yersinia pestis
caauccaaccuauauagccc

SEQ ID NO: 2284891 - RNA, 13 nt, Yersinia pestis
caauccaaaugac

SEQ ID NO: 2284892 - RNA, 16 nt, Yersinia pestis
caaucccaaagcuuau

SEQ ID NO: 2284893 - RNA, 22 nt, Yersinia pestis
caaucagacggaauaccacccc

SEQ ID NO: 2284894 - RNA, 11 nt, Yersinia pestis
caaucacugcg

SEQ ID NO: 2284895 - RNA, 19 nt, Yersinia pestis
caaucacuuuauacgcuuu

SEQ ID NO: 2284896 - RNA, 18 nt, Yersinia pestis
caaucaggaaauuaccac

SEQ ID NO: 2284897 - RNA, 18 nt, Yersinia pestis
caaucagcgcgaaaccac

SEQ ID NO: 2284898 - RNA, 19 nt, Yersinia pestis
caaucagccgcaucacuga

SEQ ID NO: 2284899 - RNA, 22 nt, Yersinia pestis
caauacguguagccaaaguggc

SEQ ID NO: 2284900 - RNA, 16 nt, Yersinia pestis
caauacggauucagcg

SEQ ID NO: 2284901 - RNA, 23 nt, Yersinia pestis
caauauaccggggaagagauaaa

SEQ ID NO: 2284902 - RNA, 18 nt, Yersinia pestis
caauauccauauuaaaug

SEQ ID NO: 2284903 - RNA, 19 nt, Yersinia pestis
caauaucaaaacuccauca

SEQ ID NO: 2284904 - RNA, 14 nt, Yersinia pestis
caaucaacauaaau

SEQ ID NO: 2284905 - RNA, 16 nt, Yersinia pestis
caaucaauaagcuaca

SEQ ID NO: 2284906 - RNA, 23 nt, Yersinia pestis
caaucaaucaccauaacugcugc

SEQ ID NO: 2284907 - RNA, 15 nt, Yersinia pestis
caaucaaaaaauaaa

SEQ ID NO: 2284908 - RNA, 18 nt, Yersinia pestis
caaucaaaaaauaaauua

SEQ ID NO: 2284909 - RNA, 16 nt, Yersinia pestis
caaucacaaccccccc

SEQ ID NO: 2284910 - RNA, 14 nt, Yersinia pestis
caaucacaucaccg

SEQ ID NO: 2284911 - RNA, 23 nt, Yersinia pestis
caaucaccggcuggcauuuuuau

SEQ ID NO: 2284912 - RNA, 14 nt, Yersinia pestis
caaucaccaccucc

SEQ ID NO: 2284913 - RNA, 13 nt, Yersinia pestis
caagauaaaguuc

SEQ ID NO: 2284914 - RNA, 18 nt, Yersinia pestis
caagacuuuccacaacag

SEQ ID NO: 2284915 - RNA, 17 nt, Yersinia pestis
caagauauuacuucuuu

SEQ ID NO: 2284916 - RNA, 18 nt, Yersinia pestis
caagauaccgaguucuca

SEQ ID NO: 2284917 - RNA, 13 nt, Yersinia pestis
caagaucccaagc

SEQ ID NO: 2284918 - RNA, 21 nt, Yersinia pestis
caagaucgcgucaucgggguu

SEQ ID NO: 2284919 - RNA, 22 nt, Yersinia pestis
caagaucgcgucaucgggguuu

SEQ ID NO: 2284920 - RNA, 22 nt, Yersinia pestis
caagaauauaauacgaaauacu

SEQ ID NO: 2284921 - RNA, 22 nt, Yersinia pestis
caagaagcgggcggccucugcu

SEQ ID NO: 2284922 - RNA, 20 nt, Yersinia pestis
caacuucaauaccaaauuua

SEQ ID NO: 2284923 - RNA, 14 nt, Yersinia pestis
caacuucaagccga

SEQ ID NO: 2284924 - RNA, 17 nt, Yersinia pestis
caacuucaugacgaaaa

SEQ ID NO: 2284925 - RNA, 23 nt, Yersinia pestis
caacuucaugacgaaaaacaccu

SEQ ID NO: 2284926 - RNA, 20 nt, Yersinia pestis
caacuuccagugccaauuga

SEQ ID NO: 2284927 - RNA, 23 nt, Yersinia pestis
caagacaacaaacaguaacccag

SEQ ID NO: 2284928 - RNA, 19 nt, Yersinia pestis
caagcauacguugccagcc

SEQ ID NO: 2284929 - RNA, 19 nt, Yersinia pestis
caagcagugucagggcaau

SEQ ID NO: 2284930 - RNA, 24 nt, Yersinia pestis
caagcagugucagggcaauaacaa

SEQ ID NO: 2284931 - RNA, 14 nt, Yersinia pestis
caagaugauaaaua

SEQ ID NO: 2284932 - RNA, 20 nt, Yersinia pestis
caagaugccuauuugcagaa

SEQ ID NO: 2284933 - RNA, 16 nt, Yersinia pestis
caagccaaacaaauga

SEQ ID NO: 2284934 - RNA, 16 nt, Yersinia pestis
caagccaacccccauu

SEQ ID NO: 2284935 - RNA, 19 nt, Yersinia pestis
caagccaauauuacggccc

SEQ ID NO: 2284936 - RNA, 17 nt, Yersinia pestis
caagccaccgcuggugg

SEQ ID NO: 2284937 - RNA, 14 nt, Yersinia pestis
caagccaauggcca

SEQ ID NO: 2284938 - RNA, 19 nt, Yersinia pestis
caagccgauaaucaauuug

SEQ ID NO: 2284939 - RNA, 21 nt, Yersinia pestis
caagccuaacaaacugaaugg

SEQ ID NO: 2284940 - RNA, 22 nt, Yersinia pestis
caagccgcuuaucucggggcca

SEQ ID NO: 2284941 - RNA, 13 nt, Yersinia pestis
caagcuacaugug

SEQ ID NO: 2284942 - RNA, 19 nt, Yersinia pestis
caagcuacaugugcauuga

SEQ ID NO: 2284943 - RNA, 20 nt, Yersinia pestis
caagcucgccaucgcaccaa

SEQ ID NO: 2284944 - RNA, 20 nt, Yersinia pestis
caagcucucacccaauaaga

SEQ ID NO: 2284945 - RNA, 16 nt, Yersinia pestis
caagccugugcuaaau

SEQ ID NO: 2284946 - RNA, 21 nt, Yersinia pestis
caagccugugcuaaaucccag

SEQ ID NO: 2284947 - RNA, 23 nt, Yersinia pestis
caagccuucauucaauugaucua

SEQ ID NO: 2284948 - RNA, 20 nt, Yersinia pestis
caaccucggucugaauaaga

SEQ ID NO: 2284949 - RNA, 16 nt, Yersinia pestis
caaccucagccucauu

SEQ ID NO: 2284950 - RNA, 18 nt, Yersinia pestis
caacgcgcagugccguca

SEQ ID NO: 2284951 - RNA, 15 nt, Yersinia pestis
caaccuauauagccc

SEQ ID NO: 2284952 - RNA, 13 nt, Yersinia pestis
caaccuaaaaaaa

SEQ ID NO: 2284953 - RNA, 18 nt, Yersinia pestis
caaccuaaaaaaaacaac

SEQ ID NO: 2284954 - RNA, 15 nt, Yersinia pestis
caaccguuaacgggc

SEQ ID NO: 2284955 - RNA, 18 nt, Yersinia pestis
caacgcuaugcagcccag

SEQ ID NO: 2284956 - RNA, 23 nt, Yersinia pestis
caacgcuccgguuuucaccccca

SEQ ID NO: 2284957 - RNA, 14 nt, Yersinia pestis
caacggacacauaa

SEQ ID NO: 2284958 - RNA, 18 nt, Yersinia pestis
caacggagagaacaggca

SEQ ID NO: 2284959 - RNA, 20 nt, Yersinia pestis
caacggagagaacaggcaga

SEQ ID NO: 2284960 - RNA, 19 nt, Yersinia pestis
caacgguagguucaaccca

SEQ ID NO: 2284961 - RNA, 17 nt, Yersinia pestis
caacggcccaauauuga

SEQ ID NO: 2284962 - RNA, 21 nt, Yersinia pestis
caacggcccaauauugaucca

SEQ ID NO: 2284963 - RNA, 18 nt, Yersinia pestis
caacggcacaucccaaua

SEQ ID NO: 2284964 - RNA, 19 nt, Yersinia pestis
caacguuuaguaaucaaua

SEQ ID NO: 2284965 - RNA, 15 nt, Yersinia pestis
caacguuaaagauga

SEQ ID NO: 2284966 - RNA, 21 nt, Yersinia pestis
caacuauugcaucuuuaauua

SEQ ID NO: 2284967 - RNA, 17 nt, Yersinia pestis
caacucagcggccuggg

SEQ ID NO: 2284968 - RNA, 19 nt, Yersinia pestis
caacucagggcuggcaccg

SEQ ID NO: 2284969 - RNA, 19 nt, Yersinia pestis
caacgugauaugccugaag

SEQ ID NO: 2284970 - RNA, 14 nt, Yersinia pestis
caacgucacuucca

SEQ ID NO: 2284971 - RNA, 14 nt, Yersinia pestis
caacggugaacaga

SEQ ID NO: 2284972 - RNA, 24 nt, Yersinia pestis
caacguaauaucugccaccgcaca

SEQ ID NO: 2284973 - RNA, 13 nt, Yersinia pestis
caacugcucaacu

SEQ ID NO: 2284974 - RNA, 18 nt, Yersinia pestis
caacugcucaacugcuca

SEQ ID NO: 2284975 - RNA, 22 nt, Yersinia pestis
caacugcuggccaacugcgccu

SEQ ID NO: 2284976 - RNA, 13 nt, Yersinia pestis
caacucuucuuua

SEQ ID NO: 2284977 - RNA, 17 nt, Yersinia pestis
caacugccccucuuuuc

SEQ ID NO: 2284978 - RNA, 20 nt, Yersinia pestis
caacucuagcgccagcaauu

SEQ ID NO: 2284979 - RNA, 21 nt, Yersinia pestis
caacucuacauugacuaauua

SEQ ID NO: 2284980 - RNA, 15 nt, Yersinia pestis
caaauaucauuauuu

SEQ ID NO: 2284981 - RNA, 18 nt, Yersinia pestis
caaauaucauuauuuuga

SEQ ID NO: 2284982 - RNA, 19 nt, Yersinia pestis
caaauauugcacaauagcu

SEQ ID NO: 2284983 - RNA, 18 nt, Yersinia pestis
caaauauugaauuaaagu

SEQ ID NO: 2284984 - RNA, 23 nt, Yersinia pestis
caaaguaccgcuuugugaugcac

SEQ ID NO: 2284985 - RNA, 22 nt, Yersinia pestis
caaaguaccuauggcgaagaga

SEQ ID NO: 2284986 - RNA, 14 nt, Yersinia pestis
caaauaguaauaau

SEQ ID NO: 2284987 - RNA, 15 nt, Yersinia pestis
caaauagguuuuacu

SEQ ID NO: 2284988 - RNA, 16 nt, Yersinia pestis
caaauagguuuuacuc

SEQ ID NO: 2284989 - RNA, 18 nt, Yersinia pestis
caaaucaucagacagcca

SEQ ID NO: 2284990 - RNA, 18 nt, Yersinia pestis
caaaucauuuaauuuauc

SEQ ID NO: 2284991 - RNA, 13 nt, Yersinia pestis
caaaucaccuugg

SEQ ID NO: 2284992 - RNA, 17 nt, Yersinia pestis
caaaucacauuucaaau

SEQ ID NO: 2284993 - RNA, 18 nt, Yersinia pestis
caaaucagcaagcugcuc

SEQ ID NO: 2284994 - RNA, 22 nt, Yersinia pestis
caaaucccguuccgcuuccccu

SEQ ID NO: 2284995 - RNA, 22 nt, Yersinia pestis
caaauccuguagcucagccugu

SEQ ID NO: 2284996 - RNA, 21 nt, Yersinia pestis
caaauccucggguuuuauacc

SEQ ID NO: 2284997 - RNA, 15 nt, Yersinia pestis
caaaugucagaucgc

SEQ ID NO: 2284998 - RNA, 14 nt, Yersinia pestis
caaauuuaaaguuu

SEQ ID NO: 2284999 - RNA, 22 nt, Yersinia pestis
caaauuguggaaauaacgcggc

SEQ ID NO: 2285000 - RNA, 17 nt, Yersinia pestis
caaauucucaaugauaa

SEQ ID NO: 2285001 - RNA, 18 nt, Yersinia pestis
caaauucucaaugauaaa

SEQ ID NO: 2285002 - RNA, 14 nt, Yersinia pestis
caaauucaccagca

SEQ ID NO: 2285003 - RNA, 13 nt, Yersinia pestis
caaauguuggaua

SEQ ID NO: 2285004 - RNA, 23 nt, Yersinia pestis
caaauuccgcuucucagucgcga

SEQ ID NO: 2285005 - RNA, 19 nt, Yersinia pestis
caaccgcuugcauacgcuu

SEQ ID NO: 2285006 - RNA, 17 nt, Yersinia pestis
caaccgaccaaaggcca

SEQ ID NO: 2285007 - RNA, 13 nt, Yersinia pestis
caaccggcgcgcu

SEQ ID NO: 2285008 - RNA, 18 nt, Yersinia pestis
caacccggcuguuaaauu

SEQ ID NO: 2285009 - RNA, 22 nt, Yersinia pestis
caacccagacaagaaugccugc

SEQ ID NO: 2285010 - RNA, 18 nt, Yersinia pestis
caacccaauaauaaucca

SEQ ID NO: 2285011 - RNA, 22 nt, Yersinia pestis
caaccauuguggcuaaacccaa

SEQ ID NO: 2285012 - RNA, 23 nt, Yersinia pestis
caaccauuuuauugccagagggc

SEQ ID NO: 2285013 - RNA, 23 nt, Yersinia pestis
caacaugggcaagcucugggcug

SEQ ID NO: 2285014 - RNA, 12 nt, Yersinia pestis
caacaucuucca

SEQ ID NO: 2285015 - RNA, 16 nt, Yersinia pestis
caacaugagccacaca

SEQ ID NO: 2285016 - RNA, 14 nt, Yersinia pestis
caacaugguccaca

SEQ ID NO: 2285017 - RNA, 13 nt, Yersinia pestis
caacauuaaaaau

SEQ ID NO: 2285018 - RNA, 15 nt, Yersinia pestis
caacauccaguucga

SEQ ID NO: 2285019 - RNA, 15 nt, Yersinia pestis
caacaucauauauua

SEQ ID NO: 2285020 - RNA, 11 nt, Yersinia pestis
caacaucaucg

SEQ ID NO: 2285021 - RNA, 13 nt, Yersinia pestis
caacaucaauggc

SEQ ID NO: 2285022 - RNA, 21 nt, Yersinia pestis
caacaucgcuugugcuacauc

SEQ ID NO: 2285023 - RNA, 22 nt, Yersinia pestis
caacaguuauuuuaauugcuga

SEQ ID NO: 2285024 - RNA, 18 nt, Yersinia pestis
caacagcgcucauagcaa

SEQ ID NO: 2285025 - RNA, 18 nt, Yersinia pestis
caacagcguaauaccacu

SEQ ID NO: 2285026 - RNA, 15 nt, Yersinia pestis
caacaguaccuucua

SEQ ID NO: 2285027 - RNA, 17 nt, Yersinia pestis
caacagcaucaucaaau

SEQ ID NO: 2285028 - RNA, 13 nt, Yersinia pestis
caacaaacagccg

SEQ ID NO: 2285029 - RNA, 16 nt, Yersinia pestis
caacaaacucugcgua

SEQ ID NO: 2285030 - RNA, 17 nt, Yersinia pestis
caacaaauucaccagca

SEQ ID NO: 2285031 - RNA, 13 nt, Yersinia pestis
caacaccacacug

SEQ ID NO: 2285032 - RNA, 20 nt, Yersinia pestis
caacaccacacugagcaccg

SEQ ID NO: 2285033 - RNA, 16 nt, Yersinia pestis
caaaaugugaaaagca

SEQ ID NO: 2285034 - RNA, 23 nt, Yersinia pestis
caaaauagaggaaauaaaugacu

SEQ ID NO: 2285035 - RNA, 15 nt, Yersinia pestis
caaaauccaccagcg

SEQ ID NO: 2285036 - RNA, 18 nt, Yersinia pestis
caaaaucccaaaauauga

SEQ ID NO: 2285037 - RNA, 21 nt, Yersinia pestis
caaaauccaccagcgggcggc

SEQ ID NO: 2285038 - RNA, 16 nt, Yersinia pestis
caaaauccgugcuggu

SEQ ID NO: 2285039 - RNA, 12 nt, Yersinia pestis
caaaauacccau

SEQ ID NO: 2285040 - RNA, 16 nt, Yersinia pestis
caaaauacuuaacaau

SEQ ID NO: 2285041 - RNA, 13 nt, Yersinia pestis
caaaagucauguu

SEQ ID NO: 2285042 - RNA, 21 nt, Yersinia pestis
caaaagugacgaaugagcagu

SEQ ID NO: 2285043 - RNA, 18 nt, Yersinia pestis
caaaaggugcaagcagcu

SEQ ID NO: 2285044 - RNA, 22 nt, Yersinia pestis
caaaagcgaucagcaauaugcu

SEQ ID NO: 2285045 - RNA, 14 nt, Yersinia pestis
caaaaggauggccc

SEQ ID NO: 2285046 - RNA, 22 nt, Yersinia pestis
caaaaggccccguaaucauggu

SEQ ID NO: 2285047 - RNA, 20 nt, Yersinia pestis
caaaaagaauuaauaaauau

SEQ ID NO: 2285048 - RNA, 14 nt, Yersinia pestis
caaaaccgugacua

SEQ ID NO: 2285049 - RNA, 15 nt, Yersinia pestis
caaaacgugaaagca

SEQ ID NO: 2285050 - RNA, 13 nt, Yersinia pestis
caaaacgaguaaa

SEQ ID NO: 2285051 - RNA, 16 nt, Yersinia pestis
caaaacgccaccagcg

SEQ ID NO: 2285052 - RNA, 21 nt, Yersinia pestis
caaaacgccaccagcgccaug

SEQ ID NO: 2285053 - RNA, 18 nt, Yersinia pestis
caaaacugaugguuuccu

SEQ ID NO: 2285054 - RNA, 15 nt, Yersinia pestis
caaaacugaagcaag

SEQ ID NO: 2285055 - RNA, 17 nt, Yersinia pestis
caaaagcaaguuaggua

SEQ ID NO: 2285056 - RNA, 23 nt, Yersinia pestis
caaaagcauccaauaccaccaau

SEQ ID NO: 2285057 - RNA, 14 nt, Yersinia pestis
caaaagcaucacca

SEQ ID NO: 2285058 - RNA, 16 nt, Yersinia pestis
caaaccguugcucagc

SEQ ID NO: 2285059 - RNA, 21 nt, Yersinia pestis
caaaccauuuuacuaaaccag

SEQ ID NO: 2285060 - RNA, 21 nt, Yersinia pestis
caaaccacucuuuuuucauag

SEQ ID NO: 2285061 - RNA, 19 nt, Yersinia pestis
caaaccaauuucucggcca

SEQ ID NO: 2285062 - RNA, 19 nt, Yersinia pestis
caaaccacauuuuuuaaaa

SEQ ID NO: 2285063 - RNA, 13 nt, Yersinia pestis
caaacaauccuau

SEQ ID NO: 2285064 - RNA, 16 nt, Yersinia pestis
caaacaaccuaaaaaa

SEQ ID NO: 2285065 - RNA, 17 nt, Yersinia pestis
caaacaaccuaaaaaaa

SEQ ID NO: 2285066 - RNA, 19 nt, Yersinia pestis
caaacaaacgcuugagcuu

SEQ ID NO: 2285067 - RNA, 22 nt, Yersinia pestis
caaacggacuccccgcucggcc

SEQ ID NO: 2285068 - RNA, 17 nt, Yersinia pestis
caaacgggugcgccaau

SEQ ID NO: 2285069 - RNA, 21 nt, Yersinia pestis
caaacggucuguuaauccuaa

SEQ ID NO: 2285070 - RNA, 15 nt, Yersinia pestis
caaacuuuguggaua

SEQ ID NO: 2285071 - RNA, 14 nt, Yersinia pestis
caaacguuuuauuc

SEQ ID NO: 2285072 - RNA, 17 nt, Yersinia pestis
caaacggugugcaaugc

SEQ ID NO: 2285073 - RNA, 20 nt, Yersinia pestis
caaacuguuuuuuaaagaaa

SEQ ID NO: 2285074 - RNA, 14 nt, Yersinia pestis
caaacuuaaaaauc

SEQ ID NO: 2285075 - RNA, 18 nt, Yersinia pestis
caaacuuaaaaaucaaaa

SEQ ID NO: 2285076 - RNA, 19 nt, Yersinia pestis
caaaggcccgcuaucacua

SEQ ID NO: 2285077 - RNA, 23 nt, Yersinia pestis
caaagcgcguaucguccagcagc

SEQ ID NO: 2285078 - RNA, 15 nt, Yersinia pestis
caaagcgcucagcgc

SEQ ID NO: 2285079 - RNA, 16 nt, Yersinia pestis
caaaggaagccgagcu

SEQ ID NO: 2285080 - RNA, 22 nt, Yersinia pestis
caaagccuacgagagaucguag

SEQ ID NO: 2285081 - RNA, 21 nt, Yersinia pestis
caaagccugccauacccgcug

SEQ ID NO: 2285082 - RNA, 22 nt, Yersinia pestis
caaagccgcugcucacauagcg

SEQ ID NO: 2285083 - RNA, 22 nt, Yersinia pestis
caaagauuucaucggcaaaaac

SEQ ID NO: 2285084 - RNA, 14 nt, Yersinia pestis
caaagcaauaaacu

SEQ ID NO: 2285085 - RNA, 23 nt, Yersinia pestis
caaagaauugagguaaaccaagu

SEQ ID NO: 2285086 - RNA, 20 nt, Yersinia pestis
caaagaccacaucaaccuga

SEQ ID NO: 2285087 - RNA, 24 nt, Yersinia pestis
caaagacuaaccucugcaaugccc

SEQ ID NO: 2285088 - RNA, 20 nt, Yersinia pestis
cacccugcgugguauacccu

SEQ ID NO: 2285089 - RNA, 13 nt, Yersinia pestis
cacccuuacccug

SEQ ID NO: 2285090 - RNA, 13 nt, Yersinia pestis
caccgagcaccaa

SEQ ID NO: 2285091 - RNA, 11 nt, Yersinia pestis
cacccgccauc

SEQ ID NO: 2285092 - RNA, 20 nt, Yersinia pestis
cacccauuuuauccucuucc

SEQ ID NO: 2285093 - RNA, 22 nt, Yersinia pestis
cacccauugcucaaacucagca

SEQ ID NO: 2285094 - RNA, 16 nt, Yersinia pestis
cacccauagcucagcu

SEQ ID NO: 2285095 - RNA, 17 nt, Yersinia pestis
cacccauagcucagcug

SEQ ID NO: 2285096 - RNA, 17 nt, Yersinia pestis
caccaguaaacgccaau

SEQ ID NO: 2285097 - RNA, 23 nt, Yersinia pestis
caccagugccaauccccaccaaa

SEQ ID NO: 2285098 - RNA, 17 nt, Yersinia pestis
cacccacgguaucugcu

SEQ ID NO: 2285099 - RNA, 20 nt, Yersinia pestis
cacccaggcugugguggcgg

SEQ ID NO: 2285100 - RNA, 12 nt, Yersinia pestis
cacccagcaaaa

SEQ ID NO: 2285101 - RNA, 20 nt, Yersinia pestis
cacccagcaaaauagcacag

SEQ ID NO: 2285102 - RNA, 18 nt, Yersinia pestis
aaaauaaagggggcaccg

SEQ ID NO: 2285103 - RNA, 16 nt, Yersinia pestis
caccguaucaucacca

SEQ ID NO: 2285104 - RNA, 11 nt, Yersinia pestis
caccuaccacc

SEQ ID NO: 2285105 - RNA, 15 nt, Yersinia pestis
caccuaccaccuacc

SEQ ID NO: 2285106 - RNA, 17 nt, Yersinia pestis
caccuaauacagcacca

SEQ ID NO: 2285107 - RNA, 14 nt, Yersinia pestis
caccuaauacagca

SEQ ID NO: 2285108 - RNA, 17 nt, Yersinia pestis
caccuaaccaaacauug

SEQ ID NO: 2285109 - RNA, 21 nt, Yersinia pestis
caccuaucgccgccgccagcc

SEQ ID NO: 2285110 - RNA, 14 nt, Yersinia pestis
caccuauaauuaac

SEQ ID NO: 2285111 - RNA, 14 nt, Yersinia pestis
caccucaaccugcc

SEQ ID NO: 2285112 - RNA, 15 nt, Yersinia pestis
caccgcgucgccgcu

SEQ ID NO: 2285113 - RNA, 21 nt, Yersinia pestis
caccgcuaaccuuaaccaaca

SEQ ID NO: 2285114 - RNA, 14 nt, Yersinia pestis
caccgcuaucacug

SEQ ID NO: 2285115 - RNA, 23 nt, Yersinia pestis
caccgcuggucgggugcaggcca

SEQ ID NO: 2285116 - RNA, 20 nt, Yersinia pestis
caccgcuguggaaucggccu

SEQ ID NO: 2285117 - RNA, 23 nt, Yersinia pestis
caccgcuuagcaauaccagccga

SEQ ID NO: 2285118 - RNA, 14 nt, Yersinia pestis
caccgcgacuucag

SEQ ID NO: 2285119 - RNA, 21 nt, Yersinia pestis
caccgaguaaacguggcccuu

SEQ ID NO: 2285120 - RNA, 13 nt, Yersinia pestis
caccuucaaccac

SEQ ID NO: 2285121 - RNA, 14 nt, Yersinia pestis
caccuuaaaauaag

SEQ ID NO: 2285122 - RNA, 14 nt, Yersinia pestis
caccugucaccugu

SEQ ID NO: 2285123 - RNA, 16 nt, Yersinia pestis
aaaauacauaucaaca

SEQ ID NO: 2285124 - RNA, 13 nt, Yersinia pestis
cacgaggacaggu

SEQ ID NO: 2285125 - RNA, 20 nt, Yersinia pestis
cacgacaugagcaugccuga

SEQ ID NO: 2285126 - RNA, 23 nt, Yersinia pestis
cacgaucuggcaaaaucccagca

SEQ ID NO: 2285127 - RNA, 21 nt, Yersinia pestis
cacgacaacaaagccgcugcu

SEQ ID NO: 2285128 - RNA, 16 nt, Yersinia pestis
aaaauagccuucccug

SEQ ID NO: 2285129 - RNA, 17 nt, Yersinia pestis
aaaauagaggaaauaaa

SEQ ID NO: 2285130 - RNA, 18 nt, Yersinia pestis
aaaauagauuaaaagucu

SEQ ID NO: 2285131 - RNA, 19 nt, Yersinia pestis
aaaauagauuaaaagucua

SEQ ID NO: 2285132 - RNA, 15 nt, Yersinia pestis
cacgaaaagcagcag

SEQ ID NO: 2285133 - RNA, 15 nt, Yersinia pestis
cacgauuugaucacg

SEQ ID NO: 2285134 - RNA, 13 nt, Yersinia pestis
cacgcaaggccag

SEQ ID NO: 2285135 - RNA, 23 nt, Yersinia pestis
cacgcgagcauaaagcuauucau

SEQ ID NO: 2285136 - RNA, 19 nt, Yersinia pestis
cacgggcuuccaucaggaa

SEQ ID NO: 2285137 - RNA, 13 nt, Yersinia pestis
cacggggaaacag

SEQ ID NO: 2285138 - RNA, 20 nt, Yersinia pestis
cacgggcgguaaucugcggc

SEQ ID NO: 2285139 - RNA, 15 nt, Yersinia pestis
cacggcgcuccauca

SEQ ID NO: 2285140 - RNA, 18 nt, Yersinia pestis
cacggaucucauucagac

SEQ ID NO: 2285141 - RNA, 15 nt, Yersinia pestis
cacggaugaucggca

SEQ ID NO: 2285142 - RNA, 13 nt, Yersinia pestis
cacggauaucaac

SEQ ID NO: 2285143 - RNA, 20 nt, Yersinia pestis
cacggccuaacaacacgcua

SEQ ID NO: 2285144 - RNA, 16 nt, Yersinia pestis
cacggagaauaaaaau

SEQ ID NO: 2285145 - RNA, 18 nt, Yersinia pestis
cacgcuccacacccgcca

SEQ ID NO: 2285146 - RNA, 22 nt, Yersinia pestis
cacgcuccacacccgccaaacc

SEQ ID NO: 2285147 - RNA, 16 nt, Yersinia pestis
cacgcuccacacaaaa

SEQ ID NO: 2285148 - RNA, 13 nt, Yersinia pestis
cacgcguucaauc

SEQ ID NO: 2285149 - RNA, 15 nt, Yersinia pestis
cacauaccacacaca

SEQ ID NO: 2285150 - RNA, 14 nt, Yersinia pestis
cacagcucucugag

SEQ ID NO: 2285151 - RNA, 14 nt, Yersinia pestis
cacagcggcggaua

SEQ ID NO: 2285152 - RNA, 22 nt, Yersinia pestis
cacaucccggcagcaguuguca

SEQ ID NO: 2285153 - RNA, 12 nt, Yersinia pestis
cacauccaaugg

SEQ ID NO: 2285154 - RNA, 22 nt, Yersinia pestis
cacauauuucaggcuguugcgu

SEQ ID NO: 2285155 - RNA, 12 nt, Yersinia pestis
cacaucaauaua

SEQ ID NO: 2285156 - RNA, 14 nt, Yersinia pestis
cacaucaaccugau

SEQ ID NO: 2285157 - RNA, 21 nt, Yersinia pestis
cacaucaaccugaucaucaaa

SEQ ID NO: 2285158 - RNA, 19 nt, Yersinia pestis
cacaucacgcuuaagacgu

SEQ ID NO: 2285159 - RNA, 15 nt, Yersinia pestis
cacaucauaaucggu

SEQ ID NO: 2285160 - RNA, 12 nt, Yersinia pestis
cacaucaggccg

SEQ ID NO: 2285161 - RNA, 13 nt, Yersinia pestis
cacaucauccacu

SEQ ID NO: 2285162 - RNA, 21 nt, Yersinia pestis
caccaaaaaacggauuuccau

SEQ ID NO: 2285163 - RNA, 15 nt, Yersinia pestis
caccaaaacgucgug

SEQ ID NO: 2285164 - RNA, 14 nt, Yersinia pestis
cacauucagucacu

SEQ ID NO: 2285165 - RNA, 17 nt, Yersinia pestis
cacauucaguacauaaa

SEQ ID NO: 2285166 - RNA, 16 nt, Yersinia pestis
cacauuccaguaaaaa

SEQ ID NO: 2285167 - RNA, 15 nt, Yersinia pestis
cacauuuugugugag

SEQ ID NO: 2285168 - RNA, 22 nt, Yersinia pestis
cacaucgcgcuuuuuaggaugu

SEQ ID NO: 2285169 - RNA, 17 nt, Yersinia pestis
cacauucaaacacuuau

SEQ ID NO: 2285170 - RNA, 13 nt, Yersinia pestis
cacauucaggccg

SEQ ID NO: 2285171 - RNA, 18 nt, Yersinia pestis
cacauuacccggccaacc

SEQ ID NO: 2285172 - RNA, 19 nt, Yersinia pestis
caccaaaugcucagccauc

SEQ ID NO: 2285173 - RNA, 17 nt, Yersinia pestis
caccaaaggaagccgag

SEQ ID NO: 2285174 - RNA, 14 nt, Yersinia pestis
caccaacaccacac

SEQ ID NO: 2285175 - RNA, 14 nt, Yersinia pestis
caccaacccgcccc

SEQ ID NO: 2285176 - RNA, 14 nt, Yersinia pestis
caccaacagcauua

SEQ ID NO: 2285177 - RNA, 18 nt, Yersinia pestis
caccaacagcauuaccaa

SEQ ID NO: 2285178 - RNA, 13 nt, Yersinia pestis
caccacaucaucc

SEQ ID NO: 2285179 - RNA, 17 nt, Yersinia pestis
caccacacugagcaccg

SEQ ID NO: 2285180 - RNA, 22 nt, Yersinia pestis
caccacaccggcugcaauaagc

SEQ ID NO: 2285181 - RNA, 15 nt, Yersinia pestis
caccaacuccugccu

SEQ ID NO: 2285182 - RNA, 16 nt, Yersinia pestis
caccaacggccccuca

SEQ ID NO: 2285183 - RNA, 21 nt, Yersinia pestis
aaaagugcuauccucuuaaug

SEQ ID NO: 2285184 - RNA, 15 nt, Yersinia pestis
caccagcagcgccca

SEQ ID NO: 2285185 - RNA, 17 nt, Yersinia pestis
aaaaguggcuaucugaa

SEQ ID NO: 2285186 - RNA, 15 nt, Yersinia pestis
caccagcgccaugau

SEQ ID NO: 2285187 - RNA, 18 nt, Yersinia pestis
caccagcguggcauugag

SEQ ID NO: 2285188 - RNA, 16 nt, Yersinia pestis
aaaauaaaauucguuu

SEQ ID NO: 2285189 - RNA, 16 nt, Yersinia pestis
aaaauaaacaucaaug

SEQ ID NO: 2285190 - RNA, 15 nt, Yersinia pestis
caccaccacaaacag

SEQ ID NO: 2285191 - RNA, 12 nt, Yersinia pestis
caccaccacacc

SEQ ID NO: 2285192 - RNA, 18 nt, Yersinia pestis
caccaccaacccgccccc

SEQ ID NO: 2285193 - RNA, 15 nt, Yersinia pestis
caccaccaccaggcg

SEQ ID NO: 2285194 - RNA, 22 nt, Yersinia pestis
caccacgaaaaaauggcagccc

SEQ ID NO: 2285195 - RNA, 18 nt, Yersinia pestis
caccacgccaauuaccgu

SEQ ID NO: 2285196 - RNA, 21 nt, Yersinia pestis
caccagaucauuuuuuuccac

SEQ ID NO: 2285197 - RNA, 14 nt, Yersinia pestis
caccagagaugaua

SEQ ID NO: 2285198 - RNA, 22 nt, Yersinia pestis
caccagacucugcuaccaggaa

SEQ ID NO: 2285199 - RNA, 18 nt, Yersinia pestis
caccacuaguuaaaacca

SEQ ID NO: 2285200 - RNA, 15 nt, Yersinia pestis
caauggaaaauacac

SEQ ID NO: 2285201 - RNA, 23 nt, Yersinia pestis
caaugcuggcaguggcggcaaaa

SEQ ID NO: 2285202 - RNA, 16 nt, Yersinia pestis
caaugacuuaacugaa

SEQ ID NO: 2285203 - RNA, 15 nt, Yersinia pestis
caaugcucaagugua

SEQ ID NO: 2285204 - RNA, 17 nt, Yersinia pestis
caaugcuccagcaacug

SEQ ID NO: 2285205 - RNA, 19 nt, Yersinia pestis
caaugcuccagcaacugaa

SEQ ID NO: 2285206 - RNA, 21 nt, Yersinia pestis
caaugacuccugaaauaaaga

SEQ ID NO: 2285207 - RNA, 20 nt, Yersinia pestis
caaugaccuuacagugauaa

SEQ ID NO: 2285208 - RNA, 19 nt, Yersinia pestis
caaucuuauugaaaacaag

SEQ ID NO: 2285209 - RNA, 15 nt, Yersinia pestis
caaucuucuucaguc

SEQ ID NO: 2285210 - RNA, 18 nt, Yersinia pestis
caaucuguuccugauucc

SEQ ID NO: 2285211 - RNA, 18 nt, Yersinia pestis
caaugaauccggauccag

SEQ ID NO: 2285212 - RNA, 15 nt, Yersinia pestis
caaugaaucaacaga

SEQ ID NO: 2285213 - RNA, 20 nt, Yersinia pestis
caaugaccacuaaauuaaau

SEQ ID NO: 2285214 - RNA, 16 nt, Yersinia pestis
caaugaccaucuucca

SEQ ID NO: 2285215 - RNA, 17 nt, Yersinia pestis
caaugaccaucuuccag

SEQ ID NO: 2285216 - RNA, 23 nt, Yersinia pestis
caauguaaaacgaguaaauacaa

SEQ ID NO: 2285217 - RNA, 18 nt, Yersinia pestis
caauggugauaaaccuca

SEQ ID NO: 2285218 - RNA, 13 nt, Yersinia pestis
caaugucaccuga

SEQ ID NO: 2285219 - RNA, 15 nt, Yersinia pestis
caaugucaugcaauu

SEQ ID NO: 2285220 - RNA, 22 nt, Yersinia pestis
caauguagacuuggcuuuuucu

SEQ ID NO: 2285221 - RNA, 14 nt, Yersinia pestis
caauggcaccgugc

SEQ ID NO: 2285222 - RNA, 18 nt, Yersinia pestis
caauggauucuugcugca

SEQ ID NO: 2285223 - RNA, 17 nt, Yersinia pestis
caauggccuuagcacgu

SEQ ID NO: 2285224 - RNA, 21 nt, Yersinia pestis
caauggccggacucauuaucc

SEQ ID NO: 2285225 - RNA, 22 nt, Yersinia pestis
caauggcuaauuagaugagugg

SEQ ID NO: 2285226 - RNA, 13 nt, Yersinia pestis
caauggcucaggc

SEQ ID NO: 2285227 - RNA, 14 nt, Yersinia pestis
caauggcuccaccg

SEQ ID NO: 2285228 - RNA, 18 nt, Yersinia pestis
caauggcuggcaaggcac

SEQ ID NO: 2285229 - RNA, 18 nt, Yersinia pestis
caauggcguuauguaaaa

SEQ ID NO: 2285230 - RNA, 21 nt, Yersinia pestis
caaugugauaccuaaaccuuc

SEQ ID NO: 2285231 - RNA, 22 nt, Yersinia pestis
caauguguugaauauccaaugg

SEQ ID NO: 2285232 - RNA, 20 nt, Yersinia pestis
caaugugcguuuauuacgug

SEQ ID NO: 2285233 - RNA, 19 nt, Yersinia pestis
caauguuaaacuuugcuau

SEQ ID NO: 2285234 - RNA, 22 nt, Yersinia pestis
caauucccaaagcgcagugcuc

SEQ ID NO: 2285235 - RNA, 22 nt, Yersinia pestis
caauucccguuagguucaauuc

SEQ ID NO: 2285236 - RNA, 18 nt, Yersinia pestis
caauucgaccguuuuuac

SEQ ID NO: 2285237 - RNA, 12 nt, Yersinia pestis
caauugcuggcu

SEQ ID NO: 2285238 - RNA, 16 nt, Yersinia pestis
caauugcggucagcau

SEQ ID NO: 2285239 - RNA, 16 nt, Yersinia pestis
caauugccugauuuuu

SEQ ID NO: 2285240 - RNA, 17 nt, Yersinia pestis
caauugcccccuaguga

SEQ ID NO: 2285241 - RNA, 14 nt, Yersinia pestis
caauuucauuuacg

SEQ ID NO: 2285242 - RNA, 20 nt, Yersinia pestis
caauuuccccugcuucguag

SEQ ID NO: 2285243 - RNA, 14 nt, Yersinia pestis
caauuuccccugcu

SEQ ID NO: 2285244 - RNA, 18 nt, Yersinia pestis
cacaagucauuggagucg

SEQ ID NO: 2285245 - RNA, 18 nt, Yersinia pestis
cacaauagaugcaguaac

SEQ ID NO: 2285246 - RNA, 22 nt, Yersinia pestis
cacaauagcuaccccuucaguc

SEQ ID NO: 2285247 - RNA, 14 nt, Yersinia pestis
cacaauccaauuua

SEQ ID NO: 2285248 - RNA, 19 nt, Yersinia pestis
cacaauccaauuuaccacu

SEQ ID NO: 2285249 - RNA, 17 nt, Yersinia pestis
cacaauacauagaagcu

SEQ ID NO: 2285250 - RNA, 19 nt, Yersinia pestis
cacaacuuuuauuggcauu

SEQ ID NO: 2285251 - RNA, 21 nt, Yersinia pestis
cacaacugcucguuagucuca

SEQ ID NO: 2285252 - RNA, 17 nt, Yersinia pestis
cacaacugaaugucucu

SEQ ID NO: 2285253 - RNA, 15 nt, Yersinia pestis
cacaacgacagccaa

SEQ ID NO: 2285254 - RNA, 15 nt, Yersinia pestis
cacaacccgauccag

SEQ ID NO: 2285255 - RNA, 22 nt, Yersinia pestis
cacaacccccccgacccacgcc

SEQ ID NO: 2285256 - RNA, 17 nt, Yersinia pestis
caauuugcaaagaaaua

SEQ ID NO: 2285257 - RNA, 13 nt, Yersinia pestis
caauuugcauaau

SEQ ID NO: 2285258 - RNA, 15 nt, Yersinia pestis
caauuugcccaucuu

SEQ ID NO: 2285259 - RNA, 12 nt, Yersinia pestis
caauuuggccaa

SEQ ID NO: 2285260 - RNA, 13 nt, Yersinia pestis
caauuuggccaau

SEQ ID NO: 2285261 - RNA, 17 nt, Yersinia pestis
cacacauaccacacaca

SEQ ID NO: 2285262 - RNA, 20 nt, Yersinia pestis
cacacauaccacacacaaag

SEQ ID NO: 2285263 - RNA, 13 nt, Yersinia pestis
cacacagaaucac

SEQ ID NO: 2285264 - RNA, 18 nt, Yersinia pestis
cacacagaaucaccaaca

SEQ ID NO: 2285265 - RNA, 23 nt, Yersinia pestis
cacaaucgcgcuguacaacaaga

SEQ ID NO: 2285266 - RNA, 12 nt, Yersinia pestis
cacaaucuucuu

SEQ ID NO: 2285267 - RNA, 23 nt, Yersinia pestis
cacaaucuugcagcgaucacaga

SEQ ID NO: 2285268 - RNA, 23 nt, Yersinia pestis
cacacacuaauaauaauuaaucu

SEQ ID NO: 2285269 - RNA, 19 nt, Yersinia pestis
cacacacaaagcccaaaaa

SEQ ID NO: 2285270 - RNA, 22 nt, Yersinia pestis
cacacguguacucauauugucc

SEQ ID NO: 2285271 - RNA, 20 nt, Yersinia pestis
cacacgauuaccugcauauc

SEQ ID NO: 2285272 - RNA, 20 nt, Yersinia pestis
cacagcaaauugcugaaaaa

SEQ ID NO: 2285273 - RNA, 12 nt, Yersinia pestis
cacagcaacagg

SEQ ID NO: 2285274 - RNA, 14 nt, Yersinia pestis
cacagcagacagcg

SEQ ID NO: 2285275 - RNA, 17 nt, Yersinia pestis
cacagcagaacaaaaca

SEQ ID NO: 2285276 - RNA, 15 nt, Yersinia pestis
cacagcauucugcuu

SEQ ID NO: 2285277 - RNA, 15 nt, Yersinia pestis
cacacugucaucacu

SEQ ID NO: 2285278 - RNA, 16 nt, Yersinia pestis
cacacugucaucacug

SEQ ID NO: 2285279 - RNA, 18 nt, Yersinia pestis
cacagauaaauaaaauaa

SEQ ID NO: 2285280 - RNA, 14 nt, Yersinia pestis
cacagauaaacaag

SEQ ID NO: 2285281 - RNA, 14 nt, Yersinia pestis
cacagauaaauaaa

SEQ ID NO: 2285282 - RNA, 22 nt, Yersinia pestis
augcagcguauucaguaaaaac

SEQ ID NO: 2285283 - RNA, 17 nt, Yersinia pestis
augcagauaaccgugcg

SEQ ID NO: 2285284 - RNA, 14 nt, Yersinia pestis
augcagagaugcag

SEQ ID NO: 2285285 - RNA, 16 nt, Yersinia pestis
augcagacucuuauau

SEQ ID NO: 2285286 - RNA, 16 nt, Yersinia pestis
augcagauuuuugcuu

SEQ ID NO: 2285287 - RNA, 16 nt, Yersinia pestis
augcaccaaucaacau

SEQ ID NO: 2285288 - RNA, 17 nt, Yersinia pestis
augcaccgacaaagaua

SEQ ID NO: 2285289 - RNA, 15 nt, Yersinia pestis
augcacaguugucug

SEQ ID NO: 2285290 - RNA, 19 nt, Yersinia pestis
augcacaguugucugaggc

SEQ ID NO: 2285291 - RNA, 16 nt, Yersinia pestis
augcacaguaggcuga

SEQ ID NO: 2285292 - RNA, 15 nt, Yersinia pestis
augccauagcugcug

SEQ ID NO: 2285293 - RNA, 15 nt, Yersinia pestis
augccaguuauuauu

SEQ ID NO: 2285294 - RNA, 23 nt, Yersinia pestis
augccauaacaucguuaauccau

SEQ ID NO: 2285295 - RNA, 21 nt, Yersinia pestis
augccgauauagcgcaccacc

SEQ ID NO: 2285296 - RNA, 14 nt, Yersinia pestis
augcgagcaaggca

SEQ ID NO: 2285297 - RNA, 13 nt, Yersinia pestis
augccuuuucuuc

SEQ ID NO: 2285298 - RNA, 21 nt, Yersinia pestis
augccuuuuaaaugaagcagu

SEQ ID NO: 2285299 - RNA, 16 nt, Yersinia pestis
augcgaaaaaagaugg

SEQ ID NO: 2285300 - RNA, 14 nt, Yersinia pestis
augcgaaaaaauau

SEQ ID NO: 2285301 - RNA, 16 nt, Yersinia pestis
augccuuguuucuggc

SEQ ID NO: 2285302 - RNA, 20 nt, Yersinia pestis
augccugcgaauuaucaucc

SEQ ID NO: 2285303 - RNA, 20 nt, Yersinia pestis
augccucugcuaacaacagu

SEQ ID NO: 2285304 - RNA, 20 nt, Yersinia pestis
augccuaauaauuuauacau

SEQ ID NO: 2285305 - RNA, 23 nt, Yersinia pestis
augccucacggcuaccagcagca

SEQ ID NO: 2285306 - RNA, 14 nt, Yersinia pestis
augauuuuuuucau

SEQ ID NO: 2285307 - RNA, 13 nt, Yersinia pestis
augauuuuuuuca

SEQ ID NO: 2285308 - RNA, 20 nt, Yersinia pestis
augauuuuuacagcaaacgu

SEQ ID NO: 2285309 - RNA, 17 nt, Yersinia pestis
augcaacuuggcaccua

SEQ ID NO: 2285310 - RNA, 21 nt, Yersinia pestis
augcaaucuaacuaauaauaa

SEQ ID NO: 2285311 - RNA, 19 nt, Yersinia pestis
augcaauuuuugcagugca

SEQ ID NO: 2285312 - RNA, 15 nt, Yersinia pestis
augcaaucuaacuaa

SEQ ID NO: 2285313 - RNA, 16 nt, Yersinia pestis
augauuggagcaaaug

SEQ ID NO: 2285314 - RNA, 15 nt, Yersinia pestis
augauucauugaguu

SEQ ID NO: 2285315 - RNA, 14 nt, Yersinia pestis
augauucgccauuc

SEQ ID NO: 2285316 - RNA, 16 nt, Yersinia pestis
augauucgccauucug

SEQ ID NO: 2285317 - RNA, 16 nt, Yersinia pestis
augauucgguuauucu

SEQ ID NO: 2285318 - RNA, 22 nt, Yersinia pestis
augauucguagaaacaucgcca

SEQ ID NO: 2285319 - RNA, 13 nt, Yersinia pestis
augauuucucgcu

SEQ ID NO: 2285320 - RNA, 19 nt, Yersinia pestis
augaugcuggguauauaua

SEQ ID NO: 2285321 - RNA, 20 nt, Yersinia pestis
augauggcgugauggcgcag

SEQ ID NO: 2285322 - RNA, 22 nt, Yersinia pestis
augauuauuuauuuacagccac

SEQ ID NO: 2285323 - RNA, 15 nt, Yersinia pestis
augauuauuuuaugg

SEQ ID NO: 2285324 - RNA, 22 nt, Yersinia pestis
augauuaggcauaaauaauaaa

SEQ ID NO: 2285325 - RNA, 20 nt, Yersinia pestis
augauguugauuaacccuuu

SEQ ID NO: 2285326 - RNA, 20 nt, Yersinia pestis
augagcacgaauuuugagga

SEQ ID NO: 2285327 - RNA, 19 nt, Yersinia pestis
augagcagcccagucucuu

SEQ ID NO: 2285328 - RNA, 15 nt, Yersinia pestis
augaucuuuauuauu

SEQ ID NO: 2285329 - RNA, 15 nt, Yersinia pestis
augaugauaucaccu

SEQ ID NO: 2285330 - RNA, 17 nt, Yersinia pestis
augaugauaucaccuuu

SEQ ID NO: 2285331 - RNA, 22 nt, Yersinia pestis
augaugaauaccaccaucacuc

SEQ ID NO: 2285332 - RNA, 14 nt, Yersinia pestis
augaugaguaacau

SEQ ID NO: 2285333 - RNA, 15 nt, Yersinia pestis
auggggagcuugccu

SEQ ID NO: 2285334 - RNA, 14 nt, Yersinia pestis
auggggaaaagcag

SEQ ID NO: 2285335 - RNA, 22 nt, Yersinia pestis
auggggaucugcauaccuggau

SEQ ID NO: 2285336 - RNA, 22 nt, Yersinia pestis
augggcugcacuuuuacgggcc

SEQ ID NO: 2285337 - RNA, 16 nt, Yersinia pestis
auggcugccaucagga

SEQ ID NO: 2285338 - RNA, 17 nt, Yersinia pestis
auggcugccaucaggau

SEQ ID NO: 2285339 - RNA, 18 nt, Yersinia pestis
auggcuccaccguucagg

SEQ ID NO: 2285340 - RNA, 15 nt, Yersinia pestis
auggcugucugauga

SEQ ID NO: 2285341 - RNA, 17 nt, Yersinia pestis
auggcuggcaaggcacg

SEQ ID NO: 2285342 - RNA, 20 nt, Yersinia pestis
auggcuaagcacaauuguua

SEQ ID NO: 2285343 - RNA, 16 nt, Yersinia pestis
auggcuaauuaauuua

SEQ ID NO: 2285344 - RNA, 21 nt, Yersinia pestis
auggcuacguagcucagcugg

SEQ ID NO: 2285345 - RNA, 13 nt, Yersinia pestis
auggcguuuucuu

SEQ ID NO: 2285346 - RNA, 23 nt, Yersinia pestis
auggcuaaacucuggcacuggca

SEQ ID NO: 2285347 - RNA, 21 nt, Yersinia pestis
auggccucguauuacccucau

SEQ ID NO: 2285348 - RNA, 14 nt, Yersinia pestis
auggccggacucau

SEQ ID NO: 2285349 - RNA, 17 nt, Yersinia pestis
auggccguaucaugggu

SEQ ID NO: 2285350 - RNA, 17 nt, Yersinia pestis
auggcagcccuuauuca

SEQ ID NO: 2285351 - RNA, 22 nt, Yersinia pestis
auggcagcccuuauucaaagaa

SEQ ID NO: 2285352 - RNA, 14 nt, Yersinia pestis
auguaaauuucccu

SEQ ID NO: 2285353 - RNA, 16 nt, Yersinia pestis
auguacacauuauuua

SEQ ID NO: 2285354 - RNA, 18 nt, Yersinia pestis
auguacaccuaaaacaua

SEQ ID NO: 2285355 - RNA, 18 nt, Yersinia pestis
augguuagguugaaauac

SEQ ID NO: 2285356 - RNA, 18 nt, Yersinia pestis
augguuaccaaaaagcaa

SEQ ID NO: 2285357 - RNA, 15 nt, Yersinia pestis
augguuaaaacucaa

SEQ ID NO: 2285358 - RNA, 22 nt, Yersinia pestis
augguugcucaaguuauacugu

SEQ ID NO: 2285359 - RNA, 13 nt, Yersinia pestis
augguaucagaaa

SEQ ID NO: 2285360 - RNA, 16 nt, Yersinia pestis
augguauagacuguuu

SEQ ID NO: 2285361 - RNA, 13 nt, Yersinia pestis
augguaagucuua

SEQ ID NO: 2285362 - RNA, 18 nt, Yersinia pestis
augguaagaauaaauaau

SEQ ID NO: 2285363 - RNA, 17 nt, Yersinia pestis
auggugccgucaacagg

SEQ ID NO: 2285364 - RNA, 18 nt, Yersinia pestis
auggugggucgugcggga

SEQ ID NO: 2285365 - RNA, 19 nt, Yersinia pestis
auggugggucgugcgggau

SEQ ID NO: 2285366 - RNA, 14 nt, Yersinia pestis
auggugcuauuucu

SEQ ID NO: 2285367 - RNA, 13 nt, Yersinia pestis
auggugcuauuuc

SEQ ID NO: 2285368 - RNA, 22 nt, Yersinia pestis
augcuuuuugcaucgcuucuga

SEQ ID NO: 2285369 - RNA, 19 nt, Yersinia pestis
auggaaaaaauacaggugu

SEQ ID NO: 2285370 - RNA, 16 nt, Yersinia pestis
auggaaaaaauacagg

SEQ ID NO: 2285371 - RNA, 18 nt, Yersinia pestis
auggaaauuauuuagaaa

SEQ ID NO: 2285372 - RNA, 23 nt, Yersinia pestis
auggaacggacauuuuacucccu

SEQ ID NO: 2285373 - RNA, 15 nt, Yersinia pestis
auggaaauagcucaa

SEQ ID NO: 2285374 - RNA, 19 nt, Yersinia pestis
auggaaauacgcuuaccug

SEQ ID NO: 2285375 - RNA, 13 nt, Yersinia pestis
auggaagaccaga

SEQ ID NO: 2285376 - RNA, 24 nt, Yersinia pestis
auggaagaaucaccgaaagaagac

SEQ ID NO: 2285377 - RNA, 16 nt, Yersinia pestis
auggaaguaauccaga

SEQ ID NO: 2285378 - RNA, 14 nt, Yersinia pestis
auggaugaccaaug

SEQ ID NO: 2285379 - RNA, 13 nt, Yersinia pestis
auggaucacccgu

SEQ ID NO: 2285380 - RNA, 17 nt, Yersinia pestis
auggauggucauaaaau

SEQ ID NO: 2285381 - RNA, 17 nt, Yersinia pestis
auggcagagcuuuucuc

SEQ ID NO: 2285382 - RNA, 19 nt, Yersinia pestis
auggcacuggaaacaaaac

SEQ ID NO: 2285383 - RNA, 22 nt, Yersinia pestis
auggagaucugggcgacccaaa

SEQ ID NO: 2285384 - RNA, 23 nt, Yersinia pestis
auggacuacacagacuggugaac

SEQ ID NO: 2285385 - RNA, 17 nt, Yersinia pestis
auggacgaacagcccca

SEQ ID NO: 2285386 - RNA, 22 nt, Yersinia pestis
auggacgaacagugccaacagc

SEQ ID NO: 2285387 - RNA, 18 nt, Yersinia pestis
augcuucaagcugccuau

SEQ ID NO: 2285388 - RNA, 19 nt, Yersinia pestis
augcuuucaucgaaaaaaa

SEQ ID NO: 2285389 - RNA, 13 nt, Yersinia pestis
augcuuucaucuu

SEQ ID NO: 2285390 - RNA, 14 nt, Yersinia pestis
augcugcacaucaa

SEQ ID NO: 2285391 - RNA, 21 nt, Yersinia pestis
augcucgcuaaucaagccuuc

SEQ ID NO: 2285392 - RNA, 11 nt, Yersinia pestis
augcuccagau

SEQ ID NO: 2285393 - RNA, 14 nt, Yersinia pestis
auguuauuaaugau

SEQ ID NO: 2285394 - RNA, 20 nt, Yersinia pestis
auguuaucgccaacacuauu

SEQ ID NO: 2285395 - RNA, 18 nt, Yersinia pestis
auguuaugaggggaggcu

SEQ ID NO: 2285396 - RNA, 16 nt, Yersinia pestis
auguuauggauuuuua

SEQ ID NO: 2285397 - RNA, 16 nt, Yersinia pestis
auguuaucgccaacac

SEQ ID NO: 2285398 - RNA, 13 nt, Yersinia pestis
auguuaggauagg

SEQ ID NO: 2285399 - RNA, 23 nt, Yersinia pestis
auguuccggacuucauaaauauu

SEQ ID NO: 2285400 - RNA, 21 nt, Yersinia pestis
auguuccugaauggcaucacc

SEQ ID NO: 2285401 - RNA, 14 nt, Yersinia pestis
auguuagagauaac

SEQ ID NO: 2285402 - RNA, 13 nt, Yersinia pestis
auguuaaaucagu

SEQ ID NO: 2285403 - RNA, 18 nt, Yersinia pestis
auguuaaaucagugaagg

SEQ ID NO: 2285404 - RNA, 20 nt, Yersinia pestis
auguguaguugaaguucaca

SEQ ID NO: 2285405 - RNA, 22 nt, Yersinia pestis
auguguaguaugcgauuuuuga

SEQ ID NO: 2285406 - RNA, 12 nt, Yersinia pestis
augugcccuugu

SEQ ID NO: 2285407 - RNA, 22 nt, Yersinia pestis
auguggauaauuucagcagcac

SEQ ID NO: 2285408 - RNA, 21 nt, Yersinia pestis
augucuuuacuaaauuagaaa

SEQ ID NO: 2285409 - RNA, 14 nt, Yersinia pestis
augugaaaagcagu

SEQ ID NO: 2285410 - RNA, 15 nt, Yersinia pestis
augugaaacauaauu

SEQ ID NO: 2285411 - RNA, 20 nt, Yersinia pestis
augugaacgcccuguaaugg

SEQ ID NO: 2285412 - RNA, 13 nt, Yersinia pestis
augugaaaagcag

SEQ ID NO: 2285413 - RNA, 22 nt, Yersinia pestis
augucuuuuucuuuuuaacuua

SEQ ID NO: 2285414 - RNA, 23 nt, Yersinia pestis
augugauguggcuugcaaucaga

SEQ ID NO: 2285415 - RNA, 14 nt, Yersinia pestis
augugauguggcuu

SEQ ID NO: 2285416 - RNA, 15 nt, Yersinia pestis
augugauauuuuacu

SEQ ID NO: 2285417 - RNA, 17 nt, Yersinia pestis
augugauaccuaaaccu

SEQ ID NO: 2285418 - RNA, 21 nt, Yersinia pestis
auguacauuauucaugaugcc

SEQ ID NO: 2285419 - RNA, 21 nt, Yersinia pestis
augucgcgacucaagccucua

SEQ ID NO: 2285420 - RNA, 16 nt, Yersinia pestis
auuaauaaauauccuc

SEQ ID NO: 2285421 - RNA, 18 nt, Yersinia pestis
auuaauaaauauccuccg

SEQ ID NO: 2285422 - RNA, 13 nt, Yersinia pestis
auuaauacaucau

SEQ ID NO: 2285423 - RNA, 14 nt, Yersinia pestis
auuaauacaucauc

SEQ ID NO: 2285424 - RNA, 16 nt, Yersinia pestis
auuaauacaucaucaa

SEQ ID NO: 2285425 - RNA, 17 nt, Yersinia pestis
auuaauacaucaucaaa

SEQ ID NO: 2285426 - RNA, 21 nt, Yersinia pestis
auuaauacaacguuuaguaau

SEQ ID NO: 2285427 - RNA, 12 nt, Yersinia pestis
auuaaggagugc

SEQ ID NO: 2285428 - RNA, 23 nt, Yersinia pestis
auuaacggugcgacaaugccccc

SEQ ID NO: 2285429 - RNA, 16 nt, Yersinia pestis
auuaacucuuuuuaaa

SEQ ID NO: 2285430 - RNA, 23 nt, Yersinia pestis
auuaacuuuucuucauugcugcu

SEQ ID NO: 2285431 - RNA, 15 nt, Yersinia pestis
auuaacuucaauuug

SEQ ID NO: 2285432 - RNA, 16 nt, Yersinia pestis
auuaaccuuaucacca

SEQ ID NO: 2285433 - RNA, 14 nt, Yersinia pestis
auuaaccuaaaaac

SEQ ID NO: 2285434 - RNA, 18 nt, Yersinia pestis
auuaaauuaauauuuaaa

SEQ ID NO: 2285435 - RNA, 14 nt, Yersinia pestis
auuaaaugguuuau

SEQ ID NO: 2285436 - RNA, 16 nt, Yersinia pestis
auuaaauguauaaaaa

SEQ ID NO: 2285437 - RNA, 20 nt, Yersinia pestis
auuaaauguauaaaaaagau

SEQ ID NO: 2285438 - RNA, 19 nt, Yersinia pestis
auuaaaugguuuauuuaag

SEQ ID NO: 2285439 - RNA, 15 nt, Yersinia pestis
auuaacgauuauuaa

SEQ ID NO: 2285440 - RNA, 22 nt, Yersinia pestis
auuaacgcucuacaacguccag

SEQ ID NO: 2285441 - RNA, 20 nt, Yersinia pestis
auuaaagccauucagcagca

SEQ ID NO: 2285442 - RNA, 17 nt, Yersinia pestis
auuaaaacugaaaaguu

SEQ ID NO: 2285443 - RNA, 16 nt, Yersinia pestis
auuaaaaccacgcauu

SEQ ID NO: 2285444 - RNA, 14 nt, Yersinia pestis
auuaaacuugcucu

SEQ ID NO: 2285445 - RNA, 14 nt, Yersinia pestis
auuaaagauuucau

SEQ ID NO: 2285446 - RNA, 22 nt, Yersinia pestis
auuaaagauuucaucauucaau

SEQ ID NO: 2285447 - RNA, 13 nt, Yersinia pestis
auuaaaaauuaau

SEQ ID NO: 2285448 - RNA, 14 nt, Yersinia pestis
auuaaaacacauca

SEQ ID NO: 2285449 - RNA, 13 nt, Yersinia pestis
auuaaaaauacaa

SEQ ID NO: 2285450 - RNA, 14 nt, Yersinia pestis
auuaaaaauacaac

SEQ ID NO: 2285451 - RNA, 22 nt, Yersinia pestis
auuaaaaauagauuaaaagucu

SEQ ID NO: 2285452 - RNA, 20 nt, Yersinia pestis
auguucucuggguaagaaca

SEQ ID NO: 2285453 - RNA, 17 nt, Yersinia pestis
auguugaaucaauugcu

SEQ ID NO: 2285454 - RNA, 19 nt, Yersinia pestis
auguucgcacugcucugcc

SEQ ID NO: 2285455 - RNA, 14 nt, Yersinia pestis
auguucgaacaugc

SEQ ID NO: 2285456 - RNA, 20 nt, Yersinia pestis
auguuccuguugcuggccag

SEQ ID NO: 2285457 - RNA, 13 nt, Yersinia pestis
auuaaaaacccuc

SEQ ID NO: 2285458 - RNA, 22 nt, Yersinia pestis
auguuuuacgaucaacccccug

SEQ ID NO: 2285459 - RNA, 19 nt, Yersinia pestis
auguugauauaagcagcac

SEQ ID NO: 2285460 - RNA, 18 nt, Yersinia pestis
auguuugaugguuaugug

SEQ ID NO: 2285461 - RNA, 14 nt, Yersinia pestis
auuaucgaucacau

SEQ ID NO: 2285462 - RNA, 15 nt, Yersinia pestis
auuaucgcaauuuca

SEQ ID NO: 2285463 - RNA, 23 nt, Yersinia pestis
auuauauaagagaugaaauuuua

SEQ ID NO: 2285464 - RNA, 15 nt, Yersinia pestis
auuaguccguagaaa

SEQ ID NO: 2285465 - RNA, 22 nt, Yersinia pestis
auuagugagcgguugaaaaguu

SEQ ID NO: 2285466 - RNA, 23 nt, Yersinia pestis
auuaguugaccuugguaaauacc

SEQ ID NO: 2285467 - RNA, 14 nt, Yersinia pestis
auuagugcacagau

SEQ ID NO: 2285468 - RNA, 15 nt, Yersinia pestis
auuagugcacagaua

SEQ ID NO: 2285469 - RNA, 19 nt, Yersinia pestis
auuauuaacgauuauuaaa

SEQ ID NO: 2285470 - RNA, 22 nt, Yersinia pestis
auuauuaacgauuauuaaacua

SEQ ID NO: 2285471 - RNA, 17 nt, Yersinia pestis
auuauggauaauuuaau

SEQ ID NO: 2285472 - RNA, 22 nt, Yersinia pestis
auuaucugaaagcaaacaauua

SEQ ID NO: 2285473 - RNA, 17 nt, Yersinia pestis
auuauggacaggcucau

SEQ ID NO: 2285474 - RNA, 23 nt, Yersinia pestis
auuauggacaggcucauuuugua

SEQ ID NO: 2285475 - RNA, 21 nt, Yersinia pestis
auuaucgaucacaugcucagu

SEQ ID NO: 2285476 - RNA, 22 nt, Yersinia pestis
auuauuuuggaguauacauuau

SEQ ID NO: 2285477 - RNA, 19 nt, Yersinia pestis
auuauuuuccagaugaaua

SEQ ID NO: 2285478 - RNA, 21 nt, Yersinia pestis
auuauuuugugcguaaagaaa

SEQ ID NO: 2285479 - RNA, 21 nt, Yersinia pestis
auuauuuuguacgaauaacuc

SEQ ID NO: 2285480 - RNA, 16 nt, Yersinia pestis
auuauuuuuauacaga

SEQ ID NO: 2285481 - RNA, 21 nt, Yersinia pestis
auuauuugggguauauauuuu

SEQ ID NO: 2285482 - RNA, 17 nt, Yersinia pestis
auuauuggcgauuuaau

SEQ ID NO: 2285483 - RNA, 21 nt, Yersinia pestis
auuauugguguguaauuuuua

SEQ ID NO: 2285484 - RNA, 22 nt, Yersinia pestis
auuauugguguguaauuuuuac

SEQ ID NO: 2285485 - RNA, 24 nt, Yersinia pestis
auuauugguguguaauuuuuacau

SEQ ID NO: 2285486 - RNA, 14 nt, Yersinia pestis
auuauuuaucaauc

SEQ ID NO: 2285487 - RNA, 21 nt, Yersinia pestis
auuauuuaaacaaugaaauug

SEQ ID NO: 2285488 - RNA, 17 nt, Yersinia pestis
auuauuguuauuaucau

SEQ ID NO: 2285489 - RNA, 14 nt, Yersinia pestis
auuauuuaauuaaa

SEQ ID NO: 2285490 - RNA, 14 nt, Yersinia pestis
auuauuuacacuua

SEQ ID NO: 2285491 - RNA, 14 nt, Yersinia pestis
auucaaguugcaga

SEQ ID NO: 2285492 - RNA, 20 nt, Yersinia pestis
auucaaggccagcacguuuu

SEQ ID NO: 2285493 - RNA, 20 nt, Yersinia pestis
auucaaggcuacccaauaac

SEQ ID NO: 2285494 - RNA, 20 nt, Yersinia pestis
auucaaggucgccauauuau

SEQ ID NO: 2285495 - RNA, 22 nt, Yersinia pestis
auucaacguguuguuuucauga

SEQ ID NO: 2285496 - RNA, 22 nt, Yersinia pestis
auucaaacggugugcaaugcag

SEQ ID NO: 2285497 - RNA, 13 nt, Yersinia pestis
auucaaacaguaa

SEQ ID NO: 2285498 - RNA, 15 nt, Yersinia pestis
auucaaaauagaaaa

SEQ ID NO: 2285499 - RNA, 21 nt, Yersinia pestis
auucaaaauagaggaaauaaa

SEQ ID NO: 2285500 - RNA, 23 nt, Yersinia pestis
auucaaaauguauuauuuuguac

SEQ ID NO: 2285501 - RNA, 18 nt, Yersinia pestis
auucaaaaauuaaauuaa

SEQ ID NO: 2285502 - RNA, 19 nt, Yersinia pestis
aaaagcccggucacucaau

SEQ ID NO: 2285503 - RNA, 18 nt, Yersinia pestis
auuaauauauaaaauaaa

SEQ ID NO: 2285504 - RNA, 17 nt, Yersinia pestis
auuaauauaauacuuaa

SEQ ID NO: 2285505 - RNA, 17 nt, Yersinia pestis
auuacccucauuuuacc

SEQ ID NO: 2285506 - RNA, 20 nt, Yersinia pestis
auuacccucauuuuacccga

SEQ ID NO: 2285507 - RNA, 17 nt, Yersinia pestis
auuaauaucaaaacuga

SEQ ID NO: 2285508 - RNA, 17 nt, Yersinia pestis
auuacaggccccaaucc

SEQ ID NO: 2285509 - RNA, 15 nt, Yersinia pestis
auuacaucaucuucu

SEQ ID NO: 2285510 - RNA, 17 nt, Yersinia pestis
auuaccugcauauccuc

SEQ ID NO: 2285511 - RNA, 14 nt, Yersinia pestis
auuaccuaauuuau

SEQ ID NO: 2285512 - RNA, 23 nt, Yersinia pestis
auuaccgucagggacaacaucau

SEQ ID NO: 2285513 - RNA, 20 nt, Yersinia pestis
auuaccggcguuuuuacagu

SEQ ID NO: 2285514 - RNA, 17 nt, Yersinia pestis
auuacgugaugaugcua

SEQ ID NO: 2285515 - RNA, 20 nt, Yersinia pestis
auuacggccccagcccagca

SEQ ID NO: 2285516 - RNA, 20 nt, Yersinia pestis
auuacucucgccaaacaaau

SEQ ID NO: 2285517 - RNA, 18 nt, Yersinia pestis
auuagaugaugcuacuug

SEQ ID NO: 2285518 - RNA, 19 nt, Yersinia pestis
auuagaugguuaacucauu

SEQ ID NO: 2285519 - RNA, 18 nt, Yersinia pestis
auuagcaguauuagcuuu

SEQ ID NO: 2285520 - RNA, 18 nt, Yersinia pestis
auuagccccaaaugccag

SEQ ID NO: 2285521 - RNA, 17 nt, Yersinia pestis
auuagccagaaauagca

SEQ ID NO: 2285522 - RNA, 14 nt, Yersinia pestis
aaaagcgaucagca

SEQ ID NO: 2285523 - RNA, 15 nt, Yersinia pestis
auuacugucauuucc

SEQ ID NO: 2285524 - RNA, 18 nt, Yersinia pestis
auuacuguucaucauauc

SEQ ID NO: 2285525 - RNA, 17 nt, Yersinia pestis
auuacuggucucaaggu

SEQ ID NO: 2285526 - RNA, 20 nt, Yersinia pestis
auuacuugauaaggcaaggc

SEQ ID NO: 2285527 - RNA, 16 nt, Yersinia pestis
auuacuuuaaagccaa

SEQ ID NO: 2285528 - RNA, 15 nt, Yersinia pestis
auuacuucuuuuuaa

SEQ ID NO: 2285529 - RNA, 17 nt, Yersinia pestis
auuagaaguucuaaaua

SEQ ID NO: 2285530 - RNA, 15 nt, Yersinia pestis
auuacuuugaauagc

SEQ ID NO: 2285531 - RNA, 14 nt, Yersinia pestis
auuacuuugaauag

SEQ ID NO: 2285532 - RNA, 13 nt, Yersinia pestis
auucaugaggcuu

SEQ ID NO: 2285533 - RNA, 15 nt, Yersinia pestis
auucaugcaucucca

SEQ ID NO: 2285534 - RNA, 20 nt, Yersinia pestis
auucaugcaucuccacucuu

SEQ ID NO: 2285535 - RNA, 17 nt, Yersinia pestis
auucaugguuucaaaau

SEQ ID NO: 2285536 - RNA, 16 nt, Yersinia pestis
auucaugguuucaaaa

SEQ ID NO: 2285537 - RNA, 16 nt, Yersinia pestis
auucaugcuaauacca

SEQ ID NO: 2285538 - RNA, 20 nt, Yersinia pestis
auucauuuuaaaaaaauuaa

SEQ ID NO: 2285539 - RNA, 15 nt, Yersinia pestis
auucauuuugcugga

SEQ ID NO: 2285540 - RNA, 15 nt, Yersinia pestis
auucauuucuuuggc

SEQ ID NO: 2285541 - RNA, 14 nt, Yersinia pestis
auucauuuuaaaaa

SEQ ID NO: 2285542 - RNA, 15 nt, Yersinia pestis
auucauuuuaaaaaa

SEQ ID NO: 2285543 - RNA, 16 nt, Yersinia pestis
auucauuuuaaaaaaa

SEQ ID NO: 2285544 - RNA, 23 nt, Yersinia pestis
auucaucaugcugucauuggugc

SEQ ID NO: 2285545 - RNA, 18 nt, Yersinia pestis
auucaucccuaaaaucau

SEQ ID NO: 2285546 - RNA, 13 nt, Yersinia pestis
auucaucagcaau

SEQ ID NO: 2285547 - RNA, 14 nt, Yersinia pestis
auucaucagcaauu

SEQ ID NO: 2285548 - RNA, 14 nt, Yersinia pestis
auucaucagggcag

SEQ ID NO: 2285549 - RNA, 15 nt, Yersinia pestis
auucaucuuuaacaa

SEQ ID NO: 2285550 - RNA, 13 nt, Yersinia pestis
auucaugaggcuc

SEQ ID NO: 2285551 - RNA, 17 nt, Yersinia pestis
auucaugaggcucagac

SEQ ID NO: 2285552 - RNA, 17 nt, Yersinia pestis
aaaaggauggcccaagc

SEQ ID NO: 2285553 - RNA, 17 nt, Yersinia pestis
auucauaucgcuaaaac

SEQ ID NO: 2285554 - RNA, 20 nt, Yersinia pestis
aaaaggcaccagcgcacuga

SEQ ID NO: 2285555 - RNA, 20 nt, Yersinia pestis
aaaaggauuuuauuaaauca

SEQ ID NO: 2285556 - RNA, 18 nt, Yersinia pestis
auucauaugacaaauaag

SEQ ID NO: 2285557 - RNA, 17 nt, Yersinia pestis
auucauaugacaaauaa

SEQ ID NO: 2285558 - RNA, 22 nt, Yersinia pestis
auuccauguucucuccuaaaau

SEQ ID NO: 2285559 - RNA, 21 nt, Yersinia pestis
auucccaccauaaugugccuc

SEQ ID NO: 2285560 - RNA, 16 nt, Yersinia pestis
auuccgucgauaucua

SEQ ID NO: 2285561 - RNA, 23 nt, Yersinia pestis
auucccugcgguuauuugcuauc

SEQ ID NO: 2285562 - RNA, 14 nt, Yersinia pestis
auucccucaauagc

SEQ ID NO: 2285563 - RNA, 21 nt, Yersinia pestis
auucccguuuuauuacugaua

SEQ ID NO: 2285564 - RNA, 22 nt, Yersinia pestis
auuccuuguggugaugaaggua

SEQ ID NO: 2285565 - RNA, 13 nt, Yersinia pestis
auucgcgccccaa

SEQ ID NO: 2285566 - RNA, 16 nt, Yersinia pestis
auucgcgguuacacca

SEQ ID NO: 2285567 - RNA, 18 nt, Yersinia pestis
auucgucaccaucaauau

SEQ ID NO: 2285568 - RNA, 13 nt, Yersinia pestis
auucguagaaaca

SEQ ID NO: 2285569 - RNA, 13 nt, Yersinia pestis
auucgucugccau

SEQ ID NO: 2285570 - RNA, 19 nt, Yersinia pestis
auucgucugccauugcuca

SEQ ID NO: 2285571 - RNA, 17 nt, Yersinia pestis
auucuauccggauuaaa

SEQ ID NO: 2285572 - RNA, 13 nt, Yersinia pestis
auucucaaaauaa

SEQ ID NO: 2285573 - RNA, 14 nt, Yersinia pestis
auucucaauauuaa

SEQ ID NO: 2285574 - RNA, 18 nt, Yersinia pestis
auucuauccggauuaaau

SEQ ID NO: 2285575 - RNA, 14 nt, Yersinia pestis
auucuccuuucuuu

SEQ ID NO: 2285576 - RNA, 13 nt, Yersinia pestis
auucuucaucuag

SEQ ID NO: 2285577 - RNA, 20 nt, Yersinia pestis
auucuggguacaacacaaaa

SEQ ID NO: 2285578 - RNA, 19 nt, Yersinia pestis
auucuggucgccagauuga

SEQ ID NO: 2285579 - RNA, 20 nt, Yersinia pestis
auucugaagacacacuuauu

SEQ ID NO: 2285580 - RNA, 17 nt, Yersinia pestis
auucucuggugauacca

SEQ ID NO: 2285581 - RNA, 12 nt, Yersinia pestis
auucucugucuu

SEQ ID NO: 2285582 - RNA, 15 nt, Yersinia pestis
auucucuucaccuuc

SEQ ID NO: 2285583 - RNA, 23 nt, Yersinia pestis
auucucucuuuugagaguucacu

SEQ ID NO: 2285584 - RNA, 22 nt, Yersinia pestis
auucucuauucugcuuuuugcu

SEQ ID NO: 2285585 - RNA, 20 nt, Yersinia pestis
auucucuacucgcucaccac

SEQ ID NO: 2285586 - RNA, 21 nt, Yersinia pestis
auucugccgacuaauauuuca

SEQ ID NO: 2285587 - RNA, 18 nt, Yersinia pestis
auucugauaccugcgcua

SEQ ID NO: 2285588 - RNA, 22 nt, Yersinia pestis
auucugauagugauuuuuuuca

SEQ ID NO: 2285589 - RNA, 23 nt, Yersinia pestis
auucugauagugauuuuuuucac

SEQ ID NO: 2285590 - RNA, 22 nt, Yersinia pestis
auucugacgggacaaucuguuc

SEQ ID NO: 2285591 - RNA, 14 nt, Yersinia pestis
auucugauaccugc

SEQ ID NO: 2285592 - RNA, 23 nt, Yersinia pestis
auucugagcaccacaauaccauu

SEQ ID NO: 2285593 - RNA, 14 nt, Yersinia pestis
auugccacggcauu

SEQ ID NO: 2285594 - RNA, 18 nt, Yersinia pestis
auugccagaacaagacug

SEQ ID NO: 2285595 - RNA, 22 nt, Yersinia pestis
auugccaucgggcaauugaaaa

SEQ ID NO: 2285596 - RNA, 17 nt, Yersinia pestis
auugcccgcguaaucuc

SEQ ID NO: 2285597 - RNA, 18 nt, Yersinia pestis
auugcccgcguaaucucu

SEQ ID NO: 2285598 - RNA, 17 nt, Yersinia pestis
auugcccaucaugccag

SEQ ID NO: 2285599 - RNA, 20 nt, Yersinia pestis
auugccgcagauaaaucugu

SEQ ID NO: 2285600 - RNA, 23 nt, Yersinia pestis
auugccgcauacaccuucuuaau

SEQ ID NO: 2285601 - RNA, 21 nt, Yersinia pestis
auugcccuacggguaaagcgu

SEQ ID NO: 2285602 - RNA, 18 nt, Yersinia pestis
auugccggauuccaccug

SEQ ID NO: 2285603 - RNA, 13 nt, Yersinia pestis
auugcgggcuggg

SEQ ID NO: 2285604 - RNA, 22 nt, Yersinia pestis
auugcguguagcgggagauaga

SEQ ID NO: 2285605 - RNA, 17 nt, Yersinia pestis
auugcuaaauuuuguac

SEQ ID NO: 2285606 - RNA, 23 nt, Yersinia pestis
auugcugaguaaauuaaauuuua

SEQ ID NO: 2285607 - RNA, 22 nt, Yersinia pestis
auugcugcuguuauuacuguca

SEQ ID NO: 2285608 - RNA, 20 nt, Yersinia pestis
auugccggauuccaccugac

SEQ ID NO: 2285609 - RNA, 16 nt, Yersinia pestis
auugccugauuuuuau

SEQ ID NO: 2285610 - RNA, 16 nt, Yersinia pestis
auugccuggcccaucu

SEQ ID NO: 2285611 - RNA, 15 nt, Yersinia pestis
auugcggcaaccaaa

SEQ ID NO: 2285612 - RNA, 17 nt, Yersinia pestis
auugcagauaccacauc

SEQ ID NO: 2285613 - RNA, 15 nt, Yersinia pestis
auugcagagcaaaac

SEQ ID NO: 2285614 - RNA, 22 nt, Yersinia pestis
auugcaucgucaugauugagau

SEQ ID NO: 2285615 - RNA, 13 nt, Yersinia pestis
auugcaacugggc

SEQ ID NO: 2285616 - RNA, 15 nt, Yersinia pestis
auugcacaauagcua

SEQ ID NO: 2285617 - RNA, 21 nt, Yersinia pestis
auugcacaugcagcauuucag

SEQ ID NO: 2285618 - RNA, 23 nt, Yersinia pestis
auugcacaugcagcauuucagga

SEQ ID NO: 2285619 - RNA, 16 nt, Yersinia pestis
auugaugauuugaccg

SEQ ID NO: 2285620 - RNA, 18 nt, Yersinia pestis
auugaugucaauuaaaaa

SEQ ID NO: 2285621 - RNA, 19 nt, Yersinia pestis
auugaugucaauuaaaaac

SEQ ID NO: 2285622 - RNA, 18 nt, Yersinia pestis
auugaugacgcuaaccac

SEQ ID NO: 2285623 - RNA, 15 nt, Yersinia pestis
auugaaaaaauaaug

SEQ ID NO: 2285624 - RNA, 22 nt, Yersinia pestis
auugaaaaucaguuuacaugau

SEQ ID NO: 2285625 - RNA, 15 nt, Yersinia pestis
auucuuuuuguuaaa

SEQ ID NO: 2285626 - RNA, 13 nt, Yersinia pestis
auucuuuaggauu

SEQ ID NO: 2285627 - RNA, 15 nt, Yersinia pestis
auuguccaaaggaag

SEQ ID NO: 2285628 - RNA, 17 nt, Yersinia pestis
auugguuuauaacaagg

SEQ ID NO: 2285629 - RNA, 18 nt, Yersinia pestis
aaaagggaguucaucaaa

SEQ ID NO: 2285630 - RNA, 16 nt, Yersinia pestis
auugguuauccuauuc

SEQ ID NO: 2285631 - RNA, 21 nt, Yersinia pestis
auugcuggcggucacgcugau

SEQ ID NO: 2285632 - RNA, 14 nt, Yersinia pestis
auugcugugguuga

SEQ ID NO: 2285633 - RNA, 18 nt, Yersinia pestis
auugcuguuguuauuacu

SEQ ID NO: 2285634 - RNA, 22 nt, Yersinia pestis
auugcuguuguuauuacuguca

SEQ ID NO: 2285635 - RNA, 22 nt, Yersinia pestis
auugcuuaccacuggccuccca

SEQ ID NO: 2285636 - RNA, 13 nt, Yersinia pestis
auuggcuccccuu

SEQ ID NO: 2285637 - RNA, 13 nt, Yersinia pestis
auuggcuuaacaa

SEQ ID NO: 2285638 - RNA, 13 nt, Yersinia pestis
auuggcugcuugc

SEQ ID NO: 2285639 - RNA, 17 nt, Yersinia pestis
auuggcuccuauagcuc

SEQ ID NO: 2285640 - RNA, 23 nt, Yersinia pestis
auuguucaauaggccagcaaugc

SEQ ID NO: 2285641 - RNA, 16 nt, Yersinia pestis
auuguucuuacuguuu

SEQ ID NO: 2285642 - RNA, 17 nt, Yersinia pestis
auuguuaccuaaccaaa

SEQ ID NO: 2285643 - RNA, 13 nt, Yersinia pestis
auuguuauuuuua

SEQ ID NO: 2285644 - RNA, 15 nt, Yersinia pestis
auuguuaucaaauca

SEQ ID NO: 2285645 - RNA, 17 nt, Yersinia pestis
auugugucaauaccuua

SEQ ID NO: 2285646 - RNA, 14 nt, Yersinia pestis
auugugucaauacc

SEQ ID NO: 2285647 - RNA, 12 nt, Yersinia pestis
auuguuugcuuu

SEQ ID NO: 2285648 - RNA, 12 nt, Yersinia pestis
auuguugccaau

SEQ ID NO: 2285649 - RNA, 13 nt, Yersinia pestis
auuuaaaguuuuu

SEQ ID NO: 2285650 - RNA, 20 nt, Yersinia pestis
auuuaaaguuuuuuauuuau

SEQ ID NO: 2285651 - RNA, 19 nt, Yersinia pestis
auuuaaauuacagacaaau

SEQ ID NO: 2285652 - RNA, 12 nt, Yersinia pestis
auuuaacaaaaa

SEQ ID NO: 2285653 - RNA, 18 nt, Yersinia pestis
auuuuuaacgucagauaa

SEQ ID NO: 2285654 - RNA, 12 nt, Yersinia pestis
auuuugugggaa

SEQ ID NO: 2285655 - RNA, 14 nt, Yersinia pestis
auuuuggccuucau

SEQ ID NO: 2285656 - RNA, 17 nt, Yersinia pestis
auuuugggugaacacag

SEQ ID NO: 2285657 - RNA, 19 nt, Yersinia pestis
auuuugucaugaaaaucuu

SEQ ID NO: 2285658 - RNA, 20 nt, Yersinia pestis
auuuuggccgcuuugguugc

SEQ ID NO: 2285659 - RNA, 17 nt, Yersinia pestis
auuuuggaguauacauu

SEQ ID NO: 2285660 - RNA, 13 nt, Yersinia pestis
auuuugcugccag

SEQ ID NO: 2285661 - RNA, 18 nt, Yersinia pestis
auuuucuauaccaauuga

SEQ ID NO: 2285662 - RNA, 15 nt, Yersinia pestis
auuuucgaacuuaac

SEQ ID NO: 2285663 - RNA, 20 nt, Yersinia pestis
auuuucgcccuaacauugag

SEQ ID NO: 2285664 - RNA, 19 nt, Yersinia pestis
auuuucauugauacaaaua

SEQ ID NO: 2285665 - RNA, 15 nt, Yersinia pestis
auuuuuuauauucca

SEQ ID NO: 2285666 - RNA, 18 nt, Yersinia pestis
auuuuugcauauaaaaca

SEQ ID NO: 2285667 - RNA, 22 nt, Yersinia pestis
auuuuucuccgauucaccuuga

SEQ ID NO: 2285668 - RNA, 15 nt, Yersinia pestis
auuuuucguccacua

SEQ ID NO: 2285669 - RNA, 21 nt, Yersinia pestis
auuuuucggugaaccaucaac

SEQ ID NO: 2285670 - RNA, 15 nt, Yersinia pestis
caaaaaaaaagccug

SEQ ID NO: 2285671 - RNA, 14 nt, Yersinia pestis
caaaaaaaauacau

SEQ ID NO: 2285672 - RNA, 20 nt, Yersinia pestis
caaaaaauauuaauccauag

SEQ ID NO: 2285673 - RNA, 12 nt, Yersinia pestis
caaaaaauaagg

SEQ ID NO: 2285674 - RNA, 11 nt, Yersinia pestis
caaaaaauaaa

SEQ ID NO: 2285675 - RNA, 23 nt, Yersinia pestis
auuuguuuuugaaucauaauggu

SEQ ID NO: 2285676 - RNA, 17 nt, Yersinia pestis
auuuuaacaacccauuu

SEQ ID NO: 2285677 - RNA, 22 nt, Yersinia pestis
auuugagcagguguaaauuuca

SEQ ID NO: 2285678 - RNA, 17 nt, Yersinia pestis
auuugauauuagccaag

SEQ ID NO: 2285679 - RNA, 20 nt, Yersinia pestis
auuuuacugcggcuuucugc

SEQ ID NO: 2285680 - RNA, 15 nt, Yersinia pestis
auuuuaaucucucca

SEQ ID NO: 2285681 - RNA, 22 nt, Yersinia pestis
auuuuaaguuaauguuuauauu

SEQ ID NO: 2285682 - RNA, 14 nt, Yersinia pestis
auuuuaaguuaaug

SEQ ID NO: 2285683 - RNA, 18 nt, Yersinia pestis
auuuuaaucucuccauga

SEQ ID NO: 2285684 - RNA, 12 nt, Yersinia pestis
auuuuaccaaca

SEQ ID NO: 2285685 - RNA, 19 nt, Yersinia pestis
auuuuagcggccucuagcu

SEQ ID NO: 2285686 - RNA, 18 nt, Yersinia pestis
auuuuaucccaaaagaag

SEQ ID NO: 2285687 - RNA, 16 nt, Yersinia pestis
auuuuauauugauaaa

SEQ ID NO: 2285688 - RNA, 18 nt, Yersinia pestis
auuuuauauugauaaaaa

SEQ ID NO: 2285689 - RNA, 16 nt, Yersinia pestis
auuuuaucgugaauaa

SEQ ID NO: 2285690 - RNA, 22 nt, Yersinia pestis
auuuuaucgugaauaaaaauaa

SEQ ID NO: 2285691 - RNA, 14 nt, Yersinia pestis
auuuuaucuacuuc

SEQ ID NO: 2285692 - RNA, 16 nt, Yersinia pestis
auuuucaugauccaca

SEQ ID NO: 2285693 - RNA, 18 nt, Yersinia pestis
auuucuugaugcggauaa

SEQ ID NO: 2285694 - RNA, 16 nt, Yersinia pestis
auuugaacuucaaauc

SEQ ID NO: 2285695 - RNA, 11 nt, Yersinia pestis
auuugaaacag

SEQ ID NO: 2285696 - RNA, 22 nt, Yersinia pestis
auuugaaacacuuauuugaaau

SEQ ID NO: 2285697 - RNA, 14 nt, Yersinia pestis
auuucuucuagcuc

SEQ ID NO: 2285698 - RNA, 23 nt, Yersinia pestis
auuucuguuaccagaaaaccuuc

SEQ ID NO: 2285699 - RNA, 13 nt, Yersinia pestis
auuucuuauauua

SEQ ID NO: 2285700 - RNA, 16 nt, Yersinia pestis
auuucuguuaccagaa

SEQ ID NO: 2285701 - RNA, 13 nt, Yersinia pestis
auuucucuuuuau

SEQ ID NO: 2285702 - RNA, 14 nt, Yersinia pestis
auuucugguuugaa

SEQ ID NO: 2285703 - RNA, 12 nt, Yersinia pestis
auuucagcugcu

SEQ ID NO: 2285704 - RNA, 17 nt, Yersinia pestis
auuucaguagcaaauaa

SEQ ID NO: 2285705 - RNA, 17 nt, Yersinia pestis
auuucaguaaucguuua

SEQ ID NO: 2285706 - RNA, 18 nt, Yersinia pestis
auuuccaucuagcucaag

SEQ ID NO: 2285707 - RNA, 14 nt, Yersinia pestis
auuuccaucugcaa

SEQ ID NO: 2285708 - RNA, 15 nt, Yersinia pestis
auuuccauaucaacc

SEQ ID NO: 2285709 - RNA, 15 nt, Yersinia pestis
auuuccauauuaugg

SEQ ID NO: 2285710 - RNA, 17 nt, Yersinia pestis
auuuccauauuauggug

SEQ ID NO: 2285711 - RNA, 13 nt, Yersinia pestis
auuuccaucaaaa

SEQ ID NO: 2285712 - RNA, 14 nt, Yersinia pestis
auuucagccaggcg

SEQ ID NO: 2285713 - RNA, 15 nt, Yersinia pestis
auuucagccaugggc

SEQ ID NO: 2285714 - RNA, 19 nt, Yersinia pestis
auuucacggauaucaacau

SEQ ID NO: 2285715 - RNA, 18 nt, Yersinia pestis
auuucaccuauaauuaac

SEQ ID NO: 2285716 - RNA, 20 nt, Yersinia pestis
auuucaccuauaauuaacag

SEQ ID NO: 2285717 - RNA, 12 nt, Yersinia pestis
auuucacccucu

SEQ ID NO: 2285718 - RNA, 22 nt, Yersinia pestis
auuucgccguauuuguauuuac

SEQ ID NO: 2285719 - RNA, 15 nt, Yersinia pestis
auuucgguaggaaua

SEQ ID NO: 2285720 - RNA, 13 nt, Yersinia pestis
auuucaaaguaaa

SEQ ID NO: 2285721 - RNA, 16 nt, Yersinia pestis
auuucaaaguaaaaua

SEQ ID NO: 2285722 - RNA, 13 nt, Yersinia pestis
auuucaaacuccg

SEQ ID NO: 2285723 - RNA, 12 nt, Yersinia pestis
auuucaaucacu

SEQ ID NO: 2285724 - RNA, 19 nt, Yersinia pestis
auuucaauucucccauuua

SEQ ID NO: 2285725 - RNA, 13 nt, Yersinia pestis
auuuauuuucccc

SEQ ID NO: 2285726 - RNA, 15 nt, Yersinia pestis
auuuauuuuccccua

SEQ ID NO: 2285727 - RNA, 14 nt, Yersinia pestis
auuuauuuuuaagg

SEQ ID NO: 2285728 - RNA, 22 nt, Yersinia pestis
auuuauuuuugcuuguuauuuu

SEQ ID NO: 2285729 - RNA, 15 nt, Yersinia pestis
auuuauuuuuucuuu

SEQ ID NO: 2285730 - RNA, 19 nt, Yersinia pestis
auuuauuuuuuguuuuuau

SEQ ID NO: 2285731 - RNA, 15 nt, Yersinia pestis
auuucaaaaaagccc

SEQ ID NO: 2285732 - RNA, 13 nt, Yersinia pestis
auuuauuuucauu

SEQ ID NO: 2285733 - RNA, 20 nt, Yersinia pestis
auuuauuuguagugacguaa

SEQ ID NO: 2285734 - RNA, 20 nt, Yersinia pestis
auuuauuuuauaaugagaau

SEQ ID NO: 2285735 - RNA, 14 nt, Yersinia pestis
auuuauuuauccug

SEQ ID NO: 2285736 - RNA, 17 nt, Yersinia pestis
auuuauuuauaaaacca

SEQ ID NO: 2285737 - RNA, 18 nt, Yersinia pestis
auuuauuuauaaaaccac

SEQ ID NO: 2285738 - RNA, 18 nt, Yersinia pestis
auuuauuguuaucaaauc

SEQ ID NO: 2285739 - RNA, 21 nt, Yersinia pestis
auuuauuguuaucaaaucagg

SEQ ID NO: 2285740 - RNA, 20 nt, Yersinia pestis
auuuauuggucaauaaaauu

SEQ ID NO: 2285741 - RNA, 21 nt, Yersinia pestis
auuuauugcggcuuagccacu

SEQ ID NO: 2285742 - RNA, 14 nt, Yersinia pestis
auuuauuaaaacac

SEQ ID NO: 2285743 - RNA, 17 nt, Yersinia pestis
auuuauuaaaacacauc

SEQ ID NO: 2285744 - RNA, 14 nt, Yersinia pestis
auuuaugaacacuc

SEQ ID NO: 2285745 - RNA, 15 nt, Yersinia pestis
aaaagucacuuaaac

SEQ ID NO: 2285746 - RNA, 21 nt, Yersinia pestis
aaaaguauugcacugagagaa

SEQ ID NO: 2285747 - RNA, 22 nt, Yersinia pestis
aaaagucagcaaaucaaacaaa

SEQ ID NO: 2285748 - RNA, 20 nt, Yersinia pestis
auuuaucugcauuaaaauaa

SEQ ID NO: 2285749 - RNA, 22 nt, Yersinia pestis
auuuaucugcauuaaaauaaca

SEQ ID NO: 2285750 - RNA, 14 nt, Yersinia pestis
auuuaucauaaaua

SEQ ID NO: 2285751 - RNA, 16 nt, Yersinia pestis
auuuaucauauuaaca

SEQ ID NO: 2285752 - RNA, 17 nt, Yersinia pestis
auuuaucgccaacauaa

SEQ ID NO: 2285753 - RNA, 19 nt, Yersinia pestis
auuuaucgcuguuuacuga

SEQ ID NO: 2285754 - RNA, 21 nt, Yersinia pestis
auuuaacgccaccaaugcauc

SEQ ID NO: 2285755 - RNA, 13 nt, Yersinia pestis
auuuauauaacga

SEQ ID NO: 2285756 - RNA, 21 nt, Yersinia pestis
auuuauagaauacaggguaaa

SEQ ID NO: 2285757 - RNA, 19 nt, Yersinia pestis
cagcgucagucaaugagcc

SEQ ID NO: 2285758 - RNA, 20 nt, Yersinia pestis
aaaauucaucuuuaacaaca

SEQ ID NO: 2285759 - RNA, 22 nt, Yersinia pestis
aaaauucguuucucuaaaauuu

SEQ ID NO: 2285760 - RNA, 18 nt, Yersinia pestis
cagcguucuucugauuca

SEQ ID NO: 2285761 - RNA, 14 nt, Yersinia pestis
cagcguugaaaaac

SEQ ID NO: 2285762 - RNA, 16 nt, Yersinia pestis
cagcguugacaccaga

SEQ ID NO: 2285763 - RNA, 21 nt, Yersinia pestis
cagcguggcccaggcaaucuc

SEQ ID NO: 2285764 - RNA, 15 nt, Yersinia pestis
cagcguggcauugag

SEQ ID NO: 2285765 - RNA, 13 nt, Yersinia pestis
aaaauuagagcaa

SEQ ID NO: 2285766 - RNA, 15 nt, Yersinia pestis
aaaauuagccaagca

SEQ ID NO: 2285767 - RNA, 15 nt, Yersinia pestis
cagcgggcgcagcca

SEQ ID NO: 2285768 - RNA, 17 nt, Yersinia pestis
aaaauucaaacaaauau

SEQ ID NO: 2285769 - RNA, 22 nt, Yersinia pestis
cagcgguaugaggaucccuucu

SEQ ID NO: 2285770 - RNA, 13 nt, Yersinia pestis
cagcguaaacagu

SEQ ID NO: 2285771 - RNA, 14 nt, Yersinia pestis
cagcguauggggaa

SEQ ID NO: 2285772 - RNA, 16 nt, Yersinia pestis
cagcguauucaguaaa

SEQ ID NO: 2285773 - RNA, 20 nt, Yersinia pestis
cagcguauucaguaaaaacu

SEQ ID NO: 2285774 - RNA, 18 nt, Yersinia pestis
cagcguagccguuaaaua

SEQ ID NO: 2285775 - RNA, 19 nt, Yersinia pestis
cagcguagccguuaaauau

SEQ ID NO: 2285776 - RNA, 20 nt, Yersinia pestis
cagcguauugugauucauac

SEQ ID NO: 2285777 - RNA, 16 nt, Yersinia pestis
cagcgucaaaccauuu

SEQ ID NO: 2285778 - RNA, 12 nt, Yersinia pestis
aaaauuaaaaua

SEQ ID NO: 2285779 - RNA, 22 nt, Yersinia pestis
aaaauuacaguucuuuauccac

SEQ ID NO: 2285780 - RNA, 16 nt, Yersinia pestis
aaaauuacccagcauc

SEQ ID NO: 2285781 - RNA, 17 nt, Yersinia pestis
cagcggcguaucaaacg

SEQ ID NO: 2285782 - RNA, 21 nt, Yersinia pestis
cagcgcuuggugaugcugcug

SEQ ID NO: 2285783 - RNA, 23 nt, Yersinia pestis
cagcgcuuggugaugcugcuggc

SEQ ID NO: 2285784 - RNA, 15 nt, Yersinia pestis
cagcggaugauaaau

SEQ ID NO: 2285785 - RNA, 18 nt, Yersinia pestis
cagcgcuauuuguaucaa

SEQ ID NO: 2285786 - RNA, 14 nt, Yersinia pestis
cagccauaacuucu

SEQ ID NO: 2285787 - RNA, 16 nt, Yersinia pestis
cagccagugcuggcaa

SEQ ID NO: 2285788 - RNA, 15 nt, Yersinia pestis
cagccaauguuucaa

SEQ ID NO: 2285789 - RNA, 21 nt, Yersinia pestis
cagccaauguuucaaaucuac

SEQ ID NO: 2285790 - RNA, 21 nt, Yersinia pestis
cagccaagacuuuccacaaca

SEQ ID NO: 2285791 - RNA, 15 nt, Yersinia pestis
cagccaagaucccaa

SEQ ID NO: 2285792 - RNA, 23 nt, Yersinia pestis
cagccauuugaacaaaccccacu

SEQ ID NO: 2285793 - RNA, 19 nt, Yersinia pestis
cagcccaccagcagcgccc

SEQ ID NO: 2285794 - RNA, 13 nt, Yersinia pestis
cagcccagcaggc

SEQ ID NO: 2285795 - RNA, 22 nt, Yersinia pestis
cagcccauuuagcuggcugaac

SEQ ID NO: 2285796 - RNA, 14 nt, Yersinia pestis
cagcccaucuuuga

SEQ ID NO: 2285797 - RNA, 19 nt, Yersinia pestis
cagcccagucucuuugcca

SEQ ID NO: 2285798 - RNA, 16 nt, Yersinia pestis
cagccccuagcaccgc

SEQ ID NO: 2285799 - RNA, 18 nt, Yersinia pestis
cagcgauauacaucacgu

SEQ ID NO: 2285800 - RNA, 23 nt, Yersinia pestis
cagccuuaauguuuuacgaucaa

SEQ ID NO: 2285801 - RNA, 15 nt, Yersinia pestis
cagcgacgauaauuu

SEQ ID NO: 2285802 - RNA, 14 nt, Yersinia pestis
cagcgagcacugcc

SEQ ID NO: 2285803 - RNA, 15 nt, Yersinia pestis
cagcgagcacugccc

SEQ ID NO: 2285804 - RNA, 16 nt, Yersinia pestis
cagcgagcacugcccc

SEQ ID NO: 2285805 - RNA, 14 nt, Yersinia pestis
cagccuaaggccau

SEQ ID NO: 2285806 - RNA, 14 nt, Yersinia pestis
cagccuaaccgcug

SEQ ID NO: 2285807 - RNA, 14 nt, Yersinia pestis
cagccuaaaaugaa

SEQ ID NO: 2285808 - RNA, 17 nt, Yersinia pestis
cagccuauccucaccgu

SEQ ID NO: 2285809 - RNA, 21 nt, Yersinia pestis
cagccuaaggccaucaauaaa

SEQ ID NO: 2285810 - RNA, 21 nt, Yersinia pestis
cagccuauggcgguuccaaag

SEQ ID NO: 2285811 - RNA, 15 nt, Yersinia pestis
cagggaucaccucuu

SEQ ID NO: 2285812 - RNA, 17 nt, Yersinia pestis
cagggcgcaauggcgcu

SEQ ID NO: 2285813 - RNA, 24 nt, Yersinia pestis
cagggcgauagcccuacuggcuga

SEQ ID NO: 2285814 - RNA, 14 nt, Yersinia pestis
cagggucaccacca

SEQ ID NO: 2285815 - RNA, 15 nt, Yersinia pestis
caggguaaauuauuu

SEQ ID NO: 2285816 - RNA, 16 nt, Yersinia pestis
caggguaaauuauuuu

SEQ ID NO: 2285817 - RNA, 17 nt, Yersinia pestis
caggggagccgaagcgc

SEQ ID NO: 2285818 - RNA, 16 nt, Yersinia pestis
caggggcaauuaucuu

SEQ ID NO: 2285819 - RNA, 23 nt, Yersinia pestis
caggggauagcaacugccaauau

SEQ ID NO: 2285820 - RNA, 20 nt, Yersinia pestis
cagggugaccgcacugccca

SEQ ID NO: 2285821 - RNA, 17 nt, Yersinia pestis
cagggugcgggccagaa

SEQ ID NO: 2285822 - RNA, 16 nt, Yersinia pestis
cagguaaugcauucug

SEQ ID NO: 2285823 - RNA, 19 nt, Yersinia pestis
cagguaauauugaagacaa

SEQ ID NO: 2285824 - RNA, 19 nt, Yersinia pestis
cagguaauuuauagaccuu

SEQ ID NO: 2285825 - RNA, 16 nt, Yersinia pestis
cagguaaugucacugc

SEQ ID NO: 2285826 - RNA, 21 nt, Yersinia pestis
caggcgacccagcgccauaac

SEQ ID NO: 2285827 - RNA, 16 nt, Yersinia pestis
caggccaagccugugc

SEQ ID NO: 2285828 - RNA, 11 nt, Yersinia pestis
caggccaauag

SEQ ID NO: 2285829 - RNA, 14 nt, Yersinia pestis
caggccaauagccc

SEQ ID NO: 2285830 - RNA, 20 nt, Yersinia pestis
caggcgaguuucccuuuucc

SEQ ID NO: 2285831 - RNA, 17 nt, Yersinia pestis
caggcuacggcugaucu

SEQ ID NO: 2285832 - RNA, 14 nt, Yersinia pestis
caggcgcuucaccc

SEQ ID NO: 2285833 - RNA, 17 nt, Yersinia pestis
caggcgcuucacccugu

SEQ ID NO: 2285834 - RNA, 19 nt, Yersinia pestis
caggcggguaacugugcag

SEQ ID NO: 2285835 - RNA, 16 nt, Yersinia pestis
caggcgugcugcuucc

SEQ ID NO: 2285836 - RNA, 15 nt, Yersinia pestis
cagcuucgccaccag

SEQ ID NO: 2285837 - RNA, 23 nt, Yersinia pestis
cagcugggauaugccguauacgu

SEQ ID NO: 2285838 - RNA, 16 nt, Yersinia pestis
caggaagagaaaagca

SEQ ID NO: 2285839 - RNA, 16 nt, Yersinia pestis
caggaagcaagaaacu

SEQ ID NO: 2285840 - RNA, 17 nt, Yersinia pestis
caggaaacuggccaacu

SEQ ID NO: 2285841 - RNA, 21 nt, Yersinia pestis
cagcuuuagcauugcagauuu

SEQ ID NO: 2285842 - RNA, 22 nt, Yersinia pestis
cagcugacuaaaucgcuuaucu

SEQ ID NO: 2285843 - RNA, 15 nt, Yersinia pestis
cagcugacgcagcag

SEQ ID NO: 2285844 - RNA, 21 nt, Yersinia pestis
cagcugauaugaaaaaucuga

SEQ ID NO: 2285845 - RNA, 22 nt, Yersinia pestis
cagcguuuccucgaucagauac

SEQ ID NO: 2285846 - RNA, 14 nt, Yersinia pestis
caggcaacgacagc

SEQ ID NO: 2285847 - RNA, 14 nt, Yersinia pestis
caggcagcacggcu

SEQ ID NO: 2285848 - RNA, 14 nt, Yersinia pestis
caggcagaaauaau

SEQ ID NO: 2285849 - RNA, 13 nt, Yersinia pestis
caggcauaucacu

SEQ ID NO: 2285850 - RNA, 20 nt, Yersinia pestis
caggcauaucacuauuucgu

SEQ ID NO: 2285851 - RNA, 19 nt, Yersinia pestis
caggauaaaccuacagcca

SEQ ID NO: 2285852 - RNA, 15 nt, Yersinia pestis
caggauuagcuucug

SEQ ID NO: 2285853 - RNA, 15 nt, Yersinia pestis
caggagugaauuucu

SEQ ID NO: 2285854 - RNA, 21 nt, Yersinia pestis
cacuucaaucacuuuauacgc

SEQ ID NO: 2285855 - RNA, 14 nt, Yersinia pestis
cacuucaagcagca

SEQ ID NO: 2285856 - RNA, 21 nt, Yersinia pestis
cacuucaucauucauuuuaaa

SEQ ID NO: 2285857 - RNA, 13 nt, Yersinia pestis
cacuucauuuucu

SEQ ID NO: 2285858 - RNA, 23 nt, Yersinia pestis
cacuucauuuucucgcggggaua

SEQ ID NO: 2285859 - RNA, 18 nt, Yersinia pestis
cacuucgauacuacaauc

SEQ ID NO: 2285860 - RNA, 20 nt, Yersinia pestis
cacuucgauacuacaaucau

SEQ ID NO: 2285861 - RNA, 22 nt, Yersinia pestis
cacuucguagggcacuuucauc

SEQ ID NO: 2285862 - RNA, 16 nt, Yersinia pestis
cacuucgguggcccug

SEQ ID NO: 2285863 - RNA, 11 nt, Yersinia pestis
cacuucucuga

SEQ ID NO: 2285864 - RNA, 23 nt, Yersinia pestis
cacuucucugacacacaaauccu

SEQ ID NO: 2285865 - RNA, 22 nt, Yersinia pestis
cacuuggguagcagcccaacac

SEQ ID NO: 2285866 - RNA, 16 nt, Yersinia pestis
cacuuguaccugugcc

SEQ ID NO: 2285867 - RNA, 17 nt, Yersinia pestis
cacuuggcuaauuguca

SEQ ID NO: 2285868 - RNA, 13 nt, Yersinia pestis
cacuuauccagcu

SEQ ID NO: 2285869 - RNA, 13 nt, Yersinia pestis
cacuuagugcugg

SEQ ID NO: 2285870 - RNA, 23 nt, Yersinia pestis
cacuuauuugaaauacuuauuug

SEQ ID NO: 2285871 - RNA, 12 nt, Yersinia pestis
cacuuauuggaa

SEQ ID NO: 2285872 - RNA, 21 nt, Yersinia pestis
cacuuauuggaaguacuuauu

SEQ ID NO: 2285873 - RNA, 22 nt, Yersinia pestis
cacuuauuggaaguacuuauuu

SEQ ID NO: 2285874 - RNA, 21 nt, Yersinia pestis
cacuuauuugaaauacuuauu

SEQ ID NO: 2285875 - RNA, 22 nt, Yersinia pestis
cacuuauuugaaauacuuauuu

SEQ ID NO: 2285876 - RNA, 19 nt, Yersinia pestis
cacuuacccgaaucacuga

SEQ ID NO: 2285877 - RNA, 13 nt, Yersinia pestis
cacuuacugccaa

SEQ ID NO: 2285878 - RNA, 22 nt, Yersinia pestis
cacuuaacacgaaccuucucug

SEQ ID NO: 2285879 - RNA, 15 nt, Yersinia pestis
cacuguuuuucauua

SEQ ID NO: 2285880 - RNA, 18 nt, Yersinia pestis
cacuggcgguugaauaug

SEQ ID NO: 2285881 - RNA, 13 nt, Yersinia pestis
cacuggcaccgcu

SEQ ID NO: 2285882 - RNA, 21 nt, Yersinia pestis
cacuggaguuaaaucccugug

SEQ ID NO: 2285883 - RNA, 15 nt, Yersinia pestis
cacuguacugggaug

SEQ ID NO: 2285884 - RNA, 20 nt, Yersinia pestis
cacuguacugggaugaagaa

SEQ ID NO: 2285885 - RNA, 24 nt, Yersinia pestis
cacuggugcugcccaaaaucaaau

SEQ ID NO: 2285886 - RNA, 20 nt, Yersinia pestis
cagaacugauuucaggaaug

SEQ ID NO: 2285887 - RNA, 16 nt, Yersinia pestis
cagaagcuuauccauu

SEQ ID NO: 2285888 - RNA, 19 nt, Yersinia pestis
cagaagggcggccagcaag

SEQ ID NO: 2285889 - RNA, 22 nt, Yersinia pestis
cagaaguaugcguggguucuuc

SEQ ID NO: 2285890 - RNA, 16 nt, Yersinia pestis
cagaagguaagccagu

SEQ ID NO: 2285891 - RNA, 19 nt, Yersinia pestis
cagaaccuguuacaucaga

SEQ ID NO: 2285892 - RNA, 16 nt, Yersinia pestis
cagaacgcaaucaggg

SEQ ID NO: 2285893 - RNA, 19 nt, Yersinia pestis
cagaacccccgcgaacagc

SEQ ID NO: 2285894 - RNA, 16 nt, Yersinia pestis
cagaacagguuuuuuc

SEQ ID NO: 2285895 - RNA, 22 nt, Yersinia pestis
cagaaagguaugugccaaaaaa

SEQ ID NO: 2285896 - RNA, 17 nt, Yersinia pestis
cagaaaguaaucuuuga

SEQ ID NO: 2285897 - RNA, 20 nt, Yersinia pestis
cacuuugucaauaaccucag

SEQ ID NO: 2285898 - RNA, 19 nt, Yersinia pestis
cacuuugggcugaucaucg

SEQ ID NO: 2285899 - RNA, 14 nt, Yersinia pestis
cacuuuucagauag

SEQ ID NO: 2285900 - RNA, 19 nt, Yersinia pestis
cagaaagaagucuaacaaa

SEQ ID NO: 2285901 - RNA, 12 nt, Yersinia pestis
cagaaagcagca

SEQ ID NO: 2285902 - RNA, 14 nt, Yersinia pestis
cagaaaaucacgua

SEQ ID NO: 2285903 - RNA, 16 nt, Yersinia pestis
cagaaacggcaucugc

SEQ ID NO: 2285904 - RNA, 14 nt, Yersinia pestis
cagaaaaccuucag

SEQ ID NO: 2285905 - RNA, 20 nt, Yersinia pestis
cagaaaaccuucagcaaaga

SEQ ID NO: 2285906 - RNA, 21 nt, Yersinia pestis
cagaaaaccuucagcaaagag

SEQ ID NO: 2285907 - RNA, 20 nt, Yersinia pestis
cacuugugguaaccccgucg

SEQ ID NO: 2285908 - RNA, 17 nt, Yersinia pestis
cacuuuaccgauuucag

SEQ ID NO: 2285909 - RNA, 12 nt, Yersinia pestis
cacuuuaaauac

SEQ ID NO: 2285910 - RNA, 22 nt, Yersinia pestis
cacuuuaaauacccagcuucuu

SEQ ID NO: 2285911 - RNA, 16 nt, Yersinia pestis
cacuuuacauaaccua

SEQ ID NO: 2285912 - RNA, 17 nt, Yersinia pestis
cacuuuagccaagguua

SEQ ID NO: 2285913 - RNA, 13 nt, Yersinia pestis
aaaauaucacuau

SEQ ID NO: 2285914 - RNA, 19 nt, Yersinia pestis
aaaauaucgcgcuucaggu

SEQ ID NO: 2285915 - RNA, 22 nt, Yersinia pestis
aaaauauuaacugcagugaaaa

SEQ ID NO: 2285916 - RNA, 18 nt, Yersinia pestis
aaaauauucuaaguaaaa

SEQ ID NO: 2285917 - RNA, 20 nt, Yersinia pestis
aaaauaugauaguguaaaaa

SEQ ID NO: 2285918 - RNA, 22 nt, Yersinia pestis
aaaauaugauaguguaaaaacc

SEQ ID NO: 2285919 - RNA, 21 nt, Yersinia pestis
cacuaccgucuuggauauuug

SEQ ID NO: 2285920 - RNA, 15 nt, Yersinia pestis
cacuacauucugaua

SEQ ID NO: 2285921 - RNA, 21 nt, Yersinia pestis
cacuacgggucguuaguccgc

SEQ ID NO: 2285922 - RNA, 18 nt, Yersinia pestis
cacuaaaccuugaauauc

SEQ ID NO: 2285923 - RNA, 15 nt, Yersinia pestis
cacuaaaacugaagc

SEQ ID NO: 2285924 - RNA, 16 nt, Yersinia pestis
cacuaaaauaucaaau

SEQ ID NO: 2285925 - RNA, 19 nt, Yersinia pestis
cacuaaccccugcauugag

SEQ ID NO: 2285926 - RNA, 22 nt, Yersinia pestis
cacuaauaccugauguuuugcu

SEQ ID NO: 2285927 - RNA, 14 nt, Yersinia pestis
cacuaauagcauuu

SEQ ID NO: 2285928 - RNA, 19 nt, Yersinia pestis
cacuaauuagugacaguag

SEQ ID NO: 2285929 - RNA, 12 nt, Yersinia pestis
cacguuuuauau

SEQ ID NO: 2285930 - RNA, 13 nt, Yersinia pestis
cacguuuccaaaa

SEQ ID NO: 2285931 - RNA, 12 nt, Yersinia pestis
cacguuuaaaca

SEQ ID NO: 2285932 - RNA, 20 nt, Yersinia pestis
cacguucggcgucgccaccc

SEQ ID NO: 2285933 - RNA, 17 nt, Yersinia pestis
cacgugcuuacuggccu

SEQ ID NO: 2285934 - RNA, 18 nt, Yersinia pestis
cacgugcuuacuggccug

SEQ ID NO: 2285935 - RNA, 18 nt, Yersinia pestis
cacguucaccaaagcaau

SEQ ID NO: 2285936 - RNA, 19 nt, Yersinia pestis
cacuauccccaauucacgc

SEQ ID NO: 2285937 - RNA, 17 nt, Yersinia pestis
cacuauaggcuauuuua

SEQ ID NO: 2285938 - RNA, 14 nt, Yersinia pestis
cacuaucacaucaa

SEQ ID NO: 2285939 - RNA, 18 nt, Yersinia pestis
cacuaucacaucaaauuu

SEQ ID NO: 2285940 - RNA, 14 nt, Yersinia pestis
cacuauuucagaca

SEQ ID NO: 2285941 - RNA, 17 nt, Yersinia pestis
cacuauuucguguauau

SEQ ID NO: 2285942 - RNA, 23 nt, Yersinia pestis
cacuauuucguguauaucacuau

SEQ ID NO: 2285943 - RNA, 18 nt, Yersinia pestis
cacuauucuccaacaacu

SEQ ID NO: 2285944 - RNA, 20 nt, Yersinia pestis
cacuauucuccaacaacugc

SEQ ID NO: 2285945 - RNA, 14 nt, Yersinia pestis
cacuaugggggauu

SEQ ID NO: 2285946 - RNA, 12 nt, Yersinia pestis
cacucaagccag

SEQ ID NO: 2285947 - RNA, 13 nt, Yersinia pestis
cacucaaugucau

SEQ ID NO: 2285948 - RNA, 14 nt, Yersinia pestis
cacucacauaagaa

SEQ ID NO: 2285949 - RNA, 14 nt, Yersinia pestis
cacucagcgcuggc

SEQ ID NO: 2285950 - RNA, 19 nt, Yersinia pestis
cacucagaucccccugcug

SEQ ID NO: 2285951 - RNA, 21 nt, Yersinia pestis
cacucagauuuacccaaaggc

SEQ ID NO: 2285952 - RNA, 14 nt, Yersinia pestis
cacucaccuaaauc

SEQ ID NO: 2285953 - RNA, 23 nt, Yersinia pestis
cacucaggguuagggaugagugu

SEQ ID NO: 2285954 - RNA, 16 nt, Yersinia pestis
cacucauaauuuugau

SEQ ID NO: 2285955 - RNA, 20 nt, Yersinia pestis
cacucauaauuuugaugcua

SEQ ID NO: 2285956 - RNA, 15 nt, Yersinia pestis
cacucauugccuggc

SEQ ID NO: 2285957 - RNA, 19 nt, Yersinia pestis
cacugcacuuuaaucgcca

SEQ ID NO: 2285958 - RNA, 15 nt, Yersinia pestis
cacugaguugcugga

SEQ ID NO: 2285959 - RNA, 15 nt, Yersinia pestis
cacugaguucugcug

SEQ ID NO: 2285960 - RNA, 22 nt, Yersinia pestis
cacugagucgucugucgggaac

SEQ ID NO: 2285961 - RNA, 17 nt, Yersinia pestis
cacugauagauucauca

SEQ ID NO: 2285962 - RNA, 22 nt, Yersinia pestis
cacugauagauucaucaccagu

SEQ ID NO: 2285963 - RNA, 12 nt, Yersinia pestis
cacugagcaccg

SEQ ID NO: 2285964 - RNA, 14 nt, Yersinia pestis
cacugagcaccgca

SEQ ID NO: 2285965 - RNA, 14 nt, Yersinia pestis
cacuggaaaaagug

SEQ ID NO: 2285966 - RNA, 13 nt, Yersinia pestis
cacugcucuaucu

SEQ ID NO: 2285967 - RNA, 13 nt, Yersinia pestis
cacugcucugccc

SEQ ID NO: 2285968 - RNA, 16 nt, Yersinia pestis
cacugccgucaaugcc

SEQ ID NO: 2285969 - RNA, 16 nt, Yersinia pestis
cacugccugcucucug

SEQ ID NO: 2285970 - RNA, 12 nt, Yersinia pestis
cacucgaaucac

SEQ ID NO: 2285971 - RNA, 13 nt, Yersinia pestis
cacuccggcauca

SEQ ID NO: 2285972 - RNA, 16 nt, Yersinia pestis
cacuccauuaauuuau

SEQ ID NO: 2285973 - RNA, 21 nt, Yersinia pestis
cacucuacuuucuacuccauu

SEQ ID NO: 2285974 - RNA, 18 nt, Yersinia pestis
cacucguuguauuuuccu

SEQ ID NO: 2285975 - RNA, 14 nt, Yersinia pestis
cacugacagcaacg

SEQ ID NO: 2285976 - RNA, 20 nt, Yersinia pestis
cacugacagcaacgacgccc

SEQ ID NO: 2285977 - RNA, 14 nt, Yersinia pestis
cacugaauaacuga

SEQ ID NO: 2285978 - RNA, 12 nt, Yersinia pestis
cagaucauuuuu

SEQ ID NO: 2285979 - RNA, 18 nt, Yersinia pestis
cagaucauuuuuuuccac

SEQ ID NO: 2285980 - RNA, 17 nt, Yersinia pestis
cagauccagaauuucau

SEQ ID NO: 2285981 - RNA, 18 nt, Yersinia pestis
cagaucccccugcugcca

SEQ ID NO: 2285982 - RNA, 19 nt, Yersinia pestis
cagaucccccugcugccag

SEQ ID NO: 2285983 - RNA, 21 nt, Yersinia pestis
cagauccucaucacugccguc

SEQ ID NO: 2285984 - RNA, 22 nt, Yersinia pestis
aaaaucguauaacauaauaaau

SEQ ID NO: 2285985 - RNA, 23 nt, Yersinia pestis
cagauccugccgccucugcuccg

SEQ ID NO: 2285986 - RNA, 20 nt, Yersinia pestis
cagauucgcaaagcgggcca

SEQ ID NO: 2285987 - RNA, 15 nt, Yersinia pestis
cagauuggcuugcuu

SEQ ID NO: 2285988 - RNA, 18 nt, Yersinia pestis
cagcaaaaacaaauaauu

SEQ ID NO: 2285989 - RNA, 18 nt, Yersinia pestis
cagauuuuugcuuuccac

SEQ ID NO: 2285990 - RNA, 19 nt, Yersinia pestis
aaaaucuuccuuuccauuu

SEQ ID NO: 2285991 - RNA, 13 nt, Yersinia pestis
cagcaaacaguga

SEQ ID NO: 2285992 - RNA, 19 nt, Yersinia pestis
cagcaaacagugauucgcu

SEQ ID NO: 2285993 - RNA, 12 nt, Yersinia pestis
cagcaaacgucc

SEQ ID NO: 2285994 - RNA, 14 nt, Yersinia pestis
cagcaaaagccucu

SEQ ID NO: 2285995 - RNA, 18 nt, Yersinia pestis
aaaaugauaaauucuugc

SEQ ID NO: 2285996 - RNA, 18 nt, Yersinia pestis
aaaaugauaauaaaaaaa

SEQ ID NO: 2285997 - RNA, 17 nt, Yersinia pestis
aaaaugaucuuuauuau

SEQ ID NO: 2285998 - RNA, 15 nt, Yersinia pestis
cagcaaaggccacca

SEQ ID NO: 2285999 - RNA, 15 nt, Yersinia pestis
cagcaaaucauuuaa

SEQ ID NO: 2286000 - RNA, 14 nt, Yersinia pestis
cagcaaaucauaaa

SEQ ID NO: 2286001 - RNA, 12 nt, Yersinia pestis
cagcaaaucaaa

SEQ ID NO: 2286002 - RNA, 22 nt, Yersinia pestis
cagcaaauaccgggacuaccaa

SEQ ID NO: 2286003 - RNA, 15 nt, Yersinia pestis
cagcaacgguuucaa

SEQ ID NO: 2286004 - RNA, 22 nt, Yersinia pestis
cagcaaguuagcgauaucugcg

SEQ ID NO: 2286005 - RNA, 18 nt, Yersinia pestis
cagcaauaaaccacuggu

SEQ ID NO: 2286006 - RNA, 15 nt, Yersinia pestis
cagcaauaaaccacu

SEQ ID NO: 2286007 - RNA, 19 nt, Yersinia pestis
aaaaugccguacaacaaua

SEQ ID NO: 2286008 - RNA, 23 nt, Yersinia pestis
cagcaccagggaugggcgccgcu

SEQ ID NO: 2286009 - RNA, 14 nt, Yersinia pestis
cagcaccauacagc

SEQ ID NO: 2286010 - RNA, 14 nt, Yersinia pestis
cagcacauuuuuau

SEQ ID NO: 2286011 - RNA, 18 nt, Yersinia pestis
cagcaauaugaauacgaa

SEQ ID NO: 2286012 - RNA, 13 nt, Yersinia pestis
cagcaauauuguc

SEQ ID NO: 2286013 - RNA, 16 nt, Yersinia pestis
cagcaccaauaucaau

SEQ ID NO: 2286014 - RNA, 18 nt, Yersinia pestis
cagcaccacaauggcaga

SEQ ID NO: 2286015 - RNA, 18 nt, Yersinia pestis
cagcagcauccugaacuu

SEQ ID NO: 2286016 - RNA, 22 nt, Yersinia pestis
cagcagauugauaacaccggcu

SEQ ID NO: 2286017 - RNA, 15 nt, Yersinia pestis
cagcacguucaccaa

SEQ ID NO: 2286018 - RNA, 22 nt, Yersinia pestis
cagcacguucaccaaagcaaug

SEQ ID NO: 2286019 - RNA, 12 nt, Yersinia pestis
cagcacucagua

SEQ ID NO: 2286020 - RNA, 23 nt, Yersinia pestis
cagcacuacguguuuuucaucug

SEQ ID NO: 2286021 - RNA, 15 nt, Yersinia pestis
cagcacuauccccaa

SEQ ID NO: 2286022 - RNA, 13 nt, Yersinia pestis
cagcacgguaacc

SEQ ID NO: 2286023 - RNA, 19 nt, Yersinia pestis
cagcacgggcuaucgggua

SEQ ID NO: 2286024 - RNA, 15 nt, Yersinia pestis
cagcacguaccgcug

SEQ ID NO: 2286025 - RNA, 21 nt, Yersinia pestis
cagaauaauaagccgugccug

SEQ ID NO: 2286026 - RNA, 21 nt, Yersinia pestis
cagaaucaccaacaccaccau

SEQ ID NO: 2286027 - RNA, 16 nt, Yersinia pestis
cagaauaucguggaga

SEQ ID NO: 2286028 - RNA, 21 nt, Yersinia pestis
cagaaucacugucaaaaagca

SEQ ID NO: 2286029 - RNA, 14 nt, Yersinia pestis
cagaaucagcccca

SEQ ID NO: 2286030 - RNA, 11 nt, Yersinia pestis
cagacaaacaa

SEQ ID NO: 2286031 - RNA, 17 nt, Yersinia pestis
cagacaaccaauacaca

SEQ ID NO: 2286032 - RNA, 21 nt, Yersinia pestis
cagacaacagucacaccaaca

SEQ ID NO: 2286033 - RNA, 15 nt, Yersinia pestis
cagacaacagucaca

SEQ ID NO: 2286034 - RNA, 19 nt, Yersinia pestis
cagacauuuuucuauuucu

SEQ ID NO: 2286035 - RNA, 17 nt, Yersinia pestis
cagaaugaaguucacca

SEQ ID NO: 2286036 - RNA, 23 nt, Yersinia pestis
cagaaugaaguucaccagcuugg

SEQ ID NO: 2286037 - RNA, 21 nt, Yersinia pestis
cagacugaaaguagaaauaaa

SEQ ID NO: 2286038 - RNA, 22 nt, Yersinia pestis
cagacugaaaguagaaauaaaa

SEQ ID NO: 2286039 - RNA, 20 nt, Yersinia pestis
cagacugaaaugacauugcg

SEQ ID NO: 2286040 - RNA, 16 nt, Yersinia pestis
cagacugcucuuuccc

SEQ ID NO: 2286041 - RNA, 13 nt, Yersinia pestis
cagacuccugccc

SEQ ID NO: 2286042 - RNA, 20 nt, Yersinia pestis
cagacguacauauaucacua

SEQ ID NO: 2286043 - RNA, 19 nt, Yersinia pestis
cagacgaguauuccccacu

SEQ ID NO: 2286044 - RNA, 17 nt, Yersinia pestis
cagacggaauaccaccc

SEQ ID NO: 2286045 - RNA, 21 nt, Yersinia pestis
cagacggcagauccugaacga

SEQ ID NO: 2286046 - RNA, 17 nt, Yersinia pestis
cagacggcagcaacgaa

SEQ ID NO: 2286047 - RNA, 18 nt, Yersinia pestis
cagaccuuuaggaaagcc

SEQ ID NO: 2286048 - RNA, 19 nt, Yersinia pestis
cagacccauuucugcuucu

SEQ ID NO: 2286049 - RNA, 18 nt, Yersinia pestis
cagaccaaauagcaagcc

SEQ ID NO: 2286050 - RNA, 20 nt, Yersinia pestis
cagaccaaauagcaagccaa

SEQ ID NO: 2286051 - RNA, 12 nt, Yersinia pestis
cagaccaaucaa

SEQ ID NO: 2286052 - RNA, 18 nt, Yersinia pestis
aaaauccugaauaauacu

SEQ ID NO: 2286053 - RNA, 19 nt, Yersinia pestis
aaaauccccggaccagccg

SEQ ID NO: 2286054 - RNA, 16 nt, Yersinia pestis
aaaaucgauggaauaa

SEQ ID NO: 2286055 - RNA, 15 nt, Yersinia pestis
cagauagucaucuuu

SEQ ID NO: 2286056 - RNA, 22 nt, Yersinia pestis
cagauaucugcucauuaccaau

SEQ ID NO: 2286057 - RNA, 23 nt, Yersinia pestis
cagauaugccaggcaucaucugc

SEQ ID NO: 2286058 - RNA, 23 nt, Yersinia pestis
cagauauuacgcagccauaccca

SEQ ID NO: 2286059 - RNA, 15 nt, Yersinia pestis
cagaucaacagauuu

SEQ ID NO: 2286060 - RNA, 18 nt, Yersinia pestis
cagaucacccgcaaaacu

SEQ ID NO: 2286061 - RNA, 15 nt, Yersinia pestis
cagauacggcuccag

SEQ ID NO: 2286062 - RNA, 17 nt, Yersinia pestis
cagauacggcuccagaa

SEQ ID NO: 2286063 - RNA, 18 nt, Yersinia pestis
cagauacggcuccagaac

SEQ ID NO: 2286064 - RNA, 14 nt, Yersinia pestis
aaaaucccccacca

SEQ ID NO: 2286065 - RNA, 11 nt, Yersinia pestis
aaaauccccca

SEQ ID NO: 2286066 - RNA, 14 nt, Yersinia pestis
cagauaccacauca

SEQ ID NO: 2286067 - RNA, 19 nt, Yersinia pestis
cagauaaaucaguggguca

SEQ ID NO: 2286068 - RNA, 13 nt, Yersinia pestis
cagauaacaacaa

SEQ ID NO: 2286069 - RNA, 16 nt, Yersinia pestis
cagauaaauaaaauaa

SEQ ID NO: 2286070 - RNA, 17 nt, Yersinia pestis
cagauaaauaaaauaau

SEQ ID NO: 2286071 - RNA, 22 nt, Yersinia pestis
aaaaucacgcggguuaucacau

SEQ ID NO: 2286072 - RNA, 23 nt, Yersinia pestis
aaaaucaccuggccaggaauuaa

SEQ ID NO: 2286073 - RNA, 19 nt, Yersinia pestis
aaaaucacgaaauacguag

SEQ ID NO: 2286074 - RNA, 18 nt, Yersinia pestis
aaaaucacguuuccaaaa

SEQ ID NO: 2286075 - RNA, 22 nt, Yersinia pestis
cagagauuguuuuccacauggc

SEQ ID NO: 2286076 - RNA, 12 nt, Yersinia pestis
cagagcaaaacu

SEQ ID NO: 2286077 - RNA, 21 nt, Yersinia pestis
cagagaugcagagaugcagug

SEQ ID NO: 2286078 - RNA, 13 nt, Yersinia pestis
cagagcucaauuu

SEQ ID NO: 2286079 - RNA, 14 nt, Yersinia pestis
cagagcgggaacgc

SEQ ID NO: 2286080 - RNA, 14 nt, Yersinia pestis
cagauaaauaaaau

SEQ ID NO: 2286081 - RNA, 15 nt, Yersinia pestis
cagauaaauaaaaua

SEQ ID NO: 2286082 - RNA, 20 nt, Yersinia pestis
cagauaaagaaaaacccguu

SEQ ID NO: 2286083 - RNA, 18 nt, Yersinia pestis
cagauaaagaaaaacccg

SEQ ID NO: 2286084 - RNA, 17 nt, Yersinia pestis
cagauaaagaaaaaccc

SEQ ID NO: 2286085 - RNA, 13 nt, Yersinia pestis
caguugcgccgcu

SEQ ID NO: 2286086 - RNA, 14 nt, Yersinia pestis
caguugauggcuuu

SEQ ID NO: 2286087 - RNA, 12 nt, Yersinia pestis
caguugccacuc

SEQ ID NO: 2286088 - RNA, 15 nt, Yersinia pestis
caguugcucauuuuc

SEQ ID NO: 2286089 - RNA, 13 nt, Yersinia pestis
caguucuggcucu

SEQ ID NO: 2286090 - RNA, 15 nt, Yersinia pestis
caguugaccauuuuu

SEQ ID NO: 2286091 - RNA, 18 nt, Yersinia pestis
caguucugguagcugcuc

SEQ ID NO: 2286092 - RNA, 16 nt, Yersinia pestis
caguucccuguucucu

SEQ ID NO: 2286093 - RNA, 22 nt, Yersinia pestis
cauaaaaaaacggugaacauuu

SEQ ID NO: 2286094 - RNA, 23 nt, Yersinia pestis
caguuuuuuauggcauaaacuga

SEQ ID NO: 2286095 - RNA, 17 nt, Yersinia pestis
caguuuuugguagguuu

SEQ ID NO: 2286096 - RNA, 13 nt, Yersinia pestis
caguuuugccgug

SEQ ID NO: 2286097 - RNA, 18 nt, Yersinia pestis
caguuuuuaauuuaaacu

SEQ ID NO: 2286098 - RNA, 18 nt, Yersinia pestis
caguuuuauuguauaaaa

SEQ ID NO: 2286099 - RNA, 22 nt, Yersinia pestis
caguuuuauuguauaaaacacc

SEQ ID NO: 2286100 - RNA, 17 nt, Yersinia pestis
caguuucacccucugcg

SEQ ID NO: 2286101 - RNA, 22 nt, Yersinia pestis
caguuuauuuucccuuucucag

SEQ ID NO: 2286102 - RNA, 14 nt, Yersinia pestis
caguuuauuuuccc

SEQ ID NO: 2286103 - RNA, 16 nt, Yersinia pestis
caguugguuagagcac

SEQ ID NO: 2286104 - RNA, 17 nt, Yersinia pestis
caguugguagagcacga

SEQ ID NO: 2286105 - RNA, 17 nt, Yersinia pestis
caguuuaccauccacua

SEQ ID NO: 2286106 - RNA, 14 nt, Yersinia pestis
caguugucugaggc

SEQ ID NO: 2286107 - RNA, 14 nt, Yersinia pestis
caguugucuauuuu

SEQ ID NO: 2286108 - RNA, 23 nt, Yersinia pestis
caguugucuauuuucauuauuuu

SEQ ID NO: 2286109 - RNA, 18 nt, Yersinia pestis
caguuacgucaggaauaa

SEQ ID NO: 2286110 - RNA, 12 nt, Yersinia pestis
caguuaggcaag

SEQ ID NO: 2286111 - RNA, 22 nt, Yersinia pestis
caguuaaggcuggcugugugag

SEQ ID NO: 2286112 - RNA, 20 nt, Yersinia pestis
caguuaaaaauagacagcag

SEQ ID NO: 2286113 - RNA, 23 nt, Yersinia pestis
caguguuuguagcgcuccagccu

SEQ ID NO: 2286114 - RNA, 18 nt, Yersinia pestis
caguguugcaacggucau

SEQ ID NO: 2286115 - RNA, 20 nt, Yersinia pestis
cagugucuggcaauccagcg

SEQ ID NO: 2286116 - RNA, 20 nt, Yersinia pestis
caguguccagccugguuggu

SEQ ID NO: 2286117 - RNA, 22 nt, Yersinia pestis
cagugucaguucgacaccuuca

SEQ ID NO: 2286118 - RNA, 20 nt, Yersinia pestis
caguucauuccccaucgcca

SEQ ID NO: 2286119 - RNA, 21 nt, Yersinia pestis
caguucauuccccaucgccaa

SEQ ID NO: 2286120 - RNA, 13 nt, Yersinia pestis
caguucauucccc

SEQ ID NO: 2286121 - RNA, 21 nt, Yersinia pestis
caguucauuacaggccccaau

SEQ ID NO: 2286122 - RNA, 14 nt, Yersinia pestis
caguucagcccccu

SEQ ID NO: 2286123 - RNA, 20 nt, Yersinia pestis
caguucagcccccucaauac

SEQ ID NO: 2286124 - RNA, 15 nt, Yersinia pestis
caguucaucaauaac

SEQ ID NO: 2286125 - RNA, 16 nt, Yersinia pestis
caguuaggcggacaac

SEQ ID NO: 2286126 - RNA, 14 nt, Yersinia pestis
caguucaacaccaa

SEQ ID NO: 2286127 - RNA, 16 nt, Yersinia pestis
caguggaacauuuucg

SEQ ID NO: 2286128 - RNA, 20 nt, Yersinia pestis
caguggaaccuccaaaugaa

SEQ ID NO: 2286129 - RNA, 20 nt, Yersinia pestis
cagugcguaaucagccgcgg

SEQ ID NO: 2286130 - RNA, 23 nt, Yersinia pestis
cagugcgguuaucgcucuugagg

SEQ ID NO: 2286131 - RNA, 16 nt, Yersinia pestis
cagugcuauucauaaa

SEQ ID NO: 2286132 - RNA, 23 nt, Yersinia pestis
cagugcuauucauaaaucaguac

SEQ ID NO: 2286133 - RNA, 20 nt, Yersinia pestis
cagugcucccugaacgccuu

SEQ ID NO: 2286134 - RNA, 18 nt, Yersinia pestis
caguguauuaccugcgac

SEQ ID NO: 2286135 - RNA, 18 nt, Yersinia pestis
caguggucaucaccguuu

SEQ ID NO: 2286136 - RNA, 22 nt, Yersinia pestis
cagugguuuuauaaauaaauag

SEQ ID NO: 2286137 - RNA, 18 nt, Yersinia pestis
caguggccauugaacaua

SEQ ID NO: 2286138 - RNA, 14 nt, Yersinia pestis
cagugggauagaga

SEQ ID NO: 2286139 - RNA, 22 nt, Yersinia pestis
cagugccgcggcggccagcggc

SEQ ID NO: 2286140 - RNA, 13 nt, Yersinia pestis
cagugcgcggcgc

SEQ ID NO: 2286141 - RNA, 20 nt, Yersinia pestis
cagugcgcgauaaacgguag

SEQ ID NO: 2286142 - RNA, 13 nt, Yersinia pestis
cagugccaguaau

SEQ ID NO: 2286143 - RNA, 23 nt, Yersinia pestis
cauaaugcggcucucuuucucca

SEQ ID NO: 2286144 - RNA, 20 nt, Yersinia pestis
cauaaugcauccacuuuuuc

SEQ ID NO: 2286145 - RNA, 19 nt, Yersinia pestis
cauacaaauaguaauaauu

SEQ ID NO: 2286146 - RNA, 23 nt, Yersinia pestis
cauaauucugccgacuaauauuu

SEQ ID NO: 2286147 - RNA, 13 nt, Yersinia pestis
cauaauucagcaa

SEQ ID NO: 2286148 - RNA, 18 nt, Yersinia pestis
cauaauuccacauaaaau

SEQ ID NO: 2286149 - RNA, 15 nt, Yersinia pestis
cauaauuaaauauua

SEQ ID NO: 2286150 - RNA, 17 nt, Yersinia pestis
cauaauuaaauauuaac

SEQ ID NO: 2286151 - RNA, 22 nt, Yersinia pestis
cauaauuaaauauuaacauuaa

SEQ ID NO: 2286152 - RNA, 16 nt, Yersinia pestis
cauaauccagaagcca

SEQ ID NO: 2286153 - RNA, 18 nt, Yersinia pestis
cauaaguccuuaaaaauc

SEQ ID NO: 2286154 - RNA, 23 nt, Yersinia pestis
cauaaguccuuaaaaauccauaa

SEQ ID NO: 2286155 - RNA, 23 nt, Yersinia pestis
cauaagugcauuuuugaaacuuu

SEQ ID NO: 2286156 - RNA, 18 nt, Yersinia pestis
cauaauaaccauuuauau

SEQ ID NO: 2286157 - RNA, 18 nt, Yersinia pestis
cauaauaaugauuauuga

SEQ ID NO: 2286158 - RNA, 15 nt, Yersinia pestis
cauaccuuacuucca

SEQ ID NO: 2286159 - RNA, 15 nt, Yersinia pestis
cauacgcagccugaa

SEQ ID NO: 2286160 - RNA, 23 nt, Yersinia pestis
cauacgcagccugaauuuccugc

SEQ ID NO: 2286161 - RNA, 22 nt, Yersinia pestis
cauacccaaauuacggcucagu

SEQ ID NO: 2286162 - RNA, 19 nt, Yersinia pestis
cauacaagccgugaccaaa

SEQ ID NO: 2286163 - RNA, 21 nt, Yersinia pestis
cauacacuaagugcaucaauc

SEQ ID NO: 2286164 - RNA, 18 nt, Yersinia pestis
cauacagcucaucaccaa

SEQ ID NO: 2286165 - RNA, 22 nt, Yersinia pestis
cauacauuggcuccccuuuggg

SEQ ID NO: 2286166 - RNA, 14 nt, Yersinia pestis
cauacauagcaccc

SEQ ID NO: 2286167 - RNA, 19 nt, Yersinia pestis
cauacagguguaccgcuuc

SEQ ID NO: 2286168 - RNA, 17 nt, Yersinia pestis
cauaaccaucaaacaua

SEQ ID NO: 2286169 - RNA, 16 nt, Yersinia pestis
cauaaccgcuaaggcc

SEQ ID NO: 2286170 - RNA, 14 nt, Yersinia pestis
cauaaauuuaucuc

SEQ ID NO: 2286171 - RNA, 19 nt, Yersinia pestis
cauaacaccaauugcaggc

SEQ ID NO: 2286172 - RNA, 21 nt, Yersinia pestis
cauaacaccaauugcaggcuu

SEQ ID NO: 2286173 - RNA, 18 nt, Yersinia pestis
cauaacaggugcaguuuc

SEQ ID NO: 2286174 - RNA, 24 nt, Yersinia pestis
cauaagacaccacaucacgcagcg

SEQ ID NO: 2286175 - RNA, 12 nt, Yersinia pestis
cauaagccgcag

SEQ ID NO: 2286176 - RNA, 19 nt, Yersinia pestis
cauaagcgggguauuuuac

SEQ ID NO: 2286177 - RNA, 19 nt, Yersinia pestis
cauaagcgacgacauuaau

SEQ ID NO: 2286178 - RNA, 21 nt, Yersinia pestis
cauaagcccccguaucaugga

SEQ ID NO: 2286179 - RNA, 20 nt, Yersinia pestis
cauaaaaaugcacugaacaa

SEQ ID NO: 2286180 - RNA, 16 nt, Yersinia pestis
cauaaaauaaauaauu

SEQ ID NO: 2286181 - RNA, 23 nt, Yersinia pestis
cauaaaaaaagaaggguuagcau

SEQ ID NO: 2286182 - RNA, 14 nt, Yersinia pestis
cauaaaaaccgccc

SEQ ID NO: 2286183 - RNA, 15 nt, Yersinia pestis
cauaaaaacuucaga

SEQ ID NO: 2286184 - RNA, 13 nt, Yersinia pestis
cauaaaaagaaaa

SEQ ID NO: 2286185 - RNA, 14 nt, Yersinia pestis
cauaaacugaaguu

SEQ ID NO: 2286186 - RNA, 16 nt, Yersinia pestis
cauaaagauagccacu

SEQ ID NO: 2286187 - RNA, 23 nt, Yersinia pestis
cauaaacugaaguuaaaaagccu

SEQ ID NO: 2286188 - RNA, 21 nt, Yersinia pestis
cauaaagacccaauacaccac

SEQ ID NO: 2286189 - RNA, 18 nt, Yersinia pestis
cauaaacaaguugaacca

SEQ ID NO: 2286190 - RNA, 16 nt, Yersinia pestis
cauaaaaugagccuga

SEQ ID NO: 2286191 - RNA, 11 nt, Yersinia pestis
cauaaauaaag

SEQ ID NO: 2286192 - RNA, 13 nt, Yersinia pestis
cauaaauaaagag

SEQ ID NO: 2286193 - RNA, 15 nt, Yersinia pestis
cauaaauaaagauac

SEQ ID NO: 2286194 - RNA, 14 nt, Yersinia pestis
cauaaagcuauuca

SEQ ID NO: 2286195 - RNA, 20 nt, Yersinia pestis
cauaaagcccgcuucaaagg

SEQ ID NO: 2286196 - RNA, 21 nt, Yersinia pestis
cauaaaucacaauuucacccc

SEQ ID NO: 2286197 - RNA, 16 nt, Yersinia pestis
cauaaauauuuuaugc

SEQ ID NO: 2286198 - RNA, 22 nt, Yersinia pestis
cauaaauauucauuaaaaaaua

SEQ ID NO: 2286199 - RNA, 20 nt, Yersinia pestis
cauaaauaggugcgccagug

SEQ ID NO: 2286200 - RNA, 15 nt, Yersinia pestis
cauaaauuaaaacug

SEQ ID NO: 2286201 - RNA, 14 nt, Yersinia pestis
caucugucuaagug

SEQ ID NO: 2286202 - RNA, 16 nt, Yersinia pestis
caucuuaccggccucu

SEQ ID NO: 2286203 - RNA, 22 nt, Yersinia pestis
caucugcaauaacgugauggua

SEQ ID NO: 2286204 - RNA, 12 nt, Yersinia pestis
caucucggcuuu

SEQ ID NO: 2286205 - RNA, 19 nt, Yersinia pestis
caucuaauguaauaaucua

SEQ ID NO: 2286206 - RNA, 20 nt, Yersinia pestis
caucuaauguaauaaucuaa

SEQ ID NO: 2286207 - RNA, 17 nt, Yersinia pestis
caucuacaacaucaucg

SEQ ID NO: 2286208 - RNA, 14 nt, Yersinia pestis
caucuagcagugau

SEQ ID NO: 2286209 - RNA, 19 nt, Yersinia pestis
caucuccgccaacccuuuu

SEQ ID NO: 2286210 - RNA, 16 nt, Yersinia pestis
caucuccgcuauuuuc

SEQ ID NO: 2286211 - RNA, 15 nt, Yersinia pestis
caucucaauaacuau

SEQ ID NO: 2286212 - RNA, 20 nt, Yersinia pestis
caucuaacucauucauaauu

SEQ ID NO: 2286213 - RNA, 15 nt, Yersinia pestis
caucgucaugauuga

SEQ ID NO: 2286214 - RNA, 18 nt, Yersinia pestis
caucgcgggcgcgcugcu

SEQ ID NO: 2286215 - RNA, 22 nt, Yersinia pestis
caucgcgggcgcgcugcugcuc

SEQ ID NO: 2286216 - RNA, 21 nt, Yersinia pestis
caucgcugcaauaaagcguca

SEQ ID NO: 2286217 - RNA, 20 nt, Yersinia pestis
caucgcugaggucagugcug

SEQ ID NO: 2286218 - RNA, 21 nt, Yersinia pestis
caucgcuggacgcaucagauc

SEQ ID NO: 2286219 - RNA, 14 nt, Yersinia pestis
caucguaaccccca

SEQ ID NO: 2286220 - RNA, 22 nt, Yersinia pestis
cauccuaaagauaauuaauuca

SEQ ID NO: 2286221 - RNA, 13 nt, Yersinia pestis
cauccuaaaaagc

SEQ ID NO: 2286222 - RNA, 17 nt, Yersinia pestis
cauccguccaaugaaua

SEQ ID NO: 2286223 - RNA, 20 nt, Yersinia pestis
cauccggugagacagugagg

SEQ ID NO: 2286224 - RNA, 13 nt, Yersinia pestis
cauccggguuuau

SEQ ID NO: 2286225 - RNA, 19 nt, Yersinia pestis
cauccugaauccccgcuuc

SEQ ID NO: 2286226 - RNA, 16 nt, Yersinia pestis
cauccugaacuuccug

SEQ ID NO: 2286227 - RNA, 15 nt, Yersinia pestis
cauccucaggaugga

SEQ ID NO: 2286228 - RNA, 21 nt, Yersinia pestis
caucauucauuuuaaaaaaau

SEQ ID NO: 2286229 - RNA, 15 nt, Yersinia pestis
caucauuauuaugua

SEQ ID NO: 2286230 - RNA, 19 nt, Yersinia pestis
caucauucauuuuaaaaaa

SEQ ID NO: 2286231 - RNA, 22 nt, Yersinia pestis
caucauuauuguccgcgcggcu

SEQ ID NO: 2286232 - RNA, 16 nt, Yersinia pestis
caucccguaggcuugg

SEQ ID NO: 2286233 - RNA, 14 nt, Yersinia pestis
caucccuuaaccac

SEQ ID NO: 2286234 - RNA, 13 nt, Yersinia pestis
cauccgcuugcag

SEQ ID NO: 2286235 - RNA, 17 nt, Yersinia pestis
cauccgaauuuuuacug

SEQ ID NO: 2286236 - RNA, 18 nt, Yersinia pestis
caucccuugacugaccau

SEQ ID NO: 2286237 - RNA, 21 nt, Yersinia pestis
caucgacaccaagacugaagu

SEQ ID NO: 2286238 - RNA, 18 nt, Yersinia pestis
caucgacgcgccauaagc

SEQ ID NO: 2286239 - RNA, 17 nt, Yersinia pestis
caucgccguuuugccau

SEQ ID NO: 2286240 - RNA, 20 nt, Yersinia pestis
caucgccuguauuuuaaugc

SEQ ID NO: 2286241 - RNA, 17 nt, Yersinia pestis
caucgccuucuggcaaa

SEQ ID NO: 2286242 - RNA, 20 nt, Yersinia pestis
caucgcgauugaaagucaca

SEQ ID NO: 2286243 - RNA, 23 nt, Yersinia pestis
caucgcgccuaccugccugcugc

SEQ ID NO: 2286244 - RNA, 15 nt, Yersinia pestis
caucgcgcuuuuuag

SEQ ID NO: 2286245 - RNA, 17 nt, Yersinia pestis
caucgcggcgcacauca

SEQ ID NO: 2286246 - RNA, 22 nt, Yersinia pestis
caucaaaacugaugguuuccug

SEQ ID NO: 2286247 - RNA, 16 nt, Yersinia pestis
caucaacuucugcaaa

SEQ ID NO: 2286248 - RNA, 16 nt, Yersinia pestis
caucaacucgccaccc

SEQ ID NO: 2286249 - RNA, 22 nt, Yersinia pestis
caucaaccucagccucauucau

SEQ ID NO: 2286250 - RNA, 22 nt, Yersinia pestis
caucaaccgggauaucaaauuc

SEQ ID NO: 2286251 - RNA, 17 nt, Yersinia pestis
cauauuaccgcugaaaa

SEQ ID NO: 2286252 - RNA, 11 nt, Yersinia pestis
cauauuauuug

SEQ ID NO: 2286253 - RNA, 17 nt, Yersinia pestis
cauauuauuaaugaaau

SEQ ID NO: 2286254 - RNA, 13 nt, Yersinia pestis
cauauucaccaca

SEQ ID NO: 2286255 - RNA, 18 nt, Yersinia pestis
cauauucaccguuuccag

SEQ ID NO: 2286256 - RNA, 18 nt, Yersinia pestis
cauauucaguaacaacau

SEQ ID NO: 2286257 - RNA, 12 nt, Yersinia pestis
cauauuggccag

SEQ ID NO: 2286258 - RNA, 17 nt, Yersinia pestis
cauauuggccaguugcc

SEQ ID NO: 2286259 - RNA, 18 nt, Yersinia pestis
cauauuguccaaaggaag

SEQ ID NO: 2286260 - RNA, 20 nt, Yersinia pestis
cauauuguccaaaggaaggg

SEQ ID NO: 2286261 - RNA, 14 nt, Yersinia pestis
cauaugcagcaucc

SEQ ID NO: 2286262 - RNA, 21 nt, Yersinia pestis
cauaugcgcgucaauccacuc

SEQ ID NO: 2286263 - RNA, 23 nt, Yersinia pestis
cauauuaaaugcauuauaaggaa

SEQ ID NO: 2286264 - RNA, 13 nt, Yersinia pestis
cauauguugaguc

SEQ ID NO: 2286265 - RNA, 21 nt, Yersinia pestis
cauauguucgaucaaaacaau

SEQ ID NO: 2286266 - RNA, 14 nt, Yersinia pestis
cauauuacucacac

SEQ ID NO: 2286267 - RNA, 14 nt, Yersinia pestis
cauacgucuccauu

SEQ ID NO: 2286268 - RNA, 13 nt, Yersinia pestis
cauacucccccau

SEQ ID NO: 2286269 - RNA, 23 nt, Yersinia pestis
cauaguugaacucgccuucaggu

SEQ ID NO: 2286270 - RNA, 21 nt, Yersinia pestis
cauaguuucaauaugcucugc

SEQ ID NO: 2286271 - RNA, 23 nt, Yersinia pestis
cauagugcaaaauuccaccauuc

SEQ ID NO: 2286272 - RNA, 17 nt, Yersinia pestis
cauauacccaaagccag

SEQ ID NO: 2286273 - RNA, 14 nt, Yersinia pestis
cauauaauccaaaa

SEQ ID NO: 2286274 - RNA, 22 nt, Yersinia pestis
cauaucuugaaccaauuuuucu

SEQ ID NO: 2286275 - RNA, 15 nt, Yersinia pestis
cauaugaaaaaccuc

SEQ ID NO: 2286276 - RNA, 15 nt, Yersinia pestis
cauaugaaugagcag

SEQ ID NO: 2286277 - RNA, 15 nt, Yersinia pestis
cauaugacaaauaag

SEQ ID NO: 2286278 - RNA, 15 nt, Yersinia pestis
cauaucguccaaagg

SEQ ID NO: 2286279 - RNA, 17 nt, Yersinia pestis
cauaucacaguuaaaaa

SEQ ID NO: 2286280 - RNA, 13 nt, Yersinia pestis
caucagacauauu

SEQ ID NO: 2286281 - RNA, 20 nt, Yersinia pestis
caucaaugauucgcugaaca

SEQ ID NO: 2286282 - RNA, 23 nt, Yersinia pestis
caucacgcagugcaucuuccaau

SEQ ID NO: 2286283 - RNA, 14 nt, Yersinia pestis
caucagcgcuggcu

SEQ ID NO: 2286284 - RNA, 18 nt, Yersinia pestis
caucagacugcucuuucc

SEQ ID NO: 2286285 - RNA, 22 nt, Yersinia pestis
caucagaucguuaaacccggca

SEQ ID NO: 2286286 - RNA, 16 nt, Yersinia pestis
caucagccagccacug

SEQ ID NO: 2286287 - RNA, 18 nt, Yersinia pestis
caucagcgcccuugccag

SEQ ID NO: 2286288 - RNA, 19 nt, Yersinia pestis
caucagcgccuuugccccg

SEQ ID NO: 2286289 - RNA, 18 nt, Yersinia pestis
caucagcgacgcuaaaca

SEQ ID NO: 2286290 - RNA, 22 nt, Yersinia pestis
caucagcgacgcuaaacacaga

SEQ ID NO: 2286291 - RNA, 21 nt, Yersinia pestis
caucagcgauucauugagcaa

SEQ ID NO: 2286292 - RNA, 22 nt, Yersinia pestis
caucagacugcucuuucccuuc

SEQ ID NO: 2286293 - RNA, 13 nt, Yersinia pestis
caucaucaauaaa

SEQ ID NO: 2286294 - RNA, 13 nt, Yersinia pestis
caucaucaaugga

SEQ ID NO: 2286295 - RNA, 15 nt, Yersinia pestis
caucaucacaaauaa

SEQ ID NO: 2286296 - RNA, 18 nt, Yersinia pestis
caucaucacauucaaaca

SEQ ID NO: 2286297 - RNA, 21 nt, Yersinia pestis
caucaucacauucaaacacuu

SEQ ID NO: 2286298 - RNA, 20 nt, Yersinia pestis
caucaucaauggauucuugc

SEQ ID NO: 2286299 - RNA, 12 nt, Yersinia pestis
caucaucccagu

SEQ ID NO: 2286300 - RNA, 22 nt, Yersinia pestis
caucaucccagucgucuucagc

SEQ ID NO: 2286301 - RNA, 15 nt, Yersinia pestis
caucauccacuagca

SEQ ID NO: 2286302 - RNA, 12 nt, Yersinia pestis
caucauccauaa

SEQ ID NO: 2286303 - RNA, 13 nt, Yersinia pestis
caucauccauaaa

SEQ ID NO: 2286304 - RNA, 15 nt, Yersinia pestis
caucaucgcacugua

SEQ ID NO: 2286305 - RNA, 14 nt, Yersinia pestis
caucaugacaaaaa

SEQ ID NO: 2286306 - RNA, 21 nt, Yersinia pestis
caucauuagccguaaugacuc

SEQ ID NO: 2286307 - RNA, 22 nt, Yersinia pestis
caucaucuucaaccuggaacca

SEQ ID NO: 2286308 - RNA, 12 nt, Yersinia pestis
caucaucuucuu

SEQ ID NO: 2286309 - RNA, 13 nt, Yersinia pestis
caucaucuucuuc

SEQ ID NO: 2286310 - RNA, 22 nt, Yersinia pestis
caucagggaauugacuaaauuu

SEQ ID NO: 2286311 - RNA, 14 nt, Yersinia pestis
caucaguaauguga

SEQ ID NO: 2286312 - RNA, 17 nt, Yersinia pestis
caucagucacuaaacca

SEQ ID NO: 2286313 - RNA, 15 nt, Yersinia pestis
caucagguguuguau

SEQ ID NO: 2286314 - RNA, 18 nt, Yersinia pestis
caucauaucgaugacagc

SEQ ID NO: 2286315 - RNA, 14 nt, Yersinia pestis
caucauauauuaaa

SEQ ID NO: 2286316 - RNA, 12 nt, Yersinia pestis
caucauacugac

SEQ ID NO: 2286317 - RNA, 16 nt, Yersinia pestis
caucauaaaaauacau

SEQ ID NO: 2286318 - RNA, 19 nt, Yersinia pestis
caucauaaaaauacauauc

SEQ ID NO: 2286319 - RNA, 21 nt, Yersinia pestis
ccaccaguaaacgccaaucac

SEQ ID NO: 2286320 - RNA, 21 nt, Yersinia pestis
ccaccaggcggcccuuggcuu

SEQ ID NO: 2286321 - RNA, 23 nt, Yersinia pestis
ccaccaggcggcccuuggcuuug

SEQ ID NO: 2286322 - RNA, 16 nt, Yersinia pestis
ccaccaguaaacgcca

SEQ ID NO: 2286323 - RNA, 24 nt, Yersinia pestis
ccaccagguuaccuauaaacuuga

SEQ ID NO: 2286324 - RNA, 19 nt, Yersinia pestis
ccacccguugcauuuuucu

SEQ ID NO: 2286325 - RNA, 18 nt, Yersinia pestis
ccacccguagcccuugca

SEQ ID NO: 2286326 - RNA, 20 nt, Yersinia pestis
ccacccugccaaaaaauaag

SEQ ID NO: 2286327 - RNA, 22 nt, Yersinia pestis
ccaccacgaaaaaauggcagcc

SEQ ID NO: 2286328 - RNA, 21 nt, Yersinia pestis
ccacgaagagcgccucacuga

SEQ ID NO: 2286329 - RNA, 21 nt, Yersinia pestis
ccaccugacuguggcugcucu

SEQ ID NO: 2286330 - RNA, 19 nt, Yersinia pestis
ccaccugaaucucgcgccc

SEQ ID NO: 2286331 - RNA, 20 nt, Yersinia pestis
ccacgaguuuucccugcgcc

SEQ ID NO: 2286332 - RNA, 13 nt, Yersinia pestis
ccacgaggacagg

SEQ ID NO: 2286333 - RNA, 17 nt, Yersinia pestis
ccacgauuuaaugguuu

SEQ ID NO: 2286334 - RNA, 17 nt, Yersinia pestis
ccacgauuagcccguuc

SEQ ID NO: 2286335 - RNA, 17 nt, Yersinia pestis
ccaccuaucuauuuuua

SEQ ID NO: 2286336 - RNA, 16 nt, Yersinia pestis
ccacgcgguacuuugc

SEQ ID NO: 2286337 - RNA, 19 nt, Yersinia pestis
ccacgcguaaucauagcca

SEQ ID NO: 2286338 - RNA, 16 nt, Yersinia pestis
ccacgcuccacacaaa

SEQ ID NO: 2286339 - RNA, 22 nt, Yersinia pestis
ccacggcaccuucugauuuuuu

SEQ ID NO: 2286340 - RNA, 12 nt, Yersinia pestis
ccacgcccaauu

SEQ ID NO: 2286341 - RNA, 22 nt, Yersinia pestis
ccacgccaguaaacagccagca

SEQ ID NO: 2286342 - RNA, 20 nt, Yersinia pestis
ccacgucuaauugcugccca

SEQ ID NO: 2286343 - RNA, 17 nt, Yersinia pestis
ccacgucuaauugcugc

SEQ ID NO: 2286344 - RNA, 15 nt, Yersinia pestis
ccacucaguguggaa

SEQ ID NO: 2286345 - RNA, 15 nt, Yersinia pestis
ccacuauccaacugg

SEQ ID NO: 2286346 - RNA, 16 nt, Yersinia pestis
ccacuaaggucaucaa

SEQ ID NO: 2286347 - RNA, 17 nt, Yersinia pestis
ccacgucaucgaagagu

SEQ ID NO: 2286348 - RNA, 15 nt, Yersinia pestis
ccacggcucacacac

SEQ ID NO: 2286349 - RNA, 17 nt, Yersinia pestis
ccacggcgcugcagcga

SEQ ID NO: 2286350 - RNA, 18 nt, Yersinia pestis
cauuuuaucgugaauaaa

SEQ ID NO: 2286351 - RNA, 20 nt, Yersinia pestis
cauuuuaucgugaauaaaaa

SEQ ID NO: 2286352 - RNA, 16 nt, Yersinia pestis
cauuuuccugcauauu

SEQ ID NO: 2286353 - RNA, 14 nt, Yersinia pestis
ccaaaguagaacug

SEQ ID NO: 2286354 - RNA, 20 nt, Yersinia pestis
ccaaaucagcaagcugcuca

SEQ ID NO: 2286355 - RNA, 17 nt, Yersinia pestis
ccaaaucugccugauac

SEQ ID NO: 2286356 - RNA, 12 nt, Yersinia pestis
ccaagacugaag

SEQ ID NO: 2286357 - RNA, 21 nt, Yersinia pestis
ccaacuuaccuugauccgcca

SEQ ID NO: 2286358 - RNA, 15 nt, Yersinia pestis
ccaagagaaacccau

SEQ ID NO: 2286359 - RNA, 22 nt, Yersinia pestis
ccaagagagaauccauuuaauc

SEQ ID NO: 2286360 - RNA, 24 nt, Yersinia pestis
ccaagauuuuuagcgugccgcagu

SEQ ID NO: 2286361 - RNA, 19 nt, Yersinia pestis
ccaagaugauaaauacaaa

SEQ ID NO: 2286362 - RNA, 14 nt, Yersinia pestis
ccaaggagauagcg

SEQ ID NO: 2286363 - RNA, 13 nt, Yersinia pestis
ccaaggauggcgc

SEQ ID NO: 2286364 - RNA, 12 nt, Yersinia pestis
ccaaggcauccg

SEQ ID NO: 2286365 - RNA, 17 nt, Yersinia pestis
ccaaggcaugauaggca

SEQ ID NO: 2286366 - RNA, 15 nt, Yersinia pestis
ccaacugagugagcg

SEQ ID NO: 2286367 - RNA, 22 nt, Yersinia pestis
ccaacgucauuuccguuaaccc

SEQ ID NO: 2286368 - RNA, 17 nt, Yersinia pestis
ccaacggccccucaggc

SEQ ID NO: 2286369 - RNA, 16 nt, Yersinia pestis
ccaacgcggcccccgc

SEQ ID NO: 2286370 - RNA, 22 nt, Yersinia pestis
ccaacgcggcccccgcaggggu

SEQ ID NO: 2286371 - RNA, 16 nt, Yersinia pestis
ccaacaucuccgccaa

SEQ ID NO: 2286372 - RNA, 21 nt, Yersinia pestis
ccaacgcacugguugcuucau

SEQ ID NO: 2286373 - RNA, 17 nt, Yersinia pestis
ccaacgcaagcgggcca

SEQ ID NO: 2286374 - RNA, 18 nt, Yersinia pestis
ccacagcaacaggguaau

SEQ ID NO: 2286375 - RNA, 21 nt, Yersinia pestis
ccacagcaaugcaccgacaaa

SEQ ID NO: 2286376 - RNA, 14 nt, Yersinia pestis
ccacacccucucuu

SEQ ID NO: 2286377 - RNA, 17 nt, Yersinia pestis
ccaauggaaaauacacu

SEQ ID NO: 2286378 - RNA, 22 nt, Yersinia pestis
ccaauuucucggccaacaucuu

SEQ ID NO: 2286379 - RNA, 13 nt, Yersinia pestis
ccaauuuggccaa

SEQ ID NO: 2286380 - RNA, 16 nt, Yersinia pestis
ccaauugacuagcagg

SEQ ID NO: 2286381 - RNA, 16 nt, Yersinia pestis
ccaauugaguaacuga

SEQ ID NO: 2286382 - RNA, 23 nt, Yersinia pestis
ccaauugcaggcuuucacgcucc

SEQ ID NO: 2286383 - RNA, 19 nt, Yersinia pestis
ccaauguugcugaauaaau

SEQ ID NO: 2286384 - RNA, 22 nt, Yersinia pestis
ccaauuggugcuuuauguauuc

SEQ ID NO: 2286385 - RNA, 12 nt, Yersinia pestis
ccaauuguuuua

SEQ ID NO: 2286386 - RNA, 24 nt, Yersinia pestis
ccaaucaccuuggaaaacagcaac

SEQ ID NO: 2286387 - RNA, 18 nt, Yersinia pestis
ccaauaugaaauuucacu

SEQ ID NO: 2286388 - RNA, 20 nt, Yersinia pestis
ccaauauuggauaauaaccu

SEQ ID NO: 2286389 - RNA, 13 nt, Yersinia pestis
ccaaucaaaaaac

SEQ ID NO: 2286390 - RNA, 16 nt, Yersinia pestis
ccaauaucugccaauu

SEQ ID NO: 2286391 - RNA, 16 nt, Yersinia pestis
ccaaucgaaccgauac

SEQ ID NO: 2286392 - RNA, 18 nt, Yersinia pestis
ccaaucaucaucccaguc

SEQ ID NO: 2286393 - RNA, 13 nt, Yersinia pestis
ccaaucaucaucc

SEQ ID NO: 2286394 - RNA, 20 nt, Yersinia pestis
ccaaguccacgggcucaugc

SEQ ID NO: 2286395 - RNA, 15 nt, Yersinia pestis
ccaaguccuccuuga

SEQ ID NO: 2286396 - RNA, 20 nt, Yersinia pestis
ccaaggcgacuuugaugcca

SEQ ID NO: 2286397 - RNA, 20 nt, Yersinia pestis
ccaaggcggaauagaggaag

SEQ ID NO: 2286398 - RNA, 18 nt, Yersinia pestis
ccaaguuugcagucgcuu

SEQ ID NO: 2286399 - RNA, 16 nt, Yersinia pestis
ccaauacaaacagggc

SEQ ID NO: 2286400 - RNA, 23 nt, Yersinia pestis
ccaaguuuacuuuguauuuugca

SEQ ID NO: 2286401 - RNA, 14 nt, Yersinia pestis
ccaauacaaucguc

SEQ ID NO: 2286402 - RNA, 16 nt, Yersinia pestis
ccaauagaaaaacacu

SEQ ID NO: 2286403 - RNA, 16 nt, Yersinia pestis
ccaauagacaaaagug

SEQ ID NO: 2286404 - RNA, 18 nt, Yersinia pestis
ccaauagauuucacuuuc

SEQ ID NO: 2286405 - RNA, 19 nt, Yersinia pestis
ccaauagcccaaauaaccu

SEQ ID NO: 2286406 - RNA, 19 nt, Yersinia pestis
cauggcaaccccuaaucca

SEQ ID NO: 2286407 - RNA, 21 nt, Yersinia pestis
cauggcaaccccuaauccagc

SEQ ID NO: 2286408 - RNA, 20 nt, Yersinia pestis
cauggaucacccguugcaag

SEQ ID NO: 2286409 - RNA, 16 nt, Yersinia pestis
cauggaucacccguug

SEQ ID NO: 2286410 - RNA, 14 nt, Yersinia pestis
caugcuuaaagccu

SEQ ID NO: 2286411 - RNA, 23 nt, Yersinia pestis
cauggaaaauauucuaaguaaaa

SEQ ID NO: 2286412 - RNA, 16 nt, Yersinia pestis
cauggaagaccagaua

SEQ ID NO: 2286413 - RNA, 13 nt, Yersinia pestis
caugcugauagca

SEQ ID NO: 2286414 - RNA, 19 nt, Yersinia pestis
caugcugaaucuguaaguc

SEQ ID NO: 2286415 - RNA, 13 nt, Yersinia pestis
caugcucuucaua

SEQ ID NO: 2286416 - RNA, 15 nt, Yersinia pestis
caugcucuucauaag

SEQ ID NO: 2286417 - RNA, 19 nt, Yersinia pestis
caugcucugcuaauacgcu

SEQ ID NO: 2286418 - RNA, 17 nt, Yersinia pestis
caugcucaguuguauua

SEQ ID NO: 2286419 - RNA, 16 nt, Yersinia pestis
caucuuccaaaggaag

SEQ ID NO: 2286420 - RNA, 18 nt, Yersinia pestis
caucuuccaaaggaaggg

SEQ ID NO: 2286421 - RNA, 12 nt, Yersinia pestis
caucuuccagca

SEQ ID NO: 2286422 - RNA, 18 nt, Yersinia pestis
caucuucgcuuucaucuu

SEQ ID NO: 2286423 - RNA, 15 nt, Yersinia pestis
caucuuccaaaggaa

SEQ ID NO: 2286424 - RNA, 16 nt, Yersinia pestis
cauguagcacacuacc

SEQ ID NO: 2286425 - RNA, 20 nt, Yersinia pestis
cauguacuagaucacagacg

SEQ ID NO: 2286426 - RNA, 23 nt, Yersinia pestis
cauguacgcuccgguucuugcgc

SEQ ID NO: 2286427 - RNA, 17 nt, Yersinia pestis
cauguaacacacagcag

SEQ ID NO: 2286428 - RNA, 22 nt, Yersinia pestis
cauguaacacacagcagacagc

SEQ ID NO: 2286429 - RNA, 11 nt, Yersinia pestis
cauguacaccg

SEQ ID NO: 2286430 - RNA, 16 nt, Yersinia pestis
caugucgccuuauugu

SEQ ID NO: 2286431 - RNA, 20 nt, Yersinia pestis
caugucggcagguaaugcau

SEQ ID NO: 2286432 - RNA, 18 nt, Yersinia pestis
cauguccguguuggcaaa

SEQ ID NO: 2286433 - RNA, 14 nt, Yersinia pestis
caugucgaucaugg

SEQ ID NO: 2286434 - RNA, 16 nt, Yersinia pestis
cauggcuugugcagca

SEQ ID NO: 2286435 - RNA, 17 nt, Yersinia pestis
cauggcuuuaugaccaa

SEQ ID NO: 2286436 - RNA, 14 nt, Yersinia pestis
caugguaagaauaa

SEQ ID NO: 2286437 - RNA, 16 nt, Yersinia pestis
caugguaagaauaaau

SEQ ID NO: 2286438 - RNA, 19 nt, Yersinia pestis
caugguagccugcacggcu

SEQ ID NO: 2286439 - RNA, 15 nt, Yersinia pestis
cauggcguaaccgcc

SEQ ID NO: 2286440 - RNA, 13 nt, Yersinia pestis
cauggcaugccau

SEQ ID NO: 2286441 - RNA, 18 nt, Yersinia pestis
cauggccaugaaucaaau

SEQ ID NO: 2286442 - RNA, 14 nt, Yersinia pestis
cauggcuaaaucca

SEQ ID NO: 2286443 - RNA, 15 nt, Yersinia pestis
cauggcucaccauaa

SEQ ID NO: 2286444 - RNA, 23 nt, Yersinia pestis
cauggcucaccauaaauucacag

SEQ ID NO: 2286445 - RNA, 16 nt, Yersinia pestis
cauggcucucuuuuuu

SEQ ID NO: 2286446 - RNA, 21 nt, Yersinia pestis
cauuacugcguucuucuugug

SEQ ID NO: 2286447 - RNA, 22 nt, Yersinia pestis
cauuacugcguucuucuugugg

SEQ ID NO: 2286448 - RNA, 20 nt, Yersinia pestis
cauuacugaugcguugugau

SEQ ID NO: 2286449 - RNA, 18 nt, Yersinia pestis
cauuaccuuggugagaac

SEQ ID NO: 2286450 - RNA, 20 nt, Yersinia pestis
cauuaccgcacacuacagcc

SEQ ID NO: 2286451 - RNA, 23 nt, Yersinia pestis
cauuaccccguugcucuacacag

SEQ ID NO: 2286452 - RNA, 15 nt, Yersinia pestis
cauuaccaauaccau

SEQ ID NO: 2286453 - RNA, 14 nt, Yersinia pestis
cauuaaggagugcc

SEQ ID NO: 2286454 - RNA, 21 nt, Yersinia pestis
cauguguuuguuuggauaaaa

SEQ ID NO: 2286455 - RNA, 17 nt, Yersinia pestis
cauuaauaccguuuucu

SEQ ID NO: 2286456 - RNA, 22 nt, Yersinia pestis
cauuaauaccguuuucuuucaa

SEQ ID NO: 2286457 - RNA, 21 nt, Yersinia pestis
cauuacagggcgaauggaaga

SEQ ID NO: 2286458 - RNA, 18 nt, Yersinia pestis
caugugcaauuaaugcug

SEQ ID NO: 2286459 - RNA, 18 nt, Yersinia pestis
cauuauaaggaauauacu

SEQ ID NO: 2286460 - RNA, 22 nt, Yersinia pestis
cauuauaaggaauauacuuuac

SEQ ID NO: 2286461 - RNA, 20 nt, Yersinia pestis
cauuagugaaucaucaauac

SEQ ID NO: 2286462 - RNA, 19 nt, Yersinia pestis
cauuagccccaaaugccag

SEQ ID NO: 2286463 - RNA, 15 nt, Yersinia pestis
cauuagcucaaauau

SEQ ID NO: 2286464 - RNA, 20 nt, Yersinia pestis
cauuaguaaugggaucaaau

SEQ ID NO: 2286465 - RNA, 16 nt, Yersinia pestis
cauuagggccaccaga

SEQ ID NO: 2286466 - RNA, 13 nt, Yersinia pestis
cauucaagccuaa

SEQ ID NO: 2286467 - RNA, 15 nt, Yersinia pestis
cauucagcagcaaga

SEQ ID NO: 2286468 - RNA, 15 nt, Yersinia pestis
cauucaaaaauuaaa

SEQ ID NO: 2286469 - RNA, 14 nt, Yersinia pestis
cauucgccugauaa

SEQ ID NO: 2286470 - RNA, 17 nt, Yersinia pestis
cauuccguuuaaacucc

SEQ ID NO: 2286471 - RNA, 15 nt, Yersinia pestis
cauuccguuuaaacu

SEQ ID NO: 2286472 - RNA, 16 nt, Yersinia pestis
cauugcaaacaucaca

SEQ ID NO: 2286473 - RNA, 20 nt, Yersinia pestis
cauugcacagguccaucagc

SEQ ID NO: 2286474 - RNA, 21 nt, Yersinia pestis
cauugccacgacgcagcucca

SEQ ID NO: 2286475 - RNA, 15 nt, Yersinia pestis
cauucgccugauaaa

SEQ ID NO: 2286476 - RNA, 17 nt, Yersinia pestis
cauuggaaaaaaucuuc

SEQ ID NO: 2286477 - RNA, 20 nt, Yersinia pestis
cauugcuuugcgauacacca

SEQ ID NO: 2286478 - RNA, 12 nt, Yersinia pestis
cauugcuaaauu

SEQ ID NO: 2286479 - RNA, 16 nt, Yersinia pestis
cauugccgaugucaau

SEQ ID NO: 2286480 - RNA, 14 nt, Yersinia pestis
cauuguaaaauaag

SEQ ID NO: 2286481 - RNA, 21 nt, Yersinia pestis
cauugucauggccugaugcac

SEQ ID NO: 2286482 - RNA, 13 nt, Yersinia pestis
cauugucaccuaa

SEQ ID NO: 2286483 - RNA, 23 nt, Yersinia pestis
cauugucaccuaaccaaacauug

SEQ ID NO: 2286484 - RNA, 13 nt, Yersinia pestis
cauugucaccuga

SEQ ID NO: 2286485 - RNA, 22 nt, Yersinia pestis
cauuggugucccaaacucugga

SEQ ID NO: 2286486 - RNA, 16 nt, Yersinia pestis
cauuggcaaaggccag

SEQ ID NO: 2286487 - RNA, 20 nt, Yersinia pestis
cauuggcuucaacuuuuuuc

SEQ ID NO: 2286488 - RNA, 20 nt, Yersinia pestis
cauuggcugguaauucgcua

SEQ ID NO: 2286489 - RNA, 18 nt, Yersinia pestis
cauuggcgguuauuauuu

SEQ ID NO: 2286490 - RNA, 20 nt, Yersinia pestis
cauuggcgguuauuauuuac

SEQ ID NO: 2286491 - RNA, 17 nt, Yersinia pestis
cauuuaauuaaaugacu

SEQ ID NO: 2286492 - RNA, 14 nt, Yersinia pestis
cauuuaaaauacuc

SEQ ID NO: 2286493 - RNA, 23 nt, Yersinia pestis
cauuguucucauuuacaggaacg

SEQ ID NO: 2286494 - RNA, 12 nt, Yersinia pestis
cauuguggagga

SEQ ID NO: 2286495 - RNA, 17 nt, Yersinia pestis
cauuguggcuaaaccca

SEQ ID NO: 2286496 - RNA, 15 nt, Yersinia pestis
cauugucugcuggcc

SEQ ID NO: 2286497 - RNA, 15 nt, Yersinia pestis
cauuuccuguauuuc

SEQ ID NO: 2286498 - RNA, 18 nt, Yersinia pestis
cauuuccuguauuuccug

SEQ ID NO: 2286499 - RNA, 22 nt, Yersinia pestis
cauuuccguuaacccaaagccc

SEQ ID NO: 2286500 - RNA, 16 nt, Yersinia pestis
cauuucgcuccaccag

SEQ ID NO: 2286501 - RNA, 12 nt, Yersinia pestis
cauuuccaucau

SEQ ID NO: 2286502 - RNA, 14 nt, Yersinia pestis
cauuucccgugcac

SEQ ID NO: 2286503 - RNA, 17 nt, Yersinia pestis
cauuucccgugcacugc

SEQ ID NO: 2286504 - RNA, 18 nt, Yersinia pestis
cauuucccgugcacugcg

SEQ ID NO: 2286505 - RNA, 14 nt, Yersinia pestis
cauuucauuaaaug

SEQ ID NO: 2286506 - RNA, 14 nt, Yersinia pestis
cauuuccaauacca

SEQ ID NO: 2286507 - RNA, 23 nt, Yersinia pestis
cauuuccaauaccaauucuucau

SEQ ID NO: 2286508 - RNA, 15 nt, Yersinia pestis
cauuuauauaacagc

SEQ ID NO: 2286509 - RNA, 19 nt, Yersinia pestis
cauuuaucuaaaacugccu

SEQ ID NO: 2286510 - RNA, 19 nt, Yersinia pestis
cauuuaucauauuaacaua

SEQ ID NO: 2286511 - RNA, 15 nt, Yersinia pestis
cauuuauuacauuua

SEQ ID NO: 2286512 - RNA, 22 nt, Yersinia pestis
cauuucaggacugucuucaacu

SEQ ID NO: 2286513 - RNA, 21 nt, Yersinia pestis
cauuuauuuccacgacaugag

SEQ ID NO: 2286514 - RNA, 15 nt, Yersinia pestis
cauuucuuauaucug

SEQ ID NO: 2286515 - RNA, 23 nt, Yersinia pestis
cauuucugguugugcuucagaca

SEQ ID NO: 2286516 - RNA, 19 nt, Yersinia pestis
cauuucucaucgcuuuuuu

SEQ ID NO: 2286517 - RNA, 21 nt, Yersinia pestis
cauuugcgcaauacgucgcau

SEQ ID NO: 2286518 - RNA, 18 nt, Yersinia pestis
cauuugcaucuauggauu

SEQ ID NO: 2286519 - RNA, 17 nt, Yersinia pestis
cauuugcacagcauuua

SEQ ID NO: 2286520 - RNA, 15 nt, Yersinia pestis
cauuugagcuguuau

SEQ ID NO: 2286521 - RNA, 15 nt, Yersinia pestis
cauuuuacucccuga

SEQ ID NO: 2286522 - RNA, 14 nt, Yersinia pestis
cauuuuagcuggca

SEQ ID NO: 2286523 - RNA, 23 nt, Yersinia pestis
cauuuuaaucucuccaugauaua

SEQ ID NO: 2286524 - RNA, 15 nt, Yersinia pestis
cauuuuaaaaaaauu

SEQ ID NO: 2286525 - RNA, 18 nt, Yersinia pestis
cauuugggcaauguugag

SEQ ID NO: 2286526 - RNA, 13 nt, Yersinia pestis
cauuuguauuuuu

SEQ ID NO: 2286527 - RNA, 14 nt, Yersinia pestis
cauuuguauuuuuu

SEQ ID NO: 2286528 - RNA, 18 nt, Yersinia pestis
cauuuguagccugucccu

SEQ ID NO: 2286529 - RNA, 19 nt, Yersinia pestis
cauuugucguuauaaacca

SEQ ID NO: 2286530 - RNA, 23 nt, Yersinia pestis
ccagcguccugugcaaagugcug

SEQ ID NO: 2286531 - RNA, 21 nt, Yersinia pestis
ccagcguccugugcaaagugc

SEQ ID NO: 2286532 - RNA, 23 nt, Yersinia pestis
ccagcguucuaucaaugccuugg

SEQ ID NO: 2286533 - RNA, 14 nt, Yersinia pestis
ccagcgguguuacc

SEQ ID NO: 2286534 - RNA, 20 nt, Yersinia pestis
ccagcgguguuaccagaccc

SEQ ID NO: 2286535 - RNA, 13 nt, Yersinia pestis
ccagcggcggcca

SEQ ID NO: 2286536 - RNA, 15 nt, Yersinia pestis
ccagcgggaaucaaa

SEQ ID NO: 2286537 - RNA, 17 nt, Yersinia pestis
ccagcgggaaucaaacu

SEQ ID NO: 2286538 - RNA, 14 nt, Yersinia pestis
ccagcggcaccgcc

SEQ ID NO: 2286539 - RNA, 21 nt, Yersinia pestis
ccacucuggggcaaucaaugu

SEQ ID NO: 2286540 - RNA, 23 nt, Yersinia pestis
ccacucggguucuaaauccugca

SEQ ID NO: 2286541 - RNA, 23 nt, Yersinia pestis
ccacugaccgggaacaacgaaac

SEQ ID NO: 2286542 - RNA, 15 nt, Yersinia pestis
ccacugaccuauuga

SEQ ID NO: 2286543 - RNA, 21 nt, Yersinia pestis
ccacugaccuauugauaaaac

SEQ ID NO: 2286544 - RNA, 16 nt, Yersinia pestis
ccagcgaaucaaacag

SEQ ID NO: 2286545 - RNA, 20 nt, Yersinia pestis
ccagccugguuuuuuaaaaa

SEQ ID NO: 2286546 - RNA, 18 nt, Yersinia pestis
ccagcgaagugccgccau

SEQ ID NO: 2286547 - RNA, 13 nt, Yersinia pestis
ccagcgccccauc

SEQ ID NO: 2286548 - RNA, 21 nt, Yersinia pestis
ccagcgccgauauacacccca

SEQ ID NO: 2286549 - RNA, 13 nt, Yersinia pestis
ccagcugcaauug

SEQ ID NO: 2286550 - RNA, 24 nt, Yersinia pestis
ccagcuuuagcauugcagauuucu

SEQ ID NO: 2286551 - RNA, 19 nt, Yersinia pestis
ccagcuuuuuacgcaacaa

SEQ ID NO: 2286552 - RNA, 14 nt, Yersinia pestis
ccagcuugggugaa

SEQ ID NO: 2286553 - RNA, 14 nt, Yersinia pestis
ccagcuucccugca

SEQ ID NO: 2286554 - RNA, 15 nt, Yersinia pestis
ccaggaagcggccag

SEQ ID NO: 2286555 - RNA, 18 nt, Yersinia pestis
ccaggaauuaacaauucu

SEQ ID NO: 2286556 - RNA, 19 nt, Yersinia pestis
ccaggaucaacuuucucuu

SEQ ID NO: 2286557 - RNA, 16 nt, Yersinia pestis
ccaggacuuuguuagc

SEQ ID NO: 2286558 - RNA, 20 nt, Yersinia pestis
ccaggacgacauccacauug

SEQ ID NO: 2286559 - RNA, 14 nt, Yersinia pestis
ccaggacauccagc

SEQ ID NO: 2286560 - RNA, 16 nt, Yersinia pestis
ccaggccacggccgcc

SEQ ID NO: 2286561 - RNA, 17 nt, Yersinia pestis
ccaggcaacgacagcaa

SEQ ID NO: 2286562 - RNA, 19 nt, Yersinia pestis
ccaggcaacgacagcaaca

SEQ ID NO: 2286563 - RNA, 20 nt, Yersinia pestis
ccaggcaagaaacuucauuu

SEQ ID NO: 2286564 - RNA, 17 nt, Yersinia pestis
ccaggucaguuuuaccc

SEQ ID NO: 2286565 - RNA, 22 nt, Yersinia pestis
ccagggcguuuaccauccagug

SEQ ID NO: 2286566 - RNA, 18 nt, Yersinia pestis
ccagggcguuuaccaucc

SEQ ID NO: 2286567 - RNA, 15 nt, Yersinia pestis
ccauucauuuuuuau

SEQ ID NO: 2286568 - RNA, 16 nt, Yersinia pestis
ccauucauuuuuuaua

SEQ ID NO: 2286569 - RNA, 16 nt, Yersinia pestis
ccauugcauauugcuc

SEQ ID NO: 2286570 - RNA, 16 nt, Yersinia pestis
ccauugauaauaauau

SEQ ID NO: 2286571 - RNA, 20 nt, Yersinia pestis
ccauuggguauggucagcaa

SEQ ID NO: 2286572 - RNA, 21 nt, Yersinia pestis
ccauugguuuuuagcuuaaca

SEQ ID NO: 2286573 - RNA, 21 nt, Yersinia pestis
ccauuguauugcucagggcca

SEQ ID NO: 2286574 - RNA, 16 nt, Yersinia pestis
ccauuguggcuaaacc

SEQ ID NO: 2286575 - RNA, 17 nt, Yersinia pestis
ccaugcucagaaaccug

SEQ ID NO: 2286576 - RNA, 21 nt, Yersinia pestis
ccauucaucaaacucugcauc

SEQ ID NO: 2286577 - RNA, 16 nt, Yersinia pestis
ccauucagcagcaaga

SEQ ID NO: 2286578 - RNA, 23 nt, Yersinia pestis
ccauucaaaaauuaaauuaauau

SEQ ID NO: 2286579 - RNA, 20 nt, Yersinia pestis
cccaauaagugaaacaaaua

SEQ ID NO: 2286580 - RNA, 17 nt, Yersinia pestis
cccaauaauaaaaaaaa

SEQ ID NO: 2286581 - RNA, 13 nt, Yersinia pestis
cccaauauugauc

SEQ ID NO: 2286582 - RNA, 15 nt, Yersinia pestis
cccaauggagaucug

SEQ ID NO: 2286583 - RNA, 20 nt, Yersinia pestis
cccaaugcugucacugucaa

SEQ ID NO: 2286584 - RNA, 20 nt, Yersinia pestis
cccaaugccauagcugcugc

SEQ ID NO: 2286585 - RNA, 13 nt, Yersinia pestis
cccaaucuugcaa

SEQ ID NO: 2286586 - RNA, 21 nt, Yersinia pestis
cccaaaaccaccaccccagca

SEQ ID NO: 2286587 - RNA, 20 nt, Yersinia pestis
cccaaaaucaaauacugugc

SEQ ID NO: 2286588 - RNA, 15 nt, Yersinia pestis
ccauuuccaucaucu

SEQ ID NO: 2286589 - RNA, 18 nt, Yersinia pestis
ccauuuccaggcuaccaa

SEQ ID NO: 2286590 - RNA, 21 nt, Yersinia pestis
ccauuuaucgccaagccagua

SEQ ID NO: 2286591 - RNA, 18 nt, Yersinia pestis
cccaaagccuacgagaga

SEQ ID NO: 2286592 - RNA, 21 nt, Yersinia pestis
cccagagauggcgaucaagcc

SEQ ID NO: 2286593 - RNA, 23 nt, Yersinia pestis
cccagagcgcggcuucagcaccu

SEQ ID NO: 2286594 - RNA, 15 nt, Yersinia pestis
cccagcaucauaaga

SEQ ID NO: 2286595 - RNA, 19 nt, Yersinia pestis
cccacuugaccuucccucu

SEQ ID NO: 2286596 - RNA, 17 nt, Yersinia pestis
cccacucggccaaacaa

SEQ ID NO: 2286597 - RNA, 16 nt, Yersinia pestis
cccacugacacugaua

SEQ ID NO: 2286598 - RNA, 18 nt, Yersinia pestis
cccacggcgacguucagc

SEQ ID NO: 2286599 - RNA, 20 nt, Yersinia pestis
cccacggauggaugcuaucc

SEQ ID NO: 2286600 - RNA, 15 nt, Yersinia pestis
cccacggcacauaau

SEQ ID NO: 2286601 - RNA, 17 nt, Yersinia pestis
cccacauuaaaggccgc

SEQ ID NO: 2286602 - RNA, 14 nt, Yersinia pestis
cccacauucaguac

SEQ ID NO: 2286603 - RNA, 14 nt, Yersinia pestis
cccacaucaggccg

SEQ ID NO: 2286604 - RNA, 15 nt, Yersinia pestis
cccacaucggccccu

SEQ ID NO: 2286605 - RNA, 13 nt, Yersinia pestis
cccacauguucga

SEQ ID NO: 2286606 - RNA, 12 nt, Yersinia pestis
aaacaagccauu

SEQ ID NO: 2286607 - RNA, 23 nt, Yersinia pestis
ccaucaucauucaauuguuccau

SEQ ID NO: 2286608 - RNA, 13 nt, Yersinia pestis
ccaucccaauaau

SEQ ID NO: 2286609 - RNA, 14 nt, Yersinia pestis
ccaucccaauaauu

SEQ ID NO: 2286610 - RNA, 11 nt, Yersinia pestis
ccaucccucac

SEQ ID NO: 2286611 - RNA, 18 nt, Yersinia pestis
ccaucccccauggggcca

SEQ ID NO: 2286612 - RNA, 24 nt, Yersinia pestis
ccaucauuacccucauguaagcca

SEQ ID NO: 2286613 - RNA, 23 nt, Yersinia pestis
ccaucaugaauaggauagacagu

SEQ ID NO: 2286614 - RNA, 15 nt, Yersinia pestis
ccaucagccaacaaa

SEQ ID NO: 2286615 - RNA, 18 nt, Yersinia pestis
ccaucagcauauuaccca

SEQ ID NO: 2286616 - RNA, 18 nt, Yersinia pestis
ccaugaugacaaugcguu

SEQ ID NO: 2286617 - RNA, 21 nt, Yersinia pestis
ccaucugaugcagguuuugga

SEQ ID NO: 2286618 - RNA, 21 nt, Yersinia pestis
ccaucucuggcuuaucuucca

SEQ ID NO: 2286619 - RNA, 21 nt, Yersinia pestis
ccaucuuacccaacagugcuc

SEQ ID NO: 2286620 - RNA, 13 nt, Yersinia pestis
ccaucgccaauac

SEQ ID NO: 2286621 - RNA, 22 nt, Yersinia pestis
ccauccuuuacuccccugccua

SEQ ID NO: 2286622 - RNA, 21 nt, Yersinia pestis
ccauccugccaacgccccuga

SEQ ID NO: 2286623 - RNA, 19 nt, Yersinia pestis
ccauccuuuugacugguca

SEQ ID NO: 2286624 - RNA, 23 nt, Yersinia pestis
ccauccuuggcgcggacgcuuua

SEQ ID NO: 2286625 - RNA, 12 nt, Yersinia pestis
ccauagauuaau

SEQ ID NO: 2286626 - RNA, 23 nt, Yersinia pestis
ccauaagcccccguaucauggaa

SEQ ID NO: 2286627 - RNA, 21 nt, Yersinia pestis
ccauaagcgggguauuuuacu

SEQ ID NO: 2286628 - RNA, 14 nt, Yersinia pestis
ccauaacuucuggu

SEQ ID NO: 2286629 - RNA, 16 nt, Yersinia pestis
ccauaacgcugcucaa

SEQ ID NO: 2286630 - RNA, 20 nt, Yersinia pestis
ccauaaccugagcaccagaa

SEQ ID NO: 2286631 - RNA, 22 nt, Yersinia pestis
ccauaagugcacugaaccccaa

SEQ ID NO: 2286632 - RNA, 13 nt, Yersinia pestis
ccaucaaaggaga

SEQ ID NO: 2286633 - RNA, 16 nt, Yersinia pestis
ccaucaaacauagaca

SEQ ID NO: 2286634 - RNA, 21 nt, Yersinia pestis
ccaucaaccacgguuuaauca

SEQ ID NO: 2286635 - RNA, 14 nt, Yersinia pestis
ccaucaacauacug

SEQ ID NO: 2286636 - RNA, 13 nt, Yersinia pestis
ccaucaacauggg

SEQ ID NO: 2286637 - RNA, 12 nt, Yersinia pestis
ccauauccaaag

SEQ ID NO: 2286638 - RNA, 13 nt, Yersinia pestis
ccauauccucgag

SEQ ID NO: 2286639 - RNA, 20 nt, Yersinia pestis
ccaucaccaucggcaauaau

SEQ ID NO: 2286640 - RNA, 14 nt, Yersinia pestis
ccaucaccaugccu

SEQ ID NO: 2286641 - RNA, 20 nt, Yersinia pestis
ccaucaccauugaccagcgu

SEQ ID NO: 2286642 - RNA, 18 nt, Yersinia pestis
ccaucaagccaccgcugg

SEQ ID NO: 2286643 - RNA, 13 nt, Yersinia pestis
ccaucaauaaacu

SEQ ID NO: 2286644 - RNA, 15 nt, Yersinia pestis
ccaucaauaaagcug

SEQ ID NO: 2286645 - RNA, 12 nt, Yersinia pestis
ccaucaauaauu

SEQ ID NO: 2286646 - RNA, 16 nt, Yersinia pestis
ccauaaaguuuuuccu

SEQ ID NO: 2286647 - RNA, 11 nt, Yersinia pestis
ccauaaauaaa

SEQ ID NO: 2286648 - RNA, 18 nt, Yersinia pestis
ccauaaacggaacucauc

SEQ ID NO: 2286649 - RNA, 20 nt, Yersinia pestis
ccaguucugguagcugcuca

SEQ ID NO: 2286650 - RNA, 13 nt, Yersinia pestis
ccagugcggaagc

SEQ ID NO: 2286651 - RNA, 16 nt, Yersinia pestis
ccaguggcaucaauau

SEQ ID NO: 2286652 - RNA, 17 nt, Yersinia pestis
ccaguuaaagaauacag

SEQ ID NO: 2286653 - RNA, 21 nt, Yersinia pestis
ccaguguuuucuccacaccaa

SEQ ID NO: 2286654 - RNA, 20 nt, Yersinia pestis
ccaguguuagcuguuuuagu

SEQ ID NO: 2286655 - RNA, 20 nt, Yersinia pestis
ccaggucgaucgacuucuua

SEQ ID NO: 2286656 - RNA, 19 nt, Yersinia pestis
ccccuagauaccgccccuc

SEQ ID NO: 2286657 - RNA, 11 nt, Yersinia pestis
ccccguggcgg

SEQ ID NO: 2286658 - RNA, 18 nt, Yersinia pestis
ccccggucacuuaaauaa

SEQ ID NO: 2286659 - RNA, 17 nt, Yersinia pestis
ccccucacauuacugau

SEQ ID NO: 2286660 - RNA, 17 nt, Yersinia pestis
ccccugcguauugcugu

SEQ ID NO: 2286661 - RNA, 14 nt, Yersinia pestis
ccccugcugccagg

SEQ ID NO: 2286662 - RNA, 14 nt, Yersinia pestis
ccccuggcaggcca

SEQ ID NO: 2286663 - RNA, 18 nt, Yersinia pestis
ccccuuaugcgacaacgc

SEQ ID NO: 2286664 - RNA, 22 nt, Yersinia pestis
ccccuucaaugaaugccgguga

SEQ ID NO: 2286665 - RNA, 18 nt, Yersinia pestis
cccgaucaucaucgguac

SEQ ID NO: 2286666 - RNA, 18 nt, Yersinia pestis
cccgaauuaauaaaaccu

SEQ ID NO: 2286667 - RNA, 15 nt, Yersinia pestis
cccgaaucacuggug

SEQ ID NO: 2286668 - RNA, 13 nt, Yersinia pestis
cccgaaucaagcu

SEQ ID NO: 2286669 - RNA, 18 nt, Yersinia pestis
cccgaagcucaagcuggu

SEQ ID NO: 2286670 - RNA, 19 nt, Yersinia pestis
cccgaugguggcagccugc

SEQ ID NO: 2286671 - RNA, 21 nt, Yersinia pestis
cccgauguggauaauuucagc

SEQ ID NO: 2286672 - RNA, 19 nt, Yersinia pestis
cccgauuucaacgcaccau

SEQ ID NO: 2286673 - RNA, 12 nt, Yersinia pestis
cccgaugacgcg

SEQ ID NO: 2286674 - RNA, 17 nt, Yersinia pestis
cccgaucuaucgggaga

SEQ ID NO: 2286675 - RNA, 21 nt, Yersinia pestis
cccgaucuaucgggagaugca

SEQ ID NO: 2286676 - RNA, 13 nt, Yersinia pestis
cccgccugcuugc

SEQ ID NO: 2286677 - RNA, 14 nt, Yersinia pestis
cccgccccccauca

SEQ ID NO: 2286678 - RNA, 22 nt, Yersinia pestis
ccccauuuaucgccaagccagu

SEQ ID NO: 2286679 - RNA, 20 nt, Yersinia pestis
ccccaugauggcguuuucuu

SEQ ID NO: 2286680 - RNA, 16 nt, Yersinia pestis
cccccgacccacgccc

SEQ ID NO: 2286681 - RNA, 16 nt, Yersinia pestis
ccccgacccacgcccc

SEQ ID NO: 2286682 - RNA, 22 nt, Yersinia pestis
ccccgacgauauuaccgagcgu

SEQ ID NO: 2286683 - RNA, 16 nt, Yersinia pestis
ccccggaucacuggcu

SEQ ID NO: 2286684 - RNA, 15 nt, Yersinia pestis
cccagccagaaugaa

SEQ ID NO: 2286685 - RNA, 21 nt, Yersinia pestis
cccagccauuugaacaaaccc

SEQ ID NO: 2286686 - RNA, 14 nt, Yersinia pestis
cccauucacaccau

SEQ ID NO: 2286687 - RNA, 21 nt, Yersinia pestis
cccauuagcaguaacguccaa

SEQ ID NO: 2286688 - RNA, 15 nt, Yersinia pestis
ccccaagcauagaag

SEQ ID NO: 2286689 - RNA, 20 nt, Yersinia pestis
ccccaacucuuucaacuucc

SEQ ID NO: 2286690 - RNA, 13 nt, Yersinia pestis
ccccaagcuuuug

SEQ ID NO: 2286691 - RNA, 22 nt, Yersinia pestis
ccccaauucacgcaaggccagg

SEQ ID NO: 2286692 - RNA, 14 nt, Yersinia pestis
ccccaaugaugacu

SEQ ID NO: 2286693 - RNA, 21 nt, Yersinia pestis
ccccaggugcuuauuuauuuu

SEQ ID NO: 2286694 - RNA, 20 nt, Yersinia pestis
ccccagucacuuacugauca

SEQ ID NO: 2286695 - RNA, 16 nt, Yersinia pestis
ccccaugaccgccagu

SEQ ID NO: 2286696 - RNA, 21 nt, Yersinia pestis
ccccaugguuacgccagcagc

SEQ ID NO: 2286697 - RNA, 18 nt, Yersinia pestis
ccccacuauucuccaaca

SEQ ID NO: 2286698 - RNA, 17 nt, Yersinia pestis
ccccacggugccuagcc

SEQ ID NO: 2286699 - RNA, 22 nt, Yersinia pestis
ccccacuuguaccugugccagu

SEQ ID NO: 2286700 - RNA, 14 nt, Yersinia pestis
ccccacuucacgca

SEQ ID NO: 2286701 - RNA, 21 nt, Yersinia pestis
aaacacgauauaccucaguua

SEQ ID NO: 2286702 - RNA, 14 nt, Yersinia pestis
aaacacgcaacacu

SEQ ID NO: 2286703 - RNA, 16 nt, Yersinia pestis
aaacacucaauaagua

SEQ ID NO: 2286704 - RNA, 23 nt, Yersinia pestis
aaacacgcgcuacgaugcagcuu

SEQ ID NO: 2286705 - RNA, 18 nt, Yersinia pestis
aaacaccuucacugaaua

SEQ ID NO: 2286706 - RNA, 17 nt, Yersinia pestis
aaacaccuucagacuga

SEQ ID NO: 2286707 - RNA, 15 nt, Yersinia pestis
cccguaggccuuaac

SEQ ID NO: 2286708 - RNA, 15 nt, Yersinia pestis
cccgguuagauaggc

SEQ ID NO: 2286709 - RNA, 16 nt, Yersinia pestis
cccggucauauucccu

SEQ ID NO: 2286710 - RNA, 20 nt, Yersinia pestis
cccggccaaccguagugagu

SEQ ID NO: 2286711 - RNA, 22 nt, Yersinia pestis
cccggccaaccguagugaguca

SEQ ID NO: 2286712 - RNA, 16 nt, Yersinia pestis
cccgcuaauucaccaa

SEQ ID NO: 2286713 - RNA, 17 nt, Yersinia pestis
cccgcuaccaagcccag

SEQ ID NO: 2286714 - RNA, 17 nt, Yersinia pestis
cccggcaccuucaacga

SEQ ID NO: 2286715 - RNA, 21 nt, Yersinia pestis
cccgcuuaaucauauuuuccu

SEQ ID NO: 2286716 - RNA, 21 nt, Yersinia pestis
cccgcuggucgauaagcacuc

SEQ ID NO: 2286717 - RNA, 20 nt, Yersinia pestis
aaaccaauagaccguagaaa

SEQ ID NO: 2286718 - RNA, 15 nt, Yersinia pestis
aaaccaccaaaauag

SEQ ID NO: 2286719 - RNA, 14 nt, Yersinia pestis
aaaccaauggaaaa

SEQ ID NO: 2286720 - RNA, 13 nt, Yersinia pestis
aaaccaacaauau

SEQ ID NO: 2286721 - RNA, 16 nt, Yersinia pestis
aaaccaaauuacuuua

SEQ ID NO: 2286722 - RNA, 13 nt, Yersinia pestis
aaaccaaaaccuu

SEQ ID NO: 2286723 - RNA, 23 nt, Yersinia pestis
aaacauuuucaucugaccaaaca

SEQ ID NO: 2286724 - RNA, 16 nt, Yersinia pestis
ccgacacccagccaga

SEQ ID NO: 2286725 - RNA, 13 nt, Yersinia pestis
ccgacacccagcc

SEQ ID NO: 2286726 - RNA, 16 nt, Yersinia pestis
ccgacaccaauaccga

SEQ ID NO: 2286727 - RNA, 16 nt, Yersinia pestis
aaacagacuaaaaacc

SEQ ID NO: 2286728 - RNA, 18 nt, Yersinia pestis
ccgaaaucucaccacgcc

SEQ ID NO: 2286729 - RNA, 15 nt, Yersinia pestis
aaacaguuacuccua

SEQ ID NO: 2286730 - RNA, 12 nt, Yersinia pestis
aaacagucuuau

SEQ ID NO: 2286731 - RNA, 16 nt, Yersinia pestis
aaacagucuuauuacu

SEQ ID NO: 2286732 - RNA, 16 nt, Yersinia pestis
aaacagucauuaacac

SEQ ID NO: 2286733 - RNA, 19 nt, Yersinia pestis
aaacauggcggcagcacag

SEQ ID NO: 2286734 - RNA, 20 nt, Yersinia pestis
aaacauggcggcagcacaga

SEQ ID NO: 2286735 - RNA, 15 nt, Yersinia pestis
cccugcuuauacgcu

SEQ ID NO: 2286736 - RNA, 16 nt, Yersinia pestis
cccugcuuguuacgua

SEQ ID NO: 2286737 - RNA, 17 nt, Yersinia pestis
cccuggcucuggccagc

SEQ ID NO: 2286738 - RNA, 18 nt, Yersinia pestis
cccugcgcauugauaauc

SEQ ID NO: 2286739 - RNA, 22 nt, Yersinia pestis
cccugcgcauugauaaucucca

SEQ ID NO: 2286740 - RNA, 17 nt, Yersinia pestis
aaacacuuaugaucuug

SEQ ID NO: 2286741 - RNA, 18 nt, Yersinia pestis
aaacacuuggauccgcag

SEQ ID NO: 2286742 - RNA, 21 nt, Yersinia pestis
cccgucgggauaucuucaauc

SEQ ID NO: 2286743 - RNA, 14 nt, Yersinia pestis
cccuugacugacca

SEQ ID NO: 2286744 - RNA, 20 nt, Yersinia pestis
cccuuggcucucgacaaccu

SEQ ID NO: 2286745 - RNA, 22 nt, Yersinia pestis
cccuuguuuaucggucacuuua

SEQ ID NO: 2286746 - RNA, 17 nt, Yersinia pestis
cccuuguuuaucuucua

SEQ ID NO: 2286747 - RNA, 22 nt, Yersinia pestis
cccuuuaaaucuagcccuucag

SEQ ID NO: 2286748 - RNA, 22 nt, Yersinia pestis
cccuuucucgccuaaguuugac

SEQ ID NO: 2286749 - RNA, 12 nt, Yersinia pestis
cccuguccagcc

SEQ ID NO: 2286750 - RNA, 20 nt, Yersinia pestis
cccugucuccuaucugaggu

SEQ ID NO: 2286751 - RNA, 17 nt, Yersinia pestis
cccugucuugccagcgg

SEQ ID NO: 2286752 - RNA, 15 nt, Yersinia pestis
cccuguagaacaccu

SEQ ID NO: 2286753 - RNA, 17 nt, Yersinia pestis
cccuguugaucugaguu

SEQ ID NO: 2286754 - RNA, 18 nt, Yersinia pestis
cccuucaucuuucaagug

SEQ ID NO: 2286755 - RNA, 22 nt, Yersinia pestis
cccuucgggcuugguguugcaa

SEQ ID NO: 2286756 - RNA, 18 nt, Yersinia pestis
cccuucggcaugcaacuu

SEQ ID NO: 2286757 - RNA, 16 nt, Yersinia pestis
ccgauaauaauuccau

SEQ ID NO: 2286758 - RNA, 14 nt, Yersinia pestis
ccgauaaacgccag

SEQ ID NO: 2286759 - RNA, 13 nt, Yersinia pestis
ccgauaaaaguac

SEQ ID NO: 2286760 - RNA, 19 nt, Yersinia pestis
ccgaguugacuuuuuuuaa

SEQ ID NO: 2286761 - RNA, 13 nt, Yersinia pestis
ccgaguguaaaaa

SEQ ID NO: 2286762 - RNA, 17 nt, Yersinia pestis
ccgagucgaucacggaa

SEQ ID NO: 2286763 - RNA, 15 nt, Yersinia pestis
ccgagggcgugcucu

SEQ ID NO: 2286764 - RNA, 19 nt, Yersinia pestis
ccgacgugugcuguaagaa

SEQ ID NO: 2286765 - RNA, 14 nt, Yersinia pestis
ccgagauauuauug

SEQ ID NO: 2286766 - RNA, 19 nt, Yersinia pestis
ccgauaagaaaucaucagc

SEQ ID NO: 2286767 - RNA, 22 nt, Yersinia pestis
ccgauaauuauaaauuccuggc

SEQ ID NO: 2286768 - RNA, 11 nt, Yersinia pestis
ccgauauaaau

SEQ ID NO: 2286769 - RNA, 14 nt, Yersinia pestis
ccgaucagcuuaau

SEQ ID NO: 2286770 - RNA, 20 nt, Yersinia pestis
ccgaugacucgaucuugaac

SEQ ID NO: 2286771 - RNA, 17 nt, Yersinia pestis
ccgaugcgacaauuucc

SEQ ID NO: 2286772 - RNA, 17 nt, Yersinia pestis
ccgcaagaauaacuggg

SEQ ID NO: 2286773 - RNA, 20 nt, Yersinia pestis
ccgcaaccgggccggguuga

SEQ ID NO: 2286774 - RNA, 18 nt, Yersinia pestis
ccgcacgaaccguggcgc

SEQ ID NO: 2286775 - RNA, 21 nt, Yersinia pestis
ccgcaauaaauggcauuuuuu

SEQ ID NO: 2286776 - RNA, 18 nt, Yersinia pestis
ccuguuuuuguuguucuu

SEQ ID NO: 2286777 - RNA, 15 nt, Yersinia pestis
ccuguucucuccguc

SEQ ID NO: 2286778 - RNA, 20 nt, Yersinia pestis
ccuguucgacauucucuacu

SEQ ID NO: 2286779 - RNA, 20 nt, Yersinia pestis
ccuguuccaacgagugcaga

SEQ ID NO: 2286780 - RNA, 18 nt, Yersinia pestis
ccuguuguaacacuugac

SEQ ID NO: 2286781 - RNA, 22 nt, Yersinia pestis
ccugugauucagccaacagcug

SEQ ID NO: 2286782 - RNA, 17 nt, Yersinia pestis
ccugugauuucagccag

SEQ ID NO: 2286783 - RNA, 22 nt, Yersinia pestis
ccugucuuaggugacaggcaaa
